United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 37

SEQ ID NO: 1642717 - RNA, 16 nt, Human
ccaggcccucugccca

SEQ ID NO: 1642718 - RNA, 15 nt, Human
ccaggcccucugccc

SEQ ID NO: 1642719 - RNA, 16 nt, Human
ccaggcugggucgccc

SEQ ID NO: 1642720 - RNA, 12 nt, Human
ccaggcuggguc

SEQ ID NO: 1642721 - RNA, 24 nt, Human
ccaggcugggucgcccuggacugu

SEQ ID NO: 1642722 - RNA, 23 nt, Human
ccaggcugggucgcccuggacug

SEQ ID NO: 1642723 - RNA, 22 nt, Human
ccaggcugggucgcccuggacu

SEQ ID NO: 1642724 - RNA, 21 nt, Human
ccaggcugggucgcccuggac

SEQ ID NO: 1642725 - RNA, 15 nt, Human
ccauucugccugccc

SEQ ID NO: 1642726 - RNA, 16 nt, Human
ccauucugccugccca

SEQ ID NO: 1642727 - RNA, 13 nt, Human
ccauuugcuccuu

SEQ ID NO: 1642728 - RNA, 13 nt, Human
ccauuuggaaauc

SEQ ID NO: 1642729 - RNA, 14 nt, Human
ccauucuccaccug

SEQ ID NO: 1642730 - RNA, 18 nt, Human
ccauguuuuguuuacggu

SEQ ID NO: 1642731 - RNA, 11 nt, Human
ccauuauucaa

SEQ ID NO: 1642732 - RNA, 13 nt, Human
cccacaggaucag

SEQ ID NO: 1642733 - RNA, 17 nt, Human
cccacaggaucagucug

SEQ ID NO: 1642734 - RNA, 18 nt, Human
cccacaggcccuuccucu

SEQ ID NO: 1642735 - RNA, 16 nt, Human
cccacaggcccuuccu

SEQ ID NO: 1642736 - RNA, 19 nt, Human
cccacauagugaugguucc

SEQ ID NO: 1642737 - RNA, 16 nt, Human
cccaagggccuggccu

SEQ ID NO: 1642738 - RNA, 17 nt, Human
cccaagggccuggccug

SEQ ID NO: 1642739 - RNA, 14 nt, Human
cccaagggccuggc

SEQ ID NO: 1642740 - RNA, 12 nt, Human
cccaagggccug

SEQ ID NO: 1642741 - RNA, 21 nt, Human
ccauuuuguauuuuacuaaua

SEQ ID NO: 1642742 - RNA, 20 nt, Human
ccauuuugcugucccuuuuc

SEQ ID NO: 1642743 - RNA, 17 nt, Human
cccaccucucucacucc

SEQ ID NO: 1642744 - RNA, 14 nt, Human
cccaccucucucac

SEQ ID NO: 1642745 - RNA, 13 nt, Human
cccaccucucuca

SEQ ID NO: 1642746 - RNA, 21 nt, Human
cccaccucagccucccaaagu

SEQ ID NO: 1642747 - RNA, 12 nt, Human
cccaccuuggcu

SEQ ID NO: 1642748 - RNA, 19 nt, Human
cccaccucucucacuccuu

SEQ ID NO: 1642749 - RNA, 17 nt, Human
cccaccucagccucccg

SEQ ID NO: 1642750 - RNA, 15 nt, Human
cccaccucagccucc

SEQ ID NO: 1642751 - RNA, 14 nt, Human
cccaccucagccuc

SEQ ID NO: 1642752 - RNA, 12 nt, Human
cccaccucagcc

SEQ ID NO: 1642753 - RNA, 15 nt, Human
cccaccuuggcugca

SEQ ID NO: 1642754 - RNA, 14 nt, Human
cccaccuuggcugc

SEQ ID NO: 1642755 - RNA, 22 nt, Human
cccaccuuggcucaaguccucu

SEQ ID NO: 1642756 - RNA, 15 nt, Human
cccaccuuggcucaa

SEQ ID NO: 1642757 - RNA, 19 nt, Human
cccacgcccccacugguga

SEQ ID NO: 1642758 - RNA, 17 nt, Human
cccacgcccccacuggu

SEQ ID NO: 1642759 - RNA, 16 nt, Human
cccaccuuggcugcag

SEQ ID NO: 1642760 - RNA, 14 nt, Human
cccacgcuggagug

SEQ ID NO: 1642761 - RNA, 15 nt, Human
ccaccucccugcaau

SEQ ID NO: 1642762 - RNA, 12 nt, Human
ccacccugcucu

SEQ ID NO: 1642763 - RNA, 11 nt, Human
ccacccugcuc

SEQ ID NO: 1642764 - RNA, 19 nt, Human
ccaccucccugcaauaaaa

SEQ ID NO: 1642765 - RNA, 21 nt, Human
ccaccucccugcaauaaaaug

SEQ ID NO: 1642766 - RNA, 20 nt, Human
ccaccucucucacuccuuga

SEQ ID NO: 1642767 - RNA, 19 nt, Human
ccaccucucucacuccuug

SEQ ID NO: 1642768 - RNA, 16 nt, Human
ccaccucucucacucc

SEQ ID NO: 1642769 - RNA, 14 nt, Human
ccaccucucucacu

SEQ ID NO: 1642770 - RNA, 16 nt, Human
ccaccugccagggaca

SEQ ID NO: 1642771 - RNA, 15 nt, Human
ccaccugccagggac

SEQ ID NO: 1642772 - RNA, 14 nt, Human
ccaccugccaggga

SEQ ID NO: 1642773 - RNA, 13 nt, Human
ccaccugccaggg

SEQ ID NO: 1642774 - RNA, 20 nt, Human
ccaccuggccucugcacucc

SEQ ID NO: 1642775 - RNA, 13 nt, Human
ccaccuggccucu

SEQ ID NO: 1642776 - RNA, 14 nt, Human
ccaccuggccucug

SEQ ID NO: 1642777 - RNA, 19 nt, Human
ccacccccacccaagggcc

SEQ ID NO: 1642778 - RNA, 14 nt, Human
ccacccuccuuuca

SEQ ID NO: 1642779 - RNA, 13 nt, Human
ccaccuuggcuca

SEQ ID NO: 1642780 - RNA, 15 nt, Human
ccacugguucuucuu

SEQ ID NO: 1642781 - RNA, 23 nt, Human
ccacuggugacaugucuuuucuu

SEQ ID NO: 1642782 - RNA, 15 nt, Human
ccacugugaagagaa

SEQ ID NO: 1642783 - RNA, 14 nt, Human
ccacugugaagaga

SEQ ID NO: 1642784 - RNA, 15 nt, Human
ccacugcucugguua

SEQ ID NO: 1642785 - RNA, 13 nt, Human
ccacugcucuggu

SEQ ID NO: 1642786 - RNA, 12 nt, Human
ccacugcucugg

SEQ ID NO: 1642787 - RNA, 20 nt, Human
ccacugcuuuuggucugugu

SEQ ID NO: 1642788 - RNA, 21 nt, Human
ccacugccuucgauacaccgg

SEQ ID NO: 1642789 - RNA, 22 nt, Human
ccacugcuuuuggucuguguga

SEQ ID NO: 1642790 - RNA, 23 nt, Human
ccacugcaucguuucaucuucca

SEQ ID NO: 1642791 - RNA, 21 nt, Human
ccacugcaucguuucaucuuc

SEQ ID NO: 1642792 - RNA, 14 nt, Human
ccaccuucccaugc

SEQ ID NO: 1642793 - RNA, 16 nt, Human
ccacugccucuuccuc

SEQ ID NO: 1642794 - RNA, 13 nt, Human
ccacugccucuuc

SEQ ID NO: 1642795 - RNA, 16 nt, Human
ccacugugccaugugc

SEQ ID NO: 1642796 - RNA, 15 nt, Human
ccacugugccaugug

SEQ ID NO: 1642797 - RNA, 19 nt, Human
ccacugugccaugugccag

SEQ ID NO: 1642798 - RNA, 22 nt, Human
ccagaagaaaauagugguguga

SEQ ID NO: 1642799 - RNA, 18 nt, Human
ccagaaaccuuuguuugc

SEQ ID NO: 1642800 - RNA, 14 nt, Human
ccagacaucaacag

SEQ ID NO: 1642801 - RNA, 24 nt, Human
ccagaccccuggcuuuucacugcu

SEQ ID NO: 1642802 - RNA, 20 nt, Human
ccagacacauguccaagaag

SEQ ID NO: 1642803 - RNA, 17 nt, Human
ccagacacauguccaag

SEQ ID NO: 1642804 - RNA, 22 nt, Human
ccagacacauguccaagaagcc

SEQ ID NO: 1642805 - RNA, 15 nt, Human
ccagacccggcugcg

SEQ ID NO: 1642806 - RNA, 14 nt, Human
ccagacccggcugc

SEQ ID NO: 1642807 - RNA, 16 nt, Human
ccagacccggcugcgu

SEQ ID NO: 1642808 - RNA, 14 nt, Human
ccagagaguggcuc

SEQ ID NO: 1642809 - RNA, 16 nt, Human
ccagagaguggcuccu

SEQ ID NO: 1642810 - RNA, 15 nt, Human
ccagagaguggcucc

SEQ ID NO: 1642811 - RNA, 22 nt, Human
ccagagaguggcuccucccggu

SEQ ID NO: 1642812 - RNA, 18 nt, Human
ccagagaguggcuccucc

SEQ ID NO: 1642813 - RNA, 19 nt, Human
ccagauuucacucuccuug

SEQ ID NO: 1642814 - RNA, 18 nt, Human
ccagauuucacucuccuu

SEQ ID NO: 1642815 - RNA, 22 nt, Human
ccagauugcaacaggcugggcu

SEQ ID NO: 1642816 - RNA, 18 nt, Human
ccagauugcaacaggcug

SEQ ID NO: 1642817 - RNA, 23 nt, Human
ccagauugcaacaggcugggcuu

SEQ ID NO: 1642818 - RNA, 16 nt, Human
ccagauugcaacaggc

SEQ ID NO: 1642819 - RNA, 14 nt, Human
ccagauugcaacag

SEQ ID NO: 1642820 - RNA, 14 nt, Human
ccagagcccaccuu

SEQ ID NO: 1642821 - RNA, 20 nt, Human
ccagcaagugagagcugggu

SEQ ID NO: 1642822 - RNA, 19 nt, Human
ccagcaagugagagcuggg

SEQ ID NO: 1642823 - RNA, 18 nt, Human
ccagcaagugagagcugg

SEQ ID NO: 1642824 - RNA, 17 nt, Human
ccagcaagugagagcug

SEQ ID NO: 1642825 - RNA, 18 nt, Human
ccagcaggcucucaggcc

SEQ ID NO: 1642826 - RNA, 17 nt, Human
ccagcaggcucucaggc

SEQ ID NO: 1642827 - RNA, 16 nt, Human
ccagcaggcucucagg

SEQ ID NO: 1642828 - RNA, 18 nt, Human
ccagcaccaucucuccuc

SEQ ID NO: 1642829 - RNA, 17 nt, Human
ccagcaccaucucuccu

SEQ ID NO: 1642830 - RNA, 24 nt, Human
ccagauuuuuuacagcugccugca

SEQ ID NO: 1642831 - RNA, 19 nt, Human
ccagccccaaaacucuccu

SEQ ID NO: 1642832 - RNA, 23 nt, Human
ccagccgagauagccaaggccaa

SEQ ID NO: 1642833 - RNA, 22 nt, Human
ccagccgagauagccaaggcca

SEQ ID NO: 1642834 - RNA, 20 nt, Human
ccagccgagauagccaaggc

SEQ ID NO: 1642835 - RNA, 17 nt, Human
ccagccgagauagccaa

SEQ ID NO: 1642836 - RNA, 17 nt, Human
ccagcccacuucugcca

SEQ ID NO: 1642837 - RNA, 16 nt, Human
ccagcccacuucugcc

SEQ ID NO: 1642838 - RNA, 23 nt, Human
ccagcaggcucucaggccagcug

SEQ ID NO: 1642839 - RNA, 21 nt, Human
ccagcaggcucucaggccagc

SEQ ID NO: 1642840 - RNA, 20 nt, Human
ccagcaggcucucaggccag

SEQ ID NO: 1642841 - RNA, 19 nt, Human
ccagcaggcucucaggcca

SEQ ID NO: 1642842 - RNA, 13 nt, Human
ccagccuggguga

SEQ ID NO: 1642843 - RNA, 13 nt, Human
ccagcgagcccug

SEQ ID NO: 1642844 - RNA, 23 nt, Human
ccagccuugaccauucuccaccu

SEQ ID NO: 1642845 - RNA, 19 nt, Human
ccagccugagcgacaguga

SEQ ID NO: 1642846 - RNA, 15 nt, Human
ccuaacgaaguaucc

SEQ ID NO: 1642847 - RNA, 11 nt, Human
ccguggcuucc

SEQ ID NO: 1642848 - RNA, 21 nt, Human
ccuacaguugaaaaacagcug

SEQ ID NO: 1642849 - RNA, 17 nt, Human
ccuaccgagucucuucu

SEQ ID NO: 1642850 - RNA, 16 nt, Human
ccuaccgagucucuuc

SEQ ID NO: 1642851 - RNA, 21 nt, Human
ccuaccgagucucuucuccac

SEQ ID NO: 1642852 - RNA, 20 nt, Human
ccuaccgagucucuucucca

SEQ ID NO: 1642853 - RNA, 19 nt, Human
ccuaccgagucucuucucc

SEQ ID NO: 1642854 - RNA, 14 nt, Human
ccguggcuucccgc

SEQ ID NO: 1642855 - RNA, 13 nt, Human
ccgggccacagag

SEQ ID NO: 1642856 - RNA, 22 nt, Human
ccgggcacucagaagacacuga

SEQ ID NO: 1642857 - RNA, 21 nt, Human
ccggcuccaggcuccuuuagc

SEQ ID NO: 1642858 - RNA, 16 nt, Human
ccggcuccaggcuccu

SEQ ID NO: 1642859 - RNA, 15 nt, Human
ccgggcucugccucc

SEQ ID NO: 1642860 - RNA, 14 nt, Human
ccgggcucugccuc

SEQ ID NO: 1642861 - RNA, 18 nt, Human
ccgggcucugccucccau

SEQ ID NO: 1642862 - RNA, 22 nt, Human
ccgggcucugccucccaucacc

SEQ ID NO: 1642863 - RNA, 18 nt, Human
ccgugaggccagagacac

SEQ ID NO: 1642864 - RNA, 11 nt, Human
ccgcuggggcc

SEQ ID NO: 1642865 - RNA, 14 nt, Human
ccgcuggggccagu

SEQ ID NO: 1642866 - RNA, 14 nt, Human
ccggaggggccugg

SEQ ID NO: 1642867 - RNA, 16 nt, Human
ccggaggggccuggca

SEQ ID NO: 1642868 - RNA, 15 nt, Human
ccggaggggccuggc

SEQ ID NO: 1642869 - RNA, 16 nt, Human
ccgaguagcugggacu

SEQ ID NO: 1642870 - RNA, 14 nt, Human
ccgaguagcuggga

SEQ ID NO: 1642871 - RNA, 18 nt, Human
ccgagucucuucuccacu

SEQ ID NO: 1642872 - RNA, 16 nt, Human
ccgagucucuucucca

SEQ ID NO: 1642873 - RNA, 14 nt, Human
ccgagucucuucuc

SEQ ID NO: 1642874 - RNA, 20 nt, Human
ccgaguagcugagauuauag

SEQ ID NO: 1642875 - RNA, 19 nt, Human
ccgagcuuugaaaauucag

SEQ ID NO: 1642876 - RNA, 23 nt, Human
ccgcacugggcuuggggaccaga

SEQ ID NO: 1642877 - RNA, 21 nt, Human
ccgagucucuucuccacugga

SEQ ID NO: 1642878 - RNA, 20 nt, Human
ccgagucucuucuccacugg

SEQ ID NO: 1642879 - RNA, 19 nt, Human
ccgagucucuucuccacug

SEQ ID NO: 1642880 - RNA, 15 nt, Human
ccgcagacaggacca

SEQ ID NO: 1642881 - RNA, 19 nt, Human
ccgagauugcaccacugca

SEQ ID NO: 1642882 - RNA, 15 nt, Human
ccgagauugcaccac

SEQ ID NO: 1642883 - RNA, 21 nt, Human
ccgagauugcaccacugcacu

SEQ ID NO: 1642884 - RNA, 18 nt, Human
ccgagauagccaaggcca

SEQ ID NO: 1642885 - RNA, 23 nt, Human
cccucuccugggcagcugccucc

SEQ ID NO: 1642886 - RNA, 11 nt, Human
cccucugccca

SEQ ID NO: 1642887 - RNA, 18 nt, Human
cccucugcccacucccug

SEQ ID NO: 1642888 - RNA, 15 nt, Human
cccucugcccacucc

SEQ ID NO: 1642889 - RNA, 19 nt, Human
cccucugcccacucccugc

SEQ ID NO: 1642890 - RNA, 14 nt, Human
cccucugcccugcg

SEQ ID NO: 1642891 - RNA, 13 nt, Human
cccucugcccugc

SEQ ID NO: 1642892 - RNA, 12 nt, Human
cccucugcccug

SEQ ID NO: 1642893 - RNA, 20 nt, Human
cccucuccugggcagcugcc

SEQ ID NO: 1642894 - RNA, 21 nt, Human
cccucuccugggcagcugccu

SEQ ID NO: 1642895 - RNA, 22 nt, Human
cccucuccugggcagcugccuc

SEQ ID NO: 1642896 - RNA, 12 nt, Human
cccucuggggcu

SEQ ID NO: 1642897 - RNA, 21 nt, Human
cccucuguucugcacacagca

SEQ ID NO: 1642898 - RNA, 20 nt, Human
cccucuguucugcacacagc

SEQ ID NO: 1642899 - RNA, 22 nt, Human
cccucuggcuccagcuggccgg

SEQ ID NO: 1642900 - RNA, 17 nt, Human
cccucuggcuccagcug

SEQ ID NO: 1642901 - RNA, 16 nt, Human
cccucuggcuccagcu

SEQ ID NO: 1642902 - RNA, 12 nt, Human
cccucuggcucc

SEQ ID NO: 1642903 - RNA, 20 nt, Human
cccucuuucccucccuuccu

SEQ ID NO: 1642904 - RNA, 17 nt, Human
cccucuuucccucccuu

SEQ ID NO: 1642905 - RNA, 12 nt, Human
cccucuuucccu

SEQ ID NO: 1642906 - RNA, 14 nt, Human
cccucccugccccu

SEQ ID NO: 1642907 - RNA, 23 nt, Human
cccucccucuuucccucccuucc

SEQ ID NO: 1642908 - RNA, 14 nt, Human
cccgcucagcccuc

SEQ ID NO: 1642909 - RNA, 13 nt, Human
cccgcucagcccu

SEQ ID NO: 1642910 - RNA, 12 nt, Human
cccgcucagccc

SEQ ID NO: 1642911 - RNA, 15 nt, Human
cccgcucagcccucc

SEQ ID NO: 1642912 - RNA, 15 nt, Human
cccuugaugaagaag

SEQ ID NO: 1642913 - RNA, 17 nt, Human
cccuuacgugaguccug

SEQ ID NO: 1642914 - RNA, 15 nt, Human
cccuuacgugagucc

SEQ ID NO: 1642915 - RNA, 14 nt, Human
cccuuagcagggaa

SEQ ID NO: 1642916 - RNA, 20 nt, Human
cccuuagaaguuuguuguga

SEQ ID NO: 1642917 - RNA, 23 nt, Human
cccuuagcagggaaacagcuaau

SEQ ID NO: 1642918 - RNA, 12 nt, Human
cccuuccaugga

SEQ ID NO: 1642919 - RNA, 20 nt, Human
cccuuccaugucgccucugc

SEQ ID NO: 1642920 - RNA, 18 nt, Human
cccuucaaccauucccca

SEQ ID NO: 1642921 - RNA, 14 nt, Human
cccuucaaccauuc

SEQ ID NO: 1642922 - RNA, 15 nt, Human
cccugguggcagugg

SEQ ID NO: 1642923 - RNA, 14 nt, Human
cccugguggcagug

SEQ ID NO: 1642924 - RNA, 13 nt, Human
cccugguggcagu

SEQ ID NO: 1642925 - RNA, 21 nt, Human
cccugguggcagcucaccucu

SEQ ID NO: 1642926 - RNA, 14 nt, Human
cccuggugcugcca

SEQ ID NO: 1642927 - RNA, 13 nt, Human
cccuggugcugcc

SEQ ID NO: 1642928 - RNA, 21 nt, Human
cccuggugaccagcaccaucu

SEQ ID NO: 1642929 - RNA, 14 nt, Human
cccugcuuucagau

SEQ ID NO: 1642930 - RNA, 23 nt, Human
cccuuaccugccaggaagccagc

SEQ ID NO: 1642931 - RNA, 20 nt, Human
cccuuaccugccaggaagcc

SEQ ID NO: 1642932 - RNA, 17 nt, Human
cccuuaccugccaggaa

SEQ ID NO: 1642933 - RNA, 19 nt, Human
cccuguuuguuucugaaag

SEQ ID NO: 1642934 - RNA, 14 nt, Human
cccuguucuggcag

SEQ ID NO: 1642935 - RNA, 13 nt, Human
cccuguucuggca

SEQ ID NO: 1642936 - RNA, 15 nt, Human
cccuggugcugccac

SEQ ID NO: 1642937 - RNA, 21 nt, Human
cccugcucuccgaccagacac

SEQ ID NO: 1642938 - RNA, 22 nt, Human
cccugcucuccgaccagacacc

SEQ ID NO: 1642939 - RNA, 21 nt, Human
cccugcugagucccaggcuga

SEQ ID NO: 1642940 - RNA, 23 nt, Human
cccugcugagucccaggcugagc

SEQ ID NO: 1642941 - RNA, 16 nt, Human
cccugccucucugcag

SEQ ID NO: 1642942 - RNA, 15 nt, Human
cccugccucucugca

SEQ ID NO: 1642943 - RNA, 21 nt, Human
cccugcgggucacaggaggga

SEQ ID NO: 1642944 - RNA, 19 nt, Human
cccugcgggucacaggagg

SEQ ID NO: 1642945 - RNA, 12 nt, Human
cccugaggccca

SEQ ID NO: 1642946 - RNA, 11 nt, Human
cccugccuccu

SEQ ID NO: 1642947 - RNA, 14 nt, Human
cccugccuccuuug

SEQ ID NO: 1642948 - RNA, 14 nt, Human
cccugccucucugc

SEQ ID NO: 1642949 - RNA, 13 nt, Human
cccugccucucug

SEQ ID NO: 1642950 - RNA, 16 nt, Human
cccuggugcugccaca

SEQ ID NO: 1642951 - RNA, 15 nt, Human
ccccucggagaagag

SEQ ID NO: 1642952 - RNA, 13 nt, Human
ccccuccucugcu

SEQ ID NO: 1642953 - RNA, 14 nt, Human
ccccuccucugcuu

SEQ ID NO: 1642954 - RNA, 17 nt, Human
ccccuccucugcuugcc

SEQ ID NO: 1642955 - RNA, 17 nt, Human
ccccuccucucugcccu

SEQ ID NO: 1642956 - RNA, 15 nt, Human
ccccuccucucugcc

SEQ ID NO: 1642957 - RNA, 18 nt, Human
ccccuccuccuggacucc

SEQ ID NO: 1642958 - RNA, 22 nt, Human
ccccuccuccuggacuccugca

SEQ ID NO: 1642959 - RNA, 12 nt, Human
ccccuccaugug

SEQ ID NO: 1642960 - RNA, 15 nt, Human
ccccucccuucaacc

SEQ ID NO: 1642961 - RNA, 16 nt, Human
ccccucagggucccug

SEQ ID NO: 1642962 - RNA, 23 nt, Human
ccccuccaaucccaccaacccuc

SEQ ID NO: 1642963 - RNA, 20 nt, Human
ccccucauagcccucacccu

SEQ ID NO: 1642964 - RNA, 19 nt, Human
cccccugacaacacucauu

SEQ ID NO: 1642965 - RNA, 19 nt, Human
cccccugcaaagcccagcu

SEQ ID NO: 1642966 - RNA, 18 nt, Human
cccccugcaaagcccagc

SEQ ID NO: 1642967 - RNA, 21 nt, Human
cccccugcaaagcccagcuug

SEQ ID NO: 1642968 - RNA, 17 nt, Human
cccccugacaacacuca

SEQ ID NO: 1642969 - RNA, 21 nt, Human
cccccucuggcuccagcuggc

SEQ ID NO: 1642970 - RNA, 19 nt, Human
cccccucuggcuccagcug

SEQ ID NO: 1642971 - RNA, 12 nt, Human
cccccucuggcu

SEQ ID NO: 1642972 - RNA, 12 nt, Human
cccccagccugc

SEQ ID NO: 1642973 - RNA, 23 nt, Human
ccccucaacucuccuccagaguc

SEQ ID NO: 1642974 - RNA, 16 nt, Human
ccccucaacaccucug

SEQ ID NO: 1642975 - RNA, 15 nt, Human
ccccucaacaccucu

SEQ ID NO: 1642976 - RNA, 20 nt, Human
ccccagugcccacaggauca

SEQ ID NO: 1642977 - RNA, 16 nt, Human
ccccagugcccacagg

SEQ ID NO: 1642978 - RNA, 15 nt, Human
ccccagugcccacag

SEQ ID NO: 1642979 - RNA, 14 nt, Human
ccccagugcccaca

SEQ ID NO: 1642980 - RNA, 22 nt, Human
ccccauaauuuuuuuuuuccuu

SEQ ID NO: 1642981 - RNA, 13 nt, Human
cccccacccaagg

SEQ ID NO: 1642982 - RNA, 17 nt, Human
ccccauccucuguacag

SEQ ID NO: 1642983 - RNA, 24 nt, Human
cccccacccaagggccuggccuga

SEQ ID NO: 1642984 - RNA, 14 nt, Human
ccccauccucugua

SEQ ID NO: 1642985 - RNA, 17 nt, Human
ccccaucauugguaccc

SEQ ID NO: 1642986 - RNA, 13 nt, Human
cccccacugguga

SEQ ID NO: 1642987 - RNA, 11 nt, Human
cccccacuggu

SEQ ID NO: 1642988 - RNA, 15 nt, Human
cccccacuggugaca

SEQ ID NO: 1642989 - RNA, 19 nt, Human
ccccuggaugcagccucac

SEQ ID NO: 1642990 - RNA, 18 nt, Human
ccccuggaugcagccuca

SEQ ID NO: 1642991 - RNA, 15 nt, Human
ccccuggaugcagcc

SEQ ID NO: 1642992 - RNA, 20 nt, Human
ccccugcugguucaggguug

SEQ ID NO: 1642993 - RNA, 15 nt, Human
ccccugcugguucag

SEQ ID NO: 1642994 - RNA, 13 nt, Human
ccccugcugguuc

SEQ ID NO: 1642995 - RNA, 11 nt, Human
ccccugcuggu

SEQ ID NO: 1642996 - RNA, 17 nt, Human
ccccugcuggguguggc

SEQ ID NO: 1642997 - RNA, 14 nt, Human
ccccugcugggugu

SEQ ID NO: 1642998 - RNA, 19 nt, Human
ccccugcccggcugcggaa

SEQ ID NO: 1642999 - RNA, 17 nt, Human
ccccugcccggcugcgg

SEQ ID NO: 1643000 - RNA, 12 nt, Human
ccccucugcccu

SEQ ID NO: 1643001 - RNA, 14 nt, Human
ccccucugcccugc

SEQ ID NO: 1643002 - RNA, 13 nt, Human
ccccucugcccug

SEQ ID NO: 1643003 - RNA, 19 nt, Human
ccccugccucucugcaggu

SEQ ID NO: 1643004 - RNA, 17 nt, Human
ccccugccucucugcag

SEQ ID NO: 1643005 - RNA, 16 nt, Human
ccccugccucucugca

SEQ ID NO: 1643006 - RNA, 15 nt, Human
ccccugccucucugc

SEQ ID NO: 1643007 - RNA, 14 nt, Human
ccccugccucucug

SEQ ID NO: 1643008 - RNA, 23 nt, Human
cccgcuaagagggagggagggcu

SEQ ID NO: 1643009 - RNA, 22 nt, Human
cccgcccaggcuuagucacuga

SEQ ID NO: 1643010 - RNA, 20 nt, Human
cccgcccaggcuuagucacu

SEQ ID NO: 1643011 - RNA, 18 nt, Human
cccgacagccuggcacag

SEQ ID NO: 1643012 - RNA, 15 nt, Human
cccgacagccuggca

SEQ ID NO: 1643013 - RNA, 20 nt, Human
ccccuuccauggacuuuguu

SEQ ID NO: 1643014 - RNA, 13 nt, Human
ccccuuccaugga

SEQ ID NO: 1643015 - RNA, 14 nt, Human
cccgacagccuggc

SEQ ID NO: 1643016 - RNA, 15 nt, Human
ccccuguucacucua

SEQ ID NO: 1643017 - RNA, 18 nt, Human
ccccuggcuuuucacugc

SEQ ID NO: 1643018 - RNA, 22 nt, Human
ccccuggcuuuucacugcuggc

SEQ ID NO: 1643019 - RNA, 20 nt, Human
ccccuggcuuuucacugcug

SEQ ID NO: 1643020 - RNA, 19 nt, Human
ccccaccgcagacaggacc

SEQ ID NO: 1643021 - RNA, 15 nt, Human
ccccaccgcagacag

SEQ ID NO: 1643022 - RNA, 16 nt, Human
ccccacccugccucac

SEQ ID NO: 1643023 - RNA, 23 nt, Human
cccauuauucaaaguugccuaaa

SEQ ID NO: 1643024 - RNA, 18 nt, Human
cccauuauucaaaguugc

SEQ ID NO: 1643025 - RNA, 14 nt, Human
cccaugagccucag

SEQ ID NO: 1643026 - RNA, 12 nt, Human
cccaucugugaa

SEQ ID NO: 1643027 - RNA, 19 nt, Human
cccaucucuacaaaaagca

SEQ ID NO: 1643028 - RNA, 14 nt, Human
cccaguugggugga

SEQ ID NO: 1643029 - RNA, 13 nt, Human
cccaguuguauuu

SEQ ID NO: 1643030 - RNA, 14 nt, Human
cccaucucuucugg

SEQ ID NO: 1643031 - RNA, 23 nt, Human
cuaagagggagggagggcuccag

SEQ ID NO: 1643032 - RNA, 22 nt, Human
cuaagagggagggagggcucca

SEQ ID NO: 1643033 - RNA, 15 nt, Human
cuaagagggagggag

SEQ ID NO: 1643034 - RNA, 13 nt, Human
cuaagagggaggg

SEQ ID NO: 1643035 - RNA, 15 nt, Human
cuaagagagaaugag

SEQ ID NO: 1643036 - RNA, 14 nt, Human
cuaagagagaauga

SEQ ID NO: 1643037 - RNA, 19 nt, Human
cuaaauugacacuuaaaaa

SEQ ID NO: 1643038 - RNA, 19 nt, Human
cuaaauucuuucauuuuag

SEQ ID NO: 1643039 - RNA, 14 nt, Human
cuaaccacgcugga

SEQ ID NO: 1643040 - RNA, 12 nt, Human
cuaaccacgcug

SEQ ID NO: 1643041 - RNA, 20 nt, Human
cgggaggcagagguugcagu

SEQ ID NO: 1643042 - RNA, 23 nt, Human
cgggaggauguucugggacacag

SEQ ID NO: 1643043 - RNA, 20 nt, Human
cguuuguuccccaagacauu

SEQ ID NO: 1643044 - RNA, 22 nt, Human
cuaaaugaaaaucgugacaaca

SEQ ID NO: 1643045 - RNA, 21 nt, Human
cuaaaucuccaaaauaaaacu

SEQ ID NO: 1643046 - RNA, 17 nt, Human
cuaaauauauuuuaaga

SEQ ID NO: 1643047 - RNA, 21 nt, Human
cuaaacugcccccucugcccu

SEQ ID NO: 1643048 - RNA, 21 nt, Human
cuaaaauggacuguggugacu

SEQ ID NO: 1643049 - RNA, 22 nt, Human
cuaaaauggacuguggugacuu

SEQ ID NO: 1643050 - RNA, 13 nt, Human
cuaaacugccccc

SEQ ID NO: 1643051 - RNA, 12 nt, Human
cuaaacugcccc

SEQ ID NO: 1643052 - RNA, 13 nt, Human
cguuuucaaaauu

SEQ ID NO: 1643053 - RNA, 14 nt, Human
cuacacuaagagag

SEQ ID NO: 1643054 - RNA, 23 nt, Human
cuacacgagauacagaauuuuau

SEQ ID NO: 1643055 - RNA, 21 nt, Human
cuacacaggggaaaagaggag

SEQ ID NO: 1643056 - RNA, 14 nt, Human
cuaauuccacagcu

SEQ ID NO: 1643057 - RNA, 16 nt, Human
cuaauuccacagcugc

SEQ ID NO: 1643058 - RNA, 15 nt, Human
cuaauuccacagcug

SEQ ID NO: 1643059 - RNA, 18 nt, Human
cuaauauguaacaagcca

SEQ ID NO: 1643060 - RNA, 21 nt, Human
cuaaucagcauucucacuccu

SEQ ID NO: 1643061 - RNA, 20 nt, Human
cuaaucagcauucucacucc

SEQ ID NO: 1643062 - RNA, 20 nt, Human
cuaaugcgcaggcuggcccu

SEQ ID NO: 1643063 - RNA, 19 nt, Human
cuaaugcgcaggcuggccc

SEQ ID NO: 1643064 - RNA, 16 nt, Human
cuaaugcgcaggcugg

SEQ ID NO: 1643065 - RNA, 15 nt, Human
cuaaugcgcaggcug

SEQ ID NO: 1643066 - RNA, 13 nt, Human
cuaaugggacacu

SEQ ID NO: 1643067 - RNA, 12 nt, Human
cuaaugggacac

SEQ ID NO: 1643068 - RNA, 23 nt, Human
cuaaugcgcaggcuggcccugcc

SEQ ID NO: 1643069 - RNA, 22 nt, Human
cuaaugcgcaggcuggcccugc

SEQ ID NO: 1643070 - RNA, 22 nt, Human
cuaauuauacccccugcaaagc

SEQ ID NO: 1643071 - RNA, 21 nt, Human
cuaagcuucacuguaaaauaa

SEQ ID NO: 1643072 - RNA, 22 nt, Human
cuaagcuauucaguaauaacuc

SEQ ID NO: 1643073 - RNA, 22 nt, Human
cuaaggacuucuuuaauuuugg

SEQ ID NO: 1643074 - RNA, 16 nt, Human
cuaaggacuucuuuaa

SEQ ID NO: 1643075 - RNA, 15 nt, Human
cuaaggacuucuuua

SEQ ID NO: 1643076 - RNA, 14 nt, Human
cuaaggacuucuuu

SEQ ID NO: 1643077 - RNA, 18 nt, Human
cuaaguaaaaccacagca

SEQ ID NO: 1643078 - RNA, 14 nt, Human
cuaaguaaaaccac

SEQ ID NO: 1643079 - RNA, 19 nt, Human
cuaaguaaaaccacagcag

SEQ ID NO: 1643080 - RNA, 14 nt, Human
cuaauaaagcugug

SEQ ID NO: 1643081 - RNA, 17 nt, Human
cuaauagacaauuuauu

SEQ ID NO: 1643082 - RNA, 19 nt, Human
cuaauagacaauuuauuau

SEQ ID NO: 1643083 - RNA, 23 nt, Human
cuaauagacaauuuauuauggca

SEQ ID NO: 1643084 - RNA, 22 nt, Human
cuaggaaauauuuauuuuaaua

SEQ ID NO: 1643085 - RNA, 18 nt, Human
cuacacugugcugagucu

SEQ ID NO: 1643086 - RNA, 17 nt, Human
cuacacugugcugaguc

SEQ ID NO: 1643087 - RNA, 14 nt, Human
cuacacugugcuga

SEQ ID NO: 1643088 - RNA, 13 nt, Human
cuacacugugcug

SEQ ID NO: 1643089 - RNA, 20 nt, Human
cuacagaggccaugggccuc

SEQ ID NO: 1643090 - RNA, 18 nt, Human
cuacagaggccaugggcc

SEQ ID NO: 1643091 - RNA, 22 nt, Human
cuacagaggccaugggccuccu

SEQ ID NO: 1643092 - RNA, 22 nt, Human
cuacagcuugaccgugaggcca

SEQ ID NO: 1643093 - RNA, 19 nt, Human
cuacagcuugaccgugagg

SEQ ID NO: 1643094 - RNA, 23 nt, Human
cuacagcuugaccgugaggccag

SEQ ID NO: 1643095 - RNA, 19 nt, Human
cuacagcuaaucagcauuc

SEQ ID NO: 1643096 - RNA, 18 nt, Human
cuacagcuaaucagcauu

SEQ ID NO: 1643097 - RNA, 22 nt, Human
cuacagcuaaucagcauucuca

SEQ ID NO: 1643098 - RNA, 21 nt, Human
cuacagcuaaucagcauucuc

SEQ ID NO: 1643099 - RNA, 20 nt, Human
cuacauggaguauaugucaa

SEQ ID NO: 1643100 - RNA, 18 nt, Human
cuacauggaguauauguc

SEQ ID NO: 1643101 - RNA, 13 nt, Human
cuacaguccuccc

SEQ ID NO: 1643102 - RNA, 16 nt, Human
cuacaggugugaguca

SEQ ID NO: 1643103 - RNA, 14 nt, Human
cuacaggugugagu

SEQ ID NO: 1643104 - RNA, 16 nt, Human
cuacaggagugagcac

SEQ ID NO: 1643105 - RNA, 15 nt, Human
cuacaggagugagca

SEQ ID NO: 1643106 - RNA, 14 nt, Human
cuacaggagugagc

SEQ ID NO: 1643107 - RNA, 17 nt, Human
cuacaggcacccaccau

SEQ ID NO: 1643108 - RNA, 15 nt, Human
cuacaggcacccacc

SEQ ID NO: 1643109 - RNA, 17 nt, Human
cuacccagcgagcccug

SEQ ID NO: 1643110 - RNA, 15 nt, Human
cuacccagcgagccc

SEQ ID NO: 1643111 - RNA, 13 nt, Human
cuacccacccucc

SEQ ID NO: 1643112 - RNA, 13 nt, Human
cuacccaggugcu

SEQ ID NO: 1643113 - RNA, 18 nt, Human
cuacccagcgagcccugg

SEQ ID NO: 1643114 - RNA, 19 nt, Human
cuacccagcgagcccuggu

SEQ ID NO: 1643115 - RNA, 17 nt, Human
cuacccucuuagaaaaa

SEQ ID NO: 1643116 - RNA, 22 nt, Human
cuacauuauaaaugucucuuua

SEQ ID NO: 1643117 - RNA, 13 nt, Human
cuacauucuguua

SEQ ID NO: 1643118 - RNA, 14 nt, Human
cuacauucuguuaa

SEQ ID NO: 1643119 - RNA, 23 nt, Human
cuagccuuagaagucacacagua

SEQ ID NO: 1643120 - RNA, 22 nt, Human
cuagccuuagaagucacacagu

SEQ ID NO: 1643121 - RNA, 21 nt, Human
cuagccuuagaagucacacag

SEQ ID NO: 1643122 - RNA, 22 nt, Human
cuagccugugccucugggacug

SEQ ID NO: 1643123 - RNA, 19 nt, Human
cuagccugugccucuggga

SEQ ID NO: 1643124 - RNA, 21 nt, Human
cuagccugugccucugggacu

SEQ ID NO: 1643125 - RNA, 24 nt, Human
cuagauacuguaucaugacaaaga

SEQ ID NO: 1643126 - RNA, 13 nt, Human
cuagauacuguau

SEQ ID NO: 1643127 - RNA, 16 nt, Human
cuagauacuguaucau

SEQ ID NO: 1643128 - RNA, 20 nt, Human
cuaggaaauauuuauuuuaa

SEQ ID NO: 1643129 - RNA, 19 nt, Human
cuaggaaauauuuauuuua

SEQ ID NO: 1643130 - RNA, 15 nt, Human
cuaggaaauauuuau

SEQ ID NO: 1643131 - RNA, 14 nt, Human
cuaggaaauauuua

SEQ ID NO: 1643132 - RNA, 15 nt, Human
cuauaggugcuacaa

SEQ ID NO: 1643133 - RNA, 19 nt, Human
cuagaguuuagcuggaaaa

SEQ ID NO: 1643134 - RNA, 18 nt, Human
cuagaguuuagcuggaaa

SEQ ID NO: 1643135 - RNA, 17 nt, Human
cuagagguucaaagaua

SEQ ID NO: 1643136 - RNA, 18 nt, Human
cuagagguucaaagauau

SEQ ID NO: 1643137 - RNA, 21 nt, Human
cuagagguucaaagauauuuu

SEQ ID NO: 1643138 - RNA, 20 nt, Human
cuacuguccuacccacccuc

SEQ ID NO: 1643139 - RNA, 22 nt, Human
cuacuuagcaugucccuaccga

SEQ ID NO: 1643140 - RNA, 17 nt, Human
cuacuuagcaugucccu

SEQ ID NO: 1643141 - RNA, 23 nt, Human
cuagacuggugacugauucuuca

SEQ ID NO: 1643142 - RNA, 22 nt, Human
cuagacuggugacugauucuuc

SEQ ID NO: 1643143 - RNA, 19 nt, Human
cuagacuggugacugauuc

SEQ ID NO: 1643144 - RNA, 18 nt, Human
cuagacuggugacugauu

SEQ ID NO: 1643145 - RNA, 17 nt, Human
cuagacuggugacugau

SEQ ID NO: 1643146 - RNA, 15 nt, Human
cuagacuggugacug

SEQ ID NO: 1643147 - RNA, 14 nt, Human
cuagacuggugacu

SEQ ID NO: 1643148 - RNA, 19 nt, Human
cuacucgaguuacagacaa

SEQ ID NO: 1643149 - RNA, 16 nt, Human
cuacucgaguuacaga

SEQ ID NO: 1643150 - RNA, 15 nt, Human
cuacucgaguuacag

SEQ ID NO: 1643151 - RNA, 19 nt, Human
cuaccgagucucuucucca

SEQ ID NO: 1643152 - RNA, 17 nt, Human
cuaccgagucucuucuc

SEQ ID NO: 1643153 - RNA, 23 nt, Human
cuaccgagucucuucuccacugg

SEQ ID NO: 1643154 - RNA, 22 nt, Human
cuaccgagucucuucuccacug

SEQ ID NO: 1643155 - RNA, 21 nt, Human
cuaccgagucucuucuccacu

SEQ ID NO: 1643156 - RNA, 19 nt, Human
cuacuguccuacccacccu

SEQ ID NO: 1643157 - RNA, 13 nt, Human
cuacucuguguca

SEQ ID NO: 1643158 - RNA, 12 nt, Human
cuacucuguguc

SEQ ID NO: 1643159 - RNA, 17 nt, Human
cuauucaguaauaacuc

SEQ ID NO: 1643160 - RNA, 16 nt, Human
cuauguaucaaugagu

SEQ ID NO: 1643161 - RNA, 13 nt, Human
cuauguaucaaug

SEQ ID NO: 1643162 - RNA, 19 nt, Human
cuaugggggcacugaggac

SEQ ID NO: 1643163 - RNA, 13 nt, Human
cuaugcugaguuu

SEQ ID NO: 1643164 - RNA, 15 nt, Human
cuaugcugaguuugu

SEQ ID NO: 1643165 - RNA, 14 nt, Human
cuaugcugaguuug

SEQ ID NO: 1643166 - RNA, 18 nt, Human
cuaugcugaguuugugcu

SEQ ID NO: 1643167 - RNA, 23 nt, Human
cuauucaguaauaacucuacccu

SEQ ID NO: 1643168 - RNA, 12 nt, Human
cuauaauuuaaa

SEQ ID NO: 1643169 - RNA, 13 nt, Human
cuauaauuuaaau

SEQ ID NO: 1643170 - RNA, 17 nt, Human
cuaggaagacuuuggaa

SEQ ID NO: 1643171 - RNA, 15 nt, Human
cuaggaagacuuugg

SEQ ID NO: 1643172 - RNA, 20 nt, Human
cuaggaacacuccuucacag

SEQ ID NO: 1643173 - RNA, 21 nt, Human
cuauagccuaggugacagagu

SEQ ID NO: 1643174 - RNA, 20 nt, Human
cuauagccuaggugacagag

SEQ ID NO: 1643175 - RNA, 18 nt, Human
cuauagccuaggugacag

SEQ ID NO: 1643176 - RNA, 19 nt, Human
cuauagccuaggugacaga

SEQ ID NO: 1643177 - RNA, 19 nt, Human
cuaugaaauauuauguuaa

SEQ ID NO: 1643178 - RNA, 22 nt, Human
cuaugaaguuuuuuuuauacag

SEQ ID NO: 1643179 - RNA, 15 nt, Human
cuaugauuuggaaaa

SEQ ID NO: 1643180 - RNA, 19 nt, Human
cuaugauuuggaaaauaaa

SEQ ID NO: 1643181 - RNA, 15 nt, Human
cucaaauuucuaaau

SEQ ID NO: 1643182 - RNA, 17 nt, Human
cucaaauuucuaaaucu

SEQ ID NO: 1643183 - RNA, 14 nt, Human
cucaacucuccucc

SEQ ID NO: 1643184 - RNA, 14 nt, Human
cucaaauuucuaaa

SEQ ID NO: 1643185 - RNA, 20 nt, Human
cuauuucuauauuuucauuc

SEQ ID NO: 1643186 - RNA, 19 nt, Human
cuauuucuauauuuucauu

SEQ ID NO: 1643187 - RNA, 18 nt, Human
cucaacucuccuccagag

SEQ ID NO: 1643188 - RNA, 16 nt, Human
cucaacucuccuccag

SEQ ID NO: 1643189 - RNA, 19 nt, Human
cucaacucuccuccagagu

SEQ ID NO: 1643190 - RNA, 23 nt, Human
cucacacggacacucaaaagcug

SEQ ID NO: 1643191 - RNA, 14 nt, Human
cucaaguccucuuu

SEQ ID NO: 1643192 - RNA, 17 nt, Human
cucacagaacccuugga

SEQ ID NO: 1643193 - RNA, 16 nt, Human
cuauugcugcuugagg

SEQ ID NO: 1643194 - RNA, 11 nt, Human
cuauugguaaa

SEQ ID NO: 1643195 - RNA, 21 nt, Human
cucauugaccugaggcccuuc

SEQ ID NO: 1643196 - RNA, 19 nt, Human
cucauugaccugaggcccu

SEQ ID NO: 1643197 - RNA, 17 nt, Human
cucauugaccugaggcc

SEQ ID NO: 1643198 - RNA, 12 nt, Human
cucauucuucug

SEQ ID NO: 1643199 - RNA, 18 nt, Human
cucauucuccuuguguua

SEQ ID NO: 1643200 - RNA, 22 nt, Human
cucauucuccuuguguuacuaa

SEQ ID NO: 1643201 - RNA, 17 nt, Human
cucauuuccaagcaagu

SEQ ID NO: 1643202 - RNA, 21 nt, Human
cucauuugucacacacuuugg

SEQ ID NO: 1643203 - RNA, 14 nt, Human
cucauuuccaagca

SEQ ID NO: 1643204 - RNA, 13 nt, Human
cucauuuccaagc

SEQ ID NO: 1643205 - RNA, 12 nt, Human
cucauuuccaag

SEQ ID NO: 1643206 - RNA, 16 nt, Human
cuccagagucagaagu

SEQ ID NO: 1643207 - RNA, 14 nt, Human
cuccacuggaugga

SEQ ID NO: 1643208 - RNA, 18 nt, Human
cuccagcucaccagcccc

SEQ ID NO: 1643209 - RNA, 16 nt, Human
cuccagcucaccagcc

SEQ ID NO: 1643210 - RNA, 15 nt, Human
cuccagcucaccagc

SEQ ID NO: 1643211 - RNA, 15 nt, Human
cuccagccccuggau

SEQ ID NO: 1643212 - RNA, 14 nt, Human
cuccagccccugga

SEQ ID NO: 1643213 - RNA, 13 nt, Human
cuccagccccugg

SEQ ID NO: 1643214 - RNA, 11 nt, Human
cuccagccccu

SEQ ID NO: 1643215 - RNA, 13 nt, Human
cuccacugccuuc

SEQ ID NO: 1643216 - RNA, 13 nt, Human
cuccacuggaugg

SEQ ID NO: 1643217 - RNA, 16 nt, Human
cuccacugccuucgau

SEQ ID NO: 1643218 - RNA, 15 nt, Human
cuccacugccuucga

SEQ ID NO: 1643219 - RNA, 14 nt, Human
cuccacugccuucg

SEQ ID NO: 1643220 - RNA, 14 nt, Human
cuccccucggagaa

SEQ ID NO: 1643221 - RNA, 20 nt, Human
cuccccagccccaucccaaa

SEQ ID NO: 1643222 - RNA, 23 nt, Human
cuccccugcuggguguggcgcag

SEQ ID NO: 1643223 - RNA, 21 nt, Human
cuccccugcuggguguggcgc

SEQ ID NO: 1643224 - RNA, 18 nt, Human
cucccucagucuggcccu

SEQ ID NO: 1643225 - RNA, 15 nt, Human
cucccuucauccuuc

SEQ ID NO: 1643226 - RNA, 23 nt, Human
cucccuucaaccauuccccaugg

SEQ ID NO: 1643227 - RNA, 22 nt, Human
cucccuucaaccauuccccaug

SEQ ID NO: 1643228 - RNA, 21 nt, Human
cucccuucaaccauuccccau

SEQ ID NO: 1643229 - RNA, 23 nt, Human
cucccgaauagcugggacuacag

SEQ ID NO: 1643230 - RNA, 20 nt, Human
cucccgaauagcugggacua

SEQ ID NO: 1643231 - RNA, 15 nt, Human
cucccgaguagcugg

SEQ ID NO: 1643232 - RNA, 16 nt, Human
cucccaucacuucccu

SEQ ID NO: 1643233 - RNA, 22 nt, Human
cucccaggcgccccuucccccu

SEQ ID NO: 1643234 - RNA, 20 nt, Human
cucccaggcgccccuucccc

SEQ ID NO: 1643235 - RNA, 19 nt, Human
cucccaggcgccccuuccc

SEQ ID NO: 1643236 - RNA, 17 nt, Human
cucccaggcgccccuuc

SEQ ID NO: 1643237 - RNA, 15 nt, Human
cucccaacucacccc

SEQ ID NO: 1643238 - RNA, 14 nt, Human
cucccaacucaccc

SEQ ID NO: 1643239 - RNA, 15 nt, Human
cucccacaaaggaga

SEQ ID NO: 1643240 - RNA, 16 nt, Human
cucccaacucacccca

SEQ ID NO: 1643241 - RNA, 23 nt, Human
cucccaaagugcugggauuacag

SEQ ID NO: 1643242 - RNA, 16 nt, Human
cucccaaagugcuggg

SEQ ID NO: 1643243 - RNA, 20 nt, Human
cuccauuuaauaauuauaug

SEQ ID NO: 1643244 - RNA, 13 nt, Human
cuccauuuaauaa

SEQ ID NO: 1643245 - RNA, 17 nt, Human
cuccaugcugccuccag

SEQ ID NO: 1643246 - RNA, 16 nt, Human
cuccaugcugccucca

SEQ ID NO: 1643247 - RNA, 15 nt, Human
cuccaugcugccucc

SEQ ID NO: 1643248 - RNA, 14 nt, Human
cuccaugcugccuc

SEQ ID NO: 1643249 - RNA, 19 nt, Human
cuccagcuggguuggaaaa

SEQ ID NO: 1643250 - RNA, 23 nt, Human
cuccagcuggccgggagccugau

SEQ ID NO: 1643251 - RNA, 22 nt, Human
cuccagcuggccgggagccuga

SEQ ID NO: 1643252 - RNA, 22 nt, Human
cucaggaaaucaaauaugcaaa

SEQ ID NO: 1643253 - RNA, 23 nt, Human
cucaggagcccugggaggcucug

SEQ ID NO: 1643254 - RNA, 22 nt, Human
cucaggagcccugggaggcucu

SEQ ID NO: 1643255 - RNA, 21 nt, Human
cucaggagcccugggaggcuc

SEQ ID NO: 1643256 - RNA, 20 nt, Human
cucaggagcccugggaggcu

SEQ ID NO: 1643257 - RNA, 17 nt, Human
cucaggagcccugggag

SEQ ID NO: 1643258 - RNA, 16 nt, Human
cucaggagcccuggga

SEQ ID NO: 1643259 - RNA, 15 nt, Human
cucaggagcccuggg

SEQ ID NO: 1643260 - RNA, 14 nt, Human
cucaggagcccugg

SEQ ID NO: 1643261 - RNA, 13 nt, Human
cucaggagcccug

SEQ ID NO: 1643262 - RNA, 12 nt, Human
cucaggagcccu

SEQ ID NO: 1643263 - RNA, 24 nt, Human
cucaggagcccugggaggcucugg

SEQ ID NO: 1643264 - RNA, 18 nt, Human
cucaggcaggugggaugg

SEQ ID NO: 1643265 - RNA, 15 nt, Human
cucaggcagguggga

SEQ ID NO: 1643266 - RNA, 20 nt, Human
cucagggccuggcucaggug

SEQ ID NO: 1643267 - RNA, 19 nt, Human
cucagggccuggcucaggu

SEQ ID NO: 1643268 - RNA, 18 nt, Human
cucagggccuggcucagg

SEQ ID NO: 1643269 - RNA, 13 nt, Human
cucagggccuggc

SEQ ID NO: 1643270 - RNA, 22 nt, Human
cucagggucccugguggcagcu

SEQ ID NO: 1643271 - RNA, 21 nt, Human
cucagggucccugguggcagc

SEQ ID NO: 1643272 - RNA, 20 nt, Human
cucagggucccugguggcag

SEQ ID NO: 1643273 - RNA, 14 nt, Human
cucagggccugguc

SEQ ID NO: 1643274 - RNA, 24 nt, Human
cucagggucccugguggcagcuca

SEQ ID NO: 1643275 - RNA, 24 nt, Human
cucagguaaucgaccugccucggc

SEQ ID NO: 1643276 - RNA, 22 nt, Human
cucagguaaucgaccugccucg

SEQ ID NO: 1643277 - RNA, 20 nt, Human
cucagguaaucgaccugccu

SEQ ID NO: 1643278 - RNA, 21 nt, Human
cucagguggggucacucuggc

SEQ ID NO: 1643279 - RNA, 20 nt, Human
cucagguggggucacucugg

SEQ ID NO: 1643280 - RNA, 19 nt, Human
cucagguggggucacucug

SEQ ID NO: 1643281 - RNA, 23 nt, Human
cucaggugauccacccaccucag

SEQ ID NO: 1643282 - RNA, 16 nt, Human
cucacugcagccucaa

SEQ ID NO: 1643283 - RNA, 15 nt, Human
cucacugcagccuca

SEQ ID NO: 1643284 - RNA, 20 nt, Human
cucacugcauccuccgccuc

SEQ ID NO: 1643285 - RNA, 15 nt, Human
cucacuguugcccag

SEQ ID NO: 1643286 - RNA, 14 nt, Human
cucacuguugccca

SEQ ID NO: 1643287 - RNA, 19 nt, Human
cucacuguugcccaggcug

SEQ ID NO: 1643288 - RNA, 18 nt, Human
cucacuguugcccaggcu

SEQ ID NO: 1643289 - RNA, 17 nt, Human
cucacuguugcccaggc

SEQ ID NO: 1643290 - RNA, 16 nt, Human
cucacuguugcccagg

SEQ ID NO: 1643291 - RNA, 19 nt, Human
cucagagagggugggagug

SEQ ID NO: 1643292 - RNA, 23 nt, Human
cucagagagggugggagugggcc

SEQ ID NO: 1643293 - RNA, 15 nt, Human
cucagagccaccccu

SEQ ID NO: 1643294 - RNA, 16 nt, Human
cucagaucuucugugg

SEQ ID NO: 1643295 - RNA, 22 nt, Human
cucagcauccuggcacccggcc

SEQ ID NO: 1643296 - RNA, 21 nt, Human
cucagcauccuggcacccggc

SEQ ID NO: 1643297 - RNA, 13 nt, Human
cucagcauccugg

SEQ ID NO: 1643298 - RNA, 20 nt, Human
cucagcaaaagaugcuucuc

SEQ ID NO: 1643299 - RNA, 19 nt, Human
cucagcaaaagaugcuucu

SEQ ID NO: 1643300 - RNA, 16 nt, Human
cucagcaggggagggu

SEQ ID NO: 1643301 - RNA, 21 nt, Human
cucagcaaaagaugcuucuca

SEQ ID NO: 1643302 - RNA, 23 nt, Human
cucagauuuuauuauguaaaucc

SEQ ID NO: 1643303 - RNA, 15 nt, Human
cucagcauccuggca

SEQ ID NO: 1643304 - RNA, 21 nt, Human
cucagcccucccugccccucc

SEQ ID NO: 1643305 - RNA, 20 nt, Human
cucagcccucccugccccuc

SEQ ID NO: 1643306 - RNA, 19 nt, Human
cucagcccucccugccccu

SEQ ID NO: 1643307 - RNA, 14 nt, Human
cucagcccucccug

SEQ ID NO: 1643308 - RNA, 21 nt, Human
cucagcggggacagcuccuuc

SEQ ID NO: 1643309 - RNA, 20 nt, Human
cucagcggggacagcuccuu

SEQ ID NO: 1643310 - RNA, 19 nt, Human
cucagcggggacagcuccu

SEQ ID NO: 1643311 - RNA, 18 nt, Human
cucagcggggacagcucc

SEQ ID NO: 1643312 - RNA, 16 nt, Human
cucagcggggacagcu

SEQ ID NO: 1643313 - RNA, 15 nt, Human
cucagcggggacagc

SEQ ID NO: 1643314 - RNA, 14 nt, Human
cucagcggggacag

SEQ ID NO: 1643315 - RNA, 23 nt, Human
cucagcggggacagcuccuucug

SEQ ID NO: 1643316 - RNA, 15 nt, Human
cucagcucccaaggc

SEQ ID NO: 1643317 - RNA, 19 nt, Human
cucagcucccaaggcucug

SEQ ID NO: 1643318 - RNA, 15 nt, Human
ccuuggacucauuuu

SEQ ID NO: 1643319 - RNA, 15 nt, Human
ccuuggauugucccc

SEQ ID NO: 1643320 - RNA, 22 nt, Human
ccuuggcucaaguccucuuuuc

SEQ ID NO: 1643321 - RNA, 19 nt, Human
ccuuggauuguccccgacc

SEQ ID NO: 1643322 - RNA, 21 nt, Human
ccuugacagggcacaccgggc

SEQ ID NO: 1643323 - RNA, 18 nt, Human
ccuugacagggcacaccg

SEQ ID NO: 1643324 - RNA, 18 nt, Human
ccuucucuccagccccug

SEQ ID NO: 1643325 - RNA, 17 nt, Human
ccuucucuccagccccu

SEQ ID NO: 1643326 - RNA, 23 nt, Human
ccuugacauuguagagcuucugg

SEQ ID NO: 1643327 - RNA, 16 nt, Human
ccuuggcugcagggag

SEQ ID NO: 1643328 - RNA, 14 nt, Human
ccuuggggagcagg

SEQ ID NO: 1643329 - RNA, 20 nt, Human
ccuuggugucgggcaugaca

SEQ ID NO: 1643330 - RNA, 19 nt, Human
ccuuggugucgggcaugac

SEQ ID NO: 1643331 - RNA, 21 nt, Human
ccuuggugucgggcaugacac

SEQ ID NO: 1643332 - RNA, 19 nt, Human
ccuucucuccagccccugg

SEQ ID NO: 1643333 - RNA, 18 nt, Human
ccuucggccuccauccug

SEQ ID NO: 1643334 - RNA, 17 nt, Human
ccuucggccuccauccu

SEQ ID NO: 1643335 - RNA, 13 nt, Human
ccuuccaggggug

SEQ ID NO: 1643336 - RNA, 18 nt, Human
ccuuccaugucgccucug

SEQ ID NO: 1643337 - RNA, 17 nt, Human
ccuuccauggacuuugu

SEQ ID NO: 1643338 - RNA, 16 nt, Human
ccuucucuccagcccc

SEQ ID NO: 1643339 - RNA, 15 nt, Human
ccuucucuccagccc

SEQ ID NO: 1643340 - RNA, 13 nt, Human
ccuucucuccagc

SEQ ID NO: 1643341 - RNA, 12 nt, Human
ccuucucuccag

SEQ ID NO: 1643342 - RNA, 19 nt, Human
ccuucauuuggcauucccc

SEQ ID NO: 1643343 - RNA, 20 nt, Human
ccugugccucugggacugga

SEQ ID NO: 1643344 - RNA, 20 nt, Human
ccugugggcccccaaaugga

SEQ ID NO: 1643345 - RNA, 20 nt, Human
ccuguggaugauaaaacaca

SEQ ID NO: 1643346 - RNA, 18 nt, Human
ccuguggaucaaauccag

SEQ ID NO: 1643347 - RNA, 23 nt, Human
cgaacauguuuuucuucucccuc

SEQ ID NO: 1643348 - RNA, 21 nt, Human
cgaacauguuuuucuucuccc

SEQ ID NO: 1643349 - RNA, 22 nt, Human
ccuuuuuuggcugcugaaggcu

SEQ ID NO: 1643350 - RNA, 20 nt, Human
ccuuuuuuggcugcugaagg

SEQ ID NO: 1643351 - RNA, 18 nt, Human
ccuuuuuuggcugcugaa

SEQ ID NO: 1643352 - RNA, 17 nt, Human
ccuuuuuuggcugcuga

SEQ ID NO: 1643353 - RNA, 23 nt, Human
cgaaagggacuuggaagcuccgc

SEQ ID NO: 1643354 - RNA, 14 nt, Human
cgaauauugcugau

SEQ ID NO: 1643355 - RNA, 12 nt, Human
cgaauauugcug

SEQ ID NO: 1643356 - RNA, 11 nt, Human
cgaauauugcu

SEQ ID NO: 1643357 - RNA, 16 nt, Human
cgaauagcugggacua

SEQ ID NO: 1643358 - RNA, 17 nt, Human
cgaauauugcugauggu

SEQ ID NO: 1643359 - RNA, 15 nt, Human
cgaauauugcugaug

SEQ ID NO: 1643360 - RNA, 23 nt, Human
ccuuugugaggaagccgcugggg

SEQ ID NO: 1643361 - RNA, 17 nt, Human
ccuuugugaggaagccg

SEQ ID NO: 1643362 - RNA, 16 nt, Human
ccuuugugaggaagcc

SEQ ID NO: 1643363 - RNA, 15 nt, Human
ccuuugugaggaagc

SEQ ID NO: 1643364 - RNA, 23 nt, Human
ccuuuguccccaccgcagacagg

SEQ ID NO: 1643365 - RNA, 22 nt, Human
ccuuuguccccaccgcagacag

SEQ ID NO: 1643366 - RNA, 14 nt, Human
ccuuugugaggaag

SEQ ID NO: 1643367 - RNA, 15 nt, Human
ccuuuuuuggcugcu

SEQ ID NO: 1643368 - RNA, 14 nt, Human
ccuuuguccccacc

SEQ ID NO: 1643369 - RNA, 18 nt, Human
ccuuuguccccaccgcag

SEQ ID NO: 1643370 - RNA, 16 nt, Human
ccuuuguccccaccgc

SEQ ID NO: 1643371 - RNA, 24 nt, Human
ccuuuguauucucuccuguaccuc

SEQ ID NO: 1643372 - RNA, 23 nt, Human
ccuuuguaaauugucagaugcug

SEQ ID NO: 1643373 - RNA, 22 nt, Human
ccuuuguauucucuccuguacc

SEQ ID NO: 1643374 - RNA, 23 nt, Human
ccuuuguauucucuccuguaccu

SEQ ID NO: 1643375 - RNA, 21 nt, Human
ccuuuguaaauugucagaugc

SEQ ID NO: 1643376 - RNA, 19 nt, Human
cgcugugcugcccugccca

SEQ ID NO: 1643377 - RNA, 23 nt, Human
cgcugugcugcccugcccaccug

SEQ ID NO: 1643378 - RNA, 21 nt, Human
cgcugugcugcccugcccacc

SEQ ID NO: 1643379 - RNA, 14 nt, Human
cgcugugcugcccu

SEQ ID NO: 1643380 - RNA, 13 nt, Human
cgcugugcugccc

SEQ ID NO: 1643381 - RNA, 11 nt, Human
cgcugugcugc

SEQ ID NO: 1643382 - RNA, 17 nt, Human
cggaauaguuggcuagg

SEQ ID NO: 1643383 - RNA, 16 nt, Human
cggaauaguuggcuag

SEQ ID NO: 1643384 - RNA, 14 nt, Human
cgcuuucuacccag

SEQ ID NO: 1643385 - RNA, 16 nt, Human
cgcuuucuacccagcg

SEQ ID NO: 1643386 - RNA, 17 nt, Human
cggagaaaggaagggcu

SEQ ID NO: 1643387 - RNA, 15 nt, Human
cggagaaaggaaggg

SEQ ID NO: 1643388 - RNA, 17 nt, Human
cggacuuagcugggaga

SEQ ID NO: 1643389 - RNA, 22 nt, Human
cggacagccacggccaggccag

SEQ ID NO: 1643390 - RNA, 21 nt, Human
cggacagccacggccaggcca

SEQ ID NO: 1643391 - RNA, 16 nt, Human
cggacuuagcugggag

SEQ ID NO: 1643392 - RNA, 21 nt, Human
cgcccagucuggaaugcagug

SEQ ID NO: 1643393 - RNA, 18 nt, Human
cgcccggcuaauuuuugu

SEQ ID NO: 1643394 - RNA, 19 nt, Human
cgcccagucuggaaugcag

SEQ ID NO: 1643395 - RNA, 13 nt, Human
cgcccagucugga

SEQ ID NO: 1643396 - RNA, 18 nt, Human
cgcccaacuaauuuuugu

SEQ ID NO: 1643397 - RNA, 19 nt, Human
cgcagcccugcagagggca

SEQ ID NO: 1643398 - RNA, 18 nt, Human
cgcagcccugcagagggc

SEQ ID NO: 1643399 - RNA, 24 nt, Human
cgcagcccugcuuugggcugcccu

SEQ ID NO: 1643400 - RNA, 15 nt, Human
cgcagcccugcuuug

SEQ ID NO: 1643401 - RNA, 13 nt, Human
cgcagcccugcuu

SEQ ID NO: 1643402 - RNA, 24 nt, Human
cgcuacccgggaagggggcuggga

SEQ ID NO: 1643403 - RNA, 21 nt, Human
cgcuacccgggaagggggcug

SEQ ID NO: 1643404 - RNA, 18 nt, Human
cgcuacccgggaaggggg

SEQ ID NO: 1643405 - RNA, 24 nt, Human
cgcguugaaauuguaauuauaucu

SEQ ID NO: 1643406 - RNA, 19 nt, Human
cgcuaaacuuuucugauag

SEQ ID NO: 1643407 - RNA, 18 nt, Human
cgcuaaacuuuucugaua

SEQ ID NO: 1643408 - RNA, 17 nt, Human
cgcuaaacuuuucugau

SEQ ID NO: 1643409 - RNA, 14 nt, Human
cgcgacaaugcaaa

SEQ ID NO: 1643410 - RNA, 15 nt, Human
cgcgacaaugcaaac

SEQ ID NO: 1643411 - RNA, 19 nt, Human
cgcgguggcucacgccugu

SEQ ID NO: 1643412 - RNA, 20 nt, Human
cggccaggccagagggagug

SEQ ID NO: 1643413 - RNA, 12 nt, Human
cggccaggccag

SEQ ID NO: 1643414 - RNA, 11 nt, Human
cggccaggcca

SEQ ID NO: 1643415 - RNA, 14 nt, Human
cggcuggcagccca

SEQ ID NO: 1643416 - RNA, 13 nt, Human
cggcuggccuggc

SEQ ID NO: 1643417 - RNA, 23 nt, Human
cggcuggcagcccaccccucaac

SEQ ID NO: 1643418 - RNA, 14 nt, Human
cggcuggccuggcc

SEQ ID NO: 1643419 - RNA, 20 nt, Human
cgggaagggggcugggacau

SEQ ID NO: 1643420 - RNA, 19 nt, Human
cgggaagggggcugggaca

SEQ ID NO: 1643421 - RNA, 16 nt, Human
cgggaagggggcuggg

SEQ ID NO: 1643422 - RNA, 18 nt, Human
cgggaauuuucaucuagg

SEQ ID NO: 1643423 - RNA, 20 nt, Human
cgggaauuuucaucuaggau

SEQ ID NO: 1643424 - RNA, 16 nt, Human
cgaggacagggaggug

SEQ ID NO: 1643425 - RNA, 19 nt, Human
cgagcccugguggcagugg

SEQ ID NO: 1643426 - RNA, 17 nt, Human
cgcagcccugcagaggg

SEQ ID NO: 1643427 - RNA, 20 nt, Human
cgcagcauauucaggaagcu

SEQ ID NO: 1643428 - RNA, 19 nt, Human
cgcagcauauucaggaagc

SEQ ID NO: 1643429 - RNA, 17 nt, Human
cgcacugggcuugggga

SEQ ID NO: 1643430 - RNA, 23 nt, Human
cgcacuucgggaggucgaggcag

SEQ ID NO: 1643431 - RNA, 13 nt, Human
cgcacugggcuug

SEQ ID NO: 1643432 - RNA, 13 nt, Human
ccugggcagcugc

SEQ ID NO: 1643433 - RNA, 14 nt, Human
ccugggcagcugcc

SEQ ID NO: 1643434 - RNA, 19 nt, Human
ccugggggcugggcagagg

SEQ ID NO: 1643435 - RNA, 21 nt, Human
ccugggggcugggcagaggaa

SEQ ID NO: 1643436 - RNA, 20 nt, Human
ccugggggcugggcagagga

SEQ ID NO: 1643437 - RNA, 16 nt, Human
ccugggcagaaggaag

SEQ ID NO: 1643438 - RNA, 18 nt, Human
ccugggagugagcugguu

SEQ ID NO: 1643439 - RNA, 16 nt, Human
ccugggagugagcugg

SEQ ID NO: 1643440 - RNA, 22 nt, Human
ccugggaggucaaggcugcagu

SEQ ID NO: 1643441 - RNA, 16 nt, Human
ccuggcccacugcauc

SEQ ID NO: 1643442 - RNA, 16 nt, Human
ccuggcuuuucacugc

SEQ ID NO: 1643443 - RNA, 18 nt, Human
ccuggcuuuucacugcug

SEQ ID NO: 1643444 - RNA, 17 nt, Human
ccuggcuuuucacugcu

SEQ ID NO: 1643445 - RNA, 23 nt, Human
ccuggccagaugcaccagcccuu

SEQ ID NO: 1643446 - RNA, 21 nt, Human
ccuggccagaugcaccagccc

SEQ ID NO: 1643447 - RNA, 14 nt, Human
ccuggcccacugca

SEQ ID NO: 1643448 - RNA, 13 nt, Human
ccuggcccacugc

SEQ ID NO: 1643449 - RNA, 13 nt, Human
ccuggccacgccc

SEQ ID NO: 1643450 - RNA, 13 nt, Human
ccuggcaugggaa

SEQ ID NO: 1643451 - RNA, 16 nt, Human
ccuggcacugcuucca

SEQ ID NO: 1643452 - RNA, 13 nt, Human
ccuggcacugcuu

SEQ ID NO: 1643453 - RNA, 17 nt, Human
ccuggcacugcuuccag

SEQ ID NO: 1643454 - RNA, 12 nt, Human
ccuggcacugcu

SEQ ID NO: 1643455 - RNA, 21 nt, Human
ccuggcacccggccccugcug

SEQ ID NO: 1643456 - RNA, 20 nt, Human
ccuggcacccggccccugcu

SEQ ID NO: 1643457 - RNA, 19 nt, Human
ccuggcacccggccccugc

SEQ ID NO: 1643458 - RNA, 16 nt, Human
ccuggagaacuagaga

SEQ ID NO: 1643459 - RNA, 13 nt, Human
ccuggagaacuag

SEQ ID NO: 1643460 - RNA, 12 nt, Human
ccuggagaacua

SEQ ID NO: 1643461 - RNA, 21 nt, Human
ccugcuaauuccccagauugc

SEQ ID NO: 1643462 - RNA, 20 nt, Human
ccugccuguugggccaggag

SEQ ID NO: 1643463 - RNA, 19 nt, Human
ccugccuguugggccagga

SEQ ID NO: 1643464 - RNA, 18 nt, Human
ccugccuguugggccagg

SEQ ID NO: 1643465 - RNA, 14 nt, Human
ccuggcaugggaau

SEQ ID NO: 1643466 - RNA, 18 nt, Human
ccugguggcagcugcggu

SEQ ID NO: 1643467 - RNA, 17 nt, Human
ccugguggcagcugcgg

SEQ ID NO: 1643468 - RNA, 16 nt, Human
ccugguggcagcugcg

SEQ ID NO: 1643469 - RNA, 15 nt, Human
ccugguggcagcugc

SEQ ID NO: 1643470 - RNA, 14 nt, Human
ccugguggcagcug

SEQ ID NO: 1643471 - RNA, 22 nt, Human
ccugguggcagcucaccucucc

SEQ ID NO: 1643472 - RNA, 21 nt, Human
ccugguggcagcucaccucuc

SEQ ID NO: 1643473 - RNA, 19 nt, Human
ccugguggcagcucaccuc

SEQ ID NO: 1643474 - RNA, 16 nt, Human
ccugucccccugacaa

SEQ ID NO: 1643475 - RNA, 15 nt, Human
ccugucccccugaca

SEQ ID NO: 1643476 - RNA, 14 nt, Human
ccugucccccugac

SEQ ID NO: 1643477 - RNA, 13 nt, Human
ccugucccccuga

SEQ ID NO: 1643478 - RNA, 12 nt, Human
ccugucccccug

SEQ ID NO: 1643479 - RNA, 16 nt, Human
ccuguagagugggagc

SEQ ID NO: 1643480 - RNA, 15 nt, Human
ccuguagagugggag

SEQ ID NO: 1643481 - RNA, 19 nt, Human
ccuguagagugggagcuga

SEQ ID NO: 1643482 - RNA, 13 nt, Human
ccuguagcccuaa

SEQ ID NO: 1643483 - RNA, 14 nt, Human
ccugguggcagugg

SEQ ID NO: 1643484 - RNA, 13 nt, Human
ccugguggcagug

SEQ ID NO: 1643485 - RNA, 15 nt, Human
ccugguggcaguggg

SEQ ID NO: 1643486 - RNA, 10 nt, Human
ccuguaccuc

SEQ ID NO: 1643487 - RNA, 12 nt, Human
ccuguaccucuu

SEQ ID NO: 1643488 - RNA, 14 nt, Human
ccugaggcuccacu

SEQ ID NO: 1643489 - RNA, 13 nt, Human
ccugaggcuccac

SEQ ID NO: 1643490 - RNA, 17 nt, Human
ccugaggcuccacuugg

SEQ ID NO: 1643491 - RNA, 16 nt, Human
ccugaggcugggcucc

SEQ ID NO: 1643492 - RNA, 15 nt, Human
ccugaggcugggcuc

SEQ ID NO: 1643493 - RNA, 14 nt, Human
ccugaggcugggcu

SEQ ID NO: 1643494 - RNA, 13 nt, Human
ccugaggcugggc

SEQ ID NO: 1643495 - RNA, 18 nt, Human
ccugaggcccagagggcc

SEQ ID NO: 1643496 - RNA, 17 nt, Human
ccugaggcccagagggc

SEQ ID NO: 1643497 - RNA, 16 nt, Human
ccugaggcccagaggg

SEQ ID NO: 1643498 - RNA, 15 nt, Human
ccugaggcccagagg

SEQ ID NO: 1643499 - RNA, 12 nt, Human
ccugagcuggga

SEQ ID NO: 1643500 - RNA, 18 nt, Human
ccugagccagauuucacu

SEQ ID NO: 1643501 - RNA, 16 nt, Human
ccugagccagauuuca

SEQ ID NO: 1643502 - RNA, 15 nt, Human
ccugagccagauuuc

SEQ ID NO: 1643503 - RNA, 20 nt, Human
ccugaagucacacagugagu

SEQ ID NO: 1643504 - RNA, 22 nt, Human
ccugaagucuuuguacagacaa

SEQ ID NO: 1643505 - RNA, 19 nt, Human
ccugaaguaagcaaagacu

SEQ ID NO: 1643506 - RNA, 20 nt, Human
ccugagccagauuucacucu

SEQ ID NO: 1643507 - RNA, 19 nt, Human
ccugccaauggacuaacuu

SEQ ID NO: 1643508 - RNA, 19 nt, Human
ccugccaccacgcccggcu

SEQ ID NO: 1643509 - RNA, 15 nt, Human
ccugccaccacgccc

SEQ ID NO: 1643510 - RNA, 23 nt, Human
ccugcauuugugaaaugauggug

SEQ ID NO: 1643511 - RNA, 13 nt, Human
ccugccacccugg

SEQ ID NO: 1643512 - RNA, 12 nt, Human
ccugccacccug

SEQ ID NO: 1643513 - RNA, 14 nt, Human
ccugccacccuggg

SEQ ID NO: 1643514 - RNA, 22 nt, Human
ccugccacccuggggagaaagu

SEQ ID NO: 1643515 - RNA, 16 nt, Human
ccugccacccugggga

SEQ ID NO: 1643516 - RNA, 21 nt, Human
ccugcacacgcuccuuccucu

SEQ ID NO: 1643517 - RNA, 19 nt, Human
ccugcaaagcccagcuuga

SEQ ID NO: 1643518 - RNA, 23 nt, Human
ccugcacaaagcccuuccauguc

SEQ ID NO: 1643519 - RNA, 14 nt, Human
ccugcaaagcccag

SEQ ID NO: 1643520 - RNA, 16 nt, Human
ccugcaaagcccagcu

SEQ ID NO: 1643521 - RNA, 15 nt, Human
ccugcaaagcccagc

SEQ ID NO: 1643522 - RNA, 20 nt, Human
ccugcacaaagcccuuccau

SEQ ID NO: 1643523 - RNA, 22 nt, Human
ccugcacaaagcccuuccaugu

SEQ ID NO: 1643524 - RNA, 18 nt, Human
ccugcaaagcccagcuug

SEQ ID NO: 1643525 - RNA, 17 nt, Human
ccugcaaagcccagcuu

SEQ ID NO: 1643526 - RNA, 13 nt, Human
ccugaaagaggaa

SEQ ID NO: 1643527 - RNA, 14 nt, Human
ccugaaagcccuga

SEQ ID NO: 1643528 - RNA, 13 nt, Human
ccugaaagcccug

SEQ ID NO: 1643529 - RNA, 18 nt, Human
ccugaaagcccugagcuu

SEQ ID NO: 1643530 - RNA, 21 nt, Human
ccugaaggccccgcccaggcu

SEQ ID NO: 1643531 - RNA, 20 nt, Human
ccugaaggccccgcccaggc

SEQ ID NO: 1643532 - RNA, 22 nt, Human
ccugaaggccccgcccaggcuu

SEQ ID NO: 1643533 - RNA, 19 nt, Human
ccugaaggccccgcccagg

SEQ ID NO: 1643534 - RNA, 18 nt, Human
ccugaaggccccgcccag

SEQ ID NO: 1643535 - RNA, 11 nt, Human
ccucuuccuga

SEQ ID NO: 1643536 - RNA, 15 nt, Human
ccugagcugggauga

SEQ ID NO: 1643537 - RNA, 17 nt, Human
ccugccccugagcccau

SEQ ID NO: 1643538 - RNA, 22 nt, Human
ccugccccuccucucugcccua

SEQ ID NO: 1643539 - RNA, 21 nt, Human
ccugccccuccucucugcccu

SEQ ID NO: 1643540 - RNA, 20 nt, Human
ccugccccuccucucugccc

SEQ ID NO: 1643541 - RNA, 19 nt, Human
ccugccccuccucucugcc

SEQ ID NO: 1643542 - RNA, 14 nt, Human
ccugccccucccuu

SEQ ID NO: 1643543 - RNA, 18 nt, Human
ccugccccuccucucugc

SEQ ID NO: 1643544 - RNA, 18 nt, Human
ccugccccucccuucaac

SEQ ID NO: 1643545 - RNA, 16 nt, Human
ccugccccucccuuca

SEQ ID NO: 1643546 - RNA, 15 nt, Human
ccugccccucccuuc

SEQ ID NO: 1643547 - RNA, 16 nt, Human
ccugcccggcugcgga

SEQ ID NO: 1643548 - RNA, 14 nt, Human
ccugcccggcugcg

SEQ ID NO: 1643549 - RNA, 15 nt, Human
ccugccaggcauggu

SEQ ID NO: 1643550 - RNA, 12 nt, Human
ccugccaggcau

SEQ ID NO: 1643551 - RNA, 14 nt, Human
ccugccuguugggc

SEQ ID NO: 1643552 - RNA, 22 nt, Human
ccugccuguucccauucuugca

SEQ ID NO: 1643553 - RNA, 14 nt, Human
ccugccucagccuc

SEQ ID NO: 1643554 - RNA, 13 nt, Human
ccugccucagccu

SEQ ID NO: 1643555 - RNA, 12 nt, Human
ccugccucagcc

SEQ ID NO: 1643556 - RNA, 22 nt, Human
ccugcccuuaccugccaggaag

SEQ ID NO: 1643557 - RNA, 21 nt, Human
ccugcccuuaccugccaggaa

SEQ ID NO: 1643558 - RNA, 19 nt, Human
ccugcccuuaccugccagg

SEQ ID NO: 1643559 - RNA, 15 nt, Human
ccugcccugugggcc

SEQ ID NO: 1643560 - RNA, 14 nt, Human
ccugcccugugggc

SEQ ID NO: 1643561 - RNA, 12 nt, Human
ccugcccugugg

SEQ ID NO: 1643562 - RNA, 11 nt, Human
ccugcccugug

SEQ ID NO: 1643563 - RNA, 23 nt, Human
ccugcccugguuuccugcccugg

SEQ ID NO: 1643564 - RNA, 22 nt, Human
ccugcccugguuuccugcccug

SEQ ID NO: 1643565 - RNA, 21 nt, Human
ccugcccugguuuccugcccu

SEQ ID NO: 1643566 - RNA, 20 nt, Human
ccugcccugguuuccugccc

SEQ ID NO: 1643567 - RNA, 19 nt, Human
ccugcccugguuuccugcc

SEQ ID NO: 1643568 - RNA, 14 nt, Human
ccugcccugguuuc

SEQ ID NO: 1643569 - RNA, 22 nt, Human
ccugcccugggaggcagugaug

SEQ ID NO: 1643570 - RNA, 20 nt, Human
ccugcccugggaggcaguga

SEQ ID NO: 1643571 - RNA, 15 nt, Human
ccugcccugggaggc

SEQ ID NO: 1643572 - RNA, 14 nt, Human
ccugcccugggagg

SEQ ID NO: 1643573 - RNA, 12 nt, Human
ccugcccuggga

SEQ ID NO: 1643574 - RNA, 10 nt, Human
ccugcccugg

SEQ ID NO: 1643575 - RNA, 22 nt, Human
ccugccuguugggccaggagcc

SEQ ID NO: 1643576 - RNA, 18 nt, Human
gaaaauauuuguaucaca

SEQ ID NO: 1643577 - RNA, 23 nt, Human
gaaaaguuuaauauuaaagccau

SEQ ID NO: 1643578 - RNA, 22 nt, Human
gaaaaucuacacuccagugaga

SEQ ID NO: 1643579 - RNA, 22 nt, Human
gaaaaucagccugcuccagcug

SEQ ID NO: 1643580 - RNA, 20 nt, Human
gaaaaucagccugcuccagc

SEQ ID NO: 1643581 - RNA, 18 nt, Human
gaaaaucuuauaauuuaa

SEQ ID NO: 1643582 - RNA, 22 nt, Human
gaaaacguggcugcuucaagga

SEQ ID NO: 1643583 - RNA, 20 nt, Human
gaaaacguggcugcuucaag

SEQ ID NO: 1643584 - RNA, 24 nt, Human
gaaaacacuguucucugcccucca

SEQ ID NO: 1643585 - RNA, 15 nt, Human
gaaaaguugaauuuu

SEQ ID NO: 1643586 - RNA, 15 nt, Human
gaaaaguuuaauauu

SEQ ID NO: 1643587 - RNA, 14 nt, Human
gaaaaguugaauuu

SEQ ID NO: 1643588 - RNA, 22 nt, Human
gaaaaguuuaauauuaaagcca

SEQ ID NO: 1643589 - RNA, 21 nt, Human
gaaaaguuuaauauuaaagcc

SEQ ID NO: 1643590 - RNA, 20 nt, Human
gaaaaguuuaauauuaaagc

SEQ ID NO: 1643591 - RNA, 19 nt, Human
gaaaaguuuaauauuaaag

SEQ ID NO: 1643592 - RNA, 22 nt, Human
cuuuuuuggcugcugaaggcuc

SEQ ID NO: 1643593 - RNA, 20 nt, Human
cuuuuuuggcugcugaaggc

SEQ ID NO: 1643594 - RNA, 17 nt, Human
cuuuuuuggcugcugaa

SEQ ID NO: 1643595 - RNA, 22 nt, Human
cuuuuuggcauaacauaaaucu

SEQ ID NO: 1643596 - RNA, 20 nt, Human
cuuuuuggcauaacauaaau

SEQ ID NO: 1643597 - RNA, 16 nt, Human
cuuuuuggcauaacau

SEQ ID NO: 1643598 - RNA, 18 nt, Human
gaaaacacuguucucugc

SEQ ID NO: 1643599 - RNA, 19 nt, Human
gaaaacacauuuuucuuag

SEQ ID NO: 1643600 - RNA, 18 nt, Human
gaaaacacauuuuucuua

SEQ ID NO: 1643601 - RNA, 15 nt, Human
gaaaaaggaggaaga

SEQ ID NO: 1643602 - RNA, 12 nt, Human
gaaaaaggagga

SEQ ID NO: 1643603 - RNA, 11 nt, Human
cuuuuguucuu

SEQ ID NO: 1643604 - RNA, 12 nt, Human
cuuuuguucuug

SEQ ID NO: 1643605 - RNA, 15 nt, Human
cuuuguucagccugc

SEQ ID NO: 1643606 - RNA, 18 nt, Human
cuuuguuaguuucuccaa

SEQ ID NO: 1643607 - RNA, 20 nt, Human
cuuuuguucuugguuuguaa

SEQ ID NO: 1643608 - RNA, 17 nt, Human
cuuuuuauggccuguga

SEQ ID NO: 1643609 - RNA, 16 nt, Human
gaaacacaacuauauu

SEQ ID NO: 1643610 - RNA, 19 nt, Human
gaaacccagcucuggucca

SEQ ID NO: 1643611 - RNA, 18 nt, Human
gaaacccagcucuggucc

SEQ ID NO: 1643612 - RNA, 16 nt, Human
gaaacccagcucuggu

SEQ ID NO: 1643613 - RNA, 15 nt, Human
gaaacccagcucugg

SEQ ID NO: 1643614 - RNA, 14 nt, Human
gaaacccagcucug

SEQ ID NO: 1643615 - RNA, 13 nt, Human
gaaacccagcucu

SEQ ID NO: 1643616 - RNA, 14 nt, Human
gaaacccugucucu

SEQ ID NO: 1643617 - RNA, 23 nt, Human
gaaacccagcucugguccauaga

SEQ ID NO: 1643618 - RNA, 23 nt, Human
gaaacucguuaauuuguaguguu

SEQ ID NO: 1643619 - RNA, 19 nt, Human
gaaacuaggugcauauuua

SEQ ID NO: 1643620 - RNA, 18 nt, Human
gaaacggaugauuucuau

SEQ ID NO: 1643621 - RNA, 17 nt, Human
gaaacggaugauuucua

SEQ ID NO: 1643622 - RNA, 17 nt, Human
gaaagagaacuuccaga

SEQ ID NO: 1643623 - RNA, 19 nt, Human
gaaagacuuuuccaacccu

SEQ ID NO: 1643624 - RNA, 21 nt, Human
gaaagaggaaugaaguacuca

SEQ ID NO: 1643625 - RNA, 20 nt, Human
gaaagaggcagcuugaaacu

SEQ ID NO: 1643626 - RNA, 17 nt, Human
gaaagcagaacagugau

SEQ ID NO: 1643627 - RNA, 22 nt, Human
gaaagcagaacagugauuacca

SEQ ID NO: 1643628 - RNA, 16 nt, Human
gaaagaguaggaagac

SEQ ID NO: 1643629 - RNA, 15 nt, Human
gaaagaguaggaaga

SEQ ID NO: 1643630 - RNA, 21 nt, Human
gaaagaguacucuuguuuccu

SEQ ID NO: 1643631 - RNA, 14 nt, Human
gaaagcagggacuu

SEQ ID NO: 1643632 - RNA, 22 nt, Human
gaaagcccugagcuuucugcua

SEQ ID NO: 1643633 - RNA, 21 nt, Human
gaaagcccugagcuuucugcu

SEQ ID NO: 1643634 - RNA, 17 nt, Human
gaaagcccugagcuuuc

SEQ ID NO: 1643635 - RNA, 21 nt, Human
gaaagcuugcccuggugccuc

SEQ ID NO: 1643636 - RNA, 17 nt, Human
gaaagcccugugcucca

SEQ ID NO: 1643637 - RNA, 19 nt, Human
cuuuauaauucuacuuuga

SEQ ID NO: 1643638 - RNA, 15 nt, Human
cuuuagcgcccaguu

SEQ ID NO: 1643639 - RNA, 14 nt, Human
cuuuagcgcccagu

SEQ ID NO: 1643640 - RNA, 15 nt, Human
cuuuaugcacaaaau

SEQ ID NO: 1643641 - RNA, 23 nt, Human
cuuuaucuugaauaauguaagac

SEQ ID NO: 1643642 - RNA, 21 nt, Human
cuuuaucuugaauaauguaag

SEQ ID NO: 1643643 - RNA, 18 nt, Human
cuuuaucuugaauaaugu

SEQ ID NO: 1643644 - RNA, 13 nt, Human
cuuuacuauggcc

SEQ ID NO: 1643645 - RNA, 22 nt, Human
cuuuaccuuuuuuauacauaaa

SEQ ID NO: 1643646 - RNA, 22 nt, Human
cuuguuagaucuaguucacucu

SEQ ID NO: 1643647 - RNA, 19 nt, Human
cuugaguuuaaauuguaau

SEQ ID NO: 1643648 - RNA, 23 nt, Human
cuuggggggcugaggugggagga

SEQ ID NO: 1643649 - RNA, 16 nt, Human
cuuguaaauagcucag

SEQ ID NO: 1643650 - RNA, 21 nt, Human
cuuguaaauagcucagguguc

SEQ ID NO: 1643651 - RNA, 22 nt, Human
cuuguacauaaugcgugcauac

SEQ ID NO: 1643652 - RNA, 19 nt, Human
cuuguacauaaugcgugca

SEQ ID NO: 1643653 - RNA, 21 nt, Human
cuuguacauaaugcgugcaua

SEQ ID NO: 1643654 - RNA, 18 nt, Human
cuuguaaauagcucaggu

SEQ ID NO: 1643655 - RNA, 17 nt, Human
cuuguaaauagcucagg

SEQ ID NO: 1643656 - RNA, 15 nt, Human
cuuguacauaaugcg

SEQ ID NO: 1643657 - RNA, 12 nt, Human
cuuguacauaau

SEQ ID NO: 1643658 - RNA, 23 nt, Human
cuugucaauaaaauccauacauu

SEQ ID NO: 1643659 - RNA, 17 nt, Human
cuuguacuuuauuuucu

SEQ ID NO: 1643660 - RNA, 12 nt, Human
cuuguguaaaua

SEQ ID NO: 1643661 - RNA, 21 nt, Human
cuuguguaaauacaauuuugu

SEQ ID NO: 1643662 - RNA, 16 nt, Human
cuuguguaaauacaau

SEQ ID NO: 1643663 - RNA, 14 nt, Human
cuuguguaaauaca

SEQ ID NO: 1643664 - RNA, 16 nt, Human
cuuucucuuucguuac

SEQ ID NO: 1643665 - RNA, 15 nt, Human
cuuuccugaggcugg

SEQ ID NO: 1643666 - RNA, 13 nt, Human
cuuuccugaggcu

SEQ ID NO: 1643667 - RNA, 17 nt, Human
cuuucuggcuaugcauu

SEQ ID NO: 1643668 - RNA, 18 nt, Human
cuuucuggcuaugcauuu

SEQ ID NO: 1643669 - RNA, 19 nt, Human
cuuucuggcuaugcauuug

SEQ ID NO: 1643670 - RNA, 20 nt, Human
cuuucuggcuaugcauuuga

SEQ ID NO: 1643671 - RNA, 20 nt, Human
cuuucugggcaccggggccu

SEQ ID NO: 1643672 - RNA, 11 nt, Human
cuuucuuccuc

SEQ ID NO: 1643673 - RNA, 16 nt, Human
cuuucccucccuuccu

SEQ ID NO: 1643674 - RNA, 14 nt, Human
cuuucccucccuuc

SEQ ID NO: 1643675 - RNA, 13 nt, Human
cuuucccucccuu

SEQ ID NO: 1643676 - RNA, 11 nt, Human
cuuucccuccc

SEQ ID NO: 1643677 - RNA, 12 nt, Human
cuuuccugaggc

SEQ ID NO: 1643678 - RNA, 15 nt, Human
cuuuccaucuacccu

SEQ ID NO: 1643679 - RNA, 14 nt, Human
cuuugaccucugca

SEQ ID NO: 1643680 - RNA, 15 nt, Human
cuuugaccucugcag

SEQ ID NO: 1643681 - RNA, 15 nt, Human
cuuucuuccucugcu

SEQ ID NO: 1643682 - RNA, 14 nt, Human
cuuucuuccucugc

SEQ ID NO: 1643683 - RNA, 13 nt, Human
cuuucuuccucug

SEQ ID NO: 1643684 - RNA, 12 nt, Human
cuuucuuccucu

SEQ ID NO: 1643685 - RNA, 17 nt, Human
cuuugaccucugcagca

SEQ ID NO: 1643686 - RNA, 18 nt, Human
cuuugaccucugcagcaa

SEQ ID NO: 1643687 - RNA, 20 nt, Human
cuuugaccucugcagcaaua

SEQ ID NO: 1643688 - RNA, 24 nt, Human
cuuugaccucugcagcaauaaagc

SEQ ID NO: 1643689 - RNA, 20 nt, Human
cuuugcagacaggcaagcac

SEQ ID NO: 1643690 - RNA, 22 nt, Human
cuuugcauaacguauaaaagcc

SEQ ID NO: 1643691 - RNA, 15 nt, Human
cuuuguccccaccgc

SEQ ID NO: 1643692 - RNA, 20 nt, Human
cuuugucuacaccauuaugu

SEQ ID NO: 1643693 - RNA, 23 nt, Human
cuuugucuacaccauuaugugcg

SEQ ID NO: 1643694 - RNA, 15 nt, Human
cuuugugaggaagcc

SEQ ID NO: 1643695 - RNA, 19 nt, Human
cuuugugaggaagccgcug

SEQ ID NO: 1643696 - RNA, 22 nt, Human
cuuugugcugggguuaucugaa

SEQ ID NO: 1643697 - RNA, 20 nt, Human
cuuugugcugggguuaucug

SEQ ID NO: 1643698 - RNA, 15 nt, Human
cuuugugcugggguu

SEQ ID NO: 1643699 - RNA, 19 nt, Human
cuuuggcuauuagagauca

SEQ ID NO: 1643700 - RNA, 14 nt, Human
cuuuguccccaccg

SEQ ID NO: 1643701 - RNA, 17 nt, Human
cuucccuacaguugaaa

SEQ ID NO: 1643702 - RNA, 23 nt, Human
cuucccgcucagcccucccugcc

SEQ ID NO: 1643703 - RNA, 19 nt, Human
cuucccgcucagcccuccc

SEQ ID NO: 1643704 - RNA, 19 nt, Human
cuuccuaauuccacagcug

SEQ ID NO: 1643705 - RNA, 18 nt, Human
cuuccuaauuccacagcu

SEQ ID NO: 1643706 - RNA, 17 nt, Human
cuuccuaauuccacagc

SEQ ID NO: 1643707 - RNA, 13 nt, Human
cuuccuaauucca

SEQ ID NO: 1643708 - RNA, 13 nt, Human
cuuccucccucau

SEQ ID NO: 1643709 - RNA, 21 nt, Human
cuuccaggggugggacacccu

SEQ ID NO: 1643710 - RNA, 17 nt, Human
cuuccaggggugggaca

SEQ ID NO: 1643711 - RNA, 15 nt, Human
cuuccagggguggga

SEQ ID NO: 1643712 - RNA, 14 nt, Human
cuuccagggguggg

SEQ ID NO: 1643713 - RNA, 19 nt, Human
cuuccaggcugggagagcc

SEQ ID NO: 1643714 - RNA, 16 nt, Human
cuuccaggcugggaga

SEQ ID NO: 1643715 - RNA, 15 nt, Human
cuuccaggcugggag

SEQ ID NO: 1643716 - RNA, 16 nt, Human
cuucaguggcagcugc

SEQ ID NO: 1643717 - RNA, 15 nt, Human
cuucaguggcagcug

SEQ ID NO: 1643718 - RNA, 14 nt, Human
cuucaguggcagcu

SEQ ID NO: 1643719 - RNA, 13 nt, Human
cuucaguggcagc

SEQ ID NO: 1643720 - RNA, 22 nt, Human
cuucagugccuuauggaacacu

SEQ ID NO: 1643721 - RNA, 18 nt, Human
cuucagugccuuauggaa

SEQ ID NO: 1643722 - RNA, 23 nt, Human
cuucaguaagccgugauuuucau

SEQ ID NO: 1643723 - RNA, 16 nt, Human
cuucaguaagccguga

SEQ ID NO: 1643724 - RNA, 15 nt, Human
cuucagggagugagg

SEQ ID NO: 1643725 - RNA, 22 nt, Human
cuucaggcucuucuccuuucac

SEQ ID NO: 1643726 - RNA, 19 nt, Human
cuucaggcucuucuccuuu

SEQ ID NO: 1643727 - RNA, 21 nt, Human
cuuccacaagagcccaggccu

SEQ ID NO: 1643728 - RNA, 19 nt, Human
cuuccacaagagcccaggc

SEQ ID NO: 1643729 - RNA, 17 nt, Human
cuuccacaagagcccag

SEQ ID NO: 1643730 - RNA, 17 nt, Human
cuucaguggcagcugcu

SEQ ID NO: 1643731 - RNA, 14 nt, Human
cuuccaggcuggga

SEQ ID NO: 1643732 - RNA, 12 nt, Human
cuuccaggcugg

SEQ ID NO: 1643733 - RNA, 22 nt, Human
cuuccacaagagcccaggccuc

SEQ ID NO: 1643734 - RNA, 15 nt, Human
cuuauuucauuucuu

SEQ ID NO: 1643735 - RNA, 15 nt, Human
cuucaaauauuuccc

SEQ ID NO: 1643736 - RNA, 17 nt, Human
cuucaaagcaaaugucu

SEQ ID NO: 1643737 - RNA, 14 nt, Human
cuuauuucauuucu

SEQ ID NO: 1643738 - RNA, 18 nt, Human
cuuauuuaaugaaagacu

SEQ ID NO: 1643739 - RNA, 17 nt, Human
cuuauuuaaugaaagac

SEQ ID NO: 1643740 - RNA, 23 nt, Human
cuucacagaugggugcuuggagg

SEQ ID NO: 1643741 - RNA, 16 nt, Human
cuucaaggauccugag

SEQ ID NO: 1643742 - RNA, 15 nt, Human
cuucaaggauccuga

SEQ ID NO: 1643743 - RNA, 13 nt, Human
cuucaaggauccu

SEQ ID NO: 1643744 - RNA, 10 nt, Human
cuucaaggau

SEQ ID NO: 1643745 - RNA, 16 nt, Human
cuucaacucccugccc

SEQ ID NO: 1643746 - RNA, 20 nt, Human
cuucaaccauuccccauggg

SEQ ID NO: 1643747 - RNA, 16 nt, Human
cuucaaccauucccca

SEQ ID NO: 1643748 - RNA, 22 nt, Human
cuuagaugcaguucugaagaag

SEQ ID NO: 1643749 - RNA, 13 nt, Human
cuuagauguauau

SEQ ID NO: 1643750 - RNA, 16 nt, Human
cuuagucacugagaca

SEQ ID NO: 1643751 - RNA, 19 nt, Human
cuuagauguauauauuucc

SEQ ID NO: 1643752 - RNA, 16 nt, Human
cuguucuggcagaguu

SEQ ID NO: 1643753 - RNA, 16 nt, Human
cuguucugcacacagc

SEQ ID NO: 1643754 - RNA, 19 nt, Human
cuuagucacugagacagcc

SEQ ID NO: 1643755 - RNA, 18 nt, Human
cuuagucacugagacagc

SEQ ID NO: 1643756 - RNA, 20 nt, Human
cuuagucacugagacagccc

SEQ ID NO: 1643757 - RNA, 19 nt, Human
cuuauaggaauugacccac

SEQ ID NO: 1643758 - RNA, 14 nt, Human
cuuauagacaacau

SEQ ID NO: 1643759 - RNA, 19 nt, Human
cuuauaucuauauuuuaca

SEQ ID NO: 1643760 - RNA, 13 nt, Human
cuuauauuaugga

SEQ ID NO: 1643761 - RNA, 13 nt, Human
cuucuguggcuca

SEQ ID NO: 1643762 - RNA, 21 nt, Human
cuucuguggguuucuaaagcu

SEQ ID NO: 1643763 - RNA, 14 nt, Human
cuucuguggguuuc

SEQ ID NO: 1643764 - RNA, 13 nt, Human
cuucuguggguuu

SEQ ID NO: 1643765 - RNA, 22 nt, Human
cuucuguggcucacagaacccu

SEQ ID NO: 1643766 - RNA, 15 nt, Human
cuucuguggcucaca

SEQ ID NO: 1643767 - RNA, 15 nt, Human
cuucuguugcugccu

SEQ ID NO: 1643768 - RNA, 18 nt, Human
cuucuuuaauuuuggaau

SEQ ID NO: 1643769 - RNA, 17 nt, Human
cuucuuuaauuuuggaa

SEQ ID NO: 1643770 - RNA, 16 nt, Human
cuucuuuaauuuugga

SEQ ID NO: 1643771 - RNA, 15 nt, Human
cuucuuuaauuuugg

SEQ ID NO: 1643772 - RNA, 23 nt, Human
cuugaaaacacuguucucugccc

SEQ ID NO: 1643773 - RNA, 14 nt, Human
cuugaaaacacugu

SEQ ID NO: 1643774 - RNA, 22 nt, Human
cuucuuuauaauucuacuuuga

SEQ ID NO: 1643775 - RNA, 19 nt, Human
cuucuuuaauuuuggaauu

SEQ ID NO: 1643776 - RNA, 18 nt, Human
cuugaaaaaugcauguug

SEQ ID NO: 1643777 - RNA, 12 nt, Human
cuugaaaaaugc

SEQ ID NO: 1643778 - RNA, 18 nt, Human
cuugaaaauuaacaugaa

SEQ ID NO: 1643779 - RNA, 13 nt, Human
cuugaaaauuaac

SEQ ID NO: 1643780 - RNA, 12 nt, Human
cuugaaaauuaa

SEQ ID NO: 1643781 - RNA, 13 nt, Human
cuugaacuccugg

SEQ ID NO: 1643782 - RNA, 16 nt, Human
cuugaacuccugaccu

SEQ ID NO: 1643783 - RNA, 13 nt, Human
cuugaacuccuga

SEQ ID NO: 1643784 - RNA, 17 nt, Human
cuugaacuuugaccucu

SEQ ID NO: 1643785 - RNA, 21 nt, Human
cuugaacuuugaccucugcag

SEQ ID NO: 1643786 - RNA, 18 nt, Human
cuugaacuccugaccuca

SEQ ID NO: 1643787 - RNA, 13 nt, Human
cuugaccucaggu

SEQ ID NO: 1643788 - RNA, 21 nt, Human
cuugaccgugaggccagagac

SEQ ID NO: 1643789 - RNA, 20 nt, Human
cuugaccgugaggccagaga

SEQ ID NO: 1643790 - RNA, 18 nt, Human
cuugaccgugaggccaga

SEQ ID NO: 1643791 - RNA, 23 nt, Human
cuugaccauucuccaccugccag

SEQ ID NO: 1643792 - RNA, 22 nt, Human
cuugaccauucuccaccugcca

SEQ ID NO: 1643793 - RNA, 17 nt, Human
cuugaccgugaggccag

SEQ ID NO: 1643794 - RNA, 16 nt, Human
cuugaagacuuuucuu

SEQ ID NO: 1643795 - RNA, 20 nt, Human
cuugaggguugggcuggugu

SEQ ID NO: 1643796 - RNA, 19 nt, Human
cuugaggguugggcuggug

SEQ ID NO: 1643797 - RNA, 21 nt, Human
cuugaggguugggcugguguc

SEQ ID NO: 1643798 - RNA, 15 nt, Human
cuugagccuugaacu

SEQ ID NO: 1643799 - RNA, 17 nt, Human
cuugagccuugaacuuu

SEQ ID NO: 1643800 - RNA, 18 nt, Human
cuugagccuugaacuuug

SEQ ID NO: 1643801 - RNA, 22 nt, Human
cuucugucuucacaacagauua

SEQ ID NO: 1643802 - RNA, 21 nt, Human
cuucugucuucacaacagauu

SEQ ID NO: 1643803 - RNA, 18 nt, Human
cuucugucuucacaacag

SEQ ID NO: 1643804 - RNA, 21 nt, Human
cuucuguccuacucuguguca

SEQ ID NO: 1643805 - RNA, 19 nt, Human
cuucuguccuacucugugu

SEQ ID NO: 1643806 - RNA, 18 nt, Human
cuucuguccuacucugug

SEQ ID NO: 1643807 - RNA, 17 nt, Human
cuucuguccuacucugu

SEQ ID NO: 1643808 - RNA, 16 nt, Human
cuucuguccuacucug

SEQ ID NO: 1643809 - RNA, 20 nt, Human
cuucuguacgucugacaggc

SEQ ID NO: 1643810 - RNA, 18 nt, Human
cuucuguacgucugacag

SEQ ID NO: 1643811 - RNA, 15 nt, Human
cuucuguacgucuga

SEQ ID NO: 1643812 - RNA, 14 nt, Human
cuucuguacgucug

SEQ ID NO: 1643813 - RNA, 21 nt, Human
cuucuguacgucugacaggca

SEQ ID NO: 1643814 - RNA, 13 nt, Human
cuucugcuucagc

SEQ ID NO: 1643815 - RNA, 23 nt, Human
cuucuggguuccuuccucugagc

SEQ ID NO: 1643816 - RNA, 17 nt, Human
cuucuggguuccuuccu

SEQ ID NO: 1643817 - RNA, 16 nt, Human
cuucuggguuccuucc

SEQ ID NO: 1643818 - RNA, 14 nt, Human
cuucugguugaugc

SEQ ID NO: 1643819 - RNA, 20 nt, Human
cuucuccacuuucuagccag

SEQ ID NO: 1643820 - RNA, 11 nt, Human
cuucuccacuu

SEQ ID NO: 1643821 - RNA, 13 nt, Human
cuucuccacugga

SEQ ID NO: 1643822 - RNA, 15 nt, Human
cuucuccacuggaug

SEQ ID NO: 1643823 - RNA, 14 nt, Human
cuucuccacuggau

SEQ ID NO: 1643824 - RNA, 15 nt, Human
cuuccucccucauuc

SEQ ID NO: 1643825 - RNA, 14 nt, Human
cuucuccaggcugu

SEQ ID NO: 1643826 - RNA, 13 nt, Human
cuucuccaggcug

SEQ ID NO: 1643827 - RNA, 12 nt, Human
cuucuccaggcu

SEQ ID NO: 1643828 - RNA, 17 nt, Human
cuucuccacuggaugga

SEQ ID NO: 1643829 - RNA, 19 nt, Human
cuucucuccagccccugga

SEQ ID NO: 1643830 - RNA, 17 nt, Human
cuucucuccagccccug

SEQ ID NO: 1643831 - RNA, 15 nt, Human
cuucucuccagcccc

SEQ ID NO: 1643832 - RNA, 13 nt, Human
cuucucuccagcc

SEQ ID NO: 1643833 - RNA, 19 nt, Human
cuucuccuucaccuuuguc

SEQ ID NO: 1643834 - RNA, 13 nt, Human
cuucucugaagga

SEQ ID NO: 1643835 - RNA, 20 nt, Human
cuguuaaaagaugaaaauau

SEQ ID NO: 1643836 - RNA, 23 nt, Human
cuguuaaaagaugaaaauauuug

SEQ ID NO: 1643837 - RNA, 21 nt, Human
cuguuaaaagaugaaaauauu

SEQ ID NO: 1643838 - RNA, 20 nt, Human
cugugugugcgccuacagga

SEQ ID NO: 1643839 - RNA, 23 nt, Human
cugugucuugcaauggcagccuu

SEQ ID NO: 1643840 - RNA, 22 nt, Human
cugugucuugcaauggcagccu

SEQ ID NO: 1643841 - RNA, 21 nt, Human
cugugucuugcaauggcagcc

SEQ ID NO: 1643842 - RNA, 23 nt, Human
cugugggcgugagaccugccccu

SEQ ID NO: 1643843 - RNA, 15 nt, Human
cuguguggcagucug

SEQ ID NO: 1643844 - RNA, 23 nt, Human
cugugugcucaggagcccuggga

SEQ ID NO: 1643845 - RNA, 21 nt, Human
cugugugcucaggagcccugg

SEQ ID NO: 1643846 - RNA, 20 nt, Human
cugugugcucaggagcccug

SEQ ID NO: 1643847 - RNA, 16 nt, Human
cugugugcucaggagc

SEQ ID NO: 1643848 - RNA, 19 nt, Human
cugugugcucaggagcccu

SEQ ID NO: 1643849 - RNA, 13 nt, Human
cuguucucugccc

SEQ ID NO: 1643850 - RNA, 17 nt, Human
cuguucucugcccucca

SEQ ID NO: 1643851 - RNA, 16 nt, Human
cuguucucugcccucc

SEQ ID NO: 1643852 - RNA, 15 nt, Human
cuguucucugcccuc

SEQ ID NO: 1643853 - RNA, 14 nt, Human
cuguucucugcccu

SEQ ID NO: 1643854 - RNA, 19 nt, Human
cuguucucugcccuccaag

SEQ ID NO: 1643855 - RNA, 18 nt, Human
cuguucucugcccuccaa

SEQ ID NO: 1643856 - RNA, 20 nt, Human
cuguucucugcccuccaaga

SEQ ID NO: 1643857 - RNA, 21 nt, Human
cuguucagcugguugagguuu

SEQ ID NO: 1643858 - RNA, 19 nt, Human
cuguucagcugguugaggu

SEQ ID NO: 1643859 - RNA, 13 nt, Human
cuguuacugucuu

SEQ ID NO: 1643860 - RNA, 23 nt, Human
cuguucaugaaagauucaaugcc

SEQ ID NO: 1643861 - RNA, 18 nt, Human
cuguucaugaaagauuca

SEQ ID NO: 1643862 - RNA, 17 nt, Human
cuguucaugaaagauuc

SEQ ID NO: 1643863 - RNA, 18 nt, Human
cuguucccauucuugcau

SEQ ID NO: 1643864 - RNA, 18 nt, Human
cugugccaugugccaggu

SEQ ID NO: 1643865 - RNA, 16 nt, Human
cugugccaugugccag

SEQ ID NO: 1643866 - RNA, 14 nt, Human
cugugccauuuugu

SEQ ID NO: 1643867 - RNA, 22 nt, Human
cugugccauuuuguauuuuacu

SEQ ID NO: 1643868 - RNA, 20 nt, Human
cugugauggggcccugccuc

SEQ ID NO: 1643869 - RNA, 19 nt, Human
cugugauggggcccugccu

SEQ ID NO: 1643870 - RNA, 17 nt, Human
cugugauggggcccugc

SEQ ID NO: 1643871 - RNA, 18 nt, Human
cugugauggggcccugcc

SEQ ID NO: 1643872 - RNA, 21 nt, Human
cugugaguacuacaguccucc

SEQ ID NO: 1643873 - RNA, 20 nt, Human
cugugaguacuacaguccuc

SEQ ID NO: 1643874 - RNA, 23 nt, Human
cugugaguacuacaguccuccca

SEQ ID NO: 1643875 - RNA, 23 nt, Human
cugucucaagagggcacuggugg

SEQ ID NO: 1643876 - RNA, 18 nt, Human
cugucuccauguuugaug

SEQ ID NO: 1643877 - RNA, 18 nt, Human
cugugccucugggacugg

SEQ ID NO: 1643878 - RNA, 17 nt, Human
cugugccucugggacug

SEQ ID NO: 1643879 - RNA, 22 nt, Human
cugugcugcccugcccaccugg

SEQ ID NO: 1643880 - RNA, 16 nt, Human
cugugccucugggacu

SEQ ID NO: 1643881 - RNA, 14 nt, Human
cugugccucuggga

SEQ ID NO: 1643882 - RNA, 11 nt, Human
cugugccucug

SEQ ID NO: 1643883 - RNA, 14 nt, Human
cugugggcccccaa

SEQ ID NO: 1643884 - RNA, 22 nt, Human
cugugggcgugagaccugcccc

SEQ ID NO: 1643885 - RNA, 21 nt, Human
cugugggcgugagaccugccc

SEQ ID NO: 1643886 - RNA, 17 nt, Human
cuguggaugauaaaaca

SEQ ID NO: 1643887 - RNA, 20 nt, Human
cuguauuuuaaaagaaugau

SEQ ID NO: 1643888 - RNA, 22 nt, Human
cuguauuuuaaaagaaugauua

SEQ ID NO: 1643889 - RNA, 23 nt, Human
cuguaucccaugagccucagcau

SEQ ID NO: 1643890 - RNA, 14 nt, Human
cuguaucccaugag

SEQ ID NO: 1643891 - RNA, 13 nt, Human
cugucaauuacag

SEQ ID NO: 1643892 - RNA, 17 nt, Human
cuguccaggcacugcug

SEQ ID NO: 1643893 - RNA, 20 nt, Human
cuguauagauuagaauucug

SEQ ID NO: 1643894 - RNA, 16 nt, Human
cuguauagauuagaau

SEQ ID NO: 1643895 - RNA, 13 nt, Human
cuguacagagccc

SEQ ID NO: 1643896 - RNA, 20 nt, Human
cugucccuuacgugaguccu

SEQ ID NO: 1643897 - RNA, 22 nt, Human
cuguccccgcacugggcuuggg

SEQ ID NO: 1643898 - RNA, 19 nt, Human
cuguccccgcacugggcuu

SEQ ID NO: 1643899 - RNA, 18 nt, Human
cuguccccgcacugggcu

SEQ ID NO: 1643900 - RNA, 16 nt, Human
cugucucaaaaaaaga

SEQ ID NO: 1643901 - RNA, 23 nt, Human
cugucucaaaaaaacacaaaagu

SEQ ID NO: 1643902 - RNA, 18 nt, Human
cugucucaaaaaaagaaa

SEQ ID NO: 1643903 - RNA, 22 nt, Human
cugucucaagagggcacuggug

SEQ ID NO: 1643904 - RNA, 15 nt, Human
cuguccgagcuuuga

SEQ ID NO: 1643905 - RNA, 22 nt, Human
cugucccuuacgugaguccugg

SEQ ID NO: 1643906 - RNA, 14 nt, Human
cuguccuacccacc

SEQ ID NO: 1643907 - RNA, 20 nt, Human
cugucuacacuaagagagaa

SEQ ID NO: 1643908 - RNA, 23 nt, Human
cuguaaucacagcuacuugggag

SEQ ID NO: 1643909 - RNA, 13 nt, Human
cugguuccucccc

SEQ ID NO: 1643910 - RNA, 12 nt, Human
cugguuccuccc

SEQ ID NO: 1643911 - RNA, 15 nt, Human
cuguacaaaguagaa

SEQ ID NO: 1643912 - RNA, 13 nt, Human
cuguacaaaguag

SEQ ID NO: 1643913 - RNA, 20 nt, Human
cuguaauccuagcacuuugg

SEQ ID NO: 1643914 - RNA, 19 nt, Human
cuggucacaggacucugcc

SEQ ID NO: 1643915 - RNA, 18 nt, Human
cuggucacaggacucugc

SEQ ID NO: 1643916 - RNA, 14 nt, Human
cugguggcagcugc

SEQ ID NO: 1643917 - RNA, 13 nt, Human
cugguggcagcug

SEQ ID NO: 1643918 - RNA, 23 nt, Human
cugguggcccgacagccuggcac

SEQ ID NO: 1643919 - RNA, 22 nt, Human
cugguggcccgacagccuggca

SEQ ID NO: 1643920 - RNA, 21 nt, Human
cugguggcccgacagccuggc

SEQ ID NO: 1643921 - RNA, 23 nt, Human
cugguggcagcucaccucucccu

SEQ ID NO: 1643922 - RNA, 22 nt, Human
cuggugcugccacacuucaggc

SEQ ID NO: 1643923 - RNA, 20 nt, Human
cuggugcugccacacuucag

SEQ ID NO: 1643924 - RNA, 13 nt, Human
cuggugcugccac

SEQ ID NO: 1643925 - RNA, 12 nt, Human
cuggugcugcca

SEQ ID NO: 1643926 - RNA, 22 nt, Human
cugggggggauuguaaaauggu

SEQ ID NO: 1643927 - RNA, 19 nt, Human
cugggggcugggcagagga

SEQ ID NO: 1643928 - RNA, 15 nt, Human
cugggggaagaagcu

SEQ ID NO: 1643929 - RNA, 13 nt, Human
cugggggaagaag

SEQ ID NO: 1643930 - RNA, 24 nt, Human
cugggcuucaguggcagcugcuuu

SEQ ID NO: 1643931 - RNA, 17 nt, Human
cuggguucuacccaggu

SEQ ID NO: 1643932 - RNA, 16 nt, Human
cuggguucuacccagg

SEQ ID NO: 1643933 - RNA, 15 nt, Human
cuggguucuacccag

SEQ ID NO: 1643934 - RNA, 14 nt, Human
cuggguacuugugg

SEQ ID NO: 1643935 - RNA, 19 nt, Human
cuggguucuacccaggugc

SEQ ID NO: 1643936 - RNA, 22 nt, Human
cuggguaacuagggaagauaau

SEQ ID NO: 1643937 - RNA, 14 nt, Human
cugccuccccuccu

SEQ ID NO: 1643938 - RNA, 15 nt, Human
cugccucuucucuac

SEQ ID NO: 1643939 - RNA, 17 nt, Human
cugccugcccaggcccc

SEQ ID NO: 1643940 - RNA, 16 nt, Human
cugccugcccaggccc

SEQ ID NO: 1643941 - RNA, 15 nt, Human
cugccugaagucaca

SEQ ID NO: 1643942 - RNA, 20 nt, Human
cugccugcccaggccccugc

SEQ ID NO: 1643943 - RNA, 22 nt, Human
cugccugggaucccucauccuc

SEQ ID NO: 1643944 - RNA, 21 nt, Human
cugccugggaucccucauccu

SEQ ID NO: 1643945 - RNA, 13 nt, Human
cugccuccccucc

SEQ ID NO: 1643946 - RNA, 21 nt, Human
cugccucucugcaggucccua

SEQ ID NO: 1643947 - RNA, 20 nt, Human
cugccucucugcaggucccu

SEQ ID NO: 1643948 - RNA, 23 nt, Human
cugccucugacacacagcucugu

SEQ ID NO: 1643949 - RNA, 22 nt, Human
cugccucugacacacagcucug

SEQ ID NO: 1643950 - RNA, 15 nt, Human
cugccucugacacac

SEQ ID NO: 1643951 - RNA, 22 nt, Human
cugccucucugcaggucccuaa

SEQ ID NO: 1643952 - RNA, 19 nt, Human
cugccucccaucacccgcu

SEQ ID NO: 1643953 - RNA, 16 nt, Human
cugccucccaucaccc

SEQ ID NO: 1643954 - RNA, 14 nt, Human
cugccucccaucac

SEQ ID NO: 1643955 - RNA, 12 nt, Human
cugccucccauc

SEQ ID NO: 1643956 - RNA, 11 nt, Human
cugccucccau

SEQ ID NO: 1643957 - RNA, 19 nt, Human
cugccuaaggacuucuuua

SEQ ID NO: 1643958 - RNA, 15 nt, Human
cugccuaaggacuuc

SEQ ID NO: 1643959 - RNA, 14 nt, Human
cugccuaaggacuu

SEQ ID NO: 1643960 - RNA, 13 nt, Human
cugccuaaggacu

SEQ ID NO: 1643961 - RNA, 12 nt, Human
cugccuaaggac

SEQ ID NO: 1643962 - RNA, 16 nt, Human
cugcccucuccugggc

SEQ ID NO: 1643963 - RNA, 19 nt, Human
cugcccuccaagaccuucu

SEQ ID NO: 1643964 - RNA, 18 nt, Human
cugcccucuccugggcag

SEQ ID NO: 1643965 - RNA, 19 nt, Human
cugcccucuccugggcagc

SEQ ID NO: 1643966 - RNA, 20 nt, Human
cugcccucuccugggcagcu

SEQ ID NO: 1643967 - RNA, 21 nt, Human
cugcccucuccugggcagcug

SEQ ID NO: 1643968 - RNA, 20 nt, Human
cugcccugcgggucacagga

SEQ ID NO: 1643969 - RNA, 22 nt, Human
cugcccugcugagucccaggcu

SEQ ID NO: 1643970 - RNA, 17 nt, Human
cucccuucccaccucuc

SEQ ID NO: 1643971 - RNA, 16 nt, Human
cucccuucccaccucu

SEQ ID NO: 1643972 - RNA, 15 nt, Human
cucccuucccaccuc

SEQ ID NO: 1643973 - RNA, 14 nt, Human
cucccuucccaccu

SEQ ID NO: 1643974 - RNA, 12 nt, Human
cugcccuccaag

SEQ ID NO: 1643975 - RNA, 23 nt, Human
cucccuucccaccucucucacuc

SEQ ID NO: 1643976 - RNA, 18 nt, Human
cugccgcagcccugcaga

SEQ ID NO: 1643977 - RNA, 17 nt, Human
cugccgcagcccugcag

SEQ ID NO: 1643978 - RNA, 15 nt, Human
cugccgcagcccugc

SEQ ID NO: 1643979 - RNA, 21 nt, Human
cugcccuuucugggcaccggg

SEQ ID NO: 1643980 - RNA, 20 nt, Human
cugcuccagcuguucagcug

SEQ ID NO: 1643981 - RNA, 19 nt, Human
cugcuccagcuguucagcu

SEQ ID NO: 1643982 - RNA, 19 nt, Human
cugcgaccacaagaaggau

SEQ ID NO: 1643983 - RNA, 20 nt, Human
cugcucuccucuugccacug

SEQ ID NO: 1643984 - RNA, 14 nt, Human
cugcucuccucuug

SEQ ID NO: 1643985 - RNA, 12 nt, Human
cugcugaaggcu

SEQ ID NO: 1643986 - RNA, 11 nt, Human
cugcugaaggc

SEQ ID NO: 1643987 - RNA, 21 nt, Human
cugcucuccucuugccacugc

SEQ ID NO: 1643988 - RNA, 18 nt, Human
cugcugaaggaauaaauu

SEQ ID NO: 1643989 - RNA, 17 nt, Human
cugcugaaggaauaaau

SEQ ID NO: 1643990 - RNA, 22 nt, Human
cugcugcccagccuccaagcuc

SEQ ID NO: 1643991 - RNA, 15 nt, Human
cugcugcccagccuc

SEQ ID NO: 1643992 - RNA, 12 nt, Human
cugcugcccagc

SEQ ID NO: 1643993 - RNA, 23 nt, Human
cugcuuccagugaggcucugccc

SEQ ID NO: 1643994 - RNA, 21 nt, Human
cugcuuccagugaggcucugc

SEQ ID NO: 1643995 - RNA, 20 nt, Human
cugcuuccagugaggcucug

SEQ ID NO: 1643996 - RNA, 19 nt, Human
cugcuuccagugaggcucu

SEQ ID NO: 1643997 - RNA, 18 nt, Human
cugcuuccagugaggcuc

SEQ ID NO: 1643998 - RNA, 16 nt, Human
cugcuuccagugaggc

SEQ ID NO: 1643999 - RNA, 15 nt, Human
cugcuuccagugagg

SEQ ID NO: 1644000 - RNA, 23 nt, Human
cugcugguucaggguuggccccu

SEQ ID NO: 1644001 - RNA, 15 nt, Human
cugcugguucagggu

SEQ ID NO: 1644002 - RNA, 13 nt, Human
cugcugguucagg

SEQ ID NO: 1644003 - RNA, 12 nt, Human
cugcuggcugcc

SEQ ID NO: 1644004 - RNA, 15 nt, Human
cugcugcuggcuggu

SEQ ID NO: 1644005 - RNA, 13 nt, Human
cuggagcucugcc

SEQ ID NO: 1644006 - RNA, 12 nt, Human
cuggagcucugc

SEQ ID NO: 1644007 - RNA, 16 nt, Human
cuggagcucugcccau

SEQ ID NO: 1644008 - RNA, 17 nt, Human
cuggagugcagugagcc

SEQ ID NO: 1644009 - RNA, 16 nt, Human
cuggagugcagugagc

SEQ ID NO: 1644010 - RNA, 15 nt, Human
cuggagugcagugag

SEQ ID NO: 1644011 - RNA, 14 nt, Human
cuggagugcaguga

SEQ ID NO: 1644012 - RNA, 22 nt, Human
cuggagguacgaaaagagggga

SEQ ID NO: 1644013 - RNA, 17 nt, Human
cuggagguacgaaaaga

SEQ ID NO: 1644014 - RNA, 21 nt, Human
cuggaccuugaacuggguacu

SEQ ID NO: 1644015 - RNA, 20 nt, Human
cuggaccuugaacuggguac

SEQ ID NO: 1644016 - RNA, 17 nt, Human
cuggaccuugaacuggg

SEQ ID NO: 1644017 - RNA, 20 nt, Human
cuggacuccucuguccaggc

SEQ ID NO: 1644018 - RNA, 19 nt, Human
cuggacuccucuguccagg

SEQ ID NO: 1644019 - RNA, 18 nt, Human
cuggacuccucuguccag

SEQ ID NO: 1644020 - RNA, 17 nt, Human
cuggacuccucugucca

SEQ ID NO: 1644021 - RNA, 14 nt, Human
cuggacuccucugu

SEQ ID NO: 1644022 - RNA, 15 nt, Human
cuggacccuguggau

SEQ ID NO: 1644023 - RNA, 16 nt, Human
cuggaccuugaacugg

SEQ ID NO: 1644024 - RNA, 17 nt, Human
cuggacaggcauguucu

SEQ ID NO: 1644025 - RNA, 14 nt, Human
cuggacaggcaugu

SEQ ID NO: 1644026 - RNA, 23 nt, Human
cuggacaggcauguucucugagg

SEQ ID NO: 1644027 - RNA, 13 nt, Human
cuggaauuugaaa

SEQ ID NO: 1644028 - RNA, 23 nt, Human
cuggccuucggccuccauccuga

SEQ ID NO: 1644029 - RNA, 14 nt, Human
cuggccugugucua

SEQ ID NO: 1644030 - RNA, 15 nt, Human
cuggcgugcaguggu

SEQ ID NO: 1644031 - RNA, 14 nt, Human
cuggcgugcagugg

SEQ ID NO: 1644032 - RNA, 24 nt, Human
cuggcucuuccaggcugggagagc

SEQ ID NO: 1644033 - RNA, 22 nt, Human
cuggcucuuccaggcugggaga

SEQ ID NO: 1644034 - RNA, 21 nt, Human
cuggcucuuccaggcugggag

SEQ ID NO: 1644035 - RNA, 22 nt, Human
cuggccuucggccuccauccug

SEQ ID NO: 1644036 - RNA, 24 nt, Human
cuggccuggccccucagggucccu

SEQ ID NO: 1644037 - RNA, 13 nt, Human
cuggccuggcccc

SEQ ID NO: 1644038 - RNA, 20 nt, Human
cuggccucugcacuccccug

SEQ ID NO: 1644039 - RNA, 18 nt, Human
cuggccucugcacucccc

SEQ ID NO: 1644040 - RNA, 21 nt, Human
cuggccucugcacuccccugc

SEQ ID NO: 1644041 - RNA, 22 nt, Human
cuggcacaguuuucugagaaag

SEQ ID NO: 1644042 - RNA, 21 nt, Human
cuggcacaguuuucugagaaa

SEQ ID NO: 1644043 - RNA, 20 nt, Human
cuggagugcagugagccgag

SEQ ID NO: 1644044 - RNA, 21 nt, Human
cuggcacccggccccugcugg

SEQ ID NO: 1644045 - RNA, 20 nt, Human
cuggcacccggccccugcug

SEQ ID NO: 1644046 - RNA, 23 nt, Human
cuggcacugcuuccagugaggcu

SEQ ID NO: 1644047 - RNA, 20 nt, Human
cuggcacugcuuccagugag

SEQ ID NO: 1644048 - RNA, 19 nt, Human
cuggcacugcuuccaguga

SEQ ID NO: 1644049 - RNA, 22 nt, Human
cuggcacccggccccugcuggu

SEQ ID NO: 1644050 - RNA, 21 nt, Human
cuggcacuuggagacuuguau

SEQ ID NO: 1644051 - RNA, 14 nt, Human
cuggcacuuggaga

SEQ ID NO: 1644052 - RNA, 15 nt, Human
cuggcccacugcauc

SEQ ID NO: 1644053 - RNA, 14 nt, Human
cuggccagaugcac

SEQ ID NO: 1644054 - RNA, 21 nt, Human
gagaguggcuccucccggugc

SEQ ID NO: 1644055 - RNA, 16 nt, Human
gagaguggcuccuccc

SEQ ID NO: 1644056 - RNA, 13 nt, Human
gagaguguugaaa

SEQ ID NO: 1644057 - RNA, 16 nt, Human
gagagggugggagugg

SEQ ID NO: 1644058 - RNA, 20 nt, Human
gagagggugggagugggccc

SEQ ID NO: 1644059 - RNA, 14 nt, Human
gagagggugggagu

SEQ ID NO: 1644060 - RNA, 19 nt, Human
gagaggggaacagacugga

SEQ ID NO: 1644061 - RNA, 13 nt, Human
gagaggggcacag

SEQ ID NO: 1644062 - RNA, 16 nt, Human
gagagcccuucauuug

SEQ ID NO: 1644063 - RNA, 22 nt, Human
gagagagcuucuguugcugccu

SEQ ID NO: 1644064 - RNA, 19 nt, Human
gagagagcuucuguugcug

SEQ ID NO: 1644065 - RNA, 20 nt, Human
gagacagcucugcauacuca

SEQ ID NO: 1644066 - RNA, 21 nt, Human
gagaaugagagacacacugaa

SEQ ID NO: 1644067 - RNA, 20 nt, Human
gagaaugagagacacacuga

SEQ ID NO: 1644068 - RNA, 23 nt, Human
gagaaugcacaaacagaggccgc

SEQ ID NO: 1644069 - RNA, 22 nt, Human
gagacaggguuuugccauguug

SEQ ID NO: 1644070 - RNA, 21 nt, Human
gagaccaucccugaaggcccc

SEQ ID NO: 1644071 - RNA, 18 nt, Human
gagaccaucccugaaggc

SEQ ID NO: 1644072 - RNA, 14 nt, Human
gagaccaucccuga

SEQ ID NO: 1644073 - RNA, 13 nt, Human
gagacucugucuc

SEQ ID NO: 1644074 - RNA, 22 nt, Human
gagacuccugcaggcagccagg

SEQ ID NO: 1644075 - RNA, 21 nt, Human
gagacucgcgacaaugcaaac

SEQ ID NO: 1644076 - RNA, 20 nt, Human
gagacucgcgacaaugcaaa

SEQ ID NO: 1644077 - RNA, 21 nt, Human
gagacuccugcaggcagccag

SEQ ID NO: 1644078 - RNA, 20 nt, Human
gagacuccugcaggcagcca

SEQ ID NO: 1644079 - RNA, 19 nt, Human
gagacuccugcaggcagcc

SEQ ID NO: 1644080 - RNA, 19 nt, Human
gagccagggucucacuaug

SEQ ID NO: 1644081 - RNA, 23 nt, Human
gagcccacuguacuugcucuuga

SEQ ID NO: 1644082 - RNA, 23 nt, Human
gagccagauuucacucuccuugg

SEQ ID NO: 1644083 - RNA, 14 nt, Human
gagccagggucuca

SEQ ID NO: 1644084 - RNA, 16 nt, Human
gagcagagaauucucu

SEQ ID NO: 1644085 - RNA, 12 nt, Human
gagcagagacca

SEQ ID NO: 1644086 - RNA, 19 nt, Human
gagccaauuuaaagaaaac

SEQ ID NO: 1644087 - RNA, 21 nt, Human
gagcauuagauuucucauuug

SEQ ID NO: 1644088 - RNA, 15 nt, Human
gagcauuagauuucu

SEQ ID NO: 1644089 - RNA, 22 nt, Human
gagcaccuuagacagucccugc

SEQ ID NO: 1644090 - RNA, 21 nt, Human
gagcaccuuagacagucccug

SEQ ID NO: 1644091 - RNA, 15 nt, Human
gagcacuaaggugug

SEQ ID NO: 1644092 - RNA, 21 nt, Human
gagcacuaaggugugcucuga

SEQ ID NO: 1644093 - RNA, 20 nt, Human
gagcaccuuagacagucccu

SEQ ID NO: 1644094 - RNA, 23 nt, Human
gagaucaaccccuucgcuccugu

SEQ ID NO: 1644095 - RNA, 16 nt, Human
gagauagccaaggcca

SEQ ID NO: 1644096 - RNA, 14 nt, Human
gagauagccaaggc

SEQ ID NO: 1644097 - RNA, 19 nt, Human
gagaucacgccacugcacu

SEQ ID NO: 1644098 - RNA, 18 nt, Human
gagaucacgccacugcac

SEQ ID NO: 1644099 - RNA, 19 nt, Human
gagauagccaaggccaaag

SEQ ID NO: 1644100 - RNA, 17 nt, Human
gagaugaggccgccaug

SEQ ID NO: 1644101 - RNA, 15 nt, Human
gacuccaaagaaaug

SEQ ID NO: 1644102 - RNA, 12 nt, Human
gacuccaaagaa

SEQ ID NO: 1644103 - RNA, 11 nt, Human
gacuccaaaga

SEQ ID NO: 1644104 - RNA, 21 nt, Human
gacucauuuuaaaaaauggaa

SEQ ID NO: 1644105 - RNA, 18 nt, Human
gacuccaaagaaauguaa

SEQ ID NO: 1644106 - RNA, 16 nt, Human
gacuccaaagaaaugu

SEQ ID NO: 1644107 - RNA, 13 nt, Human
gacucgcgacaau

SEQ ID NO: 1644108 - RNA, 13 nt, Human
gacuccugcaggc

SEQ ID NO: 1644109 - RNA, 23 nt, Human
gacuccugcacacgcuccuuccu

SEQ ID NO: 1644110 - RNA, 12 nt, Human
gacuccugcagg

SEQ ID NO: 1644111 - RNA, 14 nt, Human
gacuccucugucca

SEQ ID NO: 1644112 - RNA, 11 nt, Human
gacuccucugu

SEQ ID NO: 1644113 - RNA, 13 nt, Human
gacuacaggugug

SEQ ID NO: 1644114 - RNA, 21 nt, Human
gacuacaggugugagucacca

SEQ ID NO: 1644115 - RNA, 18 nt, Human
gacuacaggugugaguca

SEQ ID NO: 1644116 - RNA, 15 nt, Human
gacucauucuucugu

SEQ ID NO: 1644117 - RNA, 14 nt, Human
gacucauucuucug

SEQ ID NO: 1644118 - RNA, 16 nt, Human
gacugcauuauauuua

SEQ ID NO: 1644119 - RNA, 14 nt, Human
gacugcauuauauu

SEQ ID NO: 1644120 - RNA, 23 nt, Human
gacugaguacguugugcauuugg

SEQ ID NO: 1644121 - RNA, 13 nt, Human
gacugcccggcag

SEQ ID NO: 1644122 - RNA, 15 nt, Human
gacugcccggcaggg

SEQ ID NO: 1644123 - RNA, 21 nt, Human
gacugaguacguugugcauuu

SEQ ID NO: 1644124 - RNA, 22 nt, Human
gacugaguacguugugcauuug

SEQ ID NO: 1644125 - RNA, 17 nt, Human
gacucgcgacaaugcaa

SEQ ID NO: 1644126 - RNA, 18 nt, Human
gacuggaagcacagcuuc

SEQ ID NO: 1644127 - RNA, 16 nt, Human
gacuggaagcacagcu

SEQ ID NO: 1644128 - RNA, 15 nt, Human
gacuggaagcacagc

SEQ ID NO: 1644129 - RNA, 14 nt, Human
gacuggaagcacag

SEQ ID NO: 1644130 - RNA, 23 nt, Human
gacuucugucuucacaacagauu

SEQ ID NO: 1644131 - RNA, 20 nt, Human
gacuucugucuucacaacag

SEQ ID NO: 1644132 - RNA, 23 nt, Human
gacuucuaaguaaaaccacagca

SEQ ID NO: 1644133 - RNA, 19 nt, Human
gacuucuaaguaaaaccac

SEQ ID NO: 1644134 - RNA, 24 nt, Human
gacuucuaaguaaaaccacagcag

SEQ ID NO: 1644135 - RNA, 18 nt, Human
gacuucuaaguaaaacca

SEQ ID NO: 1644136 - RNA, 17 nt, Human
gacuucuaaguaaaacc

SEQ ID NO: 1644137 - RNA, 16 nt, Human
gacuucuaaguaaaac

SEQ ID NO: 1644138 - RNA, 19 nt, Human
gacuuaagcacacuugaca

SEQ ID NO: 1644139 - RNA, 19 nt, Human
gacuuaaaauauuccugca

SEQ ID NO: 1644140 - RNA, 21 nt, Human
gacuucuuuaauuuuggaauu

SEQ ID NO: 1644141 - RNA, 20 nt, Human
gacuucuuuaauuuuggaau

SEQ ID NO: 1644142 - RNA, 19 nt, Human
gacuucuuuaauuuuggaa

SEQ ID NO: 1644143 - RNA, 18 nt, Human
gacuucuuuaauuuugga

SEQ ID NO: 1644144 - RNA, 17 nt, Human
gacuucuuuaauuuugg

SEQ ID NO: 1644145 - RNA, 16 nt, Human
gacuucuuuaauuuug

SEQ ID NO: 1644146 - RNA, 13 nt, Human
gacuuggaagcuc

SEQ ID NO: 1644147 - RNA, 22 nt, Human
gagaaccuagggugauauuaac

SEQ ID NO: 1644148 - RNA, 21 nt, Human
gagaaccuagggugauauuaa

SEQ ID NO: 1644149 - RNA, 14 nt, Human
gagaaauuuauaaa

SEQ ID NO: 1644150 - RNA, 14 nt, Human
gagaaaugagcuug

SEQ ID NO: 1644151 - RNA, 21 nt, Human
gagaaaugaaaaaauauauau

SEQ ID NO: 1644152 - RNA, 16 nt, Human
gagaaagguugaagca

SEQ ID NO: 1644153 - RNA, 22 nt, Human
gagaaaguacuucuccacccug

SEQ ID NO: 1644154 - RNA, 23 nt, Human
gagaacuuccagauccuggaaau

SEQ ID NO: 1644155 - RNA, 22 nt, Human
gagaacuuccagauccuggaaa

SEQ ID NO: 1644156 - RNA, 14 nt, Human
gagaagagaaugca

SEQ ID NO: 1644157 - RNA, 13 nt, Human
gagaagagcuguu

SEQ ID NO: 1644158 - RNA, 16 nt, Human
gagaagcagaggaagg

SEQ ID NO: 1644159 - RNA, 16 nt, Human
gagaagagaaugcaca

SEQ ID NO: 1644160 - RNA, 17 nt, Human
gagaaugagagacacac

SEQ ID NO: 1644161 - RNA, 21 nt, Human
gaauugacccacaagaaauga

SEQ ID NO: 1644162 - RNA, 16 nt, Human
gaauugacccacaaga

SEQ ID NO: 1644163 - RNA, 16 nt, Human
gaauuggagcucgugg

SEQ ID NO: 1644164 - RNA, 15 nt, Human
gaauguuugccucug

SEQ ID NO: 1644165 - RNA, 13 nt, Human
gaauucuguauag

SEQ ID NO: 1644166 - RNA, 22 nt, Human
gaauucuguauagauuagaauu

SEQ ID NO: 1644167 - RNA, 21 nt, Human
gaauucuguauagauuagaau

SEQ ID NO: 1644168 - RNA, 14 nt, Human
gaauucuguauaga

SEQ ID NO: 1644169 - RNA, 13 nt, Human
gaaugucagugug

SEQ ID NO: 1644170 - RNA, 16 nt, Human
gaauggcuuuguauag

SEQ ID NO: 1644171 - RNA, 14 nt, Human
gaauggcuuuguau

SEQ ID NO: 1644172 - RNA, 21 nt, Human
gaauggcuuuguauagaaccu

SEQ ID NO: 1644173 - RNA, 17 nt, Human
gaauggcuuuguauaga

SEQ ID NO: 1644174 - RNA, 20 nt, Human
gaaugcacaaacagaggccg

SEQ ID NO: 1644175 - RNA, 15 nt, Human
gaaugcuguauaugu

SEQ ID NO: 1644176 - RNA, 21 nt, Human
gaaugcacaaacagaggccgc

SEQ ID NO: 1644177 - RNA, 18 nt, Human
gaaugaaccacaucuugc

SEQ ID NO: 1644178 - RNA, 11 nt, Human
gaaugcagugg

SEQ ID NO: 1644179 - RNA, 20 nt, Human
gaauccagacccggcugcgu

SEQ ID NO: 1644180 - RNA, 12 nt, Human
gaaaggcuccag

SEQ ID NO: 1644181 - RNA, 22 nt, Human
gacacaagccuucggcgccuua

SEQ ID NO: 1644182 - RNA, 19 nt, Human
gacacaggcccggcuccag

SEQ ID NO: 1644183 - RNA, 16 nt, Human
gacacaagccuucggc

SEQ ID NO: 1644184 - RNA, 21 nt, Human
gacacaggcccggcuccaggc

SEQ ID NO: 1644185 - RNA, 20 nt, Human
gacacaggcccggcuccagg

SEQ ID NO: 1644186 - RNA, 14 nt, Human
gacacaugcaaggu

SEQ ID NO: 1644187 - RNA, 23 nt, Human
gacacauguccaagaagcccagg

SEQ ID NO: 1644188 - RNA, 20 nt, Human
gacacauguccaagaagccc

SEQ ID NO: 1644189 - RNA, 15 nt, Human
gacacauguccaaga

SEQ ID NO: 1644190 - RNA, 19 nt, Human
gacacaugcaaggucauuu

SEQ ID NO: 1644191 - RNA, 16 nt, Human
gacaaggaaaaaauaa

SEQ ID NO: 1644192 - RNA, 21 nt, Human
gacaaggauugcuacuguccu

SEQ ID NO: 1644193 - RNA, 19 nt, Human
gacaaggauugcuacuguc

SEQ ID NO: 1644194 - RNA, 18 nt, Human
gacaaggauugcuacugu

SEQ ID NO: 1644195 - RNA, 21 nt, Human
gacaaggaugaucuaggaaga

SEQ ID NO: 1644196 - RNA, 18 nt, Human
gacaaugugaaaagaaaa

SEQ ID NO: 1644197 - RNA, 12 nt, Human
gacaaugugaaa

SEQ ID NO: 1644198 - RNA, 22 nt, Human
gacaaugcaaaccaucauugaa

SEQ ID NO: 1644199 - RNA, 20 nt, Human
gacaaugugaaaagaaaaau

SEQ ID NO: 1644200 - RNA, 19 nt, Human
gacaaugugaaaagaaaaa

SEQ ID NO: 1644201 - RNA, 23 nt, Human
gacaacacucauugaccugaggc

SEQ ID NO: 1644202 - RNA, 22 nt, Human
gacaacacucauugaccugagg

SEQ ID NO: 1644203 - RNA, 16 nt, Human
gacaacagacuucuga

SEQ ID NO: 1644204 - RNA, 15 nt, Human
gaauuguaaggaaug

SEQ ID NO: 1644205 - RNA, 20 nt, Human
gaauuucuaggacugaauua

SEQ ID NO: 1644206 - RNA, 19 nt, Human
gaauuucuaggacugaauu

SEQ ID NO: 1644207 - RNA, 22 nt, Human
gaauuucuuuugccguuauuaa

SEQ ID NO: 1644208 - RNA, 21 nt, Human
gaauuucuucaacucccugcc

SEQ ID NO: 1644209 - RNA, 20 nt, Human
gaauuugauaugugaacagu

SEQ ID NO: 1644210 - RNA, 20 nt, Human
gaauuugugaagguggaaau

SEQ ID NO: 1644211 - RNA, 17 nt, Human
gacagggaggacgcucu

SEQ ID NO: 1644212 - RNA, 23 nt, Human
gacaggaccagggauuuccauga

SEQ ID NO: 1644213 - RNA, 15 nt, Human
gacaggaccagggau

SEQ ID NO: 1644214 - RNA, 14 nt, Human
gacaggaccaggga

SEQ ID NO: 1644215 - RNA, 18 nt, Human
gacagggaggacgcucuc

SEQ ID NO: 1644216 - RNA, 16 nt, Human
gacagggaggugaccc

SEQ ID NO: 1644217 - RNA, 23 nt, Human
gacagggcacaccgggcacucag

SEQ ID NO: 1644218 - RNA, 24 nt, Human
gacagggcacaccgggcacucaga

SEQ ID NO: 1644219 - RNA, 14 nt, Human
gacaguuaagagaa

SEQ ID NO: 1644220 - RNA, 20 nt, Human
gacauagaauuaacacauga

SEQ ID NO: 1644221 - RNA, 22 nt, Human
gacaguuaagagaaaugagcuu

SEQ ID NO: 1644222 - RNA, 14 nt, Human
gacaugggaaaggg

SEQ ID NO: 1644223 - RNA, 14 nt, Human
gacaugaucuucuu

SEQ ID NO: 1644224 - RNA, 14 nt, Human
gacagagucucacu

SEQ ID NO: 1644225 - RNA, 23 nt, Human
gacagaggggguggccucccaac

SEQ ID NO: 1644226 - RNA, 22 nt, Human
gacagaggggguggccucccaa

SEQ ID NO: 1644227 - RNA, 21 nt, Human
gacagaggggguggccuccca

SEQ ID NO: 1644228 - RNA, 19 nt, Human
gacagaggggguggccucc

SEQ ID NO: 1644229 - RNA, 18 nt, Human
gacagaggggguggccuc

SEQ ID NO: 1644230 - RNA, 15 nt, Human
gacagaggggguggc

SEQ ID NO: 1644231 - RNA, 17 nt, Human
gacagaggcagccccau

SEQ ID NO: 1644232 - RNA, 16 nt, Human
gacagaggcagcccca

SEQ ID NO: 1644233 - RNA, 14 nt, Human
gacagaggcagccc

SEQ ID NO: 1644234 - RNA, 21 nt, Human
gacagagcaagugagacccug

SEQ ID NO: 1644235 - RNA, 19 nt, Human
gacagccacggccaggcca

SEQ ID NO: 1644236 - RNA, 18 nt, Human
gacagccacggccaggcc

SEQ ID NO: 1644237 - RNA, 17 nt, Human
gacagccacggccaggc

SEQ ID NO: 1644238 - RNA, 14 nt, Human
gacagccacggcca

SEQ ID NO: 1644239 - RNA, 22 nt, Human
gacagagugagacucugucuca

SEQ ID NO: 1644240 - RNA, 20 nt, Human
gacagagugagacucugucu

SEQ ID NO: 1644241 - RNA, 17 nt, Human
gacagcugccugggauc

SEQ ID NO: 1644242 - RNA, 16 nt, Human
gacagcugccugggau

SEQ ID NO: 1644243 - RNA, 21 nt, Human
gacagccacggccaggccaga

SEQ ID NO: 1644244 - RNA, 20 nt, Human
gacagccacggccaggccag

SEQ ID NO: 1644245 - RNA, 21 nt, Human
gacagcugccugggaucccuc

SEQ ID NO: 1644246 - RNA, 18 nt, Human
gacagcugccugggaucc

SEQ ID NO: 1644247 - RNA, 22 nt, Human
gacccacaagaaaugaaagcag

SEQ ID NO: 1644248 - RNA, 15 nt, Human
gacccacaagaaaug

SEQ ID NO: 1644249 - RNA, 16 nt, Human
gacccaaaaggcagaa

SEQ ID NO: 1644250 - RNA, 21 nt, Human
gacccccaaccaaguggcucc

SEQ ID NO: 1644251 - RNA, 12 nt, Human
gacccccaacca

SEQ ID NO: 1644252 - RNA, 12 nt, Human
gacccugcccug

SEQ ID NO: 1644253 - RNA, 23 nt, Human
gacccugaggcccagagggccug

SEQ ID NO: 1644254 - RNA, 22 nt, Human
gacccugaggcccagagggccu

SEQ ID NO: 1644255 - RNA, 21 nt, Human
gaccccuccaugugggcuagu

SEQ ID NO: 1644256 - RNA, 18 nt, Human
gaccccuccaugugggcu

SEQ ID NO: 1644257 - RNA, 14 nt, Human
gaccccuccaugug

SEQ ID NO: 1644258 - RNA, 17 nt, Human
gaccgugaggccagaga

SEQ ID NO: 1644259 - RNA, 16 nt, Human
gaccgugaggccagag

SEQ ID NO: 1644260 - RNA, 18 nt, Human
gaccgugaggccagagac

SEQ ID NO: 1644261 - RNA, 19 nt, Human
gaccgugaggccagagaca

SEQ ID NO: 1644262 - RNA, 21 nt, Human
gacccuuguggucccacccca

SEQ ID NO: 1644263 - RNA, 20 nt, Human
gacccuuguggucccacccc

SEQ ID NO: 1644264 - RNA, 19 nt, Human
gacccuuguggucccaccc

SEQ ID NO: 1644265 - RNA, 12 nt, Human
gacccugucuca

SEQ ID NO: 1644266 - RNA, 21 nt, Human
gaccacugcagaagacaguau

SEQ ID NO: 1644267 - RNA, 16 nt, Human
gaccacguuucuaaag

SEQ ID NO: 1644268 - RNA, 14 nt, Human
gaccacguuucuaa

SEQ ID NO: 1644269 - RNA, 11 nt, Human
gaccagagcug

SEQ ID NO: 1644270 - RNA, 21 nt, Human
gaccagacaccuugacagggc

SEQ ID NO: 1644271 - RNA, 16 nt, Human
gacaugggacauuugc

SEQ ID NO: 1644272 - RNA, 18 nt, Human
gacaugggaaaggggaag

SEQ ID NO: 1644273 - RNA, 14 nt, Human
gaccaccugcccaa

SEQ ID NO: 1644274 - RNA, 13 nt, Human
gaccaccugccca

SEQ ID NO: 1644275 - RNA, 17 nt, Human
gaccagagcugccaccu

SEQ ID NO: 1644276 - RNA, 15 nt, Human
gaccagagcugccac

SEQ ID NO: 1644277 - RNA, 14 nt, Human
gaccagagcugcca

SEQ ID NO: 1644278 - RNA, 13 nt, Human
gaccagagcugcc

SEQ ID NO: 1644279 - RNA, 19 nt, Human
gaccagagcugccaccugc

SEQ ID NO: 1644280 - RNA, 18 nt, Human
gaccagagcugccaccug

SEQ ID NO: 1644281 - RNA, 20 nt, Human
gaccagccuccaugcugccu

SEQ ID NO: 1644282 - RNA, 22 nt, Human
gaccagccuccaugcugccucc

SEQ ID NO: 1644283 - RNA, 21 nt, Human
gaccagccuccaugcugccuc

SEQ ID NO: 1644284 - RNA, 22 nt, Human
gaccauucuccaccugccaggg

SEQ ID NO: 1644285 - RNA, 21 nt, Human
gaccauucuccaccugccagg

SEQ ID NO: 1644286 - RNA, 20 nt, Human
gaccauucuccaccugccag

SEQ ID NO: 1644287 - RNA, 19 nt, Human
gaccauucuccaccugcca

SEQ ID NO: 1644288 - RNA, 23 nt, Human
gcaaagcacugacuucuaaguaa

SEQ ID NO: 1644289 - RNA, 15 nt, Human
gcaaaccaucauuga

SEQ ID NO: 1644290 - RNA, 16 nt, Human
gcaaauugucacagga

SEQ ID NO: 1644291 - RNA, 15 nt, Human
gcaaauguggcuccu

SEQ ID NO: 1644292 - RNA, 19 nt, Human
gauuuugauccaagcuggu

SEQ ID NO: 1644293 - RNA, 21 nt, Human
gauuuugaaauuuuuauuaaa

SEQ ID NO: 1644294 - RNA, 12 nt, Human
gcaaaccaucau

SEQ ID NO: 1644295 - RNA, 15 nt, Human
gauuuaacagaaaug

SEQ ID NO: 1644296 - RNA, 22 nt, Human
gauuuccguuaaaauaccagcc

SEQ ID NO: 1644297 - RNA, 16 nt, Human
gauuugagcucagccc

SEQ ID NO: 1644298 - RNA, 13 nt, Human
gauuuaacagaaa

SEQ ID NO: 1644299 - RNA, 14 nt, Human
gauuuaacagaaau

SEQ ID NO: 1644300 - RNA, 15 nt, Human
gauugcaacaggcug

SEQ ID NO: 1644301 - RNA, 14 nt, Human
gauucuccugccuc

SEQ ID NO: 1644302 - RNA, 16 nt, Human
gauucucaugccucag

SEQ ID NO: 1644303 - RNA, 20 nt, Human
gauucaaugccccugaauuu

SEQ ID NO: 1644304 - RNA, 19 nt, Human
gauucaaugccccugaauu

SEQ ID NO: 1644305 - RNA, 21 nt, Human
gauuacaggcuccugccacca

SEQ ID NO: 1644306 - RNA, 18 nt, Human
gauuacaggcuccugcca

SEQ ID NO: 1644307 - RNA, 21 nt, Human
gauucaaugccccugaauuua

SEQ ID NO: 1644308 - RNA, 22 nt, Human
gaugguucccuugaugaagaag

SEQ ID NO: 1644309 - RNA, 21 nt, Human
gaugguuccccuguucacucu

SEQ ID NO: 1644310 - RNA, 18 nt, Human
gaugguuccccuguucac

SEQ ID NO: 1644311 - RNA, 13 nt, Human
gaugguuccccug

SEQ ID NO: 1644312 - RNA, 16 nt, Human
gauggugcaaugaccu

SEQ ID NO: 1644313 - RNA, 15 nt, Human
gauggugcaaugacc

SEQ ID NO: 1644314 - RNA, 17 nt, Human
gauggugcaaugaccuu

SEQ ID NO: 1644315 - RNA, 14 nt, Human
gauggugcaaugac

SEQ ID NO: 1644316 - RNA, 12 nt, Human
gauggugcaaug

SEQ ID NO: 1644317 - RNA, 22 nt, Human
gauuacaagcgugagccacugc

SEQ ID NO: 1644318 - RNA, 15 nt, Human
gauuaaacuuaaucu

SEQ ID NO: 1644319 - RNA, 23 nt, Human
gauuacaagcgugagccacugca

SEQ ID NO: 1644320 - RNA, 17 nt, Human
gauuacaggcuccugcc

SEQ ID NO: 1644321 - RNA, 20 nt, Human
gauuacaggcgugagccacc

SEQ ID NO: 1644322 - RNA, 16 nt, Human
gauguuuaguaaucau

SEQ ID NO: 1644323 - RNA, 22 nt, Human
gaugcuagaacucccuuucaac

SEQ ID NO: 1644324 - RNA, 20 nt, Human
gaugcuagaacucccuuuca

SEQ ID NO: 1644325 - RNA, 18 nt, Human
gaugcuagaacucccuuu

SEQ ID NO: 1644326 - RNA, 16 nt, Human
gaugccccgucccccu

SEQ ID NO: 1644327 - RNA, 21 nt, Human
gaugccccgucccccucuggc

SEQ ID NO: 1644328 - RNA, 20 nt, Human
gaugcugacuguacuccucc

SEQ ID NO: 1644329 - RNA, 17 nt, Human
gaugcugacuguacucc

SEQ ID NO: 1644330 - RNA, 19 nt, Human
gaugcccaaagaugcagcc

SEQ ID NO: 1644331 - RNA, 20 nt, Human
gaugcccaaagaugcagccg

SEQ ID NO: 1644332 - RNA, 24 nt, Human
gauggggcccugccuccuuuguga

SEQ ID NO: 1644333 - RNA, 21 nt, Human
gaugggcaacccccagccugc

SEQ ID NO: 1644334 - RNA, 20 nt, Human
gaugggcaacccccagccug

SEQ ID NO: 1644335 - RNA, 22 nt, Human
gauggccgggcgcgguggcuca

SEQ ID NO: 1644336 - RNA, 15 nt, Human
gauggggcugcaccg

SEQ ID NO: 1644337 - RNA, 19 nt, Human
gauggggcugcaccggcug

SEQ ID NO: 1644338 - RNA, 13 nt, Human
gauggggcugcac

SEQ ID NO: 1644339 - RNA, 19 nt, Human
gaugggugcuuggaggaag

SEQ ID NO: 1644340 - RNA, 20 nt, Human
gcaauucuccugccucagcc

SEQ ID NO: 1644341 - RNA, 19 nt, Human
gcaauucuccugccucagc

SEQ ID NO: 1644342 - RNA, 18 nt, Human
gcaauucuccugccucag

SEQ ID NO: 1644343 - RNA, 17 nt, Human
gcaauucuccugccuca

SEQ ID NO: 1644344 - RNA, 16 nt, Human
gcaauucuccugccuc

SEQ ID NO: 1644345 - RNA, 15 nt, Human
gcaauucuccugccu

SEQ ID NO: 1644346 - RNA, 14 nt, Human
gcaauucuccugcc

SEQ ID NO: 1644347 - RNA, 14 nt, Human
gcacaaacagaggc

SEQ ID NO: 1644348 - RNA, 16 nt, Human
gcacaaacagaggccg

SEQ ID NO: 1644349 - RNA, 15 nt, Human
gcacaaacagaggcc

SEQ ID NO: 1644350 - RNA, 14 nt, Human
gcaaugugauaaaa

SEQ ID NO: 1644351 - RNA, 14 nt, Human
gcaacucaucuuag

SEQ ID NO: 1644352 - RNA, 15 nt, Human
gcaauggcagccuug

SEQ ID NO: 1644353 - RNA, 13 nt, Human
gcaacucugaagg

SEQ ID NO: 1644354 - RNA, 17 nt, Human
gcacagacccugcccug

SEQ ID NO: 1644355 - RNA, 16 nt, Human
gcacagacccugcccu

SEQ ID NO: 1644356 - RNA, 15 nt, Human
gcacagacccugccc

SEQ ID NO: 1644357 - RNA, 14 nt, Human
gcacagacccugcc

SEQ ID NO: 1644358 - RNA, 23 nt, Human
gcacagaaaauggaagacagcuc

SEQ ID NO: 1644359 - RNA, 22 nt, Human
gcacagaaaauggaagacagcu

SEQ ID NO: 1644360 - RNA, 21 nt, Human
gcacagaaaauggaagacagc

SEQ ID NO: 1644361 - RNA, 21 nt, Human
gcacagacccugcccuguggg

SEQ ID NO: 1644362 - RNA, 20 nt, Human
gcacagacccugcccugugg

SEQ ID NO: 1644363 - RNA, 19 nt, Human
gcacagacccugcccugug

SEQ ID NO: 1644364 - RNA, 18 nt, Human
gcacagacccugcccugu

SEQ ID NO: 1644365 - RNA, 22 nt, Human
gcacagacccugcccugugggc

SEQ ID NO: 1644366 - RNA, 15 nt, Human
gcacagaguuguuac

SEQ ID NO: 1644367 - RNA, 20 nt, Human
gcacagaaaauggaagacag

SEQ ID NO: 1644368 - RNA, 17 nt, Human
gcacaagcuccaagcuc

SEQ ID NO: 1644369 - RNA, 15 nt, Human
gcacaagcuccaagc

SEQ ID NO: 1644370 - RNA, 18 nt, Human
gcacaagcuccaagcucc

SEQ ID NO: 1644371 - RNA, 21 nt, Human
gcacaagcuccaagcucccag

SEQ ID NO: 1644372 - RNA, 23 nt, Human
gcacaaauucugucucuggauua

SEQ ID NO: 1644373 - RNA, 18 nt, Human
gcacugacuucuaaguaa

SEQ ID NO: 1644374 - RNA, 15 nt, Human
gcacugacuucuaag

SEQ ID NO: 1644375 - RNA, 16 nt, Human
gcacgauuucuguuua

SEQ ID NO: 1644376 - RNA, 20 nt, Human
gcacugcugcccagccucca

SEQ ID NO: 1644377 - RNA, 18 nt, Human
gcacugcugcccagccuc

SEQ ID NO: 1644378 - RNA, 15 nt, Human
gcacugcugcccagc

SEQ ID NO: 1644379 - RNA, 14 nt, Human
gcacugcugcccag

SEQ ID NO: 1644380 - RNA, 23 nt, Human
gcacugcuuccagugaggcucug

SEQ ID NO: 1644381 - RNA, 19 nt, Human
gcacugguggcccgacagc

SEQ ID NO: 1644382 - RNA, 14 nt, Human
gcacugguggcccg

SEQ ID NO: 1644383 - RNA, 19 nt, Human
gcacuguggguagacacac

SEQ ID NO: 1644384 - RNA, 14 nt, Human
gcagacaggcaagc

SEQ ID NO: 1644385 - RNA, 13 nt, Human
gcagacaggcaag

SEQ ID NO: 1644386 - RNA, 12 nt, Human
gcagacaggcaa

SEQ ID NO: 1644387 - RNA, 22 nt, Human
gcacagaguuguuacauuuuua

SEQ ID NO: 1644388 - RNA, 16 nt, Human
gcacagaguuguuaca

SEQ ID NO: 1644389 - RNA, 18 nt, Human
gcacagaguuguuacauu

SEQ ID NO: 1644390 - RNA, 19 nt, Human
gcacagaguuguuacauuu

SEQ ID NO: 1644391 - RNA, 21 nt, Human
gcacagaguuguuacauuuuu

SEQ ID NO: 1644392 - RNA, 13 nt, Human
gcacagugcaucu

SEQ ID NO: 1644393 - RNA, 18 nt, Human
gcacagugcaucucagcc

SEQ ID NO: 1644394 - RNA, 15 nt, Human
gcacagugcaucuca

SEQ ID NO: 1644395 - RNA, 13 nt, Human
gcacgauuucugu

SEQ ID NO: 1644396 - RNA, 15 nt, Human
gcacgauuucuguuu

SEQ ID NO: 1644397 - RNA, 21 nt, Human
gcaccuuagacagucccugcc

SEQ ID NO: 1644398 - RNA, 20 nt, Human
gcaccuuagacagucccugc

SEQ ID NO: 1644399 - RNA, 12 nt, Human
gcaccauaacuu

SEQ ID NO: 1644400 - RNA, 22 nt, Human
gcaccccagcuggggccaggcu

SEQ ID NO: 1644401 - RNA, 17 nt, Human
gagugacagaggcagcc

SEQ ID NO: 1644402 - RNA, 13 nt, Human
gagugggugaaua

SEQ ID NO: 1644403 - RNA, 19 nt, Human
gagugucuuaauuaaaaga

SEQ ID NO: 1644404 - RNA, 20 nt, Human
gagugugccugaagucccag

SEQ ID NO: 1644405 - RNA, 12 nt, Human
gaguuacagaca

SEQ ID NO: 1644406 - RNA, 16 nt, Human
gaguguugaaacggau

SEQ ID NO: 1644407 - RNA, 22 nt, Human
gauaaauggcuuccuggcaaua

SEQ ID NO: 1644408 - RNA, 20 nt, Human
gauaaaugccaucaauaaaa

SEQ ID NO: 1644409 - RNA, 15 nt, Human
gauaaaugccaucaa

SEQ ID NO: 1644410 - RNA, 11 nt, Human
gauaaaugcca

SEQ ID NO: 1644411 - RNA, 21 nt, Human
gaguugaagacagagcuacac

SEQ ID NO: 1644412 - RNA, 17 nt, Human
gaguugaagacagagcu

SEQ ID NO: 1644413 - RNA, 15 nt, Human
gaguugaagacagag

SEQ ID NO: 1644414 - RNA, 20 nt, Human
gaguucaucuugaauuguaa

SEQ ID NO: 1644415 - RNA, 19 nt, Human
gaguucaucuugaauugua

SEQ ID NO: 1644416 - RNA, 14 nt, Human
gaguucaucuugaa

SEQ ID NO: 1644417 - RNA, 15 nt, Human
gaguuacagacaaag

SEQ ID NO: 1644418 - RNA, 13 nt, Human
gaguuacagacaa

SEQ ID NO: 1644419 - RNA, 22 nt, Human
gauagccaaggccaaaggaagc

SEQ ID NO: 1644420 - RNA, 15 nt, Human
gauagcacagacccu

SEQ ID NO: 1644421 - RNA, 16 nt, Human
gauagcacagacccug

SEQ ID NO: 1644422 - RNA, 20 nt, Human
gauacaggaaaagcugcuga

SEQ ID NO: 1644423 - RNA, 22 nt, Human
gauaagaaccuuuugagugccu

SEQ ID NO: 1644424 - RNA, 23 nt, Human
gauacaggaaaagcugcugacag

SEQ ID NO: 1644425 - RNA, 21 nt, Human
gauacaggaaaagcugcugac

SEQ ID NO: 1644426 - RNA, 16 nt, Human
gaucacggcucacugc

SEQ ID NO: 1644427 - RNA, 15 nt, Human
gaucacggcucacug

SEQ ID NO: 1644428 - RNA, 20 nt, Human
gaucacggcucacugcagcc

SEQ ID NO: 1644429 - RNA, 14 nt, Human
gaucacagccucug

SEQ ID NO: 1644430 - RNA, 18 nt, Human
gaucacggcucacugcag

SEQ ID NO: 1644431 - RNA, 24 nt, Human
gauaugauucaaaugucuauaaac

SEQ ID NO: 1644432 - RNA, 22 nt, Human
gauaugauucaaaugucuauaa

SEQ ID NO: 1644433 - RNA, 14 nt, Human
gauaugauucaaau

SEQ ID NO: 1644434 - RNA, 17 nt, Human
gauauaaguguguguuu

SEQ ID NO: 1644435 - RNA, 15 nt, Human
gauauaagugugugu

SEQ ID NO: 1644436 - RNA, 16 nt, Human
gagguuucaaaccucc

SEQ ID NO: 1644437 - RNA, 17 nt, Human
gagguugggaggccauu

SEQ ID NO: 1644438 - RNA, 15 nt, Human
gagguugggaggcca

SEQ ID NO: 1644439 - RNA, 20 nt, Human
gaggucagagccugcaguua

SEQ ID NO: 1644440 - RNA, 17 nt, Human
gaggucagagccugcag

SEQ ID NO: 1644441 - RNA, 17 nt, Human
gaguaggaagacuuugg

SEQ ID NO: 1644442 - RNA, 13 nt, Human
gaguaggaagacu

SEQ ID NO: 1644443 - RNA, 12 nt, Human
gaguaggaagac

SEQ ID NO: 1644444 - RNA, 22 nt, Human
gaguagcugggacuacaggcac

SEQ ID NO: 1644445 - RNA, 19 nt, Human
gaguagcugggacuacagg

SEQ ID NO: 1644446 - RNA, 23 nt, Human
gaguacuacaguccucccaucuc

SEQ ID NO: 1644447 - RNA, 21 nt, Human
gaguacuacaguccucccauc

SEQ ID NO: 1644448 - RNA, 20 nt, Human
gaguacuacaguccucccau

SEQ ID NO: 1644449 - RNA, 22 nt, Human
gaguaauccaagcaaaugugaa

SEQ ID NO: 1644450 - RNA, 14 nt, Human
gagucgaggacagg

SEQ ID NO: 1644451 - RNA, 19 nt, Human
gaguccgaaagggacuugg

SEQ ID NO: 1644452 - RNA, 16 nt, Human
gagucgaggacaggga

SEQ ID NO: 1644453 - RNA, 15 nt, Human
gagucgaggacaggg

SEQ ID NO: 1644454 - RNA, 19 nt, Human
gaguaggaagacuuuggaa

SEQ ID NO: 1644455 - RNA, 18 nt, Human
gaguaggaagacuuugga

SEQ ID NO: 1644456 - RNA, 11 nt, Human
gaguauauguc

SEQ ID NO: 1644457 - RNA, 16 nt, Human
gagugacagaggcagc

SEQ ID NO: 1644458 - RNA, 15 nt, Human
gagugacagaggcag

SEQ ID NO: 1644459 - RNA, 14 nt, Human
gagugacagaggca

SEQ ID NO: 1644460 - RNA, 17 nt, Human
gagugaagcugggagaa

SEQ ID NO: 1644461 - RNA, 14 nt, Human
gagucugaaggcug

SEQ ID NO: 1644462 - RNA, 15 nt, Human
gagucugaaggcugg

SEQ ID NO: 1644463 - RNA, 13 nt, Human
gagucugaaggcu

SEQ ID NO: 1644464 - RNA, 12 nt, Human
gagucugaaggc

SEQ ID NO: 1644465 - RNA, 21 nt, Human
gagucuauuuacggaacucaa

SEQ ID NO: 1644466 - RNA, 19 nt, Human
gaggcagagguugcaguga

SEQ ID NO: 1644467 - RNA, 19 nt, Human
gaggcagccccauucugcc

SEQ ID NO: 1644468 - RNA, 9 nt, Human
gaggcaggg

SEQ ID NO: 1644469 - RNA, 20 nt, Human
gaggcagccccauucugccu

SEQ ID NO: 1644470 - RNA, 21 nt, Human
gaggcagccccauucugccug

SEQ ID NO: 1644471 - RNA, 23 nt, Human
gaggccaugggccuccugugugu

SEQ ID NO: 1644472 - RNA, 21 nt, Human
gaggccaugggccuccugugu

SEQ ID NO: 1644473 - RNA, 20 nt, Human
gaggccaugggccuccugug

SEQ ID NO: 1644474 - RNA, 18 nt, Human
gaggccaugggccuccug

SEQ ID NO: 1644475 - RNA, 17 nt, Human
gaggccaugggccuccu

SEQ ID NO: 1644476 - RNA, 14 nt, Human
gaggccaugggccu

SEQ ID NO: 1644477 - RNA, 19 nt, Human
gaggaucucuugagccugg

SEQ ID NO: 1644478 - RNA, 16 nt, Human
gaggaucucuugagcc

SEQ ID NO: 1644479 - RNA, 22 nt, Human
gaggaucucuugagccugggag

SEQ ID NO: 1644480 - RNA, 13 nt, Human
gaggaucucuuga

SEQ ID NO: 1644481 - RNA, 22 nt, Human
gagcccuguccugccuaaggcu

SEQ ID NO: 1644482 - RNA, 20 nt, Human
gaggauugcuugagcucagg

SEQ ID NO: 1644483 - RNA, 20 nt, Human
gaggcccuucucuccagccc

SEQ ID NO: 1644484 - RNA, 15 nt, Human
gaggcccuucucucc

SEQ ID NO: 1644485 - RNA, 21 nt, Human
gaggcccuucucuccagcccc

SEQ ID NO: 1644486 - RNA, 22 nt, Human
gaggcccuucucuccagccccu

SEQ ID NO: 1644487 - RNA, 16 nt, Human
gaggcccagagggccu

SEQ ID NO: 1644488 - RNA, 15 nt, Human
gaggcccagagggcc

SEQ ID NO: 1644489 - RNA, 19 nt, Human
gaggcccagagggccugca

SEQ ID NO: 1644490 - RNA, 14 nt, Human
gaggcccagagggc

SEQ ID NO: 1644491 - RNA, 13 nt, Human
gaggcccagaggg

SEQ ID NO: 1644492 - RNA, 11 nt, Human
gaggcccagag

SEQ ID NO: 1644493 - RNA, 19 nt, Human
gaggccuucucugaaggac

SEQ ID NO: 1644494 - RNA, 18 nt, Human
gaggccuucucugaagga

SEQ ID NO: 1644495 - RNA, 16 nt, Human
gaggccuucucugaag

SEQ ID NO: 1644496 - RNA, 21 nt, Human
gaggcgcaugaauuugugaag

SEQ ID NO: 1644497 - RNA, 14 nt, Human
gagggucugaggaa

SEQ ID NO: 1644498 - RNA, 13 nt, Human
gagggucugagga

SEQ ID NO: 1644499 - RNA, 21 nt, Human
gagggugaagugaagacaaug

SEQ ID NO: 1644500 - RNA, 12 nt, Human
gaggguggaaua

SEQ ID NO: 1644501 - RNA, 22 nt, Human
gagggugucccaaaaagaaagg

SEQ ID NO: 1644502 - RNA, 21 nt, Human
gaggguggugaccucugccug

SEQ ID NO: 1644503 - RNA, 14 nt, Human
gaggguggugaccu

SEQ ID NO: 1644504 - RNA, 15 nt, Human
gagggugggaguggg

SEQ ID NO: 1644505 - RNA, 13 nt, Human
gaggucagagccu

SEQ ID NO: 1644506 - RNA, 12 nt, Human
gaggucagagcc

SEQ ID NO: 1644507 - RNA, 17 nt, Human
gaggucaaggcugcagu

SEQ ID NO: 1644508 - RNA, 15 nt, Human
gaggguugggcuggu

SEQ ID NO: 1644509 - RNA, 14 nt, Human
gaggguugggcugg

SEQ ID NO: 1644510 - RNA, 21 nt, Human
gagguaaggaauaccuguccc

SEQ ID NO: 1644511 - RNA, 24 nt, Human
gagguaaggaauaccugucccccu

SEQ ID NO: 1644512 - RNA, 13 nt, Human
gaggguaaggcug

SEQ ID NO: 1644513 - RNA, 17 nt, Human
gaggggguggccuccca

SEQ ID NO: 1644514 - RNA, 17 nt, Human
gaggggcugugggcgug

SEQ ID NO: 1644515 - RNA, 18 nt, Human
gagggagugacagaggca

SEQ ID NO: 1644516 - RNA, 14 nt, Human
gagggagguaagga

SEQ ID NO: 1644517 - RNA, 20 nt, Human
gagggagggcuccagacaca

SEQ ID NO: 1644518 - RNA, 20 nt, Human
gagggagggggaaggcaggg

SEQ ID NO: 1644519 - RNA, 22 nt, Human
gagggagugacagaggcagccc

SEQ ID NO: 1644520 - RNA, 21 nt, Human
gagggagugacagaggcagcc

SEQ ID NO: 1644521 - RNA, 19 nt, Human
gagggagggcuccagacac

SEQ ID NO: 1644522 - RNA, 20 nt, Human
gaggcugggcucccuuccca

SEQ ID NO: 1644523 - RNA, 12 nt, Human
ggaaugcagugg

SEQ ID NO: 1644524 - RNA, 24 nt, Human
ggaaugauuaauuaaaacacaaca

SEQ ID NO: 1644525 - RNA, 17 nt, Human
ggaauucuguauagauu

SEQ ID NO: 1644526 - RNA, 15 nt, Human
ggaauucuguauaga

SEQ ID NO: 1644527 - RNA, 12 nt, Human
ggaauucuguau

SEQ ID NO: 1644528 - RNA, 19 nt, Human
ggaauguuugccucugccu

SEQ ID NO: 1644529 - RNA, 23 nt, Human
ggaauuucucccagucauuuaau

SEQ ID NO: 1644530 - RNA, 22 nt, Human
ggaauuggagcucgugggacag

SEQ ID NO: 1644531 - RNA, 16 nt, Human
ggaauuggagcucgug

SEQ ID NO: 1644532 - RNA, 12 nt, Human
ggaauuguguuu

SEQ ID NO: 1644533 - RNA, 17 nt, Human
ggacaaaauggaauacu

SEQ ID NO: 1644534 - RNA, 16 nt, Human
ggacaaaauggaauac

SEQ ID NO: 1644535 - RNA, 19 nt, Human
ggaauuuucaucuaggauu

SEQ ID NO: 1644536 - RNA, 20 nt, Human
ggaagugacgguuuaauggg

SEQ ID NO: 1644537 - RNA, 18 nt, Human
ggaagugcuaauuuugaa

SEQ ID NO: 1644538 - RNA, 16 nt, Human
ggaaguacuggagaaa

SEQ ID NO: 1644539 - RNA, 12 nt, Human
ggaaguacugga

SEQ ID NO: 1644540 - RNA, 18 nt, Human
ggaaguacuggagaaaau

SEQ ID NO: 1644541 - RNA, 23 nt, Human
ggaaggggagauaaggguaucug

SEQ ID NO: 1644542 - RNA, 17 nt, Human
ggaaggcugagaggaga

SEQ ID NO: 1644543 - RNA, 16 nt, Human
ggaacgcguugaaauu

SEQ ID NO: 1644544 - RNA, 14 nt, Human
ggaaggcagggagg

SEQ ID NO: 1644545 - RNA, 13 nt, Human
ggaaccugacccc

SEQ ID NO: 1644546 - RNA, 16 nt, Human
ggacauuugcucaugg

SEQ ID NO: 1644547 - RNA, 23 nt, Human
ggaccaaaaaccaguauuguaca

SEQ ID NO: 1644548 - RNA, 16 nt, Human
ggaccaaaaaccagua

SEQ ID NO: 1644549 - RNA, 20 nt, Human
ggacauugcggacagccacg

SEQ ID NO: 1644550 - RNA, 22 nt, Human
ggacagccacggccaggccaga

SEQ ID NO: 1644551 - RNA, 21 nt, Human
ggacagccacggccaggccag

SEQ ID NO: 1644552 - RNA, 20 nt, Human
ggacagccacggccaggcca

SEQ ID NO: 1644553 - RNA, 19 nt, Human
ggacagccacggccaggcc

SEQ ID NO: 1644554 - RNA, 15 nt, Human
ggacagccacggcca

SEQ ID NO: 1644555 - RNA, 22 nt, Human
ggacacucaaaagcugggcagg

SEQ ID NO: 1644556 - RNA, 17 nt, Human
ggacacucaaaagcugg

SEQ ID NO: 1644557 - RNA, 17 nt, Human
ggaccuugaacugggua

SEQ ID NO: 1644558 - RNA, 15 nt, Human
ggaccuugaacuggg

SEQ ID NO: 1644559 - RNA, 20 nt, Human
ggacgcuacccgggaagggg

SEQ ID NO: 1644560 - RNA, 19 nt, Human
ggacgcuacccgggaaggg

SEQ ID NO: 1644561 - RNA, 17 nt, Human
ggacgcuacccgggaag

SEQ ID NO: 1644562 - RNA, 23 nt, Human
ggaccucaggugagaagcagagg

SEQ ID NO: 1644563 - RNA, 19 nt, Human
ggaccucaggugagaagca

SEQ ID NO: 1644564 - RNA, 14 nt, Human
ggaccagagcugcc

SEQ ID NO: 1644565 - RNA, 13 nt, Human
ggaccagagcugc

SEQ ID NO: 1644566 - RNA, 14 nt, Human
ggacgcucucuggc

SEQ ID NO: 1644567 - RNA, 13 nt, Human
ggacgcucucugg

SEQ ID NO: 1644568 - RNA, 15 nt, Human
ggacgcucucuggcc

SEQ ID NO: 1644569 - RNA, 14 nt, Human
ggacuguggugacu

SEQ ID NO: 1644570 - RNA, 18 nt, Human
ggacuggccucugcugau

SEQ ID NO: 1644571 - RNA, 19 nt, Human
ggagaaucacuugaacccg

SEQ ID NO: 1644572 - RNA, 15 nt, Human
ggagaaucacuugaa

SEQ ID NO: 1644573 - RNA, 18 nt, Human
ggagaagcggcuggcagc

SEQ ID NO: 1644574 - RNA, 17 nt, Human
ggagaagcggcuggcag

SEQ ID NO: 1644575 - RNA, 17 nt, Human
ggacugugugcucagga

SEQ ID NO: 1644576 - RNA, 22 nt, Human
ggacuguggugacuuuggauaa

SEQ ID NO: 1644577 - RNA, 21 nt, Human
ggacuguggugacuuuggaua

SEQ ID NO: 1644578 - RNA, 17 nt, Human
ggacuguggugacuuug

SEQ ID NO: 1644579 - RNA, 15 nt, Human
ggacuguggugacuu

SEQ ID NO: 1644580 - RNA, 20 nt, Human
gcuugaggguugggcuggug

SEQ ID NO: 1644581 - RNA, 18 nt, Human
gcuugaggguugggcugg

SEQ ID NO: 1644582 - RNA, 22 nt, Human
gcuugaggguugggcugguguc

SEQ ID NO: 1644583 - RNA, 15 nt, Human
gcuuugugauuuuug

SEQ ID NO: 1644584 - RNA, 23 nt, Human
gcuuucagauacuggauuguacu

SEQ ID NO: 1644585 - RNA, 15 nt, Human
gcuuuguaugcacuu

SEQ ID NO: 1644586 - RNA, 18 nt, Human
gcuuucagauacuggauu

SEQ ID NO: 1644587 - RNA, 14 nt, Human
gcuuucagauacug

SEQ ID NO: 1644588 - RNA, 13 nt, Human
gcuuuucacugcu

SEQ ID NO: 1644589 - RNA, 18 nt, Human
gcuuuucacugcuggcug

SEQ ID NO: 1644590 - RNA, 14 nt, Human
gcuuuucacugcug

SEQ ID NO: 1644591 - RNA, 21 nt, Human
gcuuuguuuguugucagcuga

SEQ ID NO: 1644592 - RNA, 18 nt, Human
ggaaaacaugcuacacac

SEQ ID NO: 1644593 - RNA, 23 nt, Human
gcuuuucacugcuggcugccuua

SEQ ID NO: 1644594 - RNA, 22 nt, Human
gcuuuucacugcuggcugccuu

SEQ ID NO: 1644595 - RNA, 20 nt, Human
ggaaaagcugcugacagugu

SEQ ID NO: 1644596 - RNA, 18 nt, Human
ggaaaagcugcugacagu

SEQ ID NO: 1644597 - RNA, 14 nt, Human
ggaaaagcugcuga

SEQ ID NO: 1644598 - RNA, 21 nt, Human
ggaaaaccaagccguggcuuc

SEQ ID NO: 1644599 - RNA, 17 nt, Human
ggaaaucaaauaugcaa

SEQ ID NO: 1644600 - RNA, 14 nt, Human
ggaaaucaccgaaa

SEQ ID NO: 1644601 - RNA, 21 nt, Human
ggaaaucaccgaaaacguggc

SEQ ID NO: 1644602 - RNA, 16 nt, Human
ggaacaggaaacugau

SEQ ID NO: 1644603 - RNA, 21 nt, Human
ggaaaggcuccaggagcagcc

SEQ ID NO: 1644604 - RNA, 20 nt, Human
ggaaaggcuccaggagcagc

SEQ ID NO: 1644605 - RNA, 19 nt, Human
ggaaaggcuccaggagcag

SEQ ID NO: 1644606 - RNA, 17 nt, Human
ggaaaggcuccaggagc

SEQ ID NO: 1644607 - RNA, 22 nt, Human
ggaaaggcuccaggagcagcca

SEQ ID NO: 1644608 - RNA, 23 nt, Human
ggaaaaucagccugcuccagcug

SEQ ID NO: 1644609 - RNA, 19 nt, Human
ggaaaaucagccugcucca

SEQ ID NO: 1644610 - RNA, 18 nt, Human
ggaaaaguuuaauauuaa

SEQ ID NO: 1644611 - RNA, 14 nt, Human
ggaaaaguuuaaua

SEQ ID NO: 1644612 - RNA, 14 nt, Human
ggaaaggcuccagg

SEQ ID NO: 1644613 - RNA, 13 nt, Human
ggaaaggcuccag

SEQ ID NO: 1644614 - RNA, 12 nt, Human
ggaaaggcucca

SEQ ID NO: 1644615 - RNA, 20 nt, Human
gcugucuacacuaagagaga

SEQ ID NO: 1644616 - RNA, 20 nt, Human
gcugccaaugggagcucaug

SEQ ID NO: 1644617 - RNA, 19 nt, Human
gcugccaaugggagcucau

SEQ ID NO: 1644618 - RNA, 16 nt, Human
gcugccaaugggagcu

SEQ ID NO: 1644619 - RNA, 15 nt, Human
gcugccaaugggagc

SEQ ID NO: 1644620 - RNA, 17 nt, Human
gcugucuccauguuuga

SEQ ID NO: 1644621 - RNA, 20 nt, Human
gcugugggcgugagaccugc

SEQ ID NO: 1644622 - RNA, 22 nt, Human
gcugugggcgugagaccugccc

SEQ ID NO: 1644623 - RNA, 21 nt, Human
gcugugggcgugagaccugcc

SEQ ID NO: 1644624 - RNA, 14 nt, Human
gcuguucagcuggu

SEQ ID NO: 1644625 - RNA, 12 nt, Human
gcuguucaugaa

SEQ ID NO: 1644626 - RNA, 21 nt, Human
gcuguucaugaaagauucaau

SEQ ID NO: 1644627 - RNA, 17 nt, Human
gcuuagucacugagaca

SEQ ID NO: 1644628 - RNA, 15 nt, Human
gcuuagucacugaga

SEQ ID NO: 1644629 - RNA, 20 nt, Human
gcuuagucacugagacagcc

SEQ ID NO: 1644630 - RNA, 19 nt, Human
gcuuagucacugagacagc

SEQ ID NO: 1644631 - RNA, 21 nt, Human
gcuuagucacugagacagccc

SEQ ID NO: 1644632 - RNA, 16 nt, Human
gcuugaggguugggcu

SEQ ID NO: 1644633 - RNA, 15 nt, Human
gcuuccagugaggcu

SEQ ID NO: 1644634 - RNA, 18 nt, Human
gcuucauuuccugugucu

SEQ ID NO: 1644635 - RNA, 21 nt, Human
gcuucauccuccucagaucuu

SEQ ID NO: 1644636 - RNA, 17 nt, Human
gcuucauuuccuguguc

SEQ ID NO: 1644637 - RNA, 18 nt, Human
gcuuccagugaggcucug

SEQ ID NO: 1644638 - RNA, 16 nt, Human
gcuuccagugaggcuc

SEQ ID NO: 1644639 - RNA, 16 nt, Human
gcuucauuuccugugu

SEQ ID NO: 1644640 - RNA, 13 nt, Human
gcuucauuuccug

SEQ ID NO: 1644641 - RNA, 15 nt, Human
gcuucauccuccuca

SEQ ID NO: 1644642 - RNA, 12 nt, Human
gcuucauccucc

SEQ ID NO: 1644643 - RNA, 18 nt, Human
gcuucaguggcagcugcu

SEQ ID NO: 1644644 - RNA, 17 nt, Human
gcuucaguggcagcugc

SEQ ID NO: 1644645 - RNA, 19 nt, Human
gcuuaucucaggggugugc

SEQ ID NO: 1644646 - RNA, 20 nt, Human
gcuuauacacuuacacuuua

SEQ ID NO: 1644647 - RNA, 12 nt, Human
gcuuauacacuu

SEQ ID NO: 1644648 - RNA, 16 nt, Human
gcuucaguggcagcug

SEQ ID NO: 1644649 - RNA, 14 nt, Human
ggcauggcugggaa

SEQ ID NO: 1644650 - RNA, 18 nt, Human
ggcaugggaaugaauguc

SEQ ID NO: 1644651 - RNA, 17 nt, Human
ggcauuccccaggaggc

SEQ ID NO: 1644652 - RNA, 22 nt, Human
ggcaugggaaugaaugucagug

SEQ ID NO: 1644653 - RNA, 19 nt, Human
ggcauuccccaggaggcca

SEQ ID NO: 1644654 - RNA, 18 nt, Human
ggcauuccccaggaggcc

SEQ ID NO: 1644655 - RNA, 17 nt, Human
ggccacuccagaccccu

SEQ ID NO: 1644656 - RNA, 17 nt, Human
ggccagcugcuugggcu

SEQ ID NO: 1644657 - RNA, 22 nt, Human
ggccagccuugaccauucucca

SEQ ID NO: 1644658 - RNA, 20 nt, Human
ggccagccuugaccauucuc

SEQ ID NO: 1644659 - RNA, 18 nt, Human
ggccaggcccucugccca

SEQ ID NO: 1644660 - RNA, 23 nt, Human
ggccagcugcuugggcuucaucc

SEQ ID NO: 1644661 - RNA, 16 nt, Human
ggccaugggccuccug

SEQ ID NO: 1644662 - RNA, 16 nt, Human
ggccaggcugcucuug

SEQ ID NO: 1644663 - RNA, 11 nt, Human
ggccaggcugc

SEQ ID NO: 1644664 - RNA, 15 nt, Human
ggccaggcugcucuu

SEQ ID NO: 1644665 - RNA, 14 nt, Human
ggccaggcugcucu

SEQ ID NO: 1644666 - RNA, 21 nt, Human
ggcagcucagagaggguggga

SEQ ID NO: 1644667 - RNA, 16 nt, Human
ggcagcucaccucucc

SEQ ID NO: 1644668 - RNA, 17 nt, Human
ggcagcuugaggguugg

SEQ ID NO: 1644669 - RNA, 14 nt, Human
ggcagcucaccucu

SEQ ID NO: 1644670 - RNA, 12 nt, Human
ggcagcucaccu

SEQ ID NO: 1644671 - RNA, 16 nt, Human
ggcagugggagcugcc

SEQ ID NO: 1644672 - RNA, 21 nt, Human
ggcagugggacagggcauggc

SEQ ID NO: 1644673 - RNA, 14 nt, Human
ggcagugggagcug

SEQ ID NO: 1644674 - RNA, 13 nt, Human
ggcagugggagcu

SEQ ID NO: 1644675 - RNA, 20 nt, Human
ggcagggucucacucugucg

SEQ ID NO: 1644676 - RNA, 19 nt, Human
ggcagggucucacucuguc

SEQ ID NO: 1644677 - RNA, 18 nt, Human
ggcaugacacgaauauug

SEQ ID NO: 1644678 - RNA, 15 nt, Human
ggcaugaagacagau

SEQ ID NO: 1644679 - RNA, 18 nt, Human
ggcauggccagguggcca

SEQ ID NO: 1644680 - RNA, 17 nt, Human
ggcauggccagguggcc

SEQ ID NO: 1644681 - RNA, 15 nt, Human
ggauuguaaaauggu

SEQ ID NO: 1644682 - RNA, 17 nt, Human
ggcaacccccagccugc

SEQ ID NO: 1644683 - RNA, 16 nt, Human
ggcaacccccagccug

SEQ ID NO: 1644684 - RNA, 17 nt, Human
ggauugcuacuguccua

SEQ ID NO: 1644685 - RNA, 17 nt, Human
ggauuagggagagaaga

SEQ ID NO: 1644686 - RNA, 16 nt, Human
ggauucuuaaaguuga

SEQ ID NO: 1644687 - RNA, 19 nt, Human
ggauucuuaaaguugaauu

SEQ ID NO: 1644688 - RNA, 18 nt, Human
ggauucuuaaaguugaau

SEQ ID NO: 1644689 - RNA, 23 nt, Human
ggauuacaagcgugagccacugc

SEQ ID NO: 1644690 - RNA, 19 nt, Human
ggauuacaggcuccugcca

SEQ ID NO: 1644691 - RNA, 16 nt, Human
ggauucuuccucccuc

SEQ ID NO: 1644692 - RNA, 16 nt, Human
ggauucuuauggacaa

SEQ ID NO: 1644693 - RNA, 20 nt, Human
ggauucuuaaaguugaauuu

SEQ ID NO: 1644694 - RNA, 23 nt, Human
ggcacccaccaucaugucuggcu

SEQ ID NO: 1644695 - RNA, 22 nt, Human
ggcacccggccccugcugguuc

SEQ ID NO: 1644696 - RNA, 18 nt, Human
ggcaccggggccucggac

SEQ ID NO: 1644697 - RNA, 23 nt, Human
ggcaaugcuggcuguuggcuggg

SEQ ID NO: 1644698 - RNA, 15 nt, Human
ggcaaugcuggcugu

SEQ ID NO: 1644699 - RNA, 14 nt, Human
ggcaaugcuggcug

SEQ ID NO: 1644700 - RNA, 19 nt, Human
ggcaacccccagccugcua

SEQ ID NO: 1644701 - RNA, 18 nt, Human
ggcaacccccagccugcu

SEQ ID NO: 1644702 - RNA, 19 nt, Human
ggcaaucauggugcucaga

SEQ ID NO: 1644703 - RNA, 19 nt, Human
ggauuacaagcgugagcca

SEQ ID NO: 1644704 - RNA, 15 nt, Human
ggaugcuuguacaua

SEQ ID NO: 1644705 - RNA, 19 nt, Human
ggaugcagccucacagucc

SEQ ID NO: 1644706 - RNA, 13 nt, Human
ggauccuccaggu

SEQ ID NO: 1644707 - RNA, 12 nt, Human
ggauccuccagg

SEQ ID NO: 1644708 - RNA, 17 nt, Human
ggaugcagccucacagu

SEQ ID NO: 1644709 - RNA, 16 nt, Human
ggaugcagccucacag

SEQ ID NO: 1644710 - RNA, 21 nt, Human
ggaugauuggaggggggaggu

SEQ ID NO: 1644711 - RNA, 23 nt, Human
ggaugcacagaguuguuacauuu

SEQ ID NO: 1644712 - RNA, 17 nt, Human
ggaucccucauccucau

SEQ ID NO: 1644713 - RNA, 13 nt, Human
ggaucccucaucc

SEQ ID NO: 1644714 - RNA, 22 nt, Human
ggaucccucauccucauaccca

SEQ ID NO: 1644715 - RNA, 22 nt, Human
ggaucaaaccccgaccaccugc

SEQ ID NO: 1644716 - RNA, 18 nt, Human
ggauacaaaagcauguga

SEQ ID NO: 1644717 - RNA, 15 nt, Human
ggagugcagugagcc

SEQ ID NO: 1644718 - RNA, 14 nt, Human
ggagugcagugagc

SEQ ID NO: 1644719 - RNA, 12 nt, Human
ggagugcaguga

SEQ ID NO: 1644720 - RNA, 17 nt, Human
ggcccucugcccacucc

SEQ ID NO: 1644721 - RNA, 16 nt, Human
ggcccucugcccacuc

SEQ ID NO: 1644722 - RNA, 15 nt, Human
ggcccucugcccacu

SEQ ID NO: 1644723 - RNA, 13 nt, Human
ggcccucugccca

SEQ ID NO: 1644724 - RNA, 20 nt, Human
ggcccucugcccacucccug

SEQ ID NO: 1644725 - RNA, 19 nt, Human
ggcccucugcccacucccu

SEQ ID NO: 1644726 - RNA, 21 nt, Human
ggcccucugcccacucccugc

SEQ ID NO: 1644727 - RNA, 12 nt, Human
ggcccagagagg

SEQ ID NO: 1644728 - RNA, 11 nt, Human
ggcccagagag

SEQ ID NO: 1644729 - RNA, 15 nt, Human
ggcccugccuccuuu

SEQ ID NO: 1644730 - RNA, 14 nt, Human
ggcccugccuccuu

SEQ ID NO: 1644731 - RNA, 22 nt, Human
ggcccugcccugguuuccugcc

SEQ ID NO: 1644732 - RNA, 22 nt, Human
ggcccuggcucccacaggcccu

SEQ ID NO: 1644733 - RNA, 13 nt, Human
ggcccuggcuccc

SEQ ID NO: 1644734 - RNA, 13 nt, Human
ggcccugccuccu

SEQ ID NO: 1644735 - RNA, 20 nt, Human
ggcccugcccugguuuccug

SEQ ID NO: 1644736 - RNA, 13 nt, Human
ggcccugcccugg

SEQ ID NO: 1644737 - RNA, 12 nt, Human
ggcccugcccug

SEQ ID NO: 1644738 - RNA, 11 nt, Human
ggcccugcccu

SEQ ID NO: 1644739 - RNA, 16 nt, Human
ggccucugcacucccc

SEQ ID NO: 1644740 - RNA, 15 nt, Human
ggccucugcacuccc

SEQ ID NO: 1644741 - RNA, 14 nt, Human
ggccucugcacucc

SEQ ID NO: 1644742 - RNA, 13 nt, Human
ggccucugcacuc

SEQ ID NO: 1644743 - RNA, 17 nt, Human
ggccucuuaugggcugg

SEQ ID NO: 1644744 - RNA, 20 nt, Human
ggccucgguguggagaagcg

SEQ ID NO: 1644745 - RNA, 18 nt, Human
ggccucuuaugggcuggg

SEQ ID NO: 1644746 - RNA, 20 nt, Human
ggccucggacuuagcuggga

SEQ ID NO: 1644747 - RNA, 22 nt, Human
ggccucggacuuagcugggaga

SEQ ID NO: 1644748 - RNA, 16 nt, Human
ggcuccaggcuccuuu

SEQ ID NO: 1644749 - RNA, 19 nt, Human
ggcucccacaggcccuucc

SEQ ID NO: 1644750 - RNA, 18 nt, Human
ggcucccacaggcccuuc

SEQ ID NO: 1644751 - RNA, 17 nt, Human
ggcucccacaggcccuu

SEQ ID NO: 1644752 - RNA, 11 nt, Human
ggcuccaggcu

SEQ ID NO: 1644753 - RNA, 21 nt, Human
ggcucaaguccucuuuucuga

SEQ ID NO: 1644754 - RNA, 15 nt, Human
ggcucaaguccucuu

SEQ ID NO: 1644755 - RNA, 19 nt, Human
ggcuccaggagcagccaca

SEQ ID NO: 1644756 - RNA, 13 nt, Human
ggcuccaggagca

SEQ ID NO: 1644757 - RNA, 12 nt, Human
ggcuccaggagc

SEQ ID NO: 1644758 - RNA, 12 nt, Human
ggcuccagcugg

SEQ ID NO: 1644759 - RNA, 15 nt, Human
ggcuaugcauuugaa

SEQ ID NO: 1644760 - RNA, 19 nt, Human
ggcuaugggggcacugagg

SEQ ID NO: 1644761 - RNA, 15 nt, Human
ggcuaguugggcuuc

SEQ ID NO: 1644762 - RNA, 23 nt, Human
ggcuagugugguguuuccuggca

SEQ ID NO: 1644763 - RNA, 16 nt, Human
ggcuaguugggcuucc

SEQ ID NO: 1644764 - RNA, 17 nt, Human
ggcuagagguucaaaga

SEQ ID NO: 1644765 - RNA, 22 nt, Human
ggcuagagguucaaagauauuu

SEQ ID NO: 1644766 - RNA, 16 nt, Human
ggcuaggaccccucca

SEQ ID NO: 1644767 - RNA, 22 nt, Human
ggcuaggaccccuccauguggg

SEQ ID NO: 1644768 - RNA, 22 nt, Human
ggccugggggcugggcagagga

SEQ ID NO: 1644769 - RNA, 20 nt, Human
ggccugggggcugggcagag

SEQ ID NO: 1644770 - RNA, 14 nt, Human
ggccugggggcugg

SEQ ID NO: 1644771 - RNA, 11 nt, Human
ggccugugagc

SEQ ID NO: 1644772 - RNA, 15 nt, Human
ggcgcgguggcucac

SEQ ID NO: 1644773 - RNA, 23 nt, Human
ggcgcugccccuggcagccccug

SEQ ID NO: 1644774 - RNA, 21 nt, Human
ggcgcugccccuggcagcccc

SEQ ID NO: 1644775 - RNA, 19 nt, Human
ggcgcugccccuggcagcc

SEQ ID NO: 1644776 - RNA, 18 nt, Human
ggcgcugccccuggcagc

SEQ ID NO: 1644777 - RNA, 20 nt, Human
gcucucuggccuucggccuc

SEQ ID NO: 1644778 - RNA, 19 nt, Human
gcucucuggccuucggccu

SEQ ID NO: 1644779 - RNA, 15 nt, Human
gcucucuggccuucg

SEQ ID NO: 1644780 - RNA, 14 nt, Human
gcucucuggccuuc

SEQ ID NO: 1644781 - RNA, 11 nt, Human
gcucugccucc

SEQ ID NO: 1644782 - RNA, 23 nt, Human
gcucugcccuugguuaggcauug

SEQ ID NO: 1644783 - RNA, 14 nt, Human
gcucugcccuuggu

SEQ ID NO: 1644784 - RNA, 14 nt, Human
gcucugcuccucuc

SEQ ID NO: 1644785 - RNA, 13 nt, Human
gcucugcuccucu

SEQ ID NO: 1644786 - RNA, 22 nt, Human
gcucugccucccaucacccgcu

SEQ ID NO: 1644787 - RNA, 15 nt, Human
gcucugccucccauc

SEQ ID NO: 1644788 - RNA, 14 nt, Human
gcucugccucccau

SEQ ID NO: 1644789 - RNA, 13 nt, Human
gcucugccuccca

SEQ ID NO: 1644790 - RNA, 23 nt, Human
gcucugcugacagacacaggccc

SEQ ID NO: 1644791 - RNA, 20 nt, Human
gcucugcugacagacacagg

SEQ ID NO: 1644792 - RNA, 19 nt, Human
gcucugcugacagacacag

SEQ ID NO: 1644793 - RNA, 18 nt, Human
gcucugcugacagacaca

SEQ ID NO: 1644794 - RNA, 14 nt, Human
gcucugcugacaga

SEQ ID NO: 1644795 - RNA, 13 nt, Human
gcucugcugacag

SEQ ID NO: 1644796 - RNA, 21 nt, Human
gcucugcuccucuccccagca

SEQ ID NO: 1644797 - RNA, 19 nt, Human
gcucugcuccucuccccag

SEQ ID NO: 1644798 - RNA, 22 nt, Human
gcucuggacaggcauguucucu

SEQ ID NO: 1644799 - RNA, 21 nt, Human
gcucuggacaggcauguucuc

SEQ ID NO: 1644800 - RNA, 16 nt, Human
gcucuggacaggcaug

SEQ ID NO: 1644801 - RNA, 15 nt, Human
gcucuggacaggcau

SEQ ID NO: 1644802 - RNA, 14 nt, Human
gcucuggacaggca

SEQ ID NO: 1644803 - RNA, 13 nt, Human
gcucucuggccuu

SEQ ID NO: 1644804 - RNA, 12 nt, Human
gcucucuggccu

SEQ ID NO: 1644805 - RNA, 11 nt, Human
gcucucuggcc

SEQ ID NO: 1644806 - RNA, 17 nt, Human
gcucuccgaccagacac

SEQ ID NO: 1644807 - RNA, 13 nt, Human
gcucuccgaccag

SEQ ID NO: 1644808 - RNA, 19 nt, Human
gcucuccgaccagacaccu

SEQ ID NO: 1644809 - RNA, 15 nt, Human
gcucuccucuugcca

SEQ ID NO: 1644810 - RNA, 22 nt, Human
gcucuccucuugccacugccuc

SEQ ID NO: 1644811 - RNA, 19 nt, Human
gcucuccucuugccacugc

SEQ ID NO: 1644812 - RNA, 17 nt, Human
gcucgagcaugccugga

SEQ ID NO: 1644813 - RNA, 16 nt, Human
gcucgagcaugccugg

SEQ ID NO: 1644814 - RNA, 21 nt, Human
gcuccuucuguccuacucugu

SEQ ID NO: 1644815 - RNA, 19 nt, Human
gcucccuucccaccucucu

SEQ ID NO: 1644816 - RNA, 18 nt, Human
gcucccuucccaccucuc

SEQ ID NO: 1644817 - RNA, 16 nt, Human
gcucccuucccaccuc

SEQ ID NO: 1644818 - RNA, 15 nt, Human
gcucccuucccaccu

SEQ ID NO: 1644819 - RNA, 12 nt, Human
gcucuucuccag

SEQ ID NO: 1644820 - RNA, 22 nt, Human
gcucuuccaggcugggagagcc

SEQ ID NO: 1644821 - RNA, 18 nt, Human
gcucuuccaggcugggag

SEQ ID NO: 1644822 - RNA, 19 nt, Human
gcucuuccaggcugggaga

SEQ ID NO: 1644823 - RNA, 16 nt, Human
gcucuucuccaggcug

SEQ ID NO: 1644824 - RNA, 14 nt, Human
gcucuucuccaggc

SEQ ID NO: 1644825 - RNA, 13 nt, Human
gcucuucuccuuu

SEQ ID NO: 1644826 - RNA, 21 nt, Human
gcucuucuccuuucacaaccu

SEQ ID NO: 1644827 - RNA, 17 nt, Human
gcucuucuccuuucaca

SEQ ID NO: 1644828 - RNA, 16 nt, Human
gcucuugaugccuggc

SEQ ID NO: 1644829 - RNA, 15 nt, Human
gcucuugaugccugg

SEQ ID NO: 1644830 - RNA, 14 nt, Human
gcucuugaugccug

SEQ ID NO: 1644831 - RNA, 23 nt, Human
gcucuucuccuuucacaaccuuc

SEQ ID NO: 1644832 - RNA, 21 nt, Human
gcugacagacacaggcccggc

SEQ ID NO: 1644833 - RNA, 17 nt, Human
gcugacagacagcccuc

SEQ ID NO: 1644834 - RNA, 17 nt, Human
gcucuugaugccuggcg

SEQ ID NO: 1644835 - RNA, 19 nt, Human
gcugacuguacuccuccca

SEQ ID NO: 1644836 - RNA, 18 nt, Human
gcugacuguacuccuccc

SEQ ID NO: 1644837 - RNA, 21 nt, Human
gcugauggugcaaugaccuuu

SEQ ID NO: 1644838 - RNA, 18 nt, Human
gcugauggugcaaugacc

SEQ ID NO: 1644839 - RNA, 20 nt, Human
gcugcaguugccagucaccc

SEQ ID NO: 1644840 - RNA, 18 nt, Human
gcugcaguugccagucac

SEQ ID NO: 1644841 - RNA, 21 nt, Human
gcugcaguugccagucacccc

SEQ ID NO: 1644842 - RNA, 17 nt, Human
gcugcauuuaaaagaua

SEQ ID NO: 1644843 - RNA, 19 nt, Human
gcugagucugaaggcuggg

SEQ ID NO: 1644844 - RNA, 18 nt, Human
gcugagucugaaggcugg

SEQ ID NO: 1644845 - RNA, 16 nt, Human
gcugagucugaaggcu

SEQ ID NO: 1644846 - RNA, 15 nt, Human
gcugagucugaaggc

SEQ ID NO: 1644847 - RNA, 22 nt, Human
gcugagucccaggcugagccuc

SEQ ID NO: 1644848 - RNA, 21 nt, Human
gcugagucccaggcugagccu

SEQ ID NO: 1644849 - RNA, 17 nt, Human
gcugagucccaggcuga

SEQ ID NO: 1644850 - RNA, 21 nt, Human
gcugacuguacuccucccagg

SEQ ID NO: 1644851 - RNA, 23 nt, Human
gcugagugggggaucacagccuc

SEQ ID NO: 1644852 - RNA, 22 nt, Human
gcugagugggggaucacagccu

SEQ ID NO: 1644853 - RNA, 16 nt, Human
gcugauggugcaauga

SEQ ID NO: 1644854 - RNA, 15 nt, Human
gcugauggugcaaug

SEQ ID NO: 1644855 - RNA, 17 nt, Human
gcuaagcaaaaugugau

SEQ ID NO: 1644856 - RNA, 23 nt, Human
gcuaagagggagggagggcucca

SEQ ID NO: 1644857 - RNA, 14 nt, Human
gcuaagcauuccaa

SEQ ID NO: 1644858 - RNA, 15 nt, Human
gcuacccgggaaggg

SEQ ID NO: 1644859 - RNA, 14 nt, Human
gcuacccgggaagg

SEQ ID NO: 1644860 - RNA, 11 nt, Human
gcuaaggacuu

SEQ ID NO: 1644861 - RNA, 18 nt, Human
gcuagagguucaaagaua

SEQ ID NO: 1644862 - RNA, 19 nt, Human
gcuagagguucaaagauau

SEQ ID NO: 1644863 - RNA, 21 nt, Human
gcuagagguucaaagauauuu

SEQ ID NO: 1644864 - RNA, 21 nt, Human
gcuacccgggaagggggcugg

SEQ ID NO: 1644865 - RNA, 18 nt, Human
gcuaucucccccagcccc

SEQ ID NO: 1644866 - RNA, 17 nt, Human
gcuaucucccccagccc

SEQ ID NO: 1644867 - RNA, 16 nt, Human
gcuaucucccccagcc

SEQ ID NO: 1644868 - RNA, 22 nt, Human
gcuaucucccccagccccaucc

SEQ ID NO: 1644869 - RNA, 21 nt, Human
gcuaucucccccagccccauc

SEQ ID NO: 1644870 - RNA, 20 nt, Human
gcuaucucccccagccccau

SEQ ID NO: 1644871 - RNA, 19 nt, Human
gcuaucucccccagcccca

SEQ ID NO: 1644872 - RNA, 23 nt, Human
gcuaucucccccagccccauccu

SEQ ID NO: 1644873 - RNA, 22 nt, Human
gcuaagagggagggagggcucc

SEQ ID NO: 1644874 - RNA, 14 nt, Human
gcuaacauggaagu

SEQ ID NO: 1644875 - RNA, 16 nt, Human
gcuaaaugugaaugau

SEQ ID NO: 1644876 - RNA, 13 nt, Human
gcuaaaugugaau

SEQ ID NO: 1644877 - RNA, 23 nt, Human
gcgugagccacugcaccgggcca

SEQ ID NO: 1644878 - RNA, 18 nt, Human
gcgugagccacugcaccg

SEQ ID NO: 1644879 - RNA, 15 nt, Human
gcgugagaccugccc

SEQ ID NO: 1644880 - RNA, 19 nt, Human
gcgguccacccaggagccc

SEQ ID NO: 1644881 - RNA, 18 nt, Human
gcgguccacccaggagcc

SEQ ID NO: 1644882 - RNA, 20 nt, Human
gcgguccacccaggagcccc

SEQ ID NO: 1644883 - RNA, 16 nt, Human
gcgguccacccaggag

SEQ ID NO: 1644884 - RNA, 13 nt, Human
gcggggacagcuc

SEQ ID NO: 1644885 - RNA, 12 nt, Human
gcggggacagcu

SEQ ID NO: 1644886 - RNA, 15 nt, Human
gcgggcuuccuccug

SEQ ID NO: 1644887 - RNA, 23 nt, Human
gccugugagcuaggaauuguguu

SEQ ID NO: 1644888 - RNA, 17 nt, Human
gccugugaacugaacuc

SEQ ID NO: 1644889 - RNA, 20 nt, Human
gcuccauuuuuagugaaaua

SEQ ID NO: 1644890 - RNA, 23 nt, Human
gcuccaggcuccuuuagcgccca

SEQ ID NO: 1644891 - RNA, 16 nt, Human
gcuccaggcuccuuua

SEQ ID NO: 1644892 - RNA, 11 nt, Human
gcuccagcugu

SEQ ID NO: 1644893 - RNA, 24 nt, Human
gcuccaggcuccuuuagcgcccag

SEQ ID NO: 1644894 - RNA, 20 nt, Human
gcuccagcuguucagcuggu

SEQ ID NO: 1644895 - RNA, 14 nt, Human
gcuccaucuccacu

SEQ ID NO: 1644896 - RNA, 15 nt, Human
gcuccauggcugcca

SEQ ID NO: 1644897 - RNA, 19 nt, Human
gcuccaagcucccaggcau

SEQ ID NO: 1644898 - RNA, 18 nt, Human
gcuccaagcucccaggca

SEQ ID NO: 1644899 - RNA, 17 nt, Human
gcuccaagcucccaggc

SEQ ID NO: 1644900 - RNA, 16 nt, Human
gcuccaagcucccagg

SEQ ID NO: 1644901 - RNA, 21 nt, Human
gcuccaagcucccaggcauuc

SEQ ID NO: 1644902 - RNA, 23 nt, Human
gcuccagcuggccgggagccuga

SEQ ID NO: 1644903 - RNA, 17 nt, Human
gcuccagcuggccggga

SEQ ID NO: 1644904 - RNA, 15 nt, Human
gcuccaagcucccag

SEQ ID NO: 1644905 - RNA, 14 nt, Human
gcuccaagcuccca

SEQ ID NO: 1644906 - RNA, 13 nt, Human
gcuccaagcuccc

SEQ ID NO: 1644907 - RNA, 14 nt, Human
gcuccaagaauuuc

SEQ ID NO: 1644908 - RNA, 16 nt, Human
gcuccaaaugcagcuu

SEQ ID NO: 1644909 - RNA, 18 nt, Human
gcucaggugucccugcac

SEQ ID NO: 1644910 - RNA, 22 nt, Human
gcucagcggggacagcuccuuc

SEQ ID NO: 1644911 - RNA, 21 nt, Human
gcucagcggggacagcuccuu

SEQ ID NO: 1644912 - RNA, 20 nt, Human
gcucagcggggacagcuccu

SEQ ID NO: 1644913 - RNA, 16 nt, Human
gcucagcggggacagc

SEQ ID NO: 1644914 - RNA, 15 nt, Human
gcucagcggggacag

SEQ ID NO: 1644915 - RNA, 19 nt, Human
gcucaggugucccugcacu

SEQ ID NO: 1644916 - RNA, 23 nt, Human
gcucagcaaaagaugcuucucac

SEQ ID NO: 1644917 - RNA, 22 nt, Human
gcucagcaaaagaugcuucuca

SEQ ID NO: 1644918 - RNA, 20 nt, Human
gcucagcaaaagaugcuucu

SEQ ID NO: 1644919 - RNA, 17 nt, Human
gcucagcaaaagaugcu

SEQ ID NO: 1644920 - RNA, 19 nt, Human
gcucaccagccccagugcc

SEQ ID NO: 1644921 - RNA, 23 nt, Human
gcucaccagccccagugcccaca

SEQ ID NO: 1644922 - RNA, 20 nt, Human
gcucaccagccccagugccc

SEQ ID NO: 1644923 - RNA, 14 nt, Human
gcucaccucucccu

SEQ ID NO: 1644924 - RNA, 12 nt, Human
gcccucuccugg

SEQ ID NO: 1644925 - RNA, 13 nt, Human
gcccucuccuggg

SEQ ID NO: 1644926 - RNA, 14 nt, Human
gcccucuccugggc

SEQ ID NO: 1644927 - RNA, 22 nt, Human
gcccucuccugggcagcugccu

SEQ ID NO: 1644928 - RNA, 23 nt, Human
gcccucuccugggcagcugccuc

SEQ ID NO: 1644929 - RNA, 16 nt, Human
gcccugagcuuucugc

SEQ ID NO: 1644930 - RNA, 12 nt, Human
gcccucugccca

SEQ ID NO: 1644931 - RNA, 18 nt, Human
gcccggcuccaggcuccu

SEQ ID NO: 1644932 - RNA, 17 nt, Human
gcccggcuccaggcucc

SEQ ID NO: 1644933 - RNA, 22 nt, Human
gcccuggacugugugcucagga

SEQ ID NO: 1644934 - RNA, 16 nt, Human
gcccuggacugugugc

SEQ ID NO: 1644935 - RNA, 12 nt, Human
gcccuggacugu

SEQ ID NO: 1644936 - RNA, 23 nt, Human
gcccugcuuugggcugcccuggu

SEQ ID NO: 1644937 - RNA, 22 nt, Human
gcccugcuuugggcugcccugg

SEQ ID NO: 1644938 - RNA, 21 nt, Human
gcccugcuuugggcugcccug

SEQ ID NO: 1644939 - RNA, 20 nt, Human
gcccugcuuugggcugcccu

SEQ ID NO: 1644940 - RNA, 16 nt, Human
gcccggcuccaggcuc

SEQ ID NO: 1644941 - RNA, 12 nt, Human
gcccggcuccag

SEQ ID NO: 1644942 - RNA, 19 nt, Human
gcccgacagccuggcacag

SEQ ID NO: 1644943 - RNA, 17 nt, Human
gcccgacagccuggcac

SEQ ID NO: 1644944 - RNA, 16 nt, Human
gcccgacagccuggca

SEQ ID NO: 1644945 - RNA, 12 nt, Human
gccccuuccccc

SEQ ID NO: 1644946 - RNA, 21 nt, Human
gccccuguucuggcagaguug

SEQ ID NO: 1644947 - RNA, 15 nt, Human
gccccugccacccug

SEQ ID NO: 1644948 - RNA, 14 nt, Human
gccccugccacccu

SEQ ID NO: 1644949 - RNA, 13 nt, Human
gccccugccaccc

SEQ ID NO: 1644950 - RNA, 15 nt, Human
gcagacucuacagag

SEQ ID NO: 1644951 - RNA, 19 nt, Human
gccccuccucucugcccua

SEQ ID NO: 1644952 - RNA, 18 nt, Human
gccccuccucucugcccu

SEQ ID NO: 1644953 - RNA, 15 nt, Human
gccccucccuucaac

SEQ ID NO: 1644954 - RNA, 14 nt, Human
gccccucccuucaa

SEQ ID NO: 1644955 - RNA, 12 nt, Human
gccccucccuuc

SEQ ID NO: 1644956 - RNA, 19 nt, Human
gcccuucucuccagccccu

SEQ ID NO: 1644957 - RNA, 21 nt, Human
gcccuuccucuccacugccuu

SEQ ID NO: 1644958 - RNA, 19 nt, Human
gcccuuccucuccacugcc

SEQ ID NO: 1644959 - RNA, 18 nt, Human
gcccuuccucuccacugc

SEQ ID NO: 1644960 - RNA, 16 nt, Human
gcccuuccucuccacu

SEQ ID NO: 1644961 - RNA, 17 nt, Human
gcccuuccucuccacug

SEQ ID NO: 1644962 - RNA, 22 nt, Human
gcccuucucuccagccccugga

SEQ ID NO: 1644963 - RNA, 21 nt, Human
gcccuucucuccagccccugg

SEQ ID NO: 1644964 - RNA, 23 nt, Human
gcccuucucuccagccccuggau

SEQ ID NO: 1644965 - RNA, 20 nt, Human
gcccuuccucuccacugccu

SEQ ID NO: 1644966 - RNA, 17 nt, Human
gccgagauugcaccacu

SEQ ID NO: 1644967 - RNA, 18 nt, Human
gccgagauugcaccacug

SEQ ID NO: 1644968 - RNA, 19 nt, Human
gccgagaucacgccacugc

SEQ ID NO: 1644969 - RNA, 18 nt, Human
gccgagaucacgccacug

SEQ ID NO: 1644970 - RNA, 16 nt, Human
gccgagaucacgccac

SEQ ID NO: 1644971 - RNA, 23 nt, Human
gcccugguggcagugggagcugc

SEQ ID NO: 1644972 - RNA, 22 nt, Human
gcccugguggcagugggagcug

SEQ ID NO: 1644973 - RNA, 21 nt, Human
gcccugguggcagugggagcu

SEQ ID NO: 1644974 - RNA, 20 nt, Human
gcccugguggcagugggagc

SEQ ID NO: 1644975 - RNA, 19 nt, Human
gcccugguggcagugggag

SEQ ID NO: 1644976 - RNA, 18 nt, Human
gcccugguggcaguggga

SEQ ID NO: 1644977 - RNA, 17 nt, Human
gcccugguggcaguggg

SEQ ID NO: 1644978 - RNA, 14 nt, Human
gcccugguggcagu

SEQ ID NO: 1644979 - RNA, 15 nt, Human
gcccugguuuccugc

SEQ ID NO: 1644980 - RNA, 14 nt, Human
gcccugguuuccug

SEQ ID NO: 1644981 - RNA, 23 nt, Human
gcccugguuuccugcccugggag

SEQ ID NO: 1644982 - RNA, 21 nt, Human
gcccugguuuccugcccuggg

SEQ ID NO: 1644983 - RNA, 20 nt, Human
gcccugguuuccugcccugg

SEQ ID NO: 1644984 - RNA, 19 nt, Human
gcccugguuuccugcccug

SEQ ID NO: 1644985 - RNA, 18 nt, Human
gcccugguuuccugcccu

SEQ ID NO: 1644986 - RNA, 17 nt, Human
gcccugguuuccugccc

SEQ ID NO: 1644987 - RNA, 21 nt, Human
gcccugggaggcucuggagcc

SEQ ID NO: 1644988 - RNA, 19 nt, Human
gcccugggaggcucuggag

SEQ ID NO: 1644989 - RNA, 18 nt, Human
gcccugggaggcucugga

SEQ ID NO: 1644990 - RNA, 17 nt, Human
gcccugggaggcucugg

SEQ ID NO: 1644991 - RNA, 23 nt, Human
gcccugggaggcucuggagccca

SEQ ID NO: 1644992 - RNA, 16 nt, Human
gcccugggaggcagug

SEQ ID NO: 1644993 - RNA, 21 nt, Human
gcccuggugcugccacacuuc

SEQ ID NO: 1644994 - RNA, 17 nt, Human
gcccuggugcugccaca

SEQ ID NO: 1644995 - RNA, 16 nt, Human
gcccuggugcugccac

SEQ ID NO: 1644996 - RNA, 15 nt, Human
gcccuggugcugcca

SEQ ID NO: 1644997 - RNA, 16 nt, Human
gcccugggaggcucug

SEQ ID NO: 1644998 - RNA, 15 nt, Human
gcccugggaggcucu

SEQ ID NO: 1644999 - RNA, 14 nt, Human
gcccugggaggcuc

SEQ ID NO: 1645000 - RNA, 13 nt, Human
gcccugggaggcu

SEQ ID NO: 1645001 - RNA, 14 nt, Human
gcccugggaggcag

SEQ ID NO: 1645002 - RNA, 11 nt, Human
gcccugggagg

SEQ ID NO: 1645003 - RNA, 20 nt, Human
gcccuggcucccacaggccc

SEQ ID NO: 1645004 - RNA, 19 nt, Human
gcccuggcucccacaggcc

SEQ ID NO: 1645005 - RNA, 15 nt, Human
gcccuggcucccaca

SEQ ID NO: 1645006 - RNA, 17 nt, Human
gccuaagugcagccccg

SEQ ID NO: 1645007 - RNA, 16 nt, Human
gccuaaggcugaacuu

SEQ ID NO: 1645008 - RNA, 22 nt, Human
gccuauauuuuuuguuaaauga

SEQ ID NO: 1645009 - RNA, 21 nt, Human
gccucaagugauucuccugcc

SEQ ID NO: 1645010 - RNA, 20 nt, Human
gccucaagugauucuccugc

SEQ ID NO: 1645011 - RNA, 19 nt, Human
gccucaagugauucuccug

SEQ ID NO: 1645012 - RNA, 17 nt, Human
gccucaaccuccugggc

SEQ ID NO: 1645013 - RNA, 16 nt, Human
gccucaaccuccuggg

SEQ ID NO: 1645014 - RNA, 14 nt, Human
gccucaaccuccug

SEQ ID NO: 1645015 - RNA, 14 nt, Human
gccucagugccacu

SEQ ID NO: 1645016 - RNA, 12 nt, Human
gccucagugcca

SEQ ID NO: 1645017 - RNA, 18 nt, Human
gccucagucucccucccu

SEQ ID NO: 1645018 - RNA, 15 nt, Human
gccucagucucccuc

SEQ ID NO: 1645019 - RNA, 23 nt, Human
gccucagccucccaaagugcugg

SEQ ID NO: 1645020 - RNA, 14 nt, Human
gccucagccucccg

SEQ ID NO: 1645021 - RNA, 14 nt, Human
gccucccacgacug

SEQ ID NO: 1645022 - RNA, 21 nt, Human
gccucccacgacugcccggca

SEQ ID NO: 1645023 - RNA, 23 nt, Human
gccucccaacucaccccagcccc

SEQ ID NO: 1645024 - RNA, 22 nt, Human
gccucccaacucaccccagccc

SEQ ID NO: 1645025 - RNA, 15 nt, Human
gccucagugccacua

SEQ ID NO: 1645026 - RNA, 21 nt, Human
gccucccaacucaccccagcc

SEQ ID NO: 1645027 - RNA, 15 nt, Human
gccucccgaguagcu

SEQ ID NO: 1645028 - RNA, 23 nt, Human
gccucccgaauagcugggacuac

SEQ ID NO: 1645029 - RNA, 17 nt, Human
gccucccgaguagcugg

SEQ ID NO: 1645030 - RNA, 21 nt, Human
gccucggacuuagcugggaga

SEQ ID NO: 1645031 - RNA, 20 nt, Human
gccucggacuuagcugggag

SEQ ID NO: 1645032 - RNA, 19 nt, Human
gccucucugcaggucccua

SEQ ID NO: 1645033 - RNA, 15 nt, Human
gccuggccagaugca

SEQ ID NO: 1645034 - RNA, 14 nt, Human
gccuggccagaugc

SEQ ID NO: 1645035 - RNA, 16 nt, Human
gccuggccagaugcac

SEQ ID NO: 1645036 - RNA, 15 nt, Human
gccugggcagaagga

SEQ ID NO: 1645037 - RNA, 15 nt, Human
gccuggauggggcug

SEQ ID NO: 1645038 - RNA, 14 nt, Human
gccuggauggggcu

SEQ ID NO: 1645039 - RNA, 13 nt, Human
gccuggccacgcc

SEQ ID NO: 1645040 - RNA, 17 nt, Human
gccugggcagaaggaag

SEQ ID NO: 1645041 - RNA, 16 nt, Human
gccugggcagaaggaa

SEQ ID NO: 1645042 - RNA, 18 nt, Human
gccugggcagaaggaaga

SEQ ID NO: 1645043 - RNA, 20 nt, Human
gccugggggcugggcagagg

SEQ ID NO: 1645044 - RNA, 21 nt, Human
gccugggggcugggcagagga

SEQ ID NO: 1645045 - RNA, 15 nt, Human
gccugcuccagcugu

SEQ ID NO: 1645046 - RNA, 23 nt, Human
gccugcacggugaauggcuuugu

SEQ ID NO: 1645047 - RNA, 16 nt, Human
gccugauuaaagaaug

SEQ ID NO: 1645048 - RNA, 13 nt, Human
gccugauuaaaga

SEQ ID NO: 1645049 - RNA, 18 nt, Human
gccugcuccagcuguuca

SEQ ID NO: 1645050 - RNA, 16 nt, Human
gccugcuccagcuguu

SEQ ID NO: 1645051 - RNA, 22 nt, Human
gccugcuuuuuauggccuguga

SEQ ID NO: 1645052 - RNA, 19 nt, Human
gccugcuuuuuauggccug

SEQ ID NO: 1645053 - RNA, 18 nt, Human
gccugcuuuuuauggccu

SEQ ID NO: 1645054 - RNA, 22 nt, Human
gccugaagucacacagugaguc

SEQ ID NO: 1645055 - RNA, 19 nt, Human
gccucugcugauccuccca

SEQ ID NO: 1645056 - RNA, 13 nt, Human
gccucugccuguc

SEQ ID NO: 1645057 - RNA, 18 nt, Human
gccucugcugauccuccc

SEQ ID NO: 1645058 - RNA, 21 nt, Human
gccucucugcaggucccuaau

SEQ ID NO: 1645059 - RNA, 20 nt, Human
gccucucugcaggucccuaa

SEQ ID NO: 1645060 - RNA, 23 nt, Human
gccucucugcaggucccuaauaa

SEQ ID NO: 1645061 - RNA, 12 nt, Human
gccucugccugu

SEQ ID NO: 1645062 - RNA, 15 nt, Human
guacgucugacaggc

SEQ ID NO: 1645063 - RNA, 14 nt, Human
guacgucugacagg

SEQ ID NO: 1645064 - RNA, 17 nt, Human
guacgucugacaggcaa

SEQ ID NO: 1645065 - RNA, 14 nt, Human
guacguugugcauu

SEQ ID NO: 1645066 - RNA, 15 nt, Human
guacguugugcauuu

SEQ ID NO: 1645067 - RNA, 16 nt, Human
guacguugugcauuug

SEQ ID NO: 1645068 - RNA, 23 nt, Human
guacuaaggaaucuuucugcuuu

SEQ ID NO: 1645069 - RNA, 15 nt, Human
guacuaaggaaucuu

SEQ ID NO: 1645070 - RNA, 17 nt, Human
guacguugugcauuugg

SEQ ID NO: 1645071 - RNA, 15 nt, Human
guacuucuccacccu

SEQ ID NO: 1645072 - RNA, 14 nt, Human
guacuucuccaccc

SEQ ID NO: 1645073 - RNA, 17 nt, Human
guacuacaguccuccca

SEQ ID NO: 1645074 - RNA, 15 nt, Human
guaccgcaaugugac

SEQ ID NO: 1645075 - RNA, 16 nt, Human
guacccacugcucugg

SEQ ID NO: 1645076 - RNA, 13 nt, Human
guaccucuugagc

SEQ ID NO: 1645077 - RNA, 21 nt, Human
guaccucuugagccuugaacu

SEQ ID NO: 1645078 - RNA, 22 nt, Human
guaccucuugagccuugaacuu

SEQ ID NO: 1645079 - RNA, 15 nt, Human
guagaggagaaacug

SEQ ID NO: 1645080 - RNA, 16 nt, Human
guagagcggagaaagg

SEQ ID NO: 1645081 - RNA, 21 nt, Human
guacuuuuuggcauaacauaa

SEQ ID NO: 1645082 - RNA, 12 nt, Human
guacuuuuuggc

SEQ ID NO: 1645083 - RNA, 23 nt, Human
guacuuuauuuucuauaauuuaa

SEQ ID NO: 1645084 - RNA, 21 nt, Human
guacuuguggacacagcucuu

SEQ ID NO: 1645085 - RNA, 19 nt, Human
guacuucuccacccugcuc

SEQ ID NO: 1645086 - RNA, 18 nt, Human
guacuucuccacccugcu

SEQ ID NO: 1645087 - RNA, 17 nt, Human
guacuucuccacccugc

SEQ ID NO: 1645088 - RNA, 16 nt, Human
guacuucuccacccug

SEQ ID NO: 1645089 - RNA, 21 nt, Human
guacuucuccacccugcucuc

SEQ ID NO: 1645090 - RNA, 20 nt, Human
guacuucuccacccugcucu

SEQ ID NO: 1645091 - RNA, 14 nt, Human
guacuugcucuuga

SEQ ID NO: 1645092 - RNA, 20 nt, Human
guacuuguggacacagcucu

SEQ ID NO: 1645093 - RNA, 16 nt, Human
guacuuguggacacag

SEQ ID NO: 1645094 - RNA, 22 nt, Human
guacuugcucuugaugccuggc

SEQ ID NO: 1645095 - RNA, 19 nt, Human
guacuugcucuugaugccu

SEQ ID NO: 1645096 - RNA, 18 nt, Human
guacuugcucuugaugcc

SEQ ID NO: 1645097 - RNA, 16 nt, Human
guacuugcucuugaug

SEQ ID NO: 1645098 - RNA, 15 nt, Human
guacuugcucuugau

SEQ ID NO: 1645099 - RNA, 15 nt, Human
guaauuggaaaggca

SEQ ID NO: 1645100 - RNA, 18 nt, Human
guacacuguuucaaacuu

SEQ ID NO: 1645101 - RNA, 20 nt, Human
guaauuaaguacuauguauc

SEQ ID NO: 1645102 - RNA, 17 nt, Human
guaauuaaguacuaugu

SEQ ID NO: 1645103 - RNA, 14 nt, Human
guaauuaaguacua

SEQ ID NO: 1645104 - RNA, 21 nt, Human
guaauuaaguacuauguauca

SEQ ID NO: 1645105 - RNA, 13 nt, Human
guaauuauaucug

SEQ ID NO: 1645106 - RNA, 19 nt, Human
guaaugauaacuggaaacu

SEQ ID NO: 1645107 - RNA, 18 nt, Human
guaaugaugucguuugaa

SEQ ID NO: 1645108 - RNA, 13 nt, Human
guaaugaaaacca

SEQ ID NO: 1645109 - RNA, 11 nt, Human
guaaugaaaac

SEQ ID NO: 1645110 - RNA, 15 nt, Human
guaaucguguccccu

SEQ ID NO: 1645111 - RNA, 15 nt, Human
guacccacugcucug

SEQ ID NO: 1645112 - RNA, 20 nt, Human
guacauaaugcgugcauacc

SEQ ID NO: 1645113 - RNA, 20 nt, Human
guacagcaaggagauuuaca

SEQ ID NO: 1645114 - RNA, 22 nt, Human
guacagagcccacgcccccacu

SEQ ID NO: 1645115 - RNA, 18 nt, Human
guacagagcccacgcccc

SEQ ID NO: 1645116 - RNA, 12 nt, Human
guacagagccca

SEQ ID NO: 1645117 - RNA, 19 nt, Human
guacacuguuucaaacuuu

SEQ ID NO: 1645118 - RNA, 20 nt, Human
guacacuguuucaaacuuua

SEQ ID NO: 1645119 - RNA, 21 nt, Human
guacacuguuucaaacuuuac

SEQ ID NO: 1645120 - RNA, 16 nt, Human
guacagacaacaaacc

SEQ ID NO: 1645121 - RNA, 15 nt, Human
guacagacagaaaaa

SEQ ID NO: 1645122 - RNA, 23 nt, Human
guaaauacaauuuuguuucugua

SEQ ID NO: 1645123 - RNA, 22 nt, Human
guaaauacaauuuuguuucugu

SEQ ID NO: 1645124 - RNA, 15 nt, Human
guaaaucccauuauu

SEQ ID NO: 1645125 - RNA, 21 nt, Human
guaaauacaauuuuguuucug

SEQ ID NO: 1645126 - RNA, 15 nt, Human
guaaauuaacuuuua

SEQ ID NO: 1645127 - RNA, 16 nt, Human
guaaauuaacuuuuau

SEQ ID NO: 1645128 - RNA, 17 nt, Human
guaaauuaacuuuuaua

SEQ ID NO: 1645129 - RNA, 21 nt, Human
guaaauuaacuuuuauaaacu

SEQ ID NO: 1645130 - RNA, 22 nt, Human
guaaauuaacuuuuauaaacuu

SEQ ID NO: 1645131 - RNA, 18 nt, Human
guaaaugggggugcauuu

SEQ ID NO: 1645132 - RNA, 19 nt, Human
guaaaugggggugcauuug

SEQ ID NO: 1645133 - RNA, 20 nt, Human
guaaaugggggugcauuuga

SEQ ID NO: 1645134 - RNA, 21 nt, Human
guaaaucccauuauucaaagu

SEQ ID NO: 1645135 - RNA, 20 nt, Human
guaaaucccauuauucaaag

SEQ ID NO: 1645136 - RNA, 19 nt, Human
guaaaucccauuauucaaa

SEQ ID NO: 1645137 - RNA, 18 nt, Human
guaaaucccauuauucaa

SEQ ID NO: 1645138 - RNA, 17 nt, Human
guaaaucccauuauuca

SEQ ID NO: 1645139 - RNA, 16 nt, Human
guaaaucccauuauuc

SEQ ID NO: 1645140 - RNA, 18 nt, Human
guaagggaaacugccagc

SEQ ID NO: 1645141 - RNA, 17 nt, Human
guaagggaaacugccag

SEQ ID NO: 1645142 - RNA, 22 nt, Human
guaaguauucuuauuuaaugaa

SEQ ID NO: 1645143 - RNA, 13 nt, Human
guaaggaaugauu

SEQ ID NO: 1645144 - RNA, 23 nt, Human
guaaggaauaccugucccccuga

SEQ ID NO: 1645145 - RNA, 21 nt, Human
guaaggaauaccugucccccu

SEQ ID NO: 1645146 - RNA, 20 nt, Human
guaaggaauaccuguccccc

SEQ ID NO: 1645147 - RNA, 18 nt, Human
guaaggaauaccuguccc

SEQ ID NO: 1645148 - RNA, 23 nt, Human
guaaauuaacuuuuauaaacuuu

SEQ ID NO: 1645149 - RNA, 23 nt, Human
guaaaaccacagcaguugaaaag

SEQ ID NO: 1645150 - RNA, 18 nt, Human
guaaaaccacagcaguug

SEQ ID NO: 1645151 - RNA, 16 nt, Human
guaaaaccacagcagu

SEQ ID NO: 1645152 - RNA, 15 nt, Human
guaaaaccacagcag

SEQ ID NO: 1645153 - RNA, 14 nt, Human
guaaaaccacagca

SEQ ID NO: 1645154 - RNA, 20 nt, Human
guaaaaacaaagaaauuaug

SEQ ID NO: 1645155 - RNA, 18 nt, Human
guaaaaacaaagaaauua

SEQ ID NO: 1645156 - RNA, 14 nt, Human
guaaaaauaaaauu

SEQ ID NO: 1645157 - RNA, 13 nt, Human
guaaaaauaaaau

SEQ ID NO: 1645158 - RNA, 20 nt, Human
gguuuucacauuggaaacaa

SEQ ID NO: 1645159 - RNA, 12 nt, Human
gguuuucuguuc

SEQ ID NO: 1645160 - RNA, 13 nt, Human
gguuuucuguucu

SEQ ID NO: 1645161 - RNA, 15 nt, Human
gguuuucuguucuuu

SEQ ID NO: 1645162 - RNA, 23 nt, Human
gguuuugccauguuggccaggcu

SEQ ID NO: 1645163 - RNA, 21 nt, Human
gguucaagcgauucuucugcu

SEQ ID NO: 1645164 - RNA, 17 nt, Human
gguggccucccaacuca

SEQ ID NO: 1645165 - RNA, 13 nt, Human
gguggccucccaa

SEQ ID NO: 1645166 - RNA, 20 nt, Human
gguggcccgacagccuggca

SEQ ID NO: 1645167 - RNA, 19 nt, Human
gguggcccgacagccuggc

SEQ ID NO: 1645168 - RNA, 18 nt, Human
gguggcccgacagccugg

SEQ ID NO: 1645169 - RNA, 17 nt, Human
gguggcccgacagccug

SEQ ID NO: 1645170 - RNA, 16 nt, Human
gguggcccgacagccu

SEQ ID NO: 1645171 - RNA, 14 nt, Human
gguugaagcaccaa

SEQ ID NO: 1645172 - RNA, 18 nt, Human
gguucuuucuuccucugc

SEQ ID NO: 1645173 - RNA, 12 nt, Human
gguucagcuugu

SEQ ID NO: 1645174 - RNA, 23 nt, Human
gguucaagcgauucuucugcuuc

SEQ ID NO: 1645175 - RNA, 22 nt, Human
gguucaagcgauucuucugcuu

SEQ ID NO: 1645176 - RNA, 20 nt, Human
gguucacugcaaccuccgcc

SEQ ID NO: 1645177 - RNA, 13 nt, Human
gguuuaagcuguu

SEQ ID NO: 1645178 - RNA, 13 nt, Human
gguuggugggggc

SEQ ID NO: 1645179 - RNA, 18 nt, Human
gguuggcaaaaaggcagg

SEQ ID NO: 1645180 - RNA, 14 nt, Human
gguugggcuggugu

SEQ ID NO: 1645181 - RNA, 22 nt, Human
gguagacacacaugaaguccaa

SEQ ID NO: 1645182 - RNA, 15 nt, Human
gguagacacacauga

SEQ ID NO: 1645183 - RNA, 16 nt, Human
ggucagagccugcagu

SEQ ID NO: 1645184 - RNA, 15 nt, Human
ggucagagccugcag

SEQ ID NO: 1645185 - RNA, 14 nt, Human
ggucagagccugca

SEQ ID NO: 1645186 - RNA, 13 nt, Human
ggucagagccugc

SEQ ID NO: 1645187 - RNA, 12 nt, Human
ggucagagccug

SEQ ID NO: 1645188 - RNA, 22 nt, Human
ggucacucuggcagcucagaga

SEQ ID NO: 1645189 - RNA, 20 nt, Human
ggucacucuggcagcucaga

SEQ ID NO: 1645190 - RNA, 16 nt, Human
ggucacucuggcagcu

SEQ ID NO: 1645191 - RNA, 23 nt, Human
ggucccccuuccauggacuuugu

SEQ ID NO: 1645192 - RNA, 18 nt, Human
ggucccccuuccauggac

SEQ ID NO: 1645193 - RNA, 13 nt, Human
ggucccccuucca

SEQ ID NO: 1645194 - RNA, 14 nt, Human
ggucccacucaguc

SEQ ID NO: 1645195 - RNA, 12 nt, Human
ggucccacucag

SEQ ID NO: 1645196 - RNA, 22 nt, Human
ggucccacucaguccauagcag

SEQ ID NO: 1645197 - RNA, 22 nt, Human
ggucccaccccacacacgccag

SEQ ID NO: 1645198 - RNA, 22 nt, Human
gguacuucaaauccuugaagau

SEQ ID NO: 1645199 - RNA, 21 nt, Human
gguacuuguggacacagcucu

SEQ ID NO: 1645200 - RNA, 22 nt, Human
gguacuuguggacacagcucuu

SEQ ID NO: 1645201 - RNA, 15 nt, Human
ggguugggcuggugu

SEQ ID NO: 1645202 - RNA, 17 nt, Human
gguacccacugcucugg

SEQ ID NO: 1645203 - RNA, 20 nt, Human
ggguuucaccauguuggcca

SEQ ID NO: 1645204 - RNA, 22 nt, Human
ggguucuacccaggugcuagga

SEQ ID NO: 1645205 - RNA, 23 nt, Human
ggguucccuuuuuuggcugcuga

SEQ ID NO: 1645206 - RNA, 19 nt, Human
ggguuggccccugcccggc

SEQ ID NO: 1645207 - RNA, 14 nt, Human
ggguucuuucuucc

SEQ ID NO: 1645208 - RNA, 16 nt, Human
ggguucuuucuuccuc

SEQ ID NO: 1645209 - RNA, 19 nt, Human
gggugcugggccccugccu

SEQ ID NO: 1645210 - RNA, 22 nt, Human
ggguuccagcaauucuccugcc

SEQ ID NO: 1645211 - RNA, 19 nt, Human
ggugcuacaaaaacacagc

SEQ ID NO: 1645212 - RNA, 21 nt, Human
ggugcuacaaaaacacagcaa

SEQ ID NO: 1645213 - RNA, 22 nt, Human
ggugcuaucucccccagcccca

SEQ ID NO: 1645214 - RNA, 23 nt, Human
ggugcuaucucccccagccccau

SEQ ID NO: 1645215 - RNA, 13 nt, Human
gguggcagcugcg

SEQ ID NO: 1645216 - RNA, 12 nt, Human
gguggcagcugc

SEQ ID NO: 1645217 - RNA, 11 nt, Human
gguggcagcug

SEQ ID NO: 1645218 - RNA, 13 nt, Human
gguggcagcucac

SEQ ID NO: 1645219 - RNA, 23 nt, Human
gguggcagcugcgguccacccag

SEQ ID NO: 1645220 - RNA, 15 nt, Human
gguggcagcugcggu

SEQ ID NO: 1645221 - RNA, 16 nt, Human
gguggcagugggagcu

SEQ ID NO: 1645222 - RNA, 19 nt, Human
ggugcccugcuuucagaua

SEQ ID NO: 1645223 - RNA, 22 nt, Human
ggugauagguauaaguggugug

SEQ ID NO: 1645224 - RNA, 21 nt, Human
ggugaccucugccugaaguca

SEQ ID NO: 1645225 - RNA, 16 nt, Human
ggugaccucugccuga

SEQ ID NO: 1645226 - RNA, 14 nt, Human
ggugaccucugccu

SEQ ID NO: 1645227 - RNA, 21 nt, Human
ggugacagagugagacucugu

SEQ ID NO: 1645228 - RNA, 16 nt, Human
ggugaacuugguuccc

SEQ ID NO: 1645229 - RNA, 19 nt, Human
ggucugaggaauccagacc

SEQ ID NO: 1645230 - RNA, 18 nt, Human
ggugaagugaagacaaug

SEQ ID NO: 1645231 - RNA, 20 nt, Human
ggugaauggcuuuguauaga

SEQ ID NO: 1645232 - RNA, 17 nt, Human
ggugaauggcuuuguau

SEQ ID NO: 1645233 - RNA, 14 nt, Human
ggugaauggcuuug

SEQ ID NO: 1645234 - RNA, 16 nt, Human
ggucugacccacugcu

SEQ ID NO: 1645235 - RNA, 15 nt, Human
ggucugacccacugc

SEQ ID NO: 1645236 - RNA, 20 nt, Human
ggucucgaacuccugaccuu

SEQ ID NO: 1645237 - RNA, 19 nt, Human
ggucucgaacuccugaccu

SEQ ID NO: 1645238 - RNA, 16 nt, Human
ggucucacucugucgc

SEQ ID NO: 1645239 - RNA, 12 nt, Human
ggucucacucug

SEQ ID NO: 1645240 - RNA, 22 nt, Human
ggucucacuauguugcccaggc

SEQ ID NO: 1645241 - RNA, 23 nt, Human
gguccuagaaauuccccacccug

SEQ ID NO: 1645242 - RNA, 18 nt, Human
gguccgugcuaaggacuu

SEQ ID NO: 1645243 - RNA, 17 nt, Human
gguccgugcuaaggacu

SEQ ID NO: 1645244 - RNA, 22 nt, Human
ggucccugguggcagcucaccu

SEQ ID NO: 1645245 - RNA, 16 nt, Human
gguccgugcuaaggac

SEQ ID NO: 1645246 - RNA, 14 nt, Human
ggucccugguggca

SEQ ID NO: 1645247 - RNA, 18 nt, Human
ggucccuaauaaagcugu

SEQ ID NO: 1645248 - RNA, 17 nt, Human
ggucccuaauaaagcug

SEQ ID NO: 1645249 - RNA, 16 nt, Human
ggucccuaauaaagcu

SEQ ID NO: 1645250 - RNA, 13 nt, Human
ggucccuaauaaa

SEQ ID NO: 1645251 - RNA, 12 nt, Human
ggucccuaauaa

SEQ ID NO: 1645252 - RNA, 23 nt, Human
gggguucccuuuuuuggcugcug

SEQ ID NO: 1645253 - RNA, 22 nt, Human
gggguucuuucuuccucugcug

SEQ ID NO: 1645254 - RNA, 20 nt, Human
gggguucuuucuuccucugc

SEQ ID NO: 1645255 - RNA, 23 nt, Human
ggguagagcggagaaaggaaggg

SEQ ID NO: 1645256 - RNA, 23 nt, Human
ggguacuuguggacacagcucuu

SEQ ID NO: 1645257 - RNA, 22 nt, Human
ggguacuuguggacacagcucu

SEQ ID NO: 1645258 - RNA, 19 nt, Human
ggguacuuguggacacagc

SEQ ID NO: 1645259 - RNA, 15 nt, Human
ggguacccacugcuc

SEQ ID NO: 1645260 - RNA, 13 nt, Human
ggguacccacugc

SEQ ID NO: 1645261 - RNA, 18 nt, Human
ggguacccacugcucugg

SEQ ID NO: 1645262 - RNA, 17 nt, Human
ggggcugggcagaggaa

SEQ ID NO: 1645263 - RNA, 16 nt, Human
ggggcugggcagagga

SEQ ID NO: 1645264 - RNA, 13 nt, Human
ggggcugggacau

SEQ ID NO: 1645265 - RNA, 18 nt, Human
gggcuucaguggcagcug

SEQ ID NO: 1645266 - RNA, 17 nt, Human
gggcuucaguggcagcu

SEQ ID NO: 1645267 - RNA, 16 nt, Human
gggcuucaguggcagc

SEQ ID NO: 1645268 - RNA, 15 nt, Human
gggcuucaguggcag

SEQ ID NO: 1645269 - RNA, 20 nt, Human
gggcuucaguggcagcugcu

SEQ ID NO: 1645270 - RNA, 19 nt, Human
gggcuucaguggcagcugc

SEQ ID NO: 1645271 - RNA, 19 nt, Human
gggcuucauccuccucaga

SEQ ID NO: 1645272 - RNA, 20 nt, Human
gggcuuggggaccagagcug

SEQ ID NO: 1645273 - RNA, 20 nt, Human
gggcuucauccuccucagau

SEQ ID NO: 1645274 - RNA, 21 nt, Human
gggcuuggggaccagagcugc

SEQ ID NO: 1645275 - RNA, 22 nt, Human
gggcuuggggaccagagcugcc

SEQ ID NO: 1645276 - RNA, 13 nt, Human
ggggaguggccac

SEQ ID NO: 1645277 - RNA, 17 nt, Human
ggggaucacagccucug

SEQ ID NO: 1645278 - RNA, 21 nt, Human
ggcucccacaggcccuuccuc

SEQ ID NO: 1645279 - RNA, 20 nt, Human
ggcucccacaggcccuuccu

SEQ ID NO: 1645280 - RNA, 12 nt, Human
gggccuggcuca

SEQ ID NO: 1645281 - RNA, 12 nt, Human
gggccuggccug

SEQ ID NO: 1645282 - RNA, 22 nt, Human
gggccuggcagccgugccuuca

SEQ ID NO: 1645283 - RNA, 10 nt, Human
gggccuggca

SEQ ID NO: 1645284 - RNA, 16 nt, Human
gggccuggcucaggug

SEQ ID NO: 1645285 - RNA, 14 nt, Human
gggccuggcucagg

SEQ ID NO: 1645286 - RNA, 18 nt, Human
gggccuggucguuuucaa

SEQ ID NO: 1645287 - RNA, 23 nt, Human
gggcucccuucccaccucucuca

SEQ ID NO: 1645288 - RNA, 18 nt, Human
gggcucccuucccaccuc

SEQ ID NO: 1645289 - RNA, 17 nt, Human
gggcucccuucccaccu

SEQ ID NO: 1645290 - RNA, 14 nt, Human
gggcucccuuccca

SEQ ID NO: 1645291 - RNA, 13 nt, Human
gggcucccuuccc

SEQ ID NO: 1645292 - RNA, 16 nt, Human
gggcgcgguggcucac

SEQ ID NO: 1645293 - RNA, 14 nt, Human
gggcugcaccggcu

SEQ ID NO: 1645294 - RNA, 16 nt, Human
gggcugaggugggagg

SEQ ID NO: 1645295 - RNA, 17 nt, Human
gggcugcaccggcuggc

SEQ ID NO: 1645296 - RNA, 14 nt, Human
gggcuucaguggca

SEQ ID NO: 1645297 - RNA, 20 nt, Human
gggcucugccucccaucacc

SEQ ID NO: 1645298 - RNA, 17 nt, Human
gggcucugccucccauc

SEQ ID NO: 1645299 - RNA, 16 nt, Human
gggcucugccucccau

SEQ ID NO: 1645300 - RNA, 15 nt, Human
gggcucugccuccca

SEQ ID NO: 1645301 - RNA, 13 nt, Human
gggcucugccucc

SEQ ID NO: 1645302 - RNA, 22 nt, Human
guauuucuaugaaauauuaugu

SEQ ID NO: 1645303 - RNA, 17 nt, Human
guauuucuaugaaauau

SEQ ID NO: 1645304 - RNA, 19 nt, Human
guauuuauuuaguauuuau

SEQ ID NO: 1645305 - RNA, 14 nt, Human
guauuauaccuuuu

SEQ ID NO: 1645306 - RNA, 15 nt, Human
guauuauguguguuu

SEQ ID NO: 1645307 - RNA, 15 nt, Human
guauuacuucugcua

SEQ ID NO: 1645308 - RNA, 14 nt, Human
guauuacuucugcu

SEQ ID NO: 1645309 - RNA, 13 nt, Human
guauuacuucugc

SEQ ID NO: 1645310 - RNA, 22 nt, Human
guauuacaguggggaaugaaga

SEQ ID NO: 1645311 - RNA, 13 nt, Human
guagagugggagc

SEQ ID NO: 1645312 - RNA, 15 nt, Human
guagagugggagcug

SEQ ID NO: 1645313 - RNA, 20 nt, Human
guauuacaguggggaaugaa

SEQ ID NO: 1645314 - RNA, 18 nt, Human
guauuuuaaaagaaugau

SEQ ID NO: 1645315 - RNA, 19 nt, Human
gucaagagggucugaggaa

SEQ ID NO: 1645316 - RNA, 18 nt, Human
gucaagagggucugagga

SEQ ID NO: 1645317 - RNA, 17 nt, Human
guauuuuaaaagaauga

SEQ ID NO: 1645318 - RNA, 16 nt, Human
guauuuuaaaagaaug

SEQ ID NO: 1645319 - RNA, 18 nt, Human
gucaagugaaaaaggagg

SEQ ID NO: 1645320 - RNA, 16 nt, Human
gucaagugaaaaagga

SEQ ID NO: 1645321 - RNA, 19 nt, Human
gucaagugaaaaaggagga

SEQ ID NO: 1645322 - RNA, 21 nt, Human
gucaauaaaauccauacauuu

SEQ ID NO: 1645323 - RNA, 15 nt, Human
gucaauaaaauccau

SEQ ID NO: 1645324 - RNA, 15 nt, Human
gucaauuacaggaag

SEQ ID NO: 1645325 - RNA, 13 nt, Human
gucaauuacagga

SEQ ID NO: 1645326 - RNA, 16 nt, Human
gucaauuacaggaagu

SEQ ID NO: 1645327 - RNA, 14 nt, Human
gucaccucauggaa

SEQ ID NO: 1645328 - RNA, 20 nt, Human
gucaccugaagacucauucu

SEQ ID NO: 1645329 - RNA, 15 nt, Human
gucaccccggccacc

SEQ ID NO: 1645330 - RNA, 13 nt, Human
gucaccccggcca

SEQ ID NO: 1645331 - RNA, 20 nt, Human
gucccagccagcaguucaga

SEQ ID NO: 1645332 - RNA, 17 nt, Human
gucccagauacuugggg

SEQ ID NO: 1645333 - RNA, 15 nt, Human
gucccacucagucca

SEQ ID NO: 1645334 - RNA, 14 nt, Human
gucccacucagucc

SEQ ID NO: 1645335 - RNA, 16 nt, Human
guccacccaggagccc

SEQ ID NO: 1645336 - RNA, 15 nt, Human
guccacccaggagcc

SEQ ID NO: 1645337 - RNA, 14 nt, Human
guccacccaggagc

SEQ ID NO: 1645338 - RNA, 21 nt, Human
gucauauaagauucauauuua

SEQ ID NO: 1645339 - RNA, 16 nt, Human
gucaucucagcuggau

SEQ ID NO: 1645340 - RNA, 21 nt, Human
gucugaggaauccagacccgg

SEQ ID NO: 1645341 - RNA, 19 nt, Human
gucugauucccaagcucug

SEQ ID NO: 1645342 - RNA, 18 nt, Human
gucugauucccaagcucu

SEQ ID NO: 1645343 - RNA, 17 nt, Human
gucugauucccaagcuc

SEQ ID NO: 1645344 - RNA, 21 nt, Human
gucugauucccaagcucugcu

SEQ ID NO: 1645345 - RNA, 20 nt, Human
gucugauucccaagcucugc

SEQ ID NO: 1645346 - RNA, 19 nt, Human
gucugaggaauccagaccc

SEQ ID NO: 1645347 - RNA, 18 nt, Human
gucugaggaauccagacc

SEQ ID NO: 1645348 - RNA, 15 nt, Human
gucugacccacugcu

SEQ ID NO: 1645349 - RNA, 17 nt, Human
gucucuucuccacugga

SEQ ID NO: 1645350 - RNA, 14 nt, Human
gucugacccacugc

SEQ ID NO: 1645351 - RNA, 13 nt, Human
gucugacccacug

SEQ ID NO: 1645352 - RNA, 14 nt, Human
gucucuucuccacu

SEQ ID NO: 1645353 - RNA, 16 nt, Human
gucucuucuccacugg

SEQ ID NO: 1645354 - RNA, 15 nt, Human
gucucuucuccacug

SEQ ID NO: 1645355 - RNA, 23 nt, Human
gucuacacuaagagagaaugaga

SEQ ID NO: 1645356 - RNA, 15 nt, Human
gucuacacugugcug

SEQ ID NO: 1645357 - RNA, 17 nt, Human
gucuacacuaagagaga

SEQ ID NO: 1645358 - RNA, 17 nt, Human
guccuuaccagcagagc

SEQ ID NO: 1645359 - RNA, 16 nt, Human
guccuuaccagcagag

SEQ ID NO: 1645360 - RNA, 15 nt, Human
guccuuaccagcaga

SEQ ID NO: 1645361 - RNA, 18 nt, Human
guccuuaccagcagagca

SEQ ID NO: 1645362 - RNA, 19 nt, Human
gucucacuguugcccaggc

SEQ ID NO: 1645363 - RNA, 18 nt, Human
gucucacuguugcccagg

SEQ ID NO: 1645364 - RNA, 17 nt, Human
gucucacuguugcccag

SEQ ID NO: 1645365 - RNA, 16 nt, Human
gucucacuguugccca

SEQ ID NO: 1645366 - RNA, 23 nt, Human
gucucacuauguugcccaggcag

SEQ ID NO: 1645367 - RNA, 13 nt, Human
gucucacuguugc

SEQ ID NO: 1645368 - RNA, 21 nt, Human
gucucacuauguugcccaggc

SEQ ID NO: 1645369 - RNA, 20 nt, Human
gucucacuauguugcccagg

SEQ ID NO: 1645370 - RNA, 23 nt, Human
gucucacuguugcccaggcuggc

SEQ ID NO: 1645371 - RNA, 22 nt, Human
gucucacuguugcccaggcugg

SEQ ID NO: 1645372 - RNA, 21 nt, Human
gucucacuguugcccaggcug

SEQ ID NO: 1645373 - RNA, 20 nt, Human
gucucacuguugcccaggcu

SEQ ID NO: 1645374 - RNA, 11 nt, Human
gucucacucug

SEQ ID NO: 1645375 - RNA, 13 nt, Human
gucuaccugaggg

SEQ ID NO: 1645376 - RNA, 13 nt, Human
gucucagauuuua

SEQ ID NO: 1645377 - RNA, 12 nt, Human
gucccagugccg

SEQ ID NO: 1645378 - RNA, 17 nt, Human
gucccugguggcagcuc

SEQ ID NO: 1645379 - RNA, 16 nt, Human
gucccugguggcagcu

SEQ ID NO: 1645380 - RNA, 23 nt, Human
guccuacucugugucaggugggg

SEQ ID NO: 1645381 - RNA, 15 nt, Human
guccuacucuguguc

SEQ ID NO: 1645382 - RNA, 23 nt, Human
guccuagaaauuccccacccuga

SEQ ID NO: 1645383 - RNA, 20 nt, Human
guccuggggaaccugacccc

SEQ ID NO: 1645384 - RNA, 19 nt, Human
guccuggggaaccugaccc

SEQ ID NO: 1645385 - RNA, 18 nt, Human
guccugggagugagcugg

SEQ ID NO: 1645386 - RNA, 17 nt, Human
guccugggagugagcug

SEQ ID NO: 1645387 - RNA, 19 nt, Human
guccugggagugagcuggu

SEQ ID NO: 1645388 - RNA, 17 nt, Human
guccuggcaugggaaug

SEQ ID NO: 1645389 - RNA, 16 nt, Human
guccugggagugagcu

SEQ ID NO: 1645390 - RNA, 15 nt, Human
guccugggagugagc

SEQ ID NO: 1645391 - RNA, 23 nt, Human
guccucccaucucacacaugagc

SEQ ID NO: 1645392 - RNA, 14 nt, Human
guccucccaucuca

SEQ ID NO: 1645393 - RNA, 13 nt, Human
guccucccaucuc

SEQ ID NO: 1645394 - RNA, 12 nt, Human
guccucccaucu

SEQ ID NO: 1645395 - RNA, 19 nt, Human
gugaaaggaaagagggagg

SEQ ID NO: 1645396 - RNA, 13 nt, Human
gugaaaucauuca

SEQ ID NO: 1645397 - RNA, 20 nt, Human
gugaaauuauucauaauuau

SEQ ID NO: 1645398 - RNA, 18 nt, Human
gugaaauuauucauaauu

SEQ ID NO: 1645399 - RNA, 14 nt, Human
gugaaucagagcac

SEQ ID NO: 1645400 - RNA, 14 nt, Human
gugaauggcuuugu

SEQ ID NO: 1645401 - RNA, 13 nt, Human
gugaauggcuuug

SEQ ID NO: 1645402 - RNA, 19 nt, Human
gugaauggcuuuguauaga

SEQ ID NO: 1645403 - RNA, 18 nt, Human
gugaauggcuuuguauag

SEQ ID NO: 1645404 - RNA, 17 nt, Human
gugaauggcuuuguaua

SEQ ID NO: 1645405 - RNA, 16 nt, Human
gugaaaaugugugugu

SEQ ID NO: 1645406 - RNA, 23 nt, Human
gugaaaagaaaaaugagccuggc

SEQ ID NO: 1645407 - RNA, 14 nt, Human
gugaaaagaaaaau

SEQ ID NO: 1645408 - RNA, 20 nt, Human
gugaaacucguuaauuugua

SEQ ID NO: 1645409 - RNA, 12 nt, Human
gugaaacuggau

SEQ ID NO: 1645410 - RNA, 19 nt, Human
gugaaagaaaauaacaaua

SEQ ID NO: 1645411 - RNA, 16 nt, Human
gugagcagucaggaaa

SEQ ID NO: 1645412 - RNA, 17 nt, Human
gugagcaggcugugagu

SEQ ID NO: 1645413 - RNA, 17 nt, Human
gugacugaucucucgug

SEQ ID NO: 1645414 - RNA, 13 nt, Human
gugagccacugca

SEQ ID NO: 1645415 - RNA, 21 nt, Human
gugagccaccgugccuggcca

SEQ ID NO: 1645416 - RNA, 17 nt, Human
gugagccaccgugccug

SEQ ID NO: 1645417 - RNA, 15 nt, Human
gugagccaccacgcc

SEQ ID NO: 1645418 - RNA, 15 nt, Human
gugagccaccgugcc

SEQ ID NO: 1645419 - RNA, 16 nt, Human
gugagccaccacgccc

SEQ ID NO: 1645420 - RNA, 19 nt, Human
gugaggaagccgcuggggc

SEQ ID NO: 1645421 - RNA, 16 nt, Human
gugaggaagccgcugg

SEQ ID NO: 1645422 - RNA, 11 nt, Human
gugaggaagcc

SEQ ID NO: 1645423 - RNA, 14 nt, Human
gugagccacugcac

SEQ ID NO: 1645424 - RNA, 22 nt, Human
gugagccaccgugccuggccac

SEQ ID NO: 1645425 - RNA, 16 nt, Human
gugacaagcucacaga

SEQ ID NO: 1645426 - RNA, 16 nt, Human
gugacaacacuugugu

SEQ ID NO: 1645427 - RNA, 12 nt, Human
gugaccucugcc

SEQ ID NO: 1645428 - RNA, 16 nt, Human
gugaccucagcuuuga

SEQ ID NO: 1645429 - RNA, 16 nt, Human
gugacugaauuucuuu

SEQ ID NO: 1645430 - RNA, 18 nt, Human
gugacugaauuucuuuug

SEQ ID NO: 1645431 - RNA, 15 nt, Human
gugacugaauuucuu

SEQ ID NO: 1645432 - RNA, 18 nt, Human
gugcaaauugucacagga

SEQ ID NO: 1645433 - RNA, 22 nt, Human
gugcaaaguucccuacuuccug

SEQ ID NO: 1645434 - RNA, 19 nt, Human
gugcauaaguuaacuucca

SEQ ID NO: 1645435 - RNA, 22 nt, Human
gugccagguuuuuggucugacc

SEQ ID NO: 1645436 - RNA, 22 nt, Human
gugcaugcugucccuuacguga

SEQ ID NO: 1645437 - RNA, 20 nt, Human
gugccagguuuuuggucuga

SEQ ID NO: 1645438 - RNA, 18 nt, Human
gugcaucucagcccacau

SEQ ID NO: 1645439 - RNA, 18 nt, Human
gugcaugcagcaucuaag

SEQ ID NO: 1645440 - RNA, 13 nt, Human
gugcauaccacuu

SEQ ID NO: 1645441 - RNA, 14 nt, Human
gugcauaccacuuu

SEQ ID NO: 1645442 - RNA, 21 nt, Human
gugcauaccacuuuuguucuu

SEQ ID NO: 1645443 - RNA, 15 nt, Human
gugcaucucagccca

SEQ ID NO: 1645444 - RNA, 20 nt, Human
gugcccacaggaucagucug

SEQ ID NO: 1645445 - RNA, 20 nt, Human
gugauccacccaccucagcc

SEQ ID NO: 1645446 - RNA, 18 nt, Human
gugauccacccaccucag

SEQ ID NO: 1645447 - RNA, 15 nt, Human
gugauccacccaccu

SEQ ID NO: 1645448 - RNA, 13 nt, Human
gugaggccagaga

SEQ ID NO: 1645449 - RNA, 11 nt, Human
gugaggccaga

SEQ ID NO: 1645450 - RNA, 23 nt, Human
gugaggauuaaauaauguaaaua

SEQ ID NO: 1645451 - RNA, 18 nt, Human
gugauccucccaccucag

SEQ ID NO: 1645452 - RNA, 15 nt, Human
gugauccucccaccu

SEQ ID NO: 1645453 - RNA, 14 nt, Human
gugauccucccacc

SEQ ID NO: 1645454 - RNA, 22 nt, Human
gugauccacccaccucagccuc

SEQ ID NO: 1645455 - RNA, 14 nt, Human
gugauccacucgcc

SEQ ID NO: 1645456 - RNA, 22 nt, Human
gugauccucccaccucagccuc

SEQ ID NO: 1645457 - RNA, 20 nt, Human
gugauccucccaccucagcc

SEQ ID NO: 1645458 - RNA, 23 nt, Human
gugauccucccaccucagccucc

SEQ ID NO: 1645459 - RNA, 20 nt, Human
gugauucacagugugaaucu

SEQ ID NO: 1645460 - RNA, 23 nt, Human
gugauucuccugccucagccucc

SEQ ID NO: 1645461 - RNA, 22 nt, Human
gugauucuccugccucagccuc

SEQ ID NO: 1645462 - RNA, 20 nt, Human
gugauucuccugccucagcc

SEQ ID NO: 1645463 - RNA, 19 nt, Human
gugauucuccugccucagc

SEQ ID NO: 1645464 - RNA, 18 nt, Human
gugauucuccugccucag

SEQ ID NO: 1645465 - RNA, 17 nt, Human
gugauucuccugccuca

SEQ ID NO: 1645466 - RNA, 16 nt, Human
gugauucuccugccuc

SEQ ID NO: 1645467 - RNA, 14 nt, Human
gugauucuccugcc

SEQ ID NO: 1645468 - RNA, 20 nt, Human
gugauucucaugccucagcc

SEQ ID NO: 1645469 - RNA, 21 nt, Human
gugccuuggggacaagagcag

SEQ ID NO: 1645470 - RNA, 22 nt, Human
gugccgagaaggaagccuccca

SEQ ID NO: 1645471 - RNA, 16 nt, Human
gugcucuggacaggca

SEQ ID NO: 1645472 - RNA, 15 nt, Human
gugcucuggacaggc

SEQ ID NO: 1645473 - RNA, 20 nt, Human
gugcugaaugguuuucaaaa

SEQ ID NO: 1645474 - RNA, 19 nt, Human
gugcugaaugguuuucaaa

SEQ ID NO: 1645475 - RNA, 23 nt, Human
gugcugaaugguuuucaaaauaa

SEQ ID NO: 1645476 - RNA, 18 nt, Human
gugcucuggacaggcaug

SEQ ID NO: 1645477 - RNA, 17 nt, Human
gugcucuggacaggcau

SEQ ID NO: 1645478 - RNA, 19 nt, Human
gugcugagucugaaggcug

SEQ ID NO: 1645479 - RNA, 18 nt, Human
gugcugagucugaaggcu

SEQ ID NO: 1645480 - RNA, 17 nt, Human
gugcugagucugaaggc

SEQ ID NO: 1645481 - RNA, 16 nt, Human
gugcugagucugaagg

SEQ ID NO: 1645482 - RNA, 12 nt, Human
gugcugagucug

SEQ ID NO: 1645483 - RNA, 19 nt, Human
gugcugccauccagguuca

SEQ ID NO: 1645484 - RNA, 18 nt, Human
gugcugccauccagguuc

SEQ ID NO: 1645485 - RNA, 15 nt, Human
gugcugccauccagg

SEQ ID NO: 1645486 - RNA, 12 nt, Human
gugcugccacac

SEQ ID NO: 1645487 - RNA, 12 nt, Human
gugcugcauuua

SEQ ID NO: 1645488 - RNA, 19 nt, Human
gugcugcauuuaaaagaua

SEQ ID NO: 1645489 - RNA, 20 nt, Human
gugcugcauuuaaaagauac

SEQ ID NO: 1645490 - RNA, 18 nt, Human
guggaaaaauagccugcc

SEQ ID NO: 1645491 - RNA, 12 nt, Human
gugcugcccugc

SEQ ID NO: 1645492 - RNA, 11 nt, Human
gugcugcccug

SEQ ID NO: 1645493 - RNA, 22 nt, Human
gugcugccauccagguucagcu

SEQ ID NO: 1645494 - RNA, 21 nt, Human
gugcugccacacuucaggcuc

SEQ ID NO: 1645495 - RNA, 15 nt, Human
gugcuuggaggaagg

SEQ ID NO: 1645496 - RNA, 13 nt, Human
gugcuuggaggaa

SEQ ID NO: 1645497 - RNA, 12 nt, Human
gugcuuggagga

SEQ ID NO: 1645498 - RNA, 18 nt, Human
gugcuuauguaugaggua

SEQ ID NO: 1645499 - RNA, 17 nt, Human
guggaguucaucuugaa

SEQ ID NO: 1645500 - RNA, 18 nt, Human
guggaugccugguggcag

SEQ ID NO: 1645501 - RNA, 16 nt, Human
guggaugccugguggc

SEQ ID NO: 1645502 - RNA, 20 nt, Human
guggagaagcggcuggcagc

SEQ ID NO: 1645503 - RNA, 13 nt, Human
guggacuuuuauu

SEQ ID NO: 1645504 - RNA, 18 nt, Human
guggagaggcccggccuc

SEQ ID NO: 1645505 - RNA, 19 nt, Human
guggcagcugcuuuugucu

SEQ ID NO: 1645506 - RNA, 13 nt, Human
guggcagcugcuu

SEQ ID NO: 1645507 - RNA, 12 nt, Human
guggcagcugcu

SEQ ID NO: 1645508 - RNA, 23 nt, Human
guggcagcugcgguccacccagg

SEQ ID NO: 1645509 - RNA, 22 nt, Human
guggcagcugcgguccacccag

SEQ ID NO: 1645510 - RNA, 21 nt, Human
guggcagcugcgguccaccca

SEQ ID NO: 1645511 - RNA, 20 nt, Human
guggaugccugguggcagcu

SEQ ID NO: 1645512 - RNA, 17 nt, Human
guggcagugggagcugc

SEQ ID NO: 1645513 - RNA, 16 nt, Human
guggcagugggagcug

SEQ ID NO: 1645514 - RNA, 15 nt, Human
guggcagugggagcu

SEQ ID NO: 1645515 - RNA, 11 nt, Human
guggcagucug

SEQ ID NO: 1645516 - RNA, 21 nt, Human
guggcagugggagcugccugu

SEQ ID NO: 1645517 - RNA, 19 nt, Human
guggcagugggagcugccu

SEQ ID NO: 1645518 - RNA, 21 nt, Human
guggccacuccagaccccugg

SEQ ID NO: 1645519 - RNA, 19 nt, Human
uaugaccacacuccagcug

SEQ ID NO: 1645520 - RNA, 14 nt, Human
uaugaccacacucc

SEQ ID NO: 1645521 - RNA, 22 nt, Human
uaugacacaugcaaggucauuu

SEQ ID NO: 1645522 - RNA, 12 nt, Human
uaugacacaugc

SEQ ID NO: 1645523 - RNA, 23 nt, Human
uaugaauuacauuuguauaaaau

SEQ ID NO: 1645524 - RNA, 17 nt, Human
uaugaauuacauuugua

SEQ ID NO: 1645525 - RNA, 23 nt, Human
uaucugucauuugagcagggcuc

SEQ ID NO: 1645526 - RNA, 21 nt, Human
uaucugucauuugagcagggc

SEQ ID NO: 1645527 - RNA, 20 nt, Human
uaucugucauuugagcaggg

SEQ ID NO: 1645528 - RNA, 14 nt, Human
uaucuugaagacuu

SEQ ID NO: 1645529 - RNA, 18 nt, Human
uaugaauaaagacaccua

SEQ ID NO: 1645530 - RNA, 20 nt, Human
uaugaaguuuuuuuuauaca

SEQ ID NO: 1645531 - RNA, 14 nt, Human
uauccuucagccug

SEQ ID NO: 1645532 - RNA, 15 nt, Human
uauccuucagccuga

SEQ ID NO: 1645533 - RNA, 18 nt, Human
uaucguaaaauuaagaaa

SEQ ID NO: 1645534 - RNA, 15 nt, Human
uaucguaaaauuaag

SEQ ID NO: 1645535 - RNA, 19 nt, Human
uauauguuuuaagaggcag

SEQ ID NO: 1645536 - RNA, 16 nt, Human
uaucgucacugcuuaa

SEQ ID NO: 1645537 - RNA, 21 nt, Human
uaucuaauauguaacaagcca

SEQ ID NO: 1645538 - RNA, 17 nt, Human
uaucugaggaauucugu

SEQ ID NO: 1645539 - RNA, 22 nt, Human
uaucugaggaauucuguauaga

SEQ ID NO: 1645540 - RNA, 21 nt, Human
uaucugaggaauucuguauag

SEQ ID NO: 1645541 - RNA, 19 nt, Human
uaucugaggaauucuguau

SEQ ID NO: 1645542 - RNA, 18 nt, Human
uaucugaggaauucugua

SEQ ID NO: 1645543 - RNA, 16 nt, Human
uaugcuucuguuuuau

SEQ ID NO: 1645544 - RNA, 15 nt, Human
uaugcuucuguuuua

SEQ ID NO: 1645545 - RNA, 22 nt, Human
uaugcuuauacacuuacacuuu

SEQ ID NO: 1645546 - RNA, 13 nt, Human
uaugcaugaagua

SEQ ID NO: 1645547 - RNA, 18 nt, Human
uaugcaugaaguaauaug

SEQ ID NO: 1645548 - RNA, 20 nt, Human
uaugcauauuauuuuauguu

SEQ ID NO: 1645549 - RNA, 18 nt, Human
uaugcagagguccacaac

SEQ ID NO: 1645550 - RNA, 17 nt, Human
uauggacaaugacccag

SEQ ID NO: 1645551 - RNA, 19 nt, Human
uauggaacacucugagacu

SEQ ID NO: 1645552 - RNA, 18 nt, Human
uauggaacacucugagac

SEQ ID NO: 1645553 - RNA, 17 nt, Human
uauggaacacucugaga

SEQ ID NO: 1645554 - RNA, 16 nt, Human
uauggaacacucugag

SEQ ID NO: 1645555 - RNA, 13 nt, Human
uauggaacacucu

SEQ ID NO: 1645556 - RNA, 14 nt, Human
uaugcaaagcacug

SEQ ID NO: 1645557 - RNA, 13 nt, Human
uaugcaaagcacu

SEQ ID NO: 1645558 - RNA, 12 nt, Human
uaugcaaagcac

SEQ ID NO: 1645559 - RNA, 18 nt, Human
uaugauuuggaaaauaaa

SEQ ID NO: 1645560 - RNA, 17 nt, Human
uaugauuuggaaaauaa

SEQ ID NO: 1645561 - RNA, 15 nt, Human
uaugauuuggaaaau

SEQ ID NO: 1645562 - RNA, 15 nt, Human
uaugcaaagcacuga

SEQ ID NO: 1645563 - RNA, 18 nt, Human
uaugcaaucaaaucugcu

SEQ ID NO: 1645564 - RNA, 13 nt, Human
uaugcacacauuu

SEQ ID NO: 1645565 - RNA, 14 nt, Human
uaugcacacauuuu

SEQ ID NO: 1645566 - RNA, 16 nt, Human
uaugauucccagccag

SEQ ID NO: 1645567 - RNA, 21 nt, Human
uaugauucaaaugucuauaaa

SEQ ID NO: 1645568 - RNA, 16 nt, Human
uaugauucaaaugucu

SEQ ID NO: 1645569 - RNA, 16 nt, Human
uaugacuccagaauuu

SEQ ID NO: 1645570 - RNA, 23 nt, Human
uaugacuccagaauuucccaaag

SEQ ID NO: 1645571 - RNA, 17 nt, Human
uaugacuccagaauuuc

SEQ ID NO: 1645572 - RNA, 16 nt, Human
uaguauuucuaugaaa

SEQ ID NO: 1645573 - RNA, 19 nt, Human
uaguauuucuaugaaauau

SEQ ID NO: 1645574 - RNA, 18 nt, Human
uaguauuucuaugaaaua

SEQ ID NO: 1645575 - RNA, 15 nt, Human
uaguaugaggcauuu

SEQ ID NO: 1645576 - RNA, 18 nt, Human
uaggugcuacaaaaacac

SEQ ID NO: 1645577 - RNA, 23 nt, Human
uaggugacagagugagacucugu

SEQ ID NO: 1645578 - RNA, 21 nt, Human
uaggugauccacucgccuuca

SEQ ID NO: 1645579 - RNA, 13 nt, Human
uaguaucaaaaga

SEQ ID NO: 1645580 - RNA, 15 nt, Human
uagugcaaauuguca

SEQ ID NO: 1645581 - RNA, 14 nt, Human
uagugcaaauuguc

SEQ ID NO: 1645582 - RNA, 14 nt, Human
uagucaaauugugu

SEQ ID NO: 1645583 - RNA, 13 nt, Human
uagucaaauugug

SEQ ID NO: 1645584 - RNA, 20 nt, Human
uaguugcaacuuuguauaaa

SEQ ID NO: 1645585 - RNA, 13 nt, Human
uaguguucauaaa

SEQ ID NO: 1645586 - RNA, 18 nt, Human
uaggccaugggacaggga

SEQ ID NO: 1645587 - RNA, 18 nt, Human
uaggccuggccagaugca

SEQ ID NO: 1645588 - RNA, 17 nt, Human
uaggccguuccuucaaa

SEQ ID NO: 1645589 - RNA, 15 nt, Human
uaggccuggccagau

SEQ ID NO: 1645590 - RNA, 12 nt, Human
uaggaauugacc

SEQ ID NO: 1645591 - RNA, 16 nt, Human
uaggucagugcaaaua

SEQ ID NO: 1645592 - RNA, 15 nt, Human
uaggucucaauaccu

SEQ ID NO: 1645593 - RNA, 16 nt, Human
uagguaaauuacaguu

SEQ ID NO: 1645594 - RNA, 20 nt, Human
uagguauaaguggugugugu

SEQ ID NO: 1645595 - RNA, 21 nt, Human
uagggaaaaaccagcguguga

SEQ ID NO: 1645596 - RNA, 20 nt, Human
uagggaaaaaccagcgugug

SEQ ID NO: 1645597 - RNA, 19 nt, Human
uagggaaaaaccagcgugu

SEQ ID NO: 1645598 - RNA, 13 nt, Human
uauaugcuucugu

SEQ ID NO: 1645599 - RNA, 21 nt, Human
uauaugcucugcauguuacau

SEQ ID NO: 1645600 - RNA, 13 nt, Human
uauauaacaaugc

SEQ ID NO: 1645601 - RNA, 22 nt, Human
uauaucugaggaauucuguaua

SEQ ID NO: 1645602 - RNA, 21 nt, Human
uauaucugaggaauucuguau

SEQ ID NO: 1645603 - RNA, 20 nt, Human
uauaucugaggaauucugua

SEQ ID NO: 1645604 - RNA, 19 nt, Human
uauaucugaggaauucugu

SEQ ID NO: 1645605 - RNA, 18 nt, Human
uauaucugaggaauucug

SEQ ID NO: 1645606 - RNA, 20 nt, Human
uauaauucacauuguauuca

SEQ ID NO: 1645607 - RNA, 15 nt, Human
uauaauucacauugu

SEQ ID NO: 1645608 - RNA, 22 nt, Human
uauaauuaacauguuaaaccau

SEQ ID NO: 1645609 - RNA, 12 nt, Human
uauaauuaacau

SEQ ID NO: 1645610 - RNA, 14 nt, Human
uauaauuaacaugu

SEQ ID NO: 1645611 - RNA, 13 nt, Human
uauaauuaacaug

SEQ ID NO: 1645612 - RNA, 19 nt, Human
uauaauuaacauguuaaac

SEQ ID NO: 1645613 - RNA, 18 nt, Human
uauaauuaacauguuaaa

SEQ ID NO: 1645614 - RNA, 16 nt, Human
uauaauuaacauguua

SEQ ID NO: 1645615 - RNA, 15 nt, Human
uauaauuaacauguu

SEQ ID NO: 1645616 - RNA, 17 nt, Human
ucaaauaugcaaagcac

SEQ ID NO: 1645617 - RNA, 23 nt, Human
ucaaagagguuuuaaaaaaaucc

SEQ ID NO: 1645618 - RNA, 12 nt, Human
ucaaagagguuu

SEQ ID NO: 1645619 - RNA, 19 nt, Human
ucaaauaugcaaagcacug

SEQ ID NO: 1645620 - RNA, 18 nt, Human
ucaaauaugcaaagcacu

SEQ ID NO: 1645621 - RNA, 16 nt, Human
ucaaauccuugaagau

SEQ ID NO: 1645622 - RNA, 17 nt, Human
ucaaacauauauaacaa

SEQ ID NO: 1645623 - RNA, 22 nt, Human
ucaaacagucucaggaaaucaa

SEQ ID NO: 1645624 - RNA, 20 nt, Human
ucaaaccccgaccaccugcc

SEQ ID NO: 1645625 - RNA, 19 nt, Human
ucaaaccccgaccaccugc

SEQ ID NO: 1645626 - RNA, 23 nt, Human
ucaaaccccgaccaccugcccaa

SEQ ID NO: 1645627 - RNA, 22 nt, Human
ucaacuccaaacugacucuuaa

SEQ ID NO: 1645628 - RNA, 22 nt, Human
ucaacucccugccccccagccc

SEQ ID NO: 1645629 - RNA, 21 nt, Human
ucaacucccugccccccagcc

SEQ ID NO: 1645630 - RNA, 15 nt, Human
ucaacucccugcccc

SEQ ID NO: 1645631 - RNA, 14 nt, Human
ucaacucccugccc

SEQ ID NO: 1645632 - RNA, 20 nt, Human
ucaacucuccuccagaguca

SEQ ID NO: 1645633 - RNA, 18 nt, Human
ucaacugaccagccucca

SEQ ID NO: 1645634 - RNA, 24 nt, Human
ucaacugaccagccuccaugcugc

SEQ ID NO: 1645635 - RNA, 19 nt, Human
ucaaccccuucgcuccugu

SEQ ID NO: 1645636 - RNA, 18 nt, Human
ucaaccccuucgcuccug

SEQ ID NO: 1645637 - RNA, 15 nt, Human
ucaaccuccugggcu

SEQ ID NO: 1645638 - RNA, 20 nt, Human
ucaaccccuucgcuccugug

SEQ ID NO: 1645639 - RNA, 16 nt, Human
ucaaccuccugggcua

SEQ ID NO: 1645640 - RNA, 20 nt, Human
ucaagccaccaacauacucc

SEQ ID NO: 1645641 - RNA, 12 nt, Human
ucaagccaccaa

SEQ ID NO: 1645642 - RNA, 19 nt, Human
ucaagcgauucuucugcuu

SEQ ID NO: 1645643 - RNA, 18 nt, Human
ucaagcgauucuucugcu

SEQ ID NO: 1645644 - RNA, 21 nt, Human
ucaagcgauucuucugcuuca

SEQ ID NO: 1645645 - RNA, 16 nt, Human
ucaaggauccugagcc

SEQ ID NO: 1645646 - RNA, 15 nt, Human
ucaaggauccugagc

SEQ ID NO: 1645647 - RNA, 17 nt, Human
ucaaggauccugagcca

SEQ ID NO: 1645648 - RNA, 13 nt, Human
ucaauaaaaaauu

SEQ ID NO: 1645649 - RNA, 16 nt, Human
ucaauaaaaaauuaug

SEQ ID NO: 1645650 - RNA, 14 nt, Human
ucaauaaaaaauua

SEQ ID NO: 1645651 - RNA, 14 nt, Human
ucaaggauccugag

SEQ ID NO: 1645652 - RNA, 13 nt, Human
ucaaggauccuga

SEQ ID NO: 1645653 - RNA, 12 nt, Human
ucacauuuaaau

SEQ ID NO: 1645654 - RNA, 17 nt, Human
ucacauuggaaacaagu

SEQ ID NO: 1645655 - RNA, 18 nt, Human
ucacauugguguuguacu

SEQ ID NO: 1645656 - RNA, 22 nt, Human
ucacauuguauucagaguugau

SEQ ID NO: 1645657 - RNA, 18 nt, Human
ucaccaacgucugugcca

SEQ ID NO: 1645658 - RNA, 17 nt, Human
ucaccaacgucugugcc

SEQ ID NO: 1645659 - RNA, 14 nt, Human
ucacauuuauucug

SEQ ID NO: 1645660 - RNA, 18 nt, Human
ucacccgcuaagagggag

SEQ ID NO: 1645661 - RNA, 13 nt, Human
ucaccaagcccag

SEQ ID NO: 1645662 - RNA, 14 nt, Human
ucaccgaaaacgug

SEQ ID NO: 1645663 - RNA, 12 nt, Human
ucacccuuuucu

SEQ ID NO: 1645664 - RNA, 20 nt, Human
ucacccuggggcuaggaaau

SEQ ID NO: 1645665 - RNA, 19 nt, Human
ucacccgcuaagagggagg

SEQ ID NO: 1645666 - RNA, 21 nt, Human
ucaccgaaaacguggcugcuu

SEQ ID NO: 1645667 - RNA, 20 nt, Human
ucaccgaaaacguggcugcu

SEQ ID NO: 1645668 - RNA, 19 nt, Human
ucaccgaaaacguggcugc

SEQ ID NO: 1645669 - RNA, 15 nt, Human
ucaccgaaaacgugg

SEQ ID NO: 1645670 - RNA, 23 nt, Human
ucaccgaaaacguggcugcuuca

SEQ ID NO: 1645671 - RNA, 22 nt, Human
ucaccgaaaacguggcugcuuc

SEQ ID NO: 1645672 - RNA, 22 nt, Human
ucacaagacccaaaaggcagaa

SEQ ID NO: 1645673 - RNA, 14 nt, Human
ucaauaaaauccau

SEQ ID NO: 1645674 - RNA, 19 nt, Human
ucaauaaaaaauuaugaca

SEQ ID NO: 1645675 - RNA, 23 nt, Human
ucacacaugagcaucaggccagg

SEQ ID NO: 1645676 - RNA, 22 nt, Human
ucacacaugagcaucaggccag

SEQ ID NO: 1645677 - RNA, 15 nt, Human
ucacacacuuuggcu

SEQ ID NO: 1645678 - RNA, 18 nt, Human
ucacaggacucugccucc

SEQ ID NO: 1645679 - RNA, 17 nt, Human
ucacaggacucugccuc

SEQ ID NO: 1645680 - RNA, 14 nt, Human
ucacauuggaaaca

SEQ ID NO: 1645681 - RNA, 19 nt, Human
ucacaggagggagggggaa

SEQ ID NO: 1645682 - RNA, 23 nt, Human
ucacaggacucugccuccucuuc

SEQ ID NO: 1645683 - RNA, 19 nt, Human
ucacaggacucugccuccu

SEQ ID NO: 1645684 - RNA, 21 nt, Human
uauugauaugcuuauacacuu

SEQ ID NO: 1645685 - RNA, 20 nt, Human
uauugauaugcuuauacacu

SEQ ID NO: 1645686 - RNA, 23 nt, Human
uauugugcgcuaaacuuuucuga

SEQ ID NO: 1645687 - RNA, 22 nt, Human
uauugugcgcuaaacuuuucug

SEQ ID NO: 1645688 - RNA, 19 nt, Human
uauugugcgcuaaacuuuu

SEQ ID NO: 1645689 - RNA, 17 nt, Human
uauuguuuaaaaucauu

SEQ ID NO: 1645690 - RNA, 16 nt, Human
uauuguuuaaaaucau

SEQ ID NO: 1645691 - RNA, 15 nt, Human
uauuguuuaaaauca

SEQ ID NO: 1645692 - RNA, 15 nt, Human
uauugcccacgcugg

SEQ ID NO: 1645693 - RNA, 14 nt, Human
uauugcccacgcug

SEQ ID NO: 1645694 - RNA, 13 nt, Human
uauugcccacgcu

SEQ ID NO: 1645695 - RNA, 23 nt, Human
uauugcugauggugcaaugaccu

SEQ ID NO: 1645696 - RNA, 20 nt, Human
uauuguuuaaaaucauuucu

SEQ ID NO: 1645697 - RNA, 17 nt, Human
uauuuaugggauccugg

SEQ ID NO: 1645698 - RNA, 14 nt, Human
uauuuauuacugua

SEQ ID NO: 1645699 - RNA, 22 nt, Human
uauuuauuaaaugcccagcccc

SEQ ID NO: 1645700 - RNA, 13 nt, Human
uauuucuaugaaa

SEQ ID NO: 1645701 - RNA, 15 nt, Human
uauuucuaugaaaua

SEQ ID NO: 1645702 - RNA, 14 nt, Human
uauuucuaugaaau

SEQ ID NO: 1645703 - RNA, 16 nt, Human
uauuauguuaaaacug

SEQ ID NO: 1645704 - RNA, 22 nt, Human
uauuauguaaaucccauuauuc

SEQ ID NO: 1645705 - RNA, 20 nt, Human
uauuauggaggcaggaguuu

SEQ ID NO: 1645706 - RNA, 15 nt, Human
uauuauguaaauccc

SEQ ID NO: 1645707 - RNA, 12 nt, Human
uauuauguaaau

SEQ ID NO: 1645708 - RNA, 22 nt, Human
uauuaugaaacuuguguaaaua

SEQ ID NO: 1645709 - RNA, 21 nt, Human
uauuaugaaacuuguguaaau

SEQ ID NO: 1645710 - RNA, 20 nt, Human
uauuaugaaacuuguguaaa

SEQ ID NO: 1645711 - RNA, 12 nt, Human
uauuaugaaacu

SEQ ID NO: 1645712 - RNA, 17 nt, Human
uauuauauuuacaaaug

SEQ ID NO: 1645713 - RNA, 14 nt, Human
uauuauaccuuuuu

SEQ ID NO: 1645714 - RNA, 24 nt, Human
uauuaagaaagacuaucuaaaugu

SEQ ID NO: 1645715 - RNA, 16 nt, Human
uauuaagcauauauuu

SEQ ID NO: 1645716 - RNA, 14 nt, Human
uauuaaggaagaca

SEQ ID NO: 1645717 - RNA, 12 nt, Human
uauuauaccuuu

SEQ ID NO: 1645718 - RNA, 13 nt, Human
uauuauaccuuuu

SEQ ID NO: 1645719 - RNA, 17 nt, Human
uauguucuaagaaguga

SEQ ID NO: 1645720 - RNA, 22 nt, Human
uauguucuuaguggauguucug

SEQ ID NO: 1645721 - RNA, 21 nt, Human
uauguugcccaggcaggucuu

SEQ ID NO: 1645722 - RNA, 17 nt, Human
uauguugaagccuuugu

SEQ ID NO: 1645723 - RNA, 19 nt, Human
uauuaaaugcccagccccu

SEQ ID NO: 1645724 - RNA, 17 nt, Human
uauuaaaugcccagccc

SEQ ID NO: 1645725 - RNA, 15 nt, Human
uauuaaaugcccagc

SEQ ID NO: 1645726 - RNA, 16 nt, Human
uauuaagaaagacuau

SEQ ID NO: 1645727 - RNA, 19 nt, Human
uauguuagugcaaauuguc

SEQ ID NO: 1645728 - RNA, 12 nt, Human
uauguuaaaacu

SEQ ID NO: 1645729 - RNA, 19 nt, Human
uauggaggcuuugcauaga

SEQ ID NO: 1645730 - RNA, 13 nt, Human
uauguguguuuua

SEQ ID NO: 1645731 - RNA, 14 nt, Human
uauggaggcaggag

SEQ ID NO: 1645732 - RNA, 17 nt, Human
uccaaagaaauguaagg

SEQ ID NO: 1645733 - RNA, 14 nt, Human
uccaaagaaaugua

SEQ ID NO: 1645734 - RNA, 13 nt, Human
uccaaaguacacu

SEQ ID NO: 1645735 - RNA, 16 nt, Human
ucauuaggauggcuag

SEQ ID NO: 1645736 - RNA, 14 nt, Human
ucauggugcucaga

SEQ ID NO: 1645737 - RNA, 11 nt, Human
ucauagcagcu

SEQ ID NO: 1645738 - RNA, 12 nt, Human
ucauagcagcuu

SEQ ID NO: 1645739 - RNA, 20 nt, Human
ucaguguacauggaauaaca

SEQ ID NO: 1645740 - RNA, 16 nt, Human
ucagugccaaaaacaa

SEQ ID NO: 1645741 - RNA, 17 nt, Human
ucaucaaugaaugaaug

SEQ ID NO: 1645742 - RNA, 17 nt, Human
ucauccacugugccaug

SEQ ID NO: 1645743 - RNA, 14 nt, Human
ucauccacugugcc

SEQ ID NO: 1645744 - RNA, 18 nt, Human
ucauccacugugccaugu

SEQ ID NO: 1645745 - RNA, 16 nt, Human
ucaucuccccaucauu

SEQ ID NO: 1645746 - RNA, 17 nt, Human
ucaugcuguucaugaaa

SEQ ID NO: 1645747 - RNA, 22 nt, Human
ucauggaacgcguugaaauugu

SEQ ID NO: 1645748 - RNA, 21 nt, Human
ucauggaacgcguugaaauug

SEQ ID NO: 1645749 - RNA, 20 nt, Human
ucauggaacgcguugaaauu

SEQ ID NO: 1645750 - RNA, 24 nt, Human
ucagcuccagcucaccagccccag

SEQ ID NO: 1645751 - RNA, 23 nt, Human
ucagcuccagcucaccagcccca

SEQ ID NO: 1645752 - RNA, 23 nt, Human
ucaggaagcucagggccuggcuc

SEQ ID NO: 1645753 - RNA, 23 nt, Human
ucagcucugcaagaauugaagca

SEQ ID NO: 1645754 - RNA, 21 nt, Human
ucaggccugggggcugggcag

SEQ ID NO: 1645755 - RNA, 15 nt, Human
ucaggcucuucuccu

SEQ ID NO: 1645756 - RNA, 20 nt, Human
ucaggaucaaaccccgacca

SEQ ID NO: 1645757 - RNA, 15 nt, Human
ucaggagcccuggga

SEQ ID NO: 1645758 - RNA, 14 nt, Human
ucaggagcccuggg

SEQ ID NO: 1645759 - RNA, 12 nt, Human
ucaggagcccug

SEQ ID NO: 1645760 - RNA, 11 nt, Human
ucaggagcccu

SEQ ID NO: 1645761 - RNA, 19 nt, Human
ucagguggggcagcuugag

SEQ ID NO: 1645762 - RNA, 18 nt, Human
ucagguggggcagcuuga

SEQ ID NO: 1645763 - RNA, 23 nt, Human
ucaggugauccacccaccucagc

SEQ ID NO: 1645764 - RNA, 23 nt, Human
ucaggugccucaagagaaggcaa

SEQ ID NO: 1645765 - RNA, 16 nt, Human
ucaggugauccaccca

SEQ ID NO: 1645766 - RNA, 23 nt, Human
ucaggugagaagcagaggaagga

SEQ ID NO: 1645767 - RNA, 12 nt, Human
ucaggucccugc

SEQ ID NO: 1645768 - RNA, 21 nt, Human
ucaggcucuucuccuuucaca

SEQ ID NO: 1645769 - RNA, 16 nt, Human
ucaggcucuucuccuu

SEQ ID NO: 1645770 - RNA, 20 nt, Human
ucagguggggcagcuugagg

SEQ ID NO: 1645771 - RNA, 16 nt, Human
ucagucucccucccuu

SEQ ID NO: 1645772 - RNA, 23 nt, Human
ucagucugauucccaagcucugc

SEQ ID NO: 1645773 - RNA, 22 nt, Human
ucagucugauucccaagcucug

SEQ ID NO: 1645774 - RNA, 21 nt, Human
ucagucugauucccaagcucu

SEQ ID NO: 1645775 - RNA, 19 nt, Human
uccagguagagggugugua

SEQ ID NO: 1645776 - RNA, 22 nt, Human
uccaggggugggacacccugug

SEQ ID NO: 1645777 - RNA, 20 nt, Human
uccagguuuaagcuguuacu

SEQ ID NO: 1645778 - RNA, 17 nt, Human
uccaguuuuguuuggac

SEQ ID NO: 1645779 - RNA, 15 nt, Human
uccaguuuuguuugg

SEQ ID NO: 1645780 - RNA, 22 nt, Human
uccauaaucuggacuccucugu

SEQ ID NO: 1645781 - RNA, 20 nt, Human
uccaguuuuguuuggaccaa

SEQ ID NO: 1645782 - RNA, 15 nt, Human
uccauacauuugugu

SEQ ID NO: 1645783 - RNA, 21 nt, Human
uccauaaucuggacuccucug

SEQ ID NO: 1645784 - RNA, 15 nt, Human
uccauagagagcaag

SEQ ID NO: 1645785 - RNA, 14 nt, Human
uccauagagagcaa

SEQ ID NO: 1645786 - RNA, 14 nt, Human
uccaucaggccacu

SEQ ID NO: 1645787 - RNA, 20 nt, Human
uccaugggccauaugaaaag

SEQ ID NO: 1645788 - RNA, 13 nt, Human
uccauggacuuug

SEQ ID NO: 1645789 - RNA, 15 nt, Human
uccaugcugccucca

SEQ ID NO: 1645790 - RNA, 14 nt, Human
uccaugcugccucc

SEQ ID NO: 1645791 - RNA, 23 nt, Human
uccacuuggucugugagaugcua

SEQ ID NO: 1645792 - RNA, 21 nt, Human
uccacuuucuagccagaggag

SEQ ID NO: 1645793 - RNA, 20 nt, Human
uccacuuucuagccagagga

SEQ ID NO: 1645794 - RNA, 21 nt, Human
uccacuuggucugugagaugc

SEQ ID NO: 1645795 - RNA, 14 nt, Human
uccaaaguacacug

SEQ ID NO: 1645796 - RNA, 16 nt, Human
uccaaaguacacuguu

SEQ ID NO: 1645797 - RNA, 23 nt, Human
uccagaaagaaaacuuguauuau

SEQ ID NO: 1645798 - RNA, 15 nt, Human
uccaggagcagccac

SEQ ID NO: 1645799 - RNA, 14 nt, Human
uccaggagcagcca

SEQ ID NO: 1645800 - RNA, 13 nt, Human
uccaggagcagcc

SEQ ID NO: 1645801 - RNA, 12 nt, Human
uccaggagcagc

SEQ ID NO: 1645802 - RNA, 20 nt, Human
uccaggggugggacacccug

SEQ ID NO: 1645803 - RNA, 19 nt, Human
uccaggggugggacacccu

SEQ ID NO: 1645804 - RNA, 17 nt, Human
uccagcagauuauucac

SEQ ID NO: 1645805 - RNA, 22 nt, Human
uccagcaauucuccugccucag

SEQ ID NO: 1645806 - RNA, 16 nt, Human
uccagcagauuauuca

SEQ ID NO: 1645807 - RNA, 15 nt, Human
uccagcagauuauuc

SEQ ID NO: 1645808 - RNA, 14 nt, Human
uccagcagauuauu

SEQ ID NO: 1645809 - RNA, 14 nt, Human
uccccaggaggcca

SEQ ID NO: 1645810 - RNA, 17 nt, Human
uccccaggaggccagcc

SEQ ID NO: 1645811 - RNA, 17 nt, Human
ucccccagccccauccu

SEQ ID NO: 1645812 - RNA, 16 nt, Human
uccccaggaggccagc

SEQ ID NO: 1645813 - RNA, 15 nt, Human
uccccaggaggccag

SEQ ID NO: 1645814 - RNA, 21 nt, Human
ucccccagccccauccucugu

SEQ ID NO: 1645815 - RNA, 20 nt, Human
ucccccagccccauccucug

SEQ ID NO: 1645816 - RNA, 22 nt, Human
ucccccagccccauccucugua

SEQ ID NO: 1645817 - RNA, 22 nt, Human
uccccagcaagugagagcuggg

SEQ ID NO: 1645818 - RNA, 21 nt, Human
uccccagcaagugagagcugg

SEQ ID NO: 1645819 - RNA, 20 nt, Human
uccccagcaagugagagcug

SEQ ID NO: 1645820 - RNA, 23 nt, Human
uccccagauugcaacaggcuggg

SEQ ID NO: 1645821 - RNA, 22 nt, Human
uccccagauugcaacaggcugg

SEQ ID NO: 1645822 - RNA, 20 nt, Human
uccccagauugcaacaggcu

SEQ ID NO: 1645823 - RNA, 19 nt, Human
uccccagauugcaacaggc

SEQ ID NO: 1645824 - RNA, 18 nt, Human
uccccagauugcaacagg

SEQ ID NO: 1645825 - RNA, 13 nt, Human
uccccagauugca

SEQ ID NO: 1645826 - RNA, 19 nt, Human
ucccauuauucaaaguugc

SEQ ID NO: 1645827 - RNA, 18 nt, Human
ucccauuauucaaaguug

SEQ ID NO: 1645828 - RNA, 16 nt, Human
ucccauuauucaaagu

SEQ ID NO: 1645829 - RNA, 20 nt, Human
ucccaugagccucagcaucc

SEQ ID NO: 1645830 - RNA, 14 nt, Human
ucccauuauucaaa

SEQ ID NO: 1645831 - RNA, 13 nt, Human
ucccauuauucaa

SEQ ID NO: 1645832 - RNA, 18 nt, Human
ucccaccuuggcugcagg

SEQ ID NO: 1645833 - RNA, 20 nt, Human
ucccagcugugcucuggaca

SEQ ID NO: 1645834 - RNA, 17 nt, Human
ucccaccuuggcugcag

SEQ ID NO: 1645835 - RNA, 16 nt, Human
ucccaccuuggcugca

SEQ ID NO: 1645836 - RNA, 13 nt, Human
ucccaccuuggcu

SEQ ID NO: 1645837 - RNA, 22 nt, Human
ucccaccucucucacuccuuga

SEQ ID NO: 1645838 - RNA, 20 nt, Human
uccaugugggcuaguugggc

SEQ ID NO: 1645839 - RNA, 19 nt, Human
ucccaugagccucagcauc

SEQ ID NO: 1645840 - RNA, 18 nt, Human
ucccaugagccucagcau

SEQ ID NO: 1645841 - RNA, 15 nt, Human
ucccaucuuccaagg

SEQ ID NO: 1645842 - RNA, 16 nt, Human
ucccaggcgccccuuc

SEQ ID NO: 1645843 - RNA, 24 nt, Human
ucccaggcauuccccaggaggcca

SEQ ID NO: 1645844 - RNA, 22 nt, Human
ucccagcugugcucuggacagg

SEQ ID NO: 1645845 - RNA, 21 nt, Human
ucccagcugugcucuggacag

SEQ ID NO: 1645846 - RNA, 23 nt, Human
ucccagcugugcucuggacaggc

SEQ ID NO: 1645847 - RNA, 17 nt, Human
ucuacacuaagagagaa

SEQ ID NO: 1645848 - RNA, 16 nt, Human
ucuacagaggccaugg

SEQ ID NO: 1645849 - RNA, 15 nt, Human
ucuacagaggccaug

SEQ ID NO: 1645850 - RNA, 14 nt, Human
ucuaccuuccugca

SEQ ID NO: 1645851 - RNA, 14 nt, Human
ucuaucaccaagga

SEQ ID NO: 1645852 - RNA, 14 nt, Human
ucuaugacacaugc

SEQ ID NO: 1645853 - RNA, 18 nt, Human
ucuaugaaauauuauguu

SEQ ID NO: 1645854 - RNA, 17 nt, Human
ucuaugacacaugcaag

SEQ ID NO: 1645855 - RNA, 21 nt, Human
ucuaggaagacuuuggaaaga

SEQ ID NO: 1645856 - RNA, 19 nt, Human
ucuaggaagacuuuggaaa

SEQ ID NO: 1645857 - RNA, 16 nt, Human
ucuaggaagacuuugg

SEQ ID NO: 1645858 - RNA, 15 nt, Human
ucuaggaagacuuug

SEQ ID NO: 1645859 - RNA, 16 nt, Human
ucggagaagagcuguu

SEQ ID NO: 1645860 - RNA, 14 nt, Human
ucggagaagagcug

SEQ ID NO: 1645861 - RNA, 12 nt, Human
ucggagaagagc

SEQ ID NO: 1645862 - RNA, 13 nt, Human
ucgugacaacacu

SEQ ID NO: 1645863 - RNA, 18 nt, Human
ucuaaaggcuaccuuugu

SEQ ID NO: 1645864 - RNA, 17 nt, Human
ucuaaaggcuaccuuug

SEQ ID NO: 1645865 - RNA, 19 nt, Human
ucuaaaggcuaccuuugua

SEQ ID NO: 1645866 - RNA, 20 nt, Human
ucuaaaggcuaccuuuguau

SEQ ID NO: 1645867 - RNA, 16 nt, Human
ucguguccccuauccu

SEQ ID NO: 1645868 - RNA, 23 nt, Human
ucucaguccaugaagauguagag

SEQ ID NO: 1645869 - RNA, 13 nt, Human
ucuaugggacuca

SEQ ID NO: 1645870 - RNA, 12 nt, Human
ucuaugggacuc

SEQ ID NO: 1645871 - RNA, 19 nt, Human
ucuaugggacucaaugcac

SEQ ID NO: 1645872 - RNA, 23 nt, Human
ucuaugggacucaaugcacugac

SEQ ID NO: 1645873 - RNA, 18 nt, Human
ucucauacucaccucacc

SEQ ID NO: 1645874 - RNA, 16 nt, Human
ucucauacucaccuca

SEQ ID NO: 1645875 - RNA, 16 nt, Human
ucuccaccugccaggg

SEQ ID NO: 1645876 - RNA, 15 nt, Human
ucuccaccugccagg

SEQ ID NO: 1645877 - RNA, 14 nt, Human
ucuccaccugccag

SEQ ID NO: 1645878 - RNA, 19 nt, Human
ucuccaccugccagggaca

SEQ ID NO: 1645879 - RNA, 17 nt, Human
ucuccaccugccaggga

SEQ ID NO: 1645880 - RNA, 22 nt, Human
ucuccaccugccagggacagag

SEQ ID NO: 1645881 - RNA, 13 nt, Human
ucuccacuccaga

SEQ ID NO: 1645882 - RNA, 16 nt, Human
ucuccacccugcucuc

SEQ ID NO: 1645883 - RNA, 14 nt, Human
ucuccacccugcuc

SEQ ID NO: 1645884 - RNA, 17 nt, Human
ucuccacccugcucucc

SEQ ID NO: 1645885 - RNA, 13 nt, Human
ucuccacccugcu

SEQ ID NO: 1645886 - RNA, 19 nt, Human
ucucaugccucagccuccu

SEQ ID NO: 1645887 - RNA, 16 nt, Human
ucucaugccucagccu

SEQ ID NO: 1645888 - RNA, 13 nt, Human
ucucaugccucag

SEQ ID NO: 1645889 - RNA, 13 nt, Human
ucucccccagccc

SEQ ID NO: 1645890 - RNA, 12 nt, Human
ucucccccagcc

SEQ ID NO: 1645891 - RNA, 11 nt, Human
ucuccaggcug

SEQ ID NO: 1645892 - RNA, 23 nt, Human
ucucccucagucuggcccuuccu

SEQ ID NO: 1645893 - RNA, 18 nt, Human
ucucccucagucuggccc

SEQ ID NO: 1645894 - RNA, 14 nt, Human
ucucccucccuugg

SEQ ID NO: 1645895 - RNA, 15 nt, Human
ucuccagccccugga

SEQ ID NO: 1645896 - RNA, 14 nt, Human
ucuccagccccugg

SEQ ID NO: 1645897 - RNA, 13 nt, Human
ucuccagccccug

SEQ ID NO: 1645898 - RNA, 12 nt, Human
ucuccagccccu

SEQ ID NO: 1645899 - RNA, 14 nt, Human
ucuccacugccuuc

SEQ ID NO: 1645900 - RNA, 18 nt, Human
ucuccagccccuggaugc

SEQ ID NO: 1645901 - RNA, 16 nt, Human
ucuccagccccuggau

SEQ ID NO: 1645902 - RNA, 22 nt, Human
ucuccagccccuggaugcagcc

SEQ ID NO: 1645903 - RNA, 23 nt, Human
uccuagugaaagaggcagcuuga

SEQ ID NO: 1645904 - RNA, 14 nt, Human
uccuagugaaagag

SEQ ID NO: 1645905 - RNA, 23 nt, Human
uccuauauuguuuucaguguaca

SEQ ID NO: 1645906 - RNA, 12 nt, Human
uccuaguuccac

SEQ ID NO: 1645907 - RNA, 20 nt, Human
uccuaucaccugucuugccu

SEQ ID NO: 1645908 - RNA, 18 nt, Human
uccucauuagcauuuugc

SEQ ID NO: 1645909 - RNA, 17 nt, Human
uccuaucagaaguuucu

SEQ ID NO: 1645910 - RNA, 10 nt, Human
uccuccaggu

SEQ ID NO: 1645911 - RNA, 13 nt, Human
uccucccaccuca

SEQ ID NO: 1645912 - RNA, 12 nt, Human
uccucccaccuc

SEQ ID NO: 1645913 - RNA, 16 nt, Human
uccgcuuucuacccag

SEQ ID NO: 1645914 - RNA, 21 nt, Human
uccuaagcuauucaguaauaa

SEQ ID NO: 1645915 - RNA, 20 nt, Human
uccuaagcuauucaguaaua

SEQ ID NO: 1645916 - RNA, 20 nt, Human
uccgcuuucuacccagcgag

SEQ ID NO: 1645917 - RNA, 18 nt, Human
uccgcuuucuacccagcg

SEQ ID NO: 1645918 - RNA, 14 nt, Human
uccgccucuugggu

SEQ ID NO: 1645919 - RNA, 15 nt, Human
ucccccuuccaugga

SEQ ID NO: 1645920 - RNA, 16 nt, Human
ucccuuccucuuucca

SEQ ID NO: 1645921 - RNA, 15 nt, Human
ucccuuccucuuucc

SEQ ID NO: 1645922 - RNA, 18 nt, Human
uccugccccugagcccau

SEQ ID NO: 1645923 - RNA, 10 nt, Human
uccugcccug

SEQ ID NO: 1645924 - RNA, 17 nt, Human
uccugccccugagccca

SEQ ID NO: 1645925 - RNA, 20 nt, Human
uccugaggcuccacuugguc

SEQ ID NO: 1645926 - RNA, 19 nt, Human
uccugaggcuccacuuggu

SEQ ID NO: 1645927 - RNA, 21 nt, Human
uccugaggcuccacuuggucu

SEQ ID NO: 1645928 - RNA, 16 nt, Human
uccugcauuugugaaa

SEQ ID NO: 1645929 - RNA, 14 nt, Human
uccugccaggcaug

SEQ ID NO: 1645930 - RNA, 13 nt, Human
uccugccaggcau

SEQ ID NO: 1645931 - RNA, 16 nt, Human
uccugccaccacgccc

SEQ ID NO: 1645932 - RNA, 11 nt, Human
uccugccacca

SEQ ID NO: 1645933 - RNA, 17 nt, Human
uccuggcaauagucaaa

SEQ ID NO: 1645934 - RNA, 23 nt, Human
uccuggcacccggccccugcugg

SEQ ID NO: 1645935 - RNA, 16 nt, Human
uccuggcacugcuucc

SEQ ID NO: 1645936 - RNA, 13 nt, Human
uccuggcacugcu

SEQ ID NO: 1645937 - RNA, 12 nt, Human
uccuggccucaa

SEQ ID NO: 1645938 - RNA, 17 nt, Human
uccuggcacugcuucca

SEQ ID NO: 1645939 - RNA, 13 nt, Human
uccuguagcccua

SEQ ID NO: 1645940 - RNA, 11 nt, Human
uccuguagccc

SEQ ID NO: 1645941 - RNA, 17 nt, Human
uccugcccuuaccugcc

SEQ ID NO: 1645942 - RNA, 21 nt, Human
uccugcccugggaggcaguga

SEQ ID NO: 1645943 - RNA, 15 nt, Human
uccugcccugggagg

SEQ ID NO: 1645944 - RNA, 14 nt, Human
uccugcccugggag

SEQ ID NO: 1645945 - RNA, 12 nt, Human
uccugcccuggg

SEQ ID NO: 1645946 - RNA, 11 nt, Human
uccugcccugg

SEQ ID NO: 1645947 - RNA, 20 nt, Human
uccugcccuuaccugccagg

SEQ ID NO: 1645948 - RNA, 14 nt, Human
uccuggaguucugg

SEQ ID NO: 1645949 - RNA, 19 nt, Human
uccugccuaaggcugaacu

SEQ ID NO: 1645950 - RNA, 16 nt, Human
uccugccuaaggcuga

SEQ ID NO: 1645951 - RNA, 20 nt, Human
ugacaagcucacagaccuuu

SEQ ID NO: 1645952 - RNA, 15 nt, Human
ugacaagcucacaga

SEQ ID NO: 1645953 - RNA, 18 nt, Human
ugacaaggauugcuacug

SEQ ID NO: 1645954 - RNA, 12 nt, Human
ugacaagcucac

SEQ ID NO: 1645955 - RNA, 22 nt, Human
ugacagagugagacucugucuc

SEQ ID NO: 1645956 - RNA, 19 nt, Human
ugacagagugagacucugu

SEQ ID NO: 1645957 - RNA, 23 nt, Human
ugacauaaguauuuaauucaugu

SEQ ID NO: 1645958 - RNA, 17 nt, Human
ugacagagugagacucu

SEQ ID NO: 1645959 - RNA, 14 nt, Human
ugacagagugagac

SEQ ID NO: 1645960 - RNA, 23 nt, Human
ugacagaggcagccccauucugc

SEQ ID NO: 1645961 - RNA, 18 nt, Human
ugacagaggcagccccau

SEQ ID NO: 1645962 - RNA, 17 nt, Human
ugacagaggcagcccca

SEQ ID NO: 1645963 - RNA, 16 nt, Human
ugacagaggcagcccc

SEQ ID NO: 1645964 - RNA, 15 nt, Human
ugacagaggcagccc

SEQ ID NO: 1645965 - RNA, 14 nt, Human
ugacagaggcagcc

SEQ ID NO: 1645966 - RNA, 23 nt, Human
ugacagacacaggcccggcucca

SEQ ID NO: 1645967 - RNA, 20 nt, Human
ugacagacacaggcccggcu

SEQ ID NO: 1645968 - RNA, 16 nt, Human
ugacagacagcccucc

SEQ ID NO: 1645969 - RNA, 20 nt, Human
ugaccacugcagaagacagu

SEQ ID NO: 1645970 - RNA, 19 nt, Human
ugaccagcaccaucucucc

SEQ ID NO: 1645971 - RNA, 15 nt, Human
ugacaugucuuuucu

SEQ ID NO: 1645972 - RNA, 18 nt, Human
ugacaugggacauuugcu

SEQ ID NO: 1645973 - RNA, 13 nt, Human
ugacaugucuuuu

SEQ ID NO: 1645974 - RNA, 17 nt, Human
ugacaugggacauuugc

SEQ ID NO: 1645975 - RNA, 16 nt, Human
ugacaugggacauuug

SEQ ID NO: 1645976 - RNA, 16 nt, Human
ugacauagucuggcug

SEQ ID NO: 1645977 - RNA, 17 nt, Human
ugacauagucuggcugu

SEQ ID NO: 1645978 - RNA, 20 nt, Human
ugaccgugaggccagagaca

SEQ ID NO: 1645979 - RNA, 16 nt, Human
ugaccgugaggccaga

SEQ ID NO: 1645980 - RNA, 14 nt, Human
ugaccgugaggcca

SEQ ID NO: 1645981 - RNA, 13 nt, Human
ugaccgugaggcc

SEQ ID NO: 1645982 - RNA, 19 nt, Human
ugaccauucuccaccugcc

SEQ ID NO: 1645983 - RNA, 18 nt, Human
ugaccauucuccaccugc

SEQ ID NO: 1645984 - RNA, 17 nt, Human
ugaccauucuccaccug

SEQ ID NO: 1645985 - RNA, 16 nt, Human
ugaccauucuccaccu

SEQ ID NO: 1645986 - RNA, 20 nt, Human
ugaccagcaccaucucuccu

SEQ ID NO: 1645987 - RNA, 18 nt, Human
ugaauuacauuuguauaa

SEQ ID NO: 1645988 - RNA, 16 nt, Human
ugaauuacauuuguau

SEQ ID NO: 1645989 - RNA, 15 nt, Human
ugaauuacauuugua

SEQ ID NO: 1645990 - RNA, 17 nt, Human
ugaauuaugaaacuuuu

SEQ ID NO: 1645991 - RNA, 15 nt, Human
ugaauuaugaaacuu

SEQ ID NO: 1645992 - RNA, 13 nt, Human
ugaauuaugaaac

SEQ ID NO: 1645993 - RNA, 16 nt, Human
ugaauuauuuucucuc

SEQ ID NO: 1645994 - RNA, 23 nt, Human
ugaaugaugauccuaggcauuug

SEQ ID NO: 1645995 - RNA, 23 nt, Human
ugaaucauuuuaccuuugacaaa

SEQ ID NO: 1645996 - RNA, 22 nt, Human
ugaaucauuuuaccuuugacaa

SEQ ID NO: 1645997 - RNA, 15 nt, Human
ugaauaaagacaccu

SEQ ID NO: 1645998 - RNA, 14 nt, Human
ugaauaaagacacc

SEQ ID NO: 1645999 - RNA, 11 nt, Human
ugaaguccaag

SEQ ID NO: 1646000 - RNA, 23 nt, Human
ugaagucagaucugccuaaggac

SEQ ID NO: 1646001 - RNA, 17 nt, Human
ugaaggccccgcccagg

SEQ ID NO: 1646002 - RNA, 20 nt, Human
ugaagucagaucugccuaag

SEQ ID NO: 1646003 - RNA, 13 nt, Human
ugaaguccaagca

SEQ ID NO: 1646004 - RNA, 20 nt, Human
ugaaggacauugcggacagc

SEQ ID NO: 1646005 - RNA, 19 nt, Human
ugaaggacauugcggacag

SEQ ID NO: 1646006 - RNA, 22 nt, Human
ugaaggacauugcggacagcca

SEQ ID NO: 1646007 - RNA, 16 nt, Human
ugaaggccccgcccag

SEQ ID NO: 1646008 - RNA, 15 nt, Human
ugaaggccccgccca

SEQ ID NO: 1646009 - RNA, 16 nt, Human
ugaaggagagcccuuc

SEQ ID NO: 1646010 - RNA, 20 nt, Human
ugaaggagagcccuucauuu

SEQ ID NO: 1646011 - RNA, 17 nt, Human
ugaacuccuggccucaa

SEQ ID NO: 1646012 - RNA, 16 nt, Human
ugaacucugacaacag

SEQ ID NO: 1646013 - RNA, 14 nt, Human
ugaagauacugaaa

SEQ ID NO: 1646014 - RNA, 18 nt, Human
ugaagauacugaaauaaa

SEQ ID NO: 1646015 - RNA, 16 nt, Human
ugaagauacugaaaua

SEQ ID NO: 1646016 - RNA, 15 nt, Human
ugaagauacugaaau

SEQ ID NO: 1646017 - RNA, 20 nt, Human
ugaaggaauaaauugcuccu

SEQ ID NO: 1646018 - RNA, 18 nt, Human
ugaaagaggcagcuugaa

SEQ ID NO: 1646019 - RNA, 18 nt, Human
ugaaagcccugagcuuuc

SEQ ID NO: 1646020 - RNA, 18 nt, Human
ugaaagauggcugugccu

SEQ ID NO: 1646021 - RNA, 19 nt, Human
ugaaagauggcugugccuc

SEQ ID NO: 1646022 - RNA, 15 nt, Human
ugaaagguacuucaa

SEQ ID NO: 1646023 - RNA, 15 nt, Human
ugaaagggcccagag

SEQ ID NO: 1646024 - RNA, 16 nt, Human
ugaaagguacuucaaa

SEQ ID NO: 1646025 - RNA, 13 nt, Human
ugaaagggcccag

SEQ ID NO: 1646026 - RNA, 23 nt, Human
ugaaagggaguauuacaaaaaca

SEQ ID NO: 1646027 - RNA, 22 nt, Human
ugaaacaacaaauaggaauugu

SEQ ID NO: 1646028 - RNA, 14 nt, Human
ugaaacauuuuguc

SEQ ID NO: 1646029 - RNA, 20 nt, Human
ugaaaagcuccauuuuuagu

SEQ ID NO: 1646030 - RNA, 13 nt, Human
ugaaaauuuugau

SEQ ID NO: 1646031 - RNA, 19 nt, Human
ugaaaauuuugauguuuua

SEQ ID NO: 1646032 - RNA, 21 nt, Human
ugaaaauuuugauguuuuaag

SEQ ID NO: 1646033 - RNA, 16 nt, Human
ugaaauauugacuuuu

SEQ ID NO: 1646034 - RNA, 15 nt, Human
ugaaaucauucauuu

SEQ ID NO: 1646035 - RNA, 17 nt, Human
ugaaaucaguuacucuu

SEQ ID NO: 1646036 - RNA, 16 nt, Human
ugaaaucaguuacucu

SEQ ID NO: 1646037 - RNA, 12 nt, Human
ugaaauuauuca

SEQ ID NO: 1646038 - RNA, 16 nt, Human
ugaacuccuggccuca

SEQ ID NO: 1646039 - RNA, 20 nt, Human
ugaaccaccacacccagccc

SEQ ID NO: 1646040 - RNA, 17 nt, Human
ugaaccaccacacccag

SEQ ID NO: 1646041 - RNA, 23 nt, Human
ugaaccacaucuugcucugcuga

SEQ ID NO: 1646042 - RNA, 19 nt, Human
ugaaccacaucuugcucug

SEQ ID NO: 1646043 - RNA, 22 nt, Human
ugaaccaagaacuuuccaggaa

SEQ ID NO: 1646044 - RNA, 19 nt, Human
ugaacaguuguguuugaag

SEQ ID NO: 1646045 - RNA, 12 nt, Human
ucuuugccaagu

SEQ ID NO: 1646046 - RNA, 17 nt, Human
ucuuuggacacucacac

SEQ ID NO: 1646047 - RNA, 19 nt, Human
ucuuuccacagaagcucca

SEQ ID NO: 1646048 - RNA, 17 nt, Human
ucuuuccaaaguacacu

SEQ ID NO: 1646049 - RNA, 21 nt, Human
ucuuucagccaagaauucuua

SEQ ID NO: 1646050 - RNA, 20 nt, Human
ucuuucagccaagaauucuu

SEQ ID NO: 1646051 - RNA, 19 nt, Human
ucuuucagccaagaauucu

SEQ ID NO: 1646052 - RNA, 16 nt, Human
ucuuucagccaagaau

SEQ ID NO: 1646053 - RNA, 13 nt, Human
ucuuuccaaagua

SEQ ID NO: 1646054 - RNA, 14 nt, Human
ucuuuccaaaguac

SEQ ID NO: 1646055 - RNA, 23 nt, Human
ucuuucacccuuuucuguuugcu

SEQ ID NO: 1646056 - RNA, 21 nt, Human
ucuuguguguuuauugucaaa

SEQ ID NO: 1646057 - RNA, 16 nt, Human
ucuuguguguuuauug

SEQ ID NO: 1646058 - RNA, 15 nt, Human
ucuugcaugaggcua

SEQ ID NO: 1646059 - RNA, 17 nt, Human
ucuugccuuuuucauua

SEQ ID NO: 1646060 - RNA, 16 nt, Human
ucuugccuuuuucauu

SEQ ID NO: 1646061 - RNA, 19 nt, Human
ucuugccuuuuucauuauu

SEQ ID NO: 1646062 - RNA, 20 nt, Human
ucuccucugcugcuggcugg

SEQ ID NO: 1646063 - RNA, 16 nt, Human
ucucccuucauccuuc

SEQ ID NO: 1646064 - RNA, 16 nt, Human
ucuccucuugccacug

SEQ ID NO: 1646065 - RNA, 13 nt, Human
ucuccucuugcca

SEQ ID NO: 1646066 - RNA, 17 nt, Human
ucuccucuugccacugc

SEQ ID NO: 1646067 - RNA, 22 nt, Human
ucuccucuugccacugccucuu

SEQ ID NO: 1646068 - RNA, 19 nt, Human
ugagacucgcgacaaugca

SEQ ID NO: 1646069 - RNA, 21 nt, Human
ugaccucaggugauccaccca

SEQ ID NO: 1646070 - RNA, 20 nt, Human
ugaccucaggugauccaccc

SEQ ID NO: 1646071 - RNA, 22 nt, Human
ugaccucagcuuugauauuuca

SEQ ID NO: 1646072 - RNA, 17 nt, Human
ugagaaauuuauaaacu

SEQ ID NO: 1646073 - RNA, 16 nt, Human
ugagagugaacaaauu

SEQ ID NO: 1646074 - RNA, 23 nt, Human
ugagacucgcgacaaugcaaacc

SEQ ID NO: 1646075 - RNA, 22 nt, Human
ugagacucgcgacaaugcaaac

SEQ ID NO: 1646076 - RNA, 21 nt, Human
ugagacucgcgacaaugcaaa

SEQ ID NO: 1646077 - RNA, 20 nt, Human
ugagacucgcgacaaugcaa

SEQ ID NO: 1646078 - RNA, 15 nt, Human
ugagcagggcucagc

SEQ ID NO: 1646079 - RNA, 14 nt, Human
ugagcagggcucag

SEQ ID NO: 1646080 - RNA, 13 nt, Human
ugagcagggcuca

SEQ ID NO: 1646081 - RNA, 12 nt, Human
ugagcagggcuc

SEQ ID NO: 1646082 - RNA, 15 nt, Human
ugagaucagccuggg

SEQ ID NO: 1646083 - RNA, 14 nt, Human
ugagaucagccugg

SEQ ID NO: 1646084 - RNA, 15 nt, Human
ugagaucaaaacggu

SEQ ID NO: 1646085 - RNA, 17 nt, Human
ugagcagggcucagcgg

SEQ ID NO: 1646086 - RNA, 16 nt, Human
ugagcagggcucagcg

SEQ ID NO: 1646087 - RNA, 19 nt, Human
ugagcagggcucagcgggg

SEQ ID NO: 1646088 - RNA, 20 nt, Human
ugagcaucaggccaggcccu

SEQ ID NO: 1646089 - RNA, 19 nt, Human
ugagcaucaggccaggccc

SEQ ID NO: 1646090 - RNA, 18 nt, Human
ugagcaucaggccaggcc

SEQ ID NO: 1646091 - RNA, 21 nt, Human
ugagccucagcauccuggcac

SEQ ID NO: 1646092 - RNA, 18 nt, Human
ugagccucagcauccugg

SEQ ID NO: 1646093 - RNA, 22 nt, Human
ugagccucagcauccuggcacc

SEQ ID NO: 1646094 - RNA, 14 nt, Human
ugagccucagucuc

SEQ ID NO: 1646095 - RNA, 17 nt, Human
ugagccucagcauccug

SEQ ID NO: 1646096 - RNA, 21 nt, Human
ugagccgagaucacgccacug

SEQ ID NO: 1646097 - RNA, 19 nt, Human
ugagccgagaucacgccac

SEQ ID NO: 1646098 - RNA, 18 nt, Human
ugagcccuguccugccua

SEQ ID NO: 1646099 - RNA, 16 nt, Human
ugauaacuggaaacuu

SEQ ID NO: 1646100 - RNA, 21 nt, Human
ugaguugauagcacagacccu

SEQ ID NO: 1646101 - RNA, 23 nt, Human
ugaguuugggccccagaggcugg

SEQ ID NO: 1646102 - RNA, 22 nt, Human
ugaguuugggccccagaggcug

SEQ ID NO: 1646103 - RNA, 20 nt, Human
ugaguugauagcacagaccc

SEQ ID NO: 1646104 - RNA, 16 nt, Human
ugaguugauagcacag

SEQ ID NO: 1646105 - RNA, 14 nt, Human
ugagugagcaugcc

SEQ ID NO: 1646106 - RNA, 18 nt, Human
ugagucugaaggcugggu

SEQ ID NO: 1646107 - RNA, 17 nt, Human
ugagucugaaggcuggg

SEQ ID NO: 1646108 - RNA, 15 nt, Human
ugagucugaaggcug

SEQ ID NO: 1646109 - RNA, 13 nt, Human
ugagucugaaggc

SEQ ID NO: 1646110 - RNA, 19 nt, Human
ugaguccagaaguuugaga

SEQ ID NO: 1646111 - RNA, 21 nt, Human
ugaggugggaggaucucuuga

SEQ ID NO: 1646112 - RNA, 15 nt, Human
ugagucccaggcuga

SEQ ID NO: 1646113 - RNA, 19 nt, Human
ugagucgaggacagggagg

SEQ ID NO: 1646114 - RNA, 19 nt, Human
ugagucccaggcugagccu

SEQ ID NO: 1646115 - RNA, 20 nt, Human
ugaggcuccacuuggucugu

SEQ ID NO: 1646116 - RNA, 18 nt, Human
ugaggcuccacuuggucu

SEQ ID NO: 1646117 - RNA, 14 nt, Human
ugaggcucugcccu

SEQ ID NO: 1646118 - RNA, 13 nt, Human
ugaggcucugccc

SEQ ID NO: 1646119 - RNA, 17 nt, Human
ugagggaacagagaggu

SEQ ID NO: 1646120 - RNA, 15 nt, Human
ugaggcucugcccuu

SEQ ID NO: 1646121 - RNA, 13 nt, Human
ugaggugggagga

SEQ ID NO: 1646122 - RNA, 12 nt, Human
ugaggugggagg

SEQ ID NO: 1646123 - RNA, 12 nt, Human
ugaggcauuugu

SEQ ID NO: 1646124 - RNA, 23 nt, Human
ugaggcaucgcaauguaagacuc

SEQ ID NO: 1646125 - RNA, 19 nt, Human
ugaggcauuuguuugaacu

SEQ ID NO: 1646126 - RNA, 20 nt, Human
ugaggcauuuguuugaacug

SEQ ID NO: 1646127 - RNA, 17 nt, Human
ugaggcuaguguggugu

SEQ ID NO: 1646128 - RNA, 21 nt, Human
ugaggcauuuguuugaacuga

SEQ ID NO: 1646129 - RNA, 23 nt, Human
ugaggcuagugugguguuuccug

SEQ ID NO: 1646130 - RNA, 23 nt, Human
ugaggcauuuguuugaacugaua

SEQ ID NO: 1646131 - RNA, 13 nt, Human
ugagcugggauga

SEQ ID NO: 1646132 - RNA, 16 nt, Human
ugaggagcuugaaacc

SEQ ID NO: 1646133 - RNA, 16 nt, Human
ugauguguuaucucuu

SEQ ID NO: 1646134 - RNA, 19 nt, Human
ugaugucccaacuuguaaa

SEQ ID NO: 1646135 - RNA, 18 nt, Human
ugaugcuucuucagagac

SEQ ID NO: 1646136 - RNA, 17 nt, Human
ugaugcuucuucagaga

SEQ ID NO: 1646137 - RNA, 16 nt, Human
ugaugcuucuucagag

SEQ ID NO: 1646138 - RNA, 21 nt, Human
ugaugguuguacauauaagug

SEQ ID NO: 1646139 - RNA, 14 nt, Human
ugaugguuguacau

SEQ ID NO: 1646140 - RNA, 13 nt, Human
ugaugguuguaca

SEQ ID NO: 1646141 - RNA, 14 nt, Human
ugaugguuccccug

SEQ ID NO: 1646142 - RNA, 17 nt, Human
ugaucuuuaaaauacac

SEQ ID NO: 1646143 - RNA, 16 nt, Human
ugaucuuugcagacag

SEQ ID NO: 1646144 - RNA, 18 nt, Human
ugaucuuugcagacaggc

SEQ ID NO: 1646145 - RNA, 23 nt, Human
ugaugcuacaggauuugaaauug

SEQ ID NO: 1646146 - RNA, 23 nt, Human
ugaugcgggccagugcuccagcc

SEQ ID NO: 1646147 - RNA, 21 nt, Human
ugaugccugugaacugaacuc

SEQ ID NO: 1646148 - RNA, 20 nt, Human
ugaugcuacaggauuugaaa

SEQ ID NO: 1646149 - RNA, 11 nt, Human
ugaugccuggc

SEQ ID NO: 1646150 - RNA, 20 nt, Human
ugaugccugugaacugaacu

SEQ ID NO: 1646151 - RNA, 15 nt, Human
ugaugccugugaacu

SEQ ID NO: 1646152 - RNA, 14 nt, Human
ugaucuuuaaaaua

SEQ ID NO: 1646153 - RNA, 20 nt, Human
ugaucuucuuuauaauucua

SEQ ID NO: 1646154 - RNA, 15 nt, Human
ugaucugugggcaca

SEQ ID NO: 1646155 - RNA, 19 nt, Human
ugauccacccaccucagcc

SEQ ID NO: 1646156 - RNA, 18 nt, Human
ugauccacccaccucagc

SEQ ID NO: 1646157 - RNA, 17 nt, Human
ugauccacccaccucag

SEQ ID NO: 1646158 - RNA, 17 nt, Human
ugaucucucgugauuga

SEQ ID NO: 1646159 - RNA, 24 nt, Human
ugaucagcuuauugucuagugaaa

SEQ ID NO: 1646160 - RNA, 17 nt, Human
ugaucagcuuauugucu

SEQ ID NO: 1646161 - RNA, 14 nt, Human
ugauagcacagacc

SEQ ID NO: 1646162 - RNA, 13 nt, Human
ugauagcacagac

SEQ ID NO: 1646163 - RNA, 20 nt, Human
ugauaagaaccuuuugagug

SEQ ID NO: 1646164 - RNA, 15 nt, Human
ugauagaggaagccu

SEQ ID NO: 1646165 - RNA, 17 nt, Human
ugauccaagcugguccc

SEQ ID NO: 1646166 - RNA, 15 nt, Human
ugauccaagcugguc

SEQ ID NO: 1646167 - RNA, 14 nt, Human
ugauccaagcuggu

SEQ ID NO: 1646168 - RNA, 13 nt, Human
ugauccaagcugg

SEQ ID NO: 1646169 - RNA, 22 nt, Human
ugauuaugaauuacauuuguau

SEQ ID NO: 1646170 - RNA, 21 nt, Human
ugauuaugaauuacauuugua

SEQ ID NO: 1646171 - RNA, 20 nt, Human
ugauucaacagguuuuccug

SEQ ID NO: 1646172 - RNA, 16 nt, Human
ugauucagacagcugc

SEQ ID NO: 1646173 - RNA, 15 nt, Human
ugauucagacagcug

SEQ ID NO: 1646174 - RNA, 14 nt, Human
ugauucagacagcu

SEQ ID NO: 1646175 - RNA, 13 nt, Human
ugauucagacagc

SEQ ID NO: 1646176 - RNA, 12 nt, Human
ugauucacagug

SEQ ID NO: 1646177 - RNA, 22 nt, Human
ugauguuuagaaacacaacuau

SEQ ID NO: 1646178 - RNA, 20 nt, Human
ugauguucuuucacccuuuu

SEQ ID NO: 1646179 - RNA, 19 nt, Human
ugauuaugaauuacauuug

SEQ ID NO: 1646180 - RNA, 17 nt, Human
ugauuaugaauuacauu

SEQ ID NO: 1646181 - RNA, 13 nt, Human
ugauuauauguca

SEQ ID NO: 1646182 - RNA, 21 nt, Human
ugauucuccugccucagccuc

SEQ ID NO: 1646183 - RNA, 23 nt, Human
ugauucagacagcugccugggau

SEQ ID NO: 1646184 - RNA, 21 nt, Human
ugauucagacagcugccuggg

SEQ ID NO: 1646185 - RNA, 20 nt, Human
ugauucagacagcugccugg

SEQ ID NO: 1646186 - RNA, 19 nt, Human
ugauucagacagcugccug

SEQ ID NO: 1646187 - RNA, 18 nt, Human
ugauucagacagcugccu

SEQ ID NO: 1646188 - RNA, 21 nt, Human
ugauucuucagcaaaaauauu

SEQ ID NO: 1646189 - RNA, 21 nt, Human
ugauuggaggggggagguggg

SEQ ID NO: 1646190 - RNA, 13 nt, Human
ugauuggaggggg

SEQ ID NO: 1646191 - RNA, 20 nt, Human
ugauuggcaggaguuggaag

SEQ ID NO: 1646192 - RNA, 16 nt, Human
ugauugugucucuugg

SEQ ID NO: 1646193 - RNA, 17 nt, Human
ugcuguucaugaaagau

SEQ ID NO: 1646194 - RNA, 16 nt, Human
ugcuguucaugaaaga

SEQ ID NO: 1646195 - RNA, 18 nt, Human
ugcuguaacuuucugaaa

SEQ ID NO: 1646196 - RNA, 13 nt, Human
ugcugguuuuagu

SEQ ID NO: 1646197 - RNA, 20 nt, Human
ugcugggggggauuguaaaa

SEQ ID NO: 1646198 - RNA, 17 nt, Human
ugcugggcuugucugua

SEQ ID NO: 1646199 - RNA, 13 nt, Human
ugcuggguguggc

SEQ ID NO: 1646200 - RNA, 20 nt, Human
ugcugggguuaucugaaguc

SEQ ID NO: 1646201 - RNA, 17 nt, Human
ugcugggguuaucugaa

SEQ ID NO: 1646202 - RNA, 13 nt, Human
ugcugguguaugu

SEQ ID NO: 1646203 - RNA, 22 nt, Human
ugcugguguaugugugaaguga

SEQ ID NO: 1646204 - RNA, 12 nt, Human
ugcugcuugagg

SEQ ID NO: 1646205 - RNA, 19 nt, Human
ugcugcuugaggcaacuca

SEQ ID NO: 1646206 - RNA, 20 nt, Human
ugcugggauuacagguguga

SEQ ID NO: 1646207 - RNA, 14 nt, Human
ugcugggccccugc

SEQ ID NO: 1646208 - RNA, 24 nt, Human
ugcugggccccugccucucugcag

SEQ ID NO: 1646209 - RNA, 23 nt, Human
ugcugggccccugccucucugca

SEQ ID NO: 1646210 - RNA, 22 nt, Human
ugcugggccccugccucucugc

SEQ ID NO: 1646211 - RNA, 21 nt, Human
ugcugggccccugccucucug

SEQ ID NO: 1646212 - RNA, 19 nt, Human
ugcugggccccugccucuc

SEQ ID NO: 1646213 - RNA, 18 nt, Human
ugcugggccccugccucu

SEQ ID NO: 1646214 - RNA, 17 nt, Human
ugcugggccccugccuc

SEQ ID NO: 1646215 - RNA, 16 nt, Human
ugcugggccccugccu

SEQ ID NO: 1646216 - RNA, 17 nt, Human
ugcugcauuuaaaagau

SEQ ID NO: 1646217 - RNA, 18 nt, Human
ugcugcauuuaaaagaua

SEQ ID NO: 1646218 - RNA, 19 nt, Human
ugcugcauuuaaaagauac

SEQ ID NO: 1646219 - RNA, 23 nt, Human
ugcugcauuuaaaagauacaguu

SEQ ID NO: 1646220 - RNA, 17 nt, Human
ugcugccugcuuuuuau

SEQ ID NO: 1646221 - RNA, 15 nt, Human
ugcugccugcuuuuu

SEQ ID NO: 1646222 - RNA, 17 nt, Human
ugcuagaacucccuuuc

SEQ ID NO: 1646223 - RNA, 15 nt, Human
ugcuagaacucccuu

SEQ ID NO: 1646224 - RNA, 14 nt, Human
ugcuagaacucccu

SEQ ID NO: 1646225 - RNA, 13 nt, Human
ugcuagaacuccc

SEQ ID NO: 1646226 - RNA, 18 nt, Human
ugcuagaacucccuuuca

SEQ ID NO: 1646227 - RNA, 21 nt, Human
ugcuaggaacacuccuucaca

SEQ ID NO: 1646228 - RNA, 22 nt, Human
ugcuaggaacacuccuucacag

SEQ ID NO: 1646229 - RNA, 20 nt, Human
ugcucaggagcccugggagg

SEQ ID NO: 1646230 - RNA, 19 nt, Human
ugcucaggagcccugggag

SEQ ID NO: 1646231 - RNA, 18 nt, Human
ugcucaggagcccuggga

SEQ ID NO: 1646232 - RNA, 15 nt, Human
ugcucaggagcccug

SEQ ID NO: 1646233 - RNA, 17 nt, Human
ugcucacauaucuguca

SEQ ID NO: 1646234 - RNA, 23 nt, Human
ugcucuccgaccagacaccuuga

SEQ ID NO: 1646235 - RNA, 12 nt, Human
ugcucuccucuu

SEQ ID NO: 1646236 - RNA, 14 nt, Human
ugcucuccucuugc

SEQ ID NO: 1646237 - RNA, 22 nt, Human
ugcuacuguccuacccacccuc

SEQ ID NO: 1646238 - RNA, 21 nt, Human
ugcuacuguccuacccacccu

SEQ ID NO: 1646239 - RNA, 22 nt, Human
ugcuaagacucaguggggaggg

SEQ ID NO: 1646240 - RNA, 17 nt, Human
ugcggacagccacggcc

SEQ ID NO: 1646241 - RNA, 20 nt, Human
ugccuugcauaauggucaga

SEQ ID NO: 1646242 - RNA, 23 nt, Human
ugcgcaggcuggcccugcccugg

SEQ ID NO: 1646243 - RNA, 22 nt, Human
ugcgcaggcuggcccugcccug

SEQ ID NO: 1646244 - RNA, 21 nt, Human
ugcgcaggcuggcccugcccu

SEQ ID NO: 1646245 - RNA, 21 nt, Human
ugcgcuaaacuuuucugauag

SEQ ID NO: 1646246 - RNA, 20 nt, Human
ugcgcuaaacuuuucugaua

SEQ ID NO: 1646247 - RNA, 19 nt, Human
ugcgcuaaacuuuucugau

SEQ ID NO: 1646248 - RNA, 14 nt, Human
ugcaguucugaaga

SEQ ID NO: 1646249 - RNA, 12 nt, Human
ugcaguucugaa

SEQ ID NO: 1646250 - RNA, 16 nt, Human
ugcaguugccagucac

SEQ ID NO: 1646251 - RNA, 22 nt, Human
ugcaucaauuuuucuuauuuca

SEQ ID NO: 1646252 - RNA, 18 nt, Human
ugcauauuauuuuauguu

SEQ ID NO: 1646253 - RNA, 13 nt, Human
ugcagggaguccg

SEQ ID NO: 1646254 - RNA, 21 nt, Human
ugcaguggugcgaucuggguu

SEQ ID NO: 1646255 - RNA, 21 nt, Human
ugcaguuacacuaaaagguga

SEQ ID NO: 1646256 - RNA, 19 nt, Human
ugcaucagcugcugaaaca

SEQ ID NO: 1646257 - RNA, 13 nt, Human
ugcaucagcugcu

SEQ ID NO: 1646258 - RNA, 17 nt, Human
ugcaugguuuagaaagc

SEQ ID NO: 1646259 - RNA, 21 nt, Human
ugcauuuggugguuucagaaa

SEQ ID NO: 1646260 - RNA, 23 nt, Human
ugcauuuggugguuucagaaaug

SEQ ID NO: 1646261 - RNA, 16 nt, Human
ugccacuaaauugaca

SEQ ID NO: 1646262 - RNA, 22 nt, Human
ugccaggaagccagcaggcucu

SEQ ID NO: 1646263 - RNA, 20 nt, Human
ugccaggaagccagcaggcu

SEQ ID NO: 1646264 - RNA, 14 nt, Human
ugccaggcauggug

SEQ ID NO: 1646265 - RNA, 23 nt, Human
ugccucacccacccuuuuuuaaa

SEQ ID NO: 1646266 - RNA, 20 nt, Human
ugccucacccacccuuuuuu

SEQ ID NO: 1646267 - RNA, 16 nt, Human
ugccuccucuucaacu

SEQ ID NO: 1646268 - RNA, 14 nt, Human
ugccuccucuucaa

SEQ ID NO: 1646269 - RNA, 14 nt, Human
ugccucaagagaag

SEQ ID NO: 1646270 - RNA, 15 nt, Human
ugccucaagagaagg

SEQ ID NO: 1646271 - RNA, 23 nt, Human
ugccuaaauccauuuggaaaucu

SEQ ID NO: 1646272 - RNA, 22 nt, Human
ugccuaaauccauuuggaaauc

SEQ ID NO: 1646273 - RNA, 20 nt, Human
ugccuaaauccauuuggaaa

SEQ ID NO: 1646274 - RNA, 23 nt, Human
ugcccugugaguacuacaguccu

SEQ ID NO: 1646275 - RNA, 23 nt, Human
ugcccugguuuccugcccuggga

SEQ ID NO: 1646276 - RNA, 20 nt, Human
ugcccugguuuccugcccug

SEQ ID NO: 1646277 - RNA, 19 nt, Human
ugcccugguuuccugcccu

SEQ ID NO: 1646278 - RNA, 19 nt, Human
ugccuaaauccauuuggaa

SEQ ID NO: 1646279 - RNA, 15 nt, Human
ugccuaaauccauuu

SEQ ID NO: 1646280 - RNA, 13 nt, Human
ugccuaaauccau

SEQ ID NO: 1646281 - RNA, 18 nt, Human
ugcccugguuuccugccc

SEQ ID NO: 1646282 - RNA, 17 nt, Human
ugcccugguuuccugcc

SEQ ID NO: 1646283 - RNA, 17 nt, Human
ugcccuggugcugccac

SEQ ID NO: 1646284 - RNA, 16 nt, Human
ugcccuggugcugcca

SEQ ID NO: 1646285 - RNA, 14 nt, Human
ugcccuggugcugc

SEQ ID NO: 1646286 - RNA, 12 nt, Human
ugcccuggugcu

SEQ ID NO: 1646287 - RNA, 21 nt, Human
ugcccugcccaccuggccucu

SEQ ID NO: 1646288 - RNA, 13 nt, Human
ugcccugggaggc

SEQ ID NO: 1646289 - RNA, 18 nt, Human
ugcccugggaggcaguga

SEQ ID NO: 1646290 - RNA, 17 nt, Human
ugcccugggaggcagug

SEQ ID NO: 1646291 - RNA, 15 nt, Human
ugcccugggaggcag

SEQ ID NO: 1646292 - RNA, 20 nt, Human
ugcccugcccaccuggccuc

SEQ ID NO: 1646293 - RNA, 16 nt, Human
ugcccugcccaccugg

SEQ ID NO: 1646294 - RNA, 15 nt, Human
ugcccugcccaccug

SEQ ID NO: 1646295 - RNA, 16 nt, Human
ugccccuggcagcccc

SEQ ID NO: 1646296 - RNA, 20 nt, Human
ugccccuccucucugcccua

SEQ ID NO: 1646297 - RNA, 19 nt, Human
ugccccuccucucugcccu

SEQ ID NO: 1646298 - RNA, 18 nt, Human
ugccccuccucucugccc

SEQ ID NO: 1646299 - RNA, 17 nt, Human
ugccccuccucucugcc

SEQ ID NO: 1646300 - RNA, 16 nt, Human
ugccccucccuucaac

SEQ ID NO: 1646301 - RNA, 15 nt, Human
ugccccucccuucaa

SEQ ID NO: 1646302 - RNA, 14 nt, Human
ugcccggcugcgga

SEQ ID NO: 1646303 - RNA, 12 nt, Human
ugcccggcugcg

SEQ ID NO: 1646304 - RNA, 17 nt, Human
ugccccuggcagccccu

SEQ ID NO: 1646305 - RNA, 20 nt, Human
ugcccaggcuggcgugcagu

SEQ ID NO: 1646306 - RNA, 19 nt, Human
ugcccaggcuggcgugcag

SEQ ID NO: 1646307 - RNA, 18 nt, Human
ugcccaggcuggcgugca

SEQ ID NO: 1646308 - RNA, 21 nt, Human
ugguauguuuucaggcuagau

SEQ ID NO: 1646309 - RNA, 13 nt, Human
ugguauguuuuca

SEQ ID NO: 1646310 - RNA, 22 nt, Human
uggucacaggaaguagaggagg

SEQ ID NO: 1646311 - RNA, 18 nt, Human
uggucacaggacucugcc

SEQ ID NO: 1646312 - RNA, 16 nt, Human
uggucccagccagcag

SEQ ID NO: 1646313 - RNA, 19 nt, Human
uggucacaggacucugccu

SEQ ID NO: 1646314 - RNA, 20 nt, Human
uggucacaggacucugccuc

SEQ ID NO: 1646315 - RNA, 14 nt, Human
uggucccccuucca

SEQ ID NO: 1646316 - RNA, 19 nt, Human
ugguccuaaucuucugaac

SEQ ID NO: 1646317 - RNA, 17 nt, Human
ugguccuaaucuucuga

SEQ ID NO: 1646318 - RNA, 23 nt, Human
ugguccugcugcaguugccaguc

SEQ ID NO: 1646319 - RNA, 15 nt, Human
ugguccugcugcagu

SEQ ID NO: 1646320 - RNA, 13 nt, Human
ugguccugcugca

SEQ ID NO: 1646321 - RNA, 23 nt, Human
uggucccccuuccauggacuuug

SEQ ID NO: 1646322 - RNA, 18 nt, Human
uggucccccuuccaugga

SEQ ID NO: 1646323 - RNA, 16 nt, Human
uggucccccuuccaug

SEQ ID NO: 1646324 - RNA, 15 nt, Human
uggucccccuuccau

SEQ ID NO: 1646325 - RNA, 20 nt, Human
ugguccgugcuaaggacuug

SEQ ID NO: 1646326 - RNA, 19 nt, Human
ugguccgugcuaaggacuu

SEQ ID NO: 1646327 - RNA, 18 nt, Human
ugguccgugcuaaggacu

SEQ ID NO: 1646328 - RNA, 17 nt, Human
ugguccgugcuaaggac

SEQ ID NO: 1646329 - RNA, 22 nt, Human
uggugaccucugccugaaguca

SEQ ID NO: 1646330 - RNA, 17 nt, Human
uggugaccucugccuga

SEQ ID NO: 1646331 - RNA, 16 nt, Human
uggugaccucugccug

SEQ ID NO: 1646332 - RNA, 15 nt, Human
uggugaccucugccu

SEQ ID NO: 1646333 - RNA, 19 nt, Human
uggugacuuuccucuuugg

SEQ ID NO: 1646334 - RNA, 19 nt, Human
uggugacugauucuucagc

SEQ ID NO: 1646335 - RNA, 16 nt, Human
uggugacugauucuuc

SEQ ID NO: 1646336 - RNA, 15 nt, Human
uggugacugauucuu

SEQ ID NO: 1646337 - RNA, 21 nt, Human
uggugcaaugaccuuucaaua

SEQ ID NO: 1646338 - RNA, 15 nt, Human
uggugacuuuggaua

SEQ ID NO: 1646339 - RNA, 18 nt, Human
uggucuacacugugcuga

SEQ ID NO: 1646340 - RNA, 17 nt, Human
uggucuacacugugcug

SEQ ID NO: 1646341 - RNA, 16 nt, Human
uggucuacacugugcu

SEQ ID NO: 1646342 - RNA, 15 nt, Human
uggucuacacugugc

SEQ ID NO: 1646343 - RNA, 14 nt, Human
uggugaccucugcc

SEQ ID NO: 1646344 - RNA, 13 nt, Human
uggugaccucugc

SEQ ID NO: 1646345 - RNA, 19 nt, Human
uggucuacacugugcugag

SEQ ID NO: 1646346 - RNA, 14 nt, Human
uggucggaaaacau

SEQ ID NO: 1646347 - RNA, 17 nt, Human
uggucggaaaacaugcu

SEQ ID NO: 1646348 - RNA, 13 nt, Human
ugggcagcugccu

SEQ ID NO: 1646349 - RNA, 14 nt, Human
ugggcagcugccuc

SEQ ID NO: 1646350 - RNA, 15 nt, Human
ugggcagcugccucc

SEQ ID NO: 1646351 - RNA, 23 nt, Human
ugggcagagcagagaccaucccu

SEQ ID NO: 1646352 - RNA, 17 nt, Human
ugggcagcugccucccc

SEQ ID NO: 1646353 - RNA, 19 nt, Human
ugggcagcugccuccccuc

SEQ ID NO: 1646354 - RNA, 14 nt, Human
ugggccuggcuccc

SEQ ID NO: 1646355 - RNA, 11 nt, Human
ugggccuucag

SEQ ID NO: 1646356 - RNA, 23 nt, Human
ugggccccugccucucugcaggu

SEQ ID NO: 1646357 - RNA, 21 nt, Human
ugggccccugccucucugcag

SEQ ID NO: 1646358 - RNA, 20 nt, Human
uggcugggggccucagugcc

SEQ ID NO: 1646359 - RNA, 17 nt, Human
uggcugggggccucagu

SEQ ID NO: 1646360 - RNA, 16 nt, Human
uggcugggggccucag

SEQ ID NO: 1646361 - RNA, 16 nt, Human
ugggagugggcccaau

SEQ ID NO: 1646362 - RNA, 14 nt, Human
ugggagugggccca

SEQ ID NO: 1646363 - RNA, 19 nt, Human
ugggaucacauguggacuu

SEQ ID NO: 1646364 - RNA, 13 nt, Human
ugggauccuccag

SEQ ID NO: 1646365 - RNA, 12 nt, Human
ugggauccucca

SEQ ID NO: 1646366 - RNA, 14 nt, Human
ugggauccuccagg

SEQ ID NO: 1646367 - RNA, 22 nt, Human
ugggcagagcagagaccauccc

SEQ ID NO: 1646368 - RNA, 17 nt, Human
ugggauuacaggcguga

SEQ ID NO: 1646369 - RNA, 22 nt, Human
ugggauuacaagcgugagccac

SEQ ID NO: 1646370 - RNA, 18 nt, Human
uggguacuuguggacaca

SEQ ID NO: 1646371 - RNA, 17 nt, Human
uggguacuuguggacac

SEQ ID NO: 1646372 - RNA, 22 nt, Human
uggggguucuuucuuccucugc

SEQ ID NO: 1646373 - RNA, 20 nt, Human
uggggguucuuucuuccucu

SEQ ID NO: 1646374 - RNA, 19 nt, Human
uggggguucuuucuuccuc

SEQ ID NO: 1646375 - RNA, 15 nt, Human
uggggguucuuucuu

SEQ ID NO: 1646376 - RNA, 16 nt, Human
ugggggaguggccaca

SEQ ID NO: 1646377 - RNA, 13 nt, Human
uggggggggugcu

SEQ ID NO: 1646378 - RNA, 23 nt, Human
uggggaugagaaagguugaagca

SEQ ID NO: 1646379 - RNA, 15 nt, Human
uggggaugagaaagg

SEQ ID NO: 1646380 - RNA, 20 nt, Human
uggggccaguuggucccccu

SEQ ID NO: 1646381 - RNA, 21 nt, Human
uggggccaguuggucccccuu

SEQ ID NO: 1646382 - RNA, 22 nt, Human
uggggccaggcugggucgcccu

SEQ ID NO: 1646383 - RNA, 21 nt, Human
uggggccaggcugggucgccc

SEQ ID NO: 1646384 - RNA, 12 nt, Human
ugggccuucagg

SEQ ID NO: 1646385 - RNA, 15 nt, Human
ugggccuucagggag

SEQ ID NO: 1646386 - RNA, 15 nt, Human
uggcacuaguauuuc

SEQ ID NO: 1646387 - RNA, 20 nt, Human
uggcaauagucaaauugugu

SEQ ID NO: 1646388 - RNA, 16 nt, Human
uggcacuauaauguaa

SEQ ID NO: 1646389 - RNA, 15 nt, Human
uggcacuauaaugua

SEQ ID NO: 1646390 - RNA, 12 nt, Human
uggcaaaaaggc

SEQ ID NO: 1646391 - RNA, 16 nt, Human
uggcaaaaaggcagga

SEQ ID NO: 1646392 - RNA, 23 nt, Human
uggaggaaggaaacccagcucug

SEQ ID NO: 1646393 - RNA, 21 nt, Human
uggaggaaggaaacccagcuc

SEQ ID NO: 1646394 - RNA, 17 nt, Human
uggagacugucucaaga

SEQ ID NO: 1646395 - RNA, 14 nt, Human
uggagacugucuca

SEQ ID NO: 1646396 - RNA, 20 nt, Human
uggauaauaaggaaaaguuu

SEQ ID NO: 1646397 - RNA, 14 nt, Human
uggacuccucuguc

SEQ ID NO: 1646398 - RNA, 13 nt, Human
uggacuccucugu

SEQ ID NO: 1646399 - RNA, 21 nt, Human
uggagaagcucccugaaguaa

SEQ ID NO: 1646400 - RNA, 22 nt, Human
uggaccaaaaaccaguauugua

SEQ ID NO: 1646401 - RNA, 18 nt, Human
uggccagaugcaccagcc

SEQ ID NO: 1646402 - RNA, 17 nt, Human
uggccagaugcaccagc

SEQ ID NO: 1646403 - RNA, 19 nt, Human
uggcagaguugaagacaga

SEQ ID NO: 1646404 - RNA, 17 nt, Human
uggcagaguugaagaca

SEQ ID NO: 1646405 - RNA, 21 nt, Human
uggcagaguggauucuugaac

SEQ ID NO: 1646406 - RNA, 15 nt, Human
uggcagaguugaaga

SEQ ID NO: 1646407 - RNA, 12 nt, Human
uggcagaggagg

SEQ ID NO: 1646408 - RNA, 19 nt, Human
uggccagaugcaccagccc

SEQ ID NO: 1646409 - RNA, 20 nt, Human
uggccagaugcaccagcccu

SEQ ID NO: 1646410 - RNA, 17 nt, Human
uggccaggcugcucuug

SEQ ID NO: 1646411 - RNA, 16 nt, Human
uggccaggcugcucuu

SEQ ID NO: 1646412 - RNA, 13 nt, Human
uggccaggcuggu

SEQ ID NO: 1646413 - RNA, 15 nt, Human
uggccaggcuggucu

SEQ ID NO: 1646414 - RNA, 20 nt, Human
uggccaggcugcucuugaac

SEQ ID NO: 1646415 - RNA, 16 nt, Human
uggccccugcccggcu

SEQ ID NO: 1646416 - RNA, 15 nt, Human
uggccccugcccggc

SEQ ID NO: 1646417 - RNA, 20 nt, Human
uggccccugcccggcugcgg

SEQ ID NO: 1646418 - RNA, 23 nt, Human
uggcgcugccccuggcagccccu

SEQ ID NO: 1646419 - RNA, 16 nt, Human
uggcgcugccccuggc

SEQ ID NO: 1646420 - RNA, 23 nt, Human
uggcgcagcauauucaggaagcu

SEQ ID NO: 1646421 - RNA, 22 nt, Human
uggcgcagcauauucaggaagc

SEQ ID NO: 1646422 - RNA, 23 nt, Human
uggccucccaacucaccccagcc

SEQ ID NO: 1646423 - RNA, 16 nt, Human
uggcugcuucaaggau

SEQ ID NO: 1646424 - RNA, 15 nt, Human
uggcugcuucaagga

SEQ ID NO: 1646425 - RNA, 11 nt, Human
uggcugcuuca

SEQ ID NO: 1646426 - RNA, 16 nt, Human
uggcuccucccggugc

SEQ ID NO: 1646427 - RNA, 14 nt, Human
uggcuccucccggu

SEQ ID NO: 1646428 - RNA, 19 nt, Human
uggcuccucccggugccca

SEQ ID NO: 1646429 - RNA, 18 nt, Human
uggcuccucccggugccc

SEQ ID NO: 1646430 - RNA, 15 nt, Human
uggcgggguggggug

SEQ ID NO: 1646431 - RNA, 20 nt, Human
uggcucccacaggcccuucc

SEQ ID NO: 1646432 - RNA, 17 nt, Human
uggcucccacaggcccu

SEQ ID NO: 1646433 - RNA, 14 nt, Human
uggcucccacaggc

SEQ ID NO: 1646434 - RNA, 18 nt, Human
uuaacuuuuauaaacuuu

SEQ ID NO: 1646435 - RNA, 16 nt, Human
uuaacuuuuauaaacu

SEQ ID NO: 1646436 - RNA, 17 nt, Human
uuaacuuuuauaaacuu

SEQ ID NO: 1646437 - RNA, 15 nt, Human
uuaacuuuuauaaac

SEQ ID NO: 1646438 - RNA, 16 nt, Human
uuaacuucacauauug

SEQ ID NO: 1646439 - RNA, 17 nt, Human
uuaaccacuucagcuga

SEQ ID NO: 1646440 - RNA, 23 nt, Human
uuaaauguuuuuuuuuaaagacu

SEQ ID NO: 1646441 - RNA, 21 nt, Human
uuaaauguuuuuuuuuaaaga

SEQ ID NO: 1646442 - RNA, 14 nt, Human
uuaaagacuuuuau

SEQ ID NO: 1646443 - RNA, 22 nt, Human
uuaauauuaaagccauguuuau

SEQ ID NO: 1646444 - RNA, 21 nt, Human
uuaauauuaaagccauguuua

SEQ ID NO: 1646445 - RNA, 22 nt, Human
uuaauauugauaugcuuauaca

SEQ ID NO: 1646446 - RNA, 18 nt, Human
uuaauauugauaugcuua

SEQ ID NO: 1646447 - RNA, 17 nt, Human
uuaagcuguuacugucu

SEQ ID NO: 1646448 - RNA, 16 nt, Human
uuaagccuuuggaaac

SEQ ID NO: 1646449 - RNA, 15 nt, Human
uuaagccuuuggaaa

SEQ ID NO: 1646450 - RNA, 23 nt, Human
uuaagcauauauuuuuauauuua

SEQ ID NO: 1646451 - RNA, 19 nt, Human
uuaagcauauauuuuuaua

SEQ ID NO: 1646452 - RNA, 18 nt, Human
uuaagcauauauuuuuau

SEQ ID NO: 1646453 - RNA, 15 nt, Human
uuaagcauauauuuu

SEQ ID NO: 1646454 - RNA, 13 nt, Human
uuaagcauauauu

SEQ ID NO: 1646455 - RNA, 22 nt, Human
uuaaugucaauucuugccaaau

SEQ ID NO: 1646456 - RNA, 20 nt, Human
uuacaagcgugagccacugc

SEQ ID NO: 1646457 - RNA, 21 nt, Human
uuacaagcgugagccacugca

SEQ ID NO: 1646458 - RNA, 22 nt, Human
uuaaaagaauauuuuaacuucc

SEQ ID NO: 1646459 - RNA, 21 nt, Human
uuaaaagaauauuuuaacuuc

SEQ ID NO: 1646460 - RNA, 14 nt, Human
uuaaaagauacagu

SEQ ID NO: 1646461 - RNA, 17 nt, Human
uuaaaagauacaguuac

SEQ ID NO: 1646462 - RNA, 18 nt, Human
uguuuuuuuuuaaagacu

SEQ ID NO: 1646463 - RNA, 19 nt, Human
uguuuuuuuuuuccacuua

SEQ ID NO: 1646464 - RNA, 18 nt, Human
uguuuuuuuuuuccacuu

SEQ ID NO: 1646465 - RNA, 19 nt, Human
uguuuuaaggaugcuugua

SEQ ID NO: 1646466 - RNA, 22 nt, Human
uguuuuaagaggcagggucuca

SEQ ID NO: 1646467 - RNA, 18 nt, Human
uguuuuaaggaugcuugu

SEQ ID NO: 1646468 - RNA, 17 nt, Human
uguuuuguuuggagaca

SEQ ID NO: 1646469 - RNA, 18 nt, Human
uuaaaagaugaaaauauu

SEQ ID NO: 1646470 - RNA, 15 nt, Human
uuaaaagaugaaaau

SEQ ID NO: 1646471 - RNA, 13 nt, Human
uuaaaagaaugau

SEQ ID NO: 1646472 - RNA, 21 nt, Human
uuaaaauaccagccaguaaau

SEQ ID NO: 1646473 - RNA, 19 nt, Human
uguuucaaacauauauaac

SEQ ID NO: 1646474 - RNA, 16 nt, Human
uguuuagauaauacac

SEQ ID NO: 1646475 - RNA, 14 nt, Human
uggugcccugcuuu

SEQ ID NO: 1646476 - RNA, 22 nt, Human
uguuucaaacauauauaacaau

SEQ ID NO: 1646477 - RNA, 21 nt, Human
uguuucaaacauauauaacaa

SEQ ID NO: 1646478 - RNA, 20 nt, Human
uguuuagauaauacaccacu

SEQ ID NO: 1646479 - RNA, 15 nt, Human
uguuucaaacuuuac

SEQ ID NO: 1646480 - RNA, 13 nt, Human
uguuugugauuga

SEQ ID NO: 1646481 - RNA, 20 nt, Human
uguuuuaagaggcagggucu

SEQ ID NO: 1646482 - RNA, 21 nt, Human
uuagaugcaguucugaagaag

SEQ ID NO: 1646483 - RNA, 20 nt, Human
uuagaugcaguucugaagaa

SEQ ID NO: 1646484 - RNA, 22 nt, Human
uuagauaauacaccacuacauu

SEQ ID NO: 1646485 - RNA, 14 nt, Human
uuagaucuaguuca

SEQ ID NO: 1646486 - RNA, 13 nt, Human
uuagaucuaguuc

SEQ ID NO: 1646487 - RNA, 14 nt, Human
uuagaguugauacu

SEQ ID NO: 1646488 - RNA, 12 nt, Human
uuagagauuuuu

SEQ ID NO: 1646489 - RNA, 18 nt, Human
uuagagaguguugaaacg

SEQ ID NO: 1646490 - RNA, 13 nt, Human
uuagcuggaaaag

SEQ ID NO: 1646491 - RNA, 12 nt, Human
uuagcuggaaaa

SEQ ID NO: 1646492 - RNA, 12 nt, Human
uuagcugggaga

SEQ ID NO: 1646493 - RNA, 18 nt, Human
uuaggauguugaaaaagu

SEQ ID NO: 1646494 - RNA, 16 nt, Human
uuaguaugaggcauuu

SEQ ID NO: 1646495 - RNA, 18 nt, Human
uuaguaugaggcauuugu

SEQ ID NO: 1646496 - RNA, 14 nt, Human
uuaguguucauaaa

SEQ ID NO: 1646497 - RNA, 19 nt, Human
uuagaaacacaacuauauu

SEQ ID NO: 1646498 - RNA, 15 nt, Human
uuagacagucccugc

SEQ ID NO: 1646499 - RNA, 14 nt, Human
uuacuuuguguuca

SEQ ID NO: 1646500 - RNA, 18 nt, Human
uuacuuuaaaaggagcca

SEQ ID NO: 1646501 - RNA, 17 nt, Human
uuacuuuaaaaggagcc

SEQ ID NO: 1646502 - RNA, 18 nt, Human
uuagacagucccugccaa

SEQ ID NO: 1646503 - RNA, 17 nt, Human
uuagacagucccugcca

SEQ ID NO: 1646504 - RNA, 16 nt, Human
uuagacagucccugcc

SEQ ID NO: 1646505 - RNA, 17 nt, Human
uuagagaguguugaaac

SEQ ID NO: 1646506 - RNA, 16 nt, Human
uuagagaguguugaaa

SEQ ID NO: 1646507 - RNA, 14 nt, Human
uuagagaguguuga

SEQ ID NO: 1646508 - RNA, 17 nt, Human
uuacuaguuucccuugc

SEQ ID NO: 1646509 - RNA, 19 nt, Human
uuacuaucaugucaaacgu

SEQ ID NO: 1646510 - RNA, 21 nt, Human
uuacuaucaugucaaacguga

SEQ ID NO: 1646511 - RNA, 13 nt, Human
uuacuaaguuuuu

SEQ ID NO: 1646512 - RNA, 14 nt, Human
uuacuaaguuuuua

SEQ ID NO: 1646513 - RNA, 16 nt, Human
uuacuaauagacaauu

SEQ ID NO: 1646514 - RNA, 18 nt, Human
uuacuuagguguggggga

SEQ ID NO: 1646515 - RNA, 23 nt, Human
uuacuucuuauacauuugauaaa

SEQ ID NO: 1646516 - RNA, 12 nt, Human
uuacuucugcua

SEQ ID NO: 1646517 - RNA, 11 nt, Human
uuacuucugcu

SEQ ID NO: 1646518 - RNA, 21 nt, Human
uuacuuaaaccgccaaggcug

SEQ ID NO: 1646519 - RNA, 19 nt, Human
uuacuauggcccuggccua

SEQ ID NO: 1646520 - RNA, 19 nt, Human
uuacugucuuuuuucuaaa

SEQ ID NO: 1646521 - RNA, 17 nt, Human
uuacugucuuuuuucua

SEQ ID NO: 1646522 - RNA, 19 nt, Human
uuccagauccuggaaauca

SEQ ID NO: 1646523 - RNA, 21 nt, Human
uuccagagaguggcuccuccc

SEQ ID NO: 1646524 - RNA, 20 nt, Human
uuccagagaguggcuccucc

SEQ ID NO: 1646525 - RNA, 19 nt, Human
uuccagagaguggcuccuc

SEQ ID NO: 1646526 - RNA, 18 nt, Human
uuccagagaguggcuccu

SEQ ID NO: 1646527 - RNA, 17 nt, Human
uuccagagaguggcucc

SEQ ID NO: 1646528 - RNA, 15 nt, Human
uuccaaauucugcuu

SEQ ID NO: 1646529 - RNA, 17 nt, Human
uucaugcaaacuuuauu

SEQ ID NO: 1646530 - RNA, 16 nt, Human
uucauuuccugugucu

SEQ ID NO: 1646531 - RNA, 15 nt, Human
uucauuuccuguguc

SEQ ID NO: 1646532 - RNA, 15 nt, Human
uucaggaagcucagg

SEQ ID NO: 1646533 - RNA, 13 nt, Human
uucaggaagcuca

SEQ ID NO: 1646534 - RNA, 11 nt, Human
uucaggaagcu

SEQ ID NO: 1646535 - RNA, 21 nt, Human
uucaucuugaauuguaaggaa

SEQ ID NO: 1646536 - RNA, 17 nt, Human
uucaugaaagauucaau

SEQ ID NO: 1646537 - RNA, 15 nt, Human
uucaugaaagauuca

SEQ ID NO: 1646538 - RNA, 20 nt, Human
uuccccaggaggccagccuu

SEQ ID NO: 1646539 - RNA, 19 nt, Human
uuccccaggaggccagccu

SEQ ID NO: 1646540 - RNA, 18 nt, Human
uuccccaggaggccagcc

SEQ ID NO: 1646541 - RNA, 17 nt, Human
uuccccaggaggccagc

SEQ ID NO: 1646542 - RNA, 21 nt, Human
uuccccaggaggccagccuug

SEQ ID NO: 1646543 - RNA, 11 nt, Human
uuccccauggg

SEQ ID NO: 1646544 - RNA, 19 nt, Human
uuccccaugucucgacuca

SEQ ID NO: 1646545 - RNA, 20 nt, Human
uucccucccuuccucuuucc

SEQ ID NO: 1646546 - RNA, 17 nt, Human
uucccucccuuccucuu

SEQ ID NO: 1646547 - RNA, 11 nt, Human
uucccucccuu

SEQ ID NO: 1646548 - RNA, 16 nt, Human
uuccccaggaggccag

SEQ ID NO: 1646549 - RNA, 15 nt, Human
uuccccaggaggcca

SEQ ID NO: 1646550 - RNA, 16 nt, Human
uucccauuugcuccuu

SEQ ID NO: 1646551 - RNA, 14 nt, Human
uucccauucuugca

SEQ ID NO: 1646552 - RNA, 23 nt, Human
uuccagcaauucuccugccucag

SEQ ID NO: 1646553 - RNA, 22 nt, Human
uuccagcaauucuccugccuca

SEQ ID NO: 1646554 - RNA, 21 nt, Human
uuccagcaauucuccugccuc

SEQ ID NO: 1646555 - RNA, 20 nt, Human
uuccagcaauucuccugccu

SEQ ID NO: 1646556 - RNA, 20 nt, Human
uuccuuggacucauuuuaaa

SEQ ID NO: 1646557 - RNA, 20 nt, Human
uucgggaggucgaggcagga

SEQ ID NO: 1646558 - RNA, 17 nt, Human
uucuaaagcugccagcc

SEQ ID NO: 1646559 - RNA, 13 nt, Human
uucuaaagcugcc

SEQ ID NO: 1646560 - RNA, 20 nt, Human
uuccuugaguugauucagcu

SEQ ID NO: 1646561 - RNA, 14 nt, Human
uuccuggcacugcu

SEQ ID NO: 1646562 - RNA, 19 nt, Human
uuccugaugcuucuucaga

SEQ ID NO: 1646563 - RNA, 18 nt, Human
uuccugaugcuucuucag

SEQ ID NO: 1646564 - RNA, 15 nt, Human
uuccugaugcuucuu

SEQ ID NO: 1646565 - RNA, 23 nt, Human
uuccugaugcuucuucagagacu

SEQ ID NO: 1646566 - RNA, 18 nt, Human
uuccugcauuugugaaau

SEQ ID NO: 1646567 - RNA, 16 nt, Human
uuccugcauuugugaa

SEQ ID NO: 1646568 - RNA, 17 nt, Human
uuccugccaggcauggu

SEQ ID NO: 1646569 - RNA, 18 nt, Human
uucccuugaugaagaagu

SEQ ID NO: 1646570 - RNA, 20 nt, Human
uucccuuugacgccauccca

SEQ ID NO: 1646571 - RNA, 22 nt, Human
uucccuuugacgccaucccagc

SEQ ID NO: 1646572 - RNA, 21 nt, Human
uucccuuugacgccaucccag

SEQ ID NO: 1646573 - RNA, 13 nt, Human
uuccucauuagca

SEQ ID NO: 1646574 - RNA, 17 nt, Human
uucccuugaugaagaag

SEQ ID NO: 1646575 - RNA, 19 nt, Human
uucccccuccaaucccacc

SEQ ID NO: 1646576 - RNA, 15 nt, Human
uuauugcccacgcug

SEQ ID NO: 1646577 - RNA, 11 nt, Human
uuauucugcuc

SEQ ID NO: 1646578 - RNA, 17 nt, Human
uuauggcuauaggugcu

SEQ ID NO: 1646579 - RNA, 18 nt, Human
uuauuacuguaagaaaau

SEQ ID NO: 1646580 - RNA, 17 nt, Human
uuauuacuguaagaaaa

SEQ ID NO: 1646581 - RNA, 16 nt, Human
uuauuacuguaagaaa

SEQ ID NO: 1646582 - RNA, 14 nt, Human
uuauuacaguauaa

SEQ ID NO: 1646583 - RNA, 21 nt, Human
uuauggcacuaguauuucuau

SEQ ID NO: 1646584 - RNA, 16 nt, Human
uuauggaacacucuga

SEQ ID NO: 1646585 - RNA, 16 nt, Human
uuaugcaugaaguaau

SEQ ID NO: 1646586 - RNA, 22 nt, Human
uuaugcaugaaguaauaugcac

SEQ ID NO: 1646587 - RNA, 17 nt, Human
uuaucuagauacuguau

SEQ ID NO: 1646588 - RNA, 17 nt, Human
uuaucugaagucagauc

SEQ ID NO: 1646589 - RNA, 20 nt, Human
uuaucuugaauaauguaaga

SEQ ID NO: 1646590 - RNA, 14 nt, Human
uuaguuccuugagu

SEQ ID NO: 1646591 - RNA, 16 nt, Human
uuaguuccucauuagc

SEQ ID NO: 1646592 - RNA, 13 nt, Human
uuaguugcaacuu

SEQ ID NO: 1646593 - RNA, 16 nt, Human
uuaucuagauacugua

SEQ ID NO: 1646594 - RNA, 20 nt, Human
uuaguugcaacuuuguauaa

SEQ ID NO: 1646595 - RNA, 15 nt, Human
uuauugucuagugaa

SEQ ID NO: 1646596 - RNA, 18 nt, Human
uuauugucaaagugguga

SEQ ID NO: 1646597 - RNA, 17 nt, Human
uuauugucaaaguggug

SEQ ID NO: 1646598 - RNA, 16 nt, Human
uuauuuuaauaauguu

SEQ ID NO: 1646599 - RNA, 15 nt, Human
uuauuuuaauaaugu

SEQ ID NO: 1646600 - RNA, 22 nt, Human
uuauuggcuuuucugauccagu

SEQ ID NO: 1646601 - RNA, 18 nt, Human
uuauuggcuuuucugauc

SEQ ID NO: 1646602 - RNA, 16 nt, Human
uuauuggcuuuucuga

SEQ ID NO: 1646603 - RNA, 12 nt, Human
uuauuggcuuuu

SEQ ID NO: 1646604 - RNA, 17 nt, Human
uuauuuuaauaauguuu

SEQ ID NO: 1646605 - RNA, 20 nt, Human
uuauuuuauguugcauagaa

SEQ ID NO: 1646606 - RNA, 14 nt, Human
uuauuuuauuauga

SEQ ID NO: 1646607 - RNA, 13 nt, Human
uuauuuuauuaug

SEQ ID NO: 1646608 - RNA, 17 nt, Human
uucaaauccuugaagau

SEQ ID NO: 1646609 - RNA, 19 nt, Human
uucaacgcagcccugcuuu

SEQ ID NO: 1646610 - RNA, 16 nt, Human
uucaacgcagcccugc

SEQ ID NO: 1646611 - RNA, 20 nt, Human
uucaacgcagcccugcuuug

SEQ ID NO: 1646612 - RNA, 17 nt, Human
uucaacugaccagccuc

SEQ ID NO: 1646613 - RNA, 23 nt, Human
uucaaaguugccuaaauccauuu

SEQ ID NO: 1646614 - RNA, 17 nt, Human
uucaaaguugccuaaau

SEQ ID NO: 1646615 - RNA, 16 nt, Human
uucaaaguugccuaaa

SEQ ID NO: 1646616 - RNA, 15 nt, Human
uucaaaguugccuaa

SEQ ID NO: 1646617 - RNA, 11 nt, Human
uucaaaguugc

SEQ ID NO: 1646618 - RNA, 20 nt, Human
uucagacauagaauuaacac

SEQ ID NO: 1646619 - RNA, 16 nt, Human
uucagacauagaauua

SEQ ID NO: 1646620 - RNA, 21 nt, Human
uucagacagcugccugggauc

SEQ ID NO: 1646621 - RNA, 13 nt, Human
uucacucuccuug

SEQ ID NO: 1646622 - RNA, 20 nt, Human
uucagauaaucacaauacau

SEQ ID NO: 1646623 - RNA, 22 nt, Human
uucagaguugaugguuguacau

SEQ ID NO: 1646624 - RNA, 21 nt, Human
uucagaguugaugguuguaca

SEQ ID NO: 1646625 - RNA, 13 nt, Human
uucagagcugccc

SEQ ID NO: 1646626 - RNA, 14 nt, Human
uucagagcugcccu

SEQ ID NO: 1646627 - RNA, 21 nt, Human
uucacucuccauuuaauaauu

SEQ ID NO: 1646628 - RNA, 20 nt, Human
uucaauaggaaaaacugauu

SEQ ID NO: 1646629 - RNA, 18 nt, Human
uucaauaggaaaaacuga

SEQ ID NO: 1646630 - RNA, 15 nt, Human
uucaauaggaaaaac

SEQ ID NO: 1646631 - RNA, 13 nt, Human
uucaauaggaaaa

SEQ ID NO: 1646632 - RNA, 18 nt, Human
uucacggaagagccuugc

SEQ ID NO: 1646633 - RNA, 15 nt, Human
uucacgugguccuaa

SEQ ID NO: 1646634 - RNA, 17 nt, Human
uuugagaucagccuggg

SEQ ID NO: 1646635 - RNA, 16 nt, Human
uuugagaucagccugg

SEQ ID NO: 1646636 - RNA, 21 nt, Human
uuugaaauuguauuacaaauc

SEQ ID NO: 1646637 - RNA, 18 nt, Human
uuugaagcacagugauca

SEQ ID NO: 1646638 - RNA, 19 nt, Human
uuucuuguguguuuauugu

SEQ ID NO: 1646639 - RNA, 18 nt, Human
uuucuuaaccagaucauu

SEQ ID NO: 1646640 - RNA, 23 nt, Human
uuucugaucugaugcaagcaaga

SEQ ID NO: 1646641 - RNA, 18 nt, Human
uuugguaaggggaauuga

SEQ ID NO: 1646642 - RNA, 15 nt, Human
uuuguauucucuccu

SEQ ID NO: 1646643 - RNA, 16 nt, Human
uuuguaugcacuuugu

SEQ ID NO: 1646644 - RNA, 14 nt, Human
uuugcuugaaagaa

SEQ ID NO: 1646645 - RNA, 16 nt, Human
uuugcuugaaagaaaa

SEQ ID NO: 1646646 - RNA, 19 nt, Human
uuuggacccugaggcccag

SEQ ID NO: 1646647 - RNA, 15 nt, Human
uuuggacccugaggc

SEQ ID NO: 1646648 - RNA, 14 nt, Human
uuugauccaagcug

SEQ ID NO: 1646649 - RNA, 17 nt, Human
uuugauaugugaacagu

SEQ ID NO: 1646650 - RNA, 15 nt, Human
uuugauaugugaaca

SEQ ID NO: 1646651 - RNA, 14 nt, Human
uuugauaugugaac

SEQ ID NO: 1646652 - RNA, 17 nt, Human
uuucagccaagaauucu

SEQ ID NO: 1646653 - RNA, 17 nt, Human
uuuauggcacuaguauu

SEQ ID NO: 1646654 - RNA, 22 nt, Human
uuuaugauacuugaaaauuaac

SEQ ID NO: 1646655 - RNA, 20 nt, Human
uuuccuaaauauauuuuaag

SEQ ID NO: 1646656 - RNA, 19 nt, Human
uuucuaaaucuccaaaaua

SEQ ID NO: 1646657 - RNA, 22 nt, Human
uuucuaaaguaaaaacaaagaa

SEQ ID NO: 1646658 - RNA, 17 nt, Human
uuucuaaaguaaaaaca

SEQ ID NO: 1646659 - RNA, 19 nt, Human
uuuccuggcacugcuucca

SEQ ID NO: 1646660 - RNA, 23 nt, Human
uuuccuggcacugcuuccaguga

SEQ ID NO: 1646661 - RNA, 22 nt, Human
uuuccucuuagucgagccaagu

SEQ ID NO: 1646662 - RNA, 12 nt, Human
uuucucuaggaa

SEQ ID NO: 1646663 - RNA, 18 nt, Human
uuucuacccagcgagccc

SEQ ID NO: 1646664 - RNA, 15 nt, Human
uuucuacccagcgag

SEQ ID NO: 1646665 - RNA, 22 nt, Human
uuucuacccagcgagcccuggu

SEQ ID NO: 1646666 - RNA, 14 nt, Human
uuucugaaauaaca

SEQ ID NO: 1646667 - RNA, 19 nt, Human
uuucugaaauuuccuggga

SEQ ID NO: 1646668 - RNA, 12 nt, Human
uuucugaaauuu

SEQ ID NO: 1646669 - RNA, 13 nt, Human
uuucugauccagu

SEQ ID NO: 1646670 - RNA, 22 nt, Human
uuucugauccaguuuuguuugg

SEQ ID NO: 1646671 - RNA, 20 nt, Human
uuucugauccaguuuuguuu

SEQ ID NO: 1646672 - RNA, 16 nt, Human
uuucugauccaguuuu

SEQ ID NO: 1646673 - RNA, 15 nt, Human
uuucugauccaguuu

SEQ ID NO: 1646674 - RNA, 12 nt, Human
uuuauacauaaa

SEQ ID NO: 1646675 - RNA, 20 nt, Human
uuuauacauaaacaagacca

SEQ ID NO: 1646676 - RNA, 19 nt, Human
uuuagacccuauugcugcu

SEQ ID NO: 1646677 - RNA, 22 nt, Human
uuuagacccuauugcugcuuga

SEQ ID NO: 1646678 - RNA, 18 nt, Human
uuuaguugcaacuuugua

SEQ ID NO: 1646679 - RNA, 17 nt, Human
uuuaguugcaacuuugu

SEQ ID NO: 1646680 - RNA, 13 nt, Human
uuuacagagacag

SEQ ID NO: 1646681 - RNA, 14 nt, Human
uuuaauauuaaagc

SEQ ID NO: 1646682 - RNA, 21 nt, Human
uuuaauauuaaagccauguuu

SEQ ID NO: 1646683 - RNA, 20 nt, Human
uuuaauauuaaagccauguu

SEQ ID NO: 1646684 - RNA, 17 nt, Human
uuuaauauuaaagccau

SEQ ID NO: 1646685 - RNA, 15 nt, Human
uuuaauauuaaagcc

SEQ ID NO: 1646686 - RNA, 16 nt, Human
uuuacauggcuggagc

SEQ ID NO: 1646687 - RNA, 13 nt, Human
uuuacagcugccu

SEQ ID NO: 1646688 - RNA, 19 nt, Human
uuuaauaauguuucaaaca

SEQ ID NO: 1646689 - RNA, 14 nt, Human
uuuaauaauuauau

SEQ ID NO: 1646690 - RNA, 15 nt, Human
uuuaauaauguuuca

SEQ ID NO: 1646691 - RNA, 14 nt, Human
uuuaauaauguuuc

SEQ ID NO: 1646692 - RNA, 13 nt, Human
uuuaauaaaccau

SEQ ID NO: 1646693 - RNA, 22 nt, Human
uuuaauaaacacucuugaaaaa

SEQ ID NO: 1646694 - RNA, 14 nt, Human
uuuaacagaaaugu

SEQ ID NO: 1646695 - RNA, 15 nt, Human
uuuaacagaaaugua

SEQ ID NO: 1646696 - RNA, 14 nt, Human
uuuaaccucuaaau

SEQ ID NO: 1646697 - RNA, 15 nt, Human
uuuaauaaacacucu

SEQ ID NO: 1646698 - RNA, 14 nt, Human
uuuaauaaacacuc

SEQ ID NO: 1646699 - RNA, 17 nt, Human
uuguuuaaaaucauuuc

SEQ ID NO: 1646700 - RNA, 18 nt, Human
uuguuuaaaaucauuucu

SEQ ID NO: 1646701 - RNA, 15 nt, Human
uugucuuuggacccu

SEQ ID NO: 1646702 - RNA, 24 nt, Human
uugucuuuggacccugaggcccag

SEQ ID NO: 1646703 - RNA, 20 nt, Human
uugucuuuggacccugaggc

SEQ ID NO: 1646704 - RNA, 14 nt, Human
uuguuuguuuaguc

SEQ ID NO: 1646705 - RNA, 13 nt, Human
uuguuuguuuagu

SEQ ID NO: 1646706 - RNA, 20 nt, Human
uuguuuggggaugagaaagg

SEQ ID NO: 1646707 - RNA, 14 nt, Human
uuguuucuguacuu

SEQ ID NO: 1646708 - RNA, 12 nt, Human
uuguuucuguac

SEQ ID NO: 1646709 - RNA, 17 nt, Human
uuuaaaagaaugauuau

SEQ ID NO: 1646710 - RNA, 14 nt, Human
uuuaaaagaaugau

SEQ ID NO: 1646711 - RNA, 13 nt, Human
uuuaaaagauaca

SEQ ID NO: 1646712 - RNA, 16 nt, Human
uuuaaaaucauuucug

SEQ ID NO: 1646713 - RNA, 19 nt, Human
uuuaaaauacacacucaaa

SEQ ID NO: 1646714 - RNA, 12 nt, Human
uuuaaaaugucu

SEQ ID NO: 1646715 - RNA, 16 nt, Human
uuuaaaaugagaaauc

SEQ ID NO: 1646716 - RNA, 13 nt, Human
uuuaacagaaaug

SEQ ID NO: 1646717 - RNA, 15 nt, Human
uuguagcauccugga

SEQ ID NO: 1646718 - RNA, 22 nt, Human
uuguagaagucacauuccugaa

SEQ ID NO: 1646719 - RNA, 17 nt, Human
uuguagaagucacauuc

SEQ ID NO: 1646720 - RNA, 18 nt, Human
uuguacuuuagggaagua

SEQ ID NO: 1646721 - RNA, 16 nt, Human
uuguaccgcaauguga

SEQ ID NO: 1646722 - RNA, 20 nt, Human
uuguaaaauggugugaccac

SEQ ID NO: 1646723 - RNA, 14 nt, Human
uugucuaugggacu

SEQ ID NO: 1646724 - RNA, 22 nt, Human
uugucaaaguggugagaggcau

SEQ ID NO: 1646725 - RNA, 20 nt, Human
uuguaugauccuaaugaaug

SEQ ID NO: 1646726 - RNA, 22 nt, Human
uuguaugaaagauggcugugcc

SEQ ID NO: 1646727 - RNA, 20 nt, Human
uugucuaugggacucaaugc

SEQ ID NO: 1646728 - RNA, 18 nt, Human
uugucugaagucacugca

SEQ ID NO: 1646729 - RNA, 20 nt, Human
uugucugaagucacugcaca

SEQ ID NO: 1646730 - RNA, 17 nt, Human
uugucugaagucacugc

SEQ ID NO: 1646731 - RNA, 13 nt, Human
uuguaaaauggug

SEQ ID NO: 1646732 - RNA, 12 nt, Human
uuguaaaauggu

SEQ ID NO: 1646733 - RNA, 15 nt, Human
uuggucugugagaug

SEQ ID NO: 1646734 - RNA, 20 nt, Human
uuggucugacccacugcuuu

SEQ ID NO: 1646735 - RNA, 20 nt, Human
uugguaaggggaauugagga

SEQ ID NO: 1646736 - RNA, 23 nt, Human
uuggcuucacggaagagccuugc

SEQ ID NO: 1646737 - RNA, 18 nt, Human
uuggcauaacauaaaucu

SEQ ID NO: 1646738 - RNA, 23 nt, Human
uuggcauaacauaaaucugugaa

SEQ ID NO: 1646739 - RNA, 22 nt, Human
uuggcauaacauaaaucuguga

SEQ ID NO: 1646740 - RNA, 20 nt, Human
uuggcauaacauaaaucugu

SEQ ID NO: 1646741 - RNA, 19 nt, Human
uuggcauaacauaaaucug

SEQ ID NO: 1646742 - RNA, 18 nt, Human
uugcuaagcauuccaacu

SEQ ID NO: 1646743 - RNA, 16 nt, Human
uugcuaagcauuccaa

SEQ ID NO: 1646744 - RNA, 16 nt, Human
uugcugcuugaggcaa

SEQ ID NO: 1646745 - RNA, 14 nt, Human
uugcugcuugaggc

SEQ ID NO: 1646746 - RNA, 18 nt, Human
uugcugucccuuuuccuu

SEQ ID NO: 1646747 - RNA, 16 nt, Human
uugcugucccuuuucc

SEQ ID NO: 1646748 - RNA, 21 nt, Human
uugccauguuggccaggcugg

SEQ ID NO: 1646749 - RNA, 20 nt, Human
uugccauguuggccaggcug

SEQ ID NO: 1646750 - RNA, 17 nt, Human
uugccuuuuucauuauu

SEQ ID NO: 1646751 - RNA, 16 nt, Human
uugccuuuuucauuau

SEQ ID NO: 1646752 - RNA, 15 nt, Human
uugccuuuuucauua

SEQ ID NO: 1646753 - RNA, 14 nt, Human
uugccuuuuucauu

SEQ ID NO: 1646754 - RNA, 13 nt, Human
uugccuuuuucau

SEQ ID NO: 1646755 - RNA, 12 nt, Human
uugccuuuuuca

SEQ ID NO: 1646756 - RNA, 21 nt, Human
uuggacccugaggcccagagg

SEQ ID NO: 1646757 - RNA, 19 nt, Human
uuggacccugaggcccaga

SEQ ID NO: 1646758 - RNA, 18 nt, Human
uuggacccugaggcccag

SEQ ID NO: 1646759 - RNA, 15 nt, Human
uuggacccugaggcc

SEQ ID NO: 1646760 - RNA, 15 nt, Human
uuggauuguccccga

SEQ ID NO: 1646761 - RNA, 19 nt, Human
uuggaagcuccgcuuucua

SEQ ID NO: 1646762 - RNA, 18 nt, Human
uuggacaaaauggaauac

SEQ ID NO: 1646763 - RNA, 16 nt, Human
uugaaugaugccauga

SEQ ID NO: 1646764 - RNA, 12 nt, Human
uugaaugaugcc

SEQ ID NO: 1646765 - RNA, 17 nt, Human
uugaacuuugaccucug

SEQ ID NO: 1646766 - RNA, 18 nt, Human
uugaacuuugaccucugc

SEQ ID NO: 1646767 - RNA, 20 nt, Human
uugaacuuugaccucugcag

SEQ ID NO: 1646768 - RNA, 20 nt, Human
uugaaacggaugauuucuau

SEQ ID NO: 1646769 - RNA, 16 nt, Human
uugaagagguuuuaaa

SEQ ID NO: 1646770 - RNA, 20 nt, Human
uugaagcacagugaucaagu

SEQ ID NO: 1646771 - RNA, 21 nt, Human
uugaagagguuuuaaagcuuc

SEQ ID NO: 1646772 - RNA, 21 nt, Human
uugaaaaucuuauaauuuaaa

SEQ ID NO: 1646773 - RNA, 21 nt, Human
uucuuuccugaggcugggcuc

SEQ ID NO: 1646774 - RNA, 18 nt, Human
uucuuuccacagaagcuc

SEQ ID NO: 1646775 - RNA, 12 nt, Human
uucuuuaauuuu

SEQ ID NO: 1646776 - RNA, 18 nt, Human
uucuuuaauuuuggaauu

SEQ ID NO: 1646777 - RNA, 17 nt, Human
uucuuuaauuuuggaau

SEQ ID NO: 1646778 - RNA, 15 nt, Human
uugaacuuugaccuc

SEQ ID NO: 1646779 - RNA, 19 nt, Human
uugaaacggaugauuucua

SEQ ID NO: 1646780 - RNA, 16 nt, Human
uugaaacggaugauuu

SEQ ID NO: 1646781 - RNA, 18 nt, Human
uugaaaauuaacaugaau

SEQ ID NO: 1646782 - RNA, 24 nt, Human
uucuaaguaaaaccacagcaguug

SEQ ID NO: 1646783 - RNA, 20 nt, Human
uucuggcagaguugaagaca

SEQ ID NO: 1646784 - RNA, 16 nt, Human
uucuggcuaugcauuu

SEQ ID NO: 1646785 - RNA, 11 nt, Human
uucuguauaga

SEQ ID NO: 1646786 - RNA, 13 nt, Human
uucuguauagauu

SEQ ID NO: 1646787 - RNA, 14 nt, Human
uucuguauagauua

SEQ ID NO: 1646788 - RNA, 19 nt, Human
uucuuaggguuaugauuaa

SEQ ID NO: 1646789 - RNA, 17 nt, Human
uucuuagggaaggauac

SEQ ID NO: 1646790 - RNA, 13 nt, Human
uucuucagagacu

SEQ ID NO: 1646791 - RNA, 17 nt, Human
uucuuauguugcccagu

SEQ ID NO: 1646792 - RNA, 14 nt, Human
uucuuguguguuua

SEQ ID NO: 1646793 - RNA, 22 nt, Human
uugccaucccucccuccaccuc

SEQ ID NO: 1646794 - RNA, 23 nt, Human
uugccaucccucccuccaccucc

SEQ ID NO: 1646795 - RNA, 14 nt, Human
uugccaucccuccc

SEQ ID NO: 1646796 - RNA, 16 nt, Human
uugccaucccucccuc

SEQ ID NO: 1646797 - RNA, 17 nt, Human
uugccaucccucccucc

SEQ ID NO: 1646798 - RNA, 18 nt, Human
uugccaucccucccucca

SEQ ID NO: 1646799 - RNA, 19 nt, Human
uugccauguuggccaggcu

SEQ ID NO: 1646800 - RNA, 18 nt, Human
uugccauguuggccaggc

SEQ ID NO: 1646801 - RNA, 17 nt, Human
uugccauguuggccagg

SEQ ID NO: 1646802 - RNA, 16 nt, Human
uugccauguuggccag

SEQ ID NO: 1646803 - RNA, 13 nt, Human
uugccaucccucc

SEQ ID NO: 1646804 - RNA, 13 nt, Human
uugccagucaccc

SEQ ID NO: 1646805 - RNA, 16 nt, Human
uugcauaacguauaaa

SEQ ID NO: 1646806 - RNA, 17 nt, Human
uugauucauaaugacuu

SEQ ID NO: 1646807 - RNA, 13 nt, Human
uugauucauaaug

SEQ ID NO: 1646808 - RNA, 23 nt, Human
uugcagacaggcaagcaccuccu

SEQ ID NO: 1646809 - RNA, 20 nt, Human
uugauaugccuuuucccaac

SEQ ID NO: 1646810 - RNA, 16 nt, Human
uugauaugcuuauaca

SEQ ID NO: 1646811 - RNA, 16 nt, Human
uugauaugugaacagu

SEQ ID NO: 1646812 - RNA, 22 nt, Human
uugauauuuucaacgcagcccu

SEQ ID NO: 1646813 - RNA, 16 nt, Human
uugauucagcucugca

SEQ ID NO: 1646814 - RNA, 23 nt, Human
uugauucagacagcugccuggga

SEQ ID NO: 1646815 - RNA, 21 nt, Human
uugauucagacagcugccugg

SEQ ID NO: 1646816 - RNA, 17 nt, Human
uugauucagacagcugc

SEQ ID NO: 1646817 - RNA, 17 nt, Human
uugauccagaaagaaaa

SEQ ID NO: 1646818 - RNA, 19 nt, Human
uugagccuugaacuuugac

SEQ ID NO: 1646819 - RNA, 13 nt, Human
uugagcucagccc

SEQ ID NO: 1646820 - RNA, 14 nt, Human
uugaauuguaagga

SEQ ID NO: 1646821 - RNA, 14 nt, Human
uugagccuugaacu

SEQ ID NO: 1646822 - RNA, 15 nt, Human
uugagccuugaacuu

SEQ ID NO: 1646823 - RNA, 16 nt, Human
uugagccuugaacuuu

SEQ ID NO: 1646824 - RNA, 14 nt, Human
caccucucccuugg

SEQ ID NO: 1646825 - RNA, 23 nt, Human
gagccucagucucccucccuugg

SEQ ID NO: 1646826 - RNA, 19 nt, Human
uuggcauuccccacuugag

SEQ ID NO: 1646827 - RNA, 16 nt, Human
gacccccaucccaugg

SEQ ID NO: 1646828 - RNA, 18 nt, Human
gccccucagggucccugg

SEQ ID NO: 1646829 - RNA, 18 nt, Human
gcccugcugagucccagg

SEQ ID NO: 1646830 - RNA, 17 nt, Human
ggcccccaggugccagu

SEQ ID NO: 1646831 - RNA, 13 nt, Human
cugcauuggcuuu

SEQ ID NO: 1646832 - RNA, 14 nt, Human
cugcauuuaaaaga

SEQ ID NO: 1646833 - RNA, 16 nt, Human
cugccauauucuguug

SEQ ID NO: 1646834 - RNA, 16 nt, Human
cugccauccagguuca

SEQ ID NO: 1646835 - RNA, 18 nt, Human
cugccauccagguucagc

SEQ ID NO: 1646836 - RNA, 19 nt, Human
cugccauccagguucagcu

SEQ ID NO: 1646837 - RNA, 13 nt, Human
cugccccccagcc

SEQ ID NO: 1646838 - RNA, 22 nt, Human
cugccagucccccugccccagg

SEQ ID NO: 1646839 - RNA, 20 nt, Human
cugccagucccccugcccca

SEQ ID NO: 1646840 - RNA, 21 nt, Human
cugccagucccccugccccag

SEQ ID NO: 1646841 - RNA, 17 nt, Human
cugccagucccccugcc

SEQ ID NO: 1646842 - RNA, 18 nt, Human
cugcauuuaaaagauaca

SEQ ID NO: 1646843 - RNA, 17 nt, Human
cugcauuuaaaagauac

SEQ ID NO: 1646844 - RNA, 20 nt, Human
cugccagggacagagggggu

SEQ ID NO: 1646845 - RNA, 22 nt, Human
cugccagggacagagggggugg

SEQ ID NO: 1646846 - RNA, 23 nt, Human
cugccagggacagaggggguggc

SEQ ID NO: 1646847 - RNA, 14 nt, Human
cugccccucccuuc

SEQ ID NO: 1646848 - RNA, 17 nt, Human
cugccccucccuucaac

SEQ ID NO: 1646849 - RNA, 13 nt, Human
cugccccucccuu

SEQ ID NO: 1646850 - RNA, 17 nt, Human
cugccccuccucucugc

SEQ ID NO: 1646851 - RNA, 18 nt, Human
cugccccuccucucugcc

SEQ ID NO: 1646852 - RNA, 19 nt, Human
cugccccuccucucugccc

SEQ ID NO: 1646853 - RNA, 12 nt, Human
cugcccuuaccu

SEQ ID NO: 1646854 - RNA, 16 nt, Human
cugcccuuaccugcca

SEQ ID NO: 1646855 - RNA, 17 nt, Human
cugcccuuaccugccag

SEQ ID NO: 1646856 - RNA, 12 nt, Human
cugcagcuuugu

SEQ ID NO: 1646857 - RNA, 13 nt, Human
cugcaggcagcca

SEQ ID NO: 1646858 - RNA, 14 nt, Human
cugcaggcagccag

SEQ ID NO: 1646859 - RNA, 15 nt, Human
cugcaggcagccagg

SEQ ID NO: 1646860 - RNA, 16 nt, Human
cugcaggcagccaggc

SEQ ID NO: 1646861 - RNA, 17 nt, Human
cugcaggcagccaggcc

SEQ ID NO: 1646862 - RNA, 18 nt, Human
cugcaggcagccaggcca

SEQ ID NO: 1646863 - RNA, 19 nt, Human
cugcaggcagccaggccac

SEQ ID NO: 1646864 - RNA, 20 nt, Human
cugcaggcagccaggccaca

SEQ ID NO: 1646865 - RNA, 18 nt, Human
cugcacuccagccugggu

SEQ ID NO: 1646866 - RNA, 16 nt, Human
cugcacuccagccugg

SEQ ID NO: 1646867 - RNA, 17 nt, Human
cugcacuccagccuggg

SEQ ID NO: 1646868 - RNA, 24 nt, Human
cugcagccucaaccuccugggcua

SEQ ID NO: 1646869 - RNA, 19 nt, Human
cugcacuccagccugggug

SEQ ID NO: 1646870 - RNA, 23 nt, Human
cugcagccucaaccuccugggcu

SEQ ID NO: 1646871 - RNA, 14 nt, Human
cugcacggugaaug

SEQ ID NO: 1646872 - RNA, 15 nt, Human
cugcacggugaaugg

SEQ ID NO: 1646873 - RNA, 17 nt, Human
cugcacggugaauggcu

SEQ ID NO: 1646874 - RNA, 20 nt, Human
cugcacggugaauggcuuug

SEQ ID NO: 1646875 - RNA, 16 nt, Human
cugcacuauagccuag

SEQ ID NO: 1646876 - RNA, 17 nt, Human
cugcacuauagccuagg

SEQ ID NO: 1646877 - RNA, 18 nt, Human
cugcacuauagccuaggu

SEQ ID NO: 1646878 - RNA, 20 nt, Human
cugcacuauagccuagguga

SEQ ID NO: 1646879 - RNA, 13 nt, Human
cugcacuccagcc

SEQ ID NO: 1646880 - RNA, 22 nt, Human
cugcacuauagccuaggugaca

SEQ ID NO: 1646881 - RNA, 23 nt, Human
cugcacuauagccuaggugacag

SEQ ID NO: 1646882 - RNA, 17 nt, Human
cugcacuccagccugag

SEQ ID NO: 1646883 - RNA, 20 nt, Human
cugcacuccagccugagcga

SEQ ID NO: 1646884 - RNA, 15 nt, Human
cugcacuccagccug

SEQ ID NO: 1646885 - RNA, 16 nt, Human
cugcacuccagccuga

SEQ ID NO: 1646886 - RNA, 17 nt, Human
cugcaaccuucgccacc

SEQ ID NO: 1646887 - RNA, 19 nt, Human
cugcaaccuucgccaccug

SEQ ID NO: 1646888 - RNA, 20 nt, Human
cugcaaccuucgccaccugg

SEQ ID NO: 1646889 - RNA, 22 nt, Human
cugcaaccuucgccaccugggu

SEQ ID NO: 1646890 - RNA, 22 nt, Human
cugcaaccugauugugucucuu

SEQ ID NO: 1646891 - RNA, 18 nt, Human
cugcaacuuguaaaugug

SEQ ID NO: 1646892 - RNA, 19 nt, Human
cugcaacuuguaaaugugg

SEQ ID NO: 1646893 - RNA, 18 nt, Human
cugcaagaauugaagcag

SEQ ID NO: 1646894 - RNA, 20 nt, Human
cugcaaccuccgccucuugg

SEQ ID NO: 1646895 - RNA, 22 nt, Human
cugcaaccuccgccucuugggu

SEQ ID NO: 1646896 - RNA, 14 nt, Human
cugcaaccugauug

SEQ ID NO: 1646897 - RNA, 19 nt, Human
cugcaaccugauugugucu

SEQ ID NO: 1646898 - RNA, 21 nt, Human
cugcaaccugauugugucucu

SEQ ID NO: 1646899 - RNA, 23 nt, Human
cugcaccgggccacagagaaagu

SEQ ID NO: 1646900 - RNA, 12 nt, Human
cugcaagggagu

SEQ ID NO: 1646901 - RNA, 20 nt, Human
cugcaagaauugaagcagga

SEQ ID NO: 1646902 - RNA, 15 nt, Human
cucuuauaucuauau

SEQ ID NO: 1646903 - RNA, 18 nt, Human
cucuuauaucuauauuuu

SEQ ID NO: 1646904 - RNA, 14 nt, Human
cucuuaugggcugg

SEQ ID NO: 1646905 - RNA, 15 nt, Human
cucuuaugggcuggg

SEQ ID NO: 1646906 - RNA, 16 nt, Human
cugaugcuucuucaga

SEQ ID NO: 1646907 - RNA, 17 nt, Human
cugaugcuucuucagag

SEQ ID NO: 1646908 - RNA, 19 nt, Human
cugaugccaaguuguuuga

SEQ ID NO: 1646909 - RNA, 18 nt, Human
cugaugggcaacccccag

SEQ ID NO: 1646910 - RNA, 21 nt, Human
cugaugggcaacccccagccu

SEQ ID NO: 1646911 - RNA, 18 nt, Human
cugaugcuucuucagaga

SEQ ID NO: 1646912 - RNA, 19 nt, Human
cugaugcuucuucagagac

SEQ ID NO: 1646913 - RNA, 20 nt, Human
cugaugcuucuucagagacu

SEQ ID NO: 1646914 - RNA, 24 nt, Human
cugaugggcaacccccagccugcu

SEQ ID NO: 1646915 - RNA, 22 nt, Human
cugaugggcaacccccagccug

SEQ ID NO: 1646916 - RNA, 23 nt, Human
cugaugggcaacccccagccugc

SEQ ID NO: 1646917 - RNA, 18 nt, Human
cugcaaagcccagcuuga

SEQ ID NO: 1646918 - RNA, 21 nt, Human
cugcaaaggguaucaggugcu

SEQ ID NO: 1646919 - RNA, 22 nt, Human
cugcaaaggguaucaggugcug

SEQ ID NO: 1646920 - RNA, 15 nt, Human
cuggguguggcgcag

SEQ ID NO: 1646921 - RNA, 14 nt, Human
cuggguguggcgca

SEQ ID NO: 1646922 - RNA, 21 nt, Human
cuggguggcaccagcagccug

SEQ ID NO: 1646923 - RNA, 21 nt, Human
cuggugccucaccccuugcca

SEQ ID NO: 1646924 - RNA, 18 nt, Human
cuggguggcaccagcagc

SEQ ID NO: 1646925 - RNA, 20 nt, Human
cuggguggcaccagcagccu

SEQ ID NO: 1646926 - RNA, 13 nt, Human
cuggggagaaagu

SEQ ID NO: 1646927 - RNA, 14 nt, Human
cuggggagaaagua

SEQ ID NO: 1646928 - RNA, 20 nt, Human
cugggcagguuggugggggc

SEQ ID NO: 1646929 - RNA, 15 nt, Human
cugggcagcugccuc

SEQ ID NO: 1646930 - RNA, 14 nt, Human
cugggcagcugccu

SEQ ID NO: 1646931 - RNA, 20 nt, Human
cugggcagaggaaagcaaag

SEQ ID NO: 1646932 - RNA, 13 nt, Human
cugggcagcugcc

SEQ ID NO: 1646933 - RNA, 13 nt, Human
cugggcagaggaa

SEQ ID NO: 1646934 - RNA, 16 nt, Human
cugggcagaggaaagc

SEQ ID NO: 1646935 - RNA, 12 nt, Human
cugggcagagga

SEQ ID NO: 1646936 - RNA, 16 nt, Human
cugggagaaaugaaaa

SEQ ID NO: 1646937 - RNA, 17 nt, Human
cugggagaaaugaaaaa

SEQ ID NO: 1646938 - RNA, 22 nt, Human
cugggagaaccaaaaagaggcu

SEQ ID NO: 1646939 - RNA, 13 nt, Human
cugggacuacagg

SEQ ID NO: 1646940 - RNA, 15 nt, Human
cugggacuacaggca

SEQ ID NO: 1646941 - RNA, 16 nt, Human
cugggacuacaggcac

SEQ ID NO: 1646942 - RNA, 14 nt, Human
cugggacaugggaa

SEQ ID NO: 1646943 - RNA, 18 nt, Human
cugggacaugggaaaggg

SEQ ID NO: 1646944 - RNA, 22 nt, Human
cugggacaugggaaaggggaag

SEQ ID NO: 1646945 - RNA, 14 nt, Human
cuggcuaugcauuu

SEQ ID NO: 1646946 - RNA, 13 nt, Human
cuggcuaugcauu

SEQ ID NO: 1646947 - RNA, 16 nt, Human
cuggcuaugcauuuga

SEQ ID NO: 1646948 - RNA, 15 nt, Human
cuggcuaugcauuug

SEQ ID NO: 1646949 - RNA, 22 nt, Human
cuggcuaugcauuugaaaauuu

SEQ ID NO: 1646950 - RNA, 12 nt, Human
cuggcccuuccu

SEQ ID NO: 1646951 - RNA, 19 nt, Human
cugcugagucccaggcuga

SEQ ID NO: 1646952 - RNA, 23 nt, Human
cugcugagucccaggcugagccu

SEQ ID NO: 1646953 - RNA, 13 nt, Human
cugcugacagugu

SEQ ID NO: 1646954 - RNA, 15 nt, Human
cugcugacaguguug

SEQ ID NO: 1646955 - RNA, 13 nt, Human
cugcugaaggcuc

SEQ ID NO: 1646956 - RNA, 14 nt, Human
cugcugaaggcucg

SEQ ID NO: 1646957 - RNA, 15 nt, Human
cugcugaaggcucga

SEQ ID NO: 1646958 - RNA, 12 nt, Human
cugcugacagug

SEQ ID NO: 1646959 - RNA, 16 nt, Human
cugcucacauaucugu

SEQ ID NO: 1646960 - RNA, 19 nt, Human
cugcucacauaucugucau

SEQ ID NO: 1646961 - RNA, 20 nt, Human
cugcuuaacuucacauauug

SEQ ID NO: 1646962 - RNA, 19 nt, Human
cuggacugugugcucagga

SEQ ID NO: 1646963 - RNA, 22 nt, Human
cuggacugugugcucaggagcc

SEQ ID NO: 1646964 - RNA, 23 nt, Human
cuggacugugugcucaggagccc

SEQ ID NO: 1646965 - RNA, 16 nt, Human
cuggaguucugguucc

SEQ ID NO: 1646966 - RNA, 17 nt, Human
cuggaguucugguuccu

SEQ ID NO: 1646967 - RNA, 15 nt, Human
cuggaguucugguuc

SEQ ID NO: 1646968 - RNA, 15 nt, Human
cuggaugcagccuca

SEQ ID NO: 1646969 - RNA, 17 nt, Human
cuucaccuuugucccca

SEQ ID NO: 1646970 - RNA, 20 nt, Human
cuucaccuuuguccccaccg

SEQ ID NO: 1646971 - RNA, 14 nt, Human
cuucaccuuugucc

SEQ ID NO: 1646972 - RNA, 18 nt, Human
cuuauugcccacgcugga

SEQ ID NO: 1646973 - RNA, 16 nt, Human
cuucagagacuccugc

SEQ ID NO: 1646974 - RNA, 21 nt, Human
cuucagagacuccugcaggca

SEQ ID NO: 1646975 - RNA, 22 nt, Human
cuucagagacuccugcaggcag

SEQ ID NO: 1646976 - RNA, 11 nt, Human
cuucagacaua

SEQ ID NO: 1646977 - RNA, 18 nt, Human
cuucaguuaagccuuugg

SEQ ID NO: 1646978 - RNA, 13 nt, Human
cuucaucccucug

SEQ ID NO: 1646979 - RNA, 15 nt, Human
cuucauccuccucag

SEQ ID NO: 1646980 - RNA, 17 nt, Human
cuucaguuaagccuuug

SEQ ID NO: 1646981 - RNA, 18 nt, Human
cuucaguggcagcugcuu

SEQ ID NO: 1646982 - RNA, 23 nt, Human
cuucagagacuccugcaggcagc

SEQ ID NO: 1646983 - RNA, 24 nt, Human
cuucagagacuccugcaggcagcc

SEQ ID NO: 1646984 - RNA, 16 nt, Human
cuucauccuccucaga

SEQ ID NO: 1646985 - RNA, 22 nt, Human
cuucaucucccaaagugcuggg

SEQ ID NO: 1646986 - RNA, 23 nt, Human
cuucaugcugucuacacuaagag

SEQ ID NO: 1646987 - RNA, 15 nt, Human
cuuccaugucgccuc

SEQ ID NO: 1646988 - RNA, 16 nt, Human
cuuccaugucgccucu

SEQ ID NO: 1646989 - RNA, 16 nt, Human
cuuccauggacuuugu

SEQ ID NO: 1646990 - RNA, 17 nt, Human
cuuccauggacuuuguu

SEQ ID NO: 1646991 - RNA, 18 nt, Human
cuuccagugaggcucugc

SEQ ID NO: 1646992 - RNA, 17 nt, Human
cuuccagugaggcucug

SEQ ID NO: 1646993 - RNA, 19 nt, Human
cuuccagugaggcucugcc

SEQ ID NO: 1646994 - RNA, 20 nt, Human
cuuccagugaggcucugccc

SEQ ID NO: 1646995 - RNA, 17 nt, Human
cuuccaugucgccucug

SEQ ID NO: 1646996 - RNA, 18 nt, Human
cuuccaugucgccucugc

SEQ ID NO: 1646997 - RNA, 19 nt, Human
cuuccaugucgccucugca

SEQ ID NO: 1646998 - RNA, 20 nt, Human
cuuccaugucgccucugcau

SEQ ID NO: 1646999 - RNA, 18 nt, Human
cuuagcagggaaacagcu

SEQ ID NO: 1647000 - RNA, 21 nt, Human
cuuagcagggaaacagcuaau

SEQ ID NO: 1647001 - RNA, 12 nt, Human
cuuauugcccac

SEQ ID NO: 1647002 - RNA, 13 nt, Human
cuuauugcccacg

SEQ ID NO: 1647003 - RNA, 22 nt, Human
cuuaugggcuggguucuaccca

SEQ ID NO: 1647004 - RNA, 23 nt, Human
cuuaugggcuggguucuacccag

SEQ ID NO: 1647005 - RNA, 14 nt, Human
cuuaugggcugggu

SEQ ID NO: 1647006 - RNA, 21 nt, Human
cuuaugggcuggguucuaccc

SEQ ID NO: 1647007 - RNA, 18 nt, Human
cuuaaaauauuccugcau

SEQ ID NO: 1647008 - RNA, 20 nt, Human
cuuaaaauauuccugcauuu

SEQ ID NO: 1647009 - RNA, 16 nt, Human
cuguugggccaggagc

SEQ ID NO: 1647010 - RNA, 17 nt, Human
cuguugggccaggagcc

SEQ ID NO: 1647011 - RNA, 20 nt, Human
cuguugggccaggagccucc

SEQ ID NO: 1647012 - RNA, 14 nt, Human
cuuaaaguugaauu

SEQ ID NO: 1647013 - RNA, 11 nt, Human
cuuaaaguuga

SEQ ID NO: 1647014 - RNA, 13 nt, Human
cuuaaaguugaau

SEQ ID NO: 1647015 - RNA, 13 nt, Human
cuuacacaauggu

SEQ ID NO: 1647016 - RNA, 21 nt, Human
cuuaaagaguguggcaaaaua

SEQ ID NO: 1647017 - RNA, 15 nt, Human
cuuaaagaguguggc

SEQ ID NO: 1647018 - RNA, 19 nt, Human
cuuacccucauguucuuaa

SEQ ID NO: 1647019 - RNA, 18 nt, Human
cuuacccucauguucuua

SEQ ID NO: 1647020 - RNA, 17 nt, Human
cuuacccucauguucuu

SEQ ID NO: 1647021 - RNA, 13 nt, Human
cuuaccucggugc

SEQ ID NO: 1647022 - RNA, 19 nt, Human
cuuaccucggugccuuccu

SEQ ID NO: 1647023 - RNA, 21 nt, Human
cuuaccucggugccuuccucu

SEQ ID NO: 1647024 - RNA, 13 nt, Human
cuuaccugccagg

SEQ ID NO: 1647025 - RNA, 15 nt, Human
cuguugcugccucau

SEQ ID NO: 1647026 - RNA, 16 nt, Human
cuguugcugccucaug

SEQ ID NO: 1647027 - RNA, 17 nt, Human
cuguugcugccucaugc

SEQ ID NO: 1647028 - RNA, 20 nt, Human
cugugcugagucugaaggcu

SEQ ID NO: 1647029 - RNA, 22 nt, Human
cugugcugagucugaaggcugg

SEQ ID NO: 1647030 - RNA, 11 nt, Human
cugugcugccc

SEQ ID NO: 1647031 - RNA, 21 nt, Human
cugugucagguggggcagcuu

SEQ ID NO: 1647032 - RNA, 20 nt, Human
cugugucagcauagaaguaa

SEQ ID NO: 1647033 - RNA, 19 nt, Human
cugugucagguggggcagc

SEQ ID NO: 1647034 - RNA, 14 nt, Human
cugugucuugcaau

SEQ ID NO: 1647035 - RNA, 14 nt, Human
cugugucucccuuc

SEQ ID NO: 1647036 - RNA, 19 nt, Human
cugugucucccuucauccu

SEQ ID NO: 1647037 - RNA, 22 nt, Human
cugugacuucagcucuguuuua

SEQ ID NO: 1647038 - RNA, 17 nt, Human
cugugacuucagcucug

SEQ ID NO: 1647039 - RNA, 15 nt, Human
cuguucacucuacuu

SEQ ID NO: 1647040 - RNA, 20 nt, Human
cugugucuugcaauggcagc

SEQ ID NO: 1647041 - RNA, 16 nt, Human
cugugucuugcaaugg

SEQ ID NO: 1647042 - RNA, 19 nt, Human
cugugucuugcaauggcag

SEQ ID NO: 1647043 - RNA, 13 nt, Human
cuguucagcucca

SEQ ID NO: 1647044 - RNA, 14 nt, Human
cuguucagcuccag

SEQ ID NO: 1647045 - RNA, 14 nt, Human
cuuuaauuuuggaa

SEQ ID NO: 1647046 - RNA, 15 nt, Human
cuuuaauuuuggaau

SEQ ID NO: 1647047 - RNA, 13 nt, Human
cuuuaauuuugga

SEQ ID NO: 1647048 - RNA, 16 nt, Human
cuuuaauuuuggaauu

SEQ ID NO: 1647049 - RNA, 18 nt, Human
cuuuaauaucaucaguau

SEQ ID NO: 1647050 - RNA, 19 nt, Human
cuuuaauaucaucaguauu

SEQ ID NO: 1647051 - RNA, 21 nt, Human
cuuuaauaucaucaguauuga

SEQ ID NO: 1647052 - RNA, 23 nt, Human
cuuucaauaggaaaaacugauuu

SEQ ID NO: 1647053 - RNA, 20 nt, Human
cuuucaauaggaaaaacuga

SEQ ID NO: 1647054 - RNA, 21 nt, Human
cuuucaauaggaaaaacugau

SEQ ID NO: 1647055 - RNA, 22 nt, Human
cuuucaauaggaaaaacugauu

SEQ ID NO: 1647056 - RNA, 14 nt, Human
cuuuaaaugcugcu

SEQ ID NO: 1647057 - RNA, 15 nt, Human
cuuuaaaugcugcuu

SEQ ID NO: 1647058 - RNA, 16 nt, Human
cuuguggacacagcuc

SEQ ID NO: 1647059 - RNA, 14 nt, Human
cuuguggacacagc

SEQ ID NO: 1647060 - RNA, 15 nt, Human
cuuguggacacagcu

SEQ ID NO: 1647061 - RNA, 13 nt, Human
cuuguggacacag

SEQ ID NO: 1647062 - RNA, 13 nt, Human
cuuucagauacug

SEQ ID NO: 1647063 - RNA, 20 nt, Human
cuuucagauaacuguuauuu

SEQ ID NO: 1647064 - RNA, 16 nt, Human
cuuugagcuuaagaau

SEQ ID NO: 1647065 - RNA, 19 nt, Human
cuuugacgccaucccagcc

SEQ ID NO: 1647066 - RNA, 21 nt, Human
cuuugacgccaucccagcccc

SEQ ID NO: 1647067 - RNA, 22 nt, Human
cuuugacgccaucccagcccca

SEQ ID NO: 1647068 - RNA, 21 nt, Human
cuuugagugucuuaauuaaaa

SEQ ID NO: 1647069 - RNA, 17 nt, Human
cuuucuaaugugugaau

SEQ ID NO: 1647070 - RNA, 22 nt, Human
cuuucggggagaggcugaggac

SEQ ID NO: 1647071 - RNA, 20 nt, Human
cuuuggucuacacugugcug

SEQ ID NO: 1647072 - RNA, 16 nt, Human
cuuuggucuacacugu

SEQ ID NO: 1647073 - RNA, 15 nt, Human
cuuuuauaaacuuua

SEQ ID NO: 1647074 - RNA, 18 nt, Human
cuuuuauaaacuuuaccu

SEQ ID NO: 1647075 - RNA, 16 nt, Human
cuuuuauaaacuuuac

SEQ ID NO: 1647076 - RNA, 19 nt, Human
cuuuuauaaacuuuaccuu

SEQ ID NO: 1647077 - RNA, 19 nt, Human
cuuuuauuuagcaccaggg

SEQ ID NO: 1647078 - RNA, 15 nt, Human
cuuuucaaaacauuu

SEQ ID NO: 1647079 - RNA, 20 nt, Human
cuucuucagagacuccugca

SEQ ID NO: 1647080 - RNA, 21 nt, Human
cuucuucagagacuccugcag

SEQ ID NO: 1647081 - RNA, 15 nt, Human
cuucuguuuuauaau

SEQ ID NO: 1647082 - RNA, 20 nt, Human
cuucuguuuuauaauuuugu

SEQ ID NO: 1647083 - RNA, 22 nt, Human
cuucuucagagacuccugcagg

SEQ ID NO: 1647084 - RNA, 20 nt, Human
cuugaaugaugccaugagga

SEQ ID NO: 1647085 - RNA, 12 nt, Human
cuugcucugcug

SEQ ID NO: 1647086 - RNA, 23 nt, Human
cuugaaugaugccaugaggaaca

SEQ ID NO: 1647087 - RNA, 12 nt, Human
cuugacagggca

SEQ ID NO: 1647088 - RNA, 20 nt, Human
cuugccgucuaccugagggg

SEQ ID NO: 1647089 - RNA, 23 nt, Human
cuugccgucuaccugaggggccu

SEQ ID NO: 1647090 - RNA, 13 nt, Human
cuugcucugcuga

SEQ ID NO: 1647091 - RNA, 18 nt, Human
gaucugccuaaggacuuc

SEQ ID NO: 1647092 - RNA, 20 nt, Human
gaucugccuaaggacuucuu

SEQ ID NO: 1647093 - RNA, 21 nt, Human
gaucugccuaaggacuucuuu

SEQ ID NO: 1647094 - RNA, 23 nt, Human
gaucugccuaaggacuucuuuaa

SEQ ID NO: 1647095 - RNA, 14 nt, Human
gaugaucuuugcag

SEQ ID NO: 1647096 - RNA, 18 nt, Human
gauguagaggagaaacug

SEQ ID NO: 1647097 - RNA, 16 nt, Human
gaugagugagcaugcc

SEQ ID NO: 1647098 - RNA, 15 nt, Human
gaugaucuaggaaga

SEQ ID NO: 1647099 - RNA, 21 nt, Human
gaugaucuaggaagacuuugg

SEQ ID NO: 1647100 - RNA, 16 nt, Human
gaugaucuuuaaaaua

SEQ ID NO: 1647101 - RNA, 21 nt, Human
gauguauguugaagccuuugu

SEQ ID NO: 1647102 - RNA, 20 nt, Human
gauguauguugaagccuuug

SEQ ID NO: 1647103 - RNA, 20 nt, Human
gauuauaggcaccuaccacc

SEQ ID NO: 1647104 - RNA, 14 nt, Human
gauuauauuaugaa

SEQ ID NO: 1647105 - RNA, 22 nt, Human
gauuauucacugauuugacaua

SEQ ID NO: 1647106 - RNA, 12 nt, Human
gauuauuggaaa

SEQ ID NO: 1647107 - RNA, 20 nt, Human
gauuuuuuacagcugccugc

SEQ ID NO: 1647108 - RNA, 16 nt, Human
gauuuaccacuugugu

SEQ ID NO: 1647109 - RNA, 23 nt, Human
gauucuucagcaaaaauauuuua

SEQ ID NO: 1647110 - RNA, 17 nt, Human
gauucuuccucccuccc

SEQ ID NO: 1647111 - RNA, 18 nt, Human
gauucuuccucccucccu

SEQ ID NO: 1647112 - RNA, 12 nt, Human
gauucuucugcu

SEQ ID NO: 1647113 - RNA, 15 nt, Human
gauuuaccacuugug

SEQ ID NO: 1647114 - RNA, 18 nt, Human
gauucuccugccucagcc

SEQ ID NO: 1647115 - RNA, 15 nt, Human
gauucuccugccuca

SEQ ID NO: 1647116 - RNA, 17 nt, Human
gauucuccugccucagc

SEQ ID NO: 1647117 - RNA, 22 nt, Human
gcacaagcugcacccucaggca

SEQ ID NO: 1647118 - RNA, 14 nt, Human
gcacaccgggcacu

SEQ ID NO: 1647119 - RNA, 20 nt, Human
gcacagugcaucucagccca

SEQ ID NO: 1647120 - RNA, 21 nt, Human
gcacagugcaucucagcccac

SEQ ID NO: 1647121 - RNA, 19 nt, Human
gcacagugcaucucagccc

SEQ ID NO: 1647122 - RNA, 20 nt, Human
gcacaccgggcacucagaag

SEQ ID NO: 1647123 - RNA, 23 nt, Human
gcacaguuuucugagaaagacua

SEQ ID NO: 1647124 - RNA, 20 nt, Human
gcacaguuuucugagaaaga

SEQ ID NO: 1647125 - RNA, 22 nt, Human
gcacaguuuucugagaaagacu

SEQ ID NO: 1647126 - RNA, 22 nt, Human
gcaauagucaaauugugugaaa

SEQ ID NO: 1647127 - RNA, 18 nt, Human
gcaagucagaauagaaau

SEQ ID NO: 1647128 - RNA, 20 nt, Human
gcaaguauuagaauaccaca

SEQ ID NO: 1647129 - RNA, 18 nt, Human
gauuuuuuuguuguuugu

SEQ ID NO: 1647130 - RNA, 21 nt, Human
gauuuuuuuguuguuuguuua

SEQ ID NO: 1647131 - RNA, 22 nt, Human
gcacuccccugcuggguguggc

SEQ ID NO: 1647132 - RNA, 13 nt, Human
gcacucagaagac

SEQ ID NO: 1647133 - RNA, 16 nt, Human
gcacucagaagacacu

SEQ ID NO: 1647134 - RNA, 17 nt, Human
gcacucagaagacacug

SEQ ID NO: 1647135 - RNA, 17 nt, Human
gcacuccccugcugggu

SEQ ID NO: 1647136 - RNA, 22 nt, Human
gcaccuaccaccacgcccggcu

SEQ ID NO: 1647137 - RNA, 21 nt, Human
gcaccuaccaccacgcccggc

SEQ ID NO: 1647138 - RNA, 23 nt, Human
gcaccgggccacagagaaaguac

SEQ ID NO: 1647139 - RNA, 14 nt, Human
gcaccgggccacag

SEQ ID NO: 1647140 - RNA, 23 nt, Human
gcacaucagcacgauuucuguuu

SEQ ID NO: 1647141 - RNA, 22 nt, Human
gcacaucagcacgauuucuguu

SEQ ID NO: 1647142 - RNA, 12 nt, Human
gaggggccucuu

SEQ ID NO: 1647143 - RNA, 17 nt, Human
gaggcaucgcaauguaa

SEQ ID NO: 1647144 - RNA, 13 nt, Human
gaggccagagaca

SEQ ID NO: 1647145 - RNA, 14 nt, Human
gaggccagagacac

SEQ ID NO: 1647146 - RNA, 19 nt, Human
gaggccagagacacaagcc

SEQ ID NO: 1647147 - RNA, 22 nt, Human
gaggcuagugugguguuuccug

SEQ ID NO: 1647148 - RNA, 19 nt, Human
gaggcuccacuuggucugu

SEQ ID NO: 1647149 - RNA, 12 nt, Human
gaggcuccacuu

SEQ ID NO: 1647150 - RNA, 23 nt, Human
gaggcuccacuuggucugugaga

SEQ ID NO: 1647151 - RNA, 22 nt, Human
gaggccaaggugggaggauugc

SEQ ID NO: 1647152 - RNA, 15 nt, Human
gaggcagggucucac

SEQ ID NO: 1647153 - RNA, 18 nt, Human
gaggcagggucucacucu

SEQ ID NO: 1647154 - RNA, 14 nt, Human
gaggcagggucuca

SEQ ID NO: 1647155 - RNA, 20 nt, Human
gaggacgcucucuggccuuc

SEQ ID NO: 1647156 - RNA, 15 nt, Human
gaggacgcucucugg

SEQ ID NO: 1647157 - RNA, 21 nt, Human
gagcgcccacuagacccacug

SEQ ID NO: 1647158 - RNA, 13 nt, Human
gagccuugaacuu

SEQ ID NO: 1647159 - RNA, 23 nt, Human
gagccuuccaggggugggacacc

SEQ ID NO: 1647160 - RNA, 19 nt, Human
gagccuugaacuuugaccu

SEQ ID NO: 1647161 - RNA, 20 nt, Human
gagccuuccaggggugggac

SEQ ID NO: 1647162 - RNA, 18 nt, Human
gaguugauucagcucugc

SEQ ID NO: 1647163 - RNA, 22 nt, Human
gaguuguuacauuuuuaagugc

SEQ ID NO: 1647164 - RNA, 16 nt, Human
gaguuuaaauuguaau

SEQ ID NO: 1647165 - RNA, 17 nt, Human
gagucaccaagcccagu

SEQ ID NO: 1647166 - RNA, 16 nt, Human
gagucaccaagcccag

SEQ ID NO: 1647167 - RNA, 22 nt, Human
gagucagaaguuucugccgcag

SEQ ID NO: 1647168 - RNA, 12 nt, Human
gagucccaccuu

SEQ ID NO: 1647169 - RNA, 13 nt, Human
gagucccaccuug

SEQ ID NO: 1647170 - RNA, 18 nt, Human
gagugacagaggcagccc

SEQ ID NO: 1647171 - RNA, 21 nt, Human
gagugaguuggguguauugug

SEQ ID NO: 1647172 - RNA, 20 nt, Human
gagugacagaggcagcccca

SEQ ID NO: 1647173 - RNA, 15 nt, Human
gaguugauucagcuc

SEQ ID NO: 1647174 - RNA, 16 nt, Human
gaguugauucagcucu

SEQ ID NO: 1647175 - RNA, 17 nt, Human
gaguugauucagcucug

SEQ ID NO: 1647176 - RNA, 23 nt, Human
gaggugaccccagguuucuaugu

SEQ ID NO: 1647177 - RNA, 15 nt, Human
gaggucgaggcagga

SEQ ID NO: 1647178 - RNA, 22 nt, Human
gaaggggagauaaggguaucug

SEQ ID NO: 1647179 - RNA, 19 nt, Human
gaauauugcugauggugca

SEQ ID NO: 1647180 - RNA, 20 nt, Human
gaauauugcugauggugcaa

SEQ ID NO: 1647181 - RNA, 14 nt, Human
gaauauugcugaug

SEQ ID NO: 1647182 - RNA, 15 nt, Human
gaauauugcugaugg

SEQ ID NO: 1647183 - RNA, 20 nt, Human
gaauauuagugaccucagcu

SEQ ID NO: 1647184 - RNA, 20 nt, Human
gaaggcuggguucugauccu

SEQ ID NO: 1647185 - RNA, 22 nt, Human
gaaggcuggguucugauccuag

SEQ ID NO: 1647186 - RNA, 18 nt, Human
gaaggccccgcccaggcu

SEQ ID NO: 1647187 - RNA, 19 nt, Human
gaaggccccgcccaggcuu

SEQ ID NO: 1647188 - RNA, 21 nt, Human
gaaggcucgagcaugccugga

SEQ ID NO: 1647189 - RNA, 15 nt, Human
gaaggcuggguucug

SEQ ID NO: 1647190 - RNA, 19 nt, Human
gaaggcuggguucugaucc

SEQ ID NO: 1647191 - RNA, 22 nt, Human
gaagcuccgcuuucuacccagc

SEQ ID NO: 1647192 - RNA, 19 nt, Human
gaagcuccgcuuucuaccc

SEQ ID NO: 1647193 - RNA, 20 nt, Human
gaagcuaucguaaaauuaag

SEQ ID NO: 1647194 - RNA, 11 nt, Human
gaacuggcugc

SEQ ID NO: 1647195 - RNA, 12 nt, Human
gaacuggcugca

SEQ ID NO: 1647196 - RNA, 20 nt, Human
gaacucugacaacagacuuc

SEQ ID NO: 1647197 - RNA, 14 nt, Human
gaacugaaaucaua

SEQ ID NO: 1647198 - RNA, 15 nt, Human
gaagcacaugccucu

SEQ ID NO: 1647199 - RNA, 17 nt, Human
gaagcacaugccucucu

SEQ ID NO: 1647200 - RNA, 20 nt, Human
gaagcacaugccucucucag

SEQ ID NO: 1647201 - RNA, 20 nt, Human
gaagcaaugcuucaucccuu

SEQ ID NO: 1647202 - RNA, 23 nt, Human
gaagcaacccaaauguucaucaa

SEQ ID NO: 1647203 - RNA, 22 nt, Human
gaagacaaugacuuacuguaca

SEQ ID NO: 1647204 - RNA, 23 nt, Human
gaagacaaugugaaaagaaaaau

SEQ ID NO: 1647205 - RNA, 16 nt, Human
gaagacaaugacuuac

SEQ ID NO: 1647206 - RNA, 14 nt, Human
gaagcaaaauuuuu

SEQ ID NO: 1647207 - RNA, 21 nt, Human
gaagcacaugccucucucagg

SEQ ID NO: 1647208 - RNA, 15 nt, Human
gaagcagaggaagga

SEQ ID NO: 1647209 - RNA, 11 nt, Human
gaccugaggcc

SEQ ID NO: 1647210 - RNA, 13 nt, Human
gaccugaggcccu

SEQ ID NO: 1647211 - RNA, 14 nt, Human
gaccugaggcccuu

SEQ ID NO: 1647212 - RNA, 16 nt, Human
gacgccaucccagccc

SEQ ID NO: 1647213 - RNA, 14 nt, Human
gaccucugcagcaa

SEQ ID NO: 1647214 - RNA, 20 nt, Human
gaccaucccugaaggccccg

SEQ ID NO: 1647215 - RNA, 14 nt, Human
gaccaucccugaag

SEQ ID NO: 1647216 - RNA, 19 nt, Human
gacgccaucccagccccaa

SEQ ID NO: 1647217 - RNA, 17 nt, Human
gacgccaucccagcccc

SEQ ID NO: 1647218 - RNA, 18 nt, Human
gacgccaucccagcccca

SEQ ID NO: 1647219 - RNA, 16 nt, Human
gacgcuacccgggaag

SEQ ID NO: 1647220 - RNA, 18 nt, Human
gacgcuacccgggaaggg

SEQ ID NO: 1647221 - RNA, 19 nt, Human
gacgcuacccgggaagggg

SEQ ID NO: 1647222 - RNA, 15 nt, Human
gacgcucucuggccu

SEQ ID NO: 1647223 - RNA, 16 nt, Human
gacgcucucuggccuu

SEQ ID NO: 1647224 - RNA, 17 nt, Human
gacgcucucuggccuuc

SEQ ID NO: 1647225 - RNA, 17 nt, Human
gacuguggugacuuugg

SEQ ID NO: 1647226 - RNA, 13 nt, Human
gacuguggugacu

SEQ ID NO: 1647227 - RNA, 14 nt, Human
gacuguggugacuu

SEQ ID NO: 1647228 - RNA, 22 nt, Human
gacugugugcucaggagcccug

SEQ ID NO: 1647229 - RNA, 18 nt, Human
gacuguacuccucccagg

SEQ ID NO: 1647230 - RNA, 23 nt, Human
gacuguacuccucccaggcgccc

SEQ ID NO: 1647231 - RNA, 20 nt, Human
gacugaauuaugaaacuuuu

SEQ ID NO: 1647232 - RNA, 16 nt, Human
gacugaauuucuuuug

SEQ ID NO: 1647233 - RNA, 14 nt, Human
gacugaauuaugaa

SEQ ID NO: 1647234 - RNA, 14 nt, Human
gacugaauuucuuu

SEQ ID NO: 1647235 - RNA, 12 nt, Human
gacucugccucc

SEQ ID NO: 1647236 - RNA, 16 nt, Human
gacucugccuccucuu

SEQ ID NO: 1647237 - RNA, 15 nt, Human
gacucaccuccccca

SEQ ID NO: 1647238 - RNA, 22 nt, Human
gacucaccucccccaucucuuc

SEQ ID NO: 1647239 - RNA, 14 nt, Human
gacucuuaagaaga

SEQ ID NO: 1647240 - RNA, 15 nt, Human
gacucuuaagaagac

SEQ ID NO: 1647241 - RNA, 19 nt, Human
gacucugucucaaaaaaac

SEQ ID NO: 1647242 - RNA, 21 nt, Human
gacucuuaagaagacugcauu

SEQ ID NO: 1647243 - RNA, 19 nt, Human
gacauuguuggccaaagcc

SEQ ID NO: 1647244 - RNA, 16 nt, Human
gacauuugcucaugga

SEQ ID NO: 1647245 - RNA, 17 nt, Human
gacauuugcucauggaa

SEQ ID NO: 1647246 - RNA, 14 nt, Human
gacauugcggacag

SEQ ID NO: 1647247 - RNA, 15 nt, Human
gacauugcggacagc

SEQ ID NO: 1647248 - RNA, 17 nt, Human
gacauugcggacagcca

SEQ ID NO: 1647249 - RNA, 20 nt, Human
gacagcccgggcucugccuc

SEQ ID NO: 1647250 - RNA, 18 nt, Human
gacagcccgggcucugcc

SEQ ID NO: 1647251 - RNA, 19 nt, Human
gacagcccgggcucugccu

SEQ ID NO: 1647252 - RNA, 21 nt, Human
gacagugagacucugucucag

SEQ ID NO: 1647253 - RNA, 13 nt, Human
gaccauacuaauu

SEQ ID NO: 1647254 - RNA, 20 nt, Human
gaccagggauuuccaugaug

SEQ ID NO: 1647255 - RNA, 12 nt, Human
gaccaucccuga

SEQ ID NO: 1647256 - RNA, 13 nt, Human
gaccaucccugaa

SEQ ID NO: 1647257 - RNA, 18 nt, Human
gaccaucccugaaggccc

SEQ ID NO: 1647258 - RNA, 19 nt, Human
gaccaucccugaaggcccc

SEQ ID NO: 1647259 - RNA, 18 nt, Human
gaccagggauuuccauga

SEQ ID NO: 1647260 - RNA, 17 nt, Human
gacagcccgggcucugc

SEQ ID NO: 1647261 - RNA, 21 nt, Human
gacagaaagcagaacagugau

SEQ ID NO: 1647262 - RNA, 17 nt, Human
gacacagcucuucucca

SEQ ID NO: 1647263 - RNA, 22 nt, Human
gacacagcucuucuccaggcug

SEQ ID NO: 1647264 - RNA, 23 nt, Human
gacacagcucuucuccaggcugu

SEQ ID NO: 1647265 - RNA, 12 nt, Human
gacacaggcccg

SEQ ID NO: 1647266 - RNA, 14 nt, Human
gacacagcucuucu

SEQ ID NO: 1647267 - RNA, 16 nt, Human
gacacagcucuucucc

SEQ ID NO: 1647268 - RNA, 15 nt, Human
gacacacugaagaag

SEQ ID NO: 1647269 - RNA, 16 nt, Human
gacacacugaagaagc

SEQ ID NO: 1647270 - RNA, 17 nt, Human
ggcugcagggaguccga

SEQ ID NO: 1647271 - RNA, 21 nt, Human
ggcugaacacuccaauuaagg

SEQ ID NO: 1647272 - RNA, 22 nt, Human
ggcugcaugcgggcuuccuccu

SEQ ID NO: 1647273 - RNA, 20 nt, Human
ggcugcaugcgggcuuccuc

SEQ ID NO: 1647274 - RNA, 18 nt, Human
ggcucgagcaugccugga

SEQ ID NO: 1647275 - RNA, 23 nt, Human
ggcucuuccaggcugggagagcc

SEQ ID NO: 1647276 - RNA, 24 nt, Human
ggcucuuccaggcugggagagccu

SEQ ID NO: 1647277 - RNA, 13 nt, Human
ggcuccugccacc

SEQ ID NO: 1647278 - RNA, 12 nt, Human
ggcuccugccac

SEQ ID NO: 1647279 - RNA, 17 nt, Human
ggcuccucccggugccc

SEQ ID NO: 1647280 - RNA, 20 nt, Human
ggcucccuucccaccucucu

SEQ ID NO: 1647281 - RNA, 22 nt, Human
ggcucccuucccaccucucuca

SEQ ID NO: 1647282 - RNA, 17 nt, Human
ggcucccuucccaccuc

SEQ ID NO: 1647283 - RNA, 18 nt, Human
ggcucccuucccaccucu

SEQ ID NO: 1647284 - RNA, 16 nt, Human
ggcucccuucccaccu

SEQ ID NO: 1647285 - RNA, 21 nt, Human
ggcugccaucucaccuccugc

SEQ ID NO: 1647286 - RNA, 22 nt, Human
ggcugccaucucaccuccugcu

SEQ ID NO: 1647287 - RNA, 23 nt, Human
ggcugccaucucaccuccugcug

SEQ ID NO: 1647288 - RNA, 16 nt, Human
ggcuggcccugcccug

SEQ ID NO: 1647289 - RNA, 17 nt, Human
ggcuggcccugcccugg

SEQ ID NO: 1647290 - RNA, 14 nt, Human
ggcuggcgugcagu

SEQ ID NO: 1647291 - RNA, 16 nt, Human
ggcuggcgugcagugg

SEQ ID NO: 1647292 - RNA, 20 nt, Human
ggcuggcgugcaguggugcg

SEQ ID NO: 1647293 - RNA, 13 nt, Human
ggcuggcccugcc

SEQ ID NO: 1647294 - RNA, 14 nt, Human
ggcuggcccugccc

SEQ ID NO: 1647295 - RNA, 15 nt, Human
ggcuggcccugcccu

SEQ ID NO: 1647296 - RNA, 17 nt, Human
ggcuggccuggccccuc

SEQ ID NO: 1647297 - RNA, 22 nt, Human
ggcuggccuggccccucagggu

SEQ ID NO: 1647298 - RNA, 13 nt, Human
ggcugggagagcc

SEQ ID NO: 1647299 - RNA, 19 nt, Human
ggcuguaucccaugagccu

SEQ ID NO: 1647300 - RNA, 16 nt, Human
ggcuggugucaccuga

SEQ ID NO: 1647301 - RNA, 15 nt, Human
ggcuucaguggcagc

SEQ ID NO: 1647302 - RNA, 20 nt, Human
ggcuguaucccaugagccuc

SEQ ID NO: 1647303 - RNA, 22 nt, Human
ggcuguaucccaugagccucag

SEQ ID NO: 1647304 - RNA, 23 nt, Human
ggcuguaucccaugagccucagc

SEQ ID NO: 1647305 - RNA, 15 nt, Human
ggcugucaauuacag

SEQ ID NO: 1647306 - RNA, 16 nt, Human
ggcuucaguggcagcu

SEQ ID NO: 1647307 - RNA, 13 nt, Human
gggaaaaucagcc

SEQ ID NO: 1647308 - RNA, 23 nt, Human
gggaaaaucagccugcuccagcu

SEQ ID NO: 1647309 - RNA, 20 nt, Human
aaaaagcuccaaaugcagcu

SEQ ID NO: 1647310 - RNA, 13 nt, Human
aaaaaaacacaaa

SEQ ID NO: 1647311 - RNA, 14 nt, Human
gggaacagacugga

SEQ ID NO: 1647312 - RNA, 20 nt, Human
aaaaaucucaaauuucuaaa

SEQ ID NO: 1647313 - RNA, 19 nt, Human
aaaaaucucaaauuucuaa

SEQ ID NO: 1647314 - RNA, 22 nt, Human
gggaacagacuggaagcacagc

SEQ ID NO: 1647315 - RNA, 15 nt, Human
aaaaccaauguucuc

SEQ ID NO: 1647316 - RNA, 14 nt, Human
aaaacguggcugcu

SEQ ID NO: 1647317 - RNA, 16 nt, Human
aaaacguggcugcuuc

SEQ ID NO: 1647318 - RNA, 17 nt, Human
aaaacguggcugcuuca

SEQ ID NO: 1647319 - RNA, 18 nt, Human
aaaacguggcugcuucaa

SEQ ID NO: 1647320 - RNA, 19 nt, Human
aaaacugcucauaugaugu

SEQ ID NO: 1647321 - RNA, 20 nt, Human
aaaacugcugacuguuuucu

SEQ ID NO: 1647322 - RNA, 18 nt, Human
aaaacugauuuuuuuuuc

SEQ ID NO: 1647323 - RNA, 22 nt, Human
aaaacugauuuuuuuuuccuuc

SEQ ID NO: 1647324 - RNA, 19 nt, Human
aaaaccaagccguggcuuc

SEQ ID NO: 1647325 - RNA, 21 nt, Human
aaaacguggcugcuucaagga

SEQ ID NO: 1647326 - RNA, 13 nt, Human
gggagggccuggg

SEQ ID NO: 1647327 - RNA, 11 nt, Human
gggagggcucc

SEQ ID NO: 1647328 - RNA, 13 nt, Human
gggagggcuccag

SEQ ID NO: 1647329 - RNA, 19 nt, Human
gggaggccaaggugggagg

SEQ ID NO: 1647330 - RNA, 20 nt, Human
gggaggcagagguugcagug

SEQ ID NO: 1647331 - RNA, 14 nt, Human
aaaagcugggcagg

SEQ ID NO: 1647332 - RNA, 22 nt, Human
aaaagcuccauuuuuagugaaa

SEQ ID NO: 1647333 - RNA, 21 nt, Human
aaaacuuuaugcuaagugaaa

SEQ ID NO: 1647334 - RNA, 16 nt, Human
aaaagccuguuuaaga

SEQ ID NO: 1647335 - RNA, 18 nt, Human
aaaagccuguuuaagaga

SEQ ID NO: 1647336 - RNA, 15 nt, Human
gggauucuuaaaguu

SEQ ID NO: 1647337 - RNA, 20 nt, Human
gggauucuuaaaguugaauu

SEQ ID NO: 1647338 - RNA, 14 nt, Human
gggcagaggaaagc

SEQ ID NO: 1647339 - RNA, 15 nt, Human
gggauuuccaugaug

SEQ ID NO: 1647340 - RNA, 16 nt, Human
aaaagggacugagaaa

SEQ ID NO: 1647341 - RNA, 19 nt, Human
aaaagggacugagaaauuu

SEQ ID NO: 1647342 - RNA, 19 nt, Human
gggcagcugccuccccucc

SEQ ID NO: 1647343 - RNA, 14 nt, Human
gggcagcugccucc

SEQ ID NO: 1647344 - RNA, 13 nt, Human
gggcagcugccuc

SEQ ID NO: 1647345 - RNA, 23 nt, Human
gggcagcugccuccccuccucug

SEQ ID NO: 1647346 - RNA, 20 nt, Human
gggcagcugccuccccuccu

SEQ ID NO: 1647347 - RNA, 12 nt, Human
aaaauaaauuau

SEQ ID NO: 1647348 - RNA, 15 nt, Human
aaaauaccagccagu

SEQ ID NO: 1647349 - RNA, 14 nt, Human
aaaauaccagccag

SEQ ID NO: 1647350 - RNA, 21 nt, Human
aaaauaauuuuuauauuugaa

SEQ ID NO: 1647351 - RNA, 23 nt, Human
aaaauaauuuuuauauuugaaau

SEQ ID NO: 1647352 - RNA, 18 nt, Human
aaaauaguggugugauuu

SEQ ID NO: 1647353 - RNA, 12 nt, Human
aaaauagccugc

SEQ ID NO: 1647354 - RNA, 18 nt, Human
aaaauauauaucaaauau

SEQ ID NO: 1647355 - RNA, 16 nt, Human
aaagcuacuuauugua

SEQ ID NO: 1647356 - RNA, 17 nt, Human
aaagcuacuuauuguag

SEQ ID NO: 1647357 - RNA, 18 nt, Human
aaagcuaggccuggccag

SEQ ID NO: 1647358 - RNA, 21 nt, Human
aaagcagugcaugcugucccu

SEQ ID NO: 1647359 - RNA, 22 nt, Human
aaagcagugcaugcugucccuu

SEQ ID NO: 1647360 - RNA, 17 nt, Human
aaagcagugcaugcugu

SEQ ID NO: 1647361 - RNA, 11 nt, Human
aaaggaaagag

SEQ ID NO: 1647362 - RNA, 23 nt, Human
aaaggaagguucuggugugaacu

SEQ ID NO: 1647363 - RNA, 13 nt, Human
aaaggaauuuaaa

SEQ ID NO: 1647364 - RNA, 18 nt, Human
ggugcaaaguucccuacu

SEQ ID NO: 1647365 - RNA, 16 nt, Human
ggugcacaagcuccaa

SEQ ID NO: 1647366 - RNA, 22 nt, Human
ggugcacaagcuccaagcuccc

SEQ ID NO: 1647367 - RNA, 21 nt, Human
ggugauccacucgccuucauc

SEQ ID NO: 1647368 - RNA, 19 nt, Human
ggucuguucuuuccaaagu

SEQ ID NO: 1647369 - RNA, 17 nt, Human
ggucuguucuuuccaaa

SEQ ID NO: 1647370 - RNA, 21 nt, Human
ggucuugaacuccuggccuca

SEQ ID NO: 1647371 - RNA, 22 nt, Human
ggucuugaacuccuggccucaa

SEQ ID NO: 1647372 - RNA, 12 nt, Human
ggucuguucuuu

SEQ ID NO: 1647373 - RNA, 14 nt, Human
ggucugugagaugc

SEQ ID NO: 1647374 - RNA, 24 nt, Human
ggucugugagaugcuagaacuccc

SEQ ID NO: 1647375 - RNA, 17 nt, Human
aaacuuguguaaauaca

SEQ ID NO: 1647376 - RNA, 14 nt, Human
ggucccaccccaca

SEQ ID NO: 1647377 - RNA, 12 nt, Human
ggucccacccca

SEQ ID NO: 1647378 - RNA, 20 nt, Human
gguccacccaggagccccga

SEQ ID NO: 1647379 - RNA, 22 nt, Human
gguccacccaggagccccgagg

SEQ ID NO: 1647380 - RNA, 13 nt, Human
aaacuuuucugau

SEQ ID NO: 1647381 - RNA, 14 nt, Human
aaacuuuucugaua

SEQ ID NO: 1647382 - RNA, 14 nt, Human
aaacuuuaccuuuu

SEQ ID NO: 1647383 - RNA, 16 nt, Human
aaacuuuucugauaga

SEQ ID NO: 1647384 - RNA, 17 nt, Human
aaacuuuucugauagag

SEQ ID NO: 1647385 - RNA, 16 nt, Human
aaagaaugauuaugaa

SEQ ID NO: 1647386 - RNA, 18 nt, Human
gguauaaguggugugugu

SEQ ID NO: 1647387 - RNA, 23 nt, Human
gguauuggcuagagguucaaaga

SEQ ID NO: 1647388 - RNA, 19 nt, Human
aaagacuuuuccaacccuc

SEQ ID NO: 1647389 - RNA, 18 nt, Human
aaagagaacuuccagauc

SEQ ID NO: 1647390 - RNA, 17 nt, Human
aaagaauggaaggugga

SEQ ID NO: 1647391 - RNA, 22 nt, Human
aaagacuauucaaacagucuca

SEQ ID NO: 1647392 - RNA, 15 nt, Human
aaagacuguacaaag

SEQ ID NO: 1647393 - RNA, 14 nt, Human
aaagacuccaaaga

SEQ ID NO: 1647394 - RNA, 13 nt, Human
aaagacuccaaag

SEQ ID NO: 1647395 - RNA, 23 nt, Human
aaagacuauucaaacagucucag

SEQ ID NO: 1647396 - RNA, 15 nt, Human
aaagaugagugagca

SEQ ID NO: 1647397 - RNA, 13 nt, Human
aaagaggcuaugu

SEQ ID NO: 1647398 - RNA, 18 nt, Human
aaagaggcuaugugagca

SEQ ID NO: 1647399 - RNA, 20 nt, Human
aaagaggcagcuugaaacug

SEQ ID NO: 1647400 - RNA, 20 nt, Human
ggguaucaggugcugccauc

SEQ ID NO: 1647401 - RNA, 14 nt, Human
aaaccaagccgugg

SEQ ID NO: 1647402 - RNA, 16 nt, Human
aaaccaagccguggcu

SEQ ID NO: 1647403 - RNA, 18 nt, Human
aaacauugguucuuguau

SEQ ID NO: 1647404 - RNA, 20 nt, Human
aaacauugguucuuguauua

SEQ ID NO: 1647405 - RNA, 21 nt, Human
aaacauugguucuuguauuaa

SEQ ID NO: 1647406 - RNA, 17 nt, Human
aaacauugguucuugua

SEQ ID NO: 1647407 - RNA, 19 nt, Human
aaacauguuucuuuguaau

SEQ ID NO: 1647408 - RNA, 22 nt, Human
aaacauguuucuuuguaaugaa

SEQ ID NO: 1647409 - RNA, 23 nt, Human
aaacauguuucuuuguaaugaaa

SEQ ID NO: 1647410 - RNA, 22 nt, Human
gggucucacuauguugcccagg

SEQ ID NO: 1647411 - RNA, 12 nt, Human
gggucucacucu

SEQ ID NO: 1647412 - RNA, 23 nt, Human
gggucucacuauguugcccaggc

SEQ ID NO: 1647413 - RNA, 12 nt, Human
aaacugcccccu

SEQ ID NO: 1647414 - RNA, 11 nt, Human
aaacugccccc

SEQ ID NO: 1647415 - RNA, 13 nt, Human
aaacugcccccuc

SEQ ID NO: 1647416 - RNA, 17 nt, Human
aaacugcccccucugcc

SEQ ID NO: 1647417 - RNA, 19 nt, Human
aaacugcccccucugcccu

SEQ ID NO: 1647418 - RNA, 20 nt, Human
aaacugcccccucugcccug

SEQ ID NO: 1647419 - RNA, 21 nt, Human
aaacugcccccucugcccugc

SEQ ID NO: 1647420 - RNA, 16 nt, Human
aaacuggauuaaacuu

SEQ ID NO: 1647421 - RNA, 16 nt, Human
aaacuggguuccugca

SEQ ID NO: 1647422 - RNA, 15 nt, Human
aaacuggguuccugc

SEQ ID NO: 1647423 - RNA, 12 nt, Human
aaacgugaaaau

SEQ ID NO: 1647424 - RNA, 15 nt, Human
aaacgucuuaaauau

SEQ ID NO: 1647425 - RNA, 16 nt, Human
aaacguggcugcuuca

SEQ ID NO: 1647426 - RNA, 17 nt, Human
aaacguggcugcuucaa

SEQ ID NO: 1647427 - RNA, 20 nt, Human
aaacguggcugcuucaagga

SEQ ID NO: 1647428 - RNA, 16 nt, Human
aaacggaugauuucua

SEQ ID NO: 1647429 - RNA, 18 nt, Human
aaacggaugauuucuaug

SEQ ID NO: 1647430 - RNA, 23 nt, Human
aaacggccucacuaggcuucugg

SEQ ID NO: 1647431 - RNA, 21 nt, Human
aaaccacauuggagauguuua

SEQ ID NO: 1647432 - RNA, 16 nt, Human
aaaccacagcaguuga

SEQ ID NO: 1647433 - RNA, 15 nt, Human
aaaccacagcaguug

SEQ ID NO: 1647434 - RNA, 13 nt, Human
ggggccaggcugg

SEQ ID NO: 1647435 - RNA, 14 nt, Human
ggggccaggcuggg

SEQ ID NO: 1647436 - RNA, 16 nt, Human
ggggccaggcuggguc

SEQ ID NO: 1647437 - RNA, 17 nt, Human
ggggccaguuggucccc

SEQ ID NO: 1647438 - RNA, 19 nt, Human
ggggccaguuggucccccu

SEQ ID NO: 1647439 - RNA, 16 nt, Human
ggggcccugccuccuu

SEQ ID NO: 1647440 - RNA, 19 nt, Human
ggggcccugccuccuuugu

SEQ ID NO: 1647441 - RNA, 23 nt, Human
ggggcccugccuccuuugugagg

SEQ ID NO: 1647442 - RNA, 13 nt, Human
ggggaccucaggc

SEQ ID NO: 1647443 - RNA, 15 nt, Human
ggggaccucaggccu

SEQ ID NO: 1647444 - RNA, 16 nt, Human
ggggaccucaggccug

SEQ ID NO: 1647445 - RNA, 17 nt, Human
ggggaccucaggccugg

SEQ ID NO: 1647446 - RNA, 19 nt, Human
aaacaagucagucauucag

SEQ ID NO: 1647447 - RNA, 14 nt, Human
aaacacaacuauau

SEQ ID NO: 1647448 - RNA, 13 nt, Human
aaacauauauaac

SEQ ID NO: 1647449 - RNA, 16 nt, Human
aaacauauauaacaau

SEQ ID NO: 1647450 - RNA, 19 nt, Human
aaacauauauaacaaugcu

SEQ ID NO: 1647451 - RNA, 22 nt, Human
aaacaugcuacacacugcaugu

SEQ ID NO: 1647452 - RNA, 16 nt, Human
aaacaugcuacacacu

SEQ ID NO: 1647453 - RNA, 21 nt, Human
aaacauauauaacaaugcugu

SEQ ID NO: 1647454 - RNA, 22 nt, Human
aaaauggacuguggugacuuug

SEQ ID NO: 1647455 - RNA, 12 nt, Human
aaaauggaauac

SEQ ID NO: 1647456 - RNA, 21 nt, Human
aaaauggacguguuaugacuc

SEQ ID NO: 1647457 - RNA, 21 nt, Human
aaaauuggggauucuuaaagu

SEQ ID NO: 1647458 - RNA, 23 nt, Human
aaaauuggggauucuuaaaguug

SEQ ID NO: 1647459 - RNA, 21 nt, Human
aaaauguaggguuauaauaau

SEQ ID NO: 1647460 - RNA, 16 nt, Human
aaaauuuuuaaucuuu

SEQ ID NO: 1647461 - RNA, 19 nt, Human
aaaauuuuuaaucuuuaau

SEQ ID NO: 1647462 - RNA, 19 nt, Human
aaaauuuuuucucuaggaa

SEQ ID NO: 1647463 - RNA, 13 nt, Human
aaacaaagaaauu

SEQ ID NO: 1647464 - RNA, 18 nt, Human
aaacaagaccacguuucu

SEQ ID NO: 1647465 - RNA, 17 nt, Human
aaacaaggaugaauuaa

SEQ ID NO: 1647466 - RNA, 11 nt, Human
ggcaaaauaau

SEQ ID NO: 1647467 - RNA, 21 nt, Human
ggauuuugauccaagcugguc

SEQ ID NO: 1647468 - RNA, 23 nt, Human
ggauuaaacuuaaucuaaaugga

SEQ ID NO: 1647469 - RNA, 13 nt, Human
ggcaaaugacuuu

SEQ ID NO: 1647470 - RNA, 22 nt, Human
ggaugguucccuugaugaagaa

SEQ ID NO: 1647471 - RNA, 23 nt, Human
ggaugguucccuugaugaagaag

SEQ ID NO: 1647472 - RNA, 13 nt, Human
ggauguucuggga

SEQ ID NO: 1647473 - RNA, 12 nt, Human
ggaugagaaagg

SEQ ID NO: 1647474 - RNA, 22 nt, Human
ggaugagaaagguugaagcacc

SEQ ID NO: 1647475 - RNA, 21 nt, Human
ggaugaauuccaaauucugcu

SEQ ID NO: 1647476 - RNA, 22 nt, Human
ggcagccgugccuucagcucua

SEQ ID NO: 1647477 - RNA, 19 nt, Human
ggcagccgugccuucagcu

SEQ ID NO: 1647478 - RNA, 21 nt, Human
ggcagccgugccuucagcucu

SEQ ID NO: 1647479 - RNA, 18 nt, Human
ggcagccgugccuucagc

SEQ ID NO: 1647480 - RNA, 10 nt, Human
ggcagagcag

SEQ ID NO: 1647481 - RNA, 12 nt, Human
ggcagagcagag

SEQ ID NO: 1647482 - RNA, 15 nt, Human
ggcagccaggccaca

SEQ ID NO: 1647483 - RNA, 17 nt, Human
ggcagccaggccacaag

SEQ ID NO: 1647484 - RNA, 12 nt, Human
ggcagaaggaag

SEQ ID NO: 1647485 - RNA, 21 nt, Human
ggccaaggaugccccgucccc

SEQ ID NO: 1647486 - RNA, 13 nt, Human
ggccaagguggga

SEQ ID NO: 1647487 - RNA, 23 nt, Human
ggccagagggagugacagaggca

SEQ ID NO: 1647488 - RNA, 19 nt, Human
ggccagaugcaccagcccu

SEQ ID NO: 1647489 - RNA, 20 nt, Human
ggccagaugcaccagcccuu

SEQ ID NO: 1647490 - RNA, 13 nt, Human
ggccaaaggaagc

SEQ ID NO: 1647491 - RNA, 15 nt, Human
ggccaaagccaaagc

SEQ ID NO: 1647492 - RNA, 12 nt, Human
ggccaaaggaag

SEQ ID NO: 1647493 - RNA, 12 nt, Human
ggcauuguggga

SEQ ID NO: 1647494 - RNA, 19 nt, Human
ggccagguggccacuccag

SEQ ID NO: 1647495 - RNA, 16 nt, Human
ggcccgacagccuggc

SEQ ID NO: 1647496 - RNA, 17 nt, Human
ggcccgacagccuggca

SEQ ID NO: 1647497 - RNA, 23 nt, Human
ggcccuuccucuccacugccuuc

SEQ ID NO: 1647498 - RNA, 19 nt, Human
ggcccuuccucuccacugc

SEQ ID NO: 1647499 - RNA, 22 nt, Human
ggcccuuccucuccacugccuu

SEQ ID NO: 1647500 - RNA, 14 nt, Human
ggcccuuccuuuuc

SEQ ID NO: 1647501 - RNA, 13 nt, Human
ggccucccaacuc

SEQ ID NO: 1647502 - RNA, 14 nt, Human
ggccucccaacuca

SEQ ID NO: 1647503 - RNA, 18 nt, Human
ggagcccacuguacuugc

SEQ ID NO: 1647504 - RNA, 22 nt, Human
ggagcccacuguacuugcucuu

SEQ ID NO: 1647505 - RNA, 22 nt, Human
ggagcugccuguucagcuccag

SEQ ID NO: 1647506 - RNA, 16 nt, Human
ggagcugaguggggga

SEQ ID NO: 1647507 - RNA, 17 nt, Human
ggaggcucuggagccca

SEQ ID NO: 1647508 - RNA, 20 nt, Human
ggaggcucuggagcccacug

SEQ ID NO: 1647509 - RNA, 18 nt, Human
ggaggccaaggugggagg

SEQ ID NO: 1647510 - RNA, 20 nt, Human
ggaggccaaggugggaggau

SEQ ID NO: 1647511 - RNA, 13 nt, Human
ggaggccagccuu

SEQ ID NO: 1647512 - RNA, 21 nt, Human
ggaggaaaaccaagccguggc

SEQ ID NO: 1647513 - RNA, 22 nt, Human
ggaggaaaaccaagccguggcu

SEQ ID NO: 1647514 - RNA, 20 nt, Human
ggaggaaaaccaagccgugg

SEQ ID NO: 1647515 - RNA, 12 nt, Human
ggaggaagagaa

SEQ ID NO: 1647516 - RNA, 21 nt, Human
ggaggcaugugaugagaggaa

SEQ ID NO: 1647517 - RNA, 18 nt, Human
ggaggucgaggcaggagg

SEQ ID NO: 1647518 - RNA, 15 nt, Human
ggaggucgaggcagg

SEQ ID NO: 1647519 - RNA, 16 nt, Human
ggaggucgaggcagga

SEQ ID NO: 1647520 - RNA, 21 nt, Human
ggaggcucuggagcccacugu

SEQ ID NO: 1647521 - RNA, 15 nt, Human
ggaggcugagauggg

SEQ ID NO: 1647522 - RNA, 19 nt, Human
ggaggcugagaugggagaa

SEQ ID NO: 1647523 - RNA, 15 nt, Human
ggagcccacuguacu

SEQ ID NO: 1647524 - RNA, 13 nt, Human
ggagcagccacau

SEQ ID NO: 1647525 - RNA, 21 nt, Human
ggagcagccacauuccugaug

SEQ ID NO: 1647526 - RNA, 19 nt, Human
ggacccugaggcccagagg

SEQ ID NO: 1647527 - RNA, 20 nt, Human
ggacccggaggggccuggca

SEQ ID NO: 1647528 - RNA, 21 nt, Human
ggacccggaggggccuggcag

SEQ ID NO: 1647529 - RNA, 14 nt, Human
ggacccugaggccc

SEQ ID NO: 1647530 - RNA, 15 nt, Human
ggacccugaggccca

SEQ ID NO: 1647531 - RNA, 18 nt, Human
ggacccugaggcccagag

SEQ ID NO: 1647532 - RNA, 19 nt, Human
gcuuguacauaaugcgugc

SEQ ID NO: 1647533 - RNA, 17 nt, Human
ggacuuagcugggagaa

SEQ ID NO: 1647534 - RNA, 22 nt, Human
ggacugugugcucaggagcccu

SEQ ID NO: 1647535 - RNA, 23 nt, Human
ggacugugugcucaggagcccug

SEQ ID NO: 1647536 - RNA, 20 nt, Human
ggacuacaggugugagucac

SEQ ID NO: 1647537 - RNA, 12 nt, Human
ggaccucaggcc

SEQ ID NO: 1647538 - RNA, 16 nt, Human
ggacuaggguccuggg

SEQ ID NO: 1647539 - RNA, 22 nt, Human
ggacucaaugcacugacauugu

SEQ ID NO: 1647540 - RNA, 12 nt, Human
ggacuuguuaga

SEQ ID NO: 1647541 - RNA, 18 nt, Human
ggacuuuuauuuccagug

SEQ ID NO: 1647542 - RNA, 19 nt, Human
ggagaaaauggacguguua

SEQ ID NO: 1647543 - RNA, 15 nt, Human
ggacuuggaagcucc

SEQ ID NO: 1647544 - RNA, 17 nt, Human
ggacuuggaagcuccgc

SEQ ID NO: 1647545 - RNA, 16 nt, Human
ggagacugucucaaga

SEQ ID NO: 1647546 - RNA, 13 nt, Human
ggagaacuagaga

SEQ ID NO: 1647547 - RNA, 22 nt, Human
ggagaaccaaaaagaggcuaug

SEQ ID NO: 1647548 - RNA, 14 nt, Human
ggagagagacucca

SEQ ID NO: 1647549 - RNA, 13 nt, Human
ggagagccuucca

SEQ ID NO: 1647550 - RNA, 16 nt, Human
ggagagccuuccaggg

SEQ ID NO: 1647551 - RNA, 22 nt, Human
ggagagccuuccagggguggga

SEQ ID NO: 1647552 - RNA, 17 nt, Human
ggagagccuuccagggg

SEQ ID NO: 1647553 - RNA, 18 nt, Human
ggagagccuuccaggggu

SEQ ID NO: 1647554 - RNA, 15 nt, Human
ggagagcuagcagca

SEQ ID NO: 1647555 - RNA, 21 nt, Human
gccacugcacuauagccuagg

SEQ ID NO: 1647556 - RNA, 13 nt, Human
gccacccugggga

SEQ ID NO: 1647557 - RNA, 19 nt, Human
gccacccuggggagaaagu

SEQ ID NO: 1647558 - RNA, 23 nt, Human
gccacugcaccgggccacagaga

SEQ ID NO: 1647559 - RNA, 21 nt, Human
gccacuugaugacccccaacc

SEQ ID NO: 1647560 - RNA, 12 nt, Human
gccacugccucu

SEQ ID NO: 1647561 - RNA, 13 nt, Human
gccacugccucuu

SEQ ID NO: 1647562 - RNA, 16 nt, Human
gccacugccucuuccu

SEQ ID NO: 1647563 - RNA, 17 nt, Human
gccacugccucuuccuc

SEQ ID NO: 1647564 - RNA, 18 nt, Human
gccacugugaagagaacc

SEQ ID NO: 1647565 - RNA, 19 nt, Human
gccacugugaagagaacca

SEQ ID NO: 1647566 - RNA, 14 nt, Human
gccaccacgcccgg

SEQ ID NO: 1647567 - RNA, 13 nt, Human
gccaccacgcccg

SEQ ID NO: 1647568 - RNA, 22 nt, Human
gccaccaacauacucccaucug

SEQ ID NO: 1647569 - RNA, 19 nt, Human
gccaccaacauacucccau

SEQ ID NO: 1647570 - RNA, 20 nt, Human
gccaccaacauacucccauc

SEQ ID NO: 1647571 - RNA, 21 nt, Human
gccaccaacauacucccaucu

SEQ ID NO: 1647572 - RNA, 16 nt, Human
gccacauuccugaugc

SEQ ID NO: 1647573 - RNA, 20 nt, Human
gccacauuccugaugcuucu

SEQ ID NO: 1647574 - RNA, 18 nt, Human
gcacuuggagacuuguau

SEQ ID NO: 1647575 - RNA, 15 nt, Human
gccagaauuucaaac

SEQ ID NO: 1647576 - RNA, 22 nt, Human
gccagacaucaacagauaaaua

SEQ ID NO: 1647577 - RNA, 13 nt, Human
gccagcaggcucu

SEQ ID NO: 1647578 - RNA, 16 nt, Human
gccagcaggcucucag

SEQ ID NO: 1647579 - RNA, 17 nt, Human
gccagcaggcucucagg

SEQ ID NO: 1647580 - RNA, 18 nt, Human
gccagcaggcucucaggc

SEQ ID NO: 1647581 - RNA, 19 nt, Human
gccagcaggcucucaggcc

SEQ ID NO: 1647582 - RNA, 20 nt, Human
gccagcaggcucucaggcca

SEQ ID NO: 1647583 - RNA, 21 nt, Human
gccagcaggcucucaggccag

SEQ ID NO: 1647584 - RNA, 23 nt, Human
gccagcaggcucucaggccagcu

SEQ ID NO: 1647585 - RNA, 23 nt, Human
gccagcaguucagagcugcccuc

SEQ ID NO: 1647586 - RNA, 22 nt, Human
gccagcaguucagagcugcccu

SEQ ID NO: 1647587 - RNA, 12 nt, Human
gccaggccagag

SEQ ID NO: 1647588 - RNA, 23 nt, Human
gccaggccacaagacccuugugg

SEQ ID NO: 1647589 - RNA, 19 nt, Human
gccaggcccucugcccacu

SEQ ID NO: 1647590 - RNA, 20 nt, Human
gccaggcccucugcccacuc

SEQ ID NO: 1647591 - RNA, 21 nt, Human
gccaggcccucugcccacucc

SEQ ID NO: 1647592 - RNA, 16 nt, Human
gccaggcccucugccc

SEQ ID NO: 1647593 - RNA, 17 nt, Human
gccaggcccucugccca

SEQ ID NO: 1647594 - RNA, 13 nt, Human
gccaggccagagg

SEQ ID NO: 1647595 - RNA, 18 nt, Human
gcccaccuuggcucaagu

SEQ ID NO: 1647596 - RNA, 13 nt, Human
gcccacgccccca

SEQ ID NO: 1647597 - RNA, 14 nt, Human
gcccacgcccccac

SEQ ID NO: 1647598 - RNA, 15 nt, Human
gcccacgcccccacu

SEQ ID NO: 1647599 - RNA, 15 nt, Human
gcccacgcuggagug

SEQ ID NO: 1647600 - RNA, 16 nt, Human
gcccacgcuggagugc

SEQ ID NO: 1647601 - RNA, 17 nt, Human
gcccacgcuggagugca

SEQ ID NO: 1647602 - RNA, 17 nt, Human
gccauuccccgucucug

SEQ ID NO: 1647603 - RNA, 18 nt, Human
gccauuccccgucucugg

SEQ ID NO: 1647604 - RNA, 19 nt, Human
gccauguuggccaggcugg

SEQ ID NO: 1647605 - RNA, 20 nt, Human
gccauguuggccaggcuggu

SEQ ID NO: 1647606 - RNA, 22 nt, Human
gccauguuggccaggcuggucu

SEQ ID NO: 1647607 - RNA, 24 nt, Human
gccauguuggccaggcuggucuca

SEQ ID NO: 1647608 - RNA, 15 nt, Human
gccauguuggccagg

SEQ ID NO: 1647609 - RNA, 16 nt, Human
gccauguuggccaggc

SEQ ID NO: 1647610 - RNA, 17 nt, Human
gccauguuggccaggcu

SEQ ID NO: 1647611 - RNA, 18 nt, Human
gccauguuggccaggcug

SEQ ID NO: 1647612 - RNA, 14 nt, Human
gccauguuggccag

SEQ ID NO: 1647613 - RNA, 19 nt, Human
gccauauucuguuggccag

SEQ ID NO: 1647614 - RNA, 20 nt, Human
gccauauucuguuggccagu

SEQ ID NO: 1647615 - RNA, 16 nt, Human
gcccuuaccugccagg

SEQ ID NO: 1647616 - RNA, 20 nt, Human
gcccuuaccugccaggaagc

SEQ ID NO: 1647617 - RNA, 21 nt, Human
gcccuuaccugccaggaagcc

SEQ ID NO: 1647618 - RNA, 15 nt, Human
gccgccaugcuccug

SEQ ID NO: 1647619 - RNA, 16 nt, Human
gccgccaugcuccugg

SEQ ID NO: 1647620 - RNA, 16 nt, Human
gcccugcugaguccca

SEQ ID NO: 1647621 - RNA, 16 nt, Human
gcccugccuccuuugu

SEQ ID NO: 1647622 - RNA, 22 nt, Human
gcccugccuccuuugugaggaa

SEQ ID NO: 1647623 - RNA, 14 nt, Human
gcccuguuaaaaga

SEQ ID NO: 1647624 - RNA, 17 nt, Human
gcccuguuaaaagauga

SEQ ID NO: 1647625 - RNA, 21 nt, Human
gcccugcugagucccaggcug

SEQ ID NO: 1647626 - RNA, 22 nt, Human
gcccugcugagucccaggcuga

SEQ ID NO: 1647627 - RNA, 23 nt, Human
gcccugcugagucccaggcugag

SEQ ID NO: 1647628 - RNA, 13 nt, Human
gcccuguuaaaag

SEQ ID NO: 1647629 - RNA, 17 nt, Human
gcccacuagacccacug

SEQ ID NO: 1647630 - RNA, 23 nt, Human
gcccacuagacccacuggacuca

SEQ ID NO: 1647631 - RNA, 13 nt, Human
gcccacucccugc

SEQ ID NO: 1647632 - RNA, 19 nt, Human
gcccacucccugcaaccug

SEQ ID NO: 1647633 - RNA, 14 nt, Human
gcccacucccugca

SEQ ID NO: 1647634 - RNA, 15 nt, Human
gcccacucccugcaa

SEQ ID NO: 1647635 - RNA, 22 nt, Human
gcccuaaaguguauuuuuuuac

SEQ ID NO: 1647636 - RNA, 15 nt, Human
gccccugcccggcug

SEQ ID NO: 1647637 - RNA, 16 nt, Human
gccccuggaugcagcc

SEQ ID NO: 1647638 - RNA, 18 nt, Human
gccccuggaugcagccuc

SEQ ID NO: 1647639 - RNA, 22 nt, Human
gccccuggaugcagccucacag

SEQ ID NO: 1647640 - RNA, 14 nt, Human
gcccccucugcccu

SEQ ID NO: 1647641 - RNA, 13 nt, Human
gccccugcccggc

SEQ ID NO: 1647642 - RNA, 14 nt, Human
gccccugcccggcu

SEQ ID NO: 1647643 - RNA, 18 nt, Human
gccccaaaacucuccucu

SEQ ID NO: 1647644 - RNA, 19 nt, Human
gccccaaaacucuccucug

SEQ ID NO: 1647645 - RNA, 16 nt, Human
gcccccaggugccagu

SEQ ID NO: 1647646 - RNA, 22 nt, Human
gccucuuccucccucauuccac

SEQ ID NO: 1647647 - RNA, 12 nt, Human
gccucuuccucc

SEQ ID NO: 1647648 - RNA, 12 nt, Human
gccucuucucua

SEQ ID NO: 1647649 - RNA, 23 nt, Human
gccucuucucuacucuagggaaa

SEQ ID NO: 1647650 - RNA, 18 nt, Human
gccugcccaggccccugc

SEQ ID NO: 1647651 - RNA, 19 nt, Human
gccugcccaggccccugcc

SEQ ID NO: 1647652 - RNA, 20 nt, Human
gccugcccaggccccugcca

SEQ ID NO: 1647653 - RNA, 14 nt, Human
gccucugggacugg

SEQ ID NO: 1647654 - RNA, 12 nt, Human
gccucugggacu

SEQ ID NO: 1647655 - RNA, 13 nt, Human
gccuccugugugu

SEQ ID NO: 1647656 - RNA, 13 nt, Human
gccuccuccagcc

SEQ ID NO: 1647657 - RNA, 17 nt, Human
gccugccuguucccauu

SEQ ID NO: 1647658 - RNA, 16 nt, Human
gccugccucuucucua

SEQ ID NO: 1647659 - RNA, 21 nt, Human
gccugggaggucaaggcugca

SEQ ID NO: 1647660 - RNA, 22 nt, Human
gccugggaggucaaggcugcag

SEQ ID NO: 1647661 - RNA, 14 nt, Human
gccugggaucccuc

SEQ ID NO: 1647662 - RNA, 13 nt, Human
gccugugucuuua

SEQ ID NO: 1647663 - RNA, 22 nt, Human
gccugugucuuuaaaugcugcu

SEQ ID NO: 1647664 - RNA, 21 nt, Human
gccugggaucccucauccuca

SEQ ID NO: 1647665 - RNA, 18 nt, Human
gccugggaucccucaucc

SEQ ID NO: 1647666 - RNA, 20 nt, Human
gccuggccccucaggguccc

SEQ ID NO: 1647667 - RNA, 22 nt, Human
gccuggccccucagggucccug

SEQ ID NO: 1647668 - RNA, 10 nt, Human
gccuggccug

SEQ ID NO: 1647669 - RNA, 16 nt, Human
gccuggccccucaggg

SEQ ID NO: 1647670 - RNA, 17 nt, Human
gccuggccccucagggu

SEQ ID NO: 1647671 - RNA, 15 nt, Human
gccuggccccucagg

SEQ ID NO: 1647672 - RNA, 19 nt, Human
gcuugaaacccguggcgcu

SEQ ID NO: 1647673 - RNA, 19 nt, Human
gcuugggcuucauccuccu

SEQ ID NO: 1647674 - RNA, 16 nt, Human
gcuuguacauaaugcg

SEQ ID NO: 1647675 - RNA, 14 nt, Human
gcuuguacauaaug

SEQ ID NO: 1647676 - RNA, 15 nt, Human
gcuucccgcucagcc

SEQ ID NO: 1647677 - RNA, 16 nt, Human
gcuucccgcucagccc

SEQ ID NO: 1647678 - RNA, 17 nt, Human
gcuucccgcucagcccu

SEQ ID NO: 1647679 - RNA, 18 nt, Human
gcuucccgcucagcccuc

SEQ ID NO: 1647680 - RNA, 23 nt, Human
gcuucccgcucagcccucccugc

SEQ ID NO: 1647681 - RNA, 15 nt, Human
gcuggguucuaccca

SEQ ID NO: 1647682 - RNA, 15 nt, Human
gcuggguucugaucc

SEQ ID NO: 1647683 - RNA, 14 nt, Human
gcuggguuggaggg

SEQ ID NO: 1647684 - RNA, 21 nt, Human
gcuggguuggaggguguccca

SEQ ID NO: 1647685 - RNA, 20 nt, Human
gcuguaucccaugagccuca

SEQ ID NO: 1647686 - RNA, 23 nt, Human
gcuguaucccaugagccucagca

SEQ ID NO: 1647687 - RNA, 21 nt, Human
gcuguuggcugggggccucag

SEQ ID NO: 1647688 - RNA, 22 nt, Human
gcuguuggcugggggccucagu

SEQ ID NO: 1647689 - RNA, 19 nt, Human
gcugugcugcccugcccac

SEQ ID NO: 1647690 - RNA, 22 nt, Human
gcugugcugcccugcccaccug

SEQ ID NO: 1647691 - RNA, 21 nt, Human
gcugugcucuggacaggcaug

SEQ ID NO: 1647692 - RNA, 12 nt, Human
gcugugcugccc

SEQ ID NO: 1647693 - RNA, 13 nt, Human
gcugugcugcccu

SEQ ID NO: 1647694 - RNA, 14 nt, Human
gcugugcugcccug

SEQ ID NO: 1647695 - RNA, 22 nt, Human
gcuucaaggauccugagccaga

SEQ ID NO: 1647696 - RNA, 14 nt, Human
gcuuaacuucacau

SEQ ID NO: 1647697 - RNA, 20 nt, Human
gcuucacggaagagccuugc

SEQ ID NO: 1647698 - RNA, 19 nt, Human
gcugggucgcccuggacug

SEQ ID NO: 1647699 - RNA, 15 nt, Human
gcuggguguggcgca

SEQ ID NO: 1647700 - RNA, 17 nt, Human
gcugggucgcccuggac

SEQ ID NO: 1647701 - RNA, 18 nt, Human
gcugggucgcccuggacu

SEQ ID NO: 1647702 - RNA, 16 nt, Human
gcugggucgcccugga

SEQ ID NO: 1647703 - RNA, 14 nt, Human
gcugggcagguugg

SEQ ID NO: 1647704 - RNA, 16 nt, Human
gcugggcagaggaaag

SEQ ID NO: 1647705 - RNA, 17 nt, Human
gcugggcagaggaaagc

SEQ ID NO: 1647706 - RNA, 19 nt, Human
gcugggcagaggaaagcaa

SEQ ID NO: 1647707 - RNA, 16 nt, Human
gcugggcucccuuccc

SEQ ID NO: 1647708 - RNA, 17 nt, Human
gcugggcucccuuccca

SEQ ID NO: 1647709 - RNA, 20 nt, Human
gcugggcucccuucccaccu

SEQ ID NO: 1647710 - RNA, 14 nt, Human
gcuggagugcagug

SEQ ID NO: 1647711 - RNA, 15 nt, Human
gcuggagugcaguga

SEQ ID NO: 1647712 - RNA, 16 nt, Human
gcuggccuggccccuc

SEQ ID NO: 1647713 - RNA, 17 nt, Human
gcuggccuggccccuca

SEQ ID NO: 1647714 - RNA, 22 nt, Human
gcugggauuacaggcuccugcc

SEQ ID NO: 1647715 - RNA, 23 nt, Human
gcugggauuacaggcuccugcca

SEQ ID NO: 1647716 - RNA, 16 nt, Human
gcugggauuacaggug

SEQ ID NO: 1647717 - RNA, 18 nt, Human
gcuggccuggccccucag

SEQ ID NO: 1647718 - RNA, 19 nt, Human
gcuggccuggccccucagg

SEQ ID NO: 1647719 - RNA, 13 nt, Human
gcugggcagagga

SEQ ID NO: 1647720 - RNA, 14 nt, Human
gcugggcagaggaa

SEQ ID NO: 1647721 - RNA, 15 nt, Human
gcugggcagaggaaa

SEQ ID NO: 1647722 - RNA, 17 nt, Human
gcugggauuacaggugu

SEQ ID NO: 1647723 - RNA, 18 nt, Human
gcugggauuacaggugug

SEQ ID NO: 1647724 - RNA, 19 nt, Human
gcugggauuacagguguga

SEQ ID NO: 1647725 - RNA, 14 nt, Human
gcuggagcucugcc

SEQ ID NO: 1647726 - RNA, 12 nt, Human
gcuggagugcag

SEQ ID NO: 1647727 - RNA, 17 nt, Human
gcuggagcucugcccau

SEQ ID NO: 1647728 - RNA, 19 nt, Human
gcugccagccgagauagcc

SEQ ID NO: 1647729 - RNA, 21 nt, Human
gcugccagccgagauagccaa

SEQ ID NO: 1647730 - RNA, 21 nt, Human
gcugccauccagguucagcuu

SEQ ID NO: 1647731 - RNA, 23 nt, Human
gcugccaucucaccuccugcugg

SEQ ID NO: 1647732 - RNA, 22 nt, Human
gcugccaucucaccuccugcug

SEQ ID NO: 1647733 - RNA, 23 nt, Human
gcugccauccagguucagcuugu

SEQ ID NO: 1647734 - RNA, 18 nt, Human
gcugcaccggcuggccug

SEQ ID NO: 1647735 - RNA, 19 nt, Human
gcugcaccggcuggccugg

SEQ ID NO: 1647736 - RNA, 22 nt, Human
gcugcaccggcuggccuggccc

SEQ ID NO: 1647737 - RNA, 16 nt, Human
gcugcaccggcuggcc

SEQ ID NO: 1647738 - RNA, 17 nt, Human
gcugcaccggcuggccu

SEQ ID NO: 1647739 - RNA, 18 nt, Human
gcugagggugagugggug

SEQ ID NO: 1647740 - RNA, 13 nt, Human
gcugccugggauc

SEQ ID NO: 1647741 - RNA, 22 nt, Human
gcugccuccccuccucugcuug

SEQ ID NO: 1647742 - RNA, 21 nt, Human
gcugccuccccuccucugcuu

SEQ ID NO: 1647743 - RNA, 20 nt, Human
gcugccuccccuccucugcu

SEQ ID NO: 1647744 - RNA, 17 nt, Human
gcugccuccccuccucu

SEQ ID NO: 1647745 - RNA, 16 nt, Human
gcugccuccccuccuc

SEQ ID NO: 1647746 - RNA, 19 nt, Human
gcugccugggaucccucau

SEQ ID NO: 1647747 - RNA, 16 nt, Human
gcugccugggaucccu

SEQ ID NO: 1647748 - RNA, 18 nt, Human
gcugccugggaucccuca

SEQ ID NO: 1647749 - RNA, 22 nt, Human
gcuccugccaccacgcccggcu

SEQ ID NO: 1647750 - RNA, 18 nt, Human
gcuccccucggagaagag

SEQ ID NO: 1647751 - RNA, 15 nt, Human
gcuccccucggagaa

SEQ ID NO: 1647752 - RNA, 14 nt, Human
gcuccccagcccca

SEQ ID NO: 1647753 - RNA, 22 nt, Human
gcucccaggcauuccccaggag

SEQ ID NO: 1647754 - RNA, 23 nt, Human
gcucccaggcauuccccaggagg

SEQ ID NO: 1647755 - RNA, 20 nt, Human
gcucccaggcauuccccagg

SEQ ID NO: 1647756 - RNA, 21 nt, Human
gcucccaggcauuccccagga

SEQ ID NO: 1647757 - RNA, 20 nt, Human
gcucuacagcuaaucagcau

SEQ ID NO: 1647758 - RNA, 22 nt, Human
gcucuacagcuaaucagcauuc

SEQ ID NO: 1647759 - RNA, 13 nt, Human
gcucucaggccag

SEQ ID NO: 1647760 - RNA, 14 nt, Human
gcucucaggccagc

SEQ ID NO: 1647761 - RNA, 15 nt, Human
gcucucaggccagcu

SEQ ID NO: 1647762 - RNA, 16 nt, Human
gcucucaggccagcug

SEQ ID NO: 1647763 - RNA, 17 nt, Human
gcugacagacacaggcc

SEQ ID NO: 1647764 - RNA, 16 nt, Human
gcugacagacacaggc

SEQ ID NO: 1647765 - RNA, 14 nt, Human
gcugacagacacag

SEQ ID NO: 1647766 - RNA, 15 nt, Human
gcugacagacacagg

SEQ ID NO: 1647767 - RNA, 12 nt, Human
gcugaaggcucg

SEQ ID NO: 1647768 - RNA, 20 nt, Human
gcugaaggcucgagcaugcc

SEQ ID NO: 1647769 - RNA, 17 nt, Human
gcugaaugguuuucaaa

SEQ ID NO: 1647770 - RNA, 20 nt, Human
gcugaacacuccaauuaagg

SEQ ID NO: 1647771 - RNA, 21 nt, Human
gcugaacacuccaauuaagga

SEQ ID NO: 1647772 - RNA, 23 nt, Human
gcugaacacuccaauuaaggauu

SEQ ID NO: 1647773 - RNA, 15 nt, Human
gcucuuccaggcugg

SEQ ID NO: 1647774 - RNA, 16 nt, Human
gcucuuccaggcuggg

SEQ ID NO: 1647775 - RNA, 12 nt, Human
gcucuuccaggc

SEQ ID NO: 1647776 - RNA, 19 nt, Human
gcucugucgcccaggcugg

SEQ ID NO: 1647777 - RNA, 23 nt, Human
gcucugucgcccaggcuggagug

SEQ ID NO: 1647778 - RNA, 16 nt, Human
gcucuguccugggagu

SEQ ID NO: 1647779 - RNA, 15 nt, Human
gcucuguccugggag

SEQ ID NO: 1647780 - RNA, 20 nt, Human
gcucugagcaaauguggcuc

SEQ ID NO: 1647781 - RNA, 21 nt, Human
gcucugagcaaauguggcucc

SEQ ID NO: 1647782 - RNA, 23 nt, Human
gcucuggagcccacuguacuugc

SEQ ID NO: 1647783 - RNA, 14 nt, Human
gccuguucagcucc

SEQ ID NO: 1647784 - RNA, 20 nt, Human
gccuguucagcuccagcuca

SEQ ID NO: 1647785 - RNA, 14 nt, Human
gccugugucuuuaa

SEQ ID NO: 1647786 - RNA, 19 nt, Human
gccuguucagcuccagcuc

SEQ ID NO: 1647787 - RNA, 16 nt, Human
gcuauugucaccaggg

SEQ ID NO: 1647788 - RNA, 20 nt, Human
gcuauugucaccagggcugg

SEQ ID NO: 1647789 - RNA, 21 nt, Human
gcuauugucaccagggcugga

SEQ ID NO: 1647790 - RNA, 14 nt, Human
gcuaggccuggcca

SEQ ID NO: 1647791 - RNA, 15 nt, Human
gcuaggccuggccag

SEQ ID NO: 1647792 - RNA, 21 nt, Human
gcuaguaauuggaaaggcagc

SEQ ID NO: 1647793 - RNA, 16 nt, Human
gcuaguaucaaaagaa

SEQ ID NO: 1647794 - RNA, 19 nt, Human
gcuaggaacacuccuucac

SEQ ID NO: 1647795 - RNA, 21 nt, Human
gcuaggaacacuccuucacag

SEQ ID NO: 1647796 - RNA, 18 nt, Human
gcuaggaacacuccuuca

SEQ ID NO: 1647797 - RNA, 15 nt, Human
gcucaggagcccugg

SEQ ID NO: 1647798 - RNA, 18 nt, Human
gcucaggagcccugggag

SEQ ID NO: 1647799 - RNA, 21 nt, Human
gcucaggagcccugggaggcu

SEQ ID NO: 1647800 - RNA, 12 nt, Human
gcucagggccug

SEQ ID NO: 1647801 - RNA, 17 nt, Human
gcucagggccuggcuca

SEQ ID NO: 1647802 - RNA, 13 nt, Human
gcucagggccugg

SEQ ID NO: 1647803 - RNA, 16 nt, Human
gcucagggccuggcuc

SEQ ID NO: 1647804 - RNA, 14 nt, Human
gcucaggagcccug

SEQ ID NO: 1647805 - RNA, 22 nt, Human
gcucagagagggugggaguggg

SEQ ID NO: 1647806 - RNA, 18 nt, Human
gcucagagagggugggag

SEQ ID NO: 1647807 - RNA, 20 nt, Human
gcucagagagggugggagug

SEQ ID NO: 1647808 - RNA, 15 nt, Human
gcucagagagggugg

SEQ ID NO: 1647809 - RNA, 21 nt, Human
gcucagguggggucacucugg

SEQ ID NO: 1647810 - RNA, 22 nt, Human
gcucagguggggucacucuggc

SEQ ID NO: 1647811 - RNA, 13 nt, Human
cucugcagguccc

SEQ ID NO: 1647812 - RNA, 21 nt, Human
cucugcuccucuccccagcaa

SEQ ID NO: 1647813 - RNA, 17 nt, Human
cucugcacuccccugcu

SEQ ID NO: 1647814 - RNA, 18 nt, Human
cucugcacuccccugcug

SEQ ID NO: 1647815 - RNA, 21 nt, Human
cucugcugacagacacaggcc

SEQ ID NO: 1647816 - RNA, 22 nt, Human
cucugcugacagacacaggccc

SEQ ID NO: 1647817 - RNA, 23 nt, Human
cucugcugacagacacaggcccg

SEQ ID NO: 1647818 - RNA, 13 nt, Human
cucugcugcuggc

SEQ ID NO: 1647819 - RNA, 13 nt, Human
cucuguccuggga

SEQ ID NO: 1647820 - RNA, 16 nt, Human
cucuguacagagccca

SEQ ID NO: 1647821 - RNA, 16 nt, Human
cucugcugcuggcugg

SEQ ID NO: 1647822 - RNA, 14 nt, Human
cucugcugcuggcu

SEQ ID NO: 1647823 - RNA, 15 nt, Human
cucugcugcuggcug

SEQ ID NO: 1647824 - RNA, 14 nt, Human
cucuguacagagcc

SEQ ID NO: 1647825 - RNA, 15 nt, Human
cucuguacagagccc

SEQ ID NO: 1647826 - RNA, 13 nt, Human
cucuguacagagc

SEQ ID NO: 1647827 - RNA, 15 nt, Human
cucugcacuccccug

SEQ ID NO: 1647828 - RNA, 16 nt, Human
cucugcacuccccugc

SEQ ID NO: 1647829 - RNA, 20 nt, Human
cucugcacaagcugcacccu

SEQ ID NO: 1647830 - RNA, 21 nt, Human
cucugcacaagcugcacccuc

SEQ ID NO: 1647831 - RNA, 20 nt, Human
cuccuuucacaaccuucugu

SEQ ID NO: 1647832 - RNA, 17 nt, Human
cuccuuugugaggaagc

SEQ ID NO: 1647833 - RNA, 18 nt, Human
cuccuuugugaggaagcc

SEQ ID NO: 1647834 - RNA, 23 nt, Human
cuccuuugugaggaagccgcugg

SEQ ID NO: 1647835 - RNA, 17 nt, Human
cucgguguggagaagcg

SEQ ID NO: 1647836 - RNA, 23 nt, Human
cucgguguggagaagcggcuggc

SEQ ID NO: 1647837 - RNA, 16 nt, Human
cucgguguggagaagc

SEQ ID NO: 1647838 - RNA, 16 nt, Human
cucuccccaugauguu

SEQ ID NO: 1647839 - RNA, 15 nt, Human
cucuccccaugaugu

SEQ ID NO: 1647840 - RNA, 19 nt, Human
cucuauguucuaagaagug

SEQ ID NO: 1647841 - RNA, 13 nt, Human
cucuccuccagag

SEQ ID NO: 1647842 - RNA, 15 nt, Human
cucuccuccagaguc

SEQ ID NO: 1647843 - RNA, 14 nt, Human
cucucuggccuucg

SEQ ID NO: 1647844 - RNA, 16 nt, Human
cucucuggccuucggc

SEQ ID NO: 1647845 - RNA, 16 nt, Human
cucuccuccagaguca

SEQ ID NO: 1647846 - RNA, 13 nt, Human
cucucuggccuuc

SEQ ID NO: 1647847 - RNA, 14 nt, Human
cuccuuguguuacu

SEQ ID NO: 1647848 - RNA, 13 nt, Human
cuccuuucacaac

SEQ ID NO: 1647849 - RNA, 16 nt, Human
cuccuuucacaaccuu

SEQ ID NO: 1647850 - RNA, 17 nt, Human
cuccuuucacaaccuuc

SEQ ID NO: 1647851 - RNA, 15 nt, Human
cuccuuucaccacau

SEQ ID NO: 1647852 - RNA, 14 nt, Human
cuccuggggguucu

SEQ ID NO: 1647853 - RNA, 16 nt, Human
cuccuguaccucuuga

SEQ ID NO: 1647854 - RNA, 12 nt, Human
cuccucugucca

SEQ ID NO: 1647855 - RNA, 15 nt, Human
cuccucuguccaggc

SEQ ID NO: 1647856 - RNA, 15 nt, Human
cuccucugcugcugg

SEQ ID NO: 1647857 - RNA, 13 nt, Human
cuccucugcugcu

SEQ ID NO: 1647858 - RNA, 14 nt, Human
cuccucugcugcug

SEQ ID NO: 1647859 - RNA, 15 nt, Human
cuccucuugccacug

SEQ ID NO: 1647860 - RNA, 16 nt, Human
cuccucuugccacugc

SEQ ID NO: 1647861 - RNA, 12 nt, Human
cuccucuugcca

SEQ ID NO: 1647862 - RNA, 18 nt, Human
cuccucuugccacugccu

SEQ ID NO: 1647863 - RNA, 19 nt, Human
cuccuggcccacugcaucg

SEQ ID NO: 1647864 - RNA, 19 nt, Human
cuccuggccucaagugauu

SEQ ID NO: 1647865 - RNA, 18 nt, Human
cuccugggcuaagugauc

SEQ ID NO: 1647866 - RNA, 13 nt, Human
cuccuaccuggua

SEQ ID NO: 1647867 - RNA, 15 nt, Human
cucccacaggcccuu

SEQ ID NO: 1647868 - RNA, 14 nt, Human
cucccacaggcccu

SEQ ID NO: 1647869 - RNA, 16 nt, Human
cucccacaggcccuuc

SEQ ID NO: 1647870 - RNA, 20 nt, Human
cucccacaggcccuuccucu

SEQ ID NO: 1647871 - RNA, 21 nt, Human
cucccacaggcccuuccucuc

SEQ ID NO: 1647872 - RNA, 23 nt, Human
cuccaggugcacaagcuccaagc

SEQ ID NO: 1647873 - RNA, 23 nt, Human
cuccaggcuccuuuagcgcccag

SEQ ID NO: 1647874 - RNA, 20 nt, Human
cuccaggcuguaucccauga

SEQ ID NO: 1647875 - RNA, 22 nt, Human
cuccaggcuguaucccaugagc

SEQ ID NO: 1647876 - RNA, 20 nt, Human
cucccugaaguaagcaaaga

SEQ ID NO: 1647877 - RNA, 20 nt, Human
cucccucuuucccucccuuc

SEQ ID NO: 1647878 - RNA, 15 nt, Human
cucccaggcauuccc

SEQ ID NO: 1647879 - RNA, 19 nt, Human
cucccuccaccucccugca

SEQ ID NO: 1647880 - RNA, 22 nt, Human
cucccuccaccucccugcaaua

SEQ ID NO: 1647881 - RNA, 21 nt, Human
cucccuccaccucccugcaau

SEQ ID NO: 1647882 - RNA, 20 nt, Human
cucccuccaccucccugcaa

SEQ ID NO: 1647883 - RNA, 21 nt, Human
cucaggccaaacucaccugcc

SEQ ID NO: 1647884 - RNA, 19 nt, Human
cucaggccaaacucaccug

SEQ ID NO: 1647885 - RNA, 20 nt, Human
cucaggccaaacucaccugc

SEQ ID NO: 1647886 - RNA, 22 nt, Human
cucaggccugggggcugggcag

SEQ ID NO: 1647887 - RNA, 11 nt, Human
cucaggccugg

SEQ ID NO: 1647888 - RNA, 16 nt, Human
cucaggccagcugcuu

SEQ ID NO: 1647889 - RNA, 17 nt, Human
cucaggccagcugcuug

SEQ ID NO: 1647890 - RNA, 18 nt, Human
cucaggccagcugcuugg

SEQ ID NO: 1647891 - RNA, 20 nt, Human
cucaggccagcugcuugggc

SEQ ID NO: 1647892 - RNA, 13 nt, Human
cucaggccugggg

SEQ ID NO: 1647893 - RNA, 19 nt, Human
cucagccucccgaauagcu

SEQ ID NO: 1647894 - RNA, 21 nt, Human
cucagccucccgaauagcugg

SEQ ID NO: 1647895 - RNA, 22 nt, Human
cucagccucccgaauagcuggg

SEQ ID NO: 1647896 - RNA, 23 nt, Human
cucagaagacacugaugggcaac

SEQ ID NO: 1647897 - RNA, 19 nt, Human
cucagaaggcaaaugacuu

SEQ ID NO: 1647898 - RNA, 17 nt, Human
cucaccuuucccaucuu

SEQ ID NO: 1647899 - RNA, 13 nt, Human
cucagaagacacu

SEQ ID NO: 1647900 - RNA, 15 nt, Human
cucagaagacacuga

SEQ ID NO: 1647901 - RNA, 17 nt, Human
cucagaagacacugaug

SEQ ID NO: 1647902 - RNA, 20 nt, Human
cucagaagacacugaugggc

SEQ ID NO: 1647903 - RNA, 22 nt, Human
cucagaagacacugaugggcaa

SEQ ID NO: 1647904 - RNA, 22 nt, Human
cucagguugucugaagucacug

SEQ ID NO: 1647905 - RNA, 23 nt, Human
cucaggugucccugcacuugcag

SEQ ID NO: 1647906 - RNA, 22 nt, Human
cucagucuggcccuuccuuuuc

SEQ ID NO: 1647907 - RNA, 14 nt, Human
cucagguugucuga

SEQ ID NO: 1647908 - RNA, 15 nt, Human
cucaguccauagcag

SEQ ID NO: 1647909 - RNA, 17 nt, Human
cucaguccauagcagag

SEQ ID NO: 1647910 - RNA, 16 nt, Human
cucaguccaugaagau

SEQ ID NO: 1647911 - RNA, 23 nt, Human
cucaauuauuuugcauuuuuucu

SEQ ID NO: 1647912 - RNA, 17 nt, Human
cuauccuacuuccccuu

SEQ ID NO: 1647913 - RNA, 18 nt, Human
cuaucaugucaaacguga

SEQ ID NO: 1647914 - RNA, 14 nt, Human
cuaugugagaccau

SEQ ID NO: 1647915 - RNA, 13 nt, Human
cuaucucccccag

SEQ ID NO: 1647916 - RNA, 14 nt, Human
cuaucucccccagc

SEQ ID NO: 1647917 - RNA, 18 nt, Human
cuaucucauuuccaagca

SEQ ID NO: 1647918 - RNA, 18 nt, Human
cuauguugcccaggcagg

SEQ ID NO: 1647919 - RNA, 19 nt, Human
cuauguugcccaggcaggu

SEQ ID NO: 1647920 - RNA, 21 nt, Human
cuauguugcccaggcaggucu

SEQ ID NO: 1647921 - RNA, 22 nt, Human
cuauguugcccaggcaggucuu

SEQ ID NO: 1647922 - RNA, 17 nt, Human
cuaugugagcacaaagg

SEQ ID NO: 1647923 - RNA, 14 nt, Human
cuauguugcccagg

SEQ ID NO: 1647924 - RNA, 18 nt, Human
cuauguucuaagaaguga

SEQ ID NO: 1647925 - RNA, 21 nt, Human
ccuguucacucuacuuagcau

SEQ ID NO: 1647926 - RNA, 13 nt, Human
ccuguucagcucc

SEQ ID NO: 1647927 - RNA, 15 nt, Human
ccuucccaugcccug

SEQ ID NO: 1647928 - RNA, 12 nt, Human
ccuucccaccuc

SEQ ID NO: 1647929 - RNA, 14 nt, Human
ccuucccaccucuc

SEQ ID NO: 1647930 - RNA, 19 nt, Human
ccuucccaccucucucacu

SEQ ID NO: 1647931 - RNA, 22 nt, Human
ccuuauggaacacucugagacu

SEQ ID NO: 1647932 - RNA, 19 nt, Human
ccuuauggaacacucugag

SEQ ID NO: 1647933 - RNA, 20 nt, Human
ccuuauggaacacucugaga

SEQ ID NO: 1647934 - RNA, 14 nt, Human
ccuuauggaacacu

SEQ ID NO: 1647935 - RNA, 16 nt, Human
ccuuauggaacacucu

SEQ ID NO: 1647936 - RNA, 17 nt, Human
ccuuauggaacacucug

SEQ ID NO: 1647937 - RNA, 18 nt, Human
ccuuauggaacacucuga

SEQ ID NO: 1647938 - RNA, 13 nt, Human
ccuuaucaaagga

SEQ ID NO: 1647939 - RNA, 20 nt, Human
ccuuaggugauccacucgcc

SEQ ID NO: 1647940 - RNA, 14 nt, Human
ccuuaucaaaggac

SEQ ID NO: 1647941 - RNA, 18 nt, Human
ccuuaucaaaggacacca

SEQ ID NO: 1647942 - RNA, 12 nt, Human
ccuuauggaaca

SEQ ID NO: 1647943 - RNA, 16 nt, Human
ccuuagcaaauucugu

SEQ ID NO: 1647944 - RNA, 19 nt, Human
ccuuagcagggaaacagcu

SEQ ID NO: 1647945 - RNA, 20 nt, Human
ccuuagcagggaaacagcua

SEQ ID NO: 1647946 - RNA, 16 nt, Human
ccuguugggccaggag

SEQ ID NO: 1647947 - RNA, 17 nt, Human
ccuguugggccaggagc

SEQ ID NO: 1647948 - RNA, 18 nt, Human
ccuguugggccaggagcc

SEQ ID NO: 1647949 - RNA, 19 nt, Human
ccuguugggccaggagccu

SEQ ID NO: 1647950 - RNA, 20 nt, Human
ccuguugggccaggagccuc

SEQ ID NO: 1647951 - RNA, 12 nt, Human
ccuguucccauu

SEQ ID NO: 1647952 - RNA, 18 nt, Human
ccuguucccaugagauga

SEQ ID NO: 1647953 - RNA, 16 nt, Human
ccuguucugcuuuccu

SEQ ID NO: 1647954 - RNA, 12 nt, Human
ccuguucuggca

SEQ ID NO: 1647955 - RNA, 17 nt, Human
ccuguucuggcagaguu

SEQ ID NO: 1647956 - RNA, 23 nt, Human
ccuguucagcuccagcucaccag

SEQ ID NO: 1647957 - RNA, 20 nt, Human
ccuguucagcuccagcucac

SEQ ID NO: 1647958 - RNA, 21 nt, Human
ccuguucagcuccagcucacc

SEQ ID NO: 1647959 - RNA, 14 nt, Human
ccuguucagcucca

SEQ ID NO: 1647960 - RNA, 15 nt, Human
ccuguucagcuccag

SEQ ID NO: 1647961 - RNA, 16 nt, Human
ccuguucagcuccagc

SEQ ID NO: 1647962 - RNA, 19 nt, Human
ccuguucagcuccagcuca

SEQ ID NO: 1647963 - RNA, 14 nt, Human
ccuugcauaauggu

SEQ ID NO: 1647964 - RNA, 18 nt, Human
ccuuucaauaggaaaaac

SEQ ID NO: 1647965 - RNA, 17 nt, Human
ccuuucaauaggaaaaa

SEQ ID NO: 1647966 - RNA, 14 nt, Human
ccuuuauucuggca

SEQ ID NO: 1647967 - RNA, 15 nt, Human
ccuuucaauaggaaa

SEQ ID NO: 1647968 - RNA, 21 nt, Human
ccuuccuaauuccacagcugc

SEQ ID NO: 1647969 - RNA, 14 nt, Human
ccuuccucuccacu

SEQ ID NO: 1647970 - RNA, 15 nt, Human
ccuuccucuccacug

SEQ ID NO: 1647971 - RNA, 16 nt, Human
ccuuccucuccacugc

SEQ ID NO: 1647972 - RNA, 17 nt, Human
ccuuccucuccacugcc

SEQ ID NO: 1647973 - RNA, 20 nt, Human
ccuucucuccagccccugga

SEQ ID NO: 1647974 - RNA, 20 nt, Human
ccuuccucuccacugccuuc

SEQ ID NO: 1647975 - RNA, 21 nt, Human
ccuucucuccagccccuggau

SEQ ID NO: 1647976 - RNA, 23 nt, Human
ccuucucuccagccccuggaugc

SEQ ID NO: 1647977 - RNA, 14 nt, Human
ccuucucugaagga

SEQ ID NO: 1647978 - RNA, 16 nt, Human
ccuucucugaaggaca

SEQ ID NO: 1647979 - RNA, 19 nt, Human
ccuuccuaauuccacagcu

SEQ ID NO: 1647980 - RNA, 20 nt, Human
ccuuccuaauuccacagcug

SEQ ID NO: 1647981 - RNA, 18 nt, Human
ccuuccuaauuccacagc

SEQ ID NO: 1647982 - RNA, 19 nt, Human
ccuucccccuccaauccca

SEQ ID NO: 1647983 - RNA, 22 nt, Human
ccuucuguccuacucuguguca

SEQ ID NO: 1647984 - RNA, 20 nt, Human
ccuucuguccuacucugugu

SEQ ID NO: 1647985 - RNA, 21 nt, Human
ccuucuguccuacucuguguc

SEQ ID NO: 1647986 - RNA, 17 nt, Human
ccuucucuucacaguca

SEQ ID NO: 1647987 - RNA, 21 nt, Human
cguucauggaacgcguugaaa

SEQ ID NO: 1647988 - RNA, 11 nt, Human
cuaaagcugcc

SEQ ID NO: 1647989 - RNA, 16 nt, Human
cgugaggccagagaca

SEQ ID NO: 1647990 - RNA, 19 nt, Human
cgugaguccuggcauggga

SEQ ID NO: 1647991 - RNA, 18 nt, Human
cgugaguccuggcauggg

SEQ ID NO: 1647992 - RNA, 15 nt, Human
cguguuaugacucca

SEQ ID NO: 1647993 - RNA, 19 nt, Human
cguguuaugacuccagaau

SEQ ID NO: 1647994 - RNA, 23 nt, Human
cuaaaguaaaaacaaagaaauua

SEQ ID NO: 1647995 - RNA, 19 nt, Human
cuaaaguguauuuuuuuac

SEQ ID NO: 1647996 - RNA, 14 nt, Human
cuaacuugucuuug

SEQ ID NO: 1647997 - RNA, 22 nt, Human
cuaacuugucuuuggacccuga

SEQ ID NO: 1647998 - RNA, 16 nt, Human
cuaacuuuccuucauu

SEQ ID NO: 1647999 - RNA, 22 nt, Human
cgugagccacugcaccgggcca

SEQ ID NO: 1648000 - RNA, 14 nt, Human
cgugaggccagaga

SEQ ID NO: 1648001 - RNA, 14 nt, Human
cgugagccacugca

SEQ ID NO: 1648002 - RNA, 15 nt, Human
cgugagccacugcac

SEQ ID NO: 1648003 - RNA, 20 nt, Human
cgugagccacugcaccgggc

SEQ ID NO: 1648004 - RNA, 14 nt, Human
cgugacaacacuug

SEQ ID NO: 1648005 - RNA, 15 nt, Human
cgugacaacacuugu

SEQ ID NO: 1648006 - RNA, 14 nt, Human
cuaaguuuuuaugg

SEQ ID NO: 1648007 - RNA, 20 nt, Human
cuaauaaaauuuaaaagucu

SEQ ID NO: 1648008 - RNA, 19 nt, Human
cuacaaaaagcauaaaaau

SEQ ID NO: 1648009 - RNA, 20 nt, Human
cuacaaaaacacagcaaggg

SEQ ID NO: 1648010 - RNA, 20 nt, Human
cgguggcucacgccuguaau

SEQ ID NO: 1648011 - RNA, 22 nt, Human
cguacacauuuuauuuuauuau

SEQ ID NO: 1648012 - RNA, 16 nt, Human
cgggccuggagaacua

SEQ ID NO: 1648013 - RNA, 20 nt, Human
cgggccuggagaacuagaga

SEQ ID NO: 1648014 - RNA, 19 nt, Human
cgggcucagcaaaagaugc

SEQ ID NO: 1648015 - RNA, 16 nt, Human
cgggcugggagcucug

SEQ ID NO: 1648016 - RNA, 20 nt, Human
cgggcugggagcucugcaga

SEQ ID NO: 1648017 - RNA, 12 nt, Human
cgggcucugccu

SEQ ID NO: 1648018 - RNA, 13 nt, Human
cgggcucugccuc

SEQ ID NO: 1648019 - RNA, 18 nt, Human
cgggccagugcuccagcc

SEQ ID NO: 1648020 - RNA, 14 nt, Human
cgggccagugcucc

SEQ ID NO: 1648021 - RNA, 14 nt, Human
cggcucacugcagc

SEQ ID NO: 1648022 - RNA, 20 nt, Human
cggagacggagucccaccuu

SEQ ID NO: 1648023 - RNA, 17 nt, Human
cggagacggagucccac

SEQ ID NO: 1648024 - RNA, 21 nt, Human
cggagucccaccuuggcugca

SEQ ID NO: 1648025 - RNA, 22 nt, Human
cggagucccaccuuggcugcag

SEQ ID NO: 1648026 - RNA, 15 nt, Human
cggaggggccuggca

SEQ ID NO: 1648027 - RNA, 23 nt, Human
cggagucccaccuuggcugcagg

SEQ ID NO: 1648028 - RNA, 18 nt, Human
cggcuaauuuuuguauuu

SEQ ID NO: 1648029 - RNA, 20 nt, Human
cgcucugucgcccaggcugg

SEQ ID NO: 1648030 - RNA, 21 nt, Human
cgcucuuggcagguacucagc

SEQ ID NO: 1648031 - RNA, 19 nt, Human
cgcugauaagcguucaugg

SEQ ID NO: 1648032 - RNA, 19 nt, Human
cgcugccccuggcagcccc

SEQ ID NO: 1648033 - RNA, 20 nt, Human
cgcugccccuggcagccccu

SEQ ID NO: 1648034 - RNA, 17 nt, Human
cgcuggagugcagugag

SEQ ID NO: 1648035 - RNA, 18 nt, Human
cgcuggagugcagugagc

SEQ ID NO: 1648036 - RNA, 17 nt, Human
cgagucucuucuccacu

SEQ ID NO: 1648037 - RNA, 18 nt, Human
cgagucucuucuccacug

SEQ ID NO: 1648038 - RNA, 20 nt, Human
cgagucucuucuccacugga

SEQ ID NO: 1648039 - RNA, 21 nt, Human
cgagucucuucuccacuggau

SEQ ID NO: 1648040 - RNA, 22 nt, Human
cgcaggcuggcccugcccuggu

SEQ ID NO: 1648041 - RNA, 20 nt, Human
ccuuuucgcaggauucuucc

SEQ ID NO: 1648042 - RNA, 12 nt, Human
ccuuuucccaac

SEQ ID NO: 1648043 - RNA, 23 nt, Human
ccgaaggugaggagcuugaaacc

SEQ ID NO: 1648044 - RNA, 16 nt, Human
ccgaauagcugggacu

SEQ ID NO: 1648045 - RNA, 17 nt, Human
ccgaauagcugggacua

SEQ ID NO: 1648046 - RNA, 15 nt, Human
ccgaccaccugccca

SEQ ID NO: 1648047 - RNA, 18 nt, Human
ccgaccagacaccuugac

SEQ ID NO: 1648048 - RNA, 13 nt, Human
ccgaccagacacc

SEQ ID NO: 1648049 - RNA, 17 nt, Human
ccgaccagacaccuuga

SEQ ID NO: 1648050 - RNA, 19 nt, Human
ccgaaagggacuuggaagc

SEQ ID NO: 1648051 - RNA, 16 nt, Human
ccgaaaacguggcugc

SEQ ID NO: 1648052 - RNA, 17 nt, Human
ccgaaaacguggcugcu

SEQ ID NO: 1648053 - RNA, 15 nt, Human
cccuuccucuuucca

SEQ ID NO: 1648054 - RNA, 12 nt, Human
ccgcccaggcuu

SEQ ID NO: 1648055 - RNA, 16 nt, Human
ccgcagacaggaccag

SEQ ID NO: 1648056 - RNA, 17 nt, Human
ccgcagacaggaccagg

SEQ ID NO: 1648057 - RNA, 13 nt, Human
cccugucuaauga

SEQ ID NO: 1648058 - RNA, 23 nt, Human
cccugugauggggcccugccucc

SEQ ID NO: 1648059 - RNA, 21 nt, Human
cccugugauggggcccugccu

SEQ ID NO: 1648060 - RNA, 22 nt, Human
cccugugauggggcccugccuc

SEQ ID NO: 1648061 - RNA, 16 nt, Human
ccggccaccugcggug

SEQ ID NO: 1648062 - RNA, 15 nt, Human
ccggccccugcuggu

SEQ ID NO: 1648063 - RNA, 21 nt, Human
ccuagcauacguacacauuuu

SEQ ID NO: 1648064 - RNA, 20 nt, Human
ccuagccugugccucuggga

SEQ ID NO: 1648065 - RNA, 20 nt, Human
ccuaaugcgcaggcuggccc

SEQ ID NO: 1648066 - RNA, 19 nt, Human
ccuagcauacguacacauu

SEQ ID NO: 1648067 - RNA, 16 nt, Human
ccuaaggacuucuuua

SEQ ID NO: 1648068 - RNA, 17 nt, Human
ccuaaggacuucuuuaa

SEQ ID NO: 1648069 - RNA, 18 nt, Human
ccuaaggacuucuuuaau

SEQ ID NO: 1648070 - RNA, 23 nt, Human
ccuaaggacuucuuuaauuuugg

SEQ ID NO: 1648071 - RNA, 11 nt, Human
ccuaaggacuu

SEQ ID NO: 1648072 - RNA, 12 nt, Human
ccuaaggacuuc

SEQ ID NO: 1648073 - RNA, 14 nt, Human
ccuaaucuucugaa

SEQ ID NO: 1648074 - RNA, 15 nt, Human
ccggcuccaggcucc

SEQ ID NO: 1648075 - RNA, 14 nt, Human
ccgucuaccugagg

SEQ ID NO: 1648076 - RNA, 15 nt, Human
ccgucuaccugaggg

SEQ ID NO: 1648077 - RNA, 13 nt, Human
ccggcuccaggcu

SEQ ID NO: 1648078 - RNA, 14 nt, Human
ccggcuccaggcuc

SEQ ID NO: 1648079 - RNA, 17 nt, Human
ccgucuaccugaggggc

SEQ ID NO: 1648080 - RNA, 12 nt, Human
ccgugaggccag

SEQ ID NO: 1648081 - RNA, 13 nt, Human
ccgugaggccaga

SEQ ID NO: 1648082 - RNA, 14 nt, Human
ccgugaggccagag

SEQ ID NO: 1648083 - RNA, 16 nt, Human
ccgugaggccagagac

SEQ ID NO: 1648084 - RNA, 20 nt, Human
ccuaacgaaguauccuucag

SEQ ID NO: 1648085 - RNA, 12 nt, Human
cccugaaggccc

SEQ ID NO: 1648086 - RNA, 13 nt, Human
cccugaaggcccc

SEQ ID NO: 1648087 - RNA, 14 nt, Human
cccugaaggccccg

SEQ ID NO: 1648088 - RNA, 16 nt, Human
cccugaaggccccgcc

SEQ ID NO: 1648089 - RNA, 19 nt, Human
cccugaaggccccgcccag

SEQ ID NO: 1648090 - RNA, 14 nt, Human
cccugacaacacuc

SEQ ID NO: 1648091 - RNA, 20 nt, Human
cccugaaggccccgcccagg

SEQ ID NO: 1648092 - RNA, 22 nt, Human
cccugaaggccccgcccaggcu

SEQ ID NO: 1648093 - RNA, 16 nt, Human
cccugacaacacucau

SEQ ID NO: 1648094 - RNA, 22 nt, Human
cccugacaacacucauugaccu

SEQ ID NO: 1648095 - RNA, 20 nt, Human
cccugaauuuaaauagcuuu

SEQ ID NO: 1648096 - RNA, 11 nt, Human
cccuccuccug

SEQ ID NO: 1648097 - RNA, 16 nt, Human
cccuccuccuggacuc

SEQ ID NO: 1648098 - RNA, 18 nt, Human
cccuccuccuggacuccu

SEQ ID NO: 1648099 - RNA, 14 nt, Human
cccuccucucugcc

SEQ ID NO: 1648100 - RNA, 18 nt, Human
cccugaaagcccugagcu

SEQ ID NO: 1648101 - RNA, 13 nt, Human
cccucggagaaga

SEQ ID NO: 1648102 - RNA, 20 nt, Human
cccuggcucccacaggcccu

SEQ ID NO: 1648103 - RNA, 11 nt, Human
cccugcccugg

SEQ ID NO: 1648104 - RNA, 12 nt, Human
cccugcccuggu

SEQ ID NO: 1648105 - RNA, 22 nt, Human
cccugcccugguuuccugcccu

SEQ ID NO: 1648106 - RNA, 23 nt, Human
cccugcccugguuuccugcccug

SEQ ID NO: 1648107 - RNA, 11 nt, Human
cccugcccugu

SEQ ID NO: 1648108 - RNA, 13 nt, Human
cccuggaugcagc

SEQ ID NO: 1648109 - RNA, 17 nt, Human
cccuggaugcagccuca

SEQ ID NO: 1648110 - RNA, 21 nt, Human
cccuggaugcagccucacagu

SEQ ID NO: 1648111 - RNA, 19 nt, Human
cccuggauccaucaggcca

SEQ ID NO: 1648112 - RNA, 22 nt, Human
cccugcccaccuggccucugca

SEQ ID NO: 1648113 - RNA, 20 nt, Human
cccugccccccagcccuccu

SEQ ID NO: 1648114 - RNA, 15 nt, Human
cccugccccccagcc

SEQ ID NO: 1648115 - RNA, 14 nt, Human
cccugccccccagc

SEQ ID NO: 1648116 - RNA, 18 nt, Human
cccugccccucccuucaa

SEQ ID NO: 1648117 - RNA, 19 nt, Human
cccugccccucccuucaac

SEQ ID NO: 1648118 - RNA, 23 nt, Human
cccugccccucccuucaaccauu

SEQ ID NO: 1648119 - RNA, 17 nt, Human
cccugccccucccuuca

SEQ ID NO: 1648120 - RNA, 14 nt, Human
cccugcccggcugc

SEQ ID NO: 1648121 - RNA, 17 nt, Human
cccugcccggcugcgga

SEQ ID NO: 1648122 - RNA, 20 nt, Human
cccugcccaccuggccucug

SEQ ID NO: 1648123 - RNA, 16 nt, Human
cccugagcuuucugcu

SEQ ID NO: 1648124 - RNA, 14 nt, Human
cccugagcaggauu

SEQ ID NO: 1648125 - RNA, 20 nt, Human
ccugccucucugcagguccc

SEQ ID NO: 1648126 - RNA, 21 nt, Human
ccugccucucugcaggucccu

SEQ ID NO: 1648127 - RNA, 15 nt, Human
ccugccucuucucua

SEQ ID NO: 1648128 - RNA, 22 nt, Human
ccugcugcaguugccagucacc

SEQ ID NO: 1648129 - RNA, 11 nt, Human
ccugcugcagu

SEQ ID NO: 1648130 - RNA, 12 nt, Human
ccugcugcaguu

SEQ ID NO: 1648131 - RNA, 16 nt, Human
ccugcugcaguugcca

SEQ ID NO: 1648132 - RNA, 17 nt, Human
ccugccucucugcaggu

SEQ ID NO: 1648133 - RNA, 23 nt, Human
ccugccuccuuugugaggaagcc

SEQ ID NO: 1648134 - RNA, 21 nt, Human
ccugccuccuuugugaggaag

SEQ ID NO: 1648135 - RNA, 22 nt, Human
ccugccuccuuugugaggaagc

SEQ ID NO: 1648136 - RNA, 13 nt, Human
ccugccuccuuug

SEQ ID NO: 1648137 - RNA, 15 nt, Human
ccugccuccuuugug

SEQ ID NO: 1648138 - RNA, 19 nt, Human
ccugccuccuuugugagga

SEQ ID NO: 1648139 - RNA, 20 nt, Human
ccugccuccuuugugaggaa

SEQ ID NO: 1648140 - RNA, 16 nt, Human
ccucuuugagugaagc

SEQ ID NO: 1648141 - RNA, 19 nt, Human
ccucuuuggucuacacugu

SEQ ID NO: 1648142 - RNA, 19 nt, Human
ccucugccugucuccccca

SEQ ID NO: 1648143 - RNA, 15 nt, Human
ccucugccugucucc

SEQ ID NO: 1648144 - RNA, 21 nt, Human
ccucugccugaagucacacag

SEQ ID NO: 1648145 - RNA, 12 nt, Human
ccugcagagggc

SEQ ID NO: 1648146 - RNA, 16 nt, Human
ccugcaggcagccagg

SEQ ID NO: 1648147 - RNA, 17 nt, Human
ccugcaggcagccaggc

SEQ ID NO: 1648148 - RNA, 14 nt, Human
ccugcagagggcac

SEQ ID NO: 1648149 - RNA, 23 nt, Human
ccugcaggcagccaggccacaag

SEQ ID NO: 1648150 - RNA, 18 nt, Human
ccugcaggcagccaggcc

SEQ ID NO: 1648151 - RNA, 19 nt, Human
ccugcaggcagccaggcca

SEQ ID NO: 1648152 - RNA, 20 nt, Human
ccugcaggcagccaggccac

SEQ ID NO: 1648153 - RNA, 21 nt, Human
ccugcaggcagccaggccaca

SEQ ID NO: 1648154 - RNA, 17 nt, Human
ccugaggcugggcuccc

SEQ ID NO: 1648155 - RNA, 19 nt, Human
ccugaggcugggcucccuu

SEQ ID NO: 1648156 - RNA, 21 nt, Human
ccugaggcugggcucccuucc

SEQ ID NO: 1648157 - RNA, 12 nt, Human
ccugaggggccu

SEQ ID NO: 1648158 - RNA, 16 nt, Human
ccugaggggccucuua

SEQ ID NO: 1648159 - RNA, 11 nt, Human
ccucaggcagg

SEQ ID NO: 1648160 - RNA, 17 nt, Human
ccucccaacucacccca

SEQ ID NO: 1648161 - RNA, 20 nt, Human
ccucccaacucaccccagcc

SEQ ID NO: 1648162 - RNA, 21 nt, Human
ccucccaacucaccccagccc

SEQ ID NO: 1648163 - RNA, 23 nt, Human
ccucccaacucaccccagcccca

SEQ ID NO: 1648164 - RNA, 18 nt, Human
ccucagccuccugaguag

SEQ ID NO: 1648165 - RNA, 18 nt, Human
ccuccuuugugaggaagc

SEQ ID NO: 1648166 - RNA, 19 nt, Human
ccuccuuugugaggaagcc

SEQ ID NO: 1648167 - RNA, 20 nt, Human
ccuccuuugugaggaagccg

SEQ ID NO: 1648168 - RNA, 16 nt, Human
ccucgaacuggcugca

SEQ ID NO: 1648169 - RNA, 15 nt, Human
ccucgaacuggcugc

SEQ ID NO: 1648170 - RNA, 13 nt, Human
ccuccgccucccg

SEQ ID NO: 1648171 - RNA, 16 nt, Human
ccuccgccucccgggu

SEQ ID NO: 1648172 - RNA, 13 nt, Human
ccuccgccucuug

SEQ ID NO: 1648173 - RNA, 16 nt, Human
ccucucugcagguccc

SEQ ID NO: 1648174 - RNA, 17 nt, Human
ccucucugcaggucccu

SEQ ID NO: 1648175 - RNA, 18 nt, Human
ccucucugcaggucccua

SEQ ID NO: 1648176 - RNA, 19 nt, Human
ccucucugcaggucccuaa

SEQ ID NO: 1648177 - RNA, 20 nt, Human
ccucucugcaggucccuaau

SEQ ID NO: 1648178 - RNA, 12 nt, Human
ccucucucacuc

SEQ ID NO: 1648179 - RNA, 11 nt, Human
ccucugcccug

SEQ ID NO: 1648180 - RNA, 12 nt, Human
ccucugcccugc

SEQ ID NO: 1648181 - RNA, 13 nt, Human
ccucugcccugcg

SEQ ID NO: 1648182 - RNA, 14 nt, Human
ccucugcccugcgg

SEQ ID NO: 1648183 - RNA, 20 nt, Human
ccucugccucugacacacag

SEQ ID NO: 1648184 - RNA, 21 nt, Human
ccucugccucugacacacagc

SEQ ID NO: 1648185 - RNA, 23 nt, Human
ccucugccucugacacacagcuc

SEQ ID NO: 1648186 - RNA, 11 nt, Human
ccucugccuga

SEQ ID NO: 1648187 - RNA, 20 nt, Human
ccucugccugaagucacaca

SEQ ID NO: 1648188 - RNA, 20 nt, Human
ccucuccugggcagcugccu

SEQ ID NO: 1648189 - RNA, 19 nt, Human
ccucuccugggcagcugcc

SEQ ID NO: 1648190 - RNA, 18 nt, Human
ccucuccugggcagcugc

SEQ ID NO: 1648191 - RNA, 17 nt, Human
ccucuccugggcagcug

SEQ ID NO: 1648192 - RNA, 16 nt, Human
ccucuccugggcagcu

SEQ ID NO: 1648193 - RNA, 15 nt, Human
ccucuccugggcagc

SEQ ID NO: 1648194 - RNA, 22 nt, Human
ccucuccugggcagcugccucc

SEQ ID NO: 1648195 - RNA, 21 nt, Human
ccucuccugggcagcugccuc

SEQ ID NO: 1648196 - RNA, 18 nt, Human
cccacuguacuugcucuu

SEQ ID NO: 1648197 - RNA, 19 nt, Human
cccacuguacuugcucuug

SEQ ID NO: 1648198 - RNA, 23 nt, Human
cccacuguacuugcucuugaugc

SEQ ID NO: 1648199 - RNA, 15 nt, Human
cccaccgcagacagg

SEQ ID NO: 1648200 - RNA, 18 nt, Human
cccaccgcagacaggacc

SEQ ID NO: 1648201 - RNA, 16 nt, Human
cccaagccuggcaagg

SEQ ID NO: 1648202 - RNA, 23 nt, Human
cccaagccuacuuuugccauuga

SEQ ID NO: 1648203 - RNA, 20 nt, Human
cccaagaauagaugcugacu

SEQ ID NO: 1648204 - RNA, 21 nt, Human
cccaagaauagaugcugacug

SEQ ID NO: 1648205 - RNA, 17 nt, Human
cccaagcucugcuccuc

SEQ ID NO: 1648206 - RNA, 18 nt, Human
cccacccaagggccuggc

SEQ ID NO: 1648207 - RNA, 15 nt, Human
cccacccaagggccu

SEQ ID NO: 1648208 - RNA, 22 nt, Human
ccauuguggucacaggaaguag

SEQ ID NO: 1648209 - RNA, 23 nt, Human
cccaaccugcucuccucuugcca

SEQ ID NO: 1648210 - RNA, 21 nt, Human
cccaaccugcucuccucuugc

SEQ ID NO: 1648211 - RNA, 13 nt, Human
cccaaccugcucu

SEQ ID NO: 1648212 - RNA, 14 nt, Human
cccaaccugcucuc

SEQ ID NO: 1648213 - RNA, 13 nt, Human
ccauuuaaagcuu

SEQ ID NO: 1648214 - RNA, 14 nt, Human
ccaugucucgacuc

SEQ ID NO: 1648215 - RNA, 15 nt, Human
ccaugucucgacuca

SEQ ID NO: 1648216 - RNA, 20 nt, Human
ccaugucucugagcauuaga

SEQ ID NO: 1648217 - RNA, 13 nt, Human
ccaugagccucag

SEQ ID NO: 1648218 - RNA, 16 nt, Human
ccaugaggaacaaggc

SEQ ID NO: 1648219 - RNA, 17 nt, Human
ccaugaggaacaaggca

SEQ ID NO: 1648220 - RNA, 18 nt, Human
ccaugaggaacaaggcaa

SEQ ID NO: 1648221 - RNA, 19 nt, Human
ccaugggauaaaugccauc

SEQ ID NO: 1648222 - RNA, 18 nt, Human
ccaugggcacugugggua

SEQ ID NO: 1648223 - RNA, 22 nt, Human
cccagcuggggccaggcugggu

SEQ ID NO: 1648224 - RNA, 23 nt, Human
cccagcuggggccaggcuggguc

SEQ ID NO: 1648225 - RNA, 18 nt, Human
cccaggcuggcgugcagu

SEQ ID NO: 1648226 - RNA, 21 nt, Human
cccaggcuggcgugcaguggu

SEQ ID NO: 1648227 - RNA, 19 nt, Human
cccaggcuggcgugcagug

SEQ ID NO: 1648228 - RNA, 20 nt, Human
cccaggcuggcgugcagugg

SEQ ID NO: 1648229 - RNA, 14 nt, Human
cccauccucuguac

SEQ ID NO: 1648230 - RNA, 20 nt, Human
cccauccucuguacagagcc

SEQ ID NO: 1648231 - RNA, 15 nt, Human
cccauccucuguaca

SEQ ID NO: 1648232 - RNA, 19 nt, Human
cccauccucuguacagagc

SEQ ID NO: 1648233 - RNA, 19 nt, Human
cccagcccacuucugccau

SEQ ID NO: 1648234 - RNA, 21 nt, Human
cccagccccaaaacucuccuc

SEQ ID NO: 1648235 - RNA, 23 nt, Human
cccagccccaaaacucuccucug

SEQ ID NO: 1648236 - RNA, 12 nt, Human
ccccagccccaa

SEQ ID NO: 1648237 - RNA, 21 nt, Human
ccccauucugccugcccaggc

SEQ ID NO: 1648238 - RNA, 14 nt, Human
ccccagccccaucc

SEQ ID NO: 1648239 - RNA, 14 nt, Human
ccccagccccaaaa

SEQ ID NO: 1648240 - RNA, 18 nt, Human
ccccaaaacucuccucug

SEQ ID NO: 1648241 - RNA, 20 nt, Human
ccccaaaacucuccucugcu

SEQ ID NO: 1648242 - RNA, 21 nt, Human
ccccaaaacucuccucugcug

SEQ ID NO: 1648243 - RNA, 14 nt, Human
ccccggccaccugc

SEQ ID NO: 1648244 - RNA, 18 nt, Human
ccccggccaccugcggug

SEQ ID NO: 1648245 - RNA, 13 nt, Human
ccccggccaccug

SEQ ID NO: 1648246 - RNA, 14 nt, Human
ccccgcccaggcuu

SEQ ID NO: 1648247 - RNA, 12 nt, Human
ccccgcccaggc

SEQ ID NO: 1648248 - RNA, 14 nt, Human
cccccuuccaugga

SEQ ID NO: 1648249 - RNA, 15 nt, Human
ccccauuguggucac

SEQ ID NO: 1648250 - RNA, 22 nt, Human
ccagcagaaaugccuuacccuc

SEQ ID NO: 1648251 - RNA, 17 nt, Human
ccagcagaaaugccuua

SEQ ID NO: 1648252 - RNA, 16 nt, Human
ccagcagaaaugccuu

SEQ ID NO: 1648253 - RNA, 11 nt, Human
ccagcagccug

SEQ ID NO: 1648254 - RNA, 12 nt, Human
ccagcagccugg

SEQ ID NO: 1648255 - RNA, 14 nt, Human
ccagcagccuggac

SEQ ID NO: 1648256 - RNA, 13 nt, Human
ccagcagccugga

SEQ ID NO: 1648257 - RNA, 23 nt, Human
ccagccccauccucuguacagag

SEQ ID NO: 1648258 - RNA, 13 nt, Human
ccagccccuggau

SEQ ID NO: 1648259 - RNA, 14 nt, Human
ccagccccuggaug

SEQ ID NO: 1648260 - RNA, 15 nt, Human
ccagccccuggaugc

SEQ ID NO: 1648261 - RNA, 18 nt, Human
ccagccccuucugaccca

SEQ ID NO: 1648262 - RNA, 21 nt, Human
ccagcgagcccugguggcagu

SEQ ID NO: 1648263 - RNA, 18 nt, Human
ccagccccuggaugcagc

SEQ ID NO: 1648264 - RNA, 15 nt, Human
ccagccccuucugac

SEQ ID NO: 1648265 - RNA, 16 nt, Human
ccagccccuucugacc

SEQ ID NO: 1648266 - RNA, 17 nt, Human
ccagccccuucugaccc

SEQ ID NO: 1648267 - RNA, 20 nt, Human
ccaggaaaggcuccaggagc

SEQ ID NO: 1648268 - RNA, 17 nt, Human
ccaggaaaggcuccagg

SEQ ID NO: 1648269 - RNA, 18 nt, Human
ccaggaaaggcuccagga

SEQ ID NO: 1648270 - RNA, 19 nt, Human
ccaggaaaggcuccaggag

SEQ ID NO: 1648271 - RNA, 19 nt, Human
ccagucaccccggccaccu

SEQ ID NO: 1648272 - RNA, 17 nt, Human
ccagucaccccggccac

SEQ ID NO: 1648273 - RNA, 18 nt, Human
ccagucaccccggccacc

SEQ ID NO: 1648274 - RNA, 14 nt, Human
ccaguauuguacaa

SEQ ID NO: 1648275 - RNA, 16 nt, Human
ccagucaccccggcca

SEQ ID NO: 1648276 - RNA, 19 nt, Human
ccaguaucuugaagacuuu

SEQ ID NO: 1648277 - RNA, 22 nt, Human
ccaguaucuugaagacuuuucu

SEQ ID NO: 1648278 - RNA, 20 nt, Human
ccaggggugggacacccugu

SEQ ID NO: 1648279 - RNA, 21 nt, Human
ccaggggugggacacccugug

SEQ ID NO: 1648280 - RNA, 22 nt, Human
ccaggggugggacacccuguga

SEQ ID NO: 1648281 - RNA, 23 nt, Human
ccaggggugggacacccugugau

SEQ ID NO: 1648282 - RNA, 17 nt, Human
ccaggcugagccucagu

SEQ ID NO: 1648283 - RNA, 19 nt, Human
ccaggcugagccucagucu

SEQ ID NO: 1648284 - RNA, 22 nt, Human
ccaggcugagccucagucuccc

SEQ ID NO: 1648285 - RNA, 14 nt, Human
ccaggcugagccuc

SEQ ID NO: 1648286 - RNA, 16 nt, Human
ccaggcugagccucag

SEQ ID NO: 1648287 - RNA, 13 nt, Human
ccaggcugagccu

SEQ ID NO: 1648288 - RNA, 15 nt, Human
ccaggggccaugaau

SEQ ID NO: 1648289 - RNA, 13 nt, Human
ccagagagggugg

SEQ ID NO: 1648290 - RNA, 13 nt, Human
ccagaugcaccag

SEQ ID NO: 1648291 - RNA, 14 nt, Human
ccagaugcaccagc

SEQ ID NO: 1648292 - RNA, 16 nt, Human
ccagagacacaagccu

SEQ ID NO: 1648293 - RNA, 18 nt, Human
ccagagacacaagccuuc

SEQ ID NO: 1648294 - RNA, 18 nt, Human
ccacugcacuccagccug

SEQ ID NO: 1648295 - RNA, 19 nt, Human
ccacugcacuauagccuag

SEQ ID NO: 1648296 - RNA, 20 nt, Human
ccacugcacuauagccuagg

SEQ ID NO: 1648297 - RNA, 13 nt, Human
ccacugcaccggg

SEQ ID NO: 1648298 - RNA, 14 nt, Human
ccacugcaccgggc

SEQ ID NO: 1648299 - RNA, 17 nt, Human
ccacugcaccgggccac

SEQ ID NO: 1648300 - RNA, 19 nt, Human
ccacugcaccgggccacag

SEQ ID NO: 1648301 - RNA, 12 nt, Human
ccacuuggucug

SEQ ID NO: 1648302 - RNA, 22 nt, Human
ccacuuuuguucuugguuugua

SEQ ID NO: 1648303 - RNA, 21 nt, Human
ccacuuuuguucuugguuugu

SEQ ID NO: 1648304 - RNA, 15 nt, Human
ccacuuuuguucuug

SEQ ID NO: 1648305 - RNA, 14 nt, Human
ccacuuuuguucuu

SEQ ID NO: 1648306 - RNA, 17 nt, Human
ccagacccggcugcgug

SEQ ID NO: 1648307 - RNA, 13 nt, Human
ccagacgaugucu

SEQ ID NO: 1648308 - RNA, 20 nt, Human
ccagacgaugucuucauacc

SEQ ID NO: 1648309 - RNA, 20 nt, Human
ccacuuucuagccagaggag

SEQ ID NO: 1648310 - RNA, 13 nt, Human
ccacuuucuagcc

SEQ ID NO: 1648311 - RNA, 18 nt, Human
ccacuuucuagccagagg

SEQ ID NO: 1648312 - RNA, 19 nt, Human
ccacuuucuagccagagga

SEQ ID NO: 1648313 - RNA, 20 nt, Human
ccacuuggucugugagaugc

SEQ ID NO: 1648314 - RNA, 22 nt, Human
ccacuuggucugugagaugcua

SEQ ID NO: 1648315 - RNA, 15 nt, Human
ccacuuggucuguga

SEQ ID NO: 1648316 - RNA, 16 nt, Human
ccacuuggucugugag

SEQ ID NO: 1648317 - RNA, 17 nt, Human
ccacuuggucugugaga

SEQ ID NO: 1648318 - RNA, 19 nt, Human
ccacuuggucugugagaug

SEQ ID NO: 1648319 - RNA, 19 nt, Human
cagauuugaacucuucaau

SEQ ID NO: 1648320 - RNA, 17 nt, Human
cagcaccaucucuccuc

SEQ ID NO: 1648321 - RNA, 19 nt, Human
cagcaccaucucuccuccu

SEQ ID NO: 1648322 - RNA, 13 nt, Human
cagauuuaugcau

SEQ ID NO: 1648323 - RNA, 13 nt, Human
cagauuucacucu

SEQ ID NO: 1648324 - RNA, 20 nt, Human
cagauuucacucuccuuggu

SEQ ID NO: 1648325 - RNA, 19 nt, Human
cagauugcaacaggcuggg

SEQ ID NO: 1648326 - RNA, 20 nt, Human
cagauugcaacaggcugggc

SEQ ID NO: 1648327 - RNA, 18 nt, Human
cagauugcaacaggcugg

SEQ ID NO: 1648328 - RNA, 18 nt, Human
cagcacgggggccaagga

SEQ ID NO: 1648329 - RNA, 15 nt, Human
cagcacgauuucugu

SEQ ID NO: 1648330 - RNA, 14 nt, Human
cagcacgauuucug

SEQ ID NO: 1648331 - RNA, 14 nt, Human
cagccagacuggca

SEQ ID NO: 1648332 - RNA, 23 nt, Human
cagccagcaguucagagcugccc

SEQ ID NO: 1648333 - RNA, 20 nt, Human
cagccagacuggcacaguuu

SEQ ID NO: 1648334 - RNA, 15 nt, Human
cagccagacuggcac

SEQ ID NO: 1648335 - RNA, 18 nt, Human
cagccagacuggcacagu

SEQ ID NO: 1648336 - RNA, 14 nt, Human
cagauccccaagcc

SEQ ID NO: 1648337 - RNA, 14 nt, Human
cagauaugauucaa

SEQ ID NO: 1648338 - RNA, 18 nt, Human
cagauacuggauuguacu

SEQ ID NO: 1648339 - RNA, 19 nt, Human
cagauagauauaugcucug

SEQ ID NO: 1648340 - RNA, 14 nt, Human
cagauacuggauug

SEQ ID NO: 1648341 - RNA, 17 nt, Human
cagaggggguggccucc

SEQ ID NO: 1648342 - RNA, 19 nt, Human
cagauacuuggggggcuga

SEQ ID NO: 1648343 - RNA, 14 nt, Human
cagaggggguggcc

SEQ ID NO: 1648344 - RNA, 16 nt, Human
cagaggggguggccuc

SEQ ID NO: 1648345 - RNA, 12 nt, Human
cagagagggugg

SEQ ID NO: 1648346 - RNA, 13 nt, Human
cagagaggguggg

SEQ ID NO: 1648347 - RNA, 17 nt, Human
cagagaggguggugacc

SEQ ID NO: 1648348 - RNA, 20 nt, Human
cagagaggguggugaccucu

SEQ ID NO: 1648349 - RNA, 22 nt, Human
cagagaggguggugaccucugc

SEQ ID NO: 1648350 - RNA, 16 nt, Human
cagagcugccaccugc

SEQ ID NO: 1648351 - RNA, 13 nt, Human
cagagcugccacc

SEQ ID NO: 1648352 - RNA, 20 nt, Human
cagagagguuaaggugggua

SEQ ID NO: 1648353 - RNA, 23 nt, Human
cagagaggguggugaccucugcc

SEQ ID NO: 1648354 - RNA, 20 nt, Human
cagaggaaagcaaaggagau

SEQ ID NO: 1648355 - RNA, 13 nt, Human
cagaggggguggc

SEQ ID NO: 1648356 - RNA, 17 nt, Human
cagaggaaagcaaagga

SEQ ID NO: 1648357 - RNA, 19 nt, Human
cagaggaaagcaaaggaga

SEQ ID NO: 1648358 - RNA, 21 nt, Human
cagagcugcccucuccugggc

SEQ ID NO: 1648359 - RNA, 20 nt, Human
cagagcugcccucuccuggg

SEQ ID NO: 1648360 - RNA, 19 nt, Human
cagagcugcccucuccugg

SEQ ID NO: 1648361 - RNA, 18 nt, Human
cagagcugcccucuccug

SEQ ID NO: 1648362 - RNA, 23 nt, Human
cagagcugcccucuccugggcag

SEQ ID NO: 1648363 - RNA, 14 nt, Human
cagacagcccucca

SEQ ID NO: 1648364 - RNA, 13 nt, Human
cagacagcugccu

SEQ ID NO: 1648365 - RNA, 14 nt, Human
cagacagcugccug

SEQ ID NO: 1648366 - RNA, 17 nt, Human
cagacagaucuggaaug

SEQ ID NO: 1648367 - RNA, 13 nt, Human
cagacaggaccag

SEQ ID NO: 1648368 - RNA, 15 nt, Human
cagacaggaccaggg

SEQ ID NO: 1648369 - RNA, 16 nt, Human
cagacaggaccaggga

SEQ ID NO: 1648370 - RNA, 15 nt, Human
cagacagcugccugg

SEQ ID NO: 1648371 - RNA, 16 nt, Human
cagacagcugccuggg

SEQ ID NO: 1648372 - RNA, 17 nt, Human
cagacagcugccuggga

SEQ ID NO: 1648373 - RNA, 18 nt, Human
cagacagcugccugggau

SEQ ID NO: 1648374 - RNA, 17 nt, Human
cagacaggaccagggau

SEQ ID NO: 1648375 - RNA, 24 nt, Human
cagacaggaccagggauuuccaug

SEQ ID NO: 1648376 - RNA, 11 nt, Human
cagacaggcaa

SEQ ID NO: 1648377 - RNA, 13 nt, Human
cagacaggcaagc

SEQ ID NO: 1648378 - RNA, 18 nt, Human
cagacaggcaagcaccuc

SEQ ID NO: 1648379 - RNA, 20 nt, Human
cagacaggcaagcaccuccu

SEQ ID NO: 1648380 - RNA, 21 nt, Human
cagacaggcaagcaccuccug

SEQ ID NO: 1648381 - RNA, 23 nt, Human
cagacucuacagaggccaugggc

SEQ ID NO: 1648382 - RNA, 18 nt, Human
cagacucuacagaggcca

SEQ ID NO: 1648383 - RNA, 19 nt, Human
cagacucuacagaggccau

SEQ ID NO: 1648384 - RNA, 20 nt, Human
cagacucuacagaggccaug

SEQ ID NO: 1648385 - RNA, 21 nt, Human
cagacucuacagaggccaugg

SEQ ID NO: 1648386 - RNA, 17 nt, Human
cagacucuacagaggcc

SEQ ID NO: 1648387 - RNA, 22 nt, Human
cagacaggcaagcaccuccugc

SEQ ID NO: 1648388 - RNA, 23 nt, Human
cagacaggcaagcaccuccugcc

SEQ ID NO: 1648389 - RNA, 13 nt, Human
cagacuggaagca

SEQ ID NO: 1648390 - RNA, 14 nt, Human
cagacuggaagcac

SEQ ID NO: 1648391 - RNA, 16 nt, Human
cagacuggaagcacag

SEQ ID NO: 1648392 - RNA, 17 nt, Human
cagacuggaagcacagc

SEQ ID NO: 1648393 - RNA, 18 nt, Human
cagacuggaagcacagcu

SEQ ID NO: 1648394 - RNA, 22 nt, Human
cagacuggcacaguuuucugag

SEQ ID NO: 1648395 - RNA, 23 nt, Human
cagacuggcacaguuuucugaga

SEQ ID NO: 1648396 - RNA, 20 nt, Human
cagacuggaagcacagcuuc

SEQ ID NO: 1648397 - RNA, 21 nt, Human
cagacuggaagcacagcuuca

SEQ ID NO: 1648398 - RNA, 17 nt, Human
cagacuggcacaguuuu

SEQ ID NO: 1648399 - RNA, 18 nt, Human
cagacuggcacaguuuuc

SEQ ID NO: 1648400 - RNA, 21 nt, Human
cagcggaaagcccugugcucc

SEQ ID NO: 1648401 - RNA, 15 nt, Human
cagcuaacauggaag

SEQ ID NO: 1648402 - RNA, 17 nt, Human
cagccugcuccagcugu

SEQ ID NO: 1648403 - RNA, 19 nt, Human
cagccugcuccagcuguuc

SEQ ID NO: 1648404 - RNA, 16 nt, Human
cagccugcuccagcug

SEQ ID NO: 1648405 - RNA, 20 nt, Human
cagcuguaugauucccagcc

SEQ ID NO: 1648406 - RNA, 14 nt, Human
cagcuuauugucua

SEQ ID NO: 1648407 - RNA, 20 nt, Human
cagcuuauugucuagugaaa

SEQ ID NO: 1648408 - RNA, 19 nt, Human
caggaaaggcuccaggagc

SEQ ID NO: 1648409 - RNA, 20 nt, Human
caggaaaggcuccaggagca

SEQ ID NO: 1648410 - RNA, 16 nt, Human
caggaaaggcuccagg

SEQ ID NO: 1648411 - RNA, 17 nt, Human
caggaaaggcuccagga

SEQ ID NO: 1648412 - RNA, 16 nt, Human
caggaaagagaacuuc

SEQ ID NO: 1648413 - RNA, 20 nt, Human
caggaaagagaacuuccaga

SEQ ID NO: 1648414 - RNA, 21 nt, Human
cagcugacuuuucuguccgag

SEQ ID NO: 1648415 - RNA, 20 nt, Human
cagcugccuccccuccucug

SEQ ID NO: 1648416 - RNA, 19 nt, Human
cagcugccuccccuccucu

SEQ ID NO: 1648417 - RNA, 18 nt, Human
cagcugccuccccuccuc

SEQ ID NO: 1648418 - RNA, 17 nt, Human
cagcugccuccccuccu

SEQ ID NO: 1648419 - RNA, 16 nt, Human
cagcugccuccccucc

SEQ ID NO: 1648420 - RNA, 15 nt, Human
cagcugccuccccuc

SEQ ID NO: 1648421 - RNA, 14 nt, Human
cagcugccuccccu

SEQ ID NO: 1648422 - RNA, 9 nt, Human
cagcugccu

SEQ ID NO: 1648423 - RNA, 11 nt, Human
cagcugccucc

SEQ ID NO: 1648424 - RNA, 19 nt, Human
cagcugagggugagugggu

SEQ ID NO: 1648425 - RNA, 10 nt, Human
cagcugccuc

SEQ ID NO: 1648426 - RNA, 11 nt, Human
caggccaggcc

SEQ ID NO: 1648427 - RNA, 12 nt, Human
caggccaggccc

SEQ ID NO: 1648428 - RNA, 16 nt, Human
caggaccucaggugag

SEQ ID NO: 1648429 - RNA, 23 nt, Human
caggaccucaggugagaagcaga

SEQ ID NO: 1648430 - RNA, 15 nt, Human
caggcaaugcuggcu

SEQ ID NO: 1648431 - RNA, 16 nt, Human
caggcaaugcuggcug

SEQ ID NO: 1648432 - RNA, 17 nt, Human
caggcaaugcuggcugu

SEQ ID NO: 1648433 - RNA, 22 nt, Human
caggaggccagccuugaccauu

SEQ ID NO: 1648434 - RNA, 18 nt, Human
caggaggccagccuugac

SEQ ID NO: 1648435 - RNA, 19 nt, Human
caggaggccagccuugacc

SEQ ID NO: 1648436 - RNA, 19 nt, Human
caggaggaucacuugaguc

SEQ ID NO: 1648437 - RNA, 22 nt, Human
caggcugggagagccuuccagg

SEQ ID NO: 1648438 - RNA, 23 nt, Human
caggcugggagagccuuccaggg

SEQ ID NO: 1648439 - RNA, 17 nt, Human
caggggaaaaucagccu

SEQ ID NO: 1648440 - RNA, 14 nt, Human
caggggaaaagagg

SEQ ID NO: 1648441 - RNA, 16 nt, Human
caggggaaaagaggag

SEQ ID NO: 1648442 - RNA, 12 nt, Human
caggccuccuac

SEQ ID NO: 1648443 - RNA, 14 nt, Human
caggccuccuacag

SEQ ID NO: 1648444 - RNA, 21 nt, Human
caggcgugagccaccgugccu

SEQ ID NO: 1648445 - RNA, 21 nt, Human
caggcugggagagccuuccag

SEQ ID NO: 1648446 - RNA, 11 nt, Human
caggcuacugu

SEQ ID NO: 1648447 - RNA, 21 nt, Human
caugaauauuuaguguucaua

SEQ ID NO: 1648448 - RNA, 16 nt, Human
caugaauuugugaagg

SEQ ID NO: 1648449 - RNA, 13 nt, Human
caugacaaagacu

SEQ ID NO: 1648450 - RNA, 15 nt, Human
caugaugcgggccag

SEQ ID NO: 1648451 - RNA, 20 nt, Human
caugaugcgggccagugcuc

SEQ ID NO: 1648452 - RNA, 14 nt, Human
caugaugcgggcca

SEQ ID NO: 1648453 - RNA, 15 nt, Human
caugcaaggucauuu

SEQ ID NO: 1648454 - RNA, 12 nt, Human
caugcaagguca

SEQ ID NO: 1648455 - RNA, 15 nt, Human
cauggccagguggcc

SEQ ID NO: 1648456 - RNA, 20 nt, Human
caugcuccuggcccacugca

SEQ ID NO: 1648457 - RNA, 17 nt, Human
caugcuccuggcccacu

SEQ ID NO: 1648458 - RNA, 14 nt, Human
caugcuccuggccc

SEQ ID NO: 1648459 - RNA, 16 nt, Human
caugcuccuggcccac

SEQ ID NO: 1648460 - RNA, 22 nt, Human
cauggccucuucagaucucuaa

SEQ ID NO: 1648461 - RNA, 14 nt, Human
cauggccgugaacu

SEQ ID NO: 1648462 - RNA, 21 nt, Human
cauggccucuucagaucucua

SEQ ID NO: 1648463 - RNA, 20 nt, Human
caugggaaaugucaacaagu

SEQ ID NO: 1648464 - RNA, 18 nt, Human
caugggaaaggggaaguu

SEQ ID NO: 1648465 - RNA, 21 nt, Human
cauguuacauaagauaaaugu

SEQ ID NO: 1648466 - RNA, 16 nt, Human
cauguucuuaauucuu

SEQ ID NO: 1648467 - RNA, 13 nt, Human
cauguucuuaauu

SEQ ID NO: 1648468 - RNA, 15 nt, Human
cauguccaagaagcc

SEQ ID NO: 1648469 - RNA, 16 nt, Human
cauguccaagaagccc

SEQ ID NO: 1648470 - RNA, 16 nt, Human
cauguuacauaagaua

SEQ ID NO: 1648471 - RNA, 17 nt, Human
cauguuacauaagauaa

SEQ ID NO: 1648472 - RNA, 18 nt, Human
cauguucuuaauucuuag

SEQ ID NO: 1648473 - RNA, 18 nt, Human
cauguuggccaggcuggu

SEQ ID NO: 1648474 - RNA, 17 nt, Human
cauguuggccaggcugg

SEQ ID NO: 1648475 - RNA, 19 nt, Human
cauuauauuuauuacugua

SEQ ID NO: 1648476 - RNA, 19 nt, Human
cauguuggccaggcugguc

SEQ ID NO: 1648477 - RNA, 20 nt, Human
cauguuggccaggcugcucu

SEQ ID NO: 1648478 - RNA, 15 nt, Human
cauuauucaaaguug

SEQ ID NO: 1648479 - RNA, 16 nt, Human
cauuauucaaaguugc

SEQ ID NO: 1648480 - RNA, 20 nt, Human
cauucuccuuguguuacuaa

SEQ ID NO: 1648481 - RNA, 14 nt, Human
cauuauucaaaguu

SEQ ID NO: 1648482 - RNA, 17 nt, Human
cauucuccaccugccag

SEQ ID NO: 1648483 - RNA, 18 nt, Human
cauucuccaccugccagg

SEQ ID NO: 1648484 - RNA, 19 nt, Human
cauucuccaccugccaggg

SEQ ID NO: 1648485 - RNA, 21 nt, Human
cauucuccaccugccagggac

SEQ ID NO: 1648486 - RNA, 16 nt, Human
cauuggagauguuuag

SEQ ID NO: 1648487 - RNA, 18 nt, Human
cauuuaggugaggaagca

SEQ ID NO: 1648488 - RNA, 14 nt, Human
cauugguucuugua

SEQ ID NO: 1648489 - RNA, 15 nt, Human
cauugguucuuguau

SEQ ID NO: 1648490 - RNA, 17 nt, Human
cauugguguuguacuca

SEQ ID NO: 1648491 - RNA, 16 nt, Human
cauuuaggugaggaag

SEQ ID NO: 1648492 - RNA, 17 nt, Human
ccaaaaaaugcuugcuu

SEQ ID NO: 1648493 - RNA, 14 nt, Human
ccaaaaggcagaag

SEQ ID NO: 1648494 - RNA, 21 nt, Human
cauuuggugguuucagaaaug

SEQ ID NO: 1648495 - RNA, 23 nt, Human
cauuuuuuuuaagaaaaaggaug

SEQ ID NO: 1648496 - RNA, 17 nt, Human
cauuuguauaaaauaau

SEQ ID NO: 1648497 - RNA, 14 nt, Human
cauuuguauaaaau

SEQ ID NO: 1648498 - RNA, 16 nt, Human
cauuuguauaaaauaa

SEQ ID NO: 1648499 - RNA, 14 nt, Human
ccaaagugcuggga

SEQ ID NO: 1648500 - RNA, 22 nt, Human
ccaaaguacacuguuucaaacu

SEQ ID NO: 1648501 - RNA, 14 nt, Human
ccaacuauggccug

SEQ ID NO: 1648502 - RNA, 15 nt, Human
ccaacuauggccugu

SEQ ID NO: 1648503 - RNA, 16 nt, Human
ccaacuauggccugug

SEQ ID NO: 1648504 - RNA, 13 nt, Human
ccaacucacccca

SEQ ID NO: 1648505 - RNA, 15 nt, Human
ccaaaucagcugcua

SEQ ID NO: 1648506 - RNA, 23 nt, Human
ccaaaucagcugcuacuacuccu

SEQ ID NO: 1648507 - RNA, 16 nt, Human
ccaaaucauaguggcu

SEQ ID NO: 1648508 - RNA, 17 nt, Human
ccaagcucugcuccucu

SEQ ID NO: 1648509 - RNA, 16 nt, Human
ccaagcucugcuccuc

SEQ ID NO: 1648510 - RNA, 14 nt, Human
ccaagcucugcucc

SEQ ID NO: 1648511 - RNA, 15 nt, Human
ccaagcucugcuccu

SEQ ID NO: 1648512 - RNA, 21 nt, Human
ccaacucaccccagccccaaa

SEQ ID NO: 1648513 - RNA, 21 nt, Human
ccaacuccagaaagugacaag

SEQ ID NO: 1648514 - RNA, 21 nt, Human
ccaauggagacugucucaaga

SEQ ID NO: 1648515 - RNA, 23 nt, Human
ccaauggacuaacuugucuuugg

SEQ ID NO: 1648516 - RNA, 14 nt, Human
ccaaugggagcuca

SEQ ID NO: 1648517 - RNA, 22 nt, Human
caguucagagcugcccucuccu

SEQ ID NO: 1648518 - RNA, 21 nt, Human
caguucagagcugcccucucc

SEQ ID NO: 1648519 - RNA, 19 nt, Human
caguucagagcugcccucu

SEQ ID NO: 1648520 - RNA, 18 nt, Human
caguucagagcugcccuc

SEQ ID NO: 1648521 - RNA, 24 nt, Human
caguucagagcugcccucuccugg

SEQ ID NO: 1648522 - RNA, 23 nt, Human
caguucagagcugcccucuccug

SEQ ID NO: 1648523 - RNA, 17 nt, Human
caguucagagcugcccu

SEQ ID NO: 1648524 - RNA, 16 nt, Human
caguucagagcugccc

SEQ ID NO: 1648525 - RNA, 15 nt, Human
caguucagagcugcc

SEQ ID NO: 1648526 - RNA, 22 nt, Human
caguuauuauauuuacaaaugg

SEQ ID NO: 1648527 - RNA, 21 nt, Human
cagucugauucccaagcucug

SEQ ID NO: 1648528 - RNA, 22 nt, Human
cagucugauucccaagcucugc

SEQ ID NO: 1648529 - RNA, 20 nt, Human
caguuacucagaauucucua

SEQ ID NO: 1648530 - RNA, 21 nt, Human
cagugguaugaucacggcuca

SEQ ID NO: 1648531 - RNA, 19 nt, Human
caguggugcgaucuggguu

SEQ ID NO: 1648532 - RNA, 20 nt, Human
caguggugcgaucuggguuc

SEQ ID NO: 1648533 - RNA, 21 nt, Human
caguuauuauauuuacaaaug

SEQ ID NO: 1648534 - RNA, 17 nt, Human
caguuauuauauuuaca

SEQ ID NO: 1648535 - RNA, 13 nt, Human
caguuauggcuau

SEQ ID NO: 1648536 - RNA, 19 nt, Human
caguuauggcuauaggugc

SEQ ID NO: 1648537 - RNA, 20 nt, Human
caguuauggcuauaggugcu

SEQ ID NO: 1648538 - RNA, 20 nt, Human
cagugguaugaucacggcuc

SEQ ID NO: 1648539 - RNA, 16 nt, Human
cagugggagcugccug

SEQ ID NO: 1648540 - RNA, 17 nt, Human
cagugggagcugccugu

SEQ ID NO: 1648541 - RNA, 18 nt, Human
cagugggagcugccuguu

SEQ ID NO: 1648542 - RNA, 21 nt, Human
cagugcccacaggaucagucu

SEQ ID NO: 1648543 - RNA, 22 nt, Human
cagugcccacaggaucagucug

SEQ ID NO: 1648544 - RNA, 23 nt, Human
cagucugauucccaagcucugcu

SEQ ID NO: 1648545 - RNA, 22 nt, Human
cagugauuaccagggacugagg

SEQ ID NO: 1648546 - RNA, 15 nt, Human
caucuaaacugcccc

SEQ ID NO: 1648547 - RNA, 21 nt, Human
caucuaaacugcccccucugc

SEQ ID NO: 1648548 - RNA, 18 nt, Human
cauccugaggcuccacuu

SEQ ID NO: 1648549 - RNA, 19 nt, Human
cauccugaggcuccacuug

SEQ ID NO: 1648550 - RNA, 20 nt, Human
caucccaaacccuucagugc

SEQ ID NO: 1648551 - RNA, 11 nt, Human
caucccagccc

SEQ ID NO: 1648552 - RNA, 12 nt, Human
caucccagcccc

SEQ ID NO: 1648553 - RNA, 22 nt, Human
cauccucuguacagagcccacg

SEQ ID NO: 1648554 - RNA, 21 nt, Human
caucagcacgauuucuguuua

SEQ ID NO: 1648555 - RNA, 19 nt, Human
caucccaaacccuucagug

SEQ ID NO: 1648556 - RNA, 13 nt, Human
caucagcugcuga

SEQ ID NO: 1648557 - RNA, 23 nt, Human
caguuuguuaguaugaggcauuu

SEQ ID NO: 1648558 - RNA, 22 nt, Human
caguuguuagugugucuuagug

SEQ ID NO: 1648559 - RNA, 18 nt, Human
cauaauuauuauuuggcc

SEQ ID NO: 1648560 - RNA, 23 nt, Human
cauacaggaagguagaaauaucu

SEQ ID NO: 1648561 - RNA, 16 nt, Human
cauacaguuugcacuu

SEQ ID NO: 1648562 - RNA, 23 nt, Human
cauaaugcgugcauaccacuuuu

SEQ ID NO: 1648563 - RNA, 21 nt, Human
cauauuauuuuauguugcaua

SEQ ID NO: 1648564 - RNA, 16 nt, Human
cauagguuuaauaauu

SEQ ID NO: 1648565 - RNA, 16 nt, Human
cauaggugaucucauu

SEQ ID NO: 1648566 - RNA, 20 nt, Human
cauagcagcuuauucacaag

SEQ ID NO: 1648567 - RNA, 23 nt, Human
cauagcagagaaugaaagggccc

SEQ ID NO: 1648568 - RNA, 19 nt, Human
cauagcagcuuauucacaa

SEQ ID NO: 1648569 - RNA, 15 nt, Human
auuaauggaaauguu

SEQ ID NO: 1648570 - RNA, 17 nt, Human
auuacaggcuccugcca

SEQ ID NO: 1648571 - RNA, 19 nt, Human
auuacaggcuccugccacc

SEQ ID NO: 1648572 - RNA, 13 nt, Human
auuacagguguga

SEQ ID NO: 1648573 - RNA, 15 nt, Human
auuacaggcuccugc

SEQ ID NO: 1648574 - RNA, 16 nt, Human
auuacaggcuccugcc

SEQ ID NO: 1648575 - RNA, 21 nt, Human
auuaacaugaauauuuagugu

SEQ ID NO: 1648576 - RNA, 14 nt, Human
auucauauuuacuu

SEQ ID NO: 1648577 - RNA, 13 nt, Human
auuaugugccaga

SEQ ID NO: 1648578 - RNA, 21 nt, Human
auuaugugccagauuuaugca

SEQ ID NO: 1648579 - RNA, 23 nt, Human
auuaugugccagauuuaugcaua

SEQ ID NO: 1648580 - RNA, 15 nt, Human
auuauguaaauccca

SEQ ID NO: 1648581 - RNA, 17 nt, Human
auuauguaaaucccauu

SEQ ID NO: 1648582 - RNA, 22 nt, Human
auuauguaaaucccauuauuca

SEQ ID NO: 1648583 - RNA, 23 nt, Human
auuauguaaaucccauuauucaa

SEQ ID NO: 1648584 - RNA, 13 nt, Human
auuauguaaaucc

SEQ ID NO: 1648585 - RNA, 14 nt, Human
auuauguaaauccc

SEQ ID NO: 1648586 - RNA, 16 nt, Human
auuacaggugugaacc

SEQ ID NO: 1648587 - RNA, 23 nt, Human
auucucuaguuugauuaaauucu

SEQ ID NO: 1648588 - RNA, 12 nt, Human
auucucuuaucc

SEQ ID NO: 1648589 - RNA, 14 nt, Human
auucucuuauccaa

SEQ ID NO: 1648590 - RNA, 20 nt, Human
auucucuaguuugauuaaau

SEQ ID NO: 1648591 - RNA, 16 nt, Human
auucucuccuguaccu

SEQ ID NO: 1648592 - RNA, 15 nt, Human
auucucuuauccaac

SEQ ID NO: 1648593 - RNA, 22 nt, Human
auugaggacacugauauggguc

SEQ ID NO: 1648594 - RNA, 14 nt, Human
caaaccaucauuga

SEQ ID NO: 1648595 - RNA, 16 nt, Human
caaaccaucauugaaa

SEQ ID NO: 1648596 - RNA, 17 nt, Human
caaaccaucauugaaau

SEQ ID NO: 1648597 - RNA, 15 nt, Human
auuuuuuucugaauu

SEQ ID NO: 1648598 - RNA, 16 nt, Human
auuuuuuucugaaauu

SEQ ID NO: 1648599 - RNA, 17 nt, Human
auuuuuuucugaaauuu

SEQ ID NO: 1648600 - RNA, 16 nt, Human
auuuuuauuaaauuau

SEQ ID NO: 1648601 - RNA, 22 nt, Human
auuuuguuuuugucuuaaaaag

SEQ ID NO: 1648602 - RNA, 19 nt, Human
auuuuuauauuugaaauau

SEQ ID NO: 1648603 - RNA, 20 nt, Human
caaaagguuaauaaaguaau

SEQ ID NO: 1648604 - RNA, 13 nt, Human
caaaagcauguga

SEQ ID NO: 1648605 - RNA, 19 nt, Human
caaaagcaucuaugugaga

SEQ ID NO: 1648606 - RNA, 21 nt, Human
caaaagguauuuuaaucacca

SEQ ID NO: 1648607 - RNA, 20 nt, Human
auuuuuuuucuguuauauaa

SEQ ID NO: 1648608 - RNA, 18 nt, Human
auuuuuuuucuguuauau

SEQ ID NO: 1648609 - RNA, 19 nt, Human
auuuuuuuucuguuauaua

SEQ ID NO: 1648610 - RNA, 15 nt, Human
auuuuuuuucuguua

SEQ ID NO: 1648611 - RNA, 17 nt, Human
auuuuuuuucuguuaua

SEQ ID NO: 1648612 - RNA, 19 nt, Human
auuuguucuauagcuuuuc

SEQ ID NO: 1648613 - RNA, 14 nt, Human
auuuguguugaaga

SEQ ID NO: 1648614 - RNA, 15 nt, Human
auuuguguugaagag

SEQ ID NO: 1648615 - RNA, 18 nt, Human
auuuguguugaagagguu

SEQ ID NO: 1648616 - RNA, 22 nt, Human
auuuguguugaagagguuuuaa

SEQ ID NO: 1648617 - RNA, 14 nt, Human
auuuguuauaauga

SEQ ID NO: 1648618 - RNA, 13 nt, Human
auuuugaaaaacu

SEQ ID NO: 1648619 - RNA, 15 nt, Human
auuuugaaaaacugc

SEQ ID NO: 1648620 - RNA, 19 nt, Human
auuuucuauaauuuaaaua

SEQ ID NO: 1648621 - RNA, 18 nt, Human
auuuucuauaauuuaaau

SEQ ID NO: 1648622 - RNA, 17 nt, Human
auuuucuauaauuuaaa

SEQ ID NO: 1648623 - RNA, 21 nt, Human
auuucuguuuagauaauacac

SEQ ID NO: 1648624 - RNA, 19 nt, Human
auuucuguuuagauaauac

SEQ ID NO: 1648625 - RNA, 20 nt, Human
auuucuguuuagauaauaca

SEQ ID NO: 1648626 - RNA, 15 nt, Human
auuuaauaauuauau

SEQ ID NO: 1648627 - RNA, 18 nt, Human
auuuaauaauuauaugcu

SEQ ID NO: 1648628 - RNA, 22 nt, Human
auuuaauagguuuggacaaaau

SEQ ID NO: 1648629 - RNA, 13 nt, Human
auuuaauaauuau

SEQ ID NO: 1648630 - RNA, 12 nt, Human
auuucacucucc

SEQ ID NO: 1648631 - RNA, 14 nt, Human
auuucacucuccuu

SEQ ID NO: 1648632 - RNA, 13 nt, Human
caccugccaggga

SEQ ID NO: 1648633 - RNA, 18 nt, Human
caccugccccucaacucu

SEQ ID NO: 1648634 - RNA, 21 nt, Human
caccugccccucaacucuccu

SEQ ID NO: 1648635 - RNA, 11 nt, Human
caccugccagg

SEQ ID NO: 1648636 - RNA, 12 nt, Human
caccugccaggg

SEQ ID NO: 1648637 - RNA, 12 nt, Human
cacccugcucuc

SEQ ID NO: 1648638 - RNA, 12 nt, Human
cacccuccuuuc

SEQ ID NO: 1648639 - RNA, 16 nt, Human
caccugcggugcuauc

SEQ ID NO: 1648640 - RNA, 17 nt, Human
caccugcggugcuaucu

SEQ ID NO: 1648641 - RNA, 19 nt, Human
caccugcggugcuaucucc

SEQ ID NO: 1648642 - RNA, 20 nt, Human
caccugcggugcuaucuccc

SEQ ID NO: 1648643 - RNA, 21 nt, Human
cacgcuggagugcagugagcc

SEQ ID NO: 1648644 - RNA, 16 nt, Human
cacgcuggagugcagu

SEQ ID NO: 1648645 - RNA, 17 nt, Human
cacgcuggagugcagug

SEQ ID NO: 1648646 - RNA, 18 nt, Human
cacgcuggagugcaguga

SEQ ID NO: 1648647 - RNA, 20 nt, Human
cacgcuggagugcagugagc

SEQ ID NO: 1648648 - RNA, 15 nt, Human
cacgcuggagugcag

SEQ ID NO: 1648649 - RNA, 14 nt, Human
cacuccagaccccu

SEQ ID NO: 1648650 - RNA, 16 nt, Human
cacuccagaccccugg

SEQ ID NO: 1648651 - RNA, 22 nt, Human
cacuccaauuaaggauuuuaug

SEQ ID NO: 1648652 - RNA, 16 nt, Human
cacuagacccacugga

SEQ ID NO: 1648653 - RNA, 15 nt, Human
cacuacauucuguua

SEQ ID NO: 1648654 - RNA, 16 nt, Human
cacggaagagccuugc

SEQ ID NO: 1648655 - RNA, 22 nt, Human
cacggaagagccuugcggaagg

SEQ ID NO: 1648656 - RNA, 14 nt, Human
cacuacauucuguu

SEQ ID NO: 1648657 - RNA, 13 nt, Human
cacuacauucugu

SEQ ID NO: 1648658 - RNA, 23 nt, Human
cacugaagaagcaccaaucauga

SEQ ID NO: 1648659 - RNA, 17 nt, Human
cacuccagaccccuggc

SEQ ID NO: 1648660 - RNA, 21 nt, Human
cacuccagugagacagcucug

SEQ ID NO: 1648661 - RNA, 23 nt, Human
cacaucuugcucugcugacagac

SEQ ID NO: 1648662 - RNA, 16 nt, Human
cacaucuugcucugcu

SEQ ID NO: 1648663 - RNA, 17 nt, Human
cacauuuauucugcuca

SEQ ID NO: 1648664 - RNA, 18 nt, Human
cacauuuauucugcucac

SEQ ID NO: 1648665 - RNA, 17 nt, Human
caccagccccagugccc

SEQ ID NO: 1648666 - RNA, 21 nt, Human
caccagcccuuagcagggaaa

SEQ ID NO: 1648667 - RNA, 19 nt, Human
caccagcccuuagcaggga

SEQ ID NO: 1648668 - RNA, 18 nt, Human
caccagccccagugccca

SEQ ID NO: 1648669 - RNA, 21 nt, Human
caccagccccagugcccacag

SEQ ID NO: 1648670 - RNA, 22 nt, Human
caccagccccagugcccacagg

SEQ ID NO: 1648671 - RNA, 16 nt, Human
cacccagcccacuucu

SEQ ID NO: 1648672 - RNA, 12 nt, Human
cacccagcccac

SEQ ID NO: 1648673 - RNA, 13 nt, Human
cacaucuugcucu

SEQ ID NO: 1648674 - RNA, 14 nt, Human
cacaucuugcucug

SEQ ID NO: 1648675 - RNA, 15 nt, Human
cacaucuugcucugc

SEQ ID NO: 1648676 - RNA, 20 nt, Human
cacaucuugcucugcugaca

SEQ ID NO: 1648677 - RNA, 21 nt, Human
cacaucuugcucugcugacag

SEQ ID NO: 1648678 - RNA, 22 nt, Human
cacaucuugcucugcugacaga

SEQ ID NO: 1648679 - RNA, 23 nt, Human
cacaucagcuugcccuguuaaaa

SEQ ID NO: 1648680 - RNA, 13 nt, Human
cacaucagcuugc

SEQ ID NO: 1648681 - RNA, 20 nt, Human
caaguuauuuuuaauuuggu

SEQ ID NO: 1648682 - RNA, 22 nt, Human
caaguauuauaccuuuuuuaga

SEQ ID NO: 1648683 - RNA, 17 nt, Human
caaguauuauaccuuuu

SEQ ID NO: 1648684 - RNA, 13 nt, Human
caagcugcacccu

SEQ ID NO: 1648685 - RNA, 20 nt, Human
caaggauugcuacuguccua

SEQ ID NO: 1648686 - RNA, 14 nt, Human
caaggcaaggcugu

SEQ ID NO: 1648687 - RNA, 16 nt, Human
caaggcaaggcuguca

SEQ ID NO: 1648688 - RNA, 15 nt, Human
caagcucugcuccuc

SEQ ID NO: 1648689 - RNA, 16 nt, Human
caagcucugcuccucu

SEQ ID NO: 1648690 - RNA, 12 nt, Human
caagcucccagg

SEQ ID NO: 1648691 - RNA, 14 nt, Human
caagcucccaggca

SEQ ID NO: 1648692 - RNA, 15 nt, Human
caagcucccaggcau

SEQ ID NO: 1648693 - RNA, 17 nt, Human
caagcucccaggcauuc

SEQ ID NO: 1648694 - RNA, 21 nt, Human
caagcuccaucuccacuccag

SEQ ID NO: 1648695 - RNA, 17 nt, Human
caagcuccaucuccacu

SEQ ID NO: 1648696 - RNA, 19 nt, Human
caagcuccaagcucccagg

SEQ ID NO: 1648697 - RNA, 21 nt, Human
caagcuccaagcucccaggca

SEQ ID NO: 1648698 - RNA, 18 nt, Human
caagcuccaagcucccag

SEQ ID NO: 1648699 - RNA, 20 nt, Human
caauuuauuauggcacauca

SEQ ID NO: 1648700 - RNA, 12 nt, Human
caaugcuggcug

SEQ ID NO: 1648701 - RNA, 16 nt, Human
caauggcagccuuggc

SEQ ID NO: 1648702 - RNA, 13 nt, Human
caauggcagccuu

SEQ ID NO: 1648703 - RNA, 14 nt, Human
caauggcagccuug

SEQ ID NO: 1648704 - RNA, 15 nt, Human
caauggcagccuugg

SEQ ID NO: 1648705 - RNA, 14 nt, Human
caaucaaaucugcu

SEQ ID NO: 1648706 - RNA, 17 nt, Human
caaucagccuaguugau

SEQ ID NO: 1648707 - RNA, 18 nt, Human
caagcaccuagccucgcu

SEQ ID NO: 1648708 - RNA, 14 nt, Human
caagcaccuccugc

SEQ ID NO: 1648709 - RNA, 13 nt, Human
caagcaccuccug

SEQ ID NO: 1648710 - RNA, 16 nt, Human
caagaccacguuucua

SEQ ID NO: 1648711 - RNA, 14 nt, Human
caagaccacguuuc

SEQ ID NO: 1648712 - RNA, 15 nt, Human
caagcaaaugugaau

SEQ ID NO: 1648713 - RNA, 17 nt, Human
caagcaaaugugaauca

SEQ ID NO: 1648714 - RNA, 19 nt, Human
caagcaaaugugaaucauu

SEQ ID NO: 1648715 - RNA, 13 nt, Human
caagcaagaaaca

SEQ ID NO: 1648716 - RNA, 18 nt, Human
caagcaagaaacacuggg

SEQ ID NO: 1648717 - RNA, 14 nt, Human
caagcaaguauuag

SEQ ID NO: 1648718 - RNA, 14 nt, Human
caacccccagccug

SEQ ID NO: 1648719 - RNA, 17 nt, Human
caaccccuucgcuccug

SEQ ID NO: 1648720 - RNA, 14 nt, Human
caaccccuucgcuc

SEQ ID NO: 1648721 - RNA, 16 nt, Human
caaccccuucgcuccu

SEQ ID NO: 1648722 - RNA, 13 nt, Human
caacuauggccug

SEQ ID NO: 1648723 - RNA, 19 nt, Human
caacuauauuguuugcuaa

SEQ ID NO: 1648724 - RNA, 19 nt, Human
caacuaucucauuuccaag

SEQ ID NO: 1648725 - RNA, 18 nt, Human
caagaauagaugcugacu

SEQ ID NO: 1648726 - RNA, 18 nt, Human
caagaagcccaggaaagg

SEQ ID NO: 1648727 - RNA, 17 nt, Human
caagaaggaugauucaa

SEQ ID NO: 1648728 - RNA, 21 nt, Human
caacucccugccccccagccc

SEQ ID NO: 1648729 - RNA, 15 nt, Human
caagaagcccaggaa

SEQ ID NO: 1648730 - RNA, 19 nt, Human
caacucccugccccccagc

SEQ ID NO: 1648731 - RNA, 20 nt, Human
caacucccugccccccagcc

SEQ ID NO: 1648732 - RNA, 14 nt, Human
caacuauggccugu

SEQ ID NO: 1648733 - RNA, 12 nt, Human
caacuccagaaa

SEQ ID NO: 1648734 - RNA, 15 nt, Human
auguuuauuacagua

SEQ ID NO: 1648735 - RNA, 16 nt, Human
auguuuauuacaguau

SEQ ID NO: 1648736 - RNA, 18 nt, Human
auguuuauuacaguauaa

SEQ ID NO: 1648737 - RNA, 19 nt, Human
auguuuauuacaguauaau

SEQ ID NO: 1648738 - RNA, 22 nt, Human
auguuuauuacaguauaauuaa

SEQ ID NO: 1648739 - RNA, 23 nt, Human
auguuuauuacaguauaauuaac

SEQ ID NO: 1648740 - RNA, 15 nt, Human
auguuuuuuuuuaaa

SEQ ID NO: 1648741 - RNA, 23 nt, Human
auuaaaaaucucaaauuucuaaa

SEQ ID NO: 1648742 - RNA, 19 nt, Human
auuaaaacacaacaucuuu

SEQ ID NO: 1648743 - RNA, 19 nt, Human
uuuucugauccaguuuugu

SEQ ID NO: 1648744 - RNA, 21 nt, Human
uuuucuuaaccagaucauugu

SEQ ID NO: 1648745 - RNA, 14 nt, Human
uuuucuuaaauaau

SEQ ID NO: 1648746 - RNA, 23 nt, Human
uuuucuuaaauaauaaagaucau

SEQ ID NO: 1648747 - RNA, 13 nt, Human
uuuucuguucuuu

SEQ ID NO: 1648748 - RNA, 12 nt, Human
uuuucuguuaua

SEQ ID NO: 1648749 - RNA, 12 nt, Human
auguuuauuaca

SEQ ID NO: 1648750 - RNA, 17 nt, Human
auguuggccaggcuggu

SEQ ID NO: 1648751 - RNA, 19 nt, Human
uuuuauggcuuuugugcau

SEQ ID NO: 1648752 - RNA, 18 nt, Human
uuuuauggcuuuugugca

SEQ ID NO: 1648753 - RNA, 23 nt, Human
uuuuagaguugauacuacaguuu

SEQ ID NO: 1648754 - RNA, 15 nt, Human
uuuuaguagagacag

SEQ ID NO: 1648755 - RNA, 21 nt, Human
uuuuauggcuuuugugcauua

SEQ ID NO: 1648756 - RNA, 12 nt, Human
uuuuauuaaauu

SEQ ID NO: 1648757 - RNA, 17 nt, Human
uuuucucugauacagaa

SEQ ID NO: 1648758 - RNA, 16 nt, Human
uuuucuauaauuuaaa

SEQ ID NO: 1648759 - RNA, 14 nt, Human
uuuucaguguacau

SEQ ID NO: 1648760 - RNA, 20 nt, Human
uuuucaggcuagauguaugu

SEQ ID NO: 1648761 - RNA, 12 nt, Human
auguugaaagau

SEQ ID NO: 1648762 - RNA, 18 nt, Human
auguugaaagaucaaaag

SEQ ID NO: 1648763 - RNA, 13 nt, Human
auguugcccaggc

SEQ ID NO: 1648764 - RNA, 14 nt, Human
auguugcccaggca

SEQ ID NO: 1648765 - RNA, 15 nt, Human
auguugcccaggcag

SEQ ID NO: 1648766 - RNA, 16 nt, Human
auguugcccaggcagg

SEQ ID NO: 1648767 - RNA, 17 nt, Human
uuuuagaguugauacua

SEQ ID NO: 1648768 - RNA, 21 nt, Human
uuuuagacccuauugcugcuu

SEQ ID NO: 1648769 - RNA, 13 nt, Human
auguuggccaggc

SEQ ID NO: 1648770 - RNA, 20 nt, Human
auguuacauaagauaaaugu

SEQ ID NO: 1648771 - RNA, 20 nt, Human
auguuacagaaucuaacugg

SEQ ID NO: 1648772 - RNA, 19 nt, Human
auguuacauaagauaaaug

SEQ ID NO: 1648773 - RNA, 21 nt, Human
uuuuaaaaaacugcugacugu

SEQ ID NO: 1648774 - RNA, 18 nt, Human
uuuuaaaaaacugcugac

SEQ ID NO: 1648775 - RNA, 21 nt, Human
augugccagguuuuuggucug

SEQ ID NO: 1648776 - RNA, 20 nt, Human
augugcuaguaauuggaaag

SEQ ID NO: 1648777 - RNA, 21 nt, Human
augugcuaguaauuggaaagg

SEQ ID NO: 1648778 - RNA, 15 nt, Human
auguguguuuuaaaa

SEQ ID NO: 1648779 - RNA, 14 nt, Human
uuuguuucugaaag

SEQ ID NO: 1648780 - RNA, 16 nt, Human
uuuguuucugaaaggg

SEQ ID NO: 1648781 - RNA, 22 nt, Human
uuugugcauuaucuagauacug

SEQ ID NO: 1648782 - RNA, 19 nt, Human
uuugugcauuaucuagaua

SEQ ID NO: 1648783 - RNA, 22 nt, Human
uuugugauacaaugcugugccc

SEQ ID NO: 1648784 - RNA, 16 nt, Human
uuugugauacaaugcu

SEQ ID NO: 1648785 - RNA, 23 nt, Human
uuugucuuaaaaaguggaaaaau

SEQ ID NO: 1648786 - RNA, 13 nt, Human
uuugucuuaaaaa

SEQ ID NO: 1648787 - RNA, 14 nt, Human
uuugucuuaaaaag

SEQ ID NO: 1648788 - RNA, 18 nt, Human
augugauccuuuuggagu

SEQ ID NO: 1648789 - RNA, 15 nt, Human
augugaugagaggaa

SEQ ID NO: 1648790 - RNA, 16 nt, Human
uuuguaauuuuuuuau

SEQ ID NO: 1648791 - RNA, 14 nt, Human
uuuguacagacaac

SEQ ID NO: 1648792 - RNA, 17 nt, Human
uuuguaguguuggagaa

SEQ ID NO: 1648793 - RNA, 14 nt, Human
augugagacugguu

SEQ ID NO: 1648794 - RNA, 13 nt, Human
augugagaccauu

SEQ ID NO: 1648795 - RNA, 23 nt, Human
augucgucaaagcugaaauggac

SEQ ID NO: 1648796 - RNA, 16 nt, Human
auguccaagaagccca

SEQ ID NO: 1648797 - RNA, 17 nt, Human
auguccaagaagcccag

SEQ ID NO: 1648798 - RNA, 12 nt, Human
auguaucaauga

SEQ ID NO: 1648799 - RNA, 19 nt, Human
auguauauuuuauaucaau

SEQ ID NO: 1648800 - RNA, 13 nt, Human
uuuggggaagaac

SEQ ID NO: 1648801 - RNA, 21 nt, Human
uuugggguacccacugcucug

SEQ ID NO: 1648802 - RNA, 22 nt, Human
uuugggguacccacugcucugg

SEQ ID NO: 1648803 - RNA, 14 nt, Human
uuugggcugcccug

SEQ ID NO: 1648804 - RNA, 12 nt, Human
uuuggcugcuga

SEQ ID NO: 1648805 - RNA, 13 nt, Human
uuuggcugcugaa

SEQ ID NO: 1648806 - RNA, 18 nt, Human
uuugauucagacagcugc

SEQ ID NO: 1648807 - RNA, 22 nt, Human
uuuggauuggaugaauuccaaa

SEQ ID NO: 1648808 - RNA, 22 nt, Human
uuugcuggggccgaaagaacag

SEQ ID NO: 1648809 - RNA, 19 nt, Human
uuugcuggggccgaaagaa

SEQ ID NO: 1648810 - RNA, 19 nt, Human
uuugcuaagcauuccaacu

SEQ ID NO: 1648811 - RNA, 20 nt, Human
uuugcuggagcucugcccau

SEQ ID NO: 1648812 - RNA, 13 nt, Human
uuugagacagagu

SEQ ID NO: 1648813 - RNA, 16 nt, Human
uuugagaaauuaagua

SEQ ID NO: 1648814 - RNA, 15 nt, Human
uuugauucagacagc

SEQ ID NO: 1648815 - RNA, 15 nt, Human
uuugauccaagcugg

SEQ ID NO: 1648816 - RNA, 12 nt, Human
uuugaauuuugu

SEQ ID NO: 1648817 - RNA, 14 nt, Human
uuugaauuuugugu

SEQ ID NO: 1648818 - RNA, 23 nt, Human
uuucccucccuuccucuuuccau

SEQ ID NO: 1648819 - RNA, 18 nt, Human
uuugacaaagguaaauca

SEQ ID NO: 1648820 - RNA, 14 nt, Human
uuugacaaggggca

SEQ ID NO: 1648821 - RNA, 21 nt, Human
uuugaccucugcagcaauaaa

SEQ ID NO: 1648822 - RNA, 19 nt, Human
uuugaccucugcagcaaua

SEQ ID NO: 1648823 - RNA, 15 nt, Human
auucagccuggcuuc

SEQ ID NO: 1648824 - RNA, 22 nt, Human
auucaaacagucucaggaaauc

SEQ ID NO: 1648825 - RNA, 20 nt, Human
auuauaucugaggaauucug

SEQ ID NO: 1648826 - RNA, 21 nt, Human
auuauaucugaggaauucugu

SEQ ID NO: 1648827 - RNA, 22 nt, Human
auuauaucugaggaauucugua

SEQ ID NO: 1648828 - RNA, 16 nt, Human
auuauaugcuauuucu

SEQ ID NO: 1648829 - RNA, 18 nt, Human
auuauaucugaggaauuc

SEQ ID NO: 1648830 - RNA, 19 nt, Human
auuauaucugaggaauucu

SEQ ID NO: 1648831 - RNA, 19 nt, Human
auuauucaaaguugccuaa

SEQ ID NO: 1648832 - RNA, 22 nt, Human
auuauucaaaguugccuaaauc

SEQ ID NO: 1648833 - RNA, 18 nt, Human
auuauucaaaguugccua

SEQ ID NO: 1648834 - RNA, 24 nt, Human
auuauucaaaguugccuaaaucca

SEQ ID NO: 1648835 - RNA, 19 nt, Human
auuauucacugauuugaca

SEQ ID NO: 1648836 - RNA, 18 nt, Human
auuauaugcuauuucuau

SEQ ID NO: 1648837 - RNA, 17 nt, Human
auuauaugcuauuucua

SEQ ID NO: 1648838 - RNA, 19 nt, Human
auuauaugcuauuucuaua

SEQ ID NO: 1648839 - RNA, 20 nt, Human
auuauauggcuugaguuuaa

SEQ ID NO: 1648840 - RNA, 22 nt, Human
auuccccaggaggccagccuug

SEQ ID NO: 1648841 - RNA, 20 nt, Human
auuccccaggaggccagccu

SEQ ID NO: 1648842 - RNA, 18 nt, Human
auucccaagcucugcucc

SEQ ID NO: 1648843 - RNA, 19 nt, Human
auucccaagcucugcuccu

SEQ ID NO: 1648844 - RNA, 18 nt, Human
auuccagagaguggcucc

SEQ ID NO: 1648845 - RNA, 13 nt, Human
auuccacagcugc

SEQ ID NO: 1648846 - RNA, 12 nt, Human
auuccacagcug

SEQ ID NO: 1648847 - RNA, 17 nt, Human
auuccaagugauugaaa

SEQ ID NO: 1648848 - RNA, 12 nt, Human
auucacugauuu

SEQ ID NO: 1648849 - RNA, 17 nt, Human
auucacugauuugacau

SEQ ID NO: 1648850 - RNA, 14 nt, Human
auucagccuggcuu

SEQ ID NO: 1648851 - RNA, 13 nt, Human
auuagagaagaga

SEQ ID NO: 1648852 - RNA, 14 nt, Human
auuacuucugcuac

SEQ ID NO: 1648853 - RNA, 13 nt, Human
auuacuucugcua

SEQ ID NO: 1648854 - RNA, 15 nt, Human
auuacuguaagaaaa

SEQ ID NO: 1648855 - RNA, 16 nt, Human
auuacuguaagaaaau

SEQ ID NO: 1648856 - RNA, 20 nt, Human
uuuuuauauuuacuaaaaug

SEQ ID NO: 1648857 - RNA, 16 nt, Human
uuuuguuuuugucuua

SEQ ID NO: 1648858 - RNA, 15 nt, Human
uuuuguuuucauuau

SEQ ID NO: 1648859 - RNA, 15 nt, Human
uuuuggaauuuuccu

SEQ ID NO: 1648860 - RNA, 14 nt, Human
uuuugugaagcaaa

SEQ ID NO: 1648861 - RNA, 17 nt, Human
uuuuuauauuugaaaua

SEQ ID NO: 1648862 - RNA, 15 nt, Human
uuuuugaagcuguau

SEQ ID NO: 1648863 - RNA, 11 nt, Human
uuuuuguauuu

SEQ ID NO: 1648864 - RNA, 13 nt, Human
auuaaggaagaca

SEQ ID NO: 1648865 - RNA, 15 nt, Human
auuaaggauuuuaug

SEQ ID NO: 1648866 - RNA, 17 nt, Human
auuaaggauuuuaugcu

SEQ ID NO: 1648867 - RNA, 20 nt, Human
auuaaggauuuuaugcuuua

SEQ ID NO: 1648868 - RNA, 18 nt, Human
auuaaguacuauguauca

SEQ ID NO: 1648869 - RNA, 19 nt, Human
auuaaguacuauguaucaa

SEQ ID NO: 1648870 - RNA, 17 nt, Human
auuaaguaucugacauc

SEQ ID NO: 1648871 - RNA, 23 nt, Human
uuuuuggcauaacauaaaucugu

SEQ ID NO: 1648872 - RNA, 24 nt, Human
uuuuuggcauaacauaaaucugug

SEQ ID NO: 1648873 - RNA, 22 nt, Human
uuuuugggaaaagaaaagucaa

SEQ ID NO: 1648874 - RNA, 14 nt, Human
auuggaaacaaguc

SEQ ID NO: 1648875 - RNA, 13 nt, Human
auuggaaacaagu

SEQ ID NO: 1648876 - RNA, 16 nt, Human
auugcauuuccugaca

SEQ ID NO: 1648877 - RNA, 22 nt, Human
auuggcuagagguucaaagaua

SEQ ID NO: 1648878 - RNA, 20 nt, Human
auuggcuagagguucaaaga

SEQ ID NO: 1648879 - RNA, 19 nt, Human
auuggcuagagguucaaag

SEQ ID NO: 1648880 - RNA, 16 nt, Human
auuggagcucguggaa

SEQ ID NO: 1648881 - RNA, 17 nt, Human
auuggagcucgugggac

SEQ ID NO: 1648882 - RNA, 14 nt, Human
auuggggauucuua

SEQ ID NO: 1648883 - RNA, 23 nt, Human
auuggcuagagguucaaagauau

SEQ ID NO: 1648884 - RNA, 15 nt, Human
auuggggauucuuaa

SEQ ID NO: 1648885 - RNA, 16 nt, Human
auuggggauucuuaaa

SEQ ID NO: 1648886 - RNA, 20 nt, Human
auuggggauucuuaaaguug

SEQ ID NO: 1648887 - RNA, 21 nt, Human
auuggggauucuuaaaguuga

SEQ ID NO: 1648888 - RNA, 22 nt, Human
auuggggauucuuaaaguugaa

SEQ ID NO: 1648889 - RNA, 17 nt, Human
auugcaacaggcugggc

SEQ ID NO: 1648890 - RNA, 18 nt, Human
auugcaacaggcugggcu

SEQ ID NO: 1648891 - RNA, 19 nt, Human
auugcaacaggcugggcuu

SEQ ID NO: 1648892 - RNA, 12 nt, Human
auugcaccacug

SEQ ID NO: 1648893 - RNA, 15 nt, Human
auuuauaaacuuuuu

SEQ ID NO: 1648894 - RNA, 17 nt, Human
auuuaguguucauaaau

SEQ ID NO: 1648895 - RNA, 16 nt, Human
auuuaguguucauaaa

SEQ ID NO: 1648896 - RNA, 19 nt, Human
auuuacuucuuauacauuu

SEQ ID NO: 1648897 - RNA, 20 nt, Human
auuuacuucuuauacauuug

SEQ ID NO: 1648898 - RNA, 16 nt, Human
auuuaaauagcuuuuu

SEQ ID NO: 1648899 - RNA, 16 nt, Human
auuuacuaaaauggac

SEQ ID NO: 1648900 - RNA, 19 nt, Human
auuuacuaaaauggacugu

SEQ ID NO: 1648901 - RNA, 20 nt, Human
auuuacuaaaauggacugug

SEQ ID NO: 1648902 - RNA, 15 nt, Human
auuuaccacuugugu

SEQ ID NO: 1648903 - RNA, 22 nt, Human
auuuaccacuuguguuuugcaa

SEQ ID NO: 1648904 - RNA, 20 nt, Human
auuguagcauccuggaauau

SEQ ID NO: 1648905 - RNA, 17 nt, Human
auuguuuucaguguaca

SEQ ID NO: 1648906 - RNA, 15 nt, Human
auuguacuuugugcu

SEQ ID NO: 1648907 - RNA, 17 nt, Human
auuguagcauccuggaa

SEQ ID NO: 1648908 - RNA, 16 nt, Human
auuguaguccuguaau

SEQ ID NO: 1648909 - RNA, 14 nt, Human
auuuaaaaaaaauc

SEQ ID NO: 1648910 - RNA, 18 nt, Human
auuguuuucaguguacau

SEQ ID NO: 1648911 - RNA, 19 nt, Human
auuguuuucaguguacaug

SEQ ID NO: 1648912 - RNA, 17 nt, Human
auuuaaaaaaaaaccug

SEQ ID NO: 1648913 - RNA, 14 nt, Human
auuuauuggcuuuu

SEQ ID NO: 1648914 - RNA, 18 nt, Human
auuuauuggcuuuucuga

SEQ ID NO: 1648915 - RNA, 19 nt, Human
auuuauuacuguaagaaaa

SEQ ID NO: 1648916 - RNA, 20 nt, Human
auuuauuacuguaagaaaau

SEQ ID NO: 1648917 - RNA, 21 nt, Human
auuuccuaaauauauuuuaag

SEQ ID NO: 1648918 - RNA, 14 nt, Human
auuuccuaaauaua

SEQ ID NO: 1648919 - RNA, 17 nt, Human
auuuccguuaaaauacc

SEQ ID NO: 1648920 - RNA, 14 nt, Human
auuucccaaagcag

SEQ ID NO: 1648921 - RNA, 16 nt, Human
auuucccaaagcagug

SEQ ID NO: 1648922 - RNA, 20 nt, Human
auuuauuggcuuuucugauc

SEQ ID NO: 1648923 - RNA, 23 nt, Human
auuuauuggcuuuucugauccag

SEQ ID NO: 1648924 - RNA, 21 nt, Human
auuuauuuuaauaauguuuca

SEQ ID NO: 1648925 - RNA, 12 nt, Human
auuugguuuuca

SEQ ID NO: 1648926 - RNA, 14 nt, Human
auuugguuuucaca

SEQ ID NO: 1648927 - RNA, 21 nt, Human
auuuggugguuucagaaaugu

SEQ ID NO: 1648928 - RNA, 18 nt, Human
auuugauaugugaacagu

SEQ ID NO: 1648929 - RNA, 19 nt, Human
auuugauaugugaacaguu

SEQ ID NO: 1648930 - RNA, 22 nt, Human
auuugaggucuguucuuuccaa

SEQ ID NO: 1648931 - RNA, 21 nt, Human
auuugaggucuguucuuucca

SEQ ID NO: 1648932 - RNA, 16 nt, Human
auuucuuccacaagag

SEQ ID NO: 1648933 - RNA, 18 nt, Human
auuugaggucuguucuuu

SEQ ID NO: 1648934 - RNA, 17 nt, Human
auuugaggucuguucuu

SEQ ID NO: 1648935 - RNA, 15 nt, Human
auuugagcagggcuc

SEQ ID NO: 1648936 - RNA, 16 nt, Human
auuugagcagggcuca

SEQ ID NO: 1648937 - RNA, 15 nt, Human
auuugaauuuugugu

SEQ ID NO: 1648938 - RNA, 13 nt, Human
auuugaauuuugu

SEQ ID NO: 1648939 - RNA, 21 nt, Human
augccccgucccccucuggcu

SEQ ID NO: 1648940 - RNA, 18 nt, Human
augccccgucccccucug

SEQ ID NO: 1648941 - RNA, 15 nt, Human
augccccugaauuua

SEQ ID NO: 1648942 - RNA, 20 nt, Human
augccccugaauuuaaauag

SEQ ID NO: 1648943 - RNA, 17 nt, Human
augcccagccccuucug

SEQ ID NO: 1648944 - RNA, 21 nt, Human
augccaugaggaacaaggcaa

SEQ ID NO: 1648945 - RNA, 16 nt, Human
augcccagccccuucu

SEQ ID NO: 1648946 - RNA, 14 nt, Human
augccaucaauaaa

SEQ ID NO: 1648947 - RNA, 21 nt, Human
uuuaaugaaagacuguacaaa

SEQ ID NO: 1648948 - RNA, 23 nt, Human
uuuaaugaaagacuguacaaagu

SEQ ID NO: 1648949 - RNA, 13 nt, Human
augccucucucag

SEQ ID NO: 1648950 - RNA, 14 nt, Human
augccucucucagg

SEQ ID NO: 1648951 - RNA, 15 nt, Human
augccucucucaggc

SEQ ID NO: 1648952 - RNA, 20 nt, Human
augccuuuucccaacuccag

SEQ ID NO: 1648953 - RNA, 22 nt, Human
augccuuuucccaacuccagaa

SEQ ID NO: 1648954 - RNA, 14 nt, Human
augcgcaggcuggc

SEQ ID NO: 1648955 - RNA, 18 nt, Human
augcgcaggcuggcccug

SEQ ID NO: 1648956 - RNA, 20 nt, Human
augcgcaggcuggcccugcc

SEQ ID NO: 1648957 - RNA, 22 nt, Human
augcgcaggcuggcccugcccu

SEQ ID NO: 1648958 - RNA, 13 nt, Human
augcgcaggcugg

SEQ ID NO: 1648959 - RNA, 17 nt, Human
augccucucucaggcca

SEQ ID NO: 1648960 - RNA, 12 nt, Human
augcgugugugu

SEQ ID NO: 1648961 - RNA, 22 nt, Human
augcgugcauaccacuuuuguu

SEQ ID NO: 1648962 - RNA, 18 nt, Human
augcuacaggauuugaaa

SEQ ID NO: 1648963 - RNA, 16 nt, Human
augcgugugugugugu

SEQ ID NO: 1648964 - RNA, 22 nt, Human
uuuaccugaagucuuuguacag

SEQ ID NO: 1648965 - RNA, 18 nt, Human
uuuaccugaagucuuugu

SEQ ID NO: 1648966 - RNA, 16 nt, Human
uuuacugcagcuuugu

SEQ ID NO: 1648967 - RNA, 11 nt, Human
uuuacuuaaac

SEQ ID NO: 1648968 - RNA, 13 nt, Human
uuuacuucuuaua

SEQ ID NO: 1648969 - RNA, 14 nt, Human
uuuacuucuuauac

SEQ ID NO: 1648970 - RNA, 15 nt, Human
uuuacuucuuauaca

SEQ ID NO: 1648971 - RNA, 15 nt, Human
uuuagucuugucuca

SEQ ID NO: 1648972 - RNA, 17 nt, Human
uuuagggguagcauuug

SEQ ID NO: 1648973 - RNA, 17 nt, Human
uuuagucuugucucaga

SEQ ID NO: 1648974 - RNA, 23 nt, Human
uuuagucuugucucagauuuuau

SEQ ID NO: 1648975 - RNA, 21 nt, Human
uuuauaugcuucuguuuuaua

SEQ ID NO: 1648976 - RNA, 14 nt, Human
uuuaucagaauucu

SEQ ID NO: 1648977 - RNA, 14 nt, Human
augcuccuggccca

SEQ ID NO: 1648978 - RNA, 19 nt, Human
augcuccuggcccacugca

SEQ ID NO: 1648979 - RNA, 18 nt, Human
augcuggcuguuggcugg

SEQ ID NO: 1648980 - RNA, 23 nt, Human
augcuguauuuuaaaagaaugau

SEQ ID NO: 1648981 - RNA, 19 nt, Human
augcuggcuguuggcuggg

SEQ ID NO: 1648982 - RNA, 20 nt, Human
augcuggcuguuggcugggg

SEQ ID NO: 1648983 - RNA, 19 nt, Human
augcuguauuuuaaaagaa

SEQ ID NO: 1648984 - RNA, 22 nt, Human
augcuguauuuuaaaagaauga

SEQ ID NO: 1648985 - RNA, 14 nt, Human
auggaaggggcuga

SEQ ID NO: 1648986 - RNA, 17 nt, Human
auggaagacagcucuua

SEQ ID NO: 1648987 - RNA, 18 nt, Human
auggaagacagcucuuau

SEQ ID NO: 1648988 - RNA, 16 nt, Human
augcuucucacugcca

SEQ ID NO: 1648989 - RNA, 20 nt, Human
augcuucucacugccaugcc

SEQ ID NO: 1648990 - RNA, 21 nt, Human
augcuucuguuuuauaauuuu

SEQ ID NO: 1648991 - RNA, 21 nt, Human
uuucaugcuguucaugaaaga

SEQ ID NO: 1648992 - RNA, 19 nt, Human
uuucaugcuguucaugaaa

SEQ ID NO: 1648993 - RNA, 13 nt, Human
uuucagaaaugug

SEQ ID NO: 1648994 - RNA, 12 nt, Human
uuucagaaaugu

SEQ ID NO: 1648995 - RNA, 11 nt, Human
uuucagaaaug

SEQ ID NO: 1648996 - RNA, 16 nt, Human
uuucccuauuagagaa

SEQ ID NO: 1648997 - RNA, 21 nt, Human
uuucagaaagaaguggggaca

SEQ ID NO: 1648998 - RNA, 13 nt, Human
uuucacauuggaa

SEQ ID NO: 1648999 - RNA, 14 nt, Human
uuucacauuggaaa

SEQ ID NO: 1649000 - RNA, 19 nt, Human
uuucacauuggaaacaagu

SEQ ID NO: 1649001 - RNA, 12 nt, Human
uuucaaacuuua

SEQ ID NO: 1649002 - RNA, 19 nt, Human
uuucaaacauauauaacaa

SEQ ID NO: 1649003 - RNA, 15 nt, Human
uuucaaacuuuacua

SEQ ID NO: 1649004 - RNA, 14 nt, Human
uuuaagagacagcc

SEQ ID NO: 1649005 - RNA, 14 nt, Human
uuuaagaggcaggg

SEQ ID NO: 1649006 - RNA, 12 nt, Human
uuuaagagaaau

SEQ ID NO: 1649007 - RNA, 19 nt, Human
uuuaaggaugcuuguacau

SEQ ID NO: 1649008 - RNA, 21 nt, Human
uuuaagcuguuacugucuuca

SEQ ID NO: 1649009 - RNA, 22 nt, Human
uuuaaggaugcuuguacauaau

SEQ ID NO: 1649010 - RNA, 21 nt, Human
uuuaaggaugcuuguacauaa

SEQ ID NO: 1649011 - RNA, 20 nt, Human
uuuaaggaugcuuguacaua

SEQ ID NO: 1649012 - RNA, 17 nt, Human
uuuaaggguuuguggaa

SEQ ID NO: 1649013 - RNA, 20 nt, Human
uuuaaggguuuguggaaaau

SEQ ID NO: 1649014 - RNA, 22 nt, Human
uuuaaggguuuguggaaaauga

SEQ ID NO: 1649015 - RNA, 16 nt, Human
uuuaaugaaagacugu

SEQ ID NO: 1649016 - RNA, 23 nt, Human
uuuaaaaauacagauagauauau

SEQ ID NO: 1649017 - RNA, 21 nt, Human
uuuaaaaaauuaaucugggcc

SEQ ID NO: 1649018 - RNA, 14 nt, Human
uuuaaaugcugcuu

SEQ ID NO: 1649019 - RNA, 11 nt, Human
uuuaaaugcac

SEQ ID NO: 1649020 - RNA, 21 nt, Human
uuuaaauauaugcuaagucuu

SEQ ID NO: 1649021 - RNA, 23 nt, Human
augcacuuuguucuggcucuucc

SEQ ID NO: 1649022 - RNA, 17 nt, Human
augcagagguccacaac

SEQ ID NO: 1649023 - RNA, 18 nt, Human
augcagagguccacaaca

SEQ ID NO: 1649024 - RNA, 18 nt, Human
uuuaaaaaaauuccaagu

SEQ ID NO: 1649025 - RNA, 12 nt, Human
augcaaagcacu

SEQ ID NO: 1649026 - RNA, 13 nt, Human
augcaaagcacug

SEQ ID NO: 1649027 - RNA, 14 nt, Human
augcaaagcacuga

SEQ ID NO: 1649028 - RNA, 13 nt, Human
augauuucauuca

SEQ ID NO: 1649029 - RNA, 20 nt, Human
uuguucuugguuuguaaauu

SEQ ID NO: 1649030 - RNA, 19 nt, Human
uuguucuugguuuguaaau

SEQ ID NO: 1649031 - RNA, 17 nt, Human
uuguucuugguuuguaa

SEQ ID NO: 1649032 - RNA, 13 nt, Human
uugugaggaagcc

SEQ ID NO: 1649033 - RNA, 20 nt, Human
uugugauacaaugcugugcc

SEQ ID NO: 1649034 - RNA, 17 nt, Human
uugugaggaagccgcug

SEQ ID NO: 1649035 - RNA, 18 nt, Human
uugugaggaagccgcugg

SEQ ID NO: 1649036 - RNA, 15 nt, Human
uuguccccgacccuu

SEQ ID NO: 1649037 - RNA, 16 nt, Human
uuguccccgacccuug

SEQ ID NO: 1649038 - RNA, 18 nt, Human
uuguccccaccgcagaca

SEQ ID NO: 1649039 - RNA, 20 nt, Human
uuguccccaccgcagacagg

SEQ ID NO: 1649040 - RNA, 18 nt, Human
uugugaugucccaacuug

SEQ ID NO: 1649041 - RNA, 22 nt, Human
uugugaugucccaacuuguaaa

SEQ ID NO: 1649042 - RNA, 17 nt, Human
uugucacacacuuuggc

SEQ ID NO: 1649043 - RNA, 18 nt, Human
uugucacacacuuuggcu

SEQ ID NO: 1649044 - RNA, 21 nt, Human
uugucauauaagauucauauu

SEQ ID NO: 1649045 - RNA, 13 nt, Human
augaguccccugu

SEQ ID NO: 1649046 - RNA, 23 nt, Human
augaguccccuguuuguuucuga

SEQ ID NO: 1649047 - RNA, 20 nt, Human
uugucaauaaaauccauaca

SEQ ID NO: 1649048 - RNA, 22 nt, Human
augaggucagagccugcaguua

SEQ ID NO: 1649049 - RNA, 19 nt, Human
augaggucagagccugcag

SEQ ID NO: 1649050 - RNA, 20 nt, Human
augaggucagagccugcagu

SEQ ID NO: 1649051 - RNA, 21 nt, Human
augagguacaaccuguucugc

SEQ ID NO: 1649052 - RNA, 15 nt, Human
augaggucagagccu

SEQ ID NO: 1649053 - RNA, 16 nt, Human
augaggucagagccug

SEQ ID NO: 1649054 - RNA, 18 nt, Human
augaggucagagccugca

SEQ ID NO: 1649055 - RNA, 16 nt, Human
uuguagcauccuggaa

SEQ ID NO: 1649056 - RNA, 18 nt, Human
uuguagcauccuggaaua

SEQ ID NO: 1649057 - RNA, 17 nt, Human
augagguacugagagug

SEQ ID NO: 1649058 - RNA, 18 nt, Human
augagguacugagaguga

SEQ ID NO: 1649059 - RNA, 15 nt, Human
augagguacugagag

SEQ ID NO: 1649060 - RNA, 19 nt, Human
uugacaggauuauuggaaa

SEQ ID NO: 1649061 - RNA, 10 nt, Human
uugacagggc

SEQ ID NO: 1649062 - RNA, 12 nt, Human
uugacagggcac

SEQ ID NO: 1649063 - RNA, 19 nt, Human
uugacagggcacaccgggc

SEQ ID NO: 1649064 - RNA, 16 nt, Human
uugacaucaacugcau

SEQ ID NO: 1649065 - RNA, 13 nt, Human
uugacaugggaca

SEQ ID NO: 1649066 - RNA, 16 nt, Human
uugagcagggcucagc

SEQ ID NO: 1649067 - RNA, 12 nt, Human
uugagacagagu

SEQ ID NO: 1649068 - RNA, 12 nt, Human
uugagcagggcu

SEQ ID NO: 1649069 - RNA, 10 nt, Human
uugagacaga

SEQ ID NO: 1649070 - RNA, 11 nt, Human
uugagacagag

SEQ ID NO: 1649071 - RNA, 17 nt, Human
uugaccauucuccaccu

SEQ ID NO: 1649072 - RNA, 12 nt, Human
uugacuuuuuau

SEQ ID NO: 1649073 - RNA, 23 nt, Human
aucuaauauguaacaagccaccc

SEQ ID NO: 1649074 - RNA, 18 nt, Human
aucuagauacuguaucau

SEQ ID NO: 1649075 - RNA, 18 nt, Human
uugauagcacagacccug

SEQ ID NO: 1649076 - RNA, 17 nt, Human
uugauacuacaguuugu

SEQ ID NO: 1649077 - RNA, 21 nt, Human
uugagugcugucuccauguuu

SEQ ID NO: 1649078 - RNA, 19 nt, Human
aucuagauacuguaucaug

SEQ ID NO: 1649079 - RNA, 17 nt, Human
aucuaggaagacuuugg

SEQ ID NO: 1649080 - RNA, 18 nt, Human
aucuaggaagacuuugga

SEQ ID NO: 1649081 - RNA, 19 nt, Human
aucuaggaagacuuuggaa

SEQ ID NO: 1649082 - RNA, 14 nt, Human
aucucaaauuucua

SEQ ID NO: 1649083 - RNA, 23 nt, Human
aucucaaauaacuaaaagguaug

SEQ ID NO: 1649084 - RNA, 14 nt, Human
aucucaaauaacua

SEQ ID NO: 1649085 - RNA, 21 nt, Human
aucucaaauaacuaaaaggua

SEQ ID NO: 1649086 - RNA, 15 nt, Human
aucucaaaacugcac

SEQ ID NO: 1649087 - RNA, 19 nt, Human
aucucaaaacugcacuguc

SEQ ID NO: 1649088 - RNA, 20 nt, Human
aucucaaaacugcacuguca

SEQ ID NO: 1649089 - RNA, 14 nt, Human
uugcaugaggcuag

SEQ ID NO: 1649090 - RNA, 21 nt, Human
uugcaccacugcacuccagcc

SEQ ID NO: 1649091 - RNA, 14 nt, Human
uugcaauggcagcc

SEQ ID NO: 1649092 - RNA, 13 nt, Human
uugcccaggcagg

SEQ ID NO: 1649093 - RNA, 14 nt, Human
uugcccaggcaggu

SEQ ID NO: 1649094 - RNA, 16 nt, Human
uugcccaggcaggucu

SEQ ID NO: 1649095 - RNA, 18 nt, Human
uugcccaggcaggucuug

SEQ ID NO: 1649096 - RNA, 11 nt, Human
uugcccaggcu

SEQ ID NO: 1649097 - RNA, 12 nt, Human
uugcccaggcug

SEQ ID NO: 1649098 - RNA, 14 nt, Human
uugcccaggcuggc

SEQ ID NO: 1649099 - RNA, 23 nt, Human
uugcccaggcuggcgugcagugg

SEQ ID NO: 1649100 - RNA, 16 nt, Human
aucugaagucagaucu

SEQ ID NO: 1649101 - RNA, 17 nt, Human
aucugaagucagaucug

SEQ ID NO: 1649102 - RNA, 18 nt, Human
aucugaagucagaucugc

SEQ ID NO: 1649103 - RNA, 23 nt, Human
aucugaagucagaucugccuaag

SEQ ID NO: 1649104 - RNA, 16 nt, Human
aucucuuguuuaaauu

SEQ ID NO: 1649105 - RNA, 12 nt, Human
aucugaaaaugu

SEQ ID NO: 1649106 - RNA, 15 nt, Human
aucucaccuccugcu

SEQ ID NO: 1649107 - RNA, 16 nt, Human
aucucaccuccugcug

SEQ ID NO: 1649108 - RNA, 17 nt, Human
aucucaaauuucuaaau

SEQ ID NO: 1649109 - RNA, 16 nt, Human
aucucaaauuucuaaa

SEQ ID NO: 1649110 - RNA, 23 nt, Human
aucucacacaugagcaucaggcc

SEQ ID NO: 1649111 - RNA, 21 nt, Human
uugauuaaauucuugcaaagu

SEQ ID NO: 1649112 - RNA, 20 nt, Human
uugauuaaauucuugcaaag

SEQ ID NO: 1649113 - RNA, 16 nt, Human
uugauuaaauucuugc

SEQ ID NO: 1649114 - RNA, 15 nt, Human
uugauuaaauucuug

SEQ ID NO: 1649115 - RNA, 16 nt, Human
uugcaacuuuguauaa

SEQ ID NO: 1649116 - RNA, 17 nt, Human
uugcaacuuuguauaaa

SEQ ID NO: 1649117 - RNA, 18 nt, Human
uugcaacuuuguauaaaa

SEQ ID NO: 1649118 - RNA, 22 nt, Human
uugcaagccagauuuuccugaa

SEQ ID NO: 1649119 - RNA, 23 nt, Human
uugauguucuuucacccuuuucu

SEQ ID NO: 1649120 - RNA, 22 nt, Human
uuguaagcaugcacaaauucug

SEQ ID NO: 1649121 - RNA, 12 nt, Human
uuguaaugaaaa

SEQ ID NO: 1649122 - RNA, 13 nt, Human
uuguaaauuguca

SEQ ID NO: 1649123 - RNA, 20 nt, Human
uugguuuucacauuggaaac

SEQ ID NO: 1649124 - RNA, 14 nt, Human
uugguuuguaaauu

SEQ ID NO: 1649125 - RNA, 17 nt, Human
uuggugucgggcaugac

SEQ ID NO: 1649126 - RNA, 18 nt, Human
uuggugucgggcaugaca

SEQ ID NO: 1649127 - RNA, 19 nt, Human
uuggugucgggcaugacac

SEQ ID NO: 1649128 - RNA, 19 nt, Human
uuggugguuucagaaaugu

SEQ ID NO: 1649129 - RNA, 18 nt, Human
uuggugguuucagaaaug

SEQ ID NO: 1649130 - RNA, 16 nt, Human
augaaugucaguguga

SEQ ID NO: 1649131 - RNA, 18 nt, Human
augaaugucagugugacu

SEQ ID NO: 1649132 - RNA, 23 nt, Human
augaaccacaucuugcucugcug

SEQ ID NO: 1649133 - RNA, 22 nt, Human
augaaauacuguuugagguuuu

SEQ ID NO: 1649134 - RNA, 14 nt, Human
augaagcaaugcuu

SEQ ID NO: 1649135 - RNA, 15 nt, Human
augaagcaaugcuuc

SEQ ID NO: 1649136 - RNA, 17 nt, Human
augaaugaaacauuuug

SEQ ID NO: 1649137 - RNA, 12 nt, Human
aucugucauuug

SEQ ID NO: 1649138 - RNA, 17 nt, Human
aucugucauuugagcag

SEQ ID NO: 1649139 - RNA, 22 nt, Human
aucugucauuugagcagggcuc

SEQ ID NO: 1649140 - RNA, 17 nt, Human
aucuugcucugcugaca

SEQ ID NO: 1649141 - RNA, 15 nt, Human
aucuugcucugcuga

SEQ ID NO: 1649142 - RNA, 16 nt, Human
aucuugcucugcugac

SEQ ID NO: 1649143 - RNA, 15 nt, Human
aucuuauaauuuaaa

SEQ ID NO: 1649144 - RNA, 14 nt, Human
aucuugcucugcug

SEQ ID NO: 1649145 - RNA, 16 nt, Human
aucuuauaauuuaaaa

SEQ ID NO: 1649146 - RNA, 13 nt, Human
uugcuuuguaugc

SEQ ID NO: 1649147 - RNA, 15 nt, Human
uugcuuugugauuuu

SEQ ID NO: 1649148 - RNA, 14 nt, Human
uugcucuugaugcc

SEQ ID NO: 1649149 - RNA, 17 nt, Human
uugcucuugaugccugg

SEQ ID NO: 1649150 - RNA, 18 nt, Human
uugcucuugaugccuggc

SEQ ID NO: 1649151 - RNA, 12 nt, Human
aucuuuaaaaua

SEQ ID NO: 1649152 - RNA, 15 nt, Human
aucuuuaaaauacac

SEQ ID NO: 1649153 - RNA, 16 nt, Human
uugcuuuuaaaaucca

SEQ ID NO: 1649154 - RNA, 16 nt, Human
uugcuuuguaugcacu

SEQ ID NO: 1649155 - RNA, 20 nt, Human
uugcuuugugauuuuuguaa

SEQ ID NO: 1649156 - RNA, 12 nt, Human
uuggaaaauaaa

SEQ ID NO: 1649157 - RNA, 15 nt, Human
uuggaaaauaaauca

SEQ ID NO: 1649158 - RNA, 17 nt, Human
uuggaaaauaaauuauu

SEQ ID NO: 1649159 - RNA, 17 nt, Human
uuggagaagaacugaaa

SEQ ID NO: 1649160 - RNA, 22 nt, Human
uuggagaagaacugaaaucaua

SEQ ID NO: 1649161 - RNA, 15 nt, Human
uuggagaagaacuga

SEQ ID NO: 1649162 - RNA, 18 nt, Human
auauauucagccuggcuu

SEQ ID NO: 1649163 - RNA, 17 nt, Human
auaucuauauuuuacau

SEQ ID NO: 1649164 - RNA, 16 nt, Human
auaucuauauuuuaca

SEQ ID NO: 1649165 - RNA, 20 nt, Human
auaucuauauuuuacauaaa

SEQ ID NO: 1649166 - RNA, 22 nt, Human
auaucuauauuuuacauaaauu

SEQ ID NO: 1649167 - RNA, 21 nt, Human
uucaucauccuaagcuauuca

SEQ ID NO: 1649168 - RNA, 18 nt, Human
uucaucauccuaagcuau

SEQ ID NO: 1649169 - RNA, 16 nt, Human
uucauauuuacuucuu

SEQ ID NO: 1649170 - RNA, 21 nt, Human
uucauauuuacuucuuauaca

SEQ ID NO: 1649171 - RNA, 16 nt, Human
uucauaccuacaugua

SEQ ID NO: 1649172 - RNA, 19 nt, Human
uucauaccuacauguauuu

SEQ ID NO: 1649173 - RNA, 14 nt, Human
uucagccugccuuc

SEQ ID NO: 1649174 - RNA, 14 nt, Human
uucaguaauaacuc

SEQ ID NO: 1649175 - RNA, 13 nt, Human
auaugauucaaau

SEQ ID NO: 1649176 - RNA, 22 nt, Human
auaugauucaaaugucuauaaa

SEQ ID NO: 1649177 - RNA, 20 nt, Human
auaugauuuaaaucagccgu

SEQ ID NO: 1649178 - RNA, 12 nt, Human
auaugauucaaa

SEQ ID NO: 1649179 - RNA, 19 nt, Human
auaucugaggaauucugua

SEQ ID NO: 1649180 - RNA, 20 nt, Human
auaucugaggaauucuguau

SEQ ID NO: 1649181 - RNA, 21 nt, Human
auaucugaggaauucuguaua

SEQ ID NO: 1649182 - RNA, 22 nt, Human
auaucugaggaauucuguauag

SEQ ID NO: 1649183 - RNA, 23 nt, Human
auaucugaggaauucuguauaga

SEQ ID NO: 1649184 - RNA, 15 nt, Human
auaucugaggaauuc

SEQ ID NO: 1649185 - RNA, 16 nt, Human
auaucugaggaauucu

SEQ ID NO: 1649186 - RNA, 17 nt, Human
auaucugaggaauucug

SEQ ID NO: 1649187 - RNA, 18 nt, Human
auaucugaggaauucugu

SEQ ID NO: 1649188 - RNA, 22 nt, Human
auaucugaaaauguauguguaa

SEQ ID NO: 1649189 - RNA, 13 nt, Human
auaugugaacagu

SEQ ID NO: 1649190 - RNA, 14 nt, Human
auaugucaagccau

SEQ ID NO: 1649191 - RNA, 13 nt, Human
auaugcacacauu

SEQ ID NO: 1649192 - RNA, 23 nt, Human
auaugcaaagcacugacuucuaa

SEQ ID NO: 1649193 - RNA, 16 nt, Human
auaugcaaagcacuga

SEQ ID NO: 1649194 - RNA, 19 nt, Human
uucagccaagaauucuuaa

SEQ ID NO: 1649195 - RNA, 21 nt, Human
uucagcaaaaauauuuuauga

SEQ ID NO: 1649196 - RNA, 17 nt, Human
uucagaucucuaacuuc

SEQ ID NO: 1649197 - RNA, 13 nt, Human
uucacugcuggcu

SEQ ID NO: 1649198 - RNA, 15 nt, Human
uucacugcuggcugc

SEQ ID NO: 1649199 - RNA, 16 nt, Human
uucacugcuggcugcc

SEQ ID NO: 1649200 - RNA, 17 nt, Human
uucacugcuggcugccu

SEQ ID NO: 1649201 - RNA, 18 nt, Human
uucacugcuggcugccuu

SEQ ID NO: 1649202 - RNA, 19 nt, Human
uucacugcuggcugccuua

SEQ ID NO: 1649203 - RNA, 15 nt, Human
uucagaaagaagugg

SEQ ID NO: 1649204 - RNA, 17 nt, Human
auagucaaauuguguga

SEQ ID NO: 1649205 - RNA, 18 nt, Human
auagucaaauugugugaa

SEQ ID NO: 1649206 - RNA, 17 nt, Human
auauaaaugguuaaaag

SEQ ID NO: 1649207 - RNA, 17 nt, Human
auauauaacaaugcugu

SEQ ID NO: 1649208 - RNA, 18 nt, Human
auauauaacaaugcugua

SEQ ID NO: 1649209 - RNA, 19 nt, Human
auauauaacaaugcuguau

SEQ ID NO: 1649210 - RNA, 12 nt, Human
auauaacaaugc

SEQ ID NO: 1649211 - RNA, 15 nt, Human
auauaacaaugcugu

SEQ ID NO: 1649212 - RNA, 17 nt, Human
auauaacaaugcuguau

SEQ ID NO: 1649213 - RNA, 19 nt, Human
auauaagcuuguauuccuu

SEQ ID NO: 1649214 - RNA, 18 nt, Human
auagccugccucuucucu

SEQ ID NO: 1649215 - RNA, 13 nt, Human
auaagauaaaugu

SEQ ID NO: 1649216 - RNA, 17 nt, Human
auaagauaaaugugcug

SEQ ID NO: 1649217 - RNA, 17 nt, Human
auagcuacuaauuuuaa

SEQ ID NO: 1649218 - RNA, 14 nt, Human
auagcuacuaauuu

SEQ ID NO: 1649219 - RNA, 12 nt, Human
auagcugggacu

SEQ ID NO: 1649220 - RNA, 22 nt, Human
auagcucaggugucccugcacu

SEQ ID NO: 1649221 - RNA, 20 nt, Human
auagcucaggugucccugca

SEQ ID NO: 1649222 - RNA, 21 nt, Human
auagcucaggugucccugcac

SEQ ID NO: 1649223 - RNA, 18 nt, Human
auagcuagacuggugacu

SEQ ID NO: 1649224 - RNA, 19 nt, Human
auagcuagacuggugacug

SEQ ID NO: 1649225 - RNA, 23 nt, Human
auagcuagacuggugacugauuc

SEQ ID NO: 1649226 - RNA, 19 nt, Human
auagcucaggugucccugc

SEQ ID NO: 1649227 - RNA, 14 nt, Human
auagcuagacuggu

SEQ ID NO: 1649228 - RNA, 15 nt, Human
auagcuagacuggug

SEQ ID NO: 1649229 - RNA, 16 nt, Human
auagcuagacugguga

SEQ ID NO: 1649230 - RNA, 18 nt, Human
auagcuacuaauuuuaaa

SEQ ID NO: 1649231 - RNA, 17 nt, Human
uuauuuagcaccaggga

SEQ ID NO: 1649232 - RNA, 15 nt, Human
uuauuuaguauuuau

SEQ ID NO: 1649233 - RNA, 17 nt, Human
uuauuuauaaucacuuu

SEQ ID NO: 1649234 - RNA, 16 nt, Human
uuauuuaguuccuuga

SEQ ID NO: 1649235 - RNA, 18 nt, Human
uuauuuaaugaaagacug

SEQ ID NO: 1649236 - RNA, 22 nt, Human
uuauuuaaugaaagacuguaca

SEQ ID NO: 1649237 - RNA, 14 nt, Human
uuauuuaaauuuua

SEQ ID NO: 1649238 - RNA, 23 nt, Human
auagcuggucuuauuuguaaagc

SEQ ID NO: 1649239 - RNA, 22 nt, Human
auagcuggucuuauuuguaaag

SEQ ID NO: 1649240 - RNA, 17 nt, Human
auagcugggacuacagg

SEQ ID NO: 1649241 - RNA, 17 nt, Human
uuauuguuuaaaaucau

SEQ ID NO: 1649242 - RNA, 22 nt, Human
auaggcaccuaccaccacgccc

SEQ ID NO: 1649243 - RNA, 17 nt, Human
auaggcacaggaaacca

SEQ ID NO: 1649244 - RNA, 22 nt, Human
auaggaauugacccacaagaaa

SEQ ID NO: 1649245 - RNA, 22 nt, Human
uucaccauguuggccaggcugc

SEQ ID NO: 1649246 - RNA, 22 nt, Human
uucaccauguuggccaggcugg

SEQ ID NO: 1649247 - RNA, 19 nt, Human
auaggaacuuaaauaaugu

SEQ ID NO: 1649248 - RNA, 21 nt, Human
auaggaauugacccacaagaa

SEQ ID NO: 1649249 - RNA, 13 nt, Human
uucacaguucucu

SEQ ID NO: 1649250 - RNA, 14 nt, Human
uucacauuggaaac

SEQ ID NO: 1649251 - RNA, 22 nt, Human
uucaccacaugugcacaugcac

SEQ ID NO: 1649252 - RNA, 19 nt, Human
uucacauuguauucagagu

SEQ ID NO: 1649253 - RNA, 13 nt, Human
uucacauuggaaa

SEQ ID NO: 1649254 - RNA, 17 nt, Human
uucacauauugauuucc

SEQ ID NO: 1649255 - RNA, 20 nt, Human
uucaagugauucucaugccu

SEQ ID NO: 1649256 - RNA, 22 nt, Human
uucaagugauucucaugccuca

SEQ ID NO: 1649257 - RNA, 16 nt, Human
uucaaggauccugagc

SEQ ID NO: 1649258 - RNA, 18 nt, Human
uucaaggauccugagcca

SEQ ID NO: 1649259 - RNA, 19 nt, Human
uucaaggauccugagccag

SEQ ID NO: 1649260 - RNA, 21 nt, Human
uucaaggauccugagccagau

SEQ ID NO: 1649261 - RNA, 15 nt, Human
uucaaggauccugag

SEQ ID NO: 1649262 - RNA, 16 nt, Human
uucaaaauuguuacaa

SEQ ID NO: 1649263 - RNA, 15 nt, Human
uucaaacauauauaa

SEQ ID NO: 1649264 - RNA, 23 nt, Human
uucugccgcagcccugcagaggg

SEQ ID NO: 1649265 - RNA, 10 nt, Human
uucugggaca

SEQ ID NO: 1649266 - RNA, 11 nt, Human
uucugggacac

SEQ ID NO: 1649267 - RNA, 22 nt, Human
uucugggacacaguucaauucu

SEQ ID NO: 1649268 - RNA, 12 nt, Human
uucuggugugaa

SEQ ID NO: 1649269 - RNA, 14 nt, Human
uucuggugugaacu

SEQ ID NO: 1649270 - RNA, 20 nt, Human
aucauugaaaucuuuuugcu

SEQ ID NO: 1649271 - RNA, 19 nt, Human
aucauugaaaucuuuuugc

SEQ ID NO: 1649272 - RNA, 15 nt, Human
uucugaaagggacgc

SEQ ID NO: 1649273 - RNA, 14 nt, Human
uucugaagaagaug

SEQ ID NO: 1649274 - RNA, 23 nt, Human
uucugcaucagcugcugaaacaa

SEQ ID NO: 1649275 - RNA, 21 nt, Human
uucugaaauuuccugggagcu

SEQ ID NO: 1649276 - RNA, 12 nt, Human
uucugaagaaga

SEQ ID NO: 1649277 - RNA, 13 nt, Human
uucugaagaagau

SEQ ID NO: 1649278 - RNA, 17 nt, Human
aucccaggauguacaag

SEQ ID NO: 1649279 - RNA, 17 nt, Human
auccaggguggugguga

SEQ ID NO: 1649280 - RNA, 15 nt, Human
auccagguucagcuu

SEQ ID NO: 1649281 - RNA, 16 nt, Human
auccagguucagcuug

SEQ ID NO: 1649282 - RNA, 17 nt, Human
aucccauaugccugggc

SEQ ID NO: 1649283 - RNA, 16 nt, Human
aucccauaugccuggg

SEQ ID NO: 1649284 - RNA, 13 nt, Human
aucccucccucca

SEQ ID NO: 1649285 - RNA, 11 nt, Human
aucccucccuc

SEQ ID NO: 1649286 - RNA, 23 nt, Human
aucccucccuccaccucccugca

SEQ ID NO: 1649287 - RNA, 14 nt, Human
aucccucccuccac

SEQ ID NO: 1649288 - RNA, 20 nt, Human
uucucacagcuccaagaauu

SEQ ID NO: 1649289 - RNA, 19 nt, Human
uucucagaaucucaaauaa

SEQ ID NO: 1649290 - RNA, 22 nt, Human
uucucagaaucucaaauaacua

SEQ ID NO: 1649291 - RNA, 23 nt, Human
uucucagaaucucaaauaacuaa

SEQ ID NO: 1649292 - RNA, 13 nt, Human
uucuaggccuggg

SEQ ID NO: 1649293 - RNA, 23 nt, Human
uucuaggacugaauuaugaaacu

SEQ ID NO: 1649294 - RNA, 14 nt, Human
uucucaacuccaaa

SEQ ID NO: 1649295 - RNA, 18 nt, Human
uucucaacuccaaacuga

SEQ ID NO: 1649296 - RNA, 14 nt, Human
aucauucauuuucu

SEQ ID NO: 1649297 - RNA, 22 nt, Human
aucauuaaagccugaguuugcu

SEQ ID NO: 1649298 - RNA, 14 nt, Human
aucauugaaaucuu

SEQ ID NO: 1649299 - RNA, 15 nt, Human
aucauugaaaucuuu

SEQ ID NO: 1649300 - RNA, 23 nt, Human
aucauaguggcuuaaaacaacac

SEQ ID NO: 1649301 - RNA, 15 nt, Human
aucaucaguauugaa

SEQ ID NO: 1649302 - RNA, 19 nt, Human
aucaucaguauugaagcau

SEQ ID NO: 1649303 - RNA, 17 nt, Human
aucaucaguauugaagc

SEQ ID NO: 1649304 - RNA, 16 nt, Human
aucagcacgauuucug

SEQ ID NO: 1649305 - RNA, 15 nt, Human
aucagcacgauuucu

SEQ ID NO: 1649306 - RNA, 18 nt, Human
aucagcacgauuucuguu

SEQ ID NO: 1649307 - RNA, 17 nt, Human
aucagcacgauuucugu

SEQ ID NO: 1649308 - RNA, 15 nt, Human
aucaguauugaagca

SEQ ID NO: 1649309 - RNA, 22 nt, Human
aucaguauugaagcauuuuaua

SEQ ID NO: 1649310 - RNA, 18 nt, Human
auauuuucaugcuguuca

SEQ ID NO: 1649311 - RNA, 21 nt, Human
auauuuucaugcuguucauga

SEQ ID NO: 1649312 - RNA, 19 nt, Human
auauuuucaacgcagcccu

SEQ ID NO: 1649313 - RNA, 20 nt, Human
auauuuucaacgcagcccug

SEQ ID NO: 1649314 - RNA, 15 nt, Human
uuccuucagugccuu

SEQ ID NO: 1649315 - RNA, 11 nt, Human
uuccuucagug

SEQ ID NO: 1649316 - RNA, 14 nt, Human
uuccuucagugccu

SEQ ID NO: 1649317 - RNA, 16 nt, Human
uuccugggagcuuuug

SEQ ID NO: 1649318 - RNA, 15 nt, Human
uuccugggagcuuuu

SEQ ID NO: 1649319 - RNA, 11 nt, Human
uuccucuuucc

SEQ ID NO: 1649320 - RNA, 17 nt, Human
uuccuguucccaugaga

SEQ ID NO: 1649321 - RNA, 17 nt, Human
uuccuaauccucuagga

SEQ ID NO: 1649322 - RNA, 17 nt, Human
auauuuuaugauccagc

SEQ ID NO: 1649323 - RNA, 22 nt, Human
auauuuuaugauccagcagauu

SEQ ID NO: 1649324 - RNA, 12 nt, Human
auauuuuaugau

SEQ ID NO: 1649325 - RNA, 13 nt, Human
auauuuuaugauc

SEQ ID NO: 1649326 - RNA, 14 nt, Human
auauuuuaagacga

SEQ ID NO: 1649327 - RNA, 13 nt, Human
uuccuaauccucu

SEQ ID NO: 1649328 - RNA, 15 nt, Human
uuccuaauccucuag

SEQ ID NO: 1649329 - RNA, 21 nt, Human
uuccuuuuaaaacacuuccau

SEQ ID NO: 1649330 - RNA, 22 nt, Human
uuccuuuuaaaacacuuccaua

SEQ ID NO: 1649331 - RNA, 20 nt, Human
uuccuuuuaaaacacuucca

SEQ ID NO: 1649332 - RNA, 22 nt, Human
aucacggcucacugcagccuca

SEQ ID NO: 1649333 - RNA, 13 nt, Human
auauuuucauucu

SEQ ID NO: 1649334 - RNA, 18 nt, Human
aucaaguauuauaccuuu

SEQ ID NO: 1649335 - RNA, 14 nt, Human
aucaaguauuauac

SEQ ID NO: 1649336 - RNA, 13 nt, Human
aucaaguauuaua

SEQ ID NO: 1649337 - RNA, 21 nt, Human
aucaagaugugacauguuuua

SEQ ID NO: 1649338 - RNA, 14 nt, Human
auauuugaaauauu

SEQ ID NO: 1649339 - RNA, 19 nt, Human
auauuugaaauauugacuu

SEQ ID NO: 1649340 - RNA, 23 nt, Human
auauuugaaauauugacuuuuua

SEQ ID NO: 1649341 - RNA, 12 nt, Human
auauuuuaacuu

SEQ ID NO: 1649342 - RNA, 22 nt, Human
auauuuguaucacaaaucuuaa

SEQ ID NO: 1649343 - RNA, 20 nt, Human
auauuguuuucaguguacau

SEQ ID NO: 1649344 - RNA, 13 nt, Human
auauuugaaauau

SEQ ID NO: 1649345 - RNA, 17 nt, Human
auauugcugauggugca

SEQ ID NO: 1649346 - RNA, 21 nt, Human
auauugcugauggugcaauga

SEQ ID NO: 1649347 - RNA, 22 nt, Human
auauucucacagcuccaagaau

SEQ ID NO: 1649348 - RNA, 23 nt, Human
auauucucacagcuccaagaauu

SEQ ID NO: 1649349 - RNA, 16 nt, Human
auauucuguuggccag

SEQ ID NO: 1649350 - RNA, 15 nt, Human
auauugauccagaaa

SEQ ID NO: 1649351 - RNA, 22 nt, Human
auauugauccagaaagaaaacu

SEQ ID NO: 1649352 - RNA, 22 nt, Human
auauugauuuccguuaaaauac

SEQ ID NO: 1649353 - RNA, 21 nt, Human
auauugauuuccguuaaaaua

SEQ ID NO: 1649354 - RNA, 19 nt, Human
auauugauuuccguuaaaa

SEQ ID NO: 1649355 - RNA, 15 nt, Human
auauuaaagccaugu

SEQ ID NO: 1649356 - RNA, 18 nt, Human
auauuaaagccauguuua

SEQ ID NO: 1649357 - RNA, 23 nt, Human
auauuaaagccauguuuauuaca

SEQ ID NO: 1649358 - RNA, 24 nt, Human
auauuaagaaagacuaucuaaaug

SEQ ID NO: 1649359 - RNA, 22 nt, Human
auauuaaggaagacaaugugaa

SEQ ID NO: 1649360 - RNA, 20 nt, Human
auauguuuuaagaggcaggg

SEQ ID NO: 1649361 - RNA, 18 nt, Human
auauguuuuaagaggcag

SEQ ID NO: 1649362 - RNA, 15 nt, Human
agugaggcucugccc

SEQ ID NO: 1649363 - RNA, 14 nt, Human
agugaggcucugcc

SEQ ID NO: 1649364 - RNA, 16 nt, Human
agugaggcucugcccu

SEQ ID NO: 1649365 - RNA, 17 nt, Human
agugaggcucugcccuu

SEQ ID NO: 1649366 - RNA, 14 nt, Human
agugagggauuauc

SEQ ID NO: 1649367 - RNA, 21 nt, Human
agugaggcucugcccuugguu

SEQ ID NO: 1649368 - RNA, 19 nt, Human
agugaggcucugcccuugg

SEQ ID NO: 1649369 - RNA, 20 nt, Human
agugaggcucugcccuuggu

SEQ ID NO: 1649370 - RNA, 15 nt, Human
agugagucgaggaca

SEQ ID NO: 1649371 - RNA, 21 nt, Human
agugaguugauagcacagacc

SEQ ID NO: 1649372 - RNA, 21 nt, Human
ugugcccccauguaagcaccc

SEQ ID NO: 1649373 - RNA, 21 nt, Human
uguggaguucaucuugaauug

SEQ ID NO: 1649374 - RNA, 18 nt, Human
ugugcugggguuaucuga

SEQ ID NO: 1649375 - RNA, 17 nt, Human
uguggaguucaucuuga

SEQ ID NO: 1649376 - RNA, 20 nt, Human
ugugccagauuuaugcauau

SEQ ID NO: 1649377 - RNA, 20 nt, Human
ugugccagguuuuuggucug

SEQ ID NO: 1649378 - RNA, 12 nt, Human
ugugccaugugc

SEQ ID NO: 1649379 - RNA, 16 nt, Human
ugugccaugugccagg

SEQ ID NO: 1649380 - RNA, 18 nt, Human
ugugccagauuuaugcau

SEQ ID NO: 1649381 - RNA, 15 nt, Human
agugaaagaaaauaa

SEQ ID NO: 1649382 - RNA, 16 nt, Human
agugaacaaauuuaca

SEQ ID NO: 1649383 - RNA, 20 nt, Human
agugaacaaauuuacagaga

SEQ ID NO: 1649384 - RNA, 18 nt, Human
ugugaugagaggaaauca

SEQ ID NO: 1649385 - RNA, 19 nt, Human
ugugauggggcccugccuc

SEQ ID NO: 1649386 - RNA, 20 nt, Human
ugugauggggcccugccucc

SEQ ID NO: 1649387 - RNA, 15 nt, Human
agucucuucuccacu

SEQ ID NO: 1649388 - RNA, 16 nt, Human
agucucuucuccacug

SEQ ID NO: 1649389 - RNA, 18 nt, Human
agucucuucuccacugga

SEQ ID NO: 1649390 - RNA, 17 nt, Human
agucucuucuccacugg

SEQ ID NO: 1649391 - RNA, 14 nt, Human
agucuuuguacaga

SEQ ID NO: 1649392 - RNA, 13 nt, Human
agugaaacugcuu

SEQ ID NO: 1649393 - RNA, 21 nt, Human
agugaaacugcuuguuuccua

SEQ ID NO: 1649394 - RNA, 24 nt, Human
agugaaacugcuuguuuccuagca

SEQ ID NO: 1649395 - RNA, 13 nt, Human
agucucuucucca

SEQ ID NO: 1649396 - RNA, 14 nt, Human
agucucuucuccac

SEQ ID NO: 1649397 - RNA, 15 nt, Human
ugugacugaauuucu

SEQ ID NO: 1649398 - RNA, 16 nt, Human
ugugacugaauuucuu

SEQ ID NO: 1649399 - RNA, 15 nt, Human
ugugagaugcuagaa

SEQ ID NO: 1649400 - RNA, 19 nt, Human
ugugagaugcuagaacucc

SEQ ID NO: 1649401 - RNA, 22 nt, Human
ugugagaugcuagaacucccuu

SEQ ID NO: 1649402 - RNA, 22 nt, Human
agucucaggaaaucaaauaugc

SEQ ID NO: 1649403 - RNA, 14 nt, Human
ugugaacuugaaau

SEQ ID NO: 1649404 - RNA, 15 nt, Human
ugugaacuugaaauu

SEQ ID NO: 1649405 - RNA, 16 nt, Human
ugugaacuugaaauuu

SEQ ID NO: 1649406 - RNA, 12 nt, Human
ugugaacuugaa

SEQ ID NO: 1649407 - RNA, 20 nt, Human
ugugaacaguuguguuugaa

SEQ ID NO: 1649408 - RNA, 19 nt, Human
ugugaaccaccacacccag

SEQ ID NO: 1649409 - RNA, 20 nt, Human
ugugaaccaccacacccagc

SEQ ID NO: 1649410 - RNA, 21 nt, Human
ugugaaccaccacacccagcc

SEQ ID NO: 1649411 - RNA, 14 nt, Human
ugugaagagaacca

SEQ ID NO: 1649412 - RNA, 12 nt, Human
ugugaaauuauu

SEQ ID NO: 1649413 - RNA, 15 nt, Human
ugugaaaggaaagag

SEQ ID NO: 1649414 - RNA, 18 nt, Human
ugugaaaggaaagaggcu

SEQ ID NO: 1649415 - RNA, 21 nt, Human
ugugaaaggaaagagggaggu

SEQ ID NO: 1649416 - RNA, 14 nt, Human
uguuacaaauugua

SEQ ID NO: 1649417 - RNA, 17 nt, Human
aguggugcgaucugggu

SEQ ID NO: 1649418 - RNA, 23 nt, Human
aguggugguuuucuguucuuucu

SEQ ID NO: 1649419 - RNA, 21 nt, Human
aguggugguuuucuguucuuu

SEQ ID NO: 1649420 - RNA, 20 nt, Human
aguggugguuuucuguucuu

SEQ ID NO: 1649421 - RNA, 19 nt, Human
aguggugguuuucuguucu

SEQ ID NO: 1649422 - RNA, 18 nt, Human
aguggugguuuucuguuc

SEQ ID NO: 1649423 - RNA, 17 nt, Human
aguggugguuuucuguu

SEQ ID NO: 1649424 - RNA, 21 nt, Human
agugguggugaacagaacaaa

SEQ ID NO: 1649425 - RNA, 16 nt, Human
agugugguguuuccug

SEQ ID NO: 1649426 - RNA, 20 nt, Human
agugugccugaagucccaga

SEQ ID NO: 1649427 - RNA, 17 nt, Human
agugugguguuuccugg

SEQ ID NO: 1649428 - RNA, 19 nt, Human
agugugguguuuccuggca

SEQ ID NO: 1649429 - RNA, 20 nt, Human
agugugguguuuccuggcac

SEQ ID NO: 1649430 - RNA, 15 nt, Human
uguucugugauauaa

SEQ ID NO: 1649431 - RNA, 18 nt, Human
uguucugugauauaagug

SEQ ID NO: 1649432 - RNA, 13 nt, Human
uguugcccaggca

SEQ ID NO: 1649433 - RNA, 12 nt, Human
uguugcccaggc

SEQ ID NO: 1649434 - RNA, 15 nt, Human
uguugcccaggcagg

SEQ ID NO: 1649435 - RNA, 16 nt, Human
uguugcccaggcaggu

SEQ ID NO: 1649436 - RNA, 17 nt, Human
uguugcccaggcagguc

SEQ ID NO: 1649437 - RNA, 18 nt, Human
uguugcccaggcaggucu

SEQ ID NO: 1649438 - RNA, 16 nt, Human
uguucugggacacagu

SEQ ID NO: 1649439 - RNA, 14 nt, Human
uguuccuagugaaa

SEQ ID NO: 1649440 - RNA, 18 nt, Human
uguuccuagugaaagagg

SEQ ID NO: 1649441 - RNA, 20 nt, Human
uguuccacaaguuaaauaaa

SEQ ID NO: 1649442 - RNA, 14 nt, Human
uguuauauaaaugg

SEQ ID NO: 1649443 - RNA, 13 nt, Human
uguuauauaaaug

SEQ ID NO: 1649444 - RNA, 15 nt, Human
uguuauaaucuuuca

SEQ ID NO: 1649445 - RNA, 20 nt, Human
agugugucuuagugugugca

SEQ ID NO: 1649446 - RNA, 11 nt, Human
ugugugugugc

SEQ ID NO: 1649447 - RNA, 19 nt, Human
uguguguuuauugucaaag

SEQ ID NO: 1649448 - RNA, 23 nt, Human
uguguguuuauugucaaaguggu

SEQ ID NO: 1649449 - RNA, 20 nt, Human
ugugugaaagguacuucaaa

SEQ ID NO: 1649450 - RNA, 19 nt, Human
ugugucuuuaaaugcugcu

SEQ ID NO: 1649451 - RNA, 21 nt, Human
ugugucuugcaauggcagccu

SEQ ID NO: 1649452 - RNA, 21 nt, Human
ugugucucuugguccugcugc

SEQ ID NO: 1649453 - RNA, 22 nt, Human
ugugucucuugguccugcugca

SEQ ID NO: 1649454 - RNA, 17 nt, Human
ugugucucuugguccug

SEQ ID NO: 1649455 - RNA, 20 nt, Human
ugugucucuugguccugcug

SEQ ID NO: 1649456 - RNA, 13 nt, Human
uguguaaguagau

SEQ ID NO: 1649457 - RNA, 13 nt, Human
uguguugaagagg

SEQ ID NO: 1649458 - RNA, 13 nt, Human
agugcugcauuua

SEQ ID NO: 1649459 - RNA, 12 nt, Human
agugcugcauuu

SEQ ID NO: 1649460 - RNA, 19 nt, Human
agugaguuggguguauugu

SEQ ID NO: 1649461 - RNA, 20 nt, Human
agugaguuggguguauugug

SEQ ID NO: 1649462 - RNA, 22 nt, Human
agugaguugauagcacagaccc

SEQ ID NO: 1649463 - RNA, 23 nt, Human
agugaguugauagcacagacccu

SEQ ID NO: 1649464 - RNA, 19 nt, Human
agugcugcauuuaaaagau

SEQ ID NO: 1649465 - RNA, 20 nt, Human
agugcugggauuacaggugu

SEQ ID NO: 1649466 - RNA, 17 nt, Human
agugcugcauuuaaaag

SEQ ID NO: 1649467 - RNA, 16 nt, Human
agugcugcauuuaaaa

SEQ ID NO: 1649468 - RNA, 21 nt, Human
agugcugggauuacaggugug

SEQ ID NO: 1649469 - RNA, 18 nt, Human
uguguaagacaaaaagcu

SEQ ID NO: 1649470 - RNA, 20 nt, Human
ugugguguuuccuggcacug

SEQ ID NO: 1649471 - RNA, 14 nt, Human
ugugguguuuccug

SEQ ID NO: 1649472 - RNA, 16 nt, Human
ugugguguuuccuggc

SEQ ID NO: 1649473 - RNA, 16 nt, Human
uguggucccaccccac

SEQ ID NO: 1649474 - RNA, 13 nt, Human
uguggucccaccc

SEQ ID NO: 1649475 - RNA, 15 nt, Human
uguggucccacccca

SEQ ID NO: 1649476 - RNA, 21 nt, Human
uguggguuucuaaagcugcca

SEQ ID NO: 1649477 - RNA, 23 nt, Human
uguggguuucuaaagcugccagc

SEQ ID NO: 1649478 - RNA, 20 nt, Human
uguggucacaggaaguagag

SEQ ID NO: 1649479 - RNA, 14 nt, Human
uuaacaacagcugg

SEQ ID NO: 1649480 - RNA, 13 nt, Human
uuaaauaauguga

SEQ ID NO: 1649481 - RNA, 16 nt, Human
uuaaauaauaaagauc

SEQ ID NO: 1649482 - RNA, 13 nt, Human
aguuuauaaaaga

SEQ ID NO: 1649483 - RNA, 21 nt, Human
aguuuauaaaagacugucuua

SEQ ID NO: 1649484 - RNA, 22 nt, Human
uuaaaggaagguucugguguga

SEQ ID NO: 1649485 - RNA, 20 nt, Human
uuaaaggaagguucuggugu

SEQ ID NO: 1649486 - RNA, 15 nt, Human
aguuuaauauuaaag

SEQ ID NO: 1649487 - RNA, 16 nt, Human
aguuuaauauuaaagc

SEQ ID NO: 1649488 - RNA, 18 nt, Human
aguuuaauauuaaagcca

SEQ ID NO: 1649489 - RNA, 19 nt, Human
aguuuaauauuaaagccau

SEQ ID NO: 1649490 - RNA, 20 nt, Human
aguuuaauauuaaagccaug

SEQ ID NO: 1649491 - RNA, 17 nt, Human
aguuggguguauugugc

SEQ ID NO: 1649492 - RNA, 20 nt, Human
aguuggguguauugugcgcu

SEQ ID NO: 1649493 - RNA, 18 nt, Human
aguuggucccccuuccau

SEQ ID NO: 1649494 - RNA, 21 nt, Human
aguuguuugauucagacagcu

SEQ ID NO: 1649495 - RNA, 23 nt, Human
aguuguuugauucagacagcugc

SEQ ID NO: 1649496 - RNA, 16 nt, Human
aguuggcuaggacccc

SEQ ID NO: 1649497 - RNA, 16 nt, Human
aguuggguguauugug

SEQ ID NO: 1649498 - RNA, 21 nt, Human
aguuggguggaugccuggugg

SEQ ID NO: 1649499 - RNA, 13 nt, Human
aguuggcuucuaa

SEQ ID NO: 1649500 - RNA, 22 nt, Human
aguugccuaaauccauuuggaa

SEQ ID NO: 1649501 - RNA, 23 nt, Human
aguugccuaaauccauuuggaaa

SEQ ID NO: 1649502 - RNA, 22 nt, Human
aguugcauagguuuaauaauuu

SEQ ID NO: 1649503 - RNA, 14 nt, Human
aguucugguuccua

SEQ ID NO: 1649504 - RNA, 14 nt, Human
uguuuugcaagcca

SEQ ID NO: 1649505 - RNA, 21 nt, Human
aguucugcagauaaacaguag

SEQ ID NO: 1649506 - RNA, 16 nt, Human
aguucugcagauaaac

SEQ ID NO: 1649507 - RNA, 19 nt, Human
uguuuggaccaaaaaccag

SEQ ID NO: 1649508 - RNA, 13 nt, Human
uguuuggagacag

SEQ ID NO: 1649509 - RNA, 18 nt, Human
uguuuuaugacuucauua

SEQ ID NO: 1649510 - RNA, 21 nt, Human
uguuuuauuuaaccucuaaau

SEQ ID NO: 1649511 - RNA, 21 nt, Human
uguuuuauuuuaauucaguug

SEQ ID NO: 1649512 - RNA, 20 nt, Human
uguuuuccaugaguccccug

SEQ ID NO: 1649513 - RNA, 19 nt, Human
uguuuucauuaucucaaaa

SEQ ID NO: 1649514 - RNA, 23 nt, Human
uguuuagucuugucucagauuuu

SEQ ID NO: 1649515 - RNA, 22 nt, Human
uguuuagucuugucucagauuu

SEQ ID NO: 1649516 - RNA, 19 nt, Human
uguugccuugcauaauggu

SEQ ID NO: 1649517 - RNA, 19 nt, Human
uguugcccaggcaggucuu

SEQ ID NO: 1649518 - RNA, 18 nt, Human
uguuuauuacaguauaau

SEQ ID NO: 1649519 - RNA, 14 nt, Human
uguuuauuacagua

SEQ ID NO: 1649520 - RNA, 19 nt, Human
uguuuauugucaaaguggu

SEQ ID NO: 1649521 - RNA, 17 nt, Human
uguuugauucagacagc

SEQ ID NO: 1649522 - RNA, 22 nt, Human
uguuugauucagacagcugccu

SEQ ID NO: 1649523 - RNA, 22 nt, Human
uguuugagguuuuuaagccuua

SEQ ID NO: 1649524 - RNA, 14 nt, Human
uguuugagaaauua

SEQ ID NO: 1649525 - RNA, 18 nt, Human
uguuucuuuguaaugaaa

SEQ ID NO: 1649526 - RNA, 19 nt, Human
uguuucuuuguaaugaaaa

SEQ ID NO: 1649527 - RNA, 20 nt, Human
auaaaucugugaacuugaaa

SEQ ID NO: 1649528 - RNA, 21 nt, Human
auaaaucugugaacuugaaau

SEQ ID NO: 1649529 - RNA, 22 nt, Human
auaaaucugugaacuugaaauu

SEQ ID NO: 1649530 - RNA, 16 nt, Human
auaaauagcuagacug

SEQ ID NO: 1649531 - RNA, 18 nt, Human
auaaauagcuagacuggu

SEQ ID NO: 1649532 - RNA, 21 nt, Human
auaaauagcuagacuggugac

SEQ ID NO: 1649533 - RNA, 18 nt, Human
auaaacacucuugaaaaa

SEQ ID NO: 1649534 - RNA, 18 nt, Human
uuacaguauaauuaacau

SEQ ID NO: 1649535 - RNA, 19 nt, Human
uuacaguauaauuaacaug

SEQ ID NO: 1649536 - RNA, 20 nt, Human
uuacaguauaauuaacaugu

SEQ ID NO: 1649537 - RNA, 16 nt, Human
uuacaguauaauuaac

SEQ ID NO: 1649538 - RNA, 17 nt, Human
uuacaguauaauuaaca

SEQ ID NO: 1649539 - RNA, 13 nt, Human
uuacaguauaauu

SEQ ID NO: 1649540 - RNA, 13 nt, Human
uuacagcugccug

SEQ ID NO: 1649541 - RNA, 14 nt, Human
uuacagcugccugc

SEQ ID NO: 1649542 - RNA, 14 nt, Human
uuacaggaaguacu

SEQ ID NO: 1649543 - RNA, 22 nt, Human
auaaaugguuaaaagagguuuu

SEQ ID NO: 1649544 - RNA, 16 nt, Human
auaaaugguuaaaaga

SEQ ID NO: 1649545 - RNA, 13 nt, Human
uuagaaccuuucu

SEQ ID NO: 1649546 - RNA, 11 nt, Human
uuagacagagu

SEQ ID NO: 1649547 - RNA, 11 nt, Human
uuagaaauaua

SEQ ID NO: 1649548 - RNA, 12 nt, Human
uuagaaauauaa

SEQ ID NO: 1649549 - RNA, 14 nt, Human
uuagaaauauaauu

SEQ ID NO: 1649550 - RNA, 15 nt, Human
uuacuguaagaaaau

SEQ ID NO: 1649551 - RNA, 23 nt, Human
uuacucagaauucucuaguuuga

SEQ ID NO: 1649552 - RNA, 18 nt, Human
uuacucagaauucucuag

SEQ ID NO: 1649553 - RNA, 14 nt, Human
uuaccuuacagaag

SEQ ID NO: 1649554 - RNA, 12 nt, Human
uuaccugggaaa

SEQ ID NO: 1649555 - RNA, 16 nt, Human
auaaaauaauuuuuau

SEQ ID NO: 1649556 - RNA, 21 nt, Human
auaaaauaauuuuuauauuug

SEQ ID NO: 1649557 - RNA, 22 nt, Human
auaaaauaauuuuuauauuuga

SEQ ID NO: 1649558 - RNA, 18 nt, Human
auaaaauccauacauuug

SEQ ID NO: 1649559 - RNA, 19 nt, Human
auaaaauccauacauuugu

SEQ ID NO: 1649560 - RNA, 22 nt, Human
uuaagugcugcauuuaaaagau

SEQ ID NO: 1649561 - RNA, 14 nt, Human
uuaagugcugcauu

SEQ ID NO: 1649562 - RNA, 17 nt, Human
uuaaguacuauguauca

SEQ ID NO: 1649563 - RNA, 18 nt, Human
uuaaguaaugauaacugg

SEQ ID NO: 1649564 - RNA, 21 nt, Human
uuaagucuguuuuaugacuuc

SEQ ID NO: 1649565 - RNA, 17 nt, Human
uuaaguaucugacaucu

SEQ ID NO: 1649566 - RNA, 18 nt, Human
uuaagucuguuuuaugac

SEQ ID NO: 1649567 - RNA, 20 nt, Human
uuaagucuguuuuaugacuu

SEQ ID NO: 1649568 - RNA, 18 nt, Human
uuaaguaaggaauuuuau

SEQ ID NO: 1649569 - RNA, 15 nt, Human
uuaagaggcaggguc

SEQ ID NO: 1649570 - RNA, 16 nt, Human
uuaagaggcagggucu

SEQ ID NO: 1649571 - RNA, 13 nt, Human
uuaagaggcaggg

SEQ ID NO: 1649572 - RNA, 22 nt, Human
uuaagaagacugcauuauauuu

SEQ ID NO: 1649573 - RNA, 20 nt, Human
auaaaauuuuuaaucuuuaa

SEQ ID NO: 1649574 - RNA, 22 nt, Human
auaaacaagaccacguuucuaa

SEQ ID NO: 1649575 - RNA, 15 nt, Human
auaaacaagaccacg

SEQ ID NO: 1649576 - RNA, 23 nt, Human
auaaacaagaccacguuucuaaa

SEQ ID NO: 1649577 - RNA, 16 nt, Human
auaaaauuaaagcuga

SEQ ID NO: 1649578 - RNA, 19 nt, Human
uuaauuuuuuugagacaga

SEQ ID NO: 1649579 - RNA, 13 nt, Human
uuaauaaacacuc

SEQ ID NO: 1649580 - RNA, 17 nt, Human
uuaauaaacacucuuga

SEQ ID NO: 1649581 - RNA, 23 nt, Human
uuaaugaaagacuguacaaagua

SEQ ID NO: 1649582 - RNA, 20 nt, Human
uuaaugaaagacuguacaaa

SEQ ID NO: 1649583 - RNA, 15 nt, Human
uuaauucuuagcuca

SEQ ID NO: 1649584 - RNA, 17 nt, Human
agggcauggccaggugg

SEQ ID NO: 1649585 - RNA, 16 nt, Human
agggcacugguggccc

SEQ ID NO: 1649586 - RNA, 14 nt, Human
agggcacugguggc

SEQ ID NO: 1649587 - RNA, 17 nt, Human
agggagggcuccagaca

SEQ ID NO: 1649588 - RNA, 16 nt, Human
agggagggcuccagac

SEQ ID NO: 1649589 - RNA, 14 nt, Human
agggagggcuccag

SEQ ID NO: 1649590 - RNA, 15 nt, Human
agggagggcuccaga

SEQ ID NO: 1649591 - RNA, 19 nt, Human
agggcucagcggggacagc

SEQ ID NO: 1649592 - RNA, 20 nt, Human
agggcucagcggggacagcu

SEQ ID NO: 1649593 - RNA, 22 nt, Human
agggcucagcggggacagcucc

SEQ ID NO: 1649594 - RNA, 23 nt, Human
agggcucagcggggacagcuccu

SEQ ID NO: 1649595 - RNA, 12 nt, Human
ugggcagaagga

SEQ ID NO: 1649596 - RNA, 11 nt, Human
ugggcagagca

SEQ ID NO: 1649597 - RNA, 12 nt, Human
ugggcagagcag

SEQ ID NO: 1649598 - RNA, 18 nt, Human
ugggccaggagccuccug

SEQ ID NO: 1649599 - RNA, 13 nt, Human
ugggcagagcaga

SEQ ID NO: 1649600 - RNA, 20 nt, Human
ugggaggaucucuugagccu

SEQ ID NO: 1649601 - RNA, 21 nt, Human
ugggaggaucucuugagccug

SEQ ID NO: 1649602 - RNA, 22 nt, Human
ugggaggaucucuugagccugg

SEQ ID NO: 1649603 - RNA, 19 nt, Human
ugggaggccaaggugggag

SEQ ID NO: 1649604 - RNA, 20 nt, Human
ugggaggccaaggugggagg

SEQ ID NO: 1649605 - RNA, 18 nt, Human
ugggccccaguuguauuu

SEQ ID NO: 1649606 - RNA, 22 nt, Human
ugggccccaguuguauuuauuu

SEQ ID NO: 1649607 - RNA, 16 nt, Human
ugggcccccaaaugga

SEQ ID NO: 1649608 - RNA, 21 nt, Human
ugggcccccaaauggaaaugg

SEQ ID NO: 1649609 - RNA, 20 nt, Human
ugggccccugccucucugca

SEQ ID NO: 1649610 - RNA, 15 nt, Human
ugggccccugccucu

SEQ ID NO: 1649611 - RNA, 19 nt, Human
ugggccccugccucucugc

SEQ ID NO: 1649612 - RNA, 15 nt, Human
agggagggagggcuc

SEQ ID NO: 1649613 - RNA, 17 nt, Human
agggagggagggcucca

SEQ ID NO: 1649614 - RNA, 21 nt, Human
agggaauuucuucaacucccu

SEQ ID NO: 1649615 - RNA, 13 nt, Human
agggaaggggaca

SEQ ID NO: 1649616 - RNA, 22 nt, Human
agggaaggggacaaggacuagg

SEQ ID NO: 1649617 - RNA, 22 nt, Human
agggaaggauacaaaagcaugu

SEQ ID NO: 1649618 - RNA, 21 nt, Human
aggcccggcuccaggcuccuu

SEQ ID NO: 1649619 - RNA, 18 nt, Human
aggcccggcuccaggcuc

SEQ ID NO: 1649620 - RNA, 20 nt, Human
aggcccggcuccaggcuccu

SEQ ID NO: 1649621 - RNA, 19 nt, Human
ugggagagaagagaaugca

SEQ ID NO: 1649622 - RNA, 21 nt, Human
ugggagagaagagaaugcaca

SEQ ID NO: 1649623 - RNA, 18 nt, Human
ugggagacugcugaguca

SEQ ID NO: 1649624 - RNA, 16 nt, Human
ugggagagccuuccag

SEQ ID NO: 1649625 - RNA, 20 nt, Human
ugggacucaaugcacugaca

SEQ ID NO: 1649626 - RNA, 14 nt, Human
ugggacuacaggca

SEQ ID NO: 1649627 - RNA, 15 nt, Human
ugggacuacaggcac

SEQ ID NO: 1649628 - RNA, 16 nt, Human
ugggacuacaggcacc

SEQ ID NO: 1649629 - RNA, 23 nt, Human
agggaggacgcucucuggccuuc

SEQ ID NO: 1649630 - RNA, 21 nt, Human
agggaggacgcucucuggccu

SEQ ID NO: 1649631 - RNA, 22 nt, Human
agggaggacgcucucuggccuu

SEQ ID NO: 1649632 - RNA, 21 nt, Human
aggggaauaaacuguugaguc

SEQ ID NO: 1649633 - RNA, 13 nt, Human
aggggaauguuug

SEQ ID NO: 1649634 - RNA, 18 nt, Human
aggggaaaaucagccugc

SEQ ID NO: 1649635 - RNA, 22 nt, Human
aggggaaaaucagccugcucca

SEQ ID NO: 1649636 - RNA, 14 nt, Human
aggggaacagacug

SEQ ID NO: 1649637 - RNA, 13 nt, Human
aggggaaaagagg

SEQ ID NO: 1649638 - RNA, 17 nt, Human
ugggguacccacugcuc

SEQ ID NO: 1649639 - RNA, 18 nt, Human
ugggguacccacugcucu

SEQ ID NO: 1649640 - RNA, 19 nt, Human
ugggguacccacugcucug

SEQ ID NO: 1649641 - RNA, 20 nt, Human
ugggguacccacugcucugg

SEQ ID NO: 1649642 - RNA, 13 nt, Human
uggggucacucug

SEQ ID NO: 1649643 - RNA, 14 nt, Human
uggggucacucugg

SEQ ID NO: 1649644 - RNA, 16 nt, Human
uggggucacucuggca

SEQ ID NO: 1649645 - RNA, 22 nt, Human
uggggucacucuggcagcucag

SEQ ID NO: 1649646 - RNA, 16 nt, Human
uggggaccucaggccu

SEQ ID NO: 1649647 - RNA, 17 nt, Human
uggggaccucaggccug

SEQ ID NO: 1649648 - RNA, 12 nt, Human
agggcuccagac

SEQ ID NO: 1649649 - RNA, 15 nt, Human
agggcuccagacaca

SEQ ID NO: 1649650 - RNA, 14 nt, Human
uggggaccucaggc

SEQ ID NO: 1649651 - RNA, 15 nt, Human
uggggaccucaggcc

SEQ ID NO: 1649652 - RNA, 23 nt, Human
uggggcugcaccggcuggccugg

SEQ ID NO: 1649653 - RNA, 12 nt, Human
uggggcccugcc

SEQ ID NO: 1649654 - RNA, 15 nt, Human
uggggaggggcugug

SEQ ID NO: 1649655 - RNA, 16 nt, Human
ugggucgcccuggacu

SEQ ID NO: 1649656 - RNA, 18 nt, Human
ugggucgcccuggacugu

SEQ ID NO: 1649657 - RNA, 16 nt, Human
aggguggugaccucug

SEQ ID NO: 1649658 - RNA, 17 nt, Human
ugguagcuuuucccuuc

SEQ ID NO: 1649659 - RNA, 20 nt, Human
ugguagagugugccugaagu

SEQ ID NO: 1649660 - RNA, 17 nt, Human
uggguggcaccagcagc

SEQ ID NO: 1649661 - RNA, 20 nt, Human
uggguggcaccagcagccug

SEQ ID NO: 1649662 - RNA, 21 nt, Human
uggguggcaccagcagccugg

SEQ ID NO: 1649663 - RNA, 22 nt, Human
uggguggcaccagcagccugga

SEQ ID NO: 1649664 - RNA, 21 nt, Human
agggucucacucugucgccca

SEQ ID NO: 1649665 - RNA, 16 nt, Human
agggucucacucuguc

SEQ ID NO: 1649666 - RNA, 14 nt, Human
agggucucacucug

SEQ ID NO: 1649667 - RNA, 15 nt, Human
agggucucacucugu

SEQ ID NO: 1649668 - RNA, 15 nt, Human
aggguaaggcugugg

SEQ ID NO: 1649669 - RNA, 20 nt, Human
aggggguggccucccaacuc

SEQ ID NO: 1649670 - RNA, 18 nt, Human
aggggugggacacccugu

SEQ ID NO: 1649671 - RNA, 19 nt, Human
aggggaauguuugccucug

SEQ ID NO: 1649672 - RNA, 20 nt, Human
aggggaauguuugccucugc

SEQ ID NO: 1649673 - RNA, 21 nt, Human
aggggaauguuugccucugcc

SEQ ID NO: 1649674 - RNA, 16 nt, Human
aggggaauugaggaca

SEQ ID NO: 1649675 - RNA, 18 nt, Human
aggggagcaugggaagug

SEQ ID NO: 1649676 - RNA, 11 nt, Human
aguagagacag

SEQ ID NO: 1649677 - RNA, 17 nt, Human
uguaggcauaaagucag

SEQ ID NO: 1649678 - RNA, 20 nt, Human
uguaggcauaaagucagggg

SEQ ID NO: 1649679 - RNA, 21 nt, Human
aguagaagucuuagauguaua

SEQ ID NO: 1649680 - RNA, 19 nt, Human
aguagaagucuuagaugua

SEQ ID NO: 1649681 - RNA, 20 nt, Human
aguagaagucuuagauguau

SEQ ID NO: 1649682 - RNA, 22 nt, Human
uguacuugcucuugaugccugg

SEQ ID NO: 1649683 - RNA, 23 nt, Human
uguacuugcucuugaugccuggc

SEQ ID NO: 1649684 - RNA, 16 nt, Human
uguagagccagggucu

SEQ ID NO: 1649685 - RNA, 18 nt, Human
uguagagccagggucuca

SEQ ID NO: 1649686 - RNA, 14 nt, Human
uguagagcuucugg

SEQ ID NO: 1649687 - RNA, 16 nt, Human
uguagaggagaaacug

SEQ ID NO: 1649688 - RNA, 13 nt, Human
aguaaaauccaca

SEQ ID NO: 1649689 - RNA, 13 nt, Human
agguuuuucuuaa

SEQ ID NO: 1649690 - RNA, 18 nt, Human
aguaaugauaacuggaaa

SEQ ID NO: 1649691 - RNA, 20 nt, Human
aguaaugauaacuggaaacu

SEQ ID NO: 1649692 - RNA, 17 nt, Human
aguaauaugcacacauu

SEQ ID NO: 1649693 - RNA, 17 nt, Human
aguaaugauaacuggaa

SEQ ID NO: 1649694 - RNA, 15 nt, Human
aguaauaugcacaca

SEQ ID NO: 1649695 - RNA, 14 nt, Human
aguaauaugcacac

SEQ ID NO: 1649696 - RNA, 17 nt, Human
aguauuucuaugaaaua

SEQ ID NO: 1649697 - RNA, 16 nt, Human
aguauuucuaugaaau

SEQ ID NO: 1649698 - RNA, 18 nt, Human
aguauuucuaugaaauau

SEQ ID NO: 1649699 - RNA, 14 nt, Human
aguauugaagcauu

SEQ ID NO: 1649700 - RNA, 15 nt, Human
aguauugaagcauuu

SEQ ID NO: 1649701 - RNA, 18 nt, Human
aguauugaagcauuuuau

SEQ ID NO: 1649702 - RNA, 20 nt, Human
aguauugaagcauuuuauaa

SEQ ID NO: 1649703 - RNA, 21 nt, Human
aguauugaagcauuuuauaaa

SEQ ID NO: 1649704 - RNA, 19 nt, Human
agucaccccggccaccugc

SEQ ID NO: 1649705 - RNA, 15 nt, Human
agucacacagugagu

SEQ ID NO: 1649706 - RNA, 23 nt, Human
agucacacagugagucgaggaca

SEQ ID NO: 1649707 - RNA, 14 nt, Human
agucaccucaugga

SEQ ID NO: 1649708 - RNA, 15 nt, Human
agucaccucauggaa

SEQ ID NO: 1649709 - RNA, 17 nt, Human
agucaccucauggaauu

SEQ ID NO: 1649710 - RNA, 15 nt, Human
aguaugguggcuggg

SEQ ID NO: 1649711 - RNA, 16 nt, Human
aguaugguggcugggu

SEQ ID NO: 1649712 - RNA, 15 nt, Human
aguauuacuucugcu

SEQ ID NO: 1649713 - RNA, 17 nt, Human
aguaugguggcuggguu

SEQ ID NO: 1649714 - RNA, 18 nt, Human
aguauuacuucugcuaca

SEQ ID NO: 1649715 - RNA, 18 nt, Human
aguauuagaauaccacag

SEQ ID NO: 1649716 - RNA, 14 nt, Human
ugucaauuacagga

SEQ ID NO: 1649717 - RNA, 15 nt, Human
ugucaauuacaggaa

SEQ ID NO: 1649718 - RNA, 19 nt, Human
ugucaauuacaggaaguac

SEQ ID NO: 1649719 - RNA, 17 nt, Human
ugucaauuacaggaagu

SEQ ID NO: 1649720 - RNA, 14 nt, Human
uguaguguuggaga

SEQ ID NO: 1649721 - RNA, 15 nt, Human
uguaguguuggagaa

SEQ ID NO: 1649722 - RNA, 17 nt, Human
uguaucaaugaguaaca

SEQ ID NO: 1649723 - RNA, 15 nt, Human
uguaucacaaaucuu

SEQ ID NO: 1649724 - RNA, 18 nt, Human
uguaucacaaaucuuaac

SEQ ID NO: 1649725 - RNA, 20 nt, Human
uguauucucuccuguaccuc

SEQ ID NO: 1649726 - RNA, 19 nt, Human
uguauucucuccuguaccu

SEQ ID NO: 1649727 - RNA, 13 nt, Human
uguauuacaaauc

SEQ ID NO: 1649728 - RNA, 22 nt, Human
uguauuacaaauccaaugaaau

SEQ ID NO: 1649729 - RNA, 21 nt, Human
aggugagaagcagaggaagga

SEQ ID NO: 1649730 - RNA, 23 nt, Human
aggugagaagcagaggaaggaga

SEQ ID NO: 1649731 - RNA, 16 nt, Human
aggugagaagcagagg

SEQ ID NO: 1649732 - RNA, 22 nt, Human
aggugacagagugagacucugu

SEQ ID NO: 1649733 - RNA, 13 nt, Human
aggugaccccagg

SEQ ID NO: 1649734 - RNA, 18 nt, Human
aggucuugaacuccuggc

SEQ ID NO: 1649735 - RNA, 17 nt, Human
aggucuugaacuccugg

SEQ ID NO: 1649736 - RNA, 13 nt, Human
aggugacagagug

SEQ ID NO: 1649737 - RNA, 15 nt, Human
aggugacagagugag

SEQ ID NO: 1649738 - RNA, 19 nt, Human
agguccacaacacacagau

SEQ ID NO: 1649739 - RNA, 16 nt, Human
aggucuugaacuccug

SEQ ID NO: 1649740 - RNA, 15 nt, Human
uggucagauuugaac

SEQ ID NO: 1649741 - RNA, 16 nt, Human
uggucagauuugaacu

SEQ ID NO: 1649742 - RNA, 13 nt, Human
aggucagagccug

SEQ ID NO: 1649743 - RNA, 14 nt, Human
aggucagagccugc

SEQ ID NO: 1649744 - RNA, 15 nt, Human
aggucagagccugca

SEQ ID NO: 1649745 - RNA, 17 nt, Human
aggucagagccugcagu

SEQ ID NO: 1649746 - RNA, 18 nt, Human
aggucagagccugcaguu

SEQ ID NO: 1649747 - RNA, 13 nt, Human
uggugcugccaca

SEQ ID NO: 1649748 - RNA, 18 nt, Human
uggugcugccacacuuca

SEQ ID NO: 1649749 - RNA, 16 nt, Human
uggugcgaucuggguu

SEQ ID NO: 1649750 - RNA, 17 nt, Human
uggugcgaucuggguuc

SEQ ID NO: 1649751 - RNA, 16 nt, Human
uggugcccugcuuuca

SEQ ID NO: 1649752 - RNA, 19 nt, Human
uggugcccugcuuucagau

SEQ ID NO: 1649753 - RNA, 20 nt, Human
uggugcccugcuuucagaua

SEQ ID NO: 1649754 - RNA, 14 nt, Human
uggugcccugcuuu

SEQ ID NO: 1649755 - RNA, 21 nt, Human
ugguggagaggcccggccucu

SEQ ID NO: 1649756 - RNA, 14 nt, Human
ugguggcagcugcg

SEQ ID NO: 1649757 - RNA, 13 nt, Human
ugguggcagcugc

SEQ ID NO: 1649758 - RNA, 15 nt, Human
ugguggcagcugcgg

SEQ ID NO: 1649759 - RNA, 12 nt, Human
ugguggcagugg

SEQ ID NO: 1649760 - RNA, 18 nt, Human
ugguuaggcauuguggga

SEQ ID NO: 1649761 - RNA, 20 nt, Human
ugguuaggcauugugggaag

SEQ ID NO: 1649762 - RNA, 23 nt, Human
uggugugaccacugcagaagaca

SEQ ID NO: 1649763 - RNA, 14 nt, Human
uggugugaacuaaa

SEQ ID NO: 1649764 - RNA, 22 nt, Human
uggugugaacuaaacuuucaca

SEQ ID NO: 1649765 - RNA, 23 nt, Human
uggugugaacuaaacuuucacac

SEQ ID NO: 1649766 - RNA, 14 nt, Human
agguuuaagcuguu

SEQ ID NO: 1649767 - RNA, 17 nt, Human
agguucuggugugaacu

SEQ ID NO: 1649768 - RNA, 19 nt, Human
agguggggucacucuggca

SEQ ID NO: 1649769 - RNA, 17 nt, Human
aggugugaaccaccaca

SEQ ID NO: 1649770 - RNA, 15 nt, Human
aggugugcucugauc

SEQ ID NO: 1649771 - RNA, 20 nt, Human
aggugugcucugaucaucca

SEQ ID NO: 1649772 - RNA, 15 nt, Human
aggugggauccucca

SEQ ID NO: 1649773 - RNA, 18 nt, Human
aggugccucaagagaagg

SEQ ID NO: 1649774 - RNA, 16 nt, Human
aggugggauccuccag

SEQ ID NO: 1649775 - RNA, 17 nt, Human
aggugggauccuccagg

SEQ ID NO: 1649776 - RNA, 18 nt, Human
aggugggauccuccaggu

SEQ ID NO: 1649777 - RNA, 23 nt, Human
agguggggcagcuugaggguugg

SEQ ID NO: 1649778 - RNA, 14 nt, Human
aggugauccaccca

SEQ ID NO: 1649779 - RNA, 20 nt, Human
aggugauccacccaccucag

SEQ ID NO: 1649780 - RNA, 20 nt, Human
aggugcauauuuauaaaaau

SEQ ID NO: 1649781 - RNA, 21 nt, Human
aggugauccacccaccucagc

SEQ ID NO: 1649782 - RNA, 15 nt, Human
ugguuuguaaauuaa

SEQ ID NO: 1649783 - RNA, 14 nt, Human
ugguuuucaaaaua

SEQ ID NO: 1649784 - RNA, 15 nt, Human
ugguuuucaaaauaa

SEQ ID NO: 1649785 - RNA, 17 nt, Human
ugguuuucaaaauaaaa

SEQ ID NO: 1649786 - RNA, 14 nt, Human
ugguuuccugcccu

SEQ ID NO: 1649787 - RNA, 15 nt, Human
ugguuuccugcccug

SEQ ID NO: 1649788 - RNA, 20 nt, Human
ugguuuccugcccugggagg

SEQ ID NO: 1649789 - RNA, 12 nt, Human
ugguuuccugcc

SEQ ID NO: 1649790 - RNA, 13 nt, Human
ugguuuccugccc

SEQ ID NO: 1649791 - RNA, 14 nt, Human
ugguuauggagagg

SEQ ID NO: 1649792 - RNA, 19 nt, Human
uguaaauaaagaacuagca

SEQ ID NO: 1649793 - RNA, 15 nt, Human
uguaaauacaauuuu

SEQ ID NO: 1649794 - RNA, 15 nt, Human
uguaaauagcucagg

SEQ ID NO: 1649795 - RNA, 16 nt, Human
uguaaauagcucaggu

SEQ ID NO: 1649796 - RNA, 21 nt, Human
uguaaauacuguuuuuaacaa

SEQ ID NO: 1649797 - RNA, 23 nt, Human
aggaaaccaguuaggucucaaua

SEQ ID NO: 1649798 - RNA, 13 nt, Human
ugcuaucuccccc

SEQ ID NO: 1649799 - RNA, 14 nt, Human
ugcuaucuccccca

SEQ ID NO: 1649800 - RNA, 17 nt, Human
ugcuaucucccccagcc

SEQ ID NO: 1649801 - RNA, 16 nt, Human
aggaaaagcugcugac

SEQ ID NO: 1649802 - RNA, 22 nt, Human
ugcuauuucuauauuuucauuc

SEQ ID NO: 1649803 - RNA, 18 nt, Human
ugcuaucucccccagccc

SEQ ID NO: 1649804 - RNA, 15 nt, Human
ugcucuugaacuccu

SEQ ID NO: 1649805 - RNA, 20 nt, Human
ugcucuugaacuccugaccu

SEQ ID NO: 1649806 - RNA, 22 nt, Human
ugcucuugaacuccugaccuca

SEQ ID NO: 1649807 - RNA, 17 nt, Human
ugcucuugaugccuggc

SEQ ID NO: 1649808 - RNA, 16 nt, Human
ugcucugcugacagac

SEQ ID NO: 1649809 - RNA, 14 nt, Human
ugcucugcugacag

SEQ ID NO: 1649810 - RNA, 15 nt, Human
ugcucugcugacaga

SEQ ID NO: 1649811 - RNA, 21 nt, Human
ugcuccagcuguucagcuggu

SEQ ID NO: 1649812 - RNA, 19 nt, Human
ugcucugaucauccacugu

SEQ ID NO: 1649813 - RNA, 15 nt, Human
aggaaggcugagagg

SEQ ID NO: 1649814 - RNA, 15 nt, Human
aggaagcucagggcc

SEQ ID NO: 1649815 - RNA, 16 nt, Human
aggaagcucagggccu

SEQ ID NO: 1649816 - RNA, 18 nt, Human
aggaagcagcuuucccca

SEQ ID NO: 1649817 - RNA, 13 nt, Human
aggaagccagcag

SEQ ID NO: 1649818 - RNA, 13 nt, Human
aggaagcucaggg

SEQ ID NO: 1649819 - RNA, 14 nt, Human
aggaagcucagggc

SEQ ID NO: 1649820 - RNA, 23 nt, Human
aggaaaucaaauaugcaaagcac

SEQ ID NO: 1649821 - RNA, 21 nt, Human
aggaaaucaaauaugcaaagc

SEQ ID NO: 1649822 - RNA, 22 nt, Human
aggaaaucaaauaugcaaagca

SEQ ID NO: 1649823 - RNA, 20 nt, Human
aggaaaucaaauaugcaaag

SEQ ID NO: 1649824 - RNA, 13 nt, Human
agcuuaacagugu

SEQ ID NO: 1649825 - RNA, 16 nt, Human
ugcuaauuuugaaaaa

SEQ ID NO: 1649826 - RNA, 18 nt, Human
ugcuaauuuugaaaaacu

SEQ ID NO: 1649827 - RNA, 19 nt, Human
ugcuaauuuugaaaaacug

SEQ ID NO: 1649828 - RNA, 20 nt, Human
ugcuaauuuugaaaaacugc

SEQ ID NO: 1649829 - RNA, 14 nt, Human
ugcuacaaaaacac

SEQ ID NO: 1649830 - RNA, 15 nt, Human
ugcuacaaaaacaca

SEQ ID NO: 1649831 - RNA, 17 nt, Human
ugcgguccacccaggag

SEQ ID NO: 1649832 - RNA, 14 nt, Human
ugcgguccacccag

SEQ ID NO: 1649833 - RNA, 15 nt, Human
ugcgguccacccagg

SEQ ID NO: 1649834 - RNA, 17 nt, Human
ugccuuuucccaacucc

SEQ ID NO: 1649835 - RNA, 19 nt, Human
ugccuuuucccaacuccag

SEQ ID NO: 1649836 - RNA, 22 nt, Human
agcuuuccccaugucucgacuc

SEQ ID NO: 1649837 - RNA, 14 nt, Human
aggaaaagcugcug

SEQ ID NO: 1649838 - RNA, 16 nt, Human
agcuugcccuguuaaa

SEQ ID NO: 1649839 - RNA, 18 nt, Human
agcuugcccuguuaaaag

SEQ ID NO: 1649840 - RNA, 19 nt, Human
agcuugcccuguuaaaaga

SEQ ID NO: 1649841 - RNA, 20 nt, Human
agcuugaccgugaggccaga

SEQ ID NO: 1649842 - RNA, 22 nt, Human
agcuugaccgugaggccagaga

SEQ ID NO: 1649843 - RNA, 23 nt, Human
agcuugaccgugaggccagagac

SEQ ID NO: 1649844 - RNA, 20 nt, Human
agcuugcccuggugccucac

SEQ ID NO: 1649845 - RNA, 20 nt, Human
ugccugcuuuuuauggccug

SEQ ID NO: 1649846 - RNA, 21 nt, Human
ugccugcuuuuuauggccugu

SEQ ID NO: 1649847 - RNA, 22 nt, Human
ugccugcuuuuuauggccugug

SEQ ID NO: 1649848 - RNA, 24 nt, Human
ugccugcccaggccccugccaccc

SEQ ID NO: 1649849 - RNA, 12 nt, Human
ugccucugccug

SEQ ID NO: 1649850 - RNA, 22 nt, Human
ugccugcccaggccccugccac

SEQ ID NO: 1649851 - RNA, 23 nt, Human
ugccugcccaggccccugccacc

SEQ ID NO: 1649852 - RNA, 14 nt, Human
ugccucagccuccc

SEQ ID NO: 1649853 - RNA, 18 nt, Human
ugccucugccucugacac

SEQ ID NO: 1649854 - RNA, 20 nt, Human
ugccucugccucugacacac

SEQ ID NO: 1649855 - RNA, 17 nt, Human
ugccucugccucugaca

SEQ ID NO: 1649856 - RNA, 19 nt, Human
agcugccuguucagcucca

SEQ ID NO: 1649857 - RNA, 18 nt, Human
agcugccuguucagcucc

SEQ ID NO: 1649858 - RNA, 14 nt, Human
agcugccuguucag

SEQ ID NO: 1649859 - RNA, 16 nt, Human
agcugccuguucagcu

SEQ ID NO: 1649860 - RNA, 16 nt, Human
ugccuggauggggcug

SEQ ID NO: 1649861 - RNA, 17 nt, Human
ugccuggauggggcugc

SEQ ID NO: 1649862 - RNA, 20 nt, Human
ugccuggauggggcugcacc

SEQ ID NO: 1649863 - RNA, 21 nt, Human
ugccuggauggggcugcaccg

SEQ ID NO: 1649864 - RNA, 20 nt, Human
agcugcuugggcuucauccu

SEQ ID NO: 1649865 - RNA, 16 nt, Human
agcugcuugggcuuca

SEQ ID NO: 1649866 - RNA, 18 nt, Human
agcuggccgggagccuga

SEQ ID NO: 1649867 - RNA, 19 nt, Human
agcuggccgggagccugau

SEQ ID NO: 1649868 - RNA, 18 nt, Human
agcuguuacugucuucag

SEQ ID NO: 1649869 - RNA, 19 nt, Human
agcugugcucuggacaggc

SEQ ID NO: 1649870 - RNA, 17 nt, Human
agcugugcucuggacag

SEQ ID NO: 1649871 - RNA, 18 nt, Human
agcugugcucuggacagg

SEQ ID NO: 1649872 - RNA, 22 nt, Human
agcugggguggggaccucaggc

SEQ ID NO: 1649873 - RNA, 23 nt, Human
agcugggguggggaccucaggcc

SEQ ID NO: 1649874 - RNA, 20 nt, Human
agcugggacuacaggcaccc

SEQ ID NO: 1649875 - RNA, 23 nt, Human
agcugggacuacaggcacccacc

SEQ ID NO: 1649876 - RNA, 16 nt, Human
agcugggacuacaggu

SEQ ID NO: 1649877 - RNA, 20 nt, Human
agcugggguggggaccucag

SEQ ID NO: 1649878 - RNA, 21 nt, Human
ugccuuacccucauguucuua

SEQ ID NO: 1649879 - RNA, 16 nt, Human
ugccuuggggacaaga

SEQ ID NO: 1649880 - RNA, 20 nt, Human
ugccuuacccucauguucuu

SEQ ID NO: 1649881 - RNA, 16 nt, Human
ugccuguugggccagg

SEQ ID NO: 1649882 - RNA, 17 nt, Human
ugccuguugggccagga

SEQ ID NO: 1649883 - RNA, 14 nt, Human
ugccuguucccauu

SEQ ID NO: 1649884 - RNA, 19 nt, Human
agcuguuacugucuucagu

SEQ ID NO: 1649885 - RNA, 14 nt, Human
agcuguucacagcc

SEQ ID NO: 1649886 - RNA, 12 nt, Human
agcucuggucca

SEQ ID NO: 1649887 - RNA, 17 nt, Human
agcucugguccauagag

SEQ ID NO: 1649888 - RNA, 22 nt, Human
agcuccuucuguccuacucugu

SEQ ID NO: 1649889 - RNA, 16 nt, Human
agcuccuucuguccua

SEQ ID NO: 1649890 - RNA, 21 nt, Human
agcuccuucuguccuacucug

SEQ ID NO: 1649891 - RNA, 14 nt, Human
ugccaucaauaaaa

SEQ ID NO: 1649892 - RNA, 22 nt, Human
ugccaucaauaaaaaauuauga

SEQ ID NO: 1649893 - RNA, 13 nt, Human
agcuccaucucca

SEQ ID NO: 1649894 - RNA, 15 nt, Human
agcuccaucuccacu

SEQ ID NO: 1649895 - RNA, 16 nt, Human
agcuccaucuccacuc

SEQ ID NO: 1649896 - RNA, 13 nt, Human
agcucccaggcau

SEQ ID NO: 1649897 - RNA, 23 nt, Human
agcucccaggcauuccccaggag

SEQ ID NO: 1649898 - RNA, 15 nt, Human
agcuccuucuguccu

SEQ ID NO: 1649899 - RNA, 20 nt, Human
agcugccagccgagauagcc

SEQ ID NO: 1649900 - RNA, 16 nt, Human
agcucuguccugggag

SEQ ID NO: 1649901 - RNA, 21 nt, Human
agcucuguccugggagugagc

SEQ ID NO: 1649902 - RNA, 23 nt, Human
agcucuguccugggagugagcug

SEQ ID NO: 1649903 - RNA, 12 nt, Human
ugccgcagcccu

SEQ ID NO: 1649904 - RNA, 14 nt, Human
ugccgcagcccugc

SEQ ID NO: 1649905 - RNA, 12 nt, Human
ugccucagccuc

SEQ ID NO: 1649906 - RNA, 13 nt, Human
ugccucagccucc

SEQ ID NO: 1649907 - RNA, 18 nt, Human
ugcccuuaccugccagga

SEQ ID NO: 1649908 - RNA, 19 nt, Human
ugcccuuaccugccaggaa

SEQ ID NO: 1649909 - RNA, 16 nt, Human
agcugcccucuccugg

SEQ ID NO: 1649910 - RNA, 15 nt, Human
agcugcccucuccug

SEQ ID NO: 1649911 - RNA, 14 nt, Human
agcugcccucuccu

SEQ ID NO: 1649912 - RNA, 13 nt, Human
agcugcccucucc

SEQ ID NO: 1649913 - RNA, 20 nt, Human
ugcccuguuaaaagaugaaa

SEQ ID NO: 1649914 - RNA, 18 nt, Human
aggauugcuacuguccua

SEQ ID NO: 1649915 - RNA, 15 nt, Human
aggauugcuacuguc

SEQ ID NO: 1649916 - RNA, 17 nt, Human
aggauugcuacuguccu

SEQ ID NO: 1649917 - RNA, 14 nt, Human
uggagaaaauggac

SEQ ID NO: 1649918 - RNA, 17 nt, Human
aggcaaggcugucaauu

SEQ ID NO: 1649919 - RNA, 16 nt, Human
aggcaaggcugucaau

SEQ ID NO: 1649920 - RNA, 20 nt, Human
aggcaagcaccuccugccuc

SEQ ID NO: 1649921 - RNA, 18 nt, Human
aggcaagcaccuccugcc

SEQ ID NO: 1649922 - RNA, 19 nt, Human
aggcaagcaccuccugccu

SEQ ID NO: 1649923 - RNA, 17 nt, Human
uggagccaauggagacu

SEQ ID NO: 1649924 - RNA, 17 nt, Human
uggagcucguggaacag

SEQ ID NO: 1649925 - RNA, 21 nt, Human
uggagcucguggaacaguuac

SEQ ID NO: 1649926 - RNA, 21 nt, Human
uggagcucgugggacagucac

SEQ ID NO: 1649927 - RNA, 17 nt, Human
aggcaagcaccuccugc

SEQ ID NO: 1649928 - RNA, 15 nt, Human
aggcagcuugaaacu

SEQ ID NO: 1649929 - RNA, 15 nt, Human
aggcauaaagucagg

SEQ ID NO: 1649930 - RNA, 17 nt, Human
aggcaggugggauggau

SEQ ID NO: 1649931 - RNA, 12 nt, Human
aggcagggucuc

SEQ ID NO: 1649932 - RNA, 22 nt, Human
aggcaggucuugaacuccuggc

SEQ ID NO: 1649933 - RNA, 22 nt, Human
aggcauaaagucagggguuccc

SEQ ID NO: 1649934 - RNA, 18 nt, Human
aggcauugugggaagggg

SEQ ID NO: 1649935 - RNA, 20 nt, Human
aggcauuuaggccaugggac

SEQ ID NO: 1649936 - RNA, 18 nt, Human
uggcacccggccccugcu

SEQ ID NO: 1649937 - RNA, 19 nt, Human
uggcacccggccccugcug

SEQ ID NO: 1649938 - RNA, 20 nt, Human
uggcacccggccccugcugg

SEQ ID NO: 1649939 - RNA, 13 nt, Human
uggcagcucagag

SEQ ID NO: 1649940 - RNA, 23 nt, Human
uggcagcucaccucucccuugga

SEQ ID NO: 1649941 - RNA, 21 nt, Human
uggcagcucaccucucccuug

SEQ ID NO: 1649942 - RNA, 22 nt, Human
uggcagcucaccucucccuugg

SEQ ID NO: 1649943 - RNA, 13 nt, Human
aggccagccuuga

SEQ ID NO: 1649944 - RNA, 12 nt, Human
aggccagcugcu

SEQ ID NO: 1649945 - RNA, 15 nt, Human
aggccagccuugacc

SEQ ID NO: 1649946 - RNA, 13 nt, Human
aggcccagagggc

SEQ ID NO: 1649947 - RNA, 13 nt, Human
aggcccggccucu

SEQ ID NO: 1649948 - RNA, 14 nt, Human
aggcccggccucuc

SEQ ID NO: 1649949 - RNA, 15 nt, Human
aggcccggccucuca

SEQ ID NO: 1649950 - RNA, 13 nt, Human
aggcccggcucca

SEQ ID NO: 1649951 - RNA, 14 nt, Human
aggccccgcccagg

SEQ ID NO: 1649952 - RNA, 15 nt, Human
aggcccccaggugcc

SEQ ID NO: 1649953 - RNA, 23 nt, Human
uggcacaucagcacgauuucugu

SEQ ID NO: 1649954 - RNA, 21 nt, Human
uggaugccugguggcagcugc

SEQ ID NO: 1649955 - RNA, 23 nt, Human
uggaugccugguggcagcugcgg

SEQ ID NO: 1649956 - RNA, 13 nt, Human
uggauggaagggg

SEQ ID NO: 1649957 - RNA, 16 nt, Human
aggcauuugcugaaua

SEQ ID NO: 1649958 - RNA, 20 nt, Human
aggcauuugcugaauacaga

SEQ ID NO: 1649959 - RNA, 14 nt, Human
uggagugcagugag

SEQ ID NO: 1649960 - RNA, 14 nt, Human
uggaguugaaaauc

SEQ ID NO: 1649961 - RNA, 19 nt, Human
aggacuaggguccugggga

SEQ ID NO: 1649962 - RNA, 16 nt, Human
aggacuaggguccugg

SEQ ID NO: 1649963 - RNA, 18 nt, Human
aggacuaggguccugggg

SEQ ID NO: 1649964 - RNA, 15 nt, Human
aggacuaggguccug

SEQ ID NO: 1649965 - RNA, 13 nt, Human
aggaauucuguau

SEQ ID NO: 1649966 - RNA, 14 nt, Human
aggaauucuguaua

SEQ ID NO: 1649967 - RNA, 15 nt, Human
aggaauucuguauag

SEQ ID NO: 1649968 - RNA, 13 nt, Human
aggacgcucucug

SEQ ID NO: 1649969 - RNA, 14 nt, Human
aggacgcucucugg

SEQ ID NO: 1649970 - RNA, 16 nt, Human
aggacgcucucuggcc

SEQ ID NO: 1649971 - RNA, 17 nt, Human
aggacgcucucuggccu

SEQ ID NO: 1649972 - RNA, 19 nt, Human
aggacgcucucuggccuuc

SEQ ID NO: 1649973 - RNA, 20 nt, Human
aggacgcucucuggccuucg

SEQ ID NO: 1649974 - RNA, 12 nt, Human
aggacucugccu

SEQ ID NO: 1649975 - RNA, 13 nt, Human
aggacucugccuc

SEQ ID NO: 1649976 - RNA, 14 nt, Human
aggacucugccucc

SEQ ID NO: 1649977 - RNA, 16 nt, Human
aggacucugccuccuc

SEQ ID NO: 1649978 - RNA, 17 nt, Human
aggacucugccuccucu

SEQ ID NO: 1649979 - RNA, 18 nt, Human
aggacucugccuccucuu

SEQ ID NO: 1649980 - RNA, 19 nt, Human
aggacucugccuccucuuc

SEQ ID NO: 1649981 - RNA, 14 nt, Human
aggacuucuuuaau

SEQ ID NO: 1649982 - RNA, 16 nt, Human
aggacuucuuuaauuu

SEQ ID NO: 1649983 - RNA, 21 nt, Human
aggacuucuuuaauuuuggaa

SEQ ID NO: 1649984 - RNA, 22 nt, Human
aggacuucuuuaauuuuggaau

SEQ ID NO: 1649985 - RNA, 23 nt, Human
aggacuucuuuaauuuuggaauu

SEQ ID NO: 1649986 - RNA, 17 nt, Human
aggacuuuucuuugugg

SEQ ID NO: 1649987 - RNA, 19 nt, Human
aggacuuuucuuuguggcu

SEQ ID NO: 1649988 - RNA, 22 nt, Human
aggacuuuucuuuguggcuucc

SEQ ID NO: 1649989 - RNA, 23 nt, Human
aggacuuuucuuuguggcuuccu

SEQ ID NO: 1649990 - RNA, 18 nt, Human
aggagaaacuggaacucu

SEQ ID NO: 1649991 - RNA, 19 nt, Human
aggagaaacuggaacucuc

SEQ ID NO: 1649992 - RNA, 14 nt, Human
aggagcagccacau

SEQ ID NO: 1649993 - RNA, 17 nt, Human
aggagccccgaggccuu

SEQ ID NO: 1649994 - RNA, 16 nt, Human
aggagccuccugcccu

SEQ ID NO: 1649995 - RNA, 12 nt, Human
aggagcagccac

SEQ ID NO: 1649996 - RNA, 13 nt, Human
aggagcagccaca

SEQ ID NO: 1649997 - RNA, 13 nt, Human
aggaucagucuga

SEQ ID NO: 1649998 - RNA, 22 nt, Human
aggaugcacagaguuguuacau

SEQ ID NO: 1649999 - RNA, 22 nt, Human
aggaugaucuaggaagacuuug

SEQ ID NO: 1650000 - RNA, 23 nt, Human
aggaugaucuaggaagacuuugg

SEQ ID NO: 1650001 - RNA, 17 nt, Human
aggauucuuccucccuc

SEQ ID NO: 1650002 - RNA, 19 nt, Human
aggauucuuccucccuccc

SEQ ID NO: 1650003 - RNA, 17 nt, Human
ugcuuuuucucaaaaug

SEQ ID NO: 1650004 - RNA, 16 nt, Human
ugcuuuuuauggccug

SEQ ID NO: 1650005 - RNA, 21 nt, Human
uggaaauuuguuauaaugaau

SEQ ID NO: 1650006 - RNA, 23 nt, Human
uggaaauuuguuauaaugaauga

SEQ ID NO: 1650007 - RNA, 16 nt, Human
uggaagacagcucuua

SEQ ID NO: 1650008 - RNA, 14 nt, Human
ugcuuugggcugcc

SEQ ID NO: 1650009 - RNA, 15 nt, Human
ugcuuugggcugccc

SEQ ID NO: 1650010 - RNA, 17 nt, Human
aggagccuccugcccuu

SEQ ID NO: 1650011 - RNA, 15 nt, Human
ugcuugagcucagga

SEQ ID NO: 1650012 - RNA, 16 nt, Human
ugcuuugggcugcccu

SEQ ID NO: 1650013 - RNA, 17 nt, Human
ugcuuugggcugcccug

SEQ ID NO: 1650014 - RNA, 22 nt, Human
ugcuuugugauuuuuguaauuu

SEQ ID NO: 1650015 - RNA, 20 nt, Human
ugcuuuugucuaugggacuc

SEQ ID NO: 1650016 - RNA, 23 nt, Human
ugcuuuuuaauauugauaugcuu

SEQ ID NO: 1650017 - RNA, 18 nt, Human
ugcuuuuggucuguguga

SEQ ID NO: 1650018 - RNA, 17 nt, Human
ugcuuuuaaaaaaaaau

SEQ ID NO: 1650019 - RNA, 12 nt, Human
ugcagacaggca

SEQ ID NO: 1650020 - RNA, 13 nt, Human
ugcagacaggcaa

SEQ ID NO: 1650021 - RNA, 21 nt, Human
ugcagacaggcaagcaccucc

SEQ ID NO: 1650022 - RNA, 13 nt, Human
agccuccugcccu

SEQ ID NO: 1650023 - RNA, 14 nt, Human
agccuccugcccuu

SEQ ID NO: 1650024 - RNA, 18 nt, Human
agccuccugcccuuaccu

SEQ ID NO: 1650025 - RNA, 11 nt, Human
ugcaggucccu

SEQ ID NO: 1650026 - RNA, 22 nt, Human
ugcaggucccuaauaaagcugu

SEQ ID NO: 1650027 - RNA, 21 nt, Human
ugcagccucacaguccuuacc

SEQ ID NO: 1650028 - RNA, 18 nt, Human
ugcagccucacaguccuu

SEQ ID NO: 1650029 - RNA, 19 nt, Human
ugcaugcugucccuuacgu

SEQ ID NO: 1650030 - RNA, 21 nt, Human
ugcaugcugucccuuacguga

SEQ ID NO: 1650031 - RNA, 18 nt, Human
ugcaugcugucccuuacg

SEQ ID NO: 1650032 - RNA, 13 nt, Human
ugcaucucagccc

SEQ ID NO: 1650033 - RNA, 14 nt, Human
ugcaucucagccca

SEQ ID NO: 1650034 - RNA, 15 nt, Human
ugcaucucagcccac

SEQ ID NO: 1650035 - RNA, 20 nt, Human
ugcauaccacuuuuguucuu

SEQ ID NO: 1650036 - RNA, 18 nt, Human
ugcauaccacuuuuguuc

SEQ ID NO: 1650037 - RNA, 16 nt, Human
ugcauaccacuuuugu

SEQ ID NO: 1650038 - RNA, 17 nt, Human
ugcauagaauaaaauuu

SEQ ID NO: 1650039 - RNA, 20 nt, Human
ugcauagauucccugagcag

SEQ ID NO: 1650040 - RNA, 13 nt, Human
ugcauacucauua

SEQ ID NO: 1650041 - RNA, 21 nt, Human
ugcauaccacuuuuguucuug

SEQ ID NO: 1650042 - RNA, 19 nt, Human
ugcauacucauuaggaugg

SEQ ID NO: 1650043 - RNA, 17 nt, Human
agccugugccucuggga

SEQ ID NO: 1650044 - RNA, 18 nt, Human
agccugugccucugggac

SEQ ID NO: 1650045 - RNA, 19 nt, Human
agccugugccucugggacu

SEQ ID NO: 1650046 - RNA, 13 nt, Human
agccuugaacuuu

SEQ ID NO: 1650047 - RNA, 15 nt, Human
agccuguuuaagaga

SEQ ID NO: 1650048 - RNA, 22 nt, Human
agccuuagaagucacacaguau

SEQ ID NO: 1650049 - RNA, 20 nt, Human
agccuuagaagucacacagu

SEQ ID NO: 1650050 - RNA, 16 nt, Human
agccuugggaccccug

SEQ ID NO: 1650051 - RNA, 18 nt, Human
agccuugaccauucucca

SEQ ID NO: 1650052 - RNA, 19 nt, Human
agccuugaccauucuccac

SEQ ID NO: 1650053 - RNA, 21 nt, Human
agccuugaccauucuccaccu

SEQ ID NO: 1650054 - RNA, 19 nt, Human
agccuugcggaagguucua

SEQ ID NO: 1650055 - RNA, 18 nt, Human
ugccaaugggagcucaug

SEQ ID NO: 1650056 - RNA, 13 nt, Human
ugccaauggacua

SEQ ID NO: 1650057 - RNA, 14 nt, Human
ugccaaugggagcu

SEQ ID NO: 1650058 - RNA, 16 nt, Human
ugcauuuaaaagauac

SEQ ID NO: 1650059 - RNA, 17 nt, Human
ugccagccgagauagcc

SEQ ID NO: 1650060 - RNA, 22 nt, Human
ugccagccgagauagccaaggc

SEQ ID NO: 1650061 - RNA, 13 nt, Human
ugccauaauuacu

SEQ ID NO: 1650062 - RNA, 17 nt, Human
ugccaguuauggcuaua

SEQ ID NO: 1650063 - RNA, 17 nt, Human
agcccugggaggcucug

SEQ ID NO: 1650064 - RNA, 18 nt, Human
agcccugggaggcucugg

SEQ ID NO: 1650065 - RNA, 20 nt, Human
agcccugggaggcucuggag

SEQ ID NO: 1650066 - RNA, 21 nt, Human
ugcaccacugcacuccagccu

SEQ ID NO: 1650067 - RNA, 13 nt, Human
ugcaccagcccuu

SEQ ID NO: 1650068 - RNA, 22 nt, Human
ugcagaagacaguauggcagcu

SEQ ID NO: 1650069 - RNA, 16 nt, Human
ugcacuccagccuggg

SEQ ID NO: 1650070 - RNA, 15 nt, Human
ugcacuccagccugg

SEQ ID NO: 1650071 - RNA, 17 nt, Human
ugcacuccagccugagc

SEQ ID NO: 1650072 - RNA, 14 nt, Human
ugcaccggcuggcc

SEQ ID NO: 1650073 - RNA, 15 nt, Human
ugcaccggcuggccu

SEQ ID NO: 1650074 - RNA, 16 nt, Human
ugcaccggcuggccug

SEQ ID NO: 1650075 - RNA, 14 nt, Human
ugcacuccagccug

SEQ ID NO: 1650076 - RNA, 15 nt, Human
ugcacuccagccuga

SEQ ID NO: 1650077 - RNA, 16 nt, Human
agcccgggcucugccu

SEQ ID NO: 1650078 - RNA, 14 nt, Human
agcccugcagaggg

SEQ ID NO: 1650079 - RNA, 15 nt, Human
agcccugcagagggc

SEQ ID NO: 1650080 - RNA, 16 nt, Human
agcccugcagagggca

SEQ ID NO: 1650081 - RNA, 19 nt, Human
agcccugcagagggcacag

SEQ ID NO: 1650082 - RNA, 14 nt, Human
agccccuucugacc

SEQ ID NO: 1650083 - RNA, 15 nt, Human
agccccuucugaccc

SEQ ID NO: 1650084 - RNA, 16 nt, Human
agccccuucugaccca

SEQ ID NO: 1650085 - RNA, 19 nt, Human
agccccuucugacccaugc

SEQ ID NO: 1650086 - RNA, 13 nt, Human
agcccgggcucug

SEQ ID NO: 1650087 - RNA, 14 nt, Human
agcccgggcucugc

SEQ ID NO: 1650088 - RNA, 15 nt, Human
agcccgggcucugcc

SEQ ID NO: 1650089 - RNA, 14 nt, Human
agccccgaggccuu

SEQ ID NO: 1650090 - RNA, 14 nt, Human
agcccaggccuccu

SEQ ID NO: 1650091 - RNA, 19 nt, Human
agcccaggccuccuacagc

SEQ ID NO: 1650092 - RNA, 21 nt, Human
agcccaggccuccuacagcuu

SEQ ID NO: 1650093 - RNA, 18 nt, Human
agccccgugggguuccuc

SEQ ID NO: 1650094 - RNA, 15 nt, Human
ugcaaggucauuuuu

SEQ ID NO: 1650095 - RNA, 12 nt, Human
agcccaggccuc

SEQ ID NO: 1650096 - RNA, 21 nt, Human
ugcaauaaaauggguuuuacu

SEQ ID NO: 1650097 - RNA, 17 nt, Human
ugcaauaaaauggguuu

SEQ ID NO: 1650098 - RNA, 13 nt, Human
ugcaacaggcugg

SEQ ID NO: 1650099 - RNA, 15 nt, Human
ugcaagccagauuuu

SEQ ID NO: 1650100 - RNA, 21 nt, Human
ugcaagccagauuuuccugaa

SEQ ID NO: 1650101 - RNA, 23 nt, Human
ugauuugacauagucuggcugua

SEQ ID NO: 1650102 - RNA, 18 nt, Human
ugauuuccguuaaaauac

SEQ ID NO: 1650103 - RNA, 12 nt, Human
ugauuuggaaaa

SEQ ID NO: 1650104 - RNA, 12 nt, Human
ugcaaaccauca

SEQ ID NO: 1650105 - RNA, 13 nt, Human
ugcaaaccaucau

SEQ ID NO: 1650106 - RNA, 17 nt, Human
agccacggccaggccag

SEQ ID NO: 1650107 - RNA, 18 nt, Human
agccacggccaggccaga

SEQ ID NO: 1650108 - RNA, 13 nt, Human
ugauuucauucaa

SEQ ID NO: 1650109 - RNA, 23 nt, Human
ugcaaaguucccuacuuccugug

SEQ ID NO: 1650110 - RNA, 20 nt, Human
ugcaaaguaucccuacugua

SEQ ID NO: 1650111 - RNA, 14 nt, Human
ugcaaagcccagcu

SEQ ID NO: 1650112 - RNA, 15 nt, Human
ugcaaagcccagcuu

SEQ ID NO: 1650113 - RNA, 17 nt, Human
ugcaaagcccagcuuga

SEQ ID NO: 1650114 - RNA, 21 nt, Human
ugcaaaggguaucaggugcug

SEQ ID NO: 1650115 - RNA, 18 nt, Human
ugcaaaccaucauugaaa

SEQ ID NO: 1650116 - RNA, 20 nt, Human
ugcaaaccaucauugaaauc

SEQ ID NO: 1650117 - RNA, 18 nt, Human
ugcaaagcacugacuucu

SEQ ID NO: 1650118 - RNA, 20 nt, Human
ugcaaagcacugacuucuaa

SEQ ID NO: 1650119 - RNA, 22 nt, Human
ugcaaagcacugacuucuaagu

SEQ ID NO: 1650120 - RNA, 18 nt, Human
ugauccacucgccuucau

SEQ ID NO: 1650121 - RNA, 14 nt, Human
ugauccacucgccu

SEQ ID NO: 1650122 - RNA, 13 nt, Human
ugauccagaaaga

SEQ ID NO: 1650123 - RNA, 20 nt, Human
ugauccagcagauuauucac

SEQ ID NO: 1650124 - RNA, 19 nt, Human
ugauccagcagauuauuca

SEQ ID NO: 1650125 - RNA, 23 nt, Human
ugauccagaaagaaaacuuguau

SEQ ID NO: 1650126 - RNA, 18 nt, Human
ugauccucccaccucagc

SEQ ID NO: 1650127 - RNA, 13 nt, Human
ugaucuaggaaga

SEQ ID NO: 1650128 - RNA, 19 nt, Human
ugauccucccaccucagcc

SEQ ID NO: 1650129 - RNA, 20 nt, Human
ugauccucccaccucagccu

SEQ ID NO: 1650130 - RNA, 13 nt, Human
agccaccacgccc

SEQ ID NO: 1650131 - RNA, 21 nt, Human
ugauguuuuaaggaugcuugu

SEQ ID NO: 1650132 - RNA, 17 nt, Human
ugauguuuuccaugagu

SEQ ID NO: 1650133 - RNA, 23 nt, Human
ugauguuuuccaugaguccccug

SEQ ID NO: 1650134 - RNA, 19 nt, Human
ugauguuuuccaugagucc

SEQ ID NO: 1650135 - RNA, 19 nt, Human
ugauggguuaguggaugga

SEQ ID NO: 1650136 - RNA, 23 nt, Human
ugauggguuaguggauggaaggg

SEQ ID NO: 1650137 - RNA, 22 nt, Human
ugauggggcccugccuccuuug

SEQ ID NO: 1650138 - RNA, 16 nt, Human
ugauuaaauucuugca

SEQ ID NO: 1650139 - RNA, 13 nt, Human
ugauuaaauucuu

SEQ ID NO: 1650140 - RNA, 17 nt, Human
ugauuaaauucuugcaa

SEQ ID NO: 1650141 - RNA, 15 nt, Human
ugauuaaguaaugau

SEQ ID NO: 1650142 - RNA, 16 nt, Human
agccacggccaggcca

SEQ ID NO: 1650143 - RNA, 16 nt, Human
ugauuaaguaaugaua

SEQ ID NO: 1650144 - RNA, 22 nt, Human
ugaugaaaugaggucagagccu

SEQ ID NO: 1650145 - RNA, 14 nt, Human
ugaucuaggaagac

SEQ ID NO: 1650146 - RNA, 15 nt, Human
ugaucuaggaagacu

SEQ ID NO: 1650147 - RNA, 18 nt, Human
ugaugaaauguaaauacu

SEQ ID NO: 1650148 - RNA, 23 nt, Human
ugaugaaaugaggucagagccug

SEQ ID NO: 1650149 - RNA, 19 nt, Human
ugaugaucuuugcagacag

SEQ ID NO: 1650150 - RNA, 20 nt, Human
ugaugaucuuugcagacagg

SEQ ID NO: 1650151 - RNA, 21 nt, Human
ugaugaucuuugcagacaggc

SEQ ID NO: 1650152 - RNA, 22 nt, Human
ugaugggcaacccccagccugc

SEQ ID NO: 1650153 - RNA, 13 nt, Human
ugauggggcccug

SEQ ID NO: 1650154 - RNA, 13 nt, Human
agcauggcugcca

SEQ ID NO: 1650155 - RNA, 14 nt, Human
agcauccuggaaua

SEQ ID NO: 1650156 - RNA, 15 nt, Human
agcauccuggaauau

SEQ ID NO: 1650157 - RNA, 13 nt, Human
agcauccuggaau

SEQ ID NO: 1650158 - RNA, 23 nt, Human
agcaucaggccaggcccucugcc

SEQ ID NO: 1650159 - RNA, 22 nt, Human
agcaucaggccaggcccucugc

SEQ ID NO: 1650160 - RNA, 21 nt, Human
agcaucaggccaggcccucug

SEQ ID NO: 1650161 - RNA, 12 nt, Human
agcaucaggcca

SEQ ID NO: 1650162 - RNA, 18 nt, Human
ugauacaaugcugugccc

SEQ ID NO: 1650163 - RNA, 21 nt, Human
ugauacagaaaaguugaauuu

SEQ ID NO: 1650164 - RNA, 14 nt, Human
ugaucaccugcccu

SEQ ID NO: 1650165 - RNA, 18 nt, Human
ugaucacggcucacugca

SEQ ID NO: 1650166 - RNA, 15 nt, Human
ugaucacggcucacu

SEQ ID NO: 1650167 - RNA, 13 nt, Human
ugaucacggcuca

SEQ ID NO: 1650168 - RNA, 14 nt, Human
ugaucacggcucac

SEQ ID NO: 1650169 - RNA, 17 nt, Human
agcauauucaggaagcu

SEQ ID NO: 1650170 - RNA, 19 nt, Human
agcauauucaggaagcuca

SEQ ID NO: 1650171 - RNA, 21 nt, Human
agcauauucaggaagcucagg

SEQ ID NO: 1650172 - RNA, 17 nt, Human
agcauuuguguugaaga

SEQ ID NO: 1650173 - RNA, 18 nt, Human
agcauuuguguugaagag

SEQ ID NO: 1650174 - RNA, 13 nt, Human
agcauuuuauaaa

SEQ ID NO: 1650175 - RNA, 14 nt, Human
agcauuuuauaaau

SEQ ID NO: 1650176 - RNA, 15 nt, Human
agcauuuuauaaauc

SEQ ID NO: 1650177 - RNA, 20 nt, Human
agcauuuuauaaaucgcuuu

SEQ ID NO: 1650178 - RNA, 18 nt, Human
agccaaacauccuacaag

SEQ ID NO: 1650179 - RNA, 22 nt, Human
agcauuuugcuaaaugugaaug

SEQ ID NO: 1650180 - RNA, 15 nt, Human
agcauuuugcuaaau

SEQ ID NO: 1650181 - RNA, 17 nt, Human
agcauuagauuucucau

SEQ ID NO: 1650182 - RNA, 19 nt, Human
agcauggcugccaauggga

SEQ ID NO: 1650183 - RNA, 18 nt, Human
agcauucucacuccuacc

SEQ ID NO: 1650184 - RNA, 20 nt, Human
agcauucucacuccuaccug

SEQ ID NO: 1650185 - RNA, 22 nt, Human
agcauucucacuccuaccuggu

SEQ ID NO: 1650186 - RNA, 22 nt, Human
agcauuuagauguauagguuga

SEQ ID NO: 1650187 - RNA, 15 nt, Human
agcaggcugugaguu

SEQ ID NO: 1650188 - RNA, 13 nt, Human
agcagggaaacag

SEQ ID NO: 1650189 - RNA, 14 nt, Human
agcagggaaacagc

SEQ ID NO: 1650190 - RNA, 15 nt, Human
agcagggaaacagcu

SEQ ID NO: 1650191 - RNA, 21 nt, Human
agcaggcucucaggccagcug

SEQ ID NO: 1650192 - RNA, 22 nt, Human
agcaggcucucaggccagcugc

SEQ ID NO: 1650193 - RNA, 23 nt, Human
agcaggcucucaggccagcugcu

SEQ ID NO: 1650194 - RNA, 17 nt, Human
agcaggcucgggcuccc

SEQ ID NO: 1650195 - RNA, 13 nt, Human
agcaggcucucag

SEQ ID NO: 1650196 - RNA, 14 nt, Human
agcaggcucucagg

SEQ ID NO: 1650197 - RNA, 15 nt, Human
agcaggcucucaggc

SEQ ID NO: 1650198 - RNA, 16 nt, Human
agcaggcucucaggcc

SEQ ID NO: 1650199 - RNA, 17 nt, Human
agcaggcucucaggcca

SEQ ID NO: 1650200 - RNA, 18 nt, Human
agcaggcucucaggccag

SEQ ID NO: 1650201 - RNA, 19 nt, Human
agcaggcucucaggccagc

SEQ ID NO: 1650202 - RNA, 22 nt, Human
agcagggcucagcggggacagc

SEQ ID NO: 1650203 - RNA, 13 nt, Human
agcagggcucagc

SEQ ID NO: 1650204 - RNA, 14 nt, Human
agcagggcucagcg

SEQ ID NO: 1650205 - RNA, 15 nt, Human
agcagggcucagcgg

SEQ ID NO: 1650206 - RNA, 20 nt, Human
agcagggagggcuucugcca

SEQ ID NO: 1650207 - RNA, 19 nt, Human
agcagggcauggcugggaa

SEQ ID NO: 1650208 - RNA, 20 nt, Human
ugacccaugcugcccuguga

SEQ ID NO: 1650209 - RNA, 18 nt, Human
ugacccaugcugcccugu

SEQ ID NO: 1650210 - RNA, 19 nt, Human
ugacccaugcugcccugug

SEQ ID NO: 1650211 - RNA, 16 nt, Human
agcagcagggagggcu

SEQ ID NO: 1650212 - RNA, 13 nt, Human
agcaggacaugga

SEQ ID NO: 1650213 - RNA, 15 nt, Human
agcagccacauuccu

SEQ ID NO: 1650214 - RNA, 11 nt, Human
agcagccacau

SEQ ID NO: 1650215 - RNA, 14 nt, Human
agcaggcuacuguc

SEQ ID NO: 1650216 - RNA, 16 nt, Human
agcaggcuacugucag

SEQ ID NO: 1650217 - RNA, 17 nt, Human
agcaggcuacugucagc

SEQ ID NO: 1650218 - RNA, 19 nt, Human
agcaggcuacugucagcuc

SEQ ID NO: 1650219 - RNA, 20 nt, Human
agcaggcuacugucagcucc

SEQ ID NO: 1650220 - RNA, 17 nt, Human
agcagucaggaaagaga

SEQ ID NO: 1650221 - RNA, 18 nt, Human
agcagucaggaaagagaa

SEQ ID NO: 1650222 - RNA, 14 nt, Human
agcaguuugcuuug

SEQ ID NO: 1650223 - RNA, 19 nt, Human
agcauaaaaauuagccaag

SEQ ID NO: 1650224 - RNA, 19 nt, Human
agcagucaggaaagagaac

SEQ ID NO: 1650225 - RNA, 18 nt, Human
agcauauauuuuuauauu

SEQ ID NO: 1650226 - RNA, 20 nt, Human
agcauauauuuuuauauuua

SEQ ID NO: 1650227 - RNA, 22 nt, Human
agcauauauuuuuauauuuacu

SEQ ID NO: 1650228 - RNA, 19 nt, Human
ugaguacguugugcauuug

SEQ ID NO: 1650229 - RNA, 18 nt, Human
ugaguacguugugcauuu

SEQ ID NO: 1650230 - RNA, 17 nt, Human
ugaguacguugugcauu

SEQ ID NO: 1650231 - RNA, 16 nt, Human
ugaguacguugugcau

SEQ ID NO: 1650232 - RNA, 15 nt, Human
agcauauauuuuuau

SEQ ID NO: 1650233 - RNA, 19 nt, Human
agcauaccaacacgagcag

SEQ ID NO: 1650234 - RNA, 22 nt, Human
agcauaccaacacgagcaggcu

SEQ ID NO: 1650235 - RNA, 23 nt, Human
agcauaaaaauuagccaagugug

SEQ ID NO: 1650236 - RNA, 13 nt, Human
agcauaccaacac

SEQ ID NO: 1650237 - RNA, 18 nt, Human
ugagucaccaagcccagu

SEQ ID NO: 1650238 - RNA, 20 nt, Human
ugaguacguugugcauuugg

SEQ ID NO: 1650239 - RNA, 14 nt, Human
ugaguacuacaguc

SEQ ID NO: 1650240 - RNA, 13 nt, Human
ugaguccagaagu

SEQ ID NO: 1650241 - RNA, 16 nt, Human
ugagugccuuacacaa

SEQ ID NO: 1650242 - RNA, 17 nt, Human
ugagugcagcucuggag

SEQ ID NO: 1650243 - RNA, 13 nt, Human
ugagugccuuaca

SEQ ID NO: 1650244 - RNA, 14 nt, Human
ugagugccuuacac

SEQ ID NO: 1650245 - RNA, 21 nt, Human
ugagugggggaucacagccuc

SEQ ID NO: 1650246 - RNA, 23 nt, Human
ugagugggggaucacagccucug

SEQ ID NO: 1650247 - RNA, 15 nt, Human
ugauacaaugcugug

SEQ ID NO: 1650248 - RNA, 14 nt, Human
ugauacaaugcugu

SEQ ID NO: 1650249 - RNA, 12 nt, Human
agauacugaaau

SEQ ID NO: 1650250 - RNA, 13 nt, Human
agauacugaaaua

SEQ ID NO: 1650251 - RNA, 15 nt, Human
agauacugaaauaaa

SEQ ID NO: 1650252 - RNA, 17 nt, Human
agauaaagguucaugca

SEQ ID NO: 1650253 - RNA, 12 nt, Human
agauaaaugugc

SEQ ID NO: 1650254 - RNA, 14 nt, Human
agaucacgccacug

SEQ ID NO: 1650255 - RNA, 15 nt, Human
agaucacgccacugc

SEQ ID NO: 1650256 - RNA, 16 nt, Human
agaucacgccacugca

SEQ ID NO: 1650257 - RNA, 22 nt, Human
ugaauuuauuggcuuuucugau

SEQ ID NO: 1650258 - RNA, 23 nt, Human
ugaauuuauuggcuuuucugauc

SEQ ID NO: 1650259 - RNA, 16 nt, Human
ugaauuuuacauggcu

SEQ ID NO: 1650260 - RNA, 15 nt, Human
ugaauuucuuuugcc

SEQ ID NO: 1650261 - RNA, 21 nt, Human
ugaauuuauuggcuuuucuga

SEQ ID NO: 1650262 - RNA, 17 nt, Human
agaucacgccacugcac

SEQ ID NO: 1650263 - RNA, 18 nt, Human
agaucacgccacugcacu

SEQ ID NO: 1650264 - RNA, 19 nt, Human
ugaaugucagugugacuga

SEQ ID NO: 1650265 - RNA, 20 nt, Human
ugaaugguuuucaaaauaaa

SEQ ID NO: 1650266 - RNA, 20 nt, Human
agaguugaugguuguacaua

SEQ ID NO: 1650267 - RNA, 12 nt, Human
agaguuguuaca

SEQ ID NO: 1650268 - RNA, 16 nt, Human
agaguuguuacauuuu

SEQ ID NO: 1650269 - RNA, 16 nt, Human
agaguuuagcuggaaa

SEQ ID NO: 1650270 - RNA, 17 nt, Human
agaguuuagcuggaaaa

SEQ ID NO: 1650271 - RNA, 22 nt, Human
agaguugauacuacaguuuguu

SEQ ID NO: 1650272 - RNA, 20 nt, Human
agaguugauacuacaguuug

SEQ ID NO: 1650273 - RNA, 17 nt, Human
agaguugauacuacagu

SEQ ID NO: 1650274 - RNA, 14 nt, Human
agaugcaccagccc

SEQ ID NO: 1650275 - RNA, 15 nt, Human
agaugcaccagcccu

SEQ ID NO: 1650276 - RNA, 18 nt, Human
agaugcaguucugaagaa

SEQ ID NO: 1650277 - RNA, 19 nt, Human
agaugcaguucugaagaag

SEQ ID NO: 1650278 - RNA, 20 nt, Human
agaugcaguucugaagaaga

SEQ ID NO: 1650279 - RNA, 14 nt, Human
agaugcuagaacuc

SEQ ID NO: 1650280 - RNA, 15 nt, Human
agaugcuagaacucc

SEQ ID NO: 1650281 - RNA, 15 nt, Human
agaugcuucucacug

SEQ ID NO: 1650282 - RNA, 12 nt, Human
ugacccacugcu

SEQ ID NO: 1650283 - RNA, 13 nt, Human
ugacccacugcuu

SEQ ID NO: 1650284 - RNA, 17 nt, Human
ugacccacaagaaauga

SEQ ID NO: 1650285 - RNA, 20 nt, Human
ugacaggcaaugcuggcugu

SEQ ID NO: 1650286 - RNA, 21 nt, Human
ugacacacagcucuguccugg

SEQ ID NO: 1650287 - RNA, 11 nt, Human
ugacagggcac

SEQ ID NO: 1650288 - RNA, 16 nt, Human
ugacagggcacaccgg

SEQ ID NO: 1650289 - RNA, 21 nt, Human
ugacagggcacaccgggcacu

SEQ ID NO: 1650290 - RNA, 20 nt, Human
ugacagggcacaccgggcac

SEQ ID NO: 1650291 - RNA, 12 nt, Human
agaucauuguga

SEQ ID NO: 1650292 - RNA, 13 nt, Human
agaucagccuggg

SEQ ID NO: 1650293 - RNA, 15 nt, Human
agaucagccugggca

SEQ ID NO: 1650294 - RNA, 18 nt, Human
ugaccaaugauggucacc

SEQ ID NO: 1650295 - RNA, 20 nt, Human
ugacauuguuggccaaagcc

SEQ ID NO: 1650296 - RNA, 21 nt, Human
ugacauuguuggccaaagcca

SEQ ID NO: 1650297 - RNA, 19 nt, Human
agaggccaugggccuccug

SEQ ID NO: 1650298 - RNA, 21 nt, Human
agaggcagggucucacucugu

SEQ ID NO: 1650299 - RNA, 10 nt, Human
agaggcaggg

SEQ ID NO: 1650300 - RNA, 13 nt, Human
agaggcagggucu

SEQ ID NO: 1650301 - RNA, 13 nt, Human
agaggcagcccca

SEQ ID NO: 1650302 - RNA, 19 nt, Human
agaggcagccccauucugc

SEQ ID NO: 1650303 - RNA, 12 nt, Human
agagguuuuaaa

SEQ ID NO: 1650304 - RNA, 22 nt, Human
ugaagcacagugaucaaguuau

SEQ ID NO: 1650305 - RNA, 13 nt, Human
agaggcugaggac

SEQ ID NO: 1650306 - RNA, 19 nt, Human
agagguccacaacacacag

SEQ ID NO: 1650307 - RNA, 15 nt, Human
agagguugcagugag

SEQ ID NO: 1650308 - RNA, 15 nt, Human
agagcuuaacagugu

SEQ ID NO: 1650309 - RNA, 21 nt, Human
agagcuguucacagccagacu

SEQ ID NO: 1650310 - RNA, 22 nt, Human
ugaacuuugaccucugcagcaa

SEQ ID NO: 1650311 - RNA, 20 nt, Human
ugaacuuugaccucugcagc

SEQ ID NO: 1650312 - RNA, 19 nt, Human
ugaacuuugaccucugcag

SEQ ID NO: 1650313 - RNA, 22 nt, Human
agagcugcccucuccugggcag

SEQ ID NO: 1650314 - RNA, 21 nt, Human
ugaacuaggauuguaguccca

SEQ ID NO: 1650315 - RNA, 12 nt, Human
ugaacuccuggc

SEQ ID NO: 1650316 - RNA, 14 nt, Human
ugaacuccuggccu

SEQ ID NO: 1650317 - RNA, 15 nt, Human
ugaacuccuggccuc

SEQ ID NO: 1650318 - RNA, 15 nt, Human
ugaaauuuuuauuaa

SEQ ID NO: 1650319 - RNA, 19 nt, Human
ugaacaaauuuacagagac

SEQ ID NO: 1650320 - RNA, 20 nt, Human
ugaacaaauuuacagagaca

SEQ ID NO: 1650321 - RNA, 17 nt, Human
ugaaauuugaauuuugu

SEQ ID NO: 1650322 - RNA, 14 nt, Human
ugaaauuugaauuu

SEQ ID NO: 1650323 - RNA, 15 nt, Human
ugaaauuugaauuuu

SEQ ID NO: 1650324 - RNA, 16 nt, Human
ugaaauuugaauuuug

SEQ ID NO: 1650325 - RNA, 21 nt, Human
ugaaauuguaauuauaucuga

SEQ ID NO: 1650326 - RNA, 23 nt, Human
ugaaauuuccugggagcuuuugu

SEQ ID NO: 1650327 - RNA, 15 nt, Human
ugaaauuguauuaca

SEQ ID NO: 1650328 - RNA, 18 nt, Human
ugaaauauuauguuaaaa

SEQ ID NO: 1650329 - RNA, 18 nt, Human
agagcugccaccugccug

SEQ ID NO: 1650330 - RNA, 14 nt, Human
agagcugcccucuc

SEQ ID NO: 1650331 - RNA, 13 nt, Human
agagcugcccucu

SEQ ID NO: 1650332 - RNA, 15 nt, Human
agagcugcccucucc

SEQ ID NO: 1650333 - RNA, 17 nt, Human
ugaaauaagccagacau

SEQ ID NO: 1650334 - RNA, 18 nt, Human
ugaaauaagccagacauc

SEQ ID NO: 1650335 - RNA, 20 nt, Human
ugaaauaagccagacaucaa

SEQ ID NO: 1650336 - RNA, 23 nt, Human
ugaaauaagccagacaucaacag

SEQ ID NO: 1650337 - RNA, 11 nt, Human
agagccuugcg

SEQ ID NO: 1650338 - RNA, 21 nt, Human
agagccuugcggaagguucua

SEQ ID NO: 1650339 - RNA, 20 nt, Human
agagcagagaccaucccuga

SEQ ID NO: 1650340 - RNA, 17 nt, Human
agagcagagaccauccc

SEQ ID NO: 1650341 - RNA, 18 nt, Human
agagcagagaccaucccu

SEQ ID NO: 1650342 - RNA, 23 nt, Human
agagauuuuuuuguuguuuguuu

SEQ ID NO: 1650343 - RNA, 22 nt, Human
agagauuuuuuuguuguuuguu

SEQ ID NO: 1650344 - RNA, 17 nt, Human
ucuuuggacccugaggc

SEQ ID NO: 1650345 - RNA, 21 nt, Human
ucuuuggacccugaggcccag

SEQ ID NO: 1650346 - RNA, 21 nt, Human
agagcaccuuagacagucccu

SEQ ID NO: 1650347 - RNA, 12 nt, Human
agagcagagacc

SEQ ID NO: 1650348 - RNA, 15 nt, Human
agaccccuggcuuuu

SEQ ID NO: 1650349 - RNA, 21 nt, Human
agaccccuggcuuuucacugc

SEQ ID NO: 1650350 - RNA, 14 nt, Human
agacccggcugcgu

SEQ ID NO: 1650351 - RNA, 22 nt, Human
agaccugccccuccucucugcc

SEQ ID NO: 1650352 - RNA, 23 nt, Human
agaccugccccuccucucugccc

SEQ ID NO: 1650353 - RNA, 16 nt, Human
agaccugccccuccuc

SEQ ID NO: 1650354 - RNA, 23 nt, Human
agacuauucaaacagucucagga

SEQ ID NO: 1650355 - RNA, 21 nt, Human
agacucaguggggaggggcug

SEQ ID NO: 1650356 - RNA, 17 nt, Human
ucuugagccuugaacuu

SEQ ID NO: 1650357 - RNA, 15 nt, Human
agacucauucuucug

SEQ ID NO: 1650358 - RNA, 19 nt, Human
ucuugagccuugaacuuug

SEQ ID NO: 1650359 - RNA, 18 nt, Human
ucuugagccuugaacuuu

SEQ ID NO: 1650360 - RNA, 20 nt, Human
ucuugagccuugaacuuuga

SEQ ID NO: 1650361 - RNA, 23 nt, Human
ucuucuguacgucugacaggcaa

SEQ ID NO: 1650362 - RNA, 23 nt, Human
agacauacuaaccagcagaaaug

SEQ ID NO: 1650363 - RNA, 14 nt, Human
agacauagaauuaa

SEQ ID NO: 1650364 - RNA, 21 nt, Human
ucuucuguacgucugacaggc

SEQ ID NO: 1650365 - RNA, 22 nt, Human
ucuucuguacgucugacaggca

SEQ ID NO: 1650366 - RNA, 22 nt, Human
ucuucugcuucagccucccgag

SEQ ID NO: 1650367 - RNA, 16 nt, Human
ucuuauuucauuucuu

SEQ ID NO: 1650368 - RNA, 15 nt, Human
ucuuauuucauuucu

SEQ ID NO: 1650369 - RNA, 17 nt, Human
ucuuauuuaaugaaaga

SEQ ID NO: 1650370 - RNA, 14 nt, Human
ucuuuaauuuuaca

SEQ ID NO: 1650371 - RNA, 22 nt, Human
ucuuuaaugucacaggcagguc

SEQ ID NO: 1650372 - RNA, 16 nt, Human
ucuugguuuguaaauu

SEQ ID NO: 1650373 - RNA, 20 nt, Human
ucuuuaaugucacaggcagg

SEQ ID NO: 1650374 - RNA, 14 nt, Human
ucuugguuuguaaa

SEQ ID NO: 1650375 - RNA, 14 nt, Human
ucuuucuuccucug

SEQ ID NO: 1650376 - RNA, 19 nt, Human
ucuuucuggcuaugcauuu

SEQ ID NO: 1650377 - RNA, 18 nt, Human
ucuuucuggcuaugcauu

SEQ ID NO: 1650378 - RNA, 20 nt, Human
ucuuuauaauucuacuuuga

SEQ ID NO: 1650379 - RNA, 13 nt, Human
ucuuucugcuuug

SEQ ID NO: 1650380 - RNA, 15 nt, Human
ucuuucuuccucugc

SEQ ID NO: 1650381 - RNA, 16 nt, Human
ucuuucuuccucugcu

SEQ ID NO: 1650382 - RNA, 17 nt, Human
ucuuucuuccucugcug

SEQ ID NO: 1650383 - RNA, 15 nt, Human
agacucgcgacaaug

SEQ ID NO: 1650384 - RNA, 17 nt, Human
agacucgcgacaaugca

SEQ ID NO: 1650385 - RNA, 18 nt, Human
agacucgcgacaaugcaa

SEQ ID NO: 1650386 - RNA, 19 nt, Human
agacucgcgacaaugcaaa

SEQ ID NO: 1650387 - RNA, 14 nt, Human
agacugucucaaga

SEQ ID NO: 1650388 - RNA, 12 nt, Human
agacuggugacu

SEQ ID NO: 1650389 - RNA, 13 nt, Human
agacuggugacug

SEQ ID NO: 1650390 - RNA, 14 nt, Human
agacuggugacuga

SEQ ID NO: 1650391 - RNA, 20 nt, Human
agacucgcgacaaugcaaac

SEQ ID NO: 1650392 - RNA, 16 nt, Human
agacuggugacugauu

SEQ ID NO: 1650393 - RNA, 17 nt, Human
agacuggugacugauuc

SEQ ID NO: 1650394 - RNA, 19 nt, Human
agacuggugacugauucuu

SEQ ID NO: 1650395 - RNA, 15 nt, Human
agacuguacaaagua

SEQ ID NO: 1650396 - RNA, 16 nt, Human
agacuguacaaaguag

SEQ ID NO: 1650397 - RNA, 18 nt, Human
agacuuguaugaaagaug

SEQ ID NO: 1650398 - RNA, 19 nt, Human
agacuuuuuuuaaauagua

SEQ ID NO: 1650399 - RNA, 22 nt, Human
agagaaaaaauauuuuccugcc

SEQ ID NO: 1650400 - RNA, 15 nt, Human
agagacacaagccuu

SEQ ID NO: 1650401 - RNA, 24 nt, Human
agagacagaaagcagaacagugau

SEQ ID NO: 1650402 - RNA, 14 nt, Human
ucuguacuuuuugg

SEQ ID NO: 1650403 - RNA, 17 nt, Human
ucuguacuuuuuggcau

SEQ ID NO: 1650404 - RNA, 13 nt, Human
ucuguacuuuuug

SEQ ID NO: 1650405 - RNA, 22 nt, Human
ucugugaacuugaaauuugaau

SEQ ID NO: 1650406 - RNA, 19 nt, Human
ucugugaacuugaaauuug

SEQ ID NO: 1650407 - RNA, 17 nt, Human
ucuguucugcacacagc

SEQ ID NO: 1650408 - RNA, 18 nt, Human
ucuguucugcacacagca

SEQ ID NO: 1650409 - RNA, 19 nt, Human
ucuguucugcacacagcac

SEQ ID NO: 1650410 - RNA, 19 nt, Human
ucuguuuagauaauacacc

SEQ ID NO: 1650411 - RNA, 16 nt, Human
ucuguuuagauaauac

SEQ ID NO: 1650412 - RNA, 23 nt, Human
ucuguuuagauaauacaccacua

SEQ ID NO: 1650413 - RNA, 23 nt, Human
agaaccccaggguccuguagccc

SEQ ID NO: 1650414 - RNA, 21 nt, Human
agaauguguuuaaacuugguu

SEQ ID NO: 1650415 - RNA, 19 nt, Human
agaauuaguggcacuugcu

SEQ ID NO: 1650416 - RNA, 22 nt, Human
ucuggguuccuuccucugagcc

SEQ ID NO: 1650417 - RNA, 23 nt, Human
ucuggguuccuuccucugagccu

SEQ ID NO: 1650418 - RNA, 14 nt, Human
agaauucucuaguu

SEQ ID NO: 1650419 - RNA, 20 nt, Human
agaauuauaauuaguuccuc

SEQ ID NO: 1650420 - RNA, 20 nt, Human
agaauucucagaaucucaaa

SEQ ID NO: 1650421 - RNA, 19 nt, Human
ucuuacugucuuuuuucua

SEQ ID NO: 1650422 - RNA, 14 nt, Human
ucuuagauguauau

SEQ ID NO: 1650423 - RNA, 12 nt, Human
ucuuagauguau

SEQ ID NO: 1650424 - RNA, 23 nt, Human
ucuuagaugcaguucugaagaag

SEQ ID NO: 1650425 - RNA, 13 nt, Human
agacagucccugc

SEQ ID NO: 1650426 - RNA, 14 nt, Human
agacagucccugcc

SEQ ID NO: 1650427 - RNA, 15 nt, Human
agacagcugccuggg

SEQ ID NO: 1650428 - RNA, 16 nt, Human
agacagcugccuggga

SEQ ID NO: 1650429 - RNA, 12 nt, Human
agacagucccug

SEQ ID NO: 1650430 - RNA, 14 nt, Human
ucuuaauuaaaaga

SEQ ID NO: 1650431 - RNA, 12 nt, Human
agacagaaaaaa

SEQ ID NO: 1650432 - RNA, 13 nt, Human
agacagcugccug

SEQ ID NO: 1650433 - RNA, 14 nt, Human
agacagcugccugg

SEQ ID NO: 1650434 - RNA, 23 nt, Human
agacacaggcccggcuccaggcu

SEQ ID NO: 1650435 - RNA, 21 nt, Human
agacacauguccaagaagccc

SEQ ID NO: 1650436 - RNA, 22 nt, Human
agacacauguccaagaagccca

SEQ ID NO: 1650437 - RNA, 22 nt, Human
agacaccuugacagggcacacc

SEQ ID NO: 1650438 - RNA, 24 nt, Human
agacacauguccaagaagcccagg

SEQ ID NO: 1650439 - RNA, 19 nt, Human
agacacaggcccggcucca

SEQ ID NO: 1650440 - RNA, 20 nt, Human
agacacaggcccggcuccag

SEQ ID NO: 1650441 - RNA, 21 nt, Human
agacacaggcccggcuccagg

SEQ ID NO: 1650442 - RNA, 22 nt, Human
agacacaggcccggcuccaggc

SEQ ID NO: 1650443 - RNA, 16 nt, Human
agacacacugaagaag

SEQ ID NO: 1650444 - RNA, 17 nt, Human
agacacaggcccggcuc

SEQ ID NO: 1650445 - RNA, 17 nt, Human
agacacacugaagaagc

SEQ ID NO: 1650446 - RNA, 19 nt, Human
agaauucucuaguuugauu

SEQ ID NO: 1650447 - RNA, 18 nt, Human
agaauucucuaguuugau

SEQ ID NO: 1650448 - RNA, 17 nt, Human
agaauucucuuauccaa

SEQ ID NO: 1650449 - RNA, 14 nt, Human
agacacaagccuuc

SEQ ID NO: 1650450 - RNA, 13 nt, Human
agacacaagccuu

SEQ ID NO: 1650451 - RNA, 22 nt, Human
ucuccaaaauaaaacuuuuuaa

SEQ ID NO: 1650452 - RNA, 19 nt, Human
ucuccaaaauaaaacuuuu

SEQ ID NO: 1650453 - RNA, 17 nt, Human
ucuccaaaauaaaacuu

SEQ ID NO: 1650454 - RNA, 15 nt, Human
ucuccaagcaggaca

SEQ ID NO: 1650455 - RNA, 16 nt, Human
ucuccaggcuguaucc

SEQ ID NO: 1650456 - RNA, 19 nt, Human
ucucagggccuggucguuu

SEQ ID NO: 1650457 - RNA, 14 nt, Human
ucucagggccuggu

SEQ ID NO: 1650458 - RNA, 15 nt, Human
ucucagggccugguc

SEQ ID NO: 1650459 - RNA, 12 nt, Human
ucucagggccug

SEQ ID NO: 1650460 - RNA, 13 nt, Human
ucucagggccugg

SEQ ID NO: 1650461 - RNA, 12 nt, Human
ucucaggaaauc

SEQ ID NO: 1650462 - RNA, 16 nt, Human
ucuccauguuugaugu

SEQ ID NO: 1650463 - RNA, 14 nt, Human
acuuugaccucugc

SEQ ID NO: 1650464 - RNA, 17 nt, Human
acuuucuagccagagga

SEQ ID NO: 1650465 - RNA, 21 nt, Human
ucuccuccuuuucacaguucu

SEQ ID NO: 1650466 - RNA, 23 nt, Human
acuuguuagaucuaguucacucu

SEQ ID NO: 1650467 - RNA, 14 nt, Human
acuuguuagaucua

SEQ ID NO: 1650468 - RNA, 15 nt, Human
acuuguuagaucuag

SEQ ID NO: 1650469 - RNA, 16 nt, Human
acuuguguuuugcaag

SEQ ID NO: 1650470 - RNA, 21 nt, Human
ucucacagcuccaagaauuuc

SEQ ID NO: 1650471 - RNA, 11 nt, Human
ucucacuccuu

SEQ ID NO: 1650472 - RNA, 14 nt, Human
acuucaggcucuuc

SEQ ID NO: 1650473 - RNA, 16 nt, Human
acuucaggcucuucuc

SEQ ID NO: 1650474 - RNA, 11 nt, Human
acuucagcuga

SEQ ID NO: 1650475 - RNA, 16 nt, Human
acuucagcugacuuuu

SEQ ID NO: 1650476 - RNA, 15 nt, Human
acuuccugugacuuc

SEQ ID NO: 1650477 - RNA, 16 nt, Human
ucucacuauguugccc

SEQ ID NO: 1650478 - RNA, 13 nt, Human
ucucacuccuuga

SEQ ID NO: 1650479 - RNA, 16 nt, Human
ucucacucugucgccc

SEQ ID NO: 1650480 - RNA, 12 nt, Human
ucucacucuguc

SEQ ID NO: 1650481 - RNA, 14 nt, Human
acuucuccacccug

SEQ ID NO: 1650482 - RNA, 23 nt, Human
acuucuaaguaaaaccacagcag

SEQ ID NO: 1650483 - RNA, 14 nt, Human
acuugcucuugaug

SEQ ID NO: 1650484 - RNA, 16 nt, Human
acuuguggacacagcu

SEQ ID NO: 1650485 - RNA, 17 nt, Human
acuuguggacacagcuc

SEQ ID NO: 1650486 - RNA, 18 nt, Human
acuuguggacacagcucu

SEQ ID NO: 1650487 - RNA, 16 nt, Human
acuugucaauaaaauc

SEQ ID NO: 1650488 - RNA, 20 nt, Human
acuugaaauuugaauuuugu

SEQ ID NO: 1650489 - RNA, 19 nt, Human
acuugaaauuugaauuuug

SEQ ID NO: 1650490 - RNA, 18 nt, Human
acuucuccacccugcucu

SEQ ID NO: 1650491 - RNA, 15 nt, Human
acuucuccacccugc

SEQ ID NO: 1650492 - RNA, 16 nt, Human
acuucuccacccugcu

SEQ ID NO: 1650493 - RNA, 21 nt, Human
acuugaacccauauuuguaca

SEQ ID NO: 1650494 - RNA, 19 nt, Human
acuugaacccgggaggcag

SEQ ID NO: 1650495 - RNA, 20 nt, Human
acuugaacccgggaggcaga

SEQ ID NO: 1650496 - RNA, 19 nt, Human
acuugagcccagagugaac

SEQ ID NO: 1650497 - RNA, 21 nt, Human
acuugaacccgggaggcagag

SEQ ID NO: 1650498 - RNA, 17 nt, Human
ucucucacuuguuuuau

SEQ ID NO: 1650499 - RNA, 21 nt, Human
ucucucacuuguuuuauuuaa

SEQ ID NO: 1650500 - RNA, 13 nt, Human
ucucucacuccuu

SEQ ID NO: 1650501 - RNA, 15 nt, Human
ucucucacuccuuga

SEQ ID NO: 1650502 - RNA, 14 nt, Human
acuuucugaaauaa

SEQ ID NO: 1650503 - RNA, 18 nt, Human
acuuugaccucugcagca

SEQ ID NO: 1650504 - RNA, 16 nt, Human
acuuugaccucugcag

SEQ ID NO: 1650505 - RNA, 15 nt, Human
acuuugaccucugca

SEQ ID NO: 1650506 - RNA, 17 nt, Human
ucucuccagccccugga

SEQ ID NO: 1650507 - RNA, 18 nt, Human
ucucuccagccccuggau

SEQ ID NO: 1650508 - RNA, 19 nt, Human
ucucuccagccccuggaug

SEQ ID NO: 1650509 - RNA, 17 nt, Human
ucucuccuguaccucuu

SEQ ID NO: 1650510 - RNA, 16 nt, Human
ucucuccuguaccucu

SEQ ID NO: 1650511 - RNA, 14 nt, Human
ucucuccuguaccu

SEQ ID NO: 1650512 - RNA, 11 nt, Human
ucucugcccuc

SEQ ID NO: 1650513 - RNA, 15 nt, Human
ucucugcccuccaag

SEQ ID NO: 1650514 - RNA, 16 nt, Human
ucucugcccuccaaga

SEQ ID NO: 1650515 - RNA, 17 nt, Human
ucucugcccuccaagac

SEQ ID NO: 1650516 - RNA, 15 nt, Human
ucucuggaauuugaa

SEQ ID NO: 1650517 - RNA, 19 nt, Human
ucucuggaauuugaaacac

SEQ ID NO: 1650518 - RNA, 12 nt, Human
ucucuggccuuc

SEQ ID NO: 1650519 - RNA, 21 nt, Human
agaaaacuuguauuaugugug

SEQ ID NO: 1650520 - RNA, 18 nt, Human
agaaaaaggaugcacaga

SEQ ID NO: 1650521 - RNA, 19 nt, Human
agaaaacuuguauuaugug

SEQ ID NO: 1650522 - RNA, 17 nt, Human
agaaaaaggaugcacag

SEQ ID NO: 1650523 - RNA, 20 nt, Human
agaaacgaucagacagaucu

SEQ ID NO: 1650524 - RNA, 13 nt, Human
agaaaaagaaaaa

SEQ ID NO: 1650525 - RNA, 20 nt, Human
ucucuuuaaugucacaggca

SEQ ID NO: 1650526 - RNA, 21 nt, Human
ucucuuuaaugucacaggcag

SEQ ID NO: 1650527 - RNA, 21 nt, Human
ucucuggccuucggccuccau

SEQ ID NO: 1650528 - RNA, 22 nt, Human
ucucuggccuucggccuccauc

SEQ ID NO: 1650529 - RNA, 23 nt, Human
ucucuggccuucggccuccaucc

SEQ ID NO: 1650530 - RNA, 14 nt, Human
ucucuugauucaua

SEQ ID NO: 1650531 - RNA, 16 nt, Human
ucucuugauucauaau

SEQ ID NO: 1650532 - RNA, 18 nt, Human
ucucuugagccugggagg

SEQ ID NO: 1650533 - RNA, 15 nt, Human
ucugaagucagaucu

SEQ ID NO: 1650534 - RNA, 18 nt, Human
ucugaagucacugcacag

SEQ ID NO: 1650535 - RNA, 15 nt, Human
ucugaagucacugca

SEQ ID NO: 1650536 - RNA, 16 nt, Human
ucugaagucacugcac

SEQ ID NO: 1650537 - RNA, 19 nt, Human
ucugaagucagaucugccu

SEQ ID NO: 1650538 - RNA, 16 nt, Human
ucugaagugaaacugc

SEQ ID NO: 1650539 - RNA, 15 nt, Human
ucugacaacagacuu

SEQ ID NO: 1650540 - RNA, 16 nt, Human
ucugacaacagacuuc

SEQ ID NO: 1650541 - RNA, 12 nt, Human
ucugacacacag

SEQ ID NO: 1650542 - RNA, 18 nt, Human
agaaaugaaaaaauauau

SEQ ID NO: 1650543 - RNA, 23 nt, Human
agaaaugaaaaaauauauaucaa

SEQ ID NO: 1650544 - RNA, 14 nt, Human
agaaaugaaagcag

SEQ ID NO: 1650545 - RNA, 12 nt, Human
ucugaagaagau

SEQ ID NO: 1650546 - RNA, 14 nt, Human
agaaagaaaaucag

SEQ ID NO: 1650547 - RNA, 12 nt, Human
agaaaucuaaaa

SEQ ID NO: 1650548 - RNA, 15 nt, Human
agaaaucuaaaaaac

SEQ ID NO: 1650549 - RNA, 17 nt, Human
agaaaugaaaaaauaua

SEQ ID NO: 1650550 - RNA, 14 nt, Human
agaaauauaauuga

SEQ ID NO: 1650551 - RNA, 19 nt, Human
agaaauaucugaaaaugua

SEQ ID NO: 1650552 - RNA, 20 nt, Human
agaaauaucugaaaauguau

SEQ ID NO: 1650553 - RNA, 18 nt, Human
ucugcaggucccuaauaa

SEQ ID NO: 1650554 - RNA, 13 nt, Human
agaaauuaugugc

SEQ ID NO: 1650555 - RNA, 21 nt, Human
agaaauuaugugccagauuua

SEQ ID NO: 1650556 - RNA, 22 nt, Human
agaaauuaugugccagauuuau

SEQ ID NO: 1650557 - RNA, 16 nt, Human
agaaauuuauaaacuu

SEQ ID NO: 1650558 - RNA, 17 nt, Human
agaaauuuauaaacuuu

SEQ ID NO: 1650559 - RNA, 15 nt, Human
ucugcaggucccuaa

SEQ ID NO: 1650560 - RNA, 16 nt, Human
ucugcaggucccuaau

SEQ ID NO: 1650561 - RNA, 17 nt, Human
ucugcaggucccuaaua

SEQ ID NO: 1650562 - RNA, 20 nt, Human
ucugcacuccccugcugggu

SEQ ID NO: 1650563 - RNA, 22 nt, Human
ucugcacuccccugcugggugu

SEQ ID NO: 1650564 - RNA, 23 nt, Human
ucugaugcaagcaagaaacacug

SEQ ID NO: 1650565 - RNA, 13 nt, Human
ucugauacagaaa

SEQ ID NO: 1650566 - RNA, 18 nt, Human
ucugauucccaagcucug

SEQ ID NO: 1650567 - RNA, 18 nt, Human
ucugcacuccccugcugg

SEQ ID NO: 1650568 - RNA, 19 nt, Human
ucugcacuccccugcuggg

SEQ ID NO: 1650569 - RNA, 23 nt, Human
ucugagacucgcgacaaugcaaa

SEQ ID NO: 1650570 - RNA, 14 nt, Human
acuggccucugcug

SEQ ID NO: 1650571 - RNA, 16 nt, Human
acuggccucugcugau

SEQ ID NO: 1650572 - RNA, 15 nt, Human
uccuucagugccuua

SEQ ID NO: 1650573 - RNA, 16 nt, Human
uccuucagugccuuau

SEQ ID NO: 1650574 - RNA, 17 nt, Human
uccuucagugccuuaug

SEQ ID NO: 1650575 - RNA, 23 nt, Human
uccuuguguuacuaaguuuuuau

SEQ ID NO: 1650576 - RNA, 14 nt, Human
uccuuguguuacua

SEQ ID NO: 1650577 - RNA, 15 nt, Human
uccuuuagcgcccag

SEQ ID NO: 1650578 - RNA, 19 nt, Human
uccuuuagcgcccaguugg

SEQ ID NO: 1650579 - RNA, 22 nt, Human
uccuuuagcgcccaguugggug

SEQ ID NO: 1650580 - RNA, 23 nt, Human
uccuuuagcgcccaguugggugg

SEQ ID NO: 1650581 - RNA, 18 nt, Human
ucgagaaacagccugugu

SEQ ID NO: 1650582 - RNA, 18 nt, Human
ucgcuauugucaccaggg

SEQ ID NO: 1650583 - RNA, 16 nt, Human
ucgagcaugccuggau

SEQ ID NO: 1650584 - RNA, 18 nt, Human
ucgagcaugccuggaugg

SEQ ID NO: 1650585 - RNA, 19 nt, Human
ucgcgacaaugcaaaccau

SEQ ID NO: 1650586 - RNA, 13 nt, Human
ucgaggacaggga

SEQ ID NO: 1650587 - RNA, 16 nt, Human
ucgcgacaaugcaaac

SEQ ID NO: 1650588 - RNA, 14 nt, Human
acugcuggcugccu

SEQ ID NO: 1650589 - RNA, 15 nt, Human
acugcuggcugccuu

SEQ ID NO: 1650590 - RNA, 18 nt, Human
acugcuuaacuucacaua

SEQ ID NO: 1650591 - RNA, 13 nt, Human
acugccuucucaa

SEQ ID NO: 1650592 - RNA, 19 nt, Human
acugccuucucaacuccaa

SEQ ID NO: 1650593 - RNA, 20 nt, Human
acugccuucucaacuccaaa

SEQ ID NO: 1650594 - RNA, 17 nt, Human
acugcuuccagugaggc

SEQ ID NO: 1650595 - RNA, 20 nt, Human
acugcuuaacuucacauauu

SEQ ID NO: 1650596 - RNA, 14 nt, Human
acugcuuuuggucu

SEQ ID NO: 1650597 - RNA, 13 nt, Human
acugcuuguuucc

SEQ ID NO: 1650598 - RNA, 16 nt, Human
acugcuuguuuccuag

SEQ ID NO: 1650599 - RNA, 21 nt, Human
acuggcacaguuuucugagaa

SEQ ID NO: 1650600 - RNA, 19 nt, Human
acuggcacaguuuucugag

SEQ ID NO: 1650601 - RNA, 20 nt, Human
acuggcacaguuuucugaga

SEQ ID NO: 1650602 - RNA, 15 nt, Human
acuggauuaaacuua

SEQ ID NO: 1650603 - RNA, 13 nt, Human
acuggcacaguuu

SEQ ID NO: 1650604 - RNA, 17 nt, Human
acugcauccuccgccuc

SEQ ID NO: 1650605 - RNA, 20 nt, Human
acugcauccuccgccucccg

SEQ ID NO: 1650606 - RNA, 20 nt, Human
acugcaucaagaugugacau

SEQ ID NO: 1650607 - RNA, 22 nt, Human
acugcaucaagaugugacaugu

SEQ ID NO: 1650608 - RNA, 23 nt, Human
acugcauccuccgccucccgggu

SEQ ID NO: 1650609 - RNA, 16 nt, Human
acugcauguuugugau

SEQ ID NO: 1650610 - RNA, 15 nt, Human
acugcauguuuguga

SEQ ID NO: 1650611 - RNA, 16 nt, Human
acugcauaugaaagga

SEQ ID NO: 1650612 - RNA, 21 nt, Human
uccuagaaauuccccacccug

SEQ ID NO: 1650613 - RNA, 22 nt, Human
uccuagaaauuccccacccuga

SEQ ID NO: 1650614 - RNA, 14 nt, Human
acugccucuuccuc

SEQ ID NO: 1650615 - RNA, 15 nt, Human
acugccucuuccucc

SEQ ID NO: 1650616 - RNA, 16 nt, Human
acugccuauuuuaaua

SEQ ID NO: 1650617 - RNA, 21 nt, Human
acugccuauuuuaauaaacac

SEQ ID NO: 1650618 - RNA, 15 nt, Human
acugcauuauauuua

SEQ ID NO: 1650619 - RNA, 14 nt, Human
acugcauuauauuu

SEQ ID NO: 1650620 - RNA, 12 nt, Human
acugugugcuca

SEQ ID NO: 1650621 - RNA, 15 nt, Human
acugugugcucagga

SEQ ID NO: 1650622 - RNA, 19 nt, Human
acugugugcucaggagccc

SEQ ID NO: 1650623 - RNA, 20 nt, Human
acugugugcucaggagcccu

SEQ ID NO: 1650624 - RNA, 21 nt, Human
acugugugcucaggagcccug

SEQ ID NO: 1650625 - RNA, 18 nt, Human
acuguggugacuuuggau

SEQ ID NO: 1650626 - RNA, 20 nt, Human
acuguggugacuuuggauaa

SEQ ID NO: 1650627 - RNA, 21 nt, Human
acuguggugacuuuggauaau

SEQ ID NO: 1650628 - RNA, 12 nt, Human
acuguggugacu

SEQ ID NO: 1650629 - RNA, 14 nt, Human
acuguggugacuuu

SEQ ID NO: 1650630 - RNA, 15 nt, Human
acuguggugacuuug

SEQ ID NO: 1650631 - RNA, 18 nt, Human
acuguggguagacacaca

SEQ ID NO: 1650632 - RNA, 17 nt, Human
acugggagaaaugaaaa

SEQ ID NO: 1650633 - RNA, 21 nt, Human
acugucagcuccccucggaga

SEQ ID NO: 1650634 - RNA, 16 nt, Human
acugggagaaaugaaa

SEQ ID NO: 1650635 - RNA, 18 nt, Human
acugggacaggggagaac

SEQ ID NO: 1650636 - RNA, 18 nt, Human
acuguccuacccacccuc

SEQ ID NO: 1650637 - RNA, 23 nt, Human
acuguccuacccacccuccuuuc

SEQ ID NO: 1650638 - RNA, 17 nt, Human
acuguccuacccacccu

SEQ ID NO: 1650639 - RNA, 22 nt, Human
acugucagcuccccucggagaa

SEQ ID NO: 1650640 - RNA, 17 nt, Human
ucguuugaaucacagua

SEQ ID NO: 1650641 - RNA, 22 nt, Human
ucguuuucaaaauuguuacaaa

SEQ ID NO: 1650642 - RNA, 16 nt, Human
ucguaaaauuaagaaa

SEQ ID NO: 1650643 - RNA, 13 nt, Human
ucguaaaauuaag

SEQ ID NO: 1650644 - RNA, 18 nt, Human
ucggcucacugcauccuc

SEQ ID NO: 1650645 - RNA, 17 nt, Human
ucgggaggucgaggcag

SEQ ID NO: 1650646 - RNA, 19 nt, Human
ucgggaggucgaggcagga

SEQ ID NO: 1650647 - RNA, 21 nt, Human
ucgggaggucgaggcaggagg

SEQ ID NO: 1650648 - RNA, 11 nt, Human
ucgggcaugac

SEQ ID NO: 1650649 - RNA, 12 nt, Human
ucgggcaugaca

SEQ ID NO: 1650650 - RNA, 22 nt, Human
ucggguuuuauuguuuaaaauc

SEQ ID NO: 1650651 - RNA, 16 nt, Human
acuuaaauaaugugaa

SEQ ID NO: 1650652 - RNA, 18 nt, Human
acuuaaauaaugugaaac

SEQ ID NO: 1650653 - RNA, 17 nt, Human
acuuaaauaaugugaaa

SEQ ID NO: 1650654 - RNA, 17 nt, Human
acuuaagcauuuaggaa

SEQ ID NO: 1650655 - RNA, 12 nt, Human
acuguugcccag

SEQ ID NO: 1650656 - RNA, 13 nt, Human
acuguugcccagg

SEQ ID NO: 1650657 - RNA, 14 nt, Human
acuguugcccaggc

SEQ ID NO: 1650658 - RNA, 17 nt, Human
acuguugcccaggcugg

SEQ ID NO: 1650659 - RNA, 18 nt, Human
acuguugcccaggcuggc

SEQ ID NO: 1650660 - RNA, 16 nt, Human
acuuaaucuaaaugga

SEQ ID NO: 1650661 - RNA, 15 nt, Human
acuuaaucuaaaugg

SEQ ID NO: 1650662 - RNA, 13 nt, Human
acuuaaucuaaau

SEQ ID NO: 1650663 - RNA, 16 nt, Human
acuuagaaauugcauu

SEQ ID NO: 1650664 - RNA, 14 nt, Human
acuucagcucuguu

SEQ ID NO: 1650665 - RNA, 21 nt, Human
acuguucucugcccuccaaga

SEQ ID NO: 1650666 - RNA, 15 nt, Human
acuguucucugcccu

SEQ ID NO: 1650667 - RNA, 20 nt, Human
acuguucucugcccuccaag

SEQ ID NO: 1650668 - RNA, 14 nt, Human
acuguucucugccc

SEQ ID NO: 1650669 - RNA, 13 nt, Human
acuguuauuuaua

SEQ ID NO: 1650670 - RNA, 14 nt, Human
acuguuauuuauaa

SEQ ID NO: 1650671 - RNA, 22 nt, Human
ucuaccagccucccuauuuuuu

SEQ ID NO: 1650672 - RNA, 16 nt, Human
ucuaaagcugccagcc

SEQ ID NO: 1650673 - RNA, 15 nt, Human
ucuaaagcugccagc

SEQ ID NO: 1650674 - RNA, 13 nt, Human
ucuaaagcugcca

SEQ ID NO: 1650675 - RNA, 14 nt, Human
ucuaaagcugccag

SEQ ID NO: 1650676 - RNA, 20 nt, Human
ucuaaagccauuguaguccu

SEQ ID NO: 1650677 - RNA, 21 nt, Human
ucuaaguaaaaccacagcagu

SEQ ID NO: 1650678 - RNA, 22 nt, Human
ucuaaguaaaaccacagcaguu

SEQ ID NO: 1650679 - RNA, 23 nt, Human
ucuaaguaaaaccacagcaguug

SEQ ID NO: 1650680 - RNA, 16 nt, Human
ucuacauacuauggaa

SEQ ID NO: 1650681 - RNA, 15 nt, Human
acuacaggcacccac

SEQ ID NO: 1650682 - RNA, 14 nt, Human
acuacaguuuguua

SEQ ID NO: 1650683 - RNA, 13 nt, Human
acuacaguuuguu

SEQ ID NO: 1650684 - RNA, 11 nt, Human
acuacaggcac

SEQ ID NO: 1650685 - RNA, 12 nt, Human
acuaaccacgcu

SEQ ID NO: 1650686 - RNA, 14 nt, Human
acuacauucuguua

SEQ ID NO: 1650687 - RNA, 13 nt, Human
acuacauucuguu

SEQ ID NO: 1650688 - RNA, 12 nt, Human
acuacauucugu

SEQ ID NO: 1650689 - RNA, 11 nt, Human
acuacauucug

SEQ ID NO: 1650690 - RNA, 15 nt, Human
acuacaguuuguuag

SEQ ID NO: 1650691 - RNA, 12 nt, Human
ucccagccccaa

SEQ ID NO: 1650692 - RNA, 17 nt, Human
ucccagcugugcucugg

SEQ ID NO: 1650693 - RNA, 18 nt, Human
ucccagccagcaguucag

SEQ ID NO: 1650694 - RNA, 17 nt, Human
ucccagccagcaguuca

SEQ ID NO: 1650695 - RNA, 15 nt, Human
acuacauucuguuaa

SEQ ID NO: 1650696 - RNA, 17 nt, Human
uccccaugucucgacuc

SEQ ID NO: 1650697 - RNA, 12 nt, Human
uccccacccuga

SEQ ID NO: 1650698 - RNA, 22 nt, Human
uccccaccgcagacaggaccag

SEQ ID NO: 1650699 - RNA, 17 nt, Human
uccccaccgcagacagg

SEQ ID NO: 1650700 - RNA, 18 nt, Human
uccccaccgcagacagga

SEQ ID NO: 1650701 - RNA, 21 nt, Human
uccccaccgcagacaggacca

SEQ ID NO: 1650702 - RNA, 15 nt, Human
ucccaucacccgcua

SEQ ID NO: 1650703 - RNA, 22 nt, Human
ucccauaugccugggcagaagg

SEQ ID NO: 1650704 - RNA, 14 nt, Human
ucccagucauuuaa

SEQ ID NO: 1650705 - RNA, 22 nt, Human
ucccagucauuuaauaaaugug

SEQ ID NO: 1650706 - RNA, 17 nt, Human
acgugggcauucaaaug

SEQ ID NO: 1650707 - RNA, 20 nt, Human
acgugggcauucaaauguau

SEQ ID NO: 1650708 - RNA, 22 nt, Human
acguauaaaagccuguuuaaga

SEQ ID NO: 1650709 - RNA, 15 nt, Human
acgguuuuacugcag

SEQ ID NO: 1650710 - RNA, 17 nt, Human
acgguuuuacugcagcu

SEQ ID NO: 1650711 - RNA, 23 nt, Human
acguggcugcuucaaggauccug

SEQ ID NO: 1650712 - RNA, 16 nt, Human
ucccacaaaggagagc

SEQ ID NO: 1650713 - RNA, 15 nt, Human
ucccaccccacacac

SEQ ID NO: 1650714 - RNA, 20 nt, Human
ucccaccccacacacgccag

SEQ ID NO: 1650715 - RNA, 20 nt, Human
acgggaggguaaggcugugg

SEQ ID NO: 1650716 - RNA, 13 nt, Human
ucccaaagugcug

SEQ ID NO: 1650717 - RNA, 14 nt, Human
ucccaaagugcugg

SEQ ID NO: 1650718 - RNA, 21 nt, Human
ucccaaagcagugcaugcugu

SEQ ID NO: 1650719 - RNA, 17 nt, Human
ucccaaagcagugcaug

SEQ ID NO: 1650720 - RNA, 18 nt, Human
ucccaaagcagugcaugc

SEQ ID NO: 1650721 - RNA, 16 nt, Human
ucccaaagcagugcau

SEQ ID NO: 1650722 - RNA, 18 nt, Human
ucccaaacccuucagugc

SEQ ID NO: 1650723 - RNA, 18 nt, Human
uccauuuaauaauuauau

SEQ ID NO: 1650724 - RNA, 13 nt, Human
uccaugaagaugu

SEQ ID NO: 1650725 - RNA, 21 nt, Human
uccaugaagauguagaggaga

SEQ ID NO: 1650726 - RNA, 18 nt, Human
uccaucuaaacugccccc

SEQ ID NO: 1650727 - RNA, 16 nt, Human
uccaucuaaacugccc

SEQ ID NO: 1650728 - RNA, 22 nt, Human
acgccagauucuuuccugaggc

SEQ ID NO: 1650729 - RNA, 23 nt, Human
acgccagauucuuuccugaggcu

SEQ ID NO: 1650730 - RNA, 20 nt, Human
uccauccugaggcuccacuu

SEQ ID NO: 1650731 - RNA, 21 nt, Human
uccauccugaggcuccacuug

SEQ ID NO: 1650732 - RNA, 21 nt, Human
acuacuagggaaaugccuuug

SEQ ID NO: 1650733 - RNA, 17 nt, Human
acuacucccccaggugg

SEQ ID NO: 1650734 - RNA, 12 nt, Human
acucaccccagc

SEQ ID NO: 1650735 - RNA, 20 nt, Human
ucccgaauagcugggacuac

SEQ ID NO: 1650736 - RNA, 15 nt, Human
ucccgaguagcuggg

SEQ ID NO: 1650737 - RNA, 20 nt, Human
ucccgaguagcugagauuau

SEQ ID NO: 1650738 - RNA, 20 nt, Human
ucccgaguagcugggacuac

SEQ ID NO: 1650739 - RNA, 18 nt, Human
ucccgaguagcugggacu

SEQ ID NO: 1650740 - RNA, 16 nt, Human
ucccgaguagcuggga

SEQ ID NO: 1650741 - RNA, 17 nt, Human
ucccgaguagcugggac

SEQ ID NO: 1650742 - RNA, 16 nt, Human
uccccucggagaagag

SEQ ID NO: 1650743 - RNA, 17 nt, Human
uccccucggagaagagc

SEQ ID NO: 1650744 - RNA, 14 nt, Human
ucccucccuccacc

SEQ ID NO: 1650745 - RNA, 13 nt, Human
ucccucccuccac

SEQ ID NO: 1650746 - RNA, 13 nt, Human
ucccggcugcccu

SEQ ID NO: 1650747 - RNA, 14 nt, Human
ucccggcugcccuu

SEQ ID NO: 1650748 - RNA, 15 nt, Human
ucccggcugcccuuu

SEQ ID NO: 1650749 - RNA, 18 nt, Human
ucccggcugcccuuucug

SEQ ID NO: 1650750 - RNA, 22 nt, Human
ucccggcugcccuuucugggca

SEQ ID NO: 1650751 - RNA, 23 nt, Human
ucccuccaccucccugcaauaaa

SEQ ID NO: 1650752 - RNA, 21 nt, Human
ucccuccaccucccugcaaua

SEQ ID NO: 1650753 - RNA, 11 nt, Human
ucccugaaggc

SEQ ID NO: 1650754 - RNA, 15 nt, Human
ucccugaaggccccg

SEQ ID NO: 1650755 - RNA, 21 nt, Human
ucccucuuucccucccuuccu

SEQ ID NO: 1650756 - RNA, 17 nt, Human
ucccucccuccaccucc

SEQ ID NO: 1650757 - RNA, 18 nt, Human
ucccucuuucccucccuu

SEQ ID NO: 1650758 - RNA, 20 nt, Human
ucccucuuucccucccuucc

SEQ ID NO: 1650759 - RNA, 16 nt, Human
ucccucccuccaccuc

SEQ ID NO: 1650760 - RNA, 15 nt, Human
ucccucccuccaccu

SEQ ID NO: 1650761 - RNA, 14 nt, Human
ucccucuuucccuc

SEQ ID NO: 1650762 - RNA, 16 nt, Human
ucccugaaggccccgc

SEQ ID NO: 1650763 - RNA, 17 nt, Human
ucccugaaggccccgcc

SEQ ID NO: 1650764 - RNA, 11 nt, Human
ucccugagcag

SEQ ID NO: 1650765 - RNA, 14 nt, Human
acuccucuguccag

SEQ ID NO: 1650766 - RNA, 13 nt, Human
acuccucugucca

SEQ ID NO: 1650767 - RNA, 18 nt, Human
acuccugcaggcagccag

SEQ ID NO: 1650768 - RNA, 19 nt, Human
acuccugcaggcagccagg

SEQ ID NO: 1650769 - RNA, 17 nt, Human
acuccugcaggcagcca

SEQ ID NO: 1650770 - RNA, 13 nt, Human
acuccagaccccu

SEQ ID NO: 1650771 - RNA, 23 nt, Human
acuccagaauuucccaaagcagu

SEQ ID NO: 1650772 - RNA, 12 nt, Human
acuccagccugg

SEQ ID NO: 1650773 - RNA, 13 nt, Human
acuccagccuggg

SEQ ID NO: 1650774 - RNA, 15 nt, Human
acucauucuucugua

SEQ ID NO: 1650775 - RNA, 14 nt, Human
acucauugaccuga

SEQ ID NO: 1650776 - RNA, 15 nt, Human
acucauugaccugag

SEQ ID NO: 1650777 - RNA, 14 nt, Human
acuccaaagaaaug

SEQ ID NO: 1650778 - RNA, 15 nt, Human
acuccaaagaaaugu

SEQ ID NO: 1650779 - RNA, 18 nt, Human
acuccaaagaaauguaag

SEQ ID NO: 1650780 - RNA, 15 nt, Human
acuccagaauuuccc

SEQ ID NO: 1650781 - RNA, 17 nt, Human
acuccagaauuucccaa

SEQ ID NO: 1650782 - RNA, 21 nt, Human
acuccaaagaaauguaaggga

SEQ ID NO: 1650783 - RNA, 17 nt, Human
ucccuuacgugaguccu

SEQ ID NO: 1650784 - RNA, 21 nt, Human
acuccugcaggcagccaggcc

SEQ ID NO: 1650785 - RNA, 15 nt, Human
ucccugguggcagcu

SEQ ID NO: 1650786 - RNA, 12 nt, Human
ucccugucccag

SEQ ID NO: 1650787 - RNA, 19 nt, Human
uccuaaauauauuuuaaga

SEQ ID NO: 1650788 - RNA, 17 nt, Human
uccggucccugucccag

SEQ ID NO: 1650789 - RNA, 14 nt, Human
uccuacuuccccuu

SEQ ID NO: 1650790 - RNA, 16 nt, Human
uccuagaaauucccca

SEQ ID NO: 1650791 - RNA, 12 nt, Human
ucccuuuuccuu

SEQ ID NO: 1650792 - RNA, 23 nt, Human
uccaacccucaucaccaacgucu

SEQ ID NO: 1650793 - RNA, 16 nt, Human
uccaacccucaucacc

SEQ ID NO: 1650794 - RNA, 17 nt, Human
uccaacccucaucacca

SEQ ID NO: 1650795 - RNA, 14 nt, Human
uccaacccucauca

SEQ ID NO: 1650796 - RNA, 12 nt, Human
accugccaggaa

SEQ ID NO: 1650797 - RNA, 14 nt, Human
accugccaggaagc

SEQ ID NO: 1650798 - RNA, 15 nt, Human
accugccaggaagcc

SEQ ID NO: 1650799 - RNA, 12 nt, Human
uccaagaagccc

SEQ ID NO: 1650800 - RNA, 20 nt, Human
uccaagcuggucccacucag

SEQ ID NO: 1650801 - RNA, 18 nt, Human
uccaaucccaccaacccu

SEQ ID NO: 1650802 - RNA, 21 nt, Human
uccaagcuggucccacucagu

SEQ ID NO: 1650803 - RNA, 23 nt, Human
accuggccucugcacuccccugc

SEQ ID NO: 1650804 - RNA, 18 nt, Human
accuggccucugcacucc

SEQ ID NO: 1650805 - RNA, 20 nt, Human
accuggccucugcacucccc

SEQ ID NO: 1650806 - RNA, 21 nt, Human
accuggucacaggacucugcc

SEQ ID NO: 1650807 - RNA, 19 nt, Human
accuguuucugcagccacu

SEQ ID NO: 1650808 - RNA, 18 nt, Human
accuuagacagucccugc

SEQ ID NO: 1650809 - RNA, 19 nt, Human
accuuagacagucccugcc

SEQ ID NO: 1650810 - RNA, 20 nt, Human
accuuagacagucccugcca

SEQ ID NO: 1650811 - RNA, 18 nt, Human
uccacccaccucagccuc

SEQ ID NO: 1650812 - RNA, 19 nt, Human
uccacccaccucagccucc

SEQ ID NO: 1650813 - RNA, 12 nt, Human
uccacccaggag

SEQ ID NO: 1650814 - RNA, 14 nt, Human
uccacccaggagcc

SEQ ID NO: 1650815 - RNA, 15 nt, Human
uccacccaggagccc

SEQ ID NO: 1650816 - RNA, 17 nt, Human
uccacccaggagccccg

SEQ ID NO: 1650817 - RNA, 14 nt, Human
accuggccucugca

SEQ ID NO: 1650818 - RNA, 16 nt, Human
accuggccucugcacu

SEQ ID NO: 1650819 - RNA, 17 nt, Human
accuggccucugcacuc

SEQ ID NO: 1650820 - RNA, 19 nt, Human
uccagacccggcugcgugg

SEQ ID NO: 1650821 - RNA, 15 nt, Human
uccagacccggcugc

SEQ ID NO: 1650822 - RNA, 18 nt, Human
uccagacccggcugcgug

SEQ ID NO: 1650823 - RNA, 13 nt, Human
uccacugccuucg

SEQ ID NO: 1650824 - RNA, 15 nt, Human
uccacugccuucgau

SEQ ID NO: 1650825 - RNA, 22 nt, Human
uccacugccuucgauacaccgg

SEQ ID NO: 1650826 - RNA, 20 nt, Human
uccagaauuucccaaagcag

SEQ ID NO: 1650827 - RNA, 22 nt, Human
uccagaauuucccaaagcagug

SEQ ID NO: 1650828 - RNA, 13 nt, Human
uccagacacaugu

SEQ ID NO: 1650829 - RNA, 16 nt, Human
uccaccuucccaugcc

SEQ ID NO: 1650830 - RNA, 18 nt, Human
uccaccuucccaugcccu

SEQ ID NO: 1650831 - RNA, 19 nt, Human
uccaccuucccaugcccug

SEQ ID NO: 1650832 - RNA, 14 nt, Human
accuuuugagugcc

SEQ ID NO: 1650833 - RNA, 17 nt, Human
accuuuugagugccuua

SEQ ID NO: 1650834 - RNA, 20 nt, Human
accuuuugagugccuuacac

SEQ ID NO: 1650835 - RNA, 14 nt, Human
uccagccccuggau

SEQ ID NO: 1650836 - RNA, 13 nt, Human
uccagccccugga

SEQ ID NO: 1650837 - RNA, 16 nt, Human
uccagagaguggcucc

SEQ ID NO: 1650838 - RNA, 17 nt, Human
uccagagaguggcuccu

SEQ ID NO: 1650839 - RNA, 15 nt, Human
uccagagaguggcuc

SEQ ID NO: 1650840 - RNA, 12 nt, Human
uccagccccugg

SEQ ID NO: 1650841 - RNA, 21 nt, Human
uccaggcuguaucccaugagc

SEQ ID NO: 1650842 - RNA, 20 nt, Human
accuuuuuuauacauaaaca

SEQ ID NO: 1650843 - RNA, 19 nt, Human
accuuuuuuauacauaaac

SEQ ID NO: 1650844 - RNA, 22 nt, Human
accuuuuuuauacauaaacaag

SEQ ID NO: 1650845 - RNA, 21 nt, Human
accuuuuuuauacauaaacaa

SEQ ID NO: 1650846 - RNA, 14 nt, Human
acgagaaaacaaua

SEQ ID NO: 1650847 - RNA, 16 nt, Human
acgagcaggcuucuuc

SEQ ID NO: 1650848 - RNA, 19 nt, Human
acgccagauucuuuccuga

SEQ ID NO: 1650849 - RNA, 19 nt, Human
acgagcaggcuacugucag

SEQ ID NO: 1650850 - RNA, 20 nt, Human
acgagcaggcuacugucagc

SEQ ID NO: 1650851 - RNA, 14 nt, Human
accucuaaauucuu

SEQ ID NO: 1650852 - RNA, 14 nt, Human
accugaggcccuuc

SEQ ID NO: 1650853 - RNA, 22 nt, Human
accugaggcccuucucuccagc

SEQ ID NO: 1650854 - RNA, 15 nt, Human
accugaggcccuucu

SEQ ID NO: 1650855 - RNA, 16 nt, Human
accugaggcccuucuc

SEQ ID NO: 1650856 - RNA, 20 nt, Human
accugaggcccuucucucca

SEQ ID NO: 1650857 - RNA, 21 nt, Human
accugaggcccuucucuccag

SEQ ID NO: 1650858 - RNA, 15 nt, Human
accugauugugucuc

SEQ ID NO: 1650859 - RNA, 17 nt, Human
accugauugugucucuu

SEQ ID NO: 1650860 - RNA, 18 nt, Human
accugauugugucucuug

SEQ ID NO: 1650861 - RNA, 19 nt, Human
ucauugaccugaggcccuu

SEQ ID NO: 1650862 - RNA, 22 nt, Human
ucauugaaaucuuuuugcuuug

SEQ ID NO: 1650863 - RNA, 12 nt, Human
ucauugaccuga

SEQ ID NO: 1650864 - RNA, 14 nt, Human
ucauugaccugagg

SEQ ID NO: 1650865 - RNA, 15 nt, Human
ucauugaccugaggc

SEQ ID NO: 1650866 - RNA, 14 nt, Human
accuccugcugggc

SEQ ID NO: 1650867 - RNA, 16 nt, Human
accuccugcugggcag

SEQ ID NO: 1650868 - RNA, 13 nt, Human
accuccugggcua

SEQ ID NO: 1650869 - RNA, 13 nt, Human
accuccugcuggg

SEQ ID NO: 1650870 - RNA, 19 nt, Human
accucggugccuuccucuu

SEQ ID NO: 1650871 - RNA, 12 nt, Human
ucauucuucugu

SEQ ID NO: 1650872 - RNA, 12 nt, Human
ucauugaaaucu

SEQ ID NO: 1650873 - RNA, 13 nt, Human
ucauugaaaucuu

SEQ ID NO: 1650874 - RNA, 21 nt, Human
ucaugaauuaguuuuauaugc

SEQ ID NO: 1650875 - RNA, 14 nt, Human
ucauccuucuggaa

SEQ ID NO: 1650876 - RNA, 18 nt, Human
ucauccucauacccaccc

SEQ ID NO: 1650877 - RNA, 13 nt, Human
ucauccuccucag

SEQ ID NO: 1650878 - RNA, 19 nt, Human
ucauccuccucagaucuuc

SEQ ID NO: 1650879 - RNA, 18 nt, Human
ucaucuagguaaauuaca

SEQ ID NO: 1650880 - RNA, 14 nt, Human
ucaucuaggauuuu

SEQ ID NO: 1650881 - RNA, 22 nt, Human
ucauccuucuggaauaaggaga

SEQ ID NO: 1650882 - RNA, 16 nt, Human
ucaugaauuaguuuua

SEQ ID NO: 1650883 - RNA, 15 nt, Human
ucauccuaagcuauu

SEQ ID NO: 1650884 - RNA, 11 nt, Human
accuccugcug

SEQ ID NO: 1650885 - RNA, 12 nt, Human
accuccugcugg

SEQ ID NO: 1650886 - RNA, 23 nt, Human
accuccugccucgaacuggcugc

SEQ ID NO: 1650887 - RNA, 13 nt, Human
accuccugccucg

SEQ ID NO: 1650888 - RNA, 12 nt, Human
accuccugccuc

SEQ ID NO: 1650889 - RNA, 13 nt, Human
accucccugcaau

SEQ ID NO: 1650890 - RNA, 12 nt, Human
accucccugcaa

SEQ ID NO: 1650891 - RNA, 13 nt, Human
ucaggaagcucag

SEQ ID NO: 1650892 - RNA, 14 nt, Human
ucaggaagcucagg

SEQ ID NO: 1650893 - RNA, 15 nt, Human
ucaggaagcucaggg

SEQ ID NO: 1650894 - RNA, 16 nt, Human
ucaggaagcucagggc

SEQ ID NO: 1650895 - RNA, 22 nt, Human
ucaggaaaucaaauaugcaaag

SEQ ID NO: 1650896 - RNA, 23 nt, Human
ucaggaaaucaaauaugcaaagc

SEQ ID NO: 1650897 - RNA, 16 nt, Human
accuaccaccacgccc

SEQ ID NO: 1650898 - RNA, 20 nt, Human
accuaccaccacgcccggcu

SEQ ID NO: 1650899 - RNA, 21 nt, Human
accuagggugauauuaaccag

SEQ ID NO: 1650900 - RNA, 13 nt, Human
accuacauguauu

SEQ ID NO: 1650901 - RNA, 14 nt, Human
accuacauguauuu

SEQ ID NO: 1650902 - RNA, 15 nt, Human
accuacauguauuug

SEQ ID NO: 1650903 - RNA, 16 nt, Human
uauuucuauauuuuca

SEQ ID NO: 1650904 - RNA, 17 nt, Human
uauuucuauauuuucau

SEQ ID NO: 1650905 - RNA, 18 nt, Human
uauuucuauauuuucauu

SEQ ID NO: 1650906 - RNA, 15 nt, Human
acaguugaaaaacag

SEQ ID NO: 1650907 - RNA, 16 nt, Human
acaguugaaaaacagc

SEQ ID NO: 1650908 - RNA, 20 nt, Human
acaguugaaaaacagcugag

SEQ ID NO: 1650909 - RNA, 22 nt, Human
uauuucccucaccuuucccauc

SEQ ID NO: 1650910 - RNA, 23 nt, Human
uauuuccuauauuguuuucagug

SEQ ID NO: 1650911 - RNA, 21 nt, Human
uaugaaauauuauguuaaaac

SEQ ID NO: 1650912 - RNA, 13 nt, Human
uauuucauuucuu

SEQ ID NO: 1650913 - RNA, 17 nt, Human
acauacucccaucugug

SEQ ID NO: 1650914 - RNA, 14 nt, Human
acauacucugcuua

SEQ ID NO: 1650915 - RNA, 13 nt, Human
acauacucccauc

SEQ ID NO: 1650916 - RNA, 22 nt, Human
acauacuaaccagcagaaaugc

SEQ ID NO: 1650917 - RNA, 21 nt, Human
acauacuaaccagcagaaaug

SEQ ID NO: 1650918 - RNA, 13 nt, Human
acauacuaaccag

SEQ ID NO: 1650919 - RNA, 20 nt, Human
acaguuuguuaguaugaggc

SEQ ID NO: 1650920 - RNA, 16 nt, Human
acaguuuguuaguaug

SEQ ID NO: 1650921 - RNA, 15 nt, Human
acaguuuucugagaa

SEQ ID NO: 1650922 - RNA, 16 nt, Human
acaguuuucugagaaa

SEQ ID NO: 1650923 - RNA, 17 nt, Human
acaguuuucugagaaag

SEQ ID NO: 1650924 - RNA, 18 nt, Human
acaguuuucugagaaaga

SEQ ID NO: 1650925 - RNA, 19 nt, Human
acaguuuucugagaaagac

SEQ ID NO: 1650926 - RNA, 20 nt, Human
acaguuuucugagaaagacu

SEQ ID NO: 1650927 - RNA, 21 nt, Human
acaguuuucugagaaagacua

SEQ ID NO: 1650928 - RNA, 18 nt, Human
acaguuuugguugcuuua

SEQ ID NO: 1650929 - RNA, 19 nt, Human
acaguuuugguugcuuuaa

SEQ ID NO: 1650930 - RNA, 24 nt, Human
acaguuuugguugcuuuaauauca

SEQ ID NO: 1650931 - RNA, 22 nt, Human
acaugaaaacacauuuuucuua

SEQ ID NO: 1650932 - RNA, 22 nt, Human
acaucuugcucugcugacagac

SEQ ID NO: 1650933 - RNA, 19 nt, Human
acaugaaaacacauuuuuc

SEQ ID NO: 1650934 - RNA, 18 nt, Human
acaugaaaacacauuuuu

SEQ ID NO: 1650935 - RNA, 17 nt, Human
acaugaaaacacauuuu

SEQ ID NO: 1650936 - RNA, 21 nt, Human
acaucuugcucugcugacaga

SEQ ID NO: 1650937 - RNA, 18 nt, Human
acaucuugcucugcugac

SEQ ID NO: 1650938 - RNA, 19 nt, Human
acaucuugcucugcugaca

SEQ ID NO: 1650939 - RNA, 13 nt, Human
acaucuugcucug

SEQ ID NO: 1650940 - RNA, 14 nt, Human
acaucuugcucugc

SEQ ID NO: 1650941 - RNA, 16 nt, Human
acaucaacaucuuggu

SEQ ID NO: 1650942 - RNA, 18 nt, Human
acaucaacaucuugguca

SEQ ID NO: 1650943 - RNA, 13 nt, Human
acaucaacagaua

SEQ ID NO: 1650944 - RNA, 14 nt, Human
acauagucuggcug

SEQ ID NO: 1650945 - RNA, 15 nt, Human
acauagucuggcugu

SEQ ID NO: 1650946 - RNA, 16 nt, Human
acauagugaugguucc

SEQ ID NO: 1650947 - RNA, 21 nt, Human
acauagugaugguuccccugu

SEQ ID NO: 1650948 - RNA, 20 nt, Human
acauagucuggcuguaccca

SEQ ID NO: 1650949 - RNA, 19 nt, Human
acauauauaacaaugcugu

SEQ ID NO: 1650950 - RNA, 14 nt, Human
acauagaauuaaca

SEQ ID NO: 1650951 - RNA, 18 nt, Human
acauagaauuaacacaug

SEQ ID NO: 1650952 - RNA, 23 nt, Human
acauauugauuuccguuaaaaua

SEQ ID NO: 1650953 - RNA, 22 nt, Human
acauauugauuuccguuaaaau

SEQ ID NO: 1650954 - RNA, 18 nt, Human
acauauugauuuccguua

SEQ ID NO: 1650955 - RNA, 16 nt, Human
acauauugauuuccgu

SEQ ID NO: 1650956 - RNA, 14 nt, Human
acauauugauuucc

SEQ ID NO: 1650957 - RNA, 18 nt, Human
acauuagcaguuugcuuu

SEQ ID NO: 1650958 - RNA, 22 nt, Human
acauuagcaguuugcuuuguau

SEQ ID NO: 1650959 - RNA, 21 nt, Human
acauguccaagaagcccagga

SEQ ID NO: 1650960 - RNA, 17 nt, Human
ucaaauuucuaaaucuc

SEQ ID NO: 1650961 - RNA, 16 nt, Human
ucaacagguuuuccug

SEQ ID NO: 1650962 - RNA, 12 nt, Human
acauucuguuaa

SEQ ID NO: 1650963 - RNA, 16 nt, Human
ucaaauuucuaaaucu

SEQ ID NO: 1650964 - RNA, 15 nt, Human
ucaaauuucuaaauc

SEQ ID NO: 1650965 - RNA, 15 nt, Human
acauucuguuaauca

SEQ ID NO: 1650966 - RNA, 11 nt, Human
ucaaguauuau

SEQ ID NO: 1650967 - RNA, 15 nt, Human
ucaaguauuauaccu

SEQ ID NO: 1650968 - RNA, 21 nt, Human
ucaaguauuauaccuuuuuua

SEQ ID NO: 1650969 - RNA, 16 nt, Human
ucaaguauuauaccuu

SEQ ID NO: 1650970 - RNA, 23 nt, Human
ucaaguauuauaccuuuuuuaga

SEQ ID NO: 1650971 - RNA, 22 nt, Human
ucaagaugaugaugaucuuuaa

SEQ ID NO: 1650972 - RNA, 18 nt, Human
ucaaauaacuaaaaggua

SEQ ID NO: 1650973 - RNA, 20 nt, Human
ucaaauacgugggcauucaa

SEQ ID NO: 1650974 - RNA, 16 nt, Human
acaugaaguccaagca

SEQ ID NO: 1650975 - RNA, 20 nt, Human
acaugagcaucaggccaggc

SEQ ID NO: 1650976 - RNA, 19 nt, Human
acaugaucuucuuuauaau

SEQ ID NO: 1650977 - RNA, 15 nt, Human
acaugaucuucuuua

SEQ ID NO: 1650978 - RNA, 17 nt, Human
acaugaucuucuuuaua

SEQ ID NO: 1650979 - RNA, 17 nt, Human
acaugagcaucaggcca

SEQ ID NO: 1650980 - RNA, 18 nt, Human
acaugagcaucaggccag

SEQ ID NO: 1650981 - RNA, 19 nt, Human
acaugagcaucaggccagg

SEQ ID NO: 1650982 - RNA, 19 nt, Human
acaugauccugcaauucca

SEQ ID NO: 1650983 - RNA, 14 nt, Human
ucaaagcugaaaug

SEQ ID NO: 1650984 - RNA, 22 nt, Human
ucaaaguugccuaaauccauuu

SEQ ID NO: 1650985 - RNA, 19 nt, Human
ucaaaguugccuaaaucca

SEQ ID NO: 1650986 - RNA, 21 nt, Human
ucaaaguugccuaaauccauu

SEQ ID NO: 1650987 - RNA, 18 nt, Human
ucaaaagaaagaaaauca

SEQ ID NO: 1650988 - RNA, 16 nt, Human
uauuuuuauauuuacu

SEQ ID NO: 1650989 - RNA, 21 nt, Human
ucaaaauaugccccauucaac

SEQ ID NO: 1650990 - RNA, 23 nt, Human
ucaaaauaccaugccauuuaaag

SEQ ID NO: 1650991 - RNA, 21 nt, Human
ucaaaauaccaugccauuuaa

SEQ ID NO: 1650992 - RNA, 16 nt, Human
ucaaaauuguuacaaa

SEQ ID NO: 1650993 - RNA, 19 nt, Human
ucaaaauuguuacaaauug

SEQ ID NO: 1650994 - RNA, 18 nt, Human
ucaaaauaucaaguguug

SEQ ID NO: 1650995 - RNA, 23 nt, Human
accccagcuggggccaggcuggg

SEQ ID NO: 1650996 - RNA, 18 nt, Human
accccagacgaugucuuc

SEQ ID NO: 1650997 - RNA, 24 nt, Human
acccagcgagcccugguggcagug

SEQ ID NO: 1650998 - RNA, 19 nt, Human
acccagcgagcccuggugg

SEQ ID NO: 1650999 - RNA, 23 nt, Human
acccagcgagcccugguggcagu

SEQ ID NO: 1651000 - RNA, 23 nt, Human
ucagccguguaaccauggaccca

SEQ ID NO: 1651001 - RNA, 22 nt, Human
ucagccaagaauucuuaaauau

SEQ ID NO: 1651002 - RNA, 12 nt, Human
ucagagcugccc

SEQ ID NO: 1651003 - RNA, 12 nt, Human
acccccacccaa

SEQ ID NO: 1651004 - RNA, 16 nt, Human
accccuucgcuccugu

SEQ ID NO: 1651005 - RNA, 14 nt, Human
accccuucgcuccu

SEQ ID NO: 1651006 - RNA, 15 nt, Human
accccuucgcuccug

SEQ ID NO: 1651007 - RNA, 12 nt, Human
ucagcucaugga

SEQ ID NO: 1651008 - RNA, 20 nt, Human
ucagcuuguaaauagcucag

SEQ ID NO: 1651009 - RNA, 13 nt, Human
ucagcucacugca

SEQ ID NO: 1651010 - RNA, 16 nt, Human
ucagcucacugcaacc

SEQ ID NO: 1651011 - RNA, 14 nt, Human
ucagcggggacagc

SEQ ID NO: 1651012 - RNA, 13 nt, Human
ucaggaaagagaa

SEQ ID NO: 1651013 - RNA, 19 nt, Human
ucaggaaagagaacuucca

SEQ ID NO: 1651014 - RNA, 20 nt, Human
ucaggaaaucaaauaugcaa

SEQ ID NO: 1651015 - RNA, 21 nt, Human
ucaggaaaucaaauaugcaaa

SEQ ID NO: 1651016 - RNA, 23 nt, Human
ucagaaguuucugccgcagcccu

SEQ ID NO: 1651017 - RNA, 18 nt, Human
ucagaaucucaaauaacu

SEQ ID NO: 1651018 - RNA, 19 nt, Human
ucagaaucucaaauaacua

SEQ ID NO: 1651019 - RNA, 22 nt, Human
ucagagacuccugcaggcagcc

SEQ ID NO: 1651020 - RNA, 21 nt, Human
ucagagacuccugcaggcagc

SEQ ID NO: 1651021 - RNA, 17 nt, Human
ucagagacuccugcagg

SEQ ID NO: 1651022 - RNA, 20 nt, Human
ucagagacuccugcaggcag

SEQ ID NO: 1651023 - RNA, 16 nt, Human
ucagagagggugggag

SEQ ID NO: 1651024 - RNA, 21 nt, Human
ucagagagggugggagugggc

SEQ ID NO: 1651025 - RNA, 23 nt, Human
ucagagagggugggagugggccc

SEQ ID NO: 1651026 - RNA, 12 nt, Human
ucagagccugca

SEQ ID NO: 1651027 - RNA, 13 nt, Human
ucagagccugcag

SEQ ID NO: 1651028 - RNA, 14 nt, Human
ucagagccugcagu

SEQ ID NO: 1651029 - RNA, 15 nt, Human
ucagagccugcaguu

SEQ ID NO: 1651030 - RNA, 18 nt, Human
ucagagccugcaguuauu

SEQ ID NO: 1651031 - RNA, 14 nt, Human
ucagaagacacuga

SEQ ID NO: 1651032 - RNA, 19 nt, Human
ucagaaguuucucagcucc

SEQ ID NO: 1651033 - RNA, 19 nt, Human
ucagaaguuucugccgcag

SEQ ID NO: 1651034 - RNA, 22 nt, Human
ucagaaguuucugccgcagccc

SEQ ID NO: 1651035 - RNA, 18 nt, Human
ucagaaggcaaaugacuu

SEQ ID NO: 1651036 - RNA, 19 nt, Human
ucagaaggcaaaugacuuu

SEQ ID NO: 1651037 - RNA, 22 nt, Human
ucagaaggcaaaugacuuugga

SEQ ID NO: 1651038 - RNA, 19 nt, Human
accaugggauaaaugccau

SEQ ID NO: 1651039 - RNA, 22 nt, Human
accauggucggaaaacaugcua

SEQ ID NO: 1651040 - RNA, 15 nt, Human
ucacuccuaccuggu

SEQ ID NO: 1651041 - RNA, 21 nt, Human
ucacucuuauugcccacgcug

SEQ ID NO: 1651042 - RNA, 23 nt, Human
ucacucuuauugcccacgcugga

SEQ ID NO: 1651043 - RNA, 21 nt, Human
acccagauaaagguucaugca

SEQ ID NO: 1651044 - RNA, 13 nt, Human
acccacugcucug

SEQ ID NO: 1651045 - RNA, 14 nt, Human
acccacugcucugg

SEQ ID NO: 1651046 - RNA, 15 nt, Human
acccacugcucuggu

SEQ ID NO: 1651047 - RNA, 11 nt, Human
acccacugcuu

SEQ ID NO: 1651048 - RNA, 10 nt, Human
acccacugcu

SEQ ID NO: 1651049 - RNA, 11 nt, Human
acccacugcuc

SEQ ID NO: 1651050 - RNA, 23 nt, Human
accauuucuugagguaaaagcau

SEQ ID NO: 1651051 - RNA, 22 nt, Human
accacuuuuguucuugguuugu

SEQ ID NO: 1651052 - RNA, 12 nt, Human
accagagcccac

SEQ ID NO: 1651053 - RNA, 14 nt, Human
accagagcccaccu

SEQ ID NO: 1651054 - RNA, 16 nt, Human
accagagcccaccuug

SEQ ID NO: 1651055 - RNA, 14 nt, Human
accagacaccuuga

SEQ ID NO: 1651056 - RNA, 17 nt, Human
accagacaccuugacag

SEQ ID NO: 1651057 - RNA, 21 nt, Human
accacuuuuguucuugguuug

SEQ ID NO: 1651058 - RNA, 16 nt, Human
accacuuuuguucuug

SEQ ID NO: 1651059 - RNA, 15 nt, Human
accacuuuuguucuu

SEQ ID NO: 1651060 - RNA, 18 nt, Human
accacuuguguuuugcaa

SEQ ID NO: 1651061 - RNA, 17 nt, Human
ucaccccggccaccugc

SEQ ID NO: 1651062 - RNA, 18 nt, Human
ucaccccggccaccugcg

SEQ ID NO: 1651063 - RNA, 17 nt, Human
accacugcacuccagcc

SEQ ID NO: 1651064 - RNA, 20 nt, Human
accacugcacuccagccugg

SEQ ID NO: 1651065 - RNA, 15 nt, Human
accacugcucugaug

SEQ ID NO: 1651066 - RNA, 17 nt, Human
accacugcucugaugaa

SEQ ID NO: 1651067 - RNA, 23 nt, Human
accacugcucugaugaagaggag

SEQ ID NO: 1651068 - RNA, 21 nt, Human
accacugcacuccagccuggg

SEQ ID NO: 1651069 - RNA, 22 nt, Human
ucaccccggccaccugcggugc

SEQ ID NO: 1651070 - RNA, 13 nt, Human
accacugcagaag

SEQ ID NO: 1651071 - RNA, 13 nt, Human
ucaccugccccuc

SEQ ID NO: 1651072 - RNA, 16 nt, Human
ucaccugccccucaac

SEQ ID NO: 1651073 - RNA, 15 nt, Human
ucaccugccccucaa

SEQ ID NO: 1651074 - RNA, 15 nt, Human
ucaccucucccuugg

SEQ ID NO: 1651075 - RNA, 16 nt, Human
ucaccugaagacucau

SEQ ID NO: 1651076 - RNA, 14 nt, Human
accagccuccaugc

SEQ ID NO: 1651077 - RNA, 19 nt, Human
accagccuccaugcugccu

SEQ ID NO: 1651078 - RNA, 20 nt, Human
accagccuccaugcugccuc

SEQ ID NO: 1651079 - RNA, 21 nt, Human
accagccuccaugcugccucc

SEQ ID NO: 1651080 - RNA, 17 nt, Human
accagagcccaccuugg

SEQ ID NO: 1651081 - RNA, 14 nt, Human
accagggacugagg

SEQ ID NO: 1651082 - RNA, 18 nt, Human
ucacuauguugcccaggc

SEQ ID NO: 1651083 - RNA, 19 nt, Human
ucacuauguugcccaggca

SEQ ID NO: 1651084 - RNA, 20 nt, Human
ucacuauguugcccaggcag

SEQ ID NO: 1651085 - RNA, 14 nt, Human
accacacuccagcu

SEQ ID NO: 1651086 - RNA, 15 nt, Human
ucaauucuugccaaa

SEQ ID NO: 1651087 - RNA, 13 nt, Human
ucaauuuuaacaa

SEQ ID NO: 1651088 - RNA, 20 nt, Human
ucaauuuuucuuauuucauu

SEQ ID NO: 1651089 - RNA, 23 nt, Human
ucaauuuuucuuauuucauuucu

SEQ ID NO: 1651090 - RNA, 22 nt, Human
ucaaguccucuuuucugagagg

SEQ ID NO: 1651091 - RNA, 15 nt, Human
ucaagugaaaaagga

SEQ ID NO: 1651092 - RNA, 17 nt, Human
ucaagugauucucaugc

SEQ ID NO: 1651093 - RNA, 23 nt, Human
ucaagugaaaaaggaggaagaga

SEQ ID NO: 1651094 - RNA, 20 nt, Human
ucaagugauucucaugccuc

SEQ ID NO: 1651095 - RNA, 19 nt, Human
accaacauacucccaucug

SEQ ID NO: 1651096 - RNA, 21 nt, Human
accaacauacucccaucugug

SEQ ID NO: 1651097 - RNA, 22 nt, Human
accaacauacucccaucuguga

SEQ ID NO: 1651098 - RNA, 13 nt, Human
accaaucaugaau

SEQ ID NO: 1651099 - RNA, 15 nt, Human
accaauguucucucu

SEQ ID NO: 1651100 - RNA, 15 nt, Human
accaaucaugaauua

SEQ ID NO: 1651101 - RNA, 13 nt, Human
ucaccccagcccc

SEQ ID NO: 1651102 - RNA, 14 nt, Human
ucaccccagcccca

SEQ ID NO: 1651103 - RNA, 20 nt, Human
ucaccccagccccaaaacuc

SEQ ID NO: 1651104 - RNA, 15 nt, Human
ucaccccggccaccu

SEQ ID NO: 1651105 - RNA, 16 nt, Human
ucacaacaaccugguc

SEQ ID NO: 1651106 - RNA, 22 nt, Human
ucacacgucuggcuucacagau

SEQ ID NO: 1651107 - RNA, 21 nt, Human
ucacaacagauuauuaccuua

SEQ ID NO: 1651108 - RNA, 12 nt, Human
ucacauaucugu

SEQ ID NO: 1651109 - RNA, 15 nt, Human
ucacauaucugucau

SEQ ID NO: 1651110 - RNA, 15 nt, Human
ucacaguucucuccu

SEQ ID NO: 1651111 - RNA, 13 nt, Human
acacauguccaag

SEQ ID NO: 1651112 - RNA, 18 nt, Human
acacauguccaagaagcc

SEQ ID NO: 1651113 - RNA, 19 nt, Human
acacauguccaagaagccc

SEQ ID NO: 1651114 - RNA, 13 nt, Human
acacauuuuauuu

SEQ ID NO: 1651115 - RNA, 12 nt, Human
acacccagccca

SEQ ID NO: 1651116 - RNA, 13 nt, Human
acacccagcccac

SEQ ID NO: 1651117 - RNA, 21 nt, Human
acacauguccaagaagcccag

SEQ ID NO: 1651118 - RNA, 22 nt, Human
acacauguccaagaagcccagg

SEQ ID NO: 1651119 - RNA, 20 nt, Human
uauaaaaauaaaaaacacug

SEQ ID NO: 1651120 - RNA, 21 nt, Human
uauaaaaauaaaaaacacugg

SEQ ID NO: 1651121 - RNA, 18 nt, Human
uaguucagguaacaggca

SEQ ID NO: 1651122 - RNA, 18 nt, Human
acaccucugcacaagcug

SEQ ID NO: 1651123 - RNA, 21 nt, Human
acaccccagacgaugucuuca

SEQ ID NO: 1651124 - RNA, 14 nt, Human
acaccuugacaggg

SEQ ID NO: 1651125 - RNA, 15 nt, Human
acaccuugacagggc

SEQ ID NO: 1651126 - RNA, 16 nt, Human
acaccuugacagggca

SEQ ID NO: 1651127 - RNA, 19 nt, Human
acaccucugcacaagcugc

SEQ ID NO: 1651128 - RNA, 19 nt, Human
uauaacuauguugauaaaa

SEQ ID NO: 1651129 - RNA, 22 nt, Human
uauaaccaguguuguggauuua

SEQ ID NO: 1651130 - RNA, 20 nt, Human
acacuaaccacgcuggaccu

SEQ ID NO: 1651131 - RNA, 18 nt, Human
acacuaagagagaaugag

SEQ ID NO: 1651132 - RNA, 19 nt, Human
acacuaagagagaaugaga

SEQ ID NO: 1651133 - RNA, 16 nt, Human
acacuaaccacgcugg

SEQ ID NO: 1651134 - RNA, 17 nt, Human
acacuaaccacgcugga

SEQ ID NO: 1651135 - RNA, 19 nt, Human
acacuaaccacgcuggacc

SEQ ID NO: 1651136 - RNA, 17 nt, Human
acacuaagagagaauga

SEQ ID NO: 1651137 - RNA, 11 nt, Human
acacacagcuc

SEQ ID NO: 1651138 - RNA, 12 nt, Human
acacacagcucu

SEQ ID NO: 1651139 - RNA, 14 nt, Human
acacacacauacac

SEQ ID NO: 1651140 - RNA, 13 nt, Human
acacacugaagaa

SEQ ID NO: 1651141 - RNA, 14 nt, Human
acaaugcuguauuu

SEQ ID NO: 1651142 - RNA, 17 nt, Human
acaaugcuguauuuuaa

SEQ ID NO: 1651143 - RNA, 15 nt, Human
acaaugguuuucuug

SEQ ID NO: 1651144 - RNA, 18 nt, Human
acaaugcuguauuuuaaa

SEQ ID NO: 1651145 - RNA, 21 nt, Human
acaaugguuuucuuguguguu

SEQ ID NO: 1651146 - RNA, 14 nt, Human
acacaacuauauug

SEQ ID NO: 1651147 - RNA, 17 nt, Human
acacaacuauauuguuu

SEQ ID NO: 1651148 - RNA, 17 nt, Human
uagucuugucucagauu

SEQ ID NO: 1651149 - RNA, 22 nt, Human
uagucuugucucagauuuuauu

SEQ ID NO: 1651150 - RNA, 12 nt, Human
uaguguuggaga

SEQ ID NO: 1651151 - RNA, 16 nt, Human
uaguguuggagaagaa

SEQ ID NO: 1651152 - RNA, 17 nt, Human
uaguguuggagaagaac

SEQ ID NO: 1651153 - RNA, 14 nt, Human
uaguagagacaggg

SEQ ID NO: 1651154 - RNA, 13 nt, Human
uaguagagacagg

SEQ ID NO: 1651155 - RNA, 11 nt, Human
acacagugagu

SEQ ID NO: 1651156 - RNA, 14 nt, Human
acacacugaagaag

SEQ ID NO: 1651157 - RNA, 17 nt, Human
acacagugaccauacua

SEQ ID NO: 1651158 - RNA, 13 nt, Human
acacagugagucg

SEQ ID NO: 1651159 - RNA, 21 nt, Human
uagguuggcaaaaaggcagga

SEQ ID NO: 1651160 - RNA, 22 nt, Human
uagguuuggacaaaauggaaua

SEQ ID NO: 1651161 - RNA, 16 nt, Human
acagaguuguuacauu

SEQ ID NO: 1651162 - RNA, 20 nt, Human
acagaguuguuacauuuuua

SEQ ID NO: 1651163 - RNA, 19 nt, Human
acagaguuguuacauuuuu

SEQ ID NO: 1651164 - RNA, 18 nt, Human
acagaguuguuacauuuu

SEQ ID NO: 1651165 - RNA, 17 nt, Human
acagaguuguuacauuu

SEQ ID NO: 1651166 - RNA, 21 nt, Human
acagagcaagugagacccugu

SEQ ID NO: 1651167 - RNA, 14 nt, Human
acagagcccacgcc

SEQ ID NO: 1651168 - RNA, 14 nt, Human
uauccuacuucccc

SEQ ID NO: 1651169 - RNA, 17 nt, Human
uauccuacuuccccuuc

SEQ ID NO: 1651170 - RNA, 13 nt, Human
uaucucagggccu

SEQ ID NO: 1651171 - RNA, 15 nt, Human
uaucucagggccugg

SEQ ID NO: 1651172 - RNA, 16 nt, Human
uaucccggcugcccuu

SEQ ID NO: 1651173 - RNA, 20 nt, Human
uaucccuacuguaauuugug

SEQ ID NO: 1651174 - RNA, 19 nt, Human
uaucccuacuguaauuugu

SEQ ID NO: 1651175 - RNA, 15 nt, Human
uauauuuauuacugu

SEQ ID NO: 1651176 - RNA, 19 nt, Human
uauauuuauuacuguaaga

SEQ ID NO: 1651177 - RNA, 23 nt, Human
acagaugggugcuuggaggaagg

SEQ ID NO: 1651178 - RNA, 20 nt, Human
acagauacuccuccaagguu

SEQ ID NO: 1651179 - RNA, 20 nt, Human
acagauagauauaugcucug

SEQ ID NO: 1651180 - RNA, 22 nt, Human
acagaguuguuacauuuuuaag

SEQ ID NO: 1651181 - RNA, 21 nt, Human
acagaguuguuacauuuuuaa

SEQ ID NO: 1651182 - RNA, 16 nt, Human
acagcaaggagauuua

SEQ ID NO: 1651183 - RNA, 21 nt, Human
acagcccgggcucugccuccc

SEQ ID NO: 1651184 - RNA, 22 nt, Human
acagcccgggcucugccuccca

SEQ ID NO: 1651185 - RNA, 23 nt, Human
acagcccgggcucugccucccau

SEQ ID NO: 1651186 - RNA, 20 nt, Human
acagcccuucuuuccacaga

SEQ ID NO: 1651187 - RNA, 21 nt, Human
acagcccuucuuuccacagaa

SEQ ID NO: 1651188 - RNA, 20 nt, Human
uaugaaagauggcugugccu

SEQ ID NO: 1651189 - RNA, 22 nt, Human
uaugaaagauggcugugccucu

SEQ ID NO: 1651190 - RNA, 23 nt, Human
uaugaaagauggcugugccucug

SEQ ID NO: 1651191 - RNA, 20 nt, Human
acacuuguugauuaauggaa

SEQ ID NO: 1651192 - RNA, 23 nt, Human
acacuuguugauuaauggaaaug

SEQ ID NO: 1651193 - RNA, 15 nt, Human
acacuguuucaaacu

SEQ ID NO: 1651194 - RNA, 16 nt, Human
acacuguuucaaacuu

SEQ ID NO: 1651195 - RNA, 13 nt, Human
acacuuaaaaaug

SEQ ID NO: 1651196 - RNA, 15 nt, Human
acacuuaaaaauggu

SEQ ID NO: 1651197 - RNA, 19 nt, Human
acagacuggaagcacagcu

SEQ ID NO: 1651198 - RNA, 21 nt, Human
acagacuggaagcacagcuuc

SEQ ID NO: 1651199 - RNA, 22 nt, Human
acagacuggaagcacagcuuca

SEQ ID NO: 1651200 - RNA, 18 nt, Human
acagacacaggcccggcu

SEQ ID NO: 1651201 - RNA, 22 nt, Human
acagacacaggcccggcuccag

SEQ ID NO: 1651202 - RNA, 17 nt, Human
acagacacaggcccggc

SEQ ID NO: 1651203 - RNA, 19 nt, Human
acagaaagcagaacaguga

SEQ ID NO: 1651204 - RNA, 12 nt, Human
uauauuuacaaa

SEQ ID NO: 1651205 - RNA, 22 nt, Human
acacuguucucugcccuccaag

SEQ ID NO: 1651206 - RNA, 23 nt, Human
acacuguucucugcccuccaaga

SEQ ID NO: 1651207 - RNA, 16 nt, Human
acacuguucucugccc

SEQ ID NO: 1651208 - RNA, 17 nt, Human
acacuguucucugcccu

SEQ ID NO: 1651209 - RNA, 18 nt, Human
acacuguucucugcccuc

SEQ ID NO: 1651210 - RNA, 20 nt, Human
acacuguucucugcccucca

SEQ ID NO: 1651211 - RNA, 14 nt, Human
acacuguucucugc

SEQ ID NO: 1651212 - RNA, 15 nt, Human
acacuguucucugcc

SEQ ID NO: 1651213 - RNA, 12 nt, Human
acacugaagaag

SEQ ID NO: 1651214 - RNA, 14 nt, Human
acacugaagaagca

SEQ ID NO: 1651215 - RNA, 11 nt, Human
acacucugaga

SEQ ID NO: 1651216 - RNA, 13 nt, Human
acacucugagacu

SEQ ID NO: 1651217 - RNA, 14 nt, Human
acacuccagugaga

SEQ ID NO: 1651218 - RNA, 21 nt, Human
acacuccaauuaaggauuuua

SEQ ID NO: 1651219 - RNA, 18 nt, Human
acacuccaauuaaggauu

SEQ ID NO: 1651220 - RNA, 19 nt, Human
uacuuuuuggcauaacaua

SEQ ID NO: 1651221 - RNA, 20 nt, Human
uacuuuuuggcauaacauaa

SEQ ID NO: 1651222 - RNA, 14 nt, Human
uacuuuuuggcaua

SEQ ID NO: 1651223 - RNA, 16 nt, Human
uacuuugugcuggggu

SEQ ID NO: 1651224 - RNA, 22 nt, Human
uacuuugugcugggguuaucug

SEQ ID NO: 1651225 - RNA, 13 nt, Human
aauuugguuuuca

SEQ ID NO: 1651226 - RNA, 15 nt, Human
aauuugguuuucaca

SEQ ID NO: 1651227 - RNA, 21 nt, Human
aauuugguuuucacauuggaa

SEQ ID NO: 1651228 - RNA, 16 nt, Human
aauuuguuauaaugaa

SEQ ID NO: 1651229 - RNA, 16 nt, Human
aauuuuguuucuguac

SEQ ID NO: 1651230 - RNA, 22 nt, Human
aauuuuuaaucuuuaauuuuac

SEQ ID NO: 1651231 - RNA, 21 nt, Human
aauuuuucuuauuucauuucu

SEQ ID NO: 1651232 - RNA, 22 nt, Human
aauuuuuuuaucgucacugcuu

SEQ ID NO: 1651233 - RNA, 22 nt, Human
aauuuuuucucuaggaaauauu

SEQ ID NO: 1651234 - RNA, 20 nt, Human
acaaaguauuaagcauauau

SEQ ID NO: 1651235 - RNA, 14 nt, Human
acaaaacuuuucua

SEQ ID NO: 1651236 - RNA, 18 nt, Human
acaaagcccuuccauguc

SEQ ID NO: 1651237 - RNA, 21 nt, Human
acaaagcgugguggacaugca

SEQ ID NO: 1651238 - RNA, 22 nt, Human
uagauaggucagugcaaauacu

SEQ ID NO: 1651239 - RNA, 17 nt, Human
uagauaggccaugggca

SEQ ID NO: 1651240 - RNA, 14 nt, Human
uagaucuaguucac

SEQ ID NO: 1651241 - RNA, 21 nt, Human
uagaugcaguucugaagaaga

SEQ ID NO: 1651242 - RNA, 20 nt, Human
uagaugcaguucugaagaag

SEQ ID NO: 1651243 - RNA, 21 nt, Human
acaaauucugucucuggauua

SEQ ID NO: 1651244 - RNA, 15 nt, Human
acaacagcuggugcc

SEQ ID NO: 1651245 - RNA, 13 nt, Human
acaagacacagug

SEQ ID NO: 1651246 - RNA, 17 nt, Human
acaacaucuuuuucuac

SEQ ID NO: 1651247 - RNA, 17 nt, Human
acaaauuuacagagaca

SEQ ID NO: 1651248 - RNA, 17 nt, Human
acaagcgugagccacug

SEQ ID NO: 1651249 - RNA, 13 nt, Human
acaagcuccaagc

SEQ ID NO: 1651250 - RNA, 22 nt, Human
acaagcucacagaccuuugaac

SEQ ID NO: 1651251 - RNA, 18 nt, Human
acaagaccacguuucuaa

SEQ ID NO: 1651252 - RNA, 17 nt, Human
acaagaccacguuucua

SEQ ID NO: 1651253 - RNA, 14 nt, Human
acaagacacaguga

SEQ ID NO: 1651254 - RNA, 16 nt, Human
acaagaccacguuucu

SEQ ID NO: 1651255 - RNA, 18 nt, Human
acaagagcuuaacagugu

SEQ ID NO: 1651256 - RNA, 19 nt, Human
acaagagcuuaacagugug

SEQ ID NO: 1651257 - RNA, 22 nt, Human
acaagagcccaggccuccuaca

SEQ ID NO: 1651258 - RNA, 18 nt, Human
acaaucucggcucacugc

SEQ ID NO: 1651259 - RNA, 20 nt, Human
acaaucucggcucacugcau

SEQ ID NO: 1651260 - RNA, 18 nt, Human
acaagcgugagccacugc

SEQ ID NO: 1651261 - RNA, 22 nt, Human
acaagcuccaagcucccaggca

SEQ ID NO: 1651262 - RNA, 15 nt, Human
acaagcuccaagcuc

SEQ ID NO: 1651263 - RNA, 16 nt, Human
acaagcuccaagcucc

SEQ ID NO: 1651264 - RNA, 17 nt, Human
acaagcuccaagcuccc

SEQ ID NO: 1651265 - RNA, 19 nt, Human
acaagcuccaagcucccag

SEQ ID NO: 1651266 - RNA, 15 nt, Human
uagcuagacugguga

SEQ ID NO: 1651267 - RNA, 18 nt, Human
uagcuagacuggugacug

SEQ ID NO: 1651268 - RNA, 16 nt, Human
uagcucaggugucccu

SEQ ID NO: 1651269 - RNA, 16 nt, Human
uagcuacuaauuuuaa

SEQ ID NO: 1651270 - RNA, 19 nt, Human
uacugaaauaaacgucuua

SEQ ID NO: 1651271 - RNA, 22 nt, Human
uacugaaauaaacgucuuaaau

SEQ ID NO: 1651272 - RNA, 17 nt, Human
uacugagagugaacaaa

SEQ ID NO: 1651273 - RNA, 15 nt, Human
uacuguaauuuguga

SEQ ID NO: 1651274 - RNA, 17 nt, Human
uacuguaauuugugaua

SEQ ID NO: 1651275 - RNA, 16 nt, Human
uacuguaauuugugau

SEQ ID NO: 1651276 - RNA, 19 nt, Human
uacugagagugaacaaauu

SEQ ID NO: 1651277 - RNA, 19 nt, Human
uacuguacagacagaaaaa

SEQ ID NO: 1651278 - RNA, 23 nt, Human
uacuguacagacagaaaaaacug

SEQ ID NO: 1651279 - RNA, 18 nt, Human
uacuguacaugaaaacac

SEQ ID NO: 1651280 - RNA, 18 nt, Human
aauugaggacacugauau

SEQ ID NO: 1651281 - RNA, 18 nt, Human
uacuagggaaaugccuuu

SEQ ID NO: 1651282 - RNA, 22 nt, Human
uacucuacccucuuagaaaaac

SEQ ID NO: 1651283 - RNA, 18 nt, Human
uacuaaaaauacaaaaaa

SEQ ID NO: 1651284 - RNA, 16 nt, Human
uacgucugacaggcaa

SEQ ID NO: 1651285 - RNA, 13 nt, Human
uacgugaguccug

SEQ ID NO: 1651286 - RNA, 14 nt, Human
uacuaaaaauacaa

SEQ ID NO: 1651287 - RNA, 15 nt, Human
uacgucugacaggca

SEQ ID NO: 1651288 - RNA, 24 nt, Human
uacgcuccaucgcugucaucucag

SEQ ID NO: 1651289 - RNA, 13 nt, Human
aauugacccacaa

SEQ ID NO: 1651290 - RNA, 15 nt, Human
aauuugaaacacuuu

SEQ ID NO: 1651291 - RNA, 14 nt, Human
uacuuccccuuccu

SEQ ID NO: 1651292 - RNA, 15 nt, Human
uacuuccccuuccua

SEQ ID NO: 1651293 - RNA, 18 nt, Human
uacuuccccuuccuaauu

SEQ ID NO: 1651294 - RNA, 20 nt, Human
uacuuccccuuccuaauucc

SEQ ID NO: 1651295 - RNA, 23 nt, Human
uacuuccugugacuucagcucug

SEQ ID NO: 1651296 - RNA, 13 nt, Human
uacuucuccaccc

SEQ ID NO: 1651297 - RNA, 18 nt, Human
uacuucuccacccugcuc

SEQ ID NO: 1651298 - RNA, 23 nt, Human
uacuuugauauuuucaacgcagc

SEQ ID NO: 1651299 - RNA, 15 nt, Human
uacuugaaaauuaac

SEQ ID NO: 1651300 - RNA, 16 nt, Human
uacuucuuauacauuu

SEQ ID NO: 1651301 - RNA, 14 nt, Human
uacuucuuauacau

SEQ ID NO: 1651302 - RNA, 15 nt, Human
uacuucuuauacauu

SEQ ID NO: 1651303 - RNA, 20 nt, Human
uacuucuccacccugcucuc

SEQ ID NO: 1651304 - RNA, 15 nt, Human
uacuucugcuacaua

SEQ ID NO: 1651305 - RNA, 19 nt, Human
uacuucuuaggguuaugau

SEQ ID NO: 1651306 - RNA, 15 nt, Human
aauuggagcucgugg

SEQ ID NO: 1651307 - RNA, 13 nt, Human
aauuuaguauuuu

SEQ ID NO: 1651308 - RNA, 15 nt, Human
aauuuacauacucug

SEQ ID NO: 1651309 - RNA, 17 nt, Human
aauuuaccugaagucuu

SEQ ID NO: 1651310 - RNA, 17 nt, Human
aauuuacagagacagaa

SEQ ID NO: 1651311 - RNA, 18 nt, Human
aauuuacagagacagaaa

SEQ ID NO: 1651312 - RNA, 18 nt, Human
aauuucuaggacugaauu

SEQ ID NO: 1651313 - RNA, 22 nt, Human
aauuucuaggacugaauuauga

SEQ ID NO: 1651314 - RNA, 17 nt, Human
aauuucuaggacugaau

SEQ ID NO: 1651315 - RNA, 17 nt, Human
aauuuauuauggcacau

SEQ ID NO: 1651316 - RNA, 14 nt, Human
aauuuauuauggca

SEQ ID NO: 1651317 - RNA, 13 nt, Human
aauuuauuauggc

SEQ ID NO: 1651318 - RNA, 23 nt, Human
aauuucuaggacugaauuaugaa

SEQ ID NO: 1651319 - RNA, 19 nt, Human
aauuucucccagucauuua

SEQ ID NO: 1651320 - RNA, 22 nt, Human
aauuuauaaacuuuuuucuuac

SEQ ID NO: 1651321 - RNA, 22 nt, Human
uaaagguucaugcaaacuuuau

SEQ ID NO: 1651322 - RNA, 19 nt, Human
uaaaguaaaaacaaagaaa

SEQ ID NO: 1651323 - RNA, 21 nt, Human
uaaaguaaaaacaaagaaauu

SEQ ID NO: 1651324 - RNA, 22 nt, Human
uaaaguaaaaacaaagaaauua

SEQ ID NO: 1651325 - RNA, 20 nt, Human
aaguuuuuauggcuuuugug

SEQ ID NO: 1651326 - RNA, 16 nt, Human
aauaaaucauaaaacu

SEQ ID NO: 1651327 - RNA, 15 nt, Human
aauaaaacuuuuuaa

SEQ ID NO: 1651328 - RNA, 14 nt, Human
aauaaaacuuuuua

SEQ ID NO: 1651329 - RNA, 12 nt, Human
aauaaaacuuuu

SEQ ID NO: 1651330 - RNA, 18 nt, Human
aauaaaacuuuuuaaaau

SEQ ID NO: 1651331 - RNA, 16 nt, Human
aauaaauugcuccuug

SEQ ID NO: 1651332 - RNA, 20 nt, Human
aauaaauugcuccuugacau

SEQ ID NO: 1651333 - RNA, 21 nt, Human
aauaacaaugaaaguugauaa

SEQ ID NO: 1651334 - RNA, 15 nt, Human
aauaacgauaaaaga

SEQ ID NO: 1651335 - RNA, 20 nt, Human
aauaaccaaaugcaauguga

SEQ ID NO: 1651336 - RNA, 15 nt, Human
uaaaucugugaacuu

SEQ ID NO: 1651337 - RNA, 16 nt, Human
uaaaucugugaacuug

SEQ ID NO: 1651338 - RNA, 17 nt, Human
uaaaucugugaacuuga

SEQ ID NO: 1651339 - RNA, 18 nt, Human
uaaaucugugaacuugaa

SEQ ID NO: 1651340 - RNA, 19 nt, Human
uaaaucugugaacuugaaa

SEQ ID NO: 1651341 - RNA, 21 nt, Human
uaaaucugugaacuugaaauu

SEQ ID NO: 1651342 - RNA, 22 nt, Human
uaaaucugugaacuugaaauuu

SEQ ID NO: 1651343 - RNA, 18 nt, Human
uaaauagcuagacuggug

SEQ ID NO: 1651344 - RNA, 18 nt, Human
uaaaucuccaaaauaaaa

SEQ ID NO: 1651345 - RNA, 15 nt, Human
uaaaucuccaaaaua

SEQ ID NO: 1651346 - RNA, 14 nt, Human
uaaaucuccaaaau

SEQ ID NO: 1651347 - RNA, 23 nt, Human
uaaaugcaccuggaauauauaac

SEQ ID NO: 1651348 - RNA, 15 nt, Human
uaaauguugaaagau

SEQ ID NO: 1651349 - RNA, 20 nt, Human
uaaauguugaaagaucaaaa

SEQ ID NO: 1651350 - RNA, 24 nt, Human
uaaauguuuuuuuuuaaagacuuu

SEQ ID NO: 1651351 - RNA, 14 nt, Human
uaaauuaacuuuua

SEQ ID NO: 1651352 - RNA, 12 nt, Human
uaaauuaacuuu

SEQ ID NO: 1651353 - RNA, 16 nt, Human
uaaauuaacuuuuaua

SEQ ID NO: 1651354 - RNA, 15 nt, Human
uaaauuaacuuuuau

SEQ ID NO: 1651355 - RNA, 17 nt, Human
uaaauuaacuuuuauaa

SEQ ID NO: 1651356 - RNA, 18 nt, Human
uaaauuaacuuuuauaaa

SEQ ID NO: 1651357 - RNA, 19 nt, Human
uaaauaaugugaaacugga

SEQ ID NO: 1651358 - RNA, 17 nt, Human
uaaauaaauaaauagcu

SEQ ID NO: 1651359 - RNA, 14 nt, Human
uaaauaaauagcua

SEQ ID NO: 1651360 - RNA, 12 nt, Human
uaaauaaaguuu

SEQ ID NO: 1651361 - RNA, 21 nt, Human
uaaauaaaguuuguugaaaca

SEQ ID NO: 1651362 - RNA, 20 nt, Human
aauaauuuuuauauuugaaa

SEQ ID NO: 1651363 - RNA, 16 nt, Human
aauaauuuuuauauuu

SEQ ID NO: 1651364 - RNA, 17 nt, Human
aauaauuuuuauauuug

SEQ ID NO: 1651365 - RNA, 19 nt, Human
aauaauuuuuauauuugaa

SEQ ID NO: 1651366 - RNA, 17 nt, Human
uaagacauuuuuggaag

SEQ ID NO: 1651367 - RNA, 19 nt, Human
uaacuuuuauaaacuuuac

SEQ ID NO: 1651368 - RNA, 13 nt, Human
uaagaaugaaaua

SEQ ID NO: 1651369 - RNA, 15 nt, Human
uaagaaugaaauacu

SEQ ID NO: 1651370 - RNA, 21 nt, Human
uaagaaugaaauacuguuuga

SEQ ID NO: 1651371 - RNA, 18 nt, Human
uaacuuuuauaaacuuua

SEQ ID NO: 1651372 - RNA, 17 nt, Human
uaacuuuuauaaacuuu

SEQ ID NO: 1651373 - RNA, 15 nt, Human
uaacuuuuauaaacu

SEQ ID NO: 1651374 - RNA, 16 nt, Human
aauaucuccgucaacu

SEQ ID NO: 1651375 - RNA, 21 nt, Human
aauaucuccgucaacucauau

SEQ ID NO: 1651376 - RNA, 16 nt, Human
aauaucugaaaaugua

SEQ ID NO: 1651377 - RNA, 17 nt, Human
aauaucugaaaauguau

SEQ ID NO: 1651378 - RNA, 18 nt, Human
aauaucugaaaauguaug

SEQ ID NO: 1651379 - RNA, 19 nt, Human
aauaucugaaaauguaugu

SEQ ID NO: 1651380 - RNA, 20 nt, Human
aauaucugaaaauguaugug

SEQ ID NO: 1651381 - RNA, 19 nt, Human
aauaucuuuuuuuuaauaa

SEQ ID NO: 1651382 - RNA, 11 nt, Human
aauauugcuga

SEQ ID NO: 1651383 - RNA, 12 nt, Human
aauauugcugau

SEQ ID NO: 1651384 - RNA, 13 nt, Human
aauauugcugaug

SEQ ID NO: 1651385 - RNA, 15 nt, Human
aauauugcugauggu

SEQ ID NO: 1651386 - RNA, 18 nt, Human
aauauugcugauggugca

SEQ ID NO: 1651387 - RNA, 21 nt, Human
aauauugcugauggugcaaug

SEQ ID NO: 1651388 - RNA, 22 nt, Human
aauauugcugauggugcaauga

SEQ ID NO: 1651389 - RNA, 15 nt, Human
aauaugcaaagcacu

SEQ ID NO: 1651390 - RNA, 17 nt, Human
aauaugcaaagcacuga

SEQ ID NO: 1651391 - RNA, 18 nt, Human
aauauugauaugcuuaua

SEQ ID NO: 1651392 - RNA, 15 nt, Human
aauaugcacacauuu

SEQ ID NO: 1651393 - RNA, 24 nt, Human
aauaugcaaagcacugacuucuaa

SEQ ID NO: 1651394 - RNA, 17 nt, Human
aauauuuuaugauccag

SEQ ID NO: 1651395 - RNA, 18 nt, Human
aauauuuuaugauccagc

SEQ ID NO: 1651396 - RNA, 15 nt, Human
aauauuucagauaau

SEQ ID NO: 1651397 - RNA, 16 nt, Human
uaaccucuaaauucuu

SEQ ID NO: 1651398 - RNA, 15 nt, Human
uaacauggaaguacu

SEQ ID NO: 1651399 - RNA, 16 nt, Human
uaacauggaaguacua

SEQ ID NO: 1651400 - RNA, 15 nt, Human
uaacuaaaagguaug

SEQ ID NO: 1651401 - RNA, 16 nt, Human
uaacauaaaucuguga

SEQ ID NO: 1651402 - RNA, 17 nt, Human
uaacauaaaucugugaa

SEQ ID NO: 1651403 - RNA, 18 nt, Human
uaacauaaaucugugaac

SEQ ID NO: 1651404 - RNA, 20 nt, Human
uaacauaaaucugugaacuu

SEQ ID NO: 1651405 - RNA, 15 nt, Human
uaacauaaaucugug

SEQ ID NO: 1651406 - RNA, 14 nt, Human
uaacaugauuuggg

SEQ ID NO: 1651407 - RNA, 14 nt, Human
uaacauggaaguac

SEQ ID NO: 1651408 - RNA, 15 nt, Human
aauaucacuugucaa

SEQ ID NO: 1651409 - RNA, 18 nt, Human
aauaucaucaguauugaa

SEQ ID NO: 1651410 - RNA, 12 nt, Human
aauaucacuugu

SEQ ID NO: 1651411 - RNA, 24 nt, Human
aauagcuuuuuucucugauacaga

SEQ ID NO: 1651412 - RNA, 19 nt, Human
aauaggaaaaacugauuuu

SEQ ID NO: 1651413 - RNA, 17 nt, Human
aauaggaaaaacugauu

SEQ ID NO: 1651414 - RNA, 18 nt, Human
aauaggaaaaacugauuu

SEQ ID NO: 1651415 - RNA, 15 nt, Human
aauaggaaaaacuga

SEQ ID NO: 1651416 - RNA, 16 nt, Human
aauaggaaaaacugau

SEQ ID NO: 1651417 - RNA, 18 nt, Human
aauaggcguaacuaauuu

SEQ ID NO: 1651418 - RNA, 16 nt, Human
aauagaugcugacugu

SEQ ID NO: 1651419 - RNA, 20 nt, Human
aauagccugccucuucucua

SEQ ID NO: 1651420 - RNA, 13 nt, Human
aauagcugggacu

SEQ ID NO: 1651421 - RNA, 14 nt, Human
aauagcugggacua

SEQ ID NO: 1651422 - RNA, 18 nt, Human
aauagacccacaagaggc

SEQ ID NO: 1651423 - RNA, 23 nt, Human
aauagacaauuuauuauggcaca

SEQ ID NO: 1651424 - RNA, 18 nt, Human
aauagacaauuuauuaug

SEQ ID NO: 1651425 - RNA, 20 nt, Human
aauccucaguuuuugugaaa

SEQ ID NO: 1651426 - RNA, 15 nt, Human
aaucuaaauggaacc

SEQ ID NO: 1651427 - RNA, 13 nt, Human
aaucuaaauggaa

SEQ ID NO: 1651428 - RNA, 18 nt, Human
aaucuaaauggaaccacu

SEQ ID NO: 1651429 - RNA, 13 nt, Human
aauccuugaagau

SEQ ID NO: 1651430 - RNA, 12 nt, Human
aaucucaaauuu

SEQ ID NO: 1651431 - RNA, 15 nt, Human
aaucucaaauaacua

SEQ ID NO: 1651432 - RNA, 14 nt, Human
aaucucaaauuucu

SEQ ID NO: 1651433 - RNA, 15 nt, Human
aaucucaaauuucua

SEQ ID NO: 1651434 - RNA, 13 nt, Human
aaucugugaacuu

SEQ ID NO: 1651435 - RNA, 15 nt, Human
aaucugugaacuuga

SEQ ID NO: 1651436 - RNA, 17 nt, Human
aaucugugaacuugaaa

SEQ ID NO: 1651437 - RNA, 18 nt, Human
aaucugugaacuugaaau

SEQ ID NO: 1651438 - RNA, 19 nt, Human
aaucugugaacuugaaauu

SEQ ID NO: 1651439 - RNA, 16 nt, Human
aaucuuauaauuuaaa

SEQ ID NO: 1651440 - RNA, 14 nt, Human
aaucuuauaauuua

SEQ ID NO: 1651441 - RNA, 15 nt, Human
aaucaucaagucuuu

SEQ ID NO: 1651442 - RNA, 17 nt, Human
aaucauggugcucagag

SEQ ID NO: 1651443 - RNA, 19 nt, Human
aaucaugaauuaguuuuau

SEQ ID NO: 1651444 - RNA, 17 nt, Human
aaucaugaauuaguuuu

SEQ ID NO: 1651445 - RNA, 23 nt, Human
aaucaugaauuaguuuuauaugc

SEQ ID NO: 1651446 - RNA, 20 nt, Human
uaaguuuuuauggcuuuugu

SEQ ID NO: 1651447 - RNA, 18 nt, Human
uaaguuuuuuuuuaaaaa

SEQ ID NO: 1651448 - RNA, 14 nt, Human
aaucagacuaugaa

SEQ ID NO: 1651449 - RNA, 17 nt, Human
aaucagacuaugaaguu

SEQ ID NO: 1651450 - RNA, 12 nt, Human
aaucagcauucu

SEQ ID NO: 1651451 - RNA, 15 nt, Human
uaaguaucugacauc

SEQ ID NO: 1651452 - RNA, 16 nt, Human
uaaguaucugacaucu

SEQ ID NO: 1651453 - RNA, 14 nt, Human
uaaugaaagacugu

SEQ ID NO: 1651454 - RNA, 17 nt, Human
uaaugaaagacuguaca

SEQ ID NO: 1651455 - RNA, 18 nt, Human
uaaugaaagacuguacaa

SEQ ID NO: 1651456 - RNA, 19 nt, Human
uaaugaaagacuguacaaa

SEQ ID NO: 1651457 - RNA, 15 nt, Human
uaaugacuuaagcac

SEQ ID NO: 1651458 - RNA, 21 nt, Human
uaaugacuuaagcacacuuga

SEQ ID NO: 1651459 - RNA, 22 nt, Human
uaaugaaagacuguacaaagua

SEQ ID NO: 1651460 - RNA, 23 nt, Human
uaaugaaagacuguacaaaguag

SEQ ID NO: 1651461 - RNA, 13 nt, Human
aaucuucugaacu

SEQ ID NO: 1651462 - RNA, 20 nt, Human
aaucuucugaacuuggcgcu

SEQ ID NO: 1651463 - RNA, 19 nt, Human
uaauagguuuggacaaaau

SEQ ID NO: 1651464 - RNA, 14 nt, Human
uaauagguuuggac

SEQ ID NO: 1651465 - RNA, 21 nt, Human
uaaucaacugggcugaacacu

SEQ ID NO: 1651466 - RNA, 15 nt, Human
aaugaaaaccacauu

SEQ ID NO: 1651467 - RNA, 17 nt, Human
aaugacuuacuguacau

SEQ ID NO: 1651468 - RNA, 14 nt, Human
aaugacuuacugua

SEQ ID NO: 1651469 - RNA, 18 nt, Human
aaugacuuacuguacaug

SEQ ID NO: 1651470 - RNA, 15 nt, Human
aaugagccuggcaag

SEQ ID NO: 1651471 - RNA, 21 nt, Human
aaugagagacacacugaagaa

SEQ ID NO: 1651472 - RNA, 19 nt, Human
aaucuuuaaaaaaaaaauu

SEQ ID NO: 1651473 - RNA, 20 nt, Human
aaucuuuaaaaaaaaaauug

SEQ ID NO: 1651474 - RNA, 13 nt, Human
uaaugaggaaacu

SEQ ID NO: 1651475 - RNA, 16 nt, Human
uaaugauaacuggaaa

SEQ ID NO: 1651476 - RNA, 16 nt, Human
uacaguauaauuaaca

SEQ ID NO: 1651477 - RNA, 17 nt, Human
uacaguauaauuaacau

SEQ ID NO: 1651478 - RNA, 14 nt, Human
uacaguauaauuaa

SEQ ID NO: 1651479 - RNA, 17 nt, Human
uacaggcuccugccacc

SEQ ID NO: 1651480 - RNA, 14 nt, Human
uacaggcuccugcc

SEQ ID NO: 1651481 - RNA, 15 nt, Human
uacaggcuccugcca

SEQ ID NO: 1651482 - RNA, 22 nt, Human
uacaggcgugagccaccgugcc

SEQ ID NO: 1651483 - RNA, 18 nt, Human
uacagaggccaugggccu

SEQ ID NO: 1651484 - RNA, 14 nt, Human
uacaccauuaugug

SEQ ID NO: 1651485 - RNA, 19 nt, Human
uacacuaagagagaaugag

SEQ ID NO: 1651486 - RNA, 14 nt, Human
uacacuccagugag

SEQ ID NO: 1651487 - RNA, 18 nt, Human
uacaccacuacauucugu

SEQ ID NO: 1651488 - RNA, 17 nt, Human
uacaccacuacauucug

SEQ ID NO: 1651489 - RNA, 16 nt, Human
uacaccacuacauucu

SEQ ID NO: 1651490 - RNA, 15 nt, Human
uacaccacuacauuc

SEQ ID NO: 1651491 - RNA, 20 nt, Human
uacaccacuacauucuguua

SEQ ID NO: 1651492 - RNA, 19 nt, Human
uacaccacuacauucuguu

SEQ ID NO: 1651493 - RNA, 20 nt, Human
aauggacuguggugacuuug

SEQ ID NO: 1651494 - RNA, 21 nt, Human
aauggacguguuaugacucca

SEQ ID NO: 1651495 - RNA, 19 nt, Human
aauggacuuuuguacauag

SEQ ID NO: 1651496 - RNA, 14 nt, Human
aauguacugcauau

SEQ ID NO: 1651497 - RNA, 18 nt, Human
aauguacugcauaugaaa

SEQ ID NO: 1651498 - RNA, 12 nt, Human
aauguaugugua

SEQ ID NO: 1651499 - RNA, 14 nt, Human
aauguauguguaag

SEQ ID NO: 1651500 - RNA, 14 nt, Human
aauguggcuccugg

SEQ ID NO: 1651501 - RNA, 11 nt, Human
aaugugauaug

SEQ ID NO: 1651502 - RNA, 21 nt, Human
uacauaaugcgugcauaccac

SEQ ID NO: 1651503 - RNA, 20 nt, Human
uacauaaugcgugcauacca

SEQ ID NO: 1651504 - RNA, 19 nt, Human
uacauaaugcgugcauacc

SEQ ID NO: 1651505 - RNA, 18 nt, Human
uacaguauaauuaacaug

SEQ ID NO: 1651506 - RNA, 19 nt, Human
uacaguauaauuaacaugu

SEQ ID NO: 1651507 - RNA, 23 nt, Human
uacaguauaauuaacauguuaaa

SEQ ID NO: 1651508 - RNA, 17 nt, Human
uacauaaugcgugcaua

SEQ ID NO: 1651509 - RNA, 15 nt, Human
uacaguaucucaggg

SEQ ID NO: 1651510 - RNA, 19 nt, Human
uacauauaagugauugcug

SEQ ID NO: 1651511 - RNA, 22 nt, Human
uacauauaagugauugcugguu

SEQ ID NO: 1651512 - RNA, 12 nt, Human
aauguacugcau

SEQ ID NO: 1651513 - RNA, 13 nt, Human
uacaaaaacacag

SEQ ID NO: 1651514 - RNA, 14 nt, Human
uacaaaaacacagc

SEQ ID NO: 1651515 - RNA, 15 nt, Human
uacaaaagcauguga

SEQ ID NO: 1651516 - RNA, 20 nt, Human
uacaaaaagcauaaaaauua

SEQ ID NO: 1651517 - RNA, 15 nt, Human
uacaaaaacacagca

SEQ ID NO: 1651518 - RNA, 16 nt, Human
uacaaaaacacagcaa

SEQ ID NO: 1651519 - RNA, 14 nt, Human
uaauuccacagcug

SEQ ID NO: 1651520 - RNA, 17 nt, Human
uaauuccacagcugcuc

SEQ ID NO: 1651521 - RNA, 13 nt, Human
uaauuccacagcu

SEQ ID NO: 1651522 - RNA, 13 nt, Human
aaugcauaaaaug

SEQ ID NO: 1651523 - RNA, 14 nt, Human
uacaaggacagccc

SEQ ID NO: 1651524 - RNA, 16 nt, Human
aaugcauaaaauguua

SEQ ID NO: 1651525 - RNA, 14 nt, Human
aaugcccagccccu

SEQ ID NO: 1651526 - RNA, 15 nt, Human
aaugcccagccccuu

SEQ ID NO: 1651527 - RNA, 21 nt, Human
aaugccccugaauuuaaauag

SEQ ID NO: 1651528 - RNA, 13 nt, Human
aaugcugugcccu

SEQ ID NO: 1651529 - RNA, 21 nt, Human
aaugcugugcccuaaagugua

SEQ ID NO: 1651530 - RNA, 20 nt, Human
aaugcugugcccuaaagugu

SEQ ID NO: 1651531 - RNA, 20 nt, Human
aaugcccagccccuucugac

SEQ ID NO: 1651532 - RNA, 22 nt, Human
aaugcccagccccuucugaccc

SEQ ID NO: 1651533 - RNA, 23 nt, Human
aaugcccagccccuucugaccca

SEQ ID NO: 1651534 - RNA, 24 nt, Human
aaugcccagccccuucugacccau

SEQ ID NO: 1651535 - RNA, 16 nt, Human
aauggacguguuauga

SEQ ID NO: 1651536 - RNA, 15 nt, Human
gugcucaggagcccu

SEQ ID NO: 1651537 - RNA, 12 nt, Human
gugcuauguucu

SEQ ID NO: 1651538 - RNA, 22 nt, Human
gugcuaucucccccagccccau

SEQ ID NO: 1651539 - RNA, 21 nt, Human
gugcugggauuacaagcguga

SEQ ID NO: 1651540 - RNA, 22 nt, Human
gugcugggauuacaagcgugag

SEQ ID NO: 1651541 - RNA, 20 nt, Human
gugcugggauuacaggcgug

SEQ ID NO: 1651542 - RNA, 20 nt, Human
gugcugggauuacaggugug

SEQ ID NO: 1651543 - RNA, 23 nt, Human
guggacacagcucuucuccaggc

SEQ ID NO: 1651544 - RNA, 18 nt, Human
guggacacagcucuucuc

SEQ ID NO: 1651545 - RNA, 22 nt, Human
guggacacagcucuucuccagg

SEQ ID NO: 1651546 - RNA, 21 nt, Human
guggauggaaggggcugacag

SEQ ID NO: 1651547 - RNA, 21 nt, Human
guggaugccugguggcagcug

SEQ ID NO: 1651548 - RNA, 17 nt, Human
guggacauggcuguuca

SEQ ID NO: 1651549 - RNA, 19 nt, Human
guggauuuaacagaaaugu

SEQ ID NO: 1651550 - RNA, 18 nt, Human
guggauuuaacagaaaug

SEQ ID NO: 1651551 - RNA, 20 nt, Human
guggauuuaacagaaaugua

SEQ ID NO: 1651552 - RNA, 19 nt, Human
guggcaccagcagccugga

SEQ ID NO: 1651553 - RNA, 20 nt, Human
guggcagcucaccucucccu

SEQ ID NO: 1651554 - RNA, 14 nt, Human
guggcagcucaccu

SEQ ID NO: 1651555 - RNA, 16 nt, Human
guggcagcucaccucu

SEQ ID NO: 1651556 - RNA, 16 nt, Human
aagaaugauuaugaau

SEQ ID NO: 1651557 - RNA, 20 nt, Human
aagacaaaaagcuacuuauu

SEQ ID NO: 1651558 - RNA, 23 nt, Human
aagacaaaaagcuacuuauugua

SEQ ID NO: 1651559 - RNA, 19 nt, Human
aagaaugguccgugcuaag

SEQ ID NO: 1651560 - RNA, 22 nt, Human
aagaaugguccgugcuaaggac

SEQ ID NO: 1651561 - RNA, 16 nt, Human
aagaauugaagcagga

SEQ ID NO: 1651562 - RNA, 18 nt, Human
aagaaugauuaugaauua

SEQ ID NO: 1651563 - RNA, 12 nt, Human
aacuugggaacu

SEQ ID NO: 1651564 - RNA, 15 nt, Human
aacuuguauuaugug

SEQ ID NO: 1651565 - RNA, 16 nt, Human
aacuuguauuaugugu

SEQ ID NO: 1651566 - RNA, 22 nt, Human
aacuugucuuuggacccugagg

SEQ ID NO: 1651567 - RNA, 18 nt, Human
aacuugucuuuggacccu

SEQ ID NO: 1651568 - RNA, 13 nt, Human
aacuuuaccuuuu

SEQ ID NO: 1651569 - RNA, 13 nt, Human
gugccucugccug

SEQ ID NO: 1651570 - RNA, 12 nt, Human
gugccucuggga

SEQ ID NO: 1651571 - RNA, 13 nt, Human
gugccucugggac

SEQ ID NO: 1651572 - RNA, 15 nt, Human
gugccucugccuguc

SEQ ID NO: 1651573 - RNA, 14 nt, Human
gugccucugggacu

SEQ ID NO: 1651574 - RNA, 14 nt, Human
gugccuuauggaac

SEQ ID NO: 1651575 - RNA, 21 nt, Human
gugccuuauggaacacucuga

SEQ ID NO: 1651576 - RNA, 23 nt, Human
gugccuuauggaacacucugaga

SEQ ID NO: 1651577 - RNA, 15 nt, Human
gugccucaagagaag

SEQ ID NO: 1651578 - RNA, 21 nt, Human
gugaaccaccacacccagccc

SEQ ID NO: 1651579 - RNA, 18 nt, Human
gugcuaggaacacuccuu

SEQ ID NO: 1651580 - RNA, 22 nt, Human
gugcuaggaacacuccuucaca

SEQ ID NO: 1651581 - RNA, 21 nt, Human
gugcuaucucccccagcccca

SEQ ID NO: 1651582 - RNA, 18 nt, Human
gugcuaguaauuggaaag

SEQ ID NO: 1651583 - RNA, 16 nt, Human
aagaagugaaaaucua

SEQ ID NO: 1651584 - RNA, 22 nt, Human
aagaagugaaaaucuacacucc

SEQ ID NO: 1651585 - RNA, 18 nt, Human
aagaaaaaggaugcacag

SEQ ID NO: 1651586 - RNA, 17 nt, Human
aagaaaaaggaugcaca

SEQ ID NO: 1651587 - RNA, 15 nt, Human
aagaaaaaggaugca

SEQ ID NO: 1651588 - RNA, 13 nt, Human
aagaaauauaccu

SEQ ID NO: 1651589 - RNA, 20 nt, Human
aagaaagacuaucuaaaugu

SEQ ID NO: 1651590 - RNA, 22 nt, Human
aagaaagacuaucuaaauguug

SEQ ID NO: 1651591 - RNA, 13 nt, Human
aagaaagaaaauc

SEQ ID NO: 1651592 - RNA, 13 nt, Human
gugggagugggcc

SEQ ID NO: 1651593 - RNA, 14 nt, Human
gugggagugggccc

SEQ ID NO: 1651594 - RNA, 13 nt, Human
gugggauccucca

SEQ ID NO: 1651595 - RNA, 23 nt, Human
guggcgcagcauauucaggaagc

SEQ ID NO: 1651596 - RNA, 22 nt, Human
gugggacacccugugauggggc

SEQ ID NO: 1651597 - RNA, 21 nt, Human
gugggacagucaccucaugga

SEQ ID NO: 1651598 - RNA, 20 nt, Human
gugggggaucacagccucug

SEQ ID NO: 1651599 - RNA, 14 nt, Human
guggguacgggagg

SEQ ID NO: 1651600 - RNA, 14 nt, Human
guggugguuuucug

SEQ ID NO: 1651601 - RNA, 16 nt, Human
gugguuucagaaaugu

SEQ ID NO: 1651602 - RNA, 14 nt, Human
guggguagacacac

SEQ ID NO: 1651603 - RNA, 16 nt, Human
aagagcuuaacagugu

SEQ ID NO: 1651604 - RNA, 18 nt, Human
guggcccgacagccuggc

SEQ ID NO: 1651605 - RNA, 19 nt, Human
guggcccgacagccuggca

SEQ ID NO: 1651606 - RNA, 19 nt, Human
aagacugucuuaauuugca

SEQ ID NO: 1651607 - RNA, 22 nt, Human
aagacccuuguggucccacccc

SEQ ID NO: 1651608 - RNA, 18 nt, Human
aagacccuugugguccca

SEQ ID NO: 1651609 - RNA, 21 nt, Human
aagacccuuguggucccaccc

SEQ ID NO: 1651610 - RNA, 16 nt, Human
aagacuaucuaaaugu

SEQ ID NO: 1651611 - RNA, 17 nt, Human
aagacuaucuaaauguu

SEQ ID NO: 1651612 - RNA, 22 nt, Human
aagacugaguacguugugcauu

SEQ ID NO: 1651613 - RNA, 21 nt, Human
aagacugaguacguugugcau

SEQ ID NO: 1651614 - RNA, 17 nt, Human
aagacuguacaaaguag

SEQ ID NO: 1651615 - RNA, 17 nt, Human
aagacugaguacguugu

SEQ ID NO: 1651616 - RNA, 18 nt, Human
aagacuaucuaaauguug

SEQ ID NO: 1651617 - RNA, 13 nt, Human
aagacuauucaaa

SEQ ID NO: 1651618 - RNA, 14 nt, Human
aagagguuuuaaag

SEQ ID NO: 1651619 - RNA, 18 nt, Human
aagagguuuuaaagcuuc

SEQ ID NO: 1651620 - RNA, 18 nt, Human
aagagguuuuaaaaaaau

SEQ ID NO: 1651621 - RNA, 16 nt, Human
aagagguuuuucuuaa

SEQ ID NO: 1651622 - RNA, 17 nt, Human
gugguuuucuguucuuu

SEQ ID NO: 1651623 - RNA, 20 nt, Human
guggugguuuucuguucuuu

SEQ ID NO: 1651624 - RNA, 12 nt, Human
aagaugcagccg

SEQ ID NO: 1651625 - RNA, 12 nt, Human
aagcaaaggaga

SEQ ID NO: 1651626 - RNA, 13 nt, Human
aagcaaaggagau

SEQ ID NO: 1651627 - RNA, 22 nt, Human
aagcaaagacuuuccucuuagu

SEQ ID NO: 1651628 - RNA, 14 nt, Human
aagaugugacaugu

SEQ ID NO: 1651629 - RNA, 18 nt, Human
aagaugugacauguuuua

SEQ ID NO: 1651630 - RNA, 17 nt, Human
gugucuugcaauggcag

SEQ ID NO: 1651631 - RNA, 18 nt, Human
gugucuugcaauggcagc

SEQ ID NO: 1651632 - RNA, 17 nt, Human
gugugaaaaugugugug

SEQ ID NO: 1651633 - RNA, 18 nt, Human
gugucuuuuuucacuaca

SEQ ID NO: 1651634 - RNA, 17 nt, Human
gugugacuacuccccca

SEQ ID NO: 1651635 - RNA, 18 nt, Human
guguguaugcgugugugu

SEQ ID NO: 1651636 - RNA, 19 nt, Human
guguuguacucaauuuuaa

SEQ ID NO: 1651637 - RNA, 23 nt, Human
guguuuccuggcacugcuuccag

SEQ ID NO: 1651638 - RNA, 13 nt, Human
guuugccucugcc

SEQ ID NO: 1651639 - RNA, 16 nt, Human
guuugccucugccucu

SEQ ID NO: 1651640 - RNA, 20 nt, Human
guuucuguacuuuuuggcau

SEQ ID NO: 1651641 - RNA, 23 nt, Human
guuucuaaaggcuaccuuuguau

SEQ ID NO: 1651642 - RNA, 22 nt, Human
guuucuaaaggcuaccuuugua

SEQ ID NO: 1651643 - RNA, 22 nt, Human
guuugauucagacagcugccug

SEQ ID NO: 1651644 - RNA, 23 nt, Human
guuuuacaauaaaaucuugaaaa

SEQ ID NO: 1651645 - RNA, 20 nt, Human
guuugggccccagaggcugg

SEQ ID NO: 1651646 - RNA, 18 nt, Human
guuuggggaugagaaagg

SEQ ID NO: 1651647 - RNA, 15 nt, Human
guuuuacugcagcuu

SEQ ID NO: 1651648 - RNA, 20 nt, Human
guuuucuuaaccagaucauu

SEQ ID NO: 1651649 - RNA, 12 nt, Human
guuuucuguucu

SEQ ID NO: 1651650 - RNA, 11 nt, Human
guuuucuguuc

SEQ ID NO: 1651651 - RNA, 23 nt, Human
guuuucugagaaagacuauucaa

SEQ ID NO: 1651652 - RNA, 19 nt, Human
aagggccuggccugagcug

SEQ ID NO: 1651653 - RNA, 14 nt, Human
aagggccuggccug

SEQ ID NO: 1651654 - RNA, 17 nt, Human
aagggccuggccugagc

SEQ ID NO: 1651655 - RNA, 22 nt, Human
aaggggaauguuugccucugcc

SEQ ID NO: 1651656 - RNA, 23 nt, Human
aaggggaauguuugccucugccu

SEQ ID NO: 1651657 - RNA, 21 nt, Human
guuucaaacauauauaacaau

SEQ ID NO: 1651658 - RNA, 13 nt, Human
aaguaaaaacaaa

SEQ ID NO: 1651659 - RNA, 20 nt, Human
aaguaaaaacaaagaaauua

SEQ ID NO: 1651660 - RNA, 22 nt, Human
aaguaaaaacaaagaaauuaug

SEQ ID NO: 1651661 - RNA, 12 nt, Human
aaguaauaugca

SEQ ID NO: 1651662 - RNA, 19 nt, Human
guuucuaaaggcuaccuuu

SEQ ID NO: 1651663 - RNA, 16 nt, Human
aaguaauaugcacaca

SEQ ID NO: 1651664 - RNA, 15 nt, Human
aaguaauaugcacac

SEQ ID NO: 1651665 - RNA, 17 nt, Human
aaggguaucaggugcug

SEQ ID NO: 1651666 - RNA, 16 nt, Human
aaggguaucaggugcu

SEQ ID NO: 1651667 - RNA, 13 nt, Human
aagguacuucaaa

SEQ ID NO: 1651668 - RNA, 15 nt, Human
guugccuaaauccau

SEQ ID NO: 1651669 - RNA, 16 nt, Human
guugccuaaauccauu

SEQ ID NO: 1651670 - RNA, 14 nt, Human
guugccuaaaucca

SEQ ID NO: 1651671 - RNA, 21 nt, Human
guugcccaggcuggcgugcag

SEQ ID NO: 1651672 - RNA, 14 nt, Human
aaggcuccaggagc

SEQ ID NO: 1651673 - RNA, 17 nt, Human
guugcccaggcaggucu

SEQ ID NO: 1651674 - RNA, 18 nt, Human
guugcccaggcaggucuu

SEQ ID NO: 1651675 - RNA, 19 nt, Human
guugcccaggcaggucuug

SEQ ID NO: 1651676 - RNA, 18 nt, Human
aaggccaaaggaagcaca

SEQ ID NO: 1651677 - RNA, 19 nt, Human
aaggcuaccuuuguauucu

SEQ ID NO: 1651678 - RNA, 19 nt, Human
aaggaugccccgucccccu

SEQ ID NO: 1651679 - RNA, 19 nt, Human
aaggaugcuuguacauaau

SEQ ID NO: 1651680 - RNA, 17 nt, Human
aaggaugcuuguacaua

SEQ ID NO: 1651681 - RNA, 16 nt, Human
aaggaugcuuguacau

SEQ ID NO: 1651682 - RNA, 15 nt, Human
aaggaugcuuguaca

SEQ ID NO: 1651683 - RNA, 18 nt, Human
aaggaugcacagaguugu

SEQ ID NO: 1651684 - RNA, 22 nt, Human
aaggaugcacagaguuguuaca

SEQ ID NO: 1651685 - RNA, 20 nt, Human
aaggauccugagccagauuu

SEQ ID NO: 1651686 - RNA, 21 nt, Human
guugaugccugugaacugaac

SEQ ID NO: 1651687 - RNA, 23 nt, Human
guugaugaucuuugcagacaggc

SEQ ID NO: 1651688 - RNA, 14 nt, Human
aaggauccugagcc

SEQ ID NO: 1651689 - RNA, 15 nt, Human
aaggauccugagcca

SEQ ID NO: 1651690 - RNA, 17 nt, Human
aaggauccugagccaga

SEQ ID NO: 1651691 - RNA, 18 nt, Human
aaggaugaucuaggaaga

SEQ ID NO: 1651692 - RNA, 23 nt, Human
aaggaugaucuaggaagacuuug

SEQ ID NO: 1651693 - RNA, 20 nt, Human
guuuaagacauuuuuggaag

SEQ ID NO: 1651694 - RNA, 21 nt, Human
guuuaacaaaauguaugugag

SEQ ID NO: 1651695 - RNA, 10 nt, Human
guuuaaaauc

SEQ ID NO: 1651696 - RNA, 16 nt, Human
guuuaaaaucauuucu

SEQ ID NO: 1651697 - RNA, 17 nt, Human
guugccuaaauccauuu

SEQ ID NO: 1651698 - RNA, 13 nt, Human
guuggguggaugc

SEQ ID NO: 1651699 - RNA, 18 nt, Human
guuggucccccuuccaug

SEQ ID NO: 1651700 - RNA, 18 nt, Human
guuguaccgcaaugugac

SEQ ID NO: 1651701 - RNA, 17 nt, Human
aagcuaucguaaaauua

SEQ ID NO: 1651702 - RNA, 22 nt, Human
aagcuauucaguaauaacucua

SEQ ID NO: 1651703 - RNA, 21 nt, Human
aagcucuacugaggugcuaug

SEQ ID NO: 1651704 - RNA, 20 nt, Human
guucccuacuuccugugacu

SEQ ID NO: 1651705 - RNA, 16 nt, Human
guucccauuugcuccu

SEQ ID NO: 1651706 - RNA, 20 nt, Human
guucccauuugcuccuuucu

SEQ ID NO: 1651707 - RNA, 20 nt, Human
guuccauggccucuucagau

SEQ ID NO: 1651708 - RNA, 13 nt, Human
guugacaugggac

SEQ ID NO: 1651709 - RNA, 17 nt, Human
guucuuguauuaagaau

SEQ ID NO: 1651710 - RNA, 18 nt, Human
guucuuguauuaagaaug

SEQ ID NO: 1651711 - RNA, 21 nt, Human
guucuuguauuaagaaugaaa

SEQ ID NO: 1651712 - RNA, 17 nt, Human
guucuuaguuugcaguu

SEQ ID NO: 1651713 - RNA, 21 nt, Human
guucuugguuuguaaauuaac

SEQ ID NO: 1651714 - RNA, 22 nt, Human
guugaugaucuuugcagacagg

SEQ ID NO: 1651715 - RNA, 14 nt, Human
guugacaugggaca

SEQ ID NO: 1651716 - RNA, 18 nt, Human
guugacaugggacauuug

SEQ ID NO: 1651717 - RNA, 13 nt, Human
guucucuccuucu

SEQ ID NO: 1651718 - RNA, 15 nt, Human
guucuggugugaacu

SEQ ID NO: 1651719 - RNA, 18 nt, Human
guucuggugugaacuaaa

SEQ ID NO: 1651720 - RNA, 20 nt, Human
guucccuuugacgccauccc

SEQ ID NO: 1651721 - RNA, 21 nt, Human
guucccuuugacgccauccca

SEQ ID NO: 1651722 - RNA, 22 nt, Human
guucccuuugacgccaucccag

SEQ ID NO: 1651723 - RNA, 16 nt, Human
guucuacccaggugcu

SEQ ID NO: 1651724 - RNA, 12 nt, Human
guuagaucuagu

SEQ ID NO: 1651725 - RNA, 17 nt, Human
guuaguaugaggcauuu

SEQ ID NO: 1651726 - RNA, 20 nt, Human
guuaguaugaggcauuuguu

SEQ ID NO: 1651727 - RNA, 12 nt, Human
guuaagccuuug

SEQ ID NO: 1651728 - RNA, 13 nt, Human
guuaagccuuugg

SEQ ID NO: 1651729 - RNA, 16 nt, Human
guuaagccuuuggaaa

SEQ ID NO: 1651730 - RNA, 18 nt, Human
guguuuuaaaaugagaaa

SEQ ID NO: 1651731 - RNA, 18 nt, Human
guuaaugauagcuacugu

SEQ ID NO: 1651732 - RNA, 22 nt, Human
guuaaguugauggugaugaaau

SEQ ID NO: 1651733 - RNA, 15 nt, Human
guuaagucuguuuua

SEQ ID NO: 1651734 - RNA, 22 nt, Human
guuaagucuguuuuaugacuuc

SEQ ID NO: 1651735 - RNA, 13 nt, Human
guuaagucuguuu

SEQ ID NO: 1651736 - RNA, 18 nt, Human
guucagcuccagcucacc

SEQ ID NO: 1651737 - RNA, 16 nt, Human
guucagcuccagcuca

SEQ ID NO: 1651738 - RNA, 17 nt, Human
guucagcuccagcucac

SEQ ID NO: 1651739 - RNA, 20 nt, Human
guuauuuauaaucacuuuuu

SEQ ID NO: 1651740 - RNA, 14 nt, Human
guuauuuauaauca

SEQ ID NO: 1651741 - RNA, 17 nt, Human
guucaggguuggccccu

SEQ ID NO: 1651742 - RNA, 18 nt, Human
guucaggguuggccccug

SEQ ID NO: 1651743 - RNA, 19 nt, Human
guucaggguuggccccugc

SEQ ID NO: 1651744 - RNA, 17 nt, Human
aagcuaggccuggccag

SEQ ID NO: 1651745 - RNA, 18 nt, Human
aagcuaggccuggccaga

SEQ ID NO: 1651746 - RNA, 22 nt, Human
aagcuaggccuggccagaugca

SEQ ID NO: 1651747 - RNA, 21 nt, Human
aacagaaauguacagcaagga

SEQ ID NO: 1651748 - RNA, 11 nt, Human
aacagaaaugu

SEQ ID NO: 1651749 - RNA, 10 nt, Human
aacagaaaug

SEQ ID NO: 1651750 - RNA, 15 nt, Human
gucccaacuuguaaa

SEQ ID NO: 1651751 - RNA, 13 nt, Human
guccgagcuuuga

SEQ ID NO: 1651752 - RNA, 21 nt, Human
guccggucccugucccagugc

SEQ ID NO: 1651753 - RNA, 19 nt, Human
aacaguuguguuugaagca

SEQ ID NO: 1651754 - RNA, 19 nt, Human
aacagacuggaagcacagc

SEQ ID NO: 1651755 - RNA, 20 nt, Human
aacagacuggaagcacagcu

SEQ ID NO: 1651756 - RNA, 22 nt, Human
aacaggcugggcuucaguggca

SEQ ID NO: 1651757 - RNA, 13 nt, Human
aacaggcugggcu

SEQ ID NO: 1651758 - RNA, 23 nt, Human
aacaggcugggcuucaguggcag

SEQ ID NO: 1651759 - RNA, 22 nt, Human
aacaguagugauaguuguaccg

SEQ ID NO: 1651760 - RNA, 22 nt, Human
aacauuuguucuauagcuuuuc

SEQ ID NO: 1651761 - RNA, 14 nt, Human
aacauacucccauc

SEQ ID NO: 1651762 - RNA, 15 nt, Human
aacauacucccaucu

SEQ ID NO: 1651763 - RNA, 20 nt, Human
aacauuuguucuauagcuuu

SEQ ID NO: 1651764 - RNA, 18 nt, Human
aacauuugguaaggggaa

SEQ ID NO: 1651765 - RNA, 15 nt, Human
aacacuguucucugc

SEQ ID NO: 1651766 - RNA, 20 nt, Human
aacacuguucucugcccucc

SEQ ID NO: 1651767 - RNA, 14 nt, Human
aacacucugagacu

SEQ ID NO: 1651768 - RNA, 12 nt, Human
aacacucugaga

SEQ ID NO: 1651769 - RNA, 13 nt, Human
aacacucugagac

SEQ ID NO: 1651770 - RNA, 21 nt, Human
aacacucauugaccugaggcc

SEQ ID NO: 1651771 - RNA, 17 nt, Human
aacacuccaauuaagga

SEQ ID NO: 1651772 - RNA, 12 nt, Human
aacacuccuuca

SEQ ID NO: 1651773 - RNA, 11 nt, Human
aacacucugag

SEQ ID NO: 1651774 - RNA, 15 nt, Human
guccacaacacacag

SEQ ID NO: 1651775 - RNA, 21 nt, Human
guccaagcauuuagauguaua

SEQ ID NO: 1651776 - RNA, 11 nt, Human
aacacuuccau

SEQ ID NO: 1651777 - RNA, 21 nt, Human
gucauuugagcagggcucagc

SEQ ID NO: 1651778 - RNA, 21 nt, Human
aacacuguucucugcccucca

SEQ ID NO: 1651779 - RNA, 22 nt, Human
gucauuugagcagggcucagcg

SEQ ID NO: 1651780 - RNA, 24 nt, Human
guccaagcauaccaacacgagcag

SEQ ID NO: 1651781 - RNA, 23 nt, Human
aaauuuuuaaucuuuaauuuuac

SEQ ID NO: 1651782 - RNA, 21 nt, Human
gucacacaguauuacuucugc

SEQ ID NO: 1651783 - RNA, 16 nt, Human
gucacaggcaggucca

SEQ ID NO: 1651784 - RNA, 13 nt, Human
gucacaggcaggu

SEQ ID NO: 1651785 - RNA, 15 nt, Human
gucacaggcaggucc

SEQ ID NO: 1651786 - RNA, 20 nt, Human
aacaagaccacguuucuaaa

SEQ ID NO: 1651787 - RNA, 19 nt, Human
aacaagaccacguuucuaa

SEQ ID NO: 1651788 - RNA, 17 nt, Human
aacaagaccacguuucu

SEQ ID NO: 1651789 - RNA, 16 nt, Human
aacaagaccacguuuc

SEQ ID NO: 1651790 - RNA, 15 nt, Human
aacaaggcaaggcug

SEQ ID NO: 1651791 - RNA, 15 nt, Human
aacaaggaugaauua

SEQ ID NO: 1651792 - RNA, 21 nt, Human
aacaagccuccuuuuaaagua

SEQ ID NO: 1651793 - RNA, 23 nt, Human
aacaaggcaaggcugucaauuac

SEQ ID NO: 1651794 - RNA, 15 nt, Human
aacaagucagucauu

SEQ ID NO: 1651795 - RNA, 18 nt, Human
aacaagucagucauucag

SEQ ID NO: 1651796 - RNA, 22 nt, Human
aacguggcugcuucaaggaucc

SEQ ID NO: 1651797 - RNA, 16 nt, Human
aacguggcugcuucaa

SEQ ID NO: 1651798 - RNA, 19 nt, Human
aacguggcugcuucaagga

SEQ ID NO: 1651799 - RNA, 15 nt, Human
aaccugcucuccucu

SEQ ID NO: 1651800 - RNA, 11 nt, Human
aaccugcucuc

SEQ ID NO: 1651801 - RNA, 20 nt, Human
aaccugcucuccucuugcca

SEQ ID NO: 1651802 - RNA, 15 nt, Human
aacguggcugcuuca

SEQ ID NO: 1651803 - RNA, 13 nt, Human
aacuaaacuuuca

SEQ ID NO: 1651804 - RNA, 15 nt, Human
aacuaaacuuucaca

SEQ ID NO: 1651805 - RNA, 17 nt, Human
aacuaaacuuucacacc

SEQ ID NO: 1651806 - RNA, 14 nt, Human
aacuccagaaagug

SEQ ID NO: 1651807 - RNA, 13 nt, Human
aacucccugcccc

SEQ ID NO: 1651808 - RNA, 19 nt, Human
aacucccugccccccagcc

SEQ ID NO: 1651809 - RNA, 21 nt, Human
aacuccagaaagugacaagcu

SEQ ID NO: 1651810 - RNA, 15 nt, Human
gugaacacaucagcu

SEQ ID NO: 1651811 - RNA, 19 nt, Human
gugaaccaccacacccagc

SEQ ID NO: 1651812 - RNA, 18 nt, Human
aacucguuaauuuguagu

SEQ ID NO: 1651813 - RNA, 13 nt, Human
aacucccuuucaa

SEQ ID NO: 1651814 - RNA, 14 nt, Human
aacucccuuucaac

SEQ ID NO: 1651815 - RNA, 24 nt, Human
gucuuuucuugcaugaggcuagug

SEQ ID NO: 1651816 - RNA, 14 nt, Human
gucuuuucuugcau

SEQ ID NO: 1651817 - RNA, 19 nt, Human
gucuuuucuugcaugaggc

SEQ ID NO: 1651818 - RNA, 18 nt, Human
gucuuuggacccugaggc

SEQ ID NO: 1651819 - RNA, 17 nt, Human
gucuuuggacccugagg

SEQ ID NO: 1651820 - RNA, 14 nt, Human
gucuuuggacccug

SEQ ID NO: 1651821 - RNA, 15 nt, Human
gucuuuggacccuga

SEQ ID NO: 1651822 - RNA, 15 nt, Human
gucuuagauguauau

SEQ ID NO: 1651823 - RNA, 19 nt, Human
gucuuauauauuguagaua

SEQ ID NO: 1651824 - RNA, 15 nt, Human
gucuggcuucacaga

SEQ ID NO: 1651825 - RNA, 22 nt, Human
gucuuaauuaaaagaauauuuu

SEQ ID NO: 1651826 - RNA, 19 nt, Human
gucuuaauuaaaagaauau

SEQ ID NO: 1651827 - RNA, 21 nt, Human
gucuuaauuaaaagaauauuu

SEQ ID NO: 1651828 - RNA, 16 nt, Human
gucucccucccuuggg

SEQ ID NO: 1651829 - RNA, 15 nt, Human
aaccaugggauaaau

SEQ ID NO: 1651830 - RNA, 17 nt, Human
aaccaugggauaaaugc

SEQ ID NO: 1651831 - RNA, 18 nt, Human
aaccaugggauaaaugcc

SEQ ID NO: 1651832 - RNA, 20 nt, Human
aaccaugggauaaaugccau

SEQ ID NO: 1651833 - RNA, 23 nt, Human
aaccaucauugaaaucuuuuugc

SEQ ID NO: 1651834 - RNA, 21 nt, Human
aaccaucauugaaaucuuuuu

SEQ ID NO: 1651835 - RNA, 20 nt, Human
aaccacaucuugcucugcug

SEQ ID NO: 1651836 - RNA, 22 nt, Human
aaccacaucuugcucugcugac

SEQ ID NO: 1651837 - RNA, 19 nt, Human
aaccaucauugaaaucuuu

SEQ ID NO: 1651838 - RNA, 20 nt, Human
aaccaucauugaaaucuuuu

SEQ ID NO: 1651839 - RNA, 12 nt, Human
aaccacagcagu

SEQ ID NO: 1651840 - RNA, 17 nt, Human
aacccagcucuggucca

SEQ ID NO: 1651841 - RNA, 20 nt, Human
aacccauauuuguacaccaa

SEQ ID NO: 1651842 - RNA, 21 nt, Human
aaccaugggauaaaugccauc

SEQ ID NO: 1651843 - RNA, 13 nt, Human
aacccaaauguuc

SEQ ID NO: 1651844 - RNA, 13 nt, Human
aacccagcucugg

SEQ ID NO: 1651845 - RNA, 14 nt, Human
aacccagcucuggu

SEQ ID NO: 1651846 - RNA, 11 nt, Human
aacccagcucu

SEQ ID NO: 1651847 - RNA, 18 nt, Human
aacccaaauguucaucaa

SEQ ID NO: 1651848 - RNA, 17 nt, Human
aaccuccgccucuuggg

SEQ ID NO: 1651849 - RNA, 14 nt, Human
aaccuccugggcua

SEQ ID NO: 1651850 - RNA, 13 nt, Human
aacccccagccug

SEQ ID NO: 1651851 - RNA, 14 nt, Human
aacccccagccugc

SEQ ID NO: 1651852 - RNA, 15 nt, Human
aacccccagccugcu

SEQ ID NO: 1651853 - RNA, 20 nt, Human
aaccuagggugauauuaacc

SEQ ID NO: 1651854 - RNA, 15 nt, Human
aaauccauuuggaaa

SEQ ID NO: 1651855 - RNA, 16 nt, Human
aaauccauuuggaaau

SEQ ID NO: 1651856 - RNA, 14 nt, Human
aaauccauuuggaa

SEQ ID NO: 1651857 - RNA, 15 nt, Human
guaggaagacuuugg

SEQ ID NO: 1651858 - RNA, 18 nt, Human
guaggaagguuaauguuc

SEQ ID NO: 1651859 - RNA, 17 nt, Human
aaaggagagcuagcagc

SEQ ID NO: 1651860 - RNA, 14 nt, Human
aaaggaugcacaga

SEQ ID NO: 1651861 - RNA, 12 nt, Human
guagcugggacu

SEQ ID NO: 1651862 - RNA, 18 nt, Human
guagcugggacuacaggc

SEQ ID NO: 1651863 - RNA, 19 nt, Human
guagcugggacuacaggca

SEQ ID NO: 1651864 - RNA, 18 nt, Human
guagcugggauuacaggc

SEQ ID NO: 1651865 - RNA, 21 nt, Human
guagcugggacuacaggcacc

SEQ ID NO: 1651866 - RNA, 18 nt, Human
aaauccauuuggaaaucu

SEQ ID NO: 1651867 - RNA, 21 nt, Human
aaauccauuuggaaaucuuua

SEQ ID NO: 1651868 - RNA, 22 nt, Human
aaauccauuuggaaaucuuuaa

SEQ ID NO: 1651869 - RNA, 23 nt, Human
aaauccauuuggaaaucuuuaaa

SEQ ID NO: 1651870 - RNA, 13 nt, Human
aaaucccauuauu

SEQ ID NO: 1651871 - RNA, 15 nt, Human
aaaucccauuauuca

SEQ ID NO: 1651872 - RNA, 16 nt, Human
aaaucccauuauucaa

SEQ ID NO: 1651873 - RNA, 17 nt, Human
aaaucccauuauucaaa

SEQ ID NO: 1651874 - RNA, 19 nt, Human
aaaucccauuauucaaagu

SEQ ID NO: 1651875 - RNA, 20 nt, Human
aaaucccauuauucaaaguu

SEQ ID NO: 1651876 - RNA, 21 nt, Human
aaaucccauuauucaaaguug

SEQ ID NO: 1651877 - RNA, 22 nt, Human
aaaucccauuauucaaaguugc

SEQ ID NO: 1651878 - RNA, 15 nt, Human
aaaucccauuuaaaa

SEQ ID NO: 1651879 - RNA, 18 nt, Human
aaaucccuuaccucggug

SEQ ID NO: 1651880 - RNA, 13 nt, Human
aaaucgaugcagu

SEQ ID NO: 1651881 - RNA, 14 nt, Human
aaauccuugaagau

SEQ ID NO: 1651882 - RNA, 19 nt, Human
aaaucucaaauuucuaaau

SEQ ID NO: 1651883 - RNA, 17 nt, Human
aaaucucaaauuucuaa

SEQ ID NO: 1651884 - RNA, 16 nt, Human
aaaucucaaauuucua

SEQ ID NO: 1651885 - RNA, 15 nt, Human
aaaucucaaauuucu

SEQ ID NO: 1651886 - RNA, 11 nt, Human
aaaugaaaauu

SEQ ID NO: 1651887 - RNA, 17 nt, Human
aaaugaaaaucgugaca

SEQ ID NO: 1651888 - RNA, 19 nt, Human
aaaucuacacuccagugag

SEQ ID NO: 1651889 - RNA, 13 nt, Human
aaaucgcuuuuga

SEQ ID NO: 1651890 - RNA, 14 nt, Human
aaaucgcuuuugau

SEQ ID NO: 1651891 - RNA, 15 nt, Human
aaaucgcuuuugaua

SEQ ID NO: 1651892 - RNA, 13 nt, Human
aaaugagaaaucu

SEQ ID NO: 1651893 - RNA, 14 nt, Human
aaaugagaaaucua

SEQ ID NO: 1651894 - RNA, 16 nt, Human
aaaugagaaaucuaaa

SEQ ID NO: 1651895 - RNA, 13 nt, Human
aaaugagccuggc

SEQ ID NO: 1651896 - RNA, 19 nt, Human
aaaugagccuggcaagaau

SEQ ID NO: 1651897 - RNA, 16 nt, Human
aaaugagguacucucc

SEQ ID NO: 1651898 - RNA, 23 nt, Human
aaaugagguacucuccuggaaau

SEQ ID NO: 1651899 - RNA, 17 nt, Human
aaaugaggucagagccu

SEQ ID NO: 1651900 - RNA, 19 nt, Human
aaaugaggucagagccugc

SEQ ID NO: 1651901 - RNA, 11 nt, Human
aaaugagaaau

SEQ ID NO: 1651902 - RNA, 21 nt, Human
aaaugaaagcagggacuugaa

SEQ ID NO: 1651903 - RNA, 22 nt, Human
aaaugaaagcagggacuugaac

SEQ ID NO: 1651904 - RNA, 13 nt, Human
aaaugcauguugc

SEQ ID NO: 1651905 - RNA, 22 nt, Human
aaaugcaccuggaauauauaac

SEQ ID NO: 1651906 - RNA, 18 nt, Human
aaaugcaccuggaauaua

SEQ ID NO: 1651907 - RNA, 14 nt, Human
aaaugcaaugugaa

SEQ ID NO: 1651908 - RNA, 14 nt, Human
aaaugcaccuggaa

SEQ ID NO: 1651909 - RNA, 15 nt, Human
aaaugggcagagcag

SEQ ID NO: 1651910 - RNA, 18 nt, Human
aaaugggcagagcagaga

SEQ ID NO: 1651911 - RNA, 20 nt, Human
aaaugggcagagcagagacc

SEQ ID NO: 1651912 - RNA, 23 nt, Human
aaaugccuuacccucauguucuu

SEQ ID NO: 1651913 - RNA, 19 nt, Human
aaauggcuuccuggcaaua

SEQ ID NO: 1651914 - RNA, 14 nt, Human
aaaugcccagcccc

SEQ ID NO: 1651915 - RNA, 15 nt, Human
aaaugcccagccccu

SEQ ID NO: 1651916 - RNA, 18 nt, Human
aaaugcccagccccuucu

SEQ ID NO: 1651917 - RNA, 13 nt, Human
aaaugcccagcuu

SEQ ID NO: 1651918 - RNA, 13 nt, Human
aaaugcccagccc

SEQ ID NO: 1651919 - RNA, 14 nt, Human
aaaugcauuucuaa

SEQ ID NO: 1651920 - RNA, 16 nt, Human
guaugggacuggccuc

SEQ ID NO: 1651921 - RNA, 15 nt, Human
guaugggagagaaga

SEQ ID NO: 1651922 - RNA, 13 nt, Human
guaugguggcugg

SEQ ID NO: 1651923 - RNA, 13 nt, Human
guaugugugaagu

SEQ ID NO: 1651924 - RNA, 15 nt, Human
guauguggcaaaaug

SEQ ID NO: 1651925 - RNA, 17 nt, Human
guaugugugaagugagu

SEQ ID NO: 1651926 - RNA, 21 nt, Human
guaugugugaagugagugagu

SEQ ID NO: 1651927 - RNA, 15 nt, Human
guauucuuauuuaau

SEQ ID NO: 1651928 - RNA, 15 nt, Human
guaucccuacuguaa

SEQ ID NO: 1651929 - RNA, 14 nt, Human
guaugggagagaag

SEQ ID NO: 1651930 - RNA, 14 nt, Human
guaugauucccagc

SEQ ID NO: 1651931 - RNA, 18 nt, Human
guauaaaagccuguuuaa

SEQ ID NO: 1651932 - RNA, 21 nt, Human
guauaaaagccuguuuaagag

SEQ ID NO: 1651933 - RNA, 18 nt, Human
guauaaaagggacugaga

SEQ ID NO: 1651934 - RNA, 22 nt, Human
guauauugauccagaaagaaaa

SEQ ID NO: 1651935 - RNA, 17 nt, Human
guauaaaagccuguuua

SEQ ID NO: 1651936 - RNA, 16 nt, Human
aaaugggggugcauuu

SEQ ID NO: 1651937 - RNA, 15 nt, Human
aaaugggggugcauu

SEQ ID NO: 1651938 - RNA, 18 nt, Human
aaaugggggugcauuuga

SEQ ID NO: 1651939 - RNA, 17 nt, Human
aaaugggggugcauuug

SEQ ID NO: 1651940 - RNA, 19 nt, Human
aaaugggggugcauuugag

SEQ ID NO: 1651941 - RNA, 22 nt, Human
aaauguaagggaaacugccagc

SEQ ID NO: 1651942 - RNA, 19 nt, Human
gucaaaguggugagaggca

SEQ ID NO: 1651943 - RNA, 18 nt, Human
gucaaaguggugagaggc

SEQ ID NO: 1651944 - RNA, 21 nt, Human
guauuuuuuuacuaauagaca

SEQ ID NO: 1651945 - RNA, 17 nt, Human
guauuuuuuuacuaaua

SEQ ID NO: 1651946 - RNA, 19 nt, Human
gucaacucauauuuucaug

SEQ ID NO: 1651947 - RNA, 16 nt, Human
gucacacacuuuggcu

SEQ ID NO: 1651948 - RNA, 20 nt, Human
gucacacaguauuacuucug

SEQ ID NO: 1651949 - RNA, 16 nt, Human
gucaaauugugugaaa

SEQ ID NO: 1651950 - RNA, 20 nt, Human
aaauuuaguauuuuguuuca

SEQ ID NO: 1651951 - RNA, 18 nt, Human
aaauuucagcagcugcag

SEQ ID NO: 1651952 - RNA, 17 nt, Human
aaauuucagcagcugca

SEQ ID NO: 1651953 - RNA, 15 nt, Human
guauuuuuuuacuaa

SEQ ID NO: 1651954 - RNA, 14 nt, Human
guauuuuuuuacua

SEQ ID NO: 1651955 - RNA, 22 nt, Human
aaauuuccugggagcuuuugua

SEQ ID NO: 1651956 - RNA, 12 nt, Human
aaauuucuaaau

SEQ ID NO: 1651957 - RNA, 16 nt, Human
guauuuaauucauguu

SEQ ID NO: 1651958 - RNA, 20 nt, Human
guauuuaauagguuuggaca

SEQ ID NO: 1651959 - RNA, 22 nt, Human
guauuggcuagagguucaaaga

SEQ ID NO: 1651960 - RNA, 20 nt, Human
aaauguuaaguugaugguga

SEQ ID NO: 1651961 - RNA, 21 nt, Human
aaauuaacuuuuauaaacuuu

SEQ ID NO: 1651962 - RNA, 23 nt, Human
aaauuaacuuuuauaaacuuuac

SEQ ID NO: 1651963 - RNA, 22 nt, Human
aaauuaacuuuuauaaacuuua

SEQ ID NO: 1651964 - RNA, 14 nt, Human
aaauucaugcugcu

SEQ ID NO: 1651965 - RNA, 18 nt, Human
aaauucccuggccuuuca

SEQ ID NO: 1651966 - RNA, 15 nt, Human
aaauucccuggccuu

SEQ ID NO: 1651967 - RNA, 14 nt, Human
aaaaguuuaauauu

SEQ ID NO: 1651968 - RNA, 16 nt, Human
aaaaguuuaauauuaa

SEQ ID NO: 1651969 - RNA, 18 nt, Human
aaaaguugaauuuuacau

SEQ ID NO: 1651970 - RNA, 20 nt, Human
aaaaguuuaauauuaaagcc

SEQ ID NO: 1651971 - RNA, 18 nt, Human
aaaaguuuaauauuaaag

SEQ ID NO: 1651972 - RNA, 14 nt, Human
aaaauaaaacuuuu

SEQ ID NO: 1651973 - RNA, 16 nt, Human
aaaauaaaacuuuuua

SEQ ID NO: 1651974 - RNA, 13 nt, Human
aaaaucagccugc

SEQ ID NO: 1651975 - RNA, 17 nt, Human
aaaaucagccugcucca

SEQ ID NO: 1651976 - RNA, 21 nt, Human
aaaaucagccugcuccagcug

SEQ ID NO: 1651977 - RNA, 10 nt, Human
aaaaucauuu

SEQ ID NO: 1651978 - RNA, 11 nt, Human
aaaaucauuuc

SEQ ID NO: 1651979 - RNA, 12 nt, Human
aaaaucauuucu

SEQ ID NO: 1651980 - RNA, 11 nt, Human
aaaagaaaaag

SEQ ID NO: 1651981 - RNA, 19 nt, Human
aaaacacuguucucugccc

SEQ ID NO: 1651982 - RNA, 17 nt, Human
aaaacacauuuuucuua

SEQ ID NO: 1651983 - RNA, 16 nt, Human
aaaagaaaagucaagg

SEQ ID NO: 1651984 - RNA, 17 nt, Human
aaaagaaagaaaaucag

SEQ ID NO: 1651985 - RNA, 12 nt, Human
aaaagaauauuu

SEQ ID NO: 1651986 - RNA, 20 nt, Human
aaaagacaaggaaaaaauaa

SEQ ID NO: 1651987 - RNA, 13 nt, Human
aaaagaauauuuu

SEQ ID NO: 1651988 - RNA, 11 nt, Human
aaaagaaugau

SEQ ID NO: 1651989 - RNA, 13 nt, Human
aaaagacuccaaa

SEQ ID NO: 1651990 - RNA, 17 nt, Human
aaaagagguuuuucuua

SEQ ID NO: 1651991 - RNA, 21 nt, Human
aaaagagguuuuucuuaaaua

SEQ ID NO: 1651992 - RNA, 22 nt, Human
aaaagagguuuuucuuaaauaa

SEQ ID NO: 1651993 - RNA, 14 nt, Human
aaaagacugucuua

SEQ ID NO: 1651994 - RNA, 14 nt, Human
aaaccaguauugua

SEQ ID NO: 1651995 - RNA, 16 nt, Human
aaaccaguauuguaca

SEQ ID NO: 1651996 - RNA, 17 nt, Human
aaaccaguauuguacaa

SEQ ID NO: 1651997 - RNA, 18 nt, Human
aaaccaguauuguacaaa

SEQ ID NO: 1651998 - RNA, 22 nt, Human
aaaccaguauuguacaaaguau

SEQ ID NO: 1651999 - RNA, 22 nt, Human
aaaccgaacugauguaaguaaa

SEQ ID NO: 1652000 - RNA, 18 nt, Human
aaacccagcucuggucca

SEQ ID NO: 1652001 - RNA, 12 nt, Human
aaacccagcucu

SEQ ID NO: 1652002 - RNA, 16 nt, Human
aaacccagcucugguc

SEQ ID NO: 1652003 - RNA, 15 nt, Human
aaaccgccaaggcug

SEQ ID NO: 1652004 - RNA, 16 nt, Human
aaaccgccaaggcugg

SEQ ID NO: 1652005 - RNA, 12 nt, Human
aaacucuuaaaa

SEQ ID NO: 1652006 - RNA, 23 nt, Human
aaacucuuaaaacccaagugccu

SEQ ID NO: 1652007 - RNA, 23 nt, Human
aaacugauuuuuuuuuccuucag

SEQ ID NO: 1652008 - RNA, 15 nt, Human
aaacugcacugucaa

SEQ ID NO: 1652009 - RNA, 18 nt, Human
aaaaucucaaauuucuaa

SEQ ID NO: 1652010 - RNA, 16 nt, Human
aaaaucucaaauuucu

SEQ ID NO: 1652011 - RNA, 15 nt, Human
aaaaucucaaauuuc

SEQ ID NO: 1652012 - RNA, 21 nt, Human
aaaaucauuucugcaucagcu

SEQ ID NO: 1652013 - RNA, 15 nt, Human
aaagcauuguaaaug

SEQ ID NO: 1652014 - RNA, 17 nt, Human
aaagcauuguaaaugug

SEQ ID NO: 1652015 - RNA, 17 nt, Human
aaagccauguuuauuac

SEQ ID NO: 1652016 - RNA, 18 nt, Human
aaagccauguuuauuaca

SEQ ID NO: 1652017 - RNA, 23 nt, Human
aaagccauguuuauuacaguaua

SEQ ID NO: 1652018 - RNA, 14 nt, Human
aaagccauguuuau

SEQ ID NO: 1652019 - RNA, 16 nt, Human
aaagccauguuuauua

SEQ ID NO: 1652020 - RNA, 15 nt, Human
aaagaucauguaaaa

SEQ ID NO: 1652021 - RNA, 22 nt, Human
aacauggccuuugcuugaaaga

SEQ ID NO: 1652022 - RNA, 12 nt, Human
aacagccugugu

SEQ ID NO: 1652023 - RNA, 15 nt, Human
aacagccugugucuu

SEQ ID NO: 1652024 - RNA, 11 nt, Human
aacaggcagau

SEQ ID NO: 1652025 - RNA, 18 nt, Human
aaauucuugcaaaguauc

SEQ ID NO: 1652026 - RNA, 15 nt, Human
aaauucuugcaaagu

SEQ ID NO: 1652027 - RNA, 23 nt, Human
aaauucuucuccacuuucuagcc

SEQ ID NO: 1652028 - RNA, 18 nt, Human
aaccuuuguuugcaucug

SEQ ID NO: 1652029 - RNA, 16 nt, Human
aaccuuuugagugccu

SEQ ID NO: 1652030 - RNA, 23 nt, Human
aaccuuuugagugccuuacacaa

SEQ ID NO: 1652031 - RNA, 19 nt, Human
aacccucagagccaccccu

SEQ ID NO: 1652032 - RNA, 12 nt, Human
aacccucagagc

SEQ ID NO: 1652033 - RNA, 23 nt, Human
aacauggccuuugcuugaaagaa

SEQ ID NO: 1652034 - RNA, 22 nt, Human
aaauguugacaugggacauuug

SEQ ID NO: 1652035 - RNA, 17 nt, Human
aaauguucaucaaugaa

SEQ ID NO: 1652036 - RNA, 13 nt, Human
aaauguucaucaa

SEQ ID NO: 1652037 - RNA, 23 nt, Human
aaauguugacaugggacauuugc

SEQ ID NO: 1652038 - RNA, 20 nt, Human
aaaggaugcccaaagaugca

SEQ ID NO: 1652039 - RNA, 21 nt, Human
aaauauuuauuuuaauaaugu

SEQ ID NO: 1652040 - RNA, 21 nt, Human
aaauggacuguggugacuuug

SEQ ID NO: 1652041 - RNA, 20 nt, Human
aaauggacuguggugacuuu

SEQ ID NO: 1652042 - RNA, 23 nt, Human
aaauggacuguggugacuuugga

SEQ ID NO: 1652043 - RNA, 10 nt, Human
aaaugcugcu

SEQ ID NO: 1652044 - RNA, 23 nt, Human
aaaugcugcuuuuucucaaaaug

SEQ ID NO: 1652045 - RNA, 14 nt, Human
aaaugaaaaaauau

SEQ ID NO: 1652046 - RNA, 19 nt, Human
aaaugcuguaacuuucuga

SEQ ID NO: 1652047 - RNA, 19 nt, Human
aaaucuccaaaauaaaacu

SEQ ID NO: 1652048 - RNA, 13 nt, Human
aaaucuuuuugcu

SEQ ID NO: 1652049 - RNA, 14 nt, Human
aaaucuuuuugcuu

SEQ ID NO: 1652050 - RNA, 18 nt, Human
aaaucucaauauuucaga

SEQ ID NO: 1652051 - RNA, 10 nt, Human
aagccuuugu

SEQ ID NO: 1652052 - RNA, 13 nt, Human
aagcuacuuauug

SEQ ID NO: 1652053 - RNA, 16 nt, Human
aagcgugagccacugc

SEQ ID NO: 1652054 - RNA, 15 nt, Human
aagcgugagccacug

SEQ ID NO: 1652055 - RNA, 14 nt, Human
aagcggcuggcagc

SEQ ID NO: 1652056 - RNA, 18 nt, Human
aagccauaauuguucuua

SEQ ID NO: 1652057 - RNA, 19 nt, Human
aagauaauauuaaggaaga

SEQ ID NO: 1652058 - RNA, 21 nt, Human
aagauaauauuaaggaagaca

SEQ ID NO: 1652059 - RNA, 23 nt, Human
aagauacaguuacucagaauucu

SEQ ID NO: 1652060 - RNA, 17 nt, Human
aagauacaguuacucag

SEQ ID NO: 1652061 - RNA, 19 nt, Human
aaggcagggagggccuggg

SEQ ID NO: 1652062 - RNA, 22 nt, Human
aaggcagggagggccugggccc

SEQ ID NO: 1652063 - RNA, 16 nt, Human
aaggcaaggcugucaa

SEQ ID NO: 1652064 - RNA, 15 nt, Human
aaggcaaggcuguca

SEQ ID NO: 1652065 - RNA, 23 nt, Human
aaggacuuguuagaucuaguuca

SEQ ID NO: 1652066 - RNA, 13 nt, Human
aaggcaaggcugu

SEQ ID NO: 1652067 - RNA, 22 nt, Human
aagcuagacgagcaggcuucuu

SEQ ID NO: 1652068 - RNA, 15 nt, Human
aaggacuuguuagau

SEQ ID NO: 1652069 - RNA, 21 nt, Human
aaggacuuguuagaucuaguu

SEQ ID NO: 1652070 - RNA, 23 nt, Human
aaggacuucuuuaauuuuggaau

SEQ ID NO: 1652071 - RNA, 13 nt, Human
aagcugcacccuc

SEQ ID NO: 1652072 - RNA, 19 nt, Human
aagcugcacccucaggcag

SEQ ID NO: 1652073 - RNA, 12 nt, Human
aagaguguggca

SEQ ID NO: 1652074 - RNA, 14 nt, Human
aagaacuagcauaa

SEQ ID NO: 1652075 - RNA, 12 nt, Human
aacgcagcccug

SEQ ID NO: 1652076 - RNA, 16 nt, Human
aacgcagcccugcuuu

SEQ ID NO: 1652077 - RNA, 20 nt, Human
aacgcaggcccccaggugcc

SEQ ID NO: 1652078 - RNA, 11 nt, Human
aagaacugaaa

SEQ ID NO: 1652079 - RNA, 12 nt, Human
aagaacugaaau

SEQ ID NO: 1652080 - RNA, 13 nt, Human
aagaacugaaauc

SEQ ID NO: 1652081 - RNA, 15 nt, Human
aagaacugaaaucau

SEQ ID NO: 1652082 - RNA, 22 nt, Human
aagacaaugacuuacuguacau

SEQ ID NO: 1652083 - RNA, 19 nt, Human
aagacaaugugaaaagaaa

SEQ ID NO: 1652084 - RNA, 20 nt, Human
aagacaaugugaaaagaaaa

SEQ ID NO: 1652085 - RNA, 21 nt, Human
aagacaaggaaaaaauaacaa

SEQ ID NO: 1652086 - RNA, 20 nt, Human
aagaagacugcauuauauuu

SEQ ID NO: 1652087 - RNA, 15 nt, Human
aagaagacugcauua

SEQ ID NO: 1652088 - RNA, 23 nt, Human
aagacagauacuccuccaagguu

SEQ ID NO: 1652089 - RNA, 17 nt, Human
aagaccacguuucuaaa

SEQ ID NO: 1652090 - RNA, 15 nt, Human
aagaccacguuucua

SEQ ID NO: 1652091 - RNA, 21 nt, Human
aagacuuuuccaacccucauc

SEQ ID NO: 1652092 - RNA, 12 nt, Human
aagacuuuucuu

SEQ ID NO: 1652093 - RNA, 19 nt, Human
aagacuuuucuuucagcca

SEQ ID NO: 1652094 - RNA, 13 nt, Human
aagagaaaaaaua

SEQ ID NO: 1652095 - RNA, 19 nt, Human
aauaaacacucuugaaaaa

SEQ ID NO: 1652096 - RNA, 17 nt, Human
aaguuuaauauuaaagc

SEQ ID NO: 1652097 - RNA, 18 nt, Human
aaguuuaauauuaaagcc

SEQ ID NO: 1652098 - RNA, 15 nt, Human
aaguuuaauauuaaa

SEQ ID NO: 1652099 - RNA, 11 nt, Human
aauaaacacuc

SEQ ID NO: 1652100 - RNA, 16 nt, Human
aauaaacacucuugaa

SEQ ID NO: 1652101 - RNA, 23 nt, Human
aaguugaauuuauuggcuuuucu

SEQ ID NO: 1652102 - RNA, 24 nt, Human
aaguugaauuuauuggcuuuucug

SEQ ID NO: 1652103 - RNA, 22 nt, Human
aaguuguaggcauaaagucagg

SEQ ID NO: 1652104 - RNA, 21 nt, Human
aaguuguuugagaaauuaagu

SEQ ID NO: 1652105 - RNA, 22 nt, Human
aaguuguuugagaaauuaagua

SEQ ID NO: 1652106 - RNA, 22 nt, Human
aagugcugcauuuaaaagauac

SEQ ID NO: 1652107 - RNA, 14 nt, Human
aaguugaauuuauu

SEQ ID NO: 1652108 - RNA, 15 nt, Human
aaguugaauuuauug

SEQ ID NO: 1652109 - RNA, 17 nt, Human
aaguugaauuuauuggc

SEQ ID NO: 1652110 - RNA, 22 nt, Human
aagugcugggauuacaggugug

SEQ ID NO: 1652111 - RNA, 12 nt, Human
aagugcugggau

SEQ ID NO: 1652112 - RNA, 22 nt, Human
aauaaugugaaacuggauuaaa

SEQ ID NO: 1652113 - RNA, 17 nt, Human
aauaaugugaaacugga

SEQ ID NO: 1652114 - RNA, 14 nt, Human
aauaaagcagcguu

SEQ ID NO: 1652115 - RNA, 20 nt, Human
aauaaagaucauguaaaagu

SEQ ID NO: 1652116 - RNA, 14 nt, Human
aauaaagaucaugu

SEQ ID NO: 1652117 - RNA, 19 nt, Human
aauaaagaucauguaaaag

SEQ ID NO: 1652118 - RNA, 19 nt, Human
aauaauguuaacauggaca

SEQ ID NO: 1652119 - RNA, 16 nt, Human
aauauauaucaaauau

SEQ ID NO: 1652120 - RNA, 23 nt, Human
aauauguggaguucaucuugaau

SEQ ID NO: 1652121 - RNA, 13 nt, Human
aauauuaagaaag

SEQ ID NO: 1652122 - RNA, 23 nt, Human
aaucaccgaaaacguggcugcuu

SEQ ID NO: 1652123 - RNA, 22 nt, Human
aaucaaugcuauaacuauguug

SEQ ID NO: 1652124 - RNA, 21 nt, Human
aaucaccgaaaacguggcugc

SEQ ID NO: 1652125 - RNA, 14 nt, Human
aaugaagcaaugcu

SEQ ID NO: 1652126 - RNA, 20 nt, Human
aaugaagauacugaaauaaa

SEQ ID NO: 1652127 - RNA, 21 nt, Human
aaugaaagacuguacaaagua

SEQ ID NO: 1652128 - RNA, 18 nt, Human
aaugaaagacuguacaaa

SEQ ID NO: 1652129 - RNA, 20 nt, Human
aaugaaagacuguacaaagu

SEQ ID NO: 1652130 - RNA, 20 nt, Human
aaugauguauguugaagccu

SEQ ID NO: 1652131 - RNA, 20 nt, Human
aaugaugccaugaggaacaa

SEQ ID NO: 1652132 - RNA, 20 nt, Human
aaugaauacuuuauaaagga

SEQ ID NO: 1652133 - RNA, 16 nt, Human
aaucucaauauuucag

SEQ ID NO: 1652134 - RNA, 23 nt, Human
acagugaucaaguuauuuuuaau

SEQ ID NO: 1652135 - RNA, 18 nt, Human
acaggcaaugcuggcugu

SEQ ID NO: 1652136 - RNA, 23 nt, Human
acaggcacccaccaucaugucug

SEQ ID NO: 1652137 - RNA, 15 nt, Human
acagugcaucucagc

SEQ ID NO: 1652138 - RNA, 17 nt, Human
acagugcaucucagccc

SEQ ID NO: 1652139 - RNA, 18 nt, Human
acagugcaucucagccca

SEQ ID NO: 1652140 - RNA, 19 nt, Human
acagugauuaccagggacu

SEQ ID NO: 1652141 - RNA, 20 nt, Human
acagugauuaccagggacug

SEQ ID NO: 1652142 - RNA, 19 nt, Human
acagcucuucuccaggcug

SEQ ID NO: 1652143 - RNA, 20 nt, Human
acagcucuucuccaggcugu

SEQ ID NO: 1652144 - RNA, 15 nt, Human
acaggcaaugcuggc

SEQ ID NO: 1652145 - RNA, 16 nt, Human
acaggcaaugcuggcu

SEQ ID NO: 1652146 - RNA, 14 nt, Human
acaggcacccacca

SEQ ID NO: 1652147 - RNA, 17 nt, Human
acaggcaaugcuggcug

SEQ ID NO: 1652148 - RNA, 14 nt, Human
acaggauuauugga

SEQ ID NO: 1652149 - RNA, 24 nt, Human
acaggaugguucccuugaugaaga

SEQ ID NO: 1652150 - RNA, 22 nt, Human
acaggaugguucccuugaugaa

SEQ ID NO: 1652151 - RNA, 19 nt, Human
accagagcugccaccugcc

SEQ ID NO: 1652152 - RNA, 13 nt, Human
accagagcugcca

SEQ ID NO: 1652153 - RNA, 14 nt, Human
accagagcugccac

SEQ ID NO: 1652154 - RNA, 16 nt, Human
accagagcugccaccu

SEQ ID NO: 1652155 - RNA, 15 nt, Human
accaagccguggcuu

SEQ ID NO: 1652156 - RNA, 16 nt, Human
accaagccguggcuuc

SEQ ID NO: 1652157 - RNA, 17 nt, Human
accaagccguggcuucc

SEQ ID NO: 1652158 - RNA, 18 nt, Human
accaagccguggcuuccc

SEQ ID NO: 1652159 - RNA, 14 nt, Human
accaagccguggcu

SEQ ID NO: 1652160 - RNA, 21 nt, Human
accaacgucugugccauuuug

SEQ ID NO: 1652161 - RNA, 18 nt, Human
accacgcuggaccuugaa

SEQ ID NO: 1652162 - RNA, 14 nt, Human
accacgcuggaccu

SEQ ID NO: 1652163 - RNA, 16 nt, Human
accacgcuggaccuug

SEQ ID NO: 1652164 - RNA, 14 nt, Human
accacguuucuaaa

SEQ ID NO: 1652165 - RNA, 13 nt, Human
accacguuucuaa

SEQ ID NO: 1652166 - RNA, 15 nt, Human
acauuugcucaugga

SEQ ID NO: 1652167 - RNA, 16 nt, Human
acauuugcucauggaa

SEQ ID NO: 1652168 - RNA, 16 nt, Human
acauuuguauaaaaua

SEQ ID NO: 1652169 - RNA, 19 nt, Human
acauuuguauaaaauaauu

SEQ ID NO: 1652170 - RNA, 14 nt, Human
accaacgucugugc

SEQ ID NO: 1652171 - RNA, 17 nt, Human
accaacgucugugccau

SEQ ID NO: 1652172 - RNA, 21 nt, Human
acauuuguauaaaauaauuuu

SEQ ID NO: 1652173 - RNA, 16 nt, Human
acauguuaaaccaugg

SEQ ID NO: 1652174 - RNA, 21 nt, Human
acauguuaaaccaugggauaa

SEQ ID NO: 1652175 - RNA, 23 nt, Human
acauguuaaaccaugggauaaau

SEQ ID NO: 1652176 - RNA, 14 nt, Human
acauguuaaaccau

SEQ ID NO: 1652177 - RNA, 17 nt, Human
acauguguuggcagccu

SEQ ID NO: 1652178 - RNA, 19 nt, Human
acauguuuuucuucucccu

SEQ ID NO: 1652179 - RNA, 13 nt, Human
acaugcacgugug

SEQ ID NO: 1652180 - RNA, 16 nt, Human
acauacaauuccaaac

SEQ ID NO: 1652181 - RNA, 21 nt, Human
acauaaugcgugcauaccacu

SEQ ID NO: 1652182 - RNA, 20 nt, Human
acauacaggaagguagaaau

SEQ ID NO: 1652183 - RNA, 20 nt, Human
acauaaguauuuaauucaug

SEQ ID NO: 1652184 - RNA, 15 nt, Human
acauaagauaaaugu

SEQ ID NO: 1652185 - RNA, 16 nt, Human
acaaggcaaggcuguc

SEQ ID NO: 1652186 - RNA, 17 nt, Human
acaaggcaaggcuguca

SEQ ID NO: 1652187 - RNA, 19 nt, Human
acaaggcaaggcugucaau

SEQ ID NO: 1652188 - RNA, 20 nt, Human
acaaggcaaggcugucaauu

SEQ ID NO: 1652189 - RNA, 15 nt, Human
acaaguuaaauaaau

SEQ ID NO: 1652190 - RNA, 14 nt, Human
acacagcucuucuc

SEQ ID NO: 1652191 - RNA, 16 nt, Human
acacagcucuucucca

SEQ ID NO: 1652192 - RNA, 19 nt, Human
acacagcucuucuccaggc

SEQ ID NO: 1652193 - RNA, 18 nt, Human
acacagcucuucuccagg

SEQ ID NO: 1652194 - RNA, 18 nt, Human
acaccagagcccaccuug

SEQ ID NO: 1652195 - RNA, 23 nt, Human
acaccagagcccaccuuggcuca

SEQ ID NO: 1652196 - RNA, 15 nt, Human
acaccaauauucaua

SEQ ID NO: 1652197 - RNA, 12 nt, Human
aauuuccuggga

SEQ ID NO: 1652198 - RNA, 15 nt, Human
aauuuccugggagcu

SEQ ID NO: 1652199 - RNA, 17 nt, Human
aauuguaauuauaucug

SEQ ID NO: 1652200 - RNA, 15 nt, Human
aauuguaauuauauc

SEQ ID NO: 1652201 - RNA, 16 nt, Human
aauuguaauuauaucu

SEQ ID NO: 1652202 - RNA, 14 nt, Human
aauuguaauuauau

SEQ ID NO: 1652203 - RNA, 11 nt, Human
aauuguaauag

SEQ ID NO: 1652204 - RNA, 15 nt, Human
aauuucccaaagcag

SEQ ID NO: 1652205 - RNA, 17 nt, Human
aauuucccaaagcagug

SEQ ID NO: 1652206 - RNA, 22 nt, Human
aauucuagcuuugagcuuaaga

SEQ ID NO: 1652207 - RNA, 14 nt, Human
aauucuacuuugag

SEQ ID NO: 1652208 - RNA, 19 nt, Human
aauucucagaaucucaaau

SEQ ID NO: 1652209 - RNA, 17 nt, Human
aauucucuaguuugauu

SEQ ID NO: 1652210 - RNA, 15 nt, Human
aauucucuaguuuga

SEQ ID NO: 1652211 - RNA, 15 nt, Human
aauucucuuauccaa

SEQ ID NO: 1652212 - RNA, 15 nt, Human
aauucuccugccuca

SEQ ID NO: 1652213 - RNA, 16 nt, Human
aauucuccugccucag

SEQ ID NO: 1652214 - RNA, 14 nt, Human
aauucuccugccuc

SEQ ID NO: 1652215 - RNA, 21 nt, Human
aauucucauuugucacacacu

SEQ ID NO: 1652216 - RNA, 13 nt, Human
aauucuguauaga

SEQ ID NO: 1652217 - RNA, 14 nt, Human
aauucuguauagau

SEQ ID NO: 1652218 - RNA, 20 nt, Human
aauucuguauagauuagaga

SEQ ID NO: 1652219 - RNA, 12 nt, Human
aauucuguauag

SEQ ID NO: 1652220 - RNA, 15 nt, Human
aauuggggauucuua

SEQ ID NO: 1652221 - RNA, 22 nt, Human
aauuguaaggaaugauuaauua

SEQ ID NO: 1652222 - RNA, 14 nt, Human
aauucuguuuuucu

SEQ ID NO: 1652223 - RNA, 18 nt, Human
aauucuguuuuucuaggc

SEQ ID NO: 1652224 - RNA, 13 nt, Human
aauucuuaaauau

SEQ ID NO: 1652225 - RNA, 12 nt, Human
aauuaugaaacu

SEQ ID NO: 1652226 - RNA, 13 nt, Human
aauuaugaaacuu

SEQ ID NO: 1652227 - RNA, 15 nt, Human
aauuaugaaacuuuu

SEQ ID NO: 1652228 - RNA, 18 nt, Human
aauuaugaaacuuuugga

SEQ ID NO: 1652229 - RNA, 19 nt, Human
aauuaugaguuauuuuuau

SEQ ID NO: 1652230 - RNA, 19 nt, Human
aauuauacccccugcaaag

SEQ ID NO: 1652231 - RNA, 20 nt, Human
aauuauaucugaggaauucu

SEQ ID NO: 1652232 - RNA, 22 nt, Human
aauuauaucugaggaauucugu

SEQ ID NO: 1652233 - RNA, 23 nt, Human
aauuauaucugaggaauucugua

SEQ ID NO: 1652234 - RNA, 19 nt, Human
aauuauaugcuauuucuau

SEQ ID NO: 1652235 - RNA, 20 nt, Human
aauuauaugcuauuucuaua

SEQ ID NO: 1652236 - RNA, 21 nt, Human
aauuauaugcuauuucuauau

SEQ ID NO: 1652237 - RNA, 21 nt, Human
accgggcugggagcucugcag

SEQ ID NO: 1652238 - RNA, 23 nt, Human
accgggcugggagcucugcagag

SEQ ID NO: 1652239 - RNA, 18 nt, Human
accgugaggccagagaca

SEQ ID NO: 1652240 - RNA, 12 nt, Human
accucagccucc

SEQ ID NO: 1652241 - RNA, 11 nt, Human
accucagccuc

SEQ ID NO: 1652242 - RNA, 19 nt, Human
accgugccuggccacgccc

SEQ ID NO: 1652243 - RNA, 23 nt, Human
accgugaggccagagacacaagc

SEQ ID NO: 1652244 - RNA, 17 nt, Human
acccugugauggggccc

SEQ ID NO: 1652245 - RNA, 19 nt, Human
acccugugauggggcccug

SEQ ID NO: 1652246 - RNA, 20 nt, Human
acccugugauggggcccugc

SEQ ID NO: 1652247 - RNA, 21 nt, Human
acccugugauggggcccugcc

SEQ ID NO: 1652248 - RNA, 12 nt, Human
accgggcacuca

SEQ ID NO: 1652249 - RNA, 14 nt, Human
accgggcacucaga

SEQ ID NO: 1652250 - RNA, 16 nt, Human
accgggcacucagaag

SEQ ID NO: 1652251 - RNA, 11 nt, Human
accucaggccu

SEQ ID NO: 1652252 - RNA, 20 nt, Human
accucaggugauccacccac

SEQ ID NO: 1652253 - RNA, 21 nt, Human
accucaggugauccacccacc

SEQ ID NO: 1652254 - RNA, 11 nt, Human
acccucagagc

SEQ ID NO: 1652255 - RNA, 14 nt, Human
acccuauugcugcu

SEQ ID NO: 1652256 - RNA, 19 nt, Human
acccuauugcugcuugagg

SEQ ID NO: 1652257 - RNA, 13 nt, Human
acccuauugcugc

SEQ ID NO: 1652258 - RNA, 23 nt, Human
acccucaucaccaacgucugugc

SEQ ID NO: 1652259 - RNA, 18 nt, Human
acccuggcacccagggug

SEQ ID NO: 1652260 - RNA, 23 nt, Human
acccuggcacuauaauguaagcu

SEQ ID NO: 1652261 - RNA, 18 nt, Human
acccucagagccaccccu

SEQ ID NO: 1652262 - RNA, 13 nt, Human
acccucaggcagg

SEQ ID NO: 1652263 - RNA, 14 nt, Human
acccucaggcaggu

SEQ ID NO: 1652264 - RNA, 13 nt, Human
acccucaucacca

SEQ ID NO: 1652265 - RNA, 15 nt, Human
acccucaggcaggug

SEQ ID NO: 1652266 - RNA, 16 nt, Human
acccucaggcaggugg

SEQ ID NO: 1652267 - RNA, 16 nt, Human
acccuggggagaaagu

SEQ ID NO: 1652268 - RNA, 16 nt, Human
acccugugauggggcc

SEQ ID NO: 1652269 - RNA, 21 nt, Human
acccugucucuacuaaaaaua

SEQ ID NO: 1652270 - RNA, 21 nt, Human
accugccaggaagccagcagg

SEQ ID NO: 1652271 - RNA, 22 nt, Human
accugccaggaagccagcaggc

SEQ ID NO: 1652272 - RNA, 23 nt, Human
accugccaggaagccagcaggcu

SEQ ID NO: 1652273 - RNA, 12 nt, Human
accugccccuca

SEQ ID NO: 1652274 - RNA, 15 nt, Human
accugccccucaacu

SEQ ID NO: 1652275 - RNA, 20 nt, Human
accugccccucaacucuccu

SEQ ID NO: 1652276 - RNA, 12 nt, Human
accucugccuga

SEQ ID NO: 1652277 - RNA, 20 nt, Human
accucugccugaagucacac

SEQ ID NO: 1652278 - RNA, 23 nt, Human
accucugccugaagucacacagu

SEQ ID NO: 1652279 - RNA, 12 nt, Human
accuuggcucaa

SEQ ID NO: 1652280 - RNA, 20 nt, Human
acuaauguguaagacaaaaa

SEQ ID NO: 1652281 - RNA, 18 nt, Human
acuaauggggcggugaga

SEQ ID NO: 1652282 - RNA, 19 nt, Human
acgauuucuguuuagauaa

SEQ ID NO: 1652283 - RNA, 23 nt, Human
acgauuucuguuuagauaauaca

SEQ ID NO: 1652284 - RNA, 20 nt, Human
acgauuucuguuuagauaau

SEQ ID NO: 1652285 - RNA, 13 nt, Human
acgucuuaaauau

SEQ ID NO: 1652286 - RNA, 14 nt, Human
acgucuuaaauauu

SEQ ID NO: 1652287 - RNA, 13 nt, Human
acgucugugccau

SEQ ID NO: 1652288 - RNA, 19 nt, Human
acggaauaguuggcuagga

SEQ ID NO: 1652289 - RNA, 17 nt, Human
acggacacucaaaagcu

SEQ ID NO: 1652290 - RNA, 19 nt, Human
acggacacucaaaagcugg

SEQ ID NO: 1652291 - RNA, 12 nt, Human
acgcagcccugc

SEQ ID NO: 1652292 - RNA, 22 nt, Human
acgcagcccugcuuugggcugc

SEQ ID NO: 1652293 - RNA, 23 nt, Human
acgcagcccugcuuugggcugcc

SEQ ID NO: 1652294 - RNA, 22 nt, Human
acgcugugcugcccugcccacc

SEQ ID NO: 1652295 - RNA, 19 nt, Human
acgcugugcugcccugccc

SEQ ID NO: 1652296 - RNA, 19 nt, Human
acgcaggcccccaggugcc

SEQ ID NO: 1652297 - RNA, 19 nt, Human
acuucuuuaauuuuggaau

SEQ ID NO: 1652298 - RNA, 20 nt, Human
acuucuuuaauuuuggaauu

SEQ ID NO: 1652299 - RNA, 18 nt, Human
acuucuuuaauuuuggaa

SEQ ID NO: 1652300 - RNA, 17 nt, Human
acuucagcgguuuauau

SEQ ID NO: 1652301 - RNA, 21 nt, Human
acuucagacauagaauuaaca

SEQ ID NO: 1652302 - RNA, 12 nt, Human
acuugaaaauua

SEQ ID NO: 1652303 - RNA, 14 nt, Human
acuugaaaauuaac

SEQ ID NO: 1652304 - RNA, 16 nt, Human
acuugaaaauuaacau

SEQ ID NO: 1652305 - RNA, 23 nt, Human
acuuggggggcugaggugggagg

SEQ ID NO: 1652306 - RNA, 13 nt, Human
acuuggucuguga

SEQ ID NO: 1652307 - RNA, 19 nt, Human
acuguuucaaacuuuacua

SEQ ID NO: 1652308 - RNA, 18 nt, Human
acuguuucaaacuuuacu

SEQ ID NO: 1652309 - RNA, 15 nt, Human
acuguuucaaacuuu

SEQ ID NO: 1652310 - RNA, 20 nt, Human
acuuaaaauauuccugcauu

SEQ ID NO: 1652311 - RNA, 17 nt, Human
acuucaaauccuugaag

SEQ ID NO: 1652312 - RNA, 18 nt, Human
acuucaaauccuugaaga

SEQ ID NO: 1652313 - RNA, 22 nt, Human
acuuaaaaaugguuuaaauggu

SEQ ID NO: 1652314 - RNA, 16 nt, Human
acugucuuuuuucuaa

SEQ ID NO: 1652315 - RNA, 22 nt, Human
acugucuuuuuucuaaaguaaa

SEQ ID NO: 1652316 - RNA, 23 nt, Human
acugucuuuuuucuaaaguaaaa

SEQ ID NO: 1652317 - RNA, 16 nt, Human
acugugaagagaacca

SEQ ID NO: 1652318 - RNA, 17 nt, Human
acugugccaugugccag

SEQ ID NO: 1652319 - RNA, 18 nt, Human
acugugccaugugccagg

SEQ ID NO: 1652320 - RNA, 14 nt, Human
acugccaugccagc

SEQ ID NO: 1652321 - RNA, 19 nt, Human
acugcccaggccugccugu

SEQ ID NO: 1652322 - RNA, 18 nt, Human
acuggugacugauucuuc

SEQ ID NO: 1652323 - RNA, 19 nt, Human
acuggugacugauucuuca

SEQ ID NO: 1652324 - RNA, 20 nt, Human
acuggugacugauucuucag

SEQ ID NO: 1652325 - RNA, 12 nt, Human
acugguggcccg

SEQ ID NO: 1652326 - RNA, 17 nt, Human
acuguaaaauaauaacu

SEQ ID NO: 1652327 - RNA, 15 nt, Human
acugccuauuuuaau

SEQ ID NO: 1652328 - RNA, 12 nt, Human
acuggaacucuc

SEQ ID NO: 1652329 - RNA, 15 nt, Human
acucuacagaggcca

SEQ ID NO: 1652330 - RNA, 14 nt, Human
acucguuaauuugu

SEQ ID NO: 1652331 - RNA, 19 nt, Human
acucguuaauuuguagugu

SEQ ID NO: 1652332 - RNA, 15 nt, Human
acucccaagcuggac

SEQ ID NO: 1652333 - RNA, 22 nt, Human
acucccaucugugaaaggaaag

SEQ ID NO: 1652334 - RNA, 18 nt, Human
acucccugccccccagcc

SEQ ID NO: 1652335 - RNA, 14 nt, Human
acucccuuucaaca

SEQ ID NO: 1652336 - RNA, 22 nt, Human
acugauuugacauagucuggcu

SEQ ID NO: 1652337 - RNA, 16 nt, Human
acugauuuuuuuuucc

SEQ ID NO: 1652338 - RNA, 17 nt, Human
acugauuuuuuuuuccu

SEQ ID NO: 1652339 - RNA, 18 nt, Human
acugauuuuuuuuuccuu

SEQ ID NO: 1652340 - RNA, 19 nt, Human
acugauuuuuuuuuccuuc

SEQ ID NO: 1652341 - RNA, 20 nt, Human
acugauuuuuuuuuccuuca

SEQ ID NO: 1652342 - RNA, 14 nt, Human
acugauuacugccu

SEQ ID NO: 1652343 - RNA, 22 nt, Human
acugacauuguuggccaaagcc

SEQ ID NO: 1652344 - RNA, 19 nt, Human
acugauaugggucuugaua

SEQ ID NO: 1652345 - RNA, 13 nt, Human
acugaauuaugaa

SEQ ID NO: 1652346 - RNA, 14 nt, Human
acugaauuaugaaa

SEQ ID NO: 1652347 - RNA, 15 nt, Human
acugaauuaugaaac

SEQ ID NO: 1652348 - RNA, 20 nt, Human
acugaauuaugaaacuuuug

SEQ ID NO: 1652349 - RNA, 12 nt, Human
acugaauuucuu

SEQ ID NO: 1652350 - RNA, 13 nt, Human
acucuacccucuu

SEQ ID NO: 1652351 - RNA, 23 nt, Human
acugaauuucuuuugccguuauu

SEQ ID NO: 1652352 - RNA, 17 nt, Human
acugacauuguuggcca

SEQ ID NO: 1652353 - RNA, 18 nt, Human
acugacauuguuggccaa

SEQ ID NO: 1652354 - RNA, 17 nt, Human
agcuguaugauucccag

SEQ ID NO: 1652355 - RNA, 18 nt, Human
agcuguaugauucccagc

SEQ ID NO: 1652356 - RNA, 15 nt, Human
aggaacacuccuuca

SEQ ID NO: 1652357 - RNA, 20 nt, Human
aggaaaaccaagccguggcu

SEQ ID NO: 1652358 - RNA, 21 nt, Human
aggaaaaccaagccguggcuu

SEQ ID NO: 1652359 - RNA, 22 nt, Human
aggaaaaccaagccguggcuuc

SEQ ID NO: 1652360 - RNA, 23 nt, Human
aggaaaaccaagccguggcuucc

SEQ ID NO: 1652361 - RNA, 12 nt, Human
aggaacacuccu

SEQ ID NO: 1652362 - RNA, 14 nt, Human
aggaagguagaaau

SEQ ID NO: 1652363 - RNA, 11 nt, Human
aggaaguacug

SEQ ID NO: 1652364 - RNA, 15 nt, Human
aggaaguacuggaga

SEQ ID NO: 1652365 - RNA, 14 nt, Human
aggaagguucuggu

SEQ ID NO: 1652366 - RNA, 16 nt, Human
aggaagguucuggugu

SEQ ID NO: 1652367 - RNA, 21 nt, Human
aggaagguucuggugugaacu

SEQ ID NO: 1652368 - RNA, 21 nt, Human
agcuuuguuuguugucagcug

SEQ ID NO: 1652369 - RNA, 22 nt, Human
agcuuuguuuguugucagcuga

SEQ ID NO: 1652370 - RNA, 19 nt, Human
agcuuuuuucucugauaca

SEQ ID NO: 1652371 - RNA, 20 nt, Human
agcuuuuuucucugauacag

SEQ ID NO: 1652372 - RNA, 22 nt, Human
agcuuuuuucucugauacagaa

SEQ ID NO: 1652373 - RNA, 23 nt, Human
agcuuuuuucucugauacagaaa

SEQ ID NO: 1652374 - RNA, 19 nt, Human
aggaaaaccaagccguggc

SEQ ID NO: 1652375 - RNA, 18 nt, Human
aggaaaaaauaacaauga

SEQ ID NO: 1652376 - RNA, 22 nt, Human
agcucaccagccccagugccca

SEQ ID NO: 1652377 - RNA, 23 nt, Human
agcucaccagccccagugcccac

SEQ ID NO: 1652378 - RNA, 15 nt, Human
agcugacuuuucugu

SEQ ID NO: 1652379 - RNA, 21 nt, Human
agcugacuuuucuguccgagc

SEQ ID NO: 1652380 - RNA, 16 nt, Human
agcugguugagguuuc

SEQ ID NO: 1652381 - RNA, 20 nt, Human
agcuggguuggaaaacagua

SEQ ID NO: 1652382 - RNA, 16 nt, Human
agcuggguuggaaaac

SEQ ID NO: 1652383 - RNA, 16 nt, Human
agcuggucccacucag

SEQ ID NO: 1652384 - RNA, 15 nt, Human
agcuggucccacuca

SEQ ID NO: 1652385 - RNA, 14 nt, Human
agcugcugaaacaa

SEQ ID NO: 1652386 - RNA, 15 nt, Human
agcugcugaaacaac

SEQ ID NO: 1652387 - RNA, 16 nt, Human
agcugcugaaacaaca

SEQ ID NO: 1652388 - RNA, 20 nt, Human
agcugcugaaacaacaaaua

SEQ ID NO: 1652389 - RNA, 17 nt, Human
agccugcugccugcuuu

SEQ ID NO: 1652390 - RNA, 20 nt, Human
agccuggcacagggcagugg

SEQ ID NO: 1652391 - RNA, 17 nt, Human
agccuggcacagggcag

SEQ ID NO: 1652392 - RNA, 18 nt, Human
agccuggcacagggcagu

SEQ ID NO: 1652393 - RNA, 14 nt, Human
agccuggacccugu

SEQ ID NO: 1652394 - RNA, 18 nt, Human
agccugggcaaugugaua

SEQ ID NO: 1652395 - RNA, 19 nt, Human
agcuaacauggaaguacua

SEQ ID NO: 1652396 - RNA, 20 nt, Human
agcuaacauggaaguacuau

SEQ ID NO: 1652397 - RNA, 13 nt, Human
agcgacagugaga

SEQ ID NO: 1652398 - RNA, 15 nt, Human
agcgacagugagacu

SEQ ID NO: 1652399 - RNA, 17 nt, Human
agcgauucuucugcuuc

SEQ ID NO: 1652400 - RNA, 19 nt, Human
agcgauucuucugcuucag

SEQ ID NO: 1652401 - RNA, 15 nt, Human
agcgauucuucugcu

SEQ ID NO: 1652402 - RNA, 17 nt, Human
agcgacagugagacucu

SEQ ID NO: 1652403 - RNA, 13 nt, Human
agcuaaugggaca

SEQ ID NO: 1652404 - RNA, 14 nt, Human
agcuaaugggacac

SEQ ID NO: 1652405 - RNA, 15 nt, Human
agcuaaugggacacu

SEQ ID NO: 1652406 - RNA, 13 nt, Human
agcucaccagccc

SEQ ID NO: 1652407 - RNA, 14 nt, Human
agcucaccagcccc

SEQ ID NO: 1652408 - RNA, 15 nt, Human
agcucaccagcccca

SEQ ID NO: 1652409 - RNA, 21 nt, Human
agcucaccagccccagugccc

SEQ ID NO: 1652410 - RNA, 13 nt, Human
agcuacaaaugca

SEQ ID NO: 1652411 - RNA, 18 nt, Human
aggaguuucguuuucaaa

SEQ ID NO: 1652412 - RNA, 14 nt, Human
aggagugagcacua

SEQ ID NO: 1652413 - RNA, 15 nt, Human
aggaggucucuaaga

SEQ ID NO: 1652414 - RNA, 12 nt, Human
aggagugagcac

SEQ ID NO: 1652415 - RNA, 14 nt, Human
aggaggucucuaag

SEQ ID NO: 1652416 - RNA, 16 nt, Human
aggagagcccuucauu

SEQ ID NO: 1652417 - RNA, 19 nt, Human
aggaaguacuggagaaaau

SEQ ID NO: 1652418 - RNA, 13 nt, Human
aggaaguagagga

SEQ ID NO: 1652419 - RNA, 12 nt, Human
aggcauguucuc

SEQ ID NO: 1652420 - RNA, 23 nt, Human
aggcaugugaugagaggaaauca

SEQ ID NO: 1652421 - RNA, 24 nt, Human
aggcaugugaugagaggaaaucac

SEQ ID NO: 1652422 - RNA, 17 nt, Human
aggcaucgcaauguaag

SEQ ID NO: 1652423 - RNA, 18 nt, Human
aggcagccaggccacaag

SEQ ID NO: 1652424 - RNA, 21 nt, Human
aggcauuccccaggaggccag

SEQ ID NO: 1652425 - RNA, 20 nt, Human
aggcauguucucugaggaca

SEQ ID NO: 1652426 - RNA, 22 nt, Human
aggcauguucucugaggacacu

SEQ ID NO: 1652427 - RNA, 17 nt, Human
aggcauuccccaggagg

SEQ ID NO: 1652428 - RNA, 22 nt, Human
aggcauuccccaggaggccagc

SEQ ID NO: 1652429 - RNA, 23 nt, Human
aggcauuccccaggaggccagcc

SEQ ID NO: 1652430 - RNA, 23 nt, Human
aggccagcugcuugggcuucauc

SEQ ID NO: 1652431 - RNA, 14 nt, Human
aggccaugggccuc

SEQ ID NO: 1652432 - RNA, 16 nt, Human
aggccaugggccuccu

SEQ ID NO: 1652433 - RNA, 17 nt, Human
aggccaugggccuccug

SEQ ID NO: 1652434 - RNA, 17 nt, Human
aggcccucugcccacuc

SEQ ID NO: 1652435 - RNA, 13 nt, Human
aggccagcugcuu

SEQ ID NO: 1652436 - RNA, 14 nt, Human
aggccagcugcuug

SEQ ID NO: 1652437 - RNA, 16 nt, Human
aggccagcugcuuggg

SEQ ID NO: 1652438 - RNA, 16 nt, Human
aggccaggcccucugc

SEQ ID NO: 1652439 - RNA, 17 nt, Human
aggccaggcccucugcc

SEQ ID NO: 1652440 - RNA, 18 nt, Human
aggccaggcccucugccc

SEQ ID NO: 1652441 - RNA, 19 nt, Human
aggccaggcccucugccca

SEQ ID NO: 1652442 - RNA, 23 nt, Human
aggccaggcccucugcccacucc

SEQ ID NO: 1652443 - RNA, 14 nt, Human
aggcagccaggcca

SEQ ID NO: 1652444 - RNA, 15 nt, Human
aggcagccaggccac

SEQ ID NO: 1652445 - RNA, 16 nt, Human
aggcagccaggccaca

SEQ ID NO: 1652446 - RNA, 22 nt, Human
aggcagaacucaucuagguaaa

SEQ ID NO: 1652447 - RNA, 13 nt, Human
aggcagauacagg

SEQ ID NO: 1652448 - RNA, 20 nt, Human
aggcagagguugcagugagc

SEQ ID NO: 1652449 - RNA, 17 nt, Human
agggacugagaaauuua

SEQ ID NO: 1652450 - RNA, 15 nt, Human
agggacugagaaauu

SEQ ID NO: 1652451 - RNA, 13 nt, Human
agggacugagaaa

SEQ ID NO: 1652452 - RNA, 14 nt, Human
agggacugagaaau

SEQ ID NO: 1652453 - RNA, 18 nt, Human
agggccuggcucaggugg

SEQ ID NO: 1652454 - RNA, 13 nt, Human
agggccuggcuca

SEQ ID NO: 1652455 - RNA, 14 nt, Human
agggccuggcucag

SEQ ID NO: 1652456 - RNA, 21 nt, Human
aggcccucugcccacucccug

SEQ ID NO: 1652457 - RNA, 19 nt, Human
aggcccucugcccacuccc

SEQ ID NO: 1652458 - RNA, 20 nt, Human
aggcccucugcccacucccu

SEQ ID NO: 1652459 - RNA, 13 nt, Human
aggcucuucuccu

SEQ ID NO: 1652460 - RNA, 11 nt, Human
aggcugagccu

SEQ ID NO: 1652461 - RNA, 13 nt, Human
aggcugagccuca

SEQ ID NO: 1652462 - RNA, 11 nt, Human
aggcugaggac

SEQ ID NO: 1652463 - RNA, 13 nt, Human
aggcugaggacuu

SEQ ID NO: 1652464 - RNA, 22 nt, Human
aggcucuggagcccacuguacu

SEQ ID NO: 1652465 - RNA, 24 nt, Human
aggcuguaucccaugagccucagc

SEQ ID NO: 1652466 - RNA, 19 nt, Human
aggcugucaauuacaggaa

SEQ ID NO: 1652467 - RNA, 12 nt, Human
aggcugucaauu

SEQ ID NO: 1652468 - RNA, 17 nt, Human
aggcugcagugagccga

SEQ ID NO: 1652469 - RNA, 19 nt, Human
aggcugcagugagccgaga

SEQ ID NO: 1652470 - RNA, 23 nt, Human
aggcuguaucccaugagccucag

SEQ ID NO: 1652471 - RNA, 17 nt, Human
agggacaggauaagagg

SEQ ID NO: 1652472 - RNA, 15 nt, Human
agcaauucuccugcc

SEQ ID NO: 1652473 - RNA, 17 nt, Human
agcaauucuccugccuc

SEQ ID NO: 1652474 - RNA, 18 nt, Human
agcaauucuccugccuca

SEQ ID NO: 1652475 - RNA, 19 nt, Human
agcaauucuccugccucag

SEQ ID NO: 1652476 - RNA, 20 nt, Human
agcaauucuccugccucagc

SEQ ID NO: 1652477 - RNA, 21 nt, Human
agcacagacccugcccugugg

SEQ ID NO: 1652478 - RNA, 17 nt, Human
agcagugcaugcugucc

SEQ ID NO: 1652479 - RNA, 18 nt, Human
agcagugcaugcuguccc

SEQ ID NO: 1652480 - RNA, 20 nt, Human
agcagccuggacccugugga

SEQ ID NO: 1652481 - RNA, 19 nt, Human
agcagcguuucuaugacac

SEQ ID NO: 1652482 - RNA, 13 nt, Human
agcagugcaugcu

SEQ ID NO: 1652483 - RNA, 16 nt, Human
agcagugcaugcuguc

SEQ ID NO: 1652484 - RNA, 16 nt, Human
agcagccuggacccug

SEQ ID NO: 1652485 - RNA, 19 nt, Human
agcacugacuucuaaguaa

SEQ ID NO: 1652486 - RNA, 17 nt, Human
agcacugacuucuaagu

SEQ ID NO: 1652487 - RNA, 16 nt, Human
agcaucuaugugagac

SEQ ID NO: 1652488 - RNA, 17 nt, Human
agccaacuauggccugu

SEQ ID NO: 1652489 - RNA, 14 nt, Human
agccagauuucacu

SEQ ID NO: 1652490 - RNA, 17 nt, Human
agccagauuucacucuc

SEQ ID NO: 1652491 - RNA, 20 nt, Human
agccagauuucacucuccuu

SEQ ID NO: 1652492 - RNA, 22 nt, Human
agccagauuucacucuccuugg

SEQ ID NO: 1652493 - RNA, 23 nt, Human
agcccaccccucaacaccucugc

SEQ ID NO: 1652494 - RNA, 13 nt, Human
agcccaccuuggc

SEQ ID NO: 1652495 - RNA, 17 nt, Human
agcccacgcccccacug

SEQ ID NO: 1652496 - RNA, 18 nt, Human
agcccacgcccccacugg

SEQ ID NO: 1652497 - RNA, 19 nt, Human
agcccacgcccccacuggu

SEQ ID NO: 1652498 - RNA, 20 nt, Human
agcccacgcccccacuggug

SEQ ID NO: 1652499 - RNA, 22 nt, Human
agccagcaggcucucaggccag

SEQ ID NO: 1652500 - RNA, 21 nt, Human
agccagcaggcucucaggcca

SEQ ID NO: 1652501 - RNA, 23 nt, Human
agccagcaggcucucaggccagc

SEQ ID NO: 1652502 - RNA, 14 nt, Human
agccagcaguucag

SEQ ID NO: 1652503 - RNA, 14 nt, Human
agauaugauucaaa

SEQ ID NO: 1652504 - RNA, 15 nt, Human
agauaugauucaaau

SEQ ID NO: 1652505 - RNA, 16 nt, Human
agauaugauucaaaug

SEQ ID NO: 1652506 - RNA, 12 nt, Human
agaguggcuccu

SEQ ID NO: 1652507 - RNA, 13 nt, Human
agaguggcuccuc

SEQ ID NO: 1652508 - RNA, 14 nt, Human
agaguggcuccucc

SEQ ID NO: 1652509 - RNA, 15 nt, Human
agaguggcuccuccc

SEQ ID NO: 1652510 - RNA, 20 nt, Human
agagggucugaggaauccag

SEQ ID NO: 1652511 - RNA, 14 nt, Human
agaguugaagacag

SEQ ID NO: 1652512 - RNA, 15 nt, Human
agaguugaagacaga

SEQ ID NO: 1652513 - RNA, 13 nt, Human
agaguugaagaca

SEQ ID NO: 1652514 - RNA, 20 nt, Human
agauagccaaggccaaagga

SEQ ID NO: 1652515 - RNA, 20 nt, Human
agauagauaggucagugcaa

SEQ ID NO: 1652516 - RNA, 18 nt, Human
agaucucugcuuuggaaa

SEQ ID NO: 1652517 - RNA, 23 nt, Human
agaucucugcuuuggaaaucaca

SEQ ID NO: 1652518 - RNA, 13 nt, Human
agaucugccuaag

SEQ ID NO: 1652519 - RNA, 18 nt, Human
agaucugccuaaggacuu

SEQ ID NO: 1652520 - RNA, 17 nt, Human
agauggcugugccucug

SEQ ID NO: 1652521 - RNA, 18 nt, Human
agauggcugugccucugc

SEQ ID NO: 1652522 - RNA, 19 nt, Human
agauggcugugccucugcc

SEQ ID NO: 1652523 - RNA, 20 nt, Human
agauggcugugccucugccu

SEQ ID NO: 1652524 - RNA, 21 nt, Human
agauggcugugccucugccug

SEQ ID NO: 1652525 - RNA, 22 nt, Human
agauggcugugccucugccugu

SEQ ID NO: 1652526 - RNA, 18 nt, Human
agaugacaucugucuagg

SEQ ID NO: 1652527 - RNA, 22 nt, Human
agaugggugcuuggaggaagga

SEQ ID NO: 1652528 - RNA, 20 nt, Human
agaugggugcuuggaggaag

SEQ ID NO: 1652529 - RNA, 14 nt, Human
agauucuuuccuga

SEQ ID NO: 1652530 - RNA, 19 nt, Human
agcaaauucuguuuuucua

SEQ ID NO: 1652531 - RNA, 23 nt, Human
agcaaaauuuuuucucuaggaaa

SEQ ID NO: 1652532 - RNA, 17 nt, Human
agauugagauguguuca

SEQ ID NO: 1652533 - RNA, 16 nt, Human
agauugcaacaggcug

SEQ ID NO: 1652534 - RNA, 18 nt, Human
agauucuuuccugaggcu

SEQ ID NO: 1652535 - RNA, 15 nt, Human
agauucuuuccugag

SEQ ID NO: 1652536 - RNA, 16 nt, Human
agauucuuuccugagg

SEQ ID NO: 1652537 - RNA, 16 nt, Human
agauugcaccacugca

SEQ ID NO: 1652538 - RNA, 17 nt, Human
agauugcaacaggcugg

SEQ ID NO: 1652539 - RNA, 19 nt, Human
agauugcaacaggcugggc

SEQ ID NO: 1652540 - RNA, 18 nt, Human
agagcccacgcccccacu

SEQ ID NO: 1652541 - RNA, 11 nt, Human
agagagcaaga

SEQ ID NO: 1652542 - RNA, 19 nt, Human
agagagcaagacgcugugc

SEQ ID NO: 1652543 - RNA, 23 nt, Human
agagagcaagacgcugugcugcc

SEQ ID NO: 1652544 - RNA, 16 nt, Human
agacucuuuggacacu

SEQ ID NO: 1652545 - RNA, 20 nt, Human
agacgcugugcugcccugcc

SEQ ID NO: 1652546 - RNA, 16 nt, Human
agacgaugucuucaua

SEQ ID NO: 1652547 - RNA, 17 nt, Human
agacgcugugcugcccu

SEQ ID NO: 1652548 - RNA, 18 nt, Human
agacgcugugcugcccug

SEQ ID NO: 1652549 - RNA, 19 nt, Human
agacgcugugcugcccugc

SEQ ID NO: 1652550 - RNA, 15 nt, Human
agacuaucuaaaugu

SEQ ID NO: 1652551 - RNA, 13 nt, Human
agacagcccucca

SEQ ID NO: 1652552 - RNA, 14 nt, Human
agacaauuuauuau

SEQ ID NO: 1652553 - RNA, 22 nt, Human
agacagcccgggcucugccucc

SEQ ID NO: 1652554 - RNA, 23 nt, Human
agacagcccgggcucugccuccc

SEQ ID NO: 1652555 - RNA, 15 nt, Human
agaccacguuucuaa

SEQ ID NO: 1652556 - RNA, 14 nt, Human
agaccacguuucua

SEQ ID NO: 1652557 - RNA, 23 nt, Human
agaccaucccugaaggccccgcc

SEQ ID NO: 1652558 - RNA, 18 nt, Human
agacgaaacauuuguucu

SEQ ID NO: 1652559 - RNA, 17 nt, Human
agacccaaaaggcagaa

SEQ ID NO: 1652560 - RNA, 15 nt, Human
agaauuuugagcagg

SEQ ID NO: 1652561 - RNA, 20 nt, Human
agacaaugugaaaagaaaaa

SEQ ID NO: 1652562 - RNA, 19 nt, Human
agacaaggaaaaaauaaca

SEQ ID NO: 1652563 - RNA, 16 nt, Human
agaaugaaagggccca

SEQ ID NO: 1652564 - RNA, 17 nt, Human
agaaucucaaauaacua

SEQ ID NO: 1652565 - RNA, 21 nt, Human
agaaucuaacugguggacaug

SEQ ID NO: 1652566 - RNA, 22 nt, Human
agaaucuaacugguggacaugg

SEQ ID NO: 1652567 - RNA, 18 nt, Human
agaaugcucuuuacuuca

SEQ ID NO: 1652568 - RNA, 23 nt, Human
agaaugcacaaacagaggccgcc

SEQ ID NO: 1652569 - RNA, 17 nt, Human
agaagucuuagauguau

SEQ ID NO: 1652570 - RNA, 19 nt, Human
agaagucuuagauguauau

SEQ ID NO: 1652571 - RNA, 14 nt, Human
agaagucacacagu

SEQ ID NO: 1652572 - RNA, 17 nt, Human
agaaccaggcaacuugg

SEQ ID NO: 1652573 - RNA, 21 nt, Human
agaaccaaaaagaggcuaugu

SEQ ID NO: 1652574 - RNA, 20 nt, Human
agaaccaggcaacuugggaa

SEQ ID NO: 1652575 - RNA, 21 nt, Human
agaagacugcauuauauuuau

SEQ ID NO: 1652576 - RNA, 20 nt, Human
agaagagcuguucacagcca

SEQ ID NO: 1652577 - RNA, 15 nt, Human
agaagagaaugcaca

SEQ ID NO: 1652578 - RNA, 23 nt, Human
agaagagaaugcacaaacagagg

SEQ ID NO: 1652579 - RNA, 13 nt, Human
agaagagcuguuc

SEQ ID NO: 1652580 - RNA, 13 nt, Human
agaacaucccucc

SEQ ID NO: 1652581 - RNA, 17 nt, Human
agaacaucccuccuggg

SEQ ID NO: 1652582 - RNA, 17 nt, Human
agaaccaaaaagaggcu

SEQ ID NO: 1652583 - RNA, 18 nt, Human
agaaccaaaaagaggcua

SEQ ID NO: 1652584 - RNA, 22 nt, Human
agaacagugauuaccagggacu

SEQ ID NO: 1652585 - RNA, 14 nt, Human
auacaccgggccug

SEQ ID NO: 1652586 - RNA, 18 nt, Human
auacaccgggccuggaga

SEQ ID NO: 1652587 - RNA, 17 nt, Human
auacaccacuacauucu

SEQ ID NO: 1652588 - RNA, 12 nt, Human
auacuguuugag

SEQ ID NO: 1652589 - RNA, 16 nt, Human
auacuguuugagguuu

SEQ ID NO: 1652590 - RNA, 20 nt, Human
auacuguuugagguuuuuaa

SEQ ID NO: 1652591 - RNA, 21 nt, Human
auaaagaugagugagcaugcc

SEQ ID NO: 1652592 - RNA, 19 nt, Human
auaaagaucauguaaaagu

SEQ ID NO: 1652593 - RNA, 23 nt, Human
auacaaugcugugcccuaaagug

SEQ ID NO: 1652594 - RNA, 12 nt, Human
auaauguuaaca

SEQ ID NO: 1652595 - RNA, 14 nt, Human
auacaauuuuguuu

SEQ ID NO: 1652596 - RNA, 16 nt, Human
auacaauuuuguuucu

SEQ ID NO: 1652597 - RNA, 17 nt, Human
auacaauuuuguuucug

SEQ ID NO: 1652598 - RNA, 18 nt, Human
auacaauuuuguuucugu

SEQ ID NO: 1652599 - RNA, 15 nt, Human
auacaccacuacauu

SEQ ID NO: 1652600 - RNA, 15 nt, Human
auaaguggugugugu

SEQ ID NO: 1652601 - RNA, 12 nt, Human
agugcuccagcc

SEQ ID NO: 1652602 - RNA, 18 nt, Human
aguuccaccaucaagcca

SEQ ID NO: 1652603 - RNA, 21 nt, Human
aguuccaccaucaagccacca

SEQ ID NO: 1652604 - RNA, 14 nt, Human
aguucauacccugu

SEQ ID NO: 1652605 - RNA, 18 nt, Human
aguuacacuaaaagguga

SEQ ID NO: 1652606 - RNA, 17 nt, Human
aguugaaaaacagcuga

SEQ ID NO: 1652607 - RNA, 16 nt, Human
aguugaagacagagcu

SEQ ID NO: 1652608 - RNA, 17 nt, Human
aguugaagacagagcua

SEQ ID NO: 1652609 - RNA, 18 nt, Human
aguugaaaaacagcugag

SEQ ID NO: 1652610 - RNA, 14 nt, Human
aguugaaaagacuc

SEQ ID NO: 1652611 - RNA, 17 nt, Human
aguuguuagugugucuu

SEQ ID NO: 1652612 - RNA, 22 nt, Human
aguuguuagugugucuuagugu

SEQ ID NO: 1652613 - RNA, 14 nt, Human
aguuugauuaaauu

SEQ ID NO: 1652614 - RNA, 16 nt, Human
aguuugauuaaauucu

SEQ ID NO: 1652615 - RNA, 11 nt, Human
aguuugcaguu

SEQ ID NO: 1652616 - RNA, 15 nt, Human
auaaaagacagugaa

SEQ ID NO: 1652617 - RNA, 16 nt, Human
auaaaagacagugaaa

SEQ ID NO: 1652618 - RNA, 16 nt, Human
auaaaaaauuaugaca

SEQ ID NO: 1652619 - RNA, 22 nt, Human
aguauauugauccagaaagaaa

SEQ ID NO: 1652620 - RNA, 20 nt, Human
aguacuucuccacccugcuc

SEQ ID NO: 1652621 - RNA, 21 nt, Human
aguacuucuccacccugcucu

SEQ ID NO: 1652622 - RNA, 22 nt, Human
aguacuucuccacccugcucuc

SEQ ID NO: 1652623 - RNA, 15 nt, Human
aguacuggagaaaau

SEQ ID NO: 1652624 - RNA, 17 nt, Human
aguaacuuacuuaggug

SEQ ID NO: 1652625 - RNA, 20 nt, Human
aguaaaugggggugcauuug

SEQ ID NO: 1652626 - RNA, 19 nt, Human
aguaaaugggggugcauuu

SEQ ID NO: 1652627 - RNA, 21 nt, Human
aguaaaugggggugcauuuga

SEQ ID NO: 1652628 - RNA, 19 nt, Human
agucuggcuguacccagga

SEQ ID NO: 1652629 - RNA, 21 nt, Human
agucuggcuguacccaggaau

SEQ ID NO: 1652630 - RNA, 18 nt, Human
agucuggcccuuccuuuu

SEQ ID NO: 1652631 - RNA, 21 nt, Human
agucugauucccaagcucugc

SEQ ID NO: 1652632 - RNA, 22 nt, Human
agucugauucccaagcucugcu

SEQ ID NO: 1652633 - RNA, 19 nt, Human
aguccuuaccagcagagca

SEQ ID NO: 1652634 - RNA, 16 nt, Human
agucgaggacagggag

SEQ ID NO: 1652635 - RNA, 14 nt, Human
aguccucuuuucug

SEQ ID NO: 1652636 - RNA, 16 nt, Human
aguccuuaccagcaga

SEQ ID NO: 1652637 - RNA, 18 nt, Human
aguccuuaccagcagagc

SEQ ID NO: 1652638 - RNA, 13 nt, Human
agucauuuaauaa

SEQ ID NO: 1652639 - RNA, 19 nt, Human
agugccuuauggaacacuc

SEQ ID NO: 1652640 - RNA, 20 nt, Human
agugccuuauggaacacucu

SEQ ID NO: 1652641 - RNA, 21 nt, Human
agugccuuauggaacacucug

SEQ ID NO: 1652642 - RNA, 22 nt, Human
agugccuuauggaacacucuga

SEQ ID NO: 1652643 - RNA, 18 nt, Human
agugauucuccugccuca

SEQ ID NO: 1652644 - RNA, 19 nt, Human
agugauucuccugccucag

SEQ ID NO: 1652645 - RNA, 20 nt, Human
agugauucuccugccucagc

SEQ ID NO: 1652646 - RNA, 20 nt, Human
agugauccucccaccucagc

SEQ ID NO: 1652647 - RNA, 22 nt, Human
agugauccucccaccucagccu

SEQ ID NO: 1652648 - RNA, 13 nt, Human
agugauuaccagg

SEQ ID NO: 1652649 - RNA, 23 nt, Human
agugauccucccaccucagccuc

SEQ ID NO: 1652650 - RNA, 19 nt, Human
agugaugucacuagggcag

SEQ ID NO: 1652651 - RNA, 16 nt, Human
agugacagaggcagcc

SEQ ID NO: 1652652 - RNA, 19 nt, Human
agugacagaggcagcccca

SEQ ID NO: 1652653 - RNA, 14 nt, Human
agugacagaggcag

SEQ ID NO: 1652654 - RNA, 19 nt, Human
aucuaggauuuuaagggaa

SEQ ID NO: 1652655 - RNA, 11 nt, Human
aucuaggauuu

SEQ ID NO: 1652656 - RNA, 23 nt, Human
aucuaggaagacuuuggaaagag

SEQ ID NO: 1652657 - RNA, 13 nt, Human
augaccuuucaau

SEQ ID NO: 1652658 - RNA, 15 nt, Human
augaccuuucaauag

SEQ ID NO: 1652659 - RNA, 18 nt, Human
augaccuuucaauaggaa

SEQ ID NO: 1652660 - RNA, 21 nt, Human
augagccucagcauccuggca

SEQ ID NO: 1652661 - RNA, 11 nt, Human
augagccuggc

SEQ ID NO: 1652662 - RNA, 12 nt, Human
augagccuggca

SEQ ID NO: 1652663 - RNA, 15 nt, Human
augagcugugagaag

SEQ ID NO: 1652664 - RNA, 18 nt, Human
augaaacuuguguaaaua

SEQ ID NO: 1652665 - RNA, 16 nt, Human
augaaacuuuuggaag

SEQ ID NO: 1652666 - RNA, 12 nt, Human
augaaagacugu

SEQ ID NO: 1652667 - RNA, 23 nt, Human
augaagcauuuacuuuguguuca

SEQ ID NO: 1652668 - RNA, 17 nt, Human
augaauaaagacaccua

SEQ ID NO: 1652669 - RNA, 21 nt, Human
augaaguaauaugcacacauu

SEQ ID NO: 1652670 - RNA, 14 nt, Human
augaaguaauaugc

SEQ ID NO: 1652671 - RNA, 23 nt, Human
augaaguaauaugcacacauuuu

SEQ ID NO: 1652672 - RNA, 13 nt, Human
augaaguacucau

SEQ ID NO: 1652673 - RNA, 12 nt, Human
augccugguggc

SEQ ID NO: 1652674 - RNA, 13 nt, Human
augccugguggca

SEQ ID NO: 1652675 - RNA, 14 nt, Human
augccugguggcag

SEQ ID NO: 1652676 - RNA, 19 nt, Human
augccugguggcagcugcg

SEQ ID NO: 1652677 - RNA, 18 nt, Human
augccugguggcagcugc

SEQ ID NO: 1652678 - RNA, 21 nt, Human
augccugguggcagcugcggu

SEQ ID NO: 1652679 - RNA, 24 nt, Human
augcauauuauuuuauguugcaua

SEQ ID NO: 1652680 - RNA, 16 nt, Human
augcuuugaucccuuc

SEQ ID NO: 1652681 - RNA, 18 nt, Human
augcucugcauguuacau

SEQ ID NO: 1652682 - RNA, 19 nt, Human
augcucugcauguuacaua

SEQ ID NO: 1652683 - RNA, 14 nt, Human
augcuucuucagag

SEQ ID NO: 1652684 - RNA, 17 nt, Human
augcuucuucagagacu

SEQ ID NO: 1652685 - RNA, 20 nt, Human
augcuucuucagagacuccu

SEQ ID NO: 1652686 - RNA, 22 nt, Human
augcuucuucagagacuccugc

SEQ ID NO: 1652687 - RNA, 20 nt, Human
augggacauuugcucaugga

SEQ ID NO: 1652688 - RNA, 15 nt, Human
augggacagggagga

SEQ ID NO: 1652689 - RNA, 14 nt, Human
augggaaagcauug

SEQ ID NO: 1652690 - RNA, 20 nt, Human
augggaaagcauuguaaaug

SEQ ID NO: 1652691 - RNA, 15 nt, Human
auggcuuuguauaga

SEQ ID NO: 1652692 - RNA, 16 nt, Human
auggcuuuguauagaa

SEQ ID NO: 1652693 - RNA, 18 nt, Human
auggcuuuguauagaacc

SEQ ID NO: 1652694 - RNA, 23 nt, Human
auggcuuccuggcaauagucaaa

SEQ ID NO: 1652695 - RNA, 22 nt, Human
aucuaggaagacuuuggaaaga

SEQ ID NO: 1652696 - RNA, 14 nt, Human
aucgaccugccucg

SEQ ID NO: 1652697 - RNA, 12 nt, Human
auccuugaagau

SEQ ID NO: 1652698 - RNA, 18 nt, Human
auccagcagauuauucac

SEQ ID NO: 1652699 - RNA, 23 nt, Human
auccacuuuaucuugaauaaugu

SEQ ID NO: 1652700 - RNA, 21 nt, Human
auccacugugccaugugccag

SEQ ID NO: 1652701 - RNA, 19 nt, Human
aucauggagguuugaagau

SEQ ID NO: 1652702 - RNA, 15 nt, Human
aucauccuaagcuau

SEQ ID NO: 1652703 - RNA, 20 nt, Human
aucaugacaaagacugagua

SEQ ID NO: 1652704 - RNA, 21 nt, Human
aucaugaauuaguuuuauaug

SEQ ID NO: 1652705 - RNA, 15 nt, Human
auagcacagacccug

SEQ ID NO: 1652706 - RNA, 14 nt, Human
auagcacagacccu

SEQ ID NO: 1652707 - RNA, 14 nt, Human
auauuuuuuucuga

SEQ ID NO: 1652708 - RNA, 16 nt, Human
auauuuuuuucugaaa

SEQ ID NO: 1652709 - RNA, 18 nt, Human
auauuuuuuucugaaauu

SEQ ID NO: 1652710 - RNA, 18 nt, Human
auauuuuuuucuuuucuu

SEQ ID NO: 1652711 - RNA, 19 nt, Human
auauuuuuuucugaaauuu

SEQ ID NO: 1652712 - RNA, 14 nt, Human
aucaaaagaaagaa

SEQ ID NO: 1652713 - RNA, 24 nt, Human
aucaaaagguuaauaaaguaauua

SEQ ID NO: 1652714 - RNA, 20 nt, Human
aucaaaagguuaauaaagua

SEQ ID NO: 1652715 - RNA, 19 nt, Human
aucaaagagguuuuaaaaa

SEQ ID NO: 1652716 - RNA, 12 nt, Human
aucaaaggacac

SEQ ID NO: 1652717 - RNA, 22 nt, Human
caagugaaaaaggaggaagaga

SEQ ID NO: 1652718 - RNA, 23 nt, Human
caagugaaaaaggaggaagagaa

SEQ ID NO: 1652719 - RNA, 14 nt, Human
caagugagacccug

SEQ ID NO: 1652720 - RNA, 21 nt, Human
caagugauucuccugccucag

SEQ ID NO: 1652721 - RNA, 20 nt, Human
caagugauucuccugccuca

SEQ ID NO: 1652722 - RNA, 15 nt, Human
caagugagacccugu

SEQ ID NO: 1652723 - RNA, 19 nt, Human
caagugagacccugucuca

SEQ ID NO: 1652724 - RNA, 19 nt, Human
caagugauucuccugccuc

SEQ ID NO: 1652725 - RNA, 18 nt, Human
caagugauucuccugccu

SEQ ID NO: 1652726 - RNA, 23 nt, Human
caaggggaauguuugccucugcc

SEQ ID NO: 1652727 - RNA, 13 nt, Human
caaggucauuuuu

SEQ ID NO: 1652728 - RNA, 13 nt, Human
caagggccuggcc

SEQ ID NO: 1652729 - RNA, 14 nt, Human
caagggccuggccu

SEQ ID NO: 1652730 - RNA, 15 nt, Human
caagggccuggccug

SEQ ID NO: 1652731 - RNA, 21 nt, Human
caaggggaauguuugccucug

SEQ ID NO: 1652732 - RNA, 16 nt, Human
caagggccuggccuga

SEQ ID NO: 1652733 - RNA, 18 nt, Human
caagagggcacugguggc

SEQ ID NO: 1652734 - RNA, 19 nt, Human
caagagggcacugguggcc

SEQ ID NO: 1652735 - RNA, 20 nt, Human
caagagggcacugguggccc

SEQ ID NO: 1652736 - RNA, 12 nt, Human
caagagggucug

SEQ ID NO: 1652737 - RNA, 16 nt, Human
caagagggucugagga

SEQ ID NO: 1652738 - RNA, 17 nt, Human
caagagggucugaggaa

SEQ ID NO: 1652739 - RNA, 23 nt, Human
caagacgcugugcugcccugccc

SEQ ID NO: 1652740 - RNA, 21 nt, Human
caagacgcugugcugcccugc

SEQ ID NO: 1652741 - RNA, 22 nt, Human
caagacgcugugcugcccugcc

SEQ ID NO: 1652742 - RNA, 20 nt, Human
caagacgcugugcugcccug

SEQ ID NO: 1652743 - RNA, 13 nt, Human
caagaccuucucc

SEQ ID NO: 1652744 - RNA, 15 nt, Human
caagaaaugaaagca

SEQ ID NO: 1652745 - RNA, 13 nt, Human
caagaaaugaaag

SEQ ID NO: 1652746 - RNA, 16 nt, Human
caaggacuaggguccu

SEQ ID NO: 1652747 - RNA, 18 nt, Human
caaggacuaggguccugg

SEQ ID NO: 1652748 - RNA, 19 nt, Human
caaggacuaggguccuggg

SEQ ID NO: 1652749 - RNA, 20 nt, Human
caaggacuaggguccugggg

SEQ ID NO: 1652750 - RNA, 21 nt, Human
caaggacuaggguccugggga

SEQ ID NO: 1652751 - RNA, 14 nt, Human
caaggauccugagc

SEQ ID NO: 1652752 - RNA, 15 nt, Human
caaggauccugagcc

SEQ ID NO: 1652753 - RNA, 16 nt, Human
caaggauccugagcca

SEQ ID NO: 1652754 - RNA, 17 nt, Human
caaggauccugagccag

SEQ ID NO: 1652755 - RNA, 21 nt, Human
caaggcugggggaagaagcuc

SEQ ID NO: 1652756 - RNA, 13 nt, Human
caaggcugucaau

SEQ ID NO: 1652757 - RNA, 14 nt, Human
caaggcugucaauu

SEQ ID NO: 1652758 - RNA, 21 nt, Human
caaggcugucaauuacaggaa

SEQ ID NO: 1652759 - RNA, 16 nt, Human
caagcauuuagaugua

SEQ ID NO: 1652760 - RNA, 19 nt, Human
caagcauuuagauguauag

SEQ ID NO: 1652761 - RNA, 21 nt, Human
caagcauaccaacacgagcag

SEQ ID NO: 1652762 - RNA, 16 nt, Human
caagcauaccaacacg

SEQ ID NO: 1652763 - RNA, 17 nt, Human
caaccugauugugucuc

SEQ ID NO: 1652764 - RNA, 19 nt, Human
caaccugauugugucucuu

SEQ ID NO: 1652765 - RNA, 21 nt, Human
caaccugauugugucucuugg

SEQ ID NO: 1652766 - RNA, 16 nt, Human
caacugcauuggcuuu

SEQ ID NO: 1652767 - RNA, 17 nt, Human
caacugcaucaagaugu

SEQ ID NO: 1652768 - RNA, 20 nt, Human
caacugcaucaagaugugac

SEQ ID NO: 1652769 - RNA, 23 nt, Human
caacugcaucaagaugugacaug

SEQ ID NO: 1652770 - RNA, 16 nt, Human
caacauacucccaucu

SEQ ID NO: 1652771 - RNA, 14 nt, Human
caacauacucccau

SEQ ID NO: 1652772 - RNA, 15 nt, Human
caacauacucccauc

SEQ ID NO: 1652773 - RNA, 17 nt, Human
caacaggcugggcuuca

SEQ ID NO: 1652774 - RNA, 17 nt, Human
caaauuuacagagacag

SEQ ID NO: 1652775 - RNA, 14 nt, Human
caacaggcugggcu

SEQ ID NO: 1652776 - RNA, 23 nt, Human
caaauuuacagagacagaaagca

SEQ ID NO: 1652777 - RNA, 18 nt, Human
caaaguugccuaaaucca

SEQ ID NO: 1652778 - RNA, 20 nt, Human
caacaggcugggcuucagug

SEQ ID NO: 1652779 - RNA, 17 nt, Human
caaauuguaagcaugca

SEQ ID NO: 1652780 - RNA, 15 nt, Human
caaaguugccuaaau

SEQ ID NO: 1652781 - RNA, 17 nt, Human
caaaguugccuaaaucc

SEQ ID NO: 1652782 - RNA, 14 nt, Human
caaaguugccuaaa

SEQ ID NO: 1652783 - RNA, 22 nt, Human
caaaguucccuacuuccuguga

SEQ ID NO: 1652784 - RNA, 19 nt, Human
caaaguggugagaggcauc

SEQ ID NO: 1652785 - RNA, 20 nt, Human
caaaggguaucaggugcugc

SEQ ID NO: 1652786 - RNA, 21 nt, Human
caaaggguaucaggugcugcc

SEQ ID NO: 1652787 - RNA, 23 nt, Human
caaaggguaucaggugcugccau

SEQ ID NO: 1652788 - RNA, 16 nt, Human
caaaguggugagaggc

SEQ ID NO: 1652789 - RNA, 17 nt, Human
caaaguggugagaggca

SEQ ID NO: 1652790 - RNA, 20 nt, Human
caaaggagauuggaaggaac

SEQ ID NO: 1652791 - RNA, 18 nt, Human
caaagcccuuccaugucg

SEQ ID NO: 1652792 - RNA, 14 nt, Human
caaaggagauugga

SEQ ID NO: 1652793 - RNA, 17 nt, Human
auuuuaacaacagcugg

SEQ ID NO: 1652794 - RNA, 18 nt, Human
auuuuaauaauguuucaa

SEQ ID NO: 1652795 - RNA, 19 nt, Human
auuuuaauaauguuucaaa

SEQ ID NO: 1652796 - RNA, 13 nt, Human
caaagcccagcuu

SEQ ID NO: 1652797 - RNA, 14 nt, Human
caaagagguuuuaa

SEQ ID NO: 1652798 - RNA, 21 nt, Human
caaagagguuuuaaaaaaauc

SEQ ID NO: 1652799 - RNA, 13 nt, Human
caaagaaauuaug

SEQ ID NO: 1652800 - RNA, 15 nt, Human
caaagaaauuaugug

SEQ ID NO: 1652801 - RNA, 12 nt, Human
caaagaaauuau

SEQ ID NO: 1652802 - RNA, 14 nt, Human
caaagaaauguaag

SEQ ID NO: 1652803 - RNA, 18 nt, Human
caaucucggcucacugca

SEQ ID NO: 1652804 - RNA, 21 nt, Human
caaugaccuuucaauaggaaa

SEQ ID NO: 1652805 - RNA, 13 nt, Human
caaugauggucac

SEQ ID NO: 1652806 - RNA, 15 nt, Human
caaugaccuuucaau

SEQ ID NO: 1652807 - RNA, 16 nt, Human
caaugaccuuucaaua

SEQ ID NO: 1652808 - RNA, 14 nt, Human
caaugaccuuucaa

SEQ ID NO: 1652809 - RNA, 14 nt, Human
caaugauggucacc

SEQ ID NO: 1652810 - RNA, 14 nt, Human
caaugcaaaccauc

SEQ ID NO: 1652811 - RNA, 21 nt, Human
caaugcaaaccaucauugaaa

SEQ ID NO: 1652812 - RNA, 22 nt, Human
caaugcaaaccaucauugaaau

SEQ ID NO: 1652813 - RNA, 23 nt, Human
caaugcaaaccaucauugaaauc

SEQ ID NO: 1652814 - RNA, 14 nt, Human
caaugcacugacau

SEQ ID NO: 1652815 - RNA, 13 nt, Human
caaugcacuuugu

SEQ ID NO: 1652816 - RNA, 14 nt, Human
cacacccagcccac

SEQ ID NO: 1652817 - RNA, 20 nt, Human
cacacccagcccacuucugc

SEQ ID NO: 1652818 - RNA, 16 nt, Human
cacacagcucuguccu

SEQ ID NO: 1652819 - RNA, 21 nt, Human
cacaccagagcccaccuuggc

SEQ ID NO: 1652820 - RNA, 22 nt, Human
cacaccagagcccaccuuggcu

SEQ ID NO: 1652821 - RNA, 22 nt, Human
cacacagauuugagcucagccc

SEQ ID NO: 1652822 - RNA, 13 nt, Human
cacacagcucugu

SEQ ID NO: 1652823 - RNA, 14 nt, Human
cacacagcucuguc

SEQ ID NO: 1652824 - RNA, 15 nt, Human
cacacagcucugucc

SEQ ID NO: 1652825 - RNA, 20 nt, Human
cacaaucucggcucacugca

SEQ ID NO: 1652826 - RNA, 22 nt, Human
cacaaucucggcucacugcauc

SEQ ID NO: 1652827 - RNA, 23 nt, Human
cacaaucucggcucacugcaucc

SEQ ID NO: 1652828 - RNA, 24 nt, Human
cacaaucucggcucacugcauccu

SEQ ID NO: 1652829 - RNA, 15 nt, Human
cacacaccagagccc

SEQ ID NO: 1652830 - RNA, 16 nt, Human
cacacaccagagccca

SEQ ID NO: 1652831 - RNA, 20 nt, Human
cacacaccagagcccaccuu

SEQ ID NO: 1652832 - RNA, 18 nt, Human
cacacagauuugagcuca

SEQ ID NO: 1652833 - RNA, 20 nt, Human
cacacagauuugagcucagc

SEQ ID NO: 1652834 - RNA, 14 nt, Human
cacacacuuuggcu

SEQ ID NO: 1652835 - RNA, 12 nt, Human
cacacacuuuug

SEQ ID NO: 1652836 - RNA, 14 nt, Human
caaugcacuuuguu

SEQ ID NO: 1652837 - RNA, 18 nt, Human
caaugguuuucuugugug

SEQ ID NO: 1652838 - RNA, 14 nt, Human
caauuuuguuucug

SEQ ID NO: 1652839 - RNA, 16 nt, Human
caauuuuguuucugua

SEQ ID NO: 1652840 - RNA, 17 nt, Human
caauuuuguuucuguac

SEQ ID NO: 1652841 - RNA, 13 nt, Human
caauuuuguuucu

SEQ ID NO: 1652842 - RNA, 17 nt, Human
cacaaacgggcucagca

SEQ ID NO: 1652843 - RNA, 13 nt, Human
cacaagaaaugaa

SEQ ID NO: 1652844 - RNA, 15 nt, Human
cacaagaaaugaaag

SEQ ID NO: 1652845 - RNA, 17 nt, Human
cacaaagguagcuuuuc

SEQ ID NO: 1652846 - RNA, 19 nt, Human
cacaaucucggcucacugc

SEQ ID NO: 1652847 - RNA, 23 nt, Human
cacaagaaaugaaagcagggacu

SEQ ID NO: 1652848 - RNA, 23 nt, Human
cacaagacccaaaaggcagaagc

SEQ ID NO: 1652849 - RNA, 13 nt, Human
cacccaagggccu

SEQ ID NO: 1652850 - RNA, 13 nt, Human
caccaucaagcca

SEQ ID NO: 1652851 - RNA, 14 nt, Human
caccaucaagccac

SEQ ID NO: 1652852 - RNA, 15 nt, Human
caccaucaagccacc

SEQ ID NO: 1652853 - RNA, 18 nt, Human
caccauaggucaccuuua

SEQ ID NO: 1652854 - RNA, 21 nt, Human
caccauauuaccacagacaua

SEQ ID NO: 1652855 - RNA, 19 nt, Human
caccauguuggccaggcug

SEQ ID NO: 1652856 - RNA, 20 nt, Human
caccauguuggccaggcugc

SEQ ID NO: 1652857 - RNA, 20 nt, Human
caccauguuggccaggcugg

SEQ ID NO: 1652858 - RNA, 16 nt, Human
caccaucaagccacca

SEQ ID NO: 1652859 - RNA, 17 nt, Human
caccaucaagccaccaa

SEQ ID NO: 1652860 - RNA, 19 nt, Human
caccaucaagccaccaaca

SEQ ID NO: 1652861 - RNA, 24 nt, Human
caccaucaagccaccaacauacuc

SEQ ID NO: 1652862 - RNA, 15 nt, Human
caccaucaugucugg

SEQ ID NO: 1652863 - RNA, 17 nt, Human
caccaucaugucuggcu

SEQ ID NO: 1652864 - RNA, 18 nt, Human
caccaucaugucuggcua

SEQ ID NO: 1652865 - RNA, 13 nt, Human
caccaagcccagu

SEQ ID NO: 1652866 - RNA, 12 nt, Human
caccaagcccag

SEQ ID NO: 1652867 - RNA, 23 nt, Human
cacauguccaagaagcccaggaa

SEQ ID NO: 1652868 - RNA, 17 nt, Human
caccaacgucugugcca

SEQ ID NO: 1652869 - RNA, 18 nt, Human
cacauguccaagaagccc

SEQ ID NO: 1652870 - RNA, 19 nt, Human
cacauguccaagaagccca

SEQ ID NO: 1652871 - RNA, 21 nt, Human
cacauguccaagaagcccagg

SEQ ID NO: 1652872 - RNA, 22 nt, Human
cacauguccaagaagcccagga

SEQ ID NO: 1652873 - RNA, 14 nt, Human
caccacgcccggcu

SEQ ID NO: 1652874 - RNA, 15 nt, Human
caccacgcccggcua

SEQ ID NO: 1652875 - RNA, 19 nt, Human
caccacacccagcccacuu

SEQ ID NO: 1652876 - RNA, 17 nt, Human
caccagagcccaccuug

SEQ ID NO: 1652877 - RNA, 18 nt, Human
caccagagcccaccuugg

SEQ ID NO: 1652878 - RNA, 20 nt, Human
caccagagcccaccuuggcu

SEQ ID NO: 1652879 - RNA, 22 nt, Human
caccagagcccaccuuggcuca

SEQ ID NO: 1652880 - RNA, 15 nt, Human
caccagagcccaccu

SEQ ID NO: 1652881 - RNA, 22 nt, Human
cacacggacacucaaaagcugg

SEQ ID NO: 1652882 - RNA, 14 nt, Human
cacaggcccggcuc

SEQ ID NO: 1652883 - RNA, 23 nt, Human
cacaguccuuaccagcagagcac

SEQ ID NO: 1652884 - RNA, 15 nt, Human
cacaggacucugccu

SEQ ID NO: 1652885 - RNA, 16 nt, Human
cacaggacucugccuc

SEQ ID NO: 1652886 - RNA, 21 nt, Human
cacagcucuucuccaggcugu

SEQ ID NO: 1652887 - RNA, 19 nt, Human
cacagcucuucuccaggcu

SEQ ID NO: 1652888 - RNA, 20 nt, Human
cacagcucuucuccaggcug

SEQ ID NO: 1652889 - RNA, 19 nt, Human
cacaugcaaggucauuuuu

SEQ ID NO: 1652890 - RNA, 17 nt, Human
cacaugcaaggucauuu

SEQ ID NO: 1652891 - RNA, 20 nt, Human
cacaugcaaggucauuuuuu

SEQ ID NO: 1652892 - RNA, 18 nt, Human
cacaugcacgugugugca

SEQ ID NO: 1652893 - RNA, 16 nt, Human
cacauguccaagaagc

SEQ ID NO: 1652894 - RNA, 17 nt, Human
cacauguccaagaagcc

SEQ ID NO: 1652895 - RNA, 20 nt, Human
cacaugccucucucaggcca

SEQ ID NO: 1652896 - RNA, 21 nt, Human
cacaugccucucucaggccaa

SEQ ID NO: 1652897 - RNA, 13 nt, Human
cacaugagcauca

SEQ ID NO: 1652898 - RNA, 17 nt, Human
cacaugagcaucaggcc

SEQ ID NO: 1652899 - RNA, 20 nt, Human
cacaguuuugguugcuuuaa

SEQ ID NO: 1652900 - RNA, 23 nt, Human
cacaguuuugguugcuuuaauau

SEQ ID NO: 1652901 - RNA, 18 nt, Human
cacaugagcaucaggcca

SEQ ID NO: 1652902 - RNA, 19 nt, Human
cacaugagcaucaggccag

SEQ ID NO: 1652903 - RNA, 20 nt, Human
cacaugagcaucaggccagg

SEQ ID NO: 1652904 - RNA, 21 nt, Human
cacaugagcaucaggccaggc

SEQ ID NO: 1652905 - RNA, 16 nt, Human
cacaugaaguccaagc

SEQ ID NO: 1652906 - RNA, 19 nt, Human
cacaguuuugguugcuuua

SEQ ID NO: 1652907 - RNA, 17 nt, Human
cacaugaaguccaagca

SEQ ID NO: 1652908 - RNA, 20 nt, Human
cacaugaaguccaagcauuu

SEQ ID NO: 1652909 - RNA, 21 nt, Human
cacaguuuucugagaaagacu

SEQ ID NO: 1652910 - RNA, 22 nt, Human
cacaguuuucugagaaagacua

SEQ ID NO: 1652911 - RNA, 13 nt, Human
uuuuuucuuacug

SEQ ID NO: 1652912 - RNA, 13 nt, Human
uuuugaaaaacug

SEQ ID NO: 1652913 - RNA, 12 nt, Human
uuuuuuacuaau

SEQ ID NO: 1652914 - RNA, 14 nt, Human
uuuuucuguuauau

SEQ ID NO: 1652915 - RNA, 23 nt, Human
uuuuucuuaaauaauaaagauca

SEQ ID NO: 1652916 - RNA, 20 nt, Human
uuuuuuauacaggaugauga

SEQ ID NO: 1652917 - RNA, 12 nt, Human
uuuuuucugaaa

SEQ ID NO: 1652918 - RNA, 17 nt, Human
uuuuuuccuucagugcc

SEQ ID NO: 1652919 - RNA, 22 nt, Human
uuucuuacugucuuuuuucuaa

SEQ ID NO: 1652920 - RNA, 15 nt, Human
uuugagcagggcuca

SEQ ID NO: 1652921 - RNA, 13 nt, Human
uuugagugccuua

SEQ ID NO: 1652922 - RNA, 20 nt, Human
uuugagguuuuuaagccuua

SEQ ID NO: 1652923 - RNA, 14 nt, Human
uuugagcucagccc

SEQ ID NO: 1652924 - RNA, 22 nt, Human
uuugaggucuguucuuuccaaa

SEQ ID NO: 1652925 - RNA, 17 nt, Human
uuugaggucuguucuuu

SEQ ID NO: 1652926 - RNA, 19 nt, Human
uuugcauaacguauaaaag

SEQ ID NO: 1652927 - RNA, 23 nt, Human
uuugcauaacguauaaaagccug

SEQ ID NO: 1652928 - RNA, 14 nt, Human
uuugcagacaggca

SEQ ID NO: 1652929 - RNA, 15 nt, Human
uuugccagugggaac

SEQ ID NO: 1652930 - RNA, 16 nt, Human
uuugccagugggaacu

SEQ ID NO: 1652931 - RNA, 21 nt, Human
uuugcauagauucccugagca

SEQ ID NO: 1652932 - RNA, 22 nt, Human
uuugcauaggugaucucauuua

SEQ ID NO: 1652933 - RNA, 16 nt, Human
uuuggaaaucuuuaaa

SEQ ID NO: 1652934 - RNA, 22 nt, Human
uuugccauguuggccaggcugg

SEQ ID NO: 1652935 - RNA, 18 nt, Human
uuugccauguuggccagg

SEQ ID NO: 1652936 - RNA, 17 nt, Human
uuuguaaauuaacuuuu

SEQ ID NO: 1652937 - RNA, 16 nt, Human
uuuguaaauuaacuuu

SEQ ID NO: 1652938 - RNA, 15 nt, Human
uuuguaaauuaacuu

SEQ ID NO: 1652939 - RNA, 22 nt, Human
uuugguuaagucuguuuuauga

SEQ ID NO: 1652940 - RNA, 18 nt, Human
uuugguuaagucuguuuu

SEQ ID NO: 1652941 - RNA, 19 nt, Human
uuugguuaagucuguuuua

SEQ ID NO: 1652942 - RNA, 20 nt, Human
uuugguuaagucuguuuuau

SEQ ID NO: 1652943 - RNA, 11 nt, Human
uuuguauagaa

SEQ ID NO: 1652944 - RNA, 22 nt, Human
uuuguaaauuaacuuuuauaaa

SEQ ID NO: 1652945 - RNA, 21 nt, Human
uuuguauaaaauaauuuuuau

SEQ ID NO: 1652946 - RNA, 12 nt, Human
uuuguguuagag

SEQ ID NO: 1652947 - RNA, 13 nt, Human
uuuguccccaccg

SEQ ID NO: 1652948 - RNA, 21 nt, Human
uuuguccccaccgcagacagg

SEQ ID NO: 1652949 - RNA, 12 nt, Human
uuuguuguuugu

SEQ ID NO: 1652950 - RNA, 14 nt, Human
uuuguuguuuguuu

SEQ ID NO: 1652951 - RNA, 19 nt, Human
uuuguuguuuguuuagucu

SEQ ID NO: 1652952 - RNA, 15 nt, Human
uuuuaaaaugagaaa

SEQ ID NO: 1652953 - RNA, 22 nt, Human
uuuuaaaaugagaaaucuaaaa

SEQ ID NO: 1652954 - RNA, 16 nt, Human
uuuuacagcugccugc

SEQ ID NO: 1652955 - RNA, 22 nt, Human
uuuuacauaaauuuaguauuuu

SEQ ID NO: 1652956 - RNA, 17 nt, Human
uuuuaauuugguuuuca

SEQ ID NO: 1652957 - RNA, 21 nt, Human
uuuuaauuugguuuucacauu

SEQ ID NO: 1652958 - RNA, 14 nt, Human
uuuuacuguacaga

SEQ ID NO: 1652959 - RNA, 15 nt, Human
uuuuauaugcuucug

SEQ ID NO: 1652960 - RNA, 20 nt, Human
uuuuauaugcuucuguuuua

SEQ ID NO: 1652961 - RNA, 20 nt, Human
uuuuauaucaauuuaaaaaa

SEQ ID NO: 1652962 - RNA, 16 nt, Human
uuuuaugauacuugaa

SEQ ID NO: 1652963 - RNA, 20 nt, Human
uuuuaugauacuugaaaauu

SEQ ID NO: 1652964 - RNA, 18 nt, Human
uuuuaucgucacugcuua

SEQ ID NO: 1652965 - RNA, 19 nt, Human
uuuuaucgucacugcuuaa

SEQ ID NO: 1652966 - RNA, 10 nt, Human
uuuuauauuu

SEQ ID NO: 1652967 - RNA, 17 nt, Human
uuuucaacgcagcccug

SEQ ID NO: 1652968 - RNA, 21 nt, Human
uuuucaacgcagcccugcuuu

SEQ ID NO: 1652969 - RNA, 22 nt, Human
uuuucaacgcagcccugcuuug

SEQ ID NO: 1652970 - RNA, 15 nt, Human
uuuuaugauccagca

SEQ ID NO: 1652971 - RNA, 13 nt, Human
uuuuaugauccag

SEQ ID NO: 1652972 - RNA, 15 nt, Human
uuuucacaguucucu

SEQ ID NO: 1652973 - RNA, 19 nt, Human
uuuucacugcuggcugccu

SEQ ID NO: 1652974 - RNA, 20 nt, Human
uuuucacugcuggcugccuu

SEQ ID NO: 1652975 - RNA, 15 nt, Human
uuuuccuucagugcc

SEQ ID NO: 1652976 - RNA, 17 nt, Human
uuuucuugcaugaggcu

SEQ ID NO: 1652977 - RNA, 14 nt, Human
uuuucuucucccuc

SEQ ID NO: 1652978 - RNA, 13 nt, Human
uuuuccugaaaac

SEQ ID NO: 1652979 - RNA, 18 nt, Human
uuuuccaugaguccccug

SEQ ID NO: 1652980 - RNA, 19 nt, Human
uuuuccaugaguccccugu

SEQ ID NO: 1652981 - RNA, 16 nt, Human
uuucuaggacugaauu

SEQ ID NO: 1652982 - RNA, 15 nt, Human
uuucuaaugugugaa

SEQ ID NO: 1652983 - RNA, 15 nt, Human
uuucuagccagagga

SEQ ID NO: 1652984 - RNA, 14 nt, Human
uuucucuuucguua

SEQ ID NO: 1652985 - RNA, 22 nt, Human
uuucugagaaagacuauucaaa

SEQ ID NO: 1652986 - RNA, 18 nt, Human
uuucuaaaggcuaccuuu

SEQ ID NO: 1652987 - RNA, 14 nt, Human
uuucuaaaggcuac

SEQ ID NO: 1652988 - RNA, 14 nt, Human
uuucuaaagcugcc

SEQ ID NO: 1652989 - RNA, 17 nt, Human
uuucuaaagcugccagc

SEQ ID NO: 1652990 - RNA, 23 nt, Human
uuuccugacagaaggacucaggu

SEQ ID NO: 1652991 - RNA, 21 nt, Human
uuuccucuuuggucuacacug

SEQ ID NO: 1652992 - RNA, 22 nt, Human
uuuccucaaaacuucagacaua

SEQ ID NO: 1652993 - RNA, 18 nt, Human
uuuccuagcacacacuuu

SEQ ID NO: 1652994 - RNA, 21 nt, Human
uuuccuagcacacacuuuugg

SEQ ID NO: 1652995 - RNA, 13 nt, Human
uuuauuuccagug

SEQ ID NO: 1652996 - RNA, 20 nt, Human
uuucaauaggaaaaacugau

SEQ ID NO: 1652997 - RNA, 22 nt, Human
uuucaauaggaaaaacugauuu

SEQ ID NO: 1652998 - RNA, 15 nt, Human
uuucagauaaucaca

SEQ ID NO: 1652999 - RNA, 15 nt, Human
uuucagcagcugcag

SEQ ID NO: 1653000 - RNA, 21 nt, Human
uuucagauaaucacaauacau

SEQ ID NO: 1653001 - RNA, 18 nt, Human
uuucagauaacuguuauu

SEQ ID NO: 1653002 - RNA, 15 nt, Human
uuucagccaagaauu

SEQ ID NO: 1653003 - RNA, 16 nt, Human
uuucagccaagaauuc

SEQ ID NO: 1653004 - RNA, 22 nt, Human
uuucauugcugggcuugucugu

SEQ ID NO: 1653005 - RNA, 13 nt, Human
uuuccaggaaggc

SEQ ID NO: 1653006 - RNA, 15 nt, Human
uuuccaaaguacacu

SEQ ID NO: 1653007 - RNA, 12 nt, Human
uuuccaaaguac

SEQ ID NO: 1653008 - RNA, 13 nt, Human
uuuaugauccagc

SEQ ID NO: 1653009 - RNA, 21 nt, Human
uuuaucgucacugcuuaacuu

SEQ ID NO: 1653010 - RNA, 16 nt, Human
uuuauaaacuuuaccu

SEQ ID NO: 1653011 - RNA, 16 nt, Human
uuuaucgucacugcuu

SEQ ID NO: 1653012 - RNA, 14 nt, Human
uuuauaaacuuuac

SEQ ID NO: 1653013 - RNA, 14 nt, Human
uuuaugcauauuau

SEQ ID NO: 1653014 - RNA, 17 nt, Human
uuuauuggcuuuucuga

SEQ ID NO: 1653015 - RNA, 21 nt, Human
uuuauuggcuuuucugaucca

SEQ ID NO: 1653016 - RNA, 14 nt, Human
uuuauugucaaagu

SEQ ID NO: 1653017 - RNA, 16 nt, Human
uuuauugucaaagugg

SEQ ID NO: 1653018 - RNA, 22 nt, Human
uuuauuguuuaaaaucauuucu

SEQ ID NO: 1653019 - RNA, 17 nt, Human
uuuacauggcuggagcu

SEQ ID NO: 1653020 - RNA, 15 nt, Human
uuguauuuauuuagu

SEQ ID NO: 1653021 - RNA, 20 nt, Human
uuguauuuuacuaauaaaau

SEQ ID NO: 1653022 - RNA, 20 nt, Human
uuuagaaacacaacuauauu

SEQ ID NO: 1653023 - RNA, 12 nt, Human
uuuagaaacaca

SEQ ID NO: 1653024 - RNA, 15 nt, Human
uuuacuuuguguuca

SEQ ID NO: 1653025 - RNA, 22 nt, Human
uuuacauggcuggagcuagaau

SEQ ID NO: 1653026 - RNA, 14 nt, Human
uucucaugccucag

SEQ ID NO: 1653027 - RNA, 21 nt, Human
uucucaugccucagccuccug

SEQ ID NO: 1653028 - RNA, 11 nt, Human
uucucaugccu

SEQ ID NO: 1653029 - RNA, 12 nt, Human
uucucaugccuc

SEQ ID NO: 1653030 - RNA, 14 nt, Human
uucuauuguuucuu

SEQ ID NO: 1653031 - RNA, 17 nt, Human
uucuaugcugaguuugu

SEQ ID NO: 1653032 - RNA, 11 nt, Human
uucuauauuuu

SEQ ID NO: 1653033 - RNA, 14 nt, Human
uucuauauuuucau

SEQ ID NO: 1653034 - RNA, 14 nt, Human
uucuauauguuuaa

SEQ ID NO: 1653035 - RNA, 15 nt, Human
uucuauauuuucauu

SEQ ID NO: 1653036 - RNA, 16 nt, Human
uucuauauuuucauuc

SEQ ID NO: 1653037 - RNA, 18 nt, Human
uucuauauuuucauucuc

SEQ ID NO: 1653038 - RNA, 21 nt, Human
uucuauauuuucauucuccua

SEQ ID NO: 1653039 - RNA, 17 nt, Human
uucuaugacacaugcaa

SEQ ID NO: 1653040 - RNA, 16 nt, Human
uucuaugacacaugca

SEQ ID NO: 1653041 - RNA, 14 nt, Human
uucucugauacaga

SEQ ID NO: 1653042 - RNA, 15 nt, Human
uucucugauacagaa

SEQ ID NO: 1653043 - RNA, 16 nt, Human
uucucugauacagaaa

SEQ ID NO: 1653044 - RNA, 17 nt, Human
uucucugauacagaaaa

SEQ ID NO: 1653045 - RNA, 21 nt, Human
uucugacccaugcugcccugu

SEQ ID NO: 1653046 - RNA, 18 nt, Human
uucugacccaugcugccc

SEQ ID NO: 1653047 - RNA, 20 nt, Human
uucugacccaugcugcccug

SEQ ID NO: 1653048 - RNA, 16 nt, Human
uucuccacccugcucu

SEQ ID NO: 1653049 - RNA, 11 nt, Human
uucuccaggcu

SEQ ID NO: 1653050 - RNA, 16 nt, Human
uucuccaagcaggaca

SEQ ID NO: 1653051 - RNA, 13 nt, Human
uucuccacccugc

SEQ ID NO: 1653052 - RNA, 18 nt, Human
uucucuccagccccugga

SEQ ID NO: 1653053 - RNA, 23 nt, Human
uucucuccucuccccaugauguu

SEQ ID NO: 1653054 - RNA, 19 nt, Human
uucccuuugacgccauccc

SEQ ID NO: 1653055 - RNA, 17 nt, Human
uuccuagcacacacuuu

SEQ ID NO: 1653056 - RNA, 22 nt, Human
uuccccacuugagaauuacccu

SEQ ID NO: 1653057 - RNA, 22 nt, Human
uuccucccucccucuuucccuc

SEQ ID NO: 1653058 - RNA, 12 nt, Human
uuccucccuccc

SEQ ID NO: 1653059 - RNA, 19 nt, Human
uuccucccucccucuuucc

SEQ ID NO: 1653060 - RNA, 21 nt, Human
uuccucccucccucuuucccu

SEQ ID NO: 1653061 - RNA, 23 nt, Human
uuccucauaguaugguggcuggg

SEQ ID NO: 1653062 - RNA, 20 nt, Human
uuccuagguauaauucacau

SEQ ID NO: 1653063 - RNA, 19 nt, Human
uuccuagcacacacuuuug

SEQ ID NO: 1653064 - RNA, 12 nt, Human
uuccuagugaaa

SEQ ID NO: 1653065 - RNA, 16 nt, Human
uucuaaaggcuaccuu

SEQ ID NO: 1653066 - RNA, 18 nt, Human
uucuaaaggcuaccuuug

SEQ ID NO: 1653067 - RNA, 17 nt, Human
uucuaaaggcuaccuuu

SEQ ID NO: 1653068 - RNA, 19 nt, Human
uucuaaaggcuaccuuugu

SEQ ID NO: 1653069 - RNA, 22 nt, Human
uucggccuccauccugaggcuc

SEQ ID NO: 1653070 - RNA, 18 nt, Human
uucggccuccauccugag

SEQ ID NO: 1653071 - RNA, 19 nt, Human
uucggccuccauccugagg

SEQ ID NO: 1653072 - RNA, 13 nt, Human
uuccugcccuggg

SEQ ID NO: 1653073 - RNA, 16 nt, Human
uuccugcccugggagg

SEQ ID NO: 1653074 - RNA, 22 nt, Human
uuccugcccugggaggcaguga

SEQ ID NO: 1653075 - RNA, 11 nt, Human
uuccugcccug

SEQ ID NO: 1653076 - RNA, 16 nt, Human
uuccuucagugccuua

SEQ ID NO: 1653077 - RNA, 19 nt, Human
uuccuucagugccuuaugg

SEQ ID NO: 1653078 - RNA, 23 nt, Human
uuccuucagugccuuauggaaca

SEQ ID NO: 1653079 - RNA, 19 nt, Human
uuccuucauucaacccacc

SEQ ID NO: 1653080 - RNA, 13 nt, Human
uuccuuccucuga

SEQ ID NO: 1653081 - RNA, 17 nt, Human
uuccuuccucugagccu

SEQ ID NO: 1653082 - RNA, 19 nt, Human
uucaaugccccugaauuua

SEQ ID NO: 1653083 - RNA, 18 nt, Human
uucaauucucauuuguca

SEQ ID NO: 1653084 - RNA, 14 nt, Human
uucaacgcagcccu

SEQ ID NO: 1653085 - RNA, 15 nt, Human
uucaacgcagcccug

SEQ ID NO: 1653086 - RNA, 16 nt, Human
uucaaucccaggaugu

SEQ ID NO: 1653087 - RNA, 17 nt, Human
uucaaccauuccccaug

SEQ ID NO: 1653088 - RNA, 20 nt, Human
uucaaccauuccccauggga

SEQ ID NO: 1653089 - RNA, 13 nt, Human
uucaacgcagccc

SEQ ID NO: 1653090 - RNA, 21 nt, Human
uucaacagguuuuccugaaga

SEQ ID NO: 1653091 - RNA, 16 nt, Human
uuacuaaaauggacug

SEQ ID NO: 1653092 - RNA, 17 nt, Human
uuacuaaaauggacugu

SEQ ID NO: 1653093 - RNA, 18 nt, Human
uuacuaaaauggacugug

SEQ ID NO: 1653094 - RNA, 15 nt, Human
uuacuaaaauggacu

SEQ ID NO: 1653095 - RNA, 13 nt, Human
uuacgugaguccu

SEQ ID NO: 1653096 - RNA, 14 nt, Human
uuacgugaguccug

SEQ ID NO: 1653097 - RNA, 23 nt, Human
uucaaauuguaagcaugcacaaa

SEQ ID NO: 1653098 - RNA, 15 nt, Human
uucaaagcaaauguc

SEQ ID NO: 1653099 - RNA, 13 nt, Human
uucaaagauauuu

SEQ ID NO: 1653100 - RNA, 23 nt, Human
uucagcuccagcucaccagcccc

SEQ ID NO: 1653101 - RNA, 17 nt, Human
uucagcucugcaagaau

SEQ ID NO: 1653102 - RNA, 24 nt, Human
uucagcucugcaagaauugaagca

SEQ ID NO: 1653103 - RNA, 21 nt, Human
uucagcugguugagguuucaa

SEQ ID NO: 1653104 - RNA, 16 nt, Human
uucaggaagcucaggg

SEQ ID NO: 1653105 - RNA, 18 nt, Human
uucagcugcauacaguuu

SEQ ID NO: 1653106 - RNA, 17 nt, Human
uucagcugacuuuucug

SEQ ID NO: 1653107 - RNA, 15 nt, Human
uucaggcucuucucc

SEQ ID NO: 1653108 - RNA, 20 nt, Human
uucaggaagcucagggccug

SEQ ID NO: 1653109 - RNA, 17 nt, Human
uucaggaagcucagggc

SEQ ID NO: 1653110 - RNA, 19 nt, Human
uucaggaagcucagggccu

SEQ ID NO: 1653111 - RNA, 14 nt, Human
uucacucuccuugg

SEQ ID NO: 1653112 - RNA, 11 nt, Human
uucacugauuu

SEQ ID NO: 1653113 - RNA, 15 nt, Human
uucagagacuccugc

SEQ ID NO: 1653114 - RNA, 23 nt, Human
uucagagcugcccucuccugggc

SEQ ID NO: 1653115 - RNA, 22 nt, Human
uucagagcugcccucuccuggg

SEQ ID NO: 1653116 - RNA, 21 nt, Human
uucagagcugcccucuccugg

SEQ ID NO: 1653117 - RNA, 15 nt, Human
uucaucuaggauuuu

SEQ ID NO: 1653118 - RNA, 13 nt, Human
uucauaaugacuu

SEQ ID NO: 1653119 - RNA, 23 nt, Human
uucauaaugacuuaagcacacuu

SEQ ID NO: 1653120 - RNA, 16 nt, Human
uucaggcucuucuccu

SEQ ID NO: 1653121 - RNA, 19 nt, Human
uucagugccuuauggaaca

SEQ ID NO: 1653122 - RNA, 21 nt, Human
uucagugccuuauggaacacu

SEQ ID NO: 1653123 - RNA, 13 nt, Human
uucaguggcagcu

SEQ ID NO: 1653124 - RNA, 19 nt, Human
uucauuuaggugaggaagc

SEQ ID NO: 1653125 - RNA, 20 nt, Human
uucaucuuccaacucaaacu

SEQ ID NO: 1653126 - RNA, 11 nt, Human
uucaucuugaa

SEQ ID NO: 1653127 - RNA, 18 nt, Human
uucaugaaagauucaaug

SEQ ID NO: 1653128 - RNA, 12 nt, Human
uucaucuugaau

SEQ ID NO: 1653129 - RNA, 17 nt, Human
uucaucuugaauuguaa

SEQ ID NO: 1653130 - RNA, 20 nt, Human
uuccaugucgccucugcauu

SEQ ID NO: 1653131 - RNA, 21 nt, Human
uuccaugucgccucugcauuc

SEQ ID NO: 1653132 - RNA, 14 nt, Human
uuccccaagacauu

SEQ ID NO: 1653133 - RNA, 17 nt, Human
uuccaugucgccucugc

SEQ ID NO: 1653134 - RNA, 18 nt, Human
uuccaugucgccucugca

SEQ ID NO: 1653135 - RNA, 19 nt, Human
uuccaugucgccucugcau

SEQ ID NO: 1653136 - RNA, 17 nt, Human
uuccaugaguccccugu

SEQ ID NO: 1653137 - RNA, 21 nt, Human
uuccacuuagaaauugcauuu

SEQ ID NO: 1653138 - RNA, 19 nt, Human
uuccacuuauaggaauuga

SEQ ID NO: 1653139 - RNA, 12 nt, Human
uugcugccucau

SEQ ID NO: 1653140 - RNA, 15 nt, Human
uugcugccucaugcu

SEQ ID NO: 1653141 - RNA, 11 nt, Human
uugcugccuca

SEQ ID NO: 1653142 - RNA, 20 nt, Human
uugcugauggugcaaugacc

SEQ ID NO: 1653143 - RNA, 22 nt, Human
uugcugauggugcaaugaccuu

SEQ ID NO: 1653144 - RNA, 16 nt, Human
uugccucugccucuga

SEQ ID NO: 1653145 - RNA, 18 nt, Human
uugccucugccucugaca

SEQ ID NO: 1653146 - RNA, 11 nt, Human
uugccucugcc

SEQ ID NO: 1653147 - RNA, 14 nt, Human
uugccucugccucu

SEQ ID NO: 1653148 - RNA, 18 nt, Human
uugccacugccucuuccu

SEQ ID NO: 1653149 - RNA, 18 nt, Human
uugccagucaccccggcc

SEQ ID NO: 1653150 - RNA, 23 nt, Human
uugcccacgcuggagugcaguga

SEQ ID NO: 1653151 - RNA, 11 nt, Human
uugcccaggca

SEQ ID NO: 1653152 - RNA, 12 nt, Human
uuggaaaucuuu

SEQ ID NO: 1653153 - RNA, 15 nt, Human
uuggaaaucuuuaaa

SEQ ID NO: 1653154 - RNA, 20 nt, Human
uugcuggggccgaaagaaca

SEQ ID NO: 1653155 - RNA, 21 nt, Human
uuggaccaaaaaccaguauug

SEQ ID NO: 1653156 - RNA, 11 nt, Human
uuggaaggaac

SEQ ID NO: 1653157 - RNA, 19 nt, Human
uuggaaggaacguccccug

SEQ ID NO: 1653158 - RNA, 14 nt, Human
uuggauuguccccg

SEQ ID NO: 1653159 - RNA, 17 nt, Human
uuggcaaaaaggcagga

SEQ ID NO: 1653160 - RNA, 13 nt, Human
uuggcauucccca

SEQ ID NO: 1653161 - RNA, 14 nt, Human
uuggccaggcuggu

SEQ ID NO: 1653162 - RNA, 24 nt, Human
uuggccaaagccaaagcuaggccu

SEQ ID NO: 1653163 - RNA, 18 nt, Human
uuggcugggggccucagu

SEQ ID NO: 1653164 - RNA, 21 nt, Human
uuggcugggggccucagugcc

SEQ ID NO: 1653165 - RNA, 22 nt, Human
uuggcugggggccucagugcca

SEQ ID NO: 1653166 - RNA, 12 nt, Human
uugguaaaccuu

SEQ ID NO: 1653167 - RNA, 14 nt, Human
uugguaaaccuuuu

SEQ ID NO: 1653168 - RNA, 16 nt, Human
uuggguggaugccugg

SEQ ID NO: 1653169 - RNA, 19 nt, Human
uuggcuuuucugauccagu

SEQ ID NO: 1653170 - RNA, 22 nt, Human
uuggcuuuucugauccaguuuu

SEQ ID NO: 1653171 - RNA, 15 nt, Human
uuggcuuuucugauc

SEQ ID NO: 1653172 - RNA, 22 nt, Human
uuggcuuuggguugcaggaccu

SEQ ID NO: 1653173 - RNA, 16 nt, Human
uugggaggccauuugu

SEQ ID NO: 1653174 - RNA, 12 nt, Human
uugggaggcuga

SEQ ID NO: 1653175 - RNA, 22 nt, Human
uuggucccccuuccauggacuu

SEQ ID NO: 1653176 - RNA, 16 nt, Human
uuggucccccuuccau

SEQ ID NO: 1653177 - RNA, 12 nt, Human
uugguccugcug

SEQ ID NO: 1653178 - RNA, 13 nt, Human
uugguccugcugc

SEQ ID NO: 1653179 - RNA, 16 nt, Human
uuguaaaggaauuuaa

SEQ ID NO: 1653180 - RNA, 12 nt, Human
uuguacagacaa

SEQ ID NO: 1653181 - RNA, 13 nt, Human
uuguacagacaac

SEQ ID NO: 1653182 - RNA, 11 nt, Human
uuguaaaugug

SEQ ID NO: 1653183 - RNA, 14 nt, Human
uuguaaaugugcuu

SEQ ID NO: 1653184 - RNA, 18 nt, Human
uuguaaaugugcuuuuaa

SEQ ID NO: 1653185 - RNA, 14 nt, Human
uuguauucagaguu

SEQ ID NO: 1653186 - RNA, 21 nt, Human
uuguauucucuccuguaccuc

SEQ ID NO: 1653187 - RNA, 14 nt, Human
uuguacauaaugcg

SEQ ID NO: 1653188 - RNA, 14 nt, Human
uuguagagccaggg

SEQ ID NO: 1653189 - RNA, 15 nt, Human
uuguagagccagggu

SEQ ID NO: 1653190 - RNA, 19 nt, Human
uuguaucacaaaucuuaac

SEQ ID NO: 1653191 - RNA, 14 nt, Human
uugacgccauccca

SEQ ID NO: 1653192 - RNA, 15 nt, Human
uugacgccaucccag

SEQ ID NO: 1653193 - RNA, 22 nt, Human
uugacgccaucccagccccaau

SEQ ID NO: 1653194 - RNA, 22 nt, Human
uugaccugaggcccuucucucc

SEQ ID NO: 1653195 - RNA, 12 nt, Human
uugaccugaggc

SEQ ID NO: 1653196 - RNA, 19 nt, Human
uugaccugaggcccuucuc

SEQ ID NO: 1653197 - RNA, 20 nt, Human
uugaccgugaggccagagac

SEQ ID NO: 1653198 - RNA, 21 nt, Human
uugaccgugaggccagagaca

SEQ ID NO: 1653199 - RNA, 15 nt, Human
uugaccucaggugau

SEQ ID NO: 1653200 - RNA, 21 nt, Human
uugaccucaggugauccaccc

SEQ ID NO: 1653201 - RNA, 19 nt, Human
uugauagcacagacccugc

SEQ ID NO: 1653202 - RNA, 20 nt, Human
uugauagcacagacccugcc

SEQ ID NO: 1653203 - RNA, 14 nt, Human
uugaggacacugau

SEQ ID NO: 1653204 - RNA, 15 nt, Human
uugaggacacugaua

SEQ ID NO: 1653205 - RNA, 18 nt, Human
uugauuuccguuaaaaua

SEQ ID NO: 1653206 - RNA, 14 nt, Human
uugcaacaggcugg

SEQ ID NO: 1653207 - RNA, 17 nt, Human
uugcaacaggcugggcu

SEQ ID NO: 1653208 - RNA, 21 nt, Human
uugauagcacagacccugccc

SEQ ID NO: 1653209 - RNA, 23 nt, Human
uugauagcacagacccugcccug

SEQ ID NO: 1653210 - RNA, 12 nt, Human
uugaugaagaag

SEQ ID NO: 1653211 - RNA, 16 nt, Human
uugcagacaggcaagc

SEQ ID NO: 1653212 - RNA, 22 nt, Human
uugcagacaggcaagcaccucc

SEQ ID NO: 1653213 - RNA, 14 nt, Human
uugcauagaauaaa

SEQ ID NO: 1653214 - RNA, 14 nt, Human
uugccacugccucu

SEQ ID NO: 1653215 - RNA, 15 nt, Human
uugccacugccucuu

SEQ ID NO: 1653216 - RNA, 18 nt, Human
uugcauagauucccugag

SEQ ID NO: 1653217 - RNA, 19 nt, Human
uucuguccuacucuguguc

SEQ ID NO: 1653218 - RNA, 17 nt, Human
uucuguccuacucugug

SEQ ID NO: 1653219 - RNA, 12 nt, Human
uucuguggcuca

SEQ ID NO: 1653220 - RNA, 16 nt, Human
uucuguggcucacaga

SEQ ID NO: 1653221 - RNA, 23 nt, Human
uucuguggguuucuaaagcugcc

SEQ ID NO: 1653222 - RNA, 17 nt, Human
uucuguccgagcuuuga

SEQ ID NO: 1653223 - RNA, 21 nt, Human
uucuguccgagcuuugaaaau

SEQ ID NO: 1653224 - RNA, 14 nt, Human
uucugagcauuuaa

SEQ ID NO: 1653225 - RNA, 15 nt, Human
uucugagaaagacua

SEQ ID NO: 1653226 - RNA, 16 nt, Human
uucuugguuuguaaau

SEQ ID NO: 1653227 - RNA, 13 nt, Human
uucuugguuugua

SEQ ID NO: 1653228 - RNA, 18 nt, Human
uucuugguuuguaaauua

SEQ ID NO: 1653229 - RNA, 17 nt, Human
uucuugguuuguaaauu

SEQ ID NO: 1653230 - RNA, 23 nt, Human
uucuugguuuguaaauuaacuuu

SEQ ID NO: 1653231 - RNA, 11 nt, Human
uucuguucuuu

SEQ ID NO: 1653232 - RNA, 19 nt, Human
uucuuauuuaaugaaagac

SEQ ID NO: 1653233 - RNA, 23 nt, Human
uucuuauuuaaugaaagacugua

SEQ ID NO: 1653234 - RNA, 14 nt, Human
uucuucaacucccu

SEQ ID NO: 1653235 - RNA, 15 nt, Human
uucuuauuucauuuc

SEQ ID NO: 1653236 - RNA, 18 nt, Human
uucuuuauaauucuacuu

SEQ ID NO: 1653237 - RNA, 12 nt, Human
uucuuguauuaa

SEQ ID NO: 1653238 - RNA, 13 nt, Human
uucuuguauuaag

SEQ ID NO: 1653239 - RNA, 18 nt, Human
uucuuguauuaagaauga

SEQ ID NO: 1653240 - RNA, 19 nt, Human
uugaaaacacuguucucug

SEQ ID NO: 1653241 - RNA, 21 nt, Human
uugaaaacacuguucucugcc

SEQ ID NO: 1653242 - RNA, 22 nt, Human
uugaaacggaugauuucuaugc

SEQ ID NO: 1653243 - RNA, 21 nt, Human
uugaaacggaugauuucuaug

SEQ ID NO: 1653244 - RNA, 22 nt, Human
uugaaaacacuguucucugccc

SEQ ID NO: 1653245 - RNA, 23 nt, Human
uugaaacugagaugugaacacau

SEQ ID NO: 1653246 - RNA, 18 nt, Human
uugaaaagacuccaaaga

SEQ ID NO: 1653247 - RNA, 22 nt, Human
uugaaaagacuccaaagaaaug

SEQ ID NO: 1653248 - RNA, 23 nt, Human
uugaaaagacuccaaagaaaugu

SEQ ID NO: 1653249 - RNA, 19 nt, Human
uugaacucuucaaucucuu

SEQ ID NO: 1653250 - RNA, 16 nt, Human
uugaacugauaaagau

SEQ ID NO: 1653251 - RNA, 22 nt, Human
uugaacuuugaccucugcagca

SEQ ID NO: 1653252 - RNA, 19 nt, Human
uugaagacuuuucuuucag

SEQ ID NO: 1653253 - RNA, 17 nt, Human
uugaagacagagcuaca

SEQ ID NO: 1653254 - RNA, 22 nt, Human
ugugcacaugcacgugugugca

SEQ ID NO: 1653255 - RNA, 14 nt, Human
ugugccucugccug

SEQ ID NO: 1653256 - RNA, 13 nt, Human
ugugccucuggga

SEQ ID NO: 1653257 - RNA, 15 nt, Human
ugugccucugggacu

SEQ ID NO: 1653258 - RNA, 16 nt, Human
ugugccucugggacug

SEQ ID NO: 1653259 - RNA, 22 nt, Human
ugugcuuauguaugagguacaa

SEQ ID NO: 1653260 - RNA, 14 nt, Human
ugugcgcuaaacuu

SEQ ID NO: 1653261 - RNA, 15 nt, Human
ugugccucugccugu

SEQ ID NO: 1653262 - RNA, 17 nt, Human
ugugccucugggacugg

SEQ ID NO: 1653263 - RNA, 19 nt, Human
ugugcgcuaaacuuuucug

SEQ ID NO: 1653264 - RNA, 22 nt, Human
ugugcgcuaaacuuuucugaua

SEQ ID NO: 1653265 - RNA, 23 nt, Human
ugugcgcuaaacuuuucugauag

SEQ ID NO: 1653266 - RNA, 20 nt, Human
ugugcgugcauguguguuca

SEQ ID NO: 1653267 - RNA, 15 nt, Human
uguggacacagcucu

SEQ ID NO: 1653268 - RNA, 16 nt, Human
uguggacacagcucuu

SEQ ID NO: 1653269 - RNA, 21 nt, Human
uguggcuccuggggguucuuu

SEQ ID NO: 1653270 - RNA, 12 nt, Human
uguggagaagcg

SEQ ID NO: 1653271 - RNA, 21 nt, Human
uguggagaagcggcuggcagc

SEQ ID NO: 1653272 - RNA, 17 nt, Human
uguggaaaaugaaaauu

SEQ ID NO: 1653273 - RNA, 14 nt, Human
uguggacacagcuc

SEQ ID NO: 1653274 - RNA, 12 nt, Human
ugugggaagggg

SEQ ID NO: 1653275 - RNA, 13 nt, Human
ugugauauaagug

SEQ ID NO: 1653276 - RNA, 21 nt, Human
ugugauacaaugcugugcccu

SEQ ID NO: 1653277 - RNA, 15 nt, Human
ugugagucaccaagc

SEQ ID NO: 1653278 - RNA, 18 nt, Human
ugugaguacuacaguccu

SEQ ID NO: 1653279 - RNA, 19 nt, Human
ugugaguacuacaguccuc

SEQ ID NO: 1653280 - RNA, 20 nt, Human
ugugaguacuacaguccucc

SEQ ID NO: 1653281 - RNA, 23 nt, Human
ugugaguacuacaguccucccau

SEQ ID NO: 1653282 - RNA, 16 nt, Human
ugugaaucauuuuacc

SEQ ID NO: 1653283 - RNA, 21 nt, Human
ugugacaaggauugcuacugu

SEQ ID NO: 1653284 - RNA, 15 nt, Human
ugugacauguuuuau

SEQ ID NO: 1653285 - RNA, 22 nt, Human
ugugaccacugcagaagacagu

SEQ ID NO: 1653286 - RNA, 16 nt, Human
ugucucaggucccugc

SEQ ID NO: 1653287 - RNA, 17 nt, Human
ugucucaggucccugca

SEQ ID NO: 1653288 - RNA, 20 nt, Human
ugucucaagagggcacuggu

SEQ ID NO: 1653289 - RNA, 21 nt, Human
ugucucaagagggcacuggug

SEQ ID NO: 1653290 - RNA, 23 nt, Human
ugucucaagagggcacugguggc

SEQ ID NO: 1653291 - RNA, 13 nt, Human
uguccccaccgca

SEQ ID NO: 1653292 - RNA, 21 nt, Human
ugucucaguccaugaagaugu

SEQ ID NO: 1653293 - RNA, 22 nt, Human
ugucucaguccaugaagaugua

SEQ ID NO: 1653294 - RNA, 14 nt, Human
ugucuuuuuucuaa

SEQ ID NO: 1653295 - RNA, 19 nt, Human
ugucuuuggacccugaggc

SEQ ID NO: 1653296 - RNA, 22 nt, Human
ugucuuuggacccugaggccca

SEQ ID NO: 1653297 - RNA, 18 nt, Human
ugucuuuggacccugagg

SEQ ID NO: 1653298 - RNA, 13 nt, Human
ugugaaacauguu

SEQ ID NO: 1653299 - RNA, 13 nt, Human
ugugaaaggaaag

SEQ ID NO: 1653300 - RNA, 14 nt, Human
ugugaaaggaaaga

SEQ ID NO: 1653301 - RNA, 17 nt, Human
uguacgucugacaggca

SEQ ID NO: 1653302 - RNA, 16 nt, Human
uguacgucugacaggc

SEQ ID NO: 1653303 - RNA, 12 nt, Human
uguacuccuccc

SEQ ID NO: 1653304 - RNA, 13 nt, Human
uguacuccuccca

SEQ ID NO: 1653305 - RNA, 13 nt, Human
uguacucaauuuu

SEQ ID NO: 1653306 - RNA, 19 nt, Human
uguacugcauaugaaagga

SEQ ID NO: 1653307 - RNA, 17 nt, Human
uguagauaauacaguuc

SEQ ID NO: 1653308 - RNA, 14 nt, Human
uguaccucuugagc

SEQ ID NO: 1653309 - RNA, 22 nt, Human
uguaccucuugagccuugaacu

SEQ ID NO: 1653310 - RNA, 23 nt, Human
uguaccucuugagccuugaacuu

SEQ ID NO: 1653311 - RNA, 15 nt, Human
uguaccgcaauguga

SEQ ID NO: 1653312 - RNA, 15 nt, Human
uguaaucacagcuac

SEQ ID NO: 1653313 - RNA, 17 nt, Human
uguaaauuaacuuuuau

SEQ ID NO: 1653314 - RNA, 16 nt, Human
uguaaauuaacuuuua

SEQ ID NO: 1653315 - RNA, 15 nt, Human
uguaaauuaacuuuu

SEQ ID NO: 1653316 - RNA, 14 nt, Human
uguaaauuaacuuu

SEQ ID NO: 1653317 - RNA, 13 nt, Human
uguaaauuaacuu

SEQ ID NO: 1653318 - RNA, 23 nt, Human
ugucccaaaaagaaaggagggga

SEQ ID NO: 1653319 - RNA, 12 nt, Human
ugucagugugac

SEQ ID NO: 1653320 - RNA, 20 nt, Human
ugucagugugacugaucucu

SEQ ID NO: 1653321 - RNA, 14 nt, Human
uguauuuguuugca

SEQ ID NO: 1653322 - RNA, 14 nt, Human
uguaugcacuuugu

SEQ ID NO: 1653323 - RNA, 16 nt, Human
uguaugauucccagcc

SEQ ID NO: 1653324 - RNA, 16 nt, Human
uguauagaaccucuuu

SEQ ID NO: 1653325 - RNA, 19 nt, Human
uguaucccaugagccucag

SEQ ID NO: 1653326 - RNA, 23 nt, Human
uguaucccaugagccucagcauc

SEQ ID NO: 1653327 - RNA, 22 nt, Human
uguguuuaggaacuacugagga

SEQ ID NO: 1653328 - RNA, 13 nt, Human
uguguuuauuguc

SEQ ID NO: 1653329 - RNA, 17 nt, Human
ugugugaagugagugag

SEQ ID NO: 1653330 - RNA, 19 nt, Human
ugugucagcauagaaguaa

SEQ ID NO: 1653331 - RNA, 18 nt, Human
uguuaaaccaugggauaa

SEQ ID NO: 1653332 - RNA, 20 nt, Human
uguuaaaccaugggauaaau

SEQ ID NO: 1653333 - RNA, 21 nt, Human
uguuaaaccaugggauaaaug

SEQ ID NO: 1653334 - RNA, 23 nt, Human
uguuaaaccaugggauaaaugcc

SEQ ID NO: 1653335 - RNA, 13 nt, Human
uguuacauuuuua

SEQ ID NO: 1653336 - RNA, 22 nt, Human
uguuacauuuuuaagugcugca

SEQ ID NO: 1653337 - RNA, 15 nt, Human
uguuacugucuucag

SEQ ID NO: 1653338 - RNA, 16 nt, Human
uguuacugucuucagu

SEQ ID NO: 1653339 - RNA, 16 nt, Human
uguuagaucuaguuca

SEQ ID NO: 1653340 - RNA, 12 nt, Human
uguuauaaucuu

SEQ ID NO: 1653341 - RNA, 15 nt, Human
uguucagcuccagcu

SEQ ID NO: 1653342 - RNA, 16 nt, Human
uguucagcuccagcuc

SEQ ID NO: 1653343 - RNA, 18 nt, Human
uguucagcuccagcucac

SEQ ID NO: 1653344 - RNA, 11 nt, Human
uguucagcugg

SEQ ID NO: 1653345 - RNA, 14 nt, Human
uguucagcuccagc

SEQ ID NO: 1653346 - RNA, 16 nt, Human
uguucacagccagacu

SEQ ID NO: 1653347 - RNA, 13 nt, Human
uguucauaaauaa

SEQ ID NO: 1653348 - RNA, 20 nt, Human
uguucaugaaagauucaaug

SEQ ID NO: 1653349 - RNA, 12 nt, Human
uguucuauagcu

SEQ ID NO: 1653350 - RNA, 16 nt, Human
uguucucugaggacac

SEQ ID NO: 1653351 - RNA, 18 nt, Human
uguucucugaggacacua

SEQ ID NO: 1653352 - RNA, 12 nt, Human
uguucucugccc

SEQ ID NO: 1653353 - RNA, 18 nt, Human
uguucugacccugcuuca

SEQ ID NO: 1653354 - RNA, 17 nt, Human
uguucugcacacagcac

SEQ ID NO: 1653355 - RNA, 14 nt, Human
uguucuuucuggcu

SEQ ID NO: 1653356 - RNA, 19 nt, Human
uguucucugcccuccaaga

SEQ ID NO: 1653357 - RNA, 15 nt, Human
uguucugacccugcu

SEQ ID NO: 1653358 - RNA, 20 nt, Human
uguugaaacggaugauuucu

SEQ ID NO: 1653359 - RNA, 22 nt, Human
uguucuuucuggcuaugcauuu

SEQ ID NO: 1653360 - RNA, 20 nt, Human
uguucuuucuggcuaugcau

SEQ ID NO: 1653361 - RNA, 21 nt, Human
uguugaaacggaugauuucua

SEQ ID NO: 1653362 - RNA, 22 nt, Human
uguugaaacggaugauuucuau

SEQ ID NO: 1653363 - RNA, 23 nt, Human
uguugaaacggaugauuucuaug

SEQ ID NO: 1653364 - RNA, 11 nt, Human
uguugaaagau

SEQ ID NO: 1653365 - RNA, 13 nt, Human
uguugcugccuca

SEQ ID NO: 1653366 - RNA, 19 nt, Human
uguugaagagguuuuaaag

SEQ ID NO: 1653367 - RNA, 11 nt, Human
uguuggccagg

SEQ ID NO: 1653368 - RNA, 14 nt, Human
uguugcugccucau

SEQ ID NO: 1653369 - RNA, 21 nt, Human
uguuggagaagaacugaaauc

SEQ ID NO: 1653370 - RNA, 13 nt, Human
uguuggccaggcu

SEQ ID NO: 1653371 - RNA, 18 nt, Human
uguuggccaggcugcucu

SEQ ID NO: 1653372 - RNA, 14 nt, Human
uguuggccaggcug

SEQ ID NO: 1653373 - RNA, 14 nt, Human
uguuguuuguuuag

SEQ ID NO: 1653374 - RNA, 17 nt, Human
uguuuacagauccccaa

SEQ ID NO: 1653375 - RNA, 14 nt, Human
uguuuaaaaucauu

SEQ ID NO: 1653376 - RNA, 13 nt, Human
uguuuaaaaucau

SEQ ID NO: 1653377 - RNA, 23 nt, Human
uuacaauaaaaucuugaaaaugc

SEQ ID NO: 1653378 - RNA, 20 nt, Human
uuacagagacagaaagcaga

SEQ ID NO: 1653379 - RNA, 22 nt, Human
uuacauggcuggagcuagaauu

SEQ ID NO: 1653380 - RNA, 23 nt, Human
uuacauggcuggagcuagaauuu

SEQ ID NO: 1653381 - RNA, 14 nt, Human
uuacauuuccuaaa

SEQ ID NO: 1653382 - RNA, 14 nt, Human
uuacauuuguauaa

SEQ ID NO: 1653383 - RNA, 15 nt, Human
uuacauuuguauaaa

SEQ ID NO: 1653384 - RNA, 16 nt, Human
uuacggaacucaaaua

SEQ ID NO: 1653385 - RNA, 20 nt, Human
uuacgguuuuccagguuuaa

SEQ ID NO: 1653386 - RNA, 22 nt, Human
uuaccuuuuuuauacauaaaca

SEQ ID NO: 1653387 - RNA, 20 nt, Human
uuaccuuuuuuauacauaaa

SEQ ID NO: 1653388 - RNA, 19 nt, Human
uuaccuuuuuuauacauaa

SEQ ID NO: 1653389 - RNA, 23 nt, Human
uuacauuuuuaagugcugcauuu

SEQ ID NO: 1653390 - RNA, 22 nt, Human
uuacauuuuuaagugcugcauu

SEQ ID NO: 1653391 - RNA, 21 nt, Human
uuacauuuuuaagugcugcau

SEQ ID NO: 1653392 - RNA, 20 nt, Human
uuacauuuuuaagugcugca

SEQ ID NO: 1653393 - RNA, 14 nt, Human
uuaccagcagagca

SEQ ID NO: 1653394 - RNA, 21 nt, Human
uuaccacuuguguuuugcaag

SEQ ID NO: 1653395 - RNA, 21 nt, Human
uuaauagguuuggacaaaaug

SEQ ID NO: 1653396 - RNA, 18 nt, Human
uuaauaucaucaguauug

SEQ ID NO: 1653397 - RNA, 18 nt, Human
uuaaugucacaggcaggu

SEQ ID NO: 1653398 - RNA, 14 nt, Human
uuaauggaaauguu

SEQ ID NO: 1653399 - RNA, 17 nt, Human
uuaaugucacaggcagg

SEQ ID NO: 1653400 - RNA, 22 nt, Human
uuaaugucaauucuugccaaau

SEQ ID NO: 1653401 - RNA, 21 nt, Human
uuaaggaagacaaugugaaaa

SEQ ID NO: 1653402 - RNA, 20 nt, Human
uuaaggaugcuuguacauaa

SEQ ID NO: 1653403 - RNA, 19 nt, Human
uuaaggaugcuuguacaua

SEQ ID NO: 1653404 - RNA, 18 nt, Human
uuaaggaugcuuguacau

SEQ ID NO: 1653405 - RNA, 17 nt, Human
uuaaggaugcuuguaca

SEQ ID NO: 1653406 - RNA, 22 nt, Human
uuaaggaugcuuguacauaaug

SEQ ID NO: 1653407 - RNA, 13 nt, Human
uuaaggauuuuau

SEQ ID NO: 1653408 - RNA, 15 nt, Human
uuaaggauuuuaugc

SEQ ID NO: 1653409 - RNA, 18 nt, Human
uuaaggauuuuaugcuuu

SEQ ID NO: 1653410 - RNA, 20 nt, Human
uuaaggauuuuaugcuuuaa

SEQ ID NO: 1653411 - RNA, 16 nt, Human
uuaauaauguuucaaa

SEQ ID NO: 1653412 - RNA, 20 nt, Human
uuaauaauuauaugcuauuu

SEQ ID NO: 1653413 - RNA, 23 nt, Human
uuaauaauuauaugcuauuucua

SEQ ID NO: 1653414 - RNA, 16 nt, Human
uuaauagguuuggaca

SEQ ID NO: 1653415 - RNA, 18 nt, Human
uuaauaauuauaugcuau

SEQ ID NO: 1653416 - RNA, 18 nt, Human
uuaauaauguuucaaaca

SEQ ID NO: 1653417 - RNA, 18 nt, Human
uuaaauaguaaaaauaaa

SEQ ID NO: 1653418 - RNA, 15 nt, Human
uuaaagcuuccauug

SEQ ID NO: 1653419 - RNA, 20 nt, Human
uuaaagcuuccauuguuguc

SEQ ID NO: 1653420 - RNA, 19 nt, Human
uuaaauagcuuuuuucucu

SEQ ID NO: 1653421 - RNA, 18 nt, Human
uuaaaugcaccuggaaua

SEQ ID NO: 1653422 - RNA, 17 nt, Human
uuaaaugcaccuggaau

SEQ ID NO: 1653423 - RNA, 16 nt, Human
uuaaaugcaccuggaa

SEQ ID NO: 1653424 - RNA, 12 nt, Human
uuaacauguuaa

SEQ ID NO: 1653425 - RNA, 18 nt, Human
uuaacauguuaaaccaug

SEQ ID NO: 1653426 - RNA, 19 nt, Human
uuaacauguuaaaccaugg

SEQ ID NO: 1653427 - RNA, 12 nt, Human
uuaaaugcugcu

SEQ ID NO: 1653428 - RNA, 13 nt, Human
uuaaaugcccagc

SEQ ID NO: 1653429 - RNA, 18 nt, Human
uuaaaugcccagccccuu

SEQ ID NO: 1653430 - RNA, 18 nt, Human
uuaaacuuaaucuaaaug

SEQ ID NO: 1653431 - RNA, 16 nt, Human
uuaaacuuaaucuaaa

SEQ ID NO: 1653432 - RNA, 19 nt, Human
uuaaaagaaugauuaugaa

SEQ ID NO: 1653433 - RNA, 22 nt, Human
uuaaacuuaaucuaaauggaac

SEQ ID NO: 1653434 - RNA, 20 nt, Human
uuaaacuuaaucuaaaugga

SEQ ID NO: 1653435 - RNA, 20 nt, Human
uuaaagcuuauuaaaacuca

SEQ ID NO: 1653436 - RNA, 23 nt, Human
uguuuuaaaaugagaaaucuaaa

SEQ ID NO: 1653437 - RNA, 13 nt, Human
uguuuuugucuua

SEQ ID NO: 1653438 - RNA, 23 nt, Human
uguuuccuggcacugcuuccagu

SEQ ID NO: 1653439 - RNA, 20 nt, Human
uguuuccuggcacugcuucc

SEQ ID NO: 1653440 - RNA, 21 nt, Human
uguuuccuggcacugcuucca

SEQ ID NO: 1653441 - RNA, 22 nt, Human
uguuuccuggcacugcuuccag

SEQ ID NO: 1653442 - RNA, 12 nt, Human
uguuuguuuagu

SEQ ID NO: 1653443 - RNA, 17 nt, Human
uguuuguugucagcuga

SEQ ID NO: 1653444 - RNA, 18 nt, Human
uguuuuaaaaugagaaau

SEQ ID NO: 1653445 - RNA, 21 nt, Human
uguuuguuuagucuugucuca

SEQ ID NO: 1653446 - RNA, 16 nt, Human
ugggacagggcauggc

SEQ ID NO: 1653447 - RNA, 16 nt, Human
ugggacaugggaaagg

SEQ ID NO: 1653448 - RNA, 19 nt, Human
ugggacauuugcucaugga

SEQ ID NO: 1653449 - RNA, 20 nt, Human
ugggacauuugcucauggaa

SEQ ID NO: 1653450 - RNA, 23 nt, Human
ugggagcugccuguucagcucca

SEQ ID NO: 1653451 - RNA, 14 nt, Human
uggcuuuguauaga

SEQ ID NO: 1653452 - RNA, 22 nt, Human
uggcuuuguauagaaccucuuu

SEQ ID NO: 1653453 - RNA, 15 nt, Human
uggcuguacccagga

SEQ ID NO: 1653454 - RNA, 15 nt, Human
uggcugggggccuca

SEQ ID NO: 1653455 - RNA, 14 nt, Human
uggcugggggccuc

SEQ ID NO: 1653456 - RNA, 22 nt, Human
uggcugguuagagguucccuuu

SEQ ID NO: 1653457 - RNA, 14 nt, Human
uggcuuuucacugc

SEQ ID NO: 1653458 - RNA, 15 nt, Human
uggcuuuucacugcu

SEQ ID NO: 1653459 - RNA, 22 nt, Human
ugggaaugaaugucagugugac

SEQ ID NO: 1653460 - RNA, 18 nt, Human
ugggacagucaccucaug

SEQ ID NO: 1653461 - RNA, 20 nt, Human
ugggacagucaccucaugga

SEQ ID NO: 1653462 - RNA, 21 nt, Human
ugggacagucaccucauggaa

SEQ ID NO: 1653463 - RNA, 19 nt, Human
uggcucuuccaggcuggga

SEQ ID NO: 1653464 - RNA, 16 nt, Human
uggcucuuccaggcug

SEQ ID NO: 1653465 - RNA, 12 nt, Human
uggcugggggcc

SEQ ID NO: 1653466 - RNA, 13 nt, Human
uggcucuuccagg

SEQ ID NO: 1653467 - RNA, 15 nt, Human
uggcucuuccaggcu

SEQ ID NO: 1653468 - RNA, 14 nt, Human
uggcuaaauucaug

SEQ ID NO: 1653469 - RNA, 22 nt, Human
uggcucagguggggucacucug

SEQ ID NO: 1653470 - RNA, 20 nt, Human
uggcucagguggggucacuc

SEQ ID NO: 1653471 - RNA, 15 nt, Human
uggcgcugccccugg

SEQ ID NO: 1653472 - RNA, 14 nt, Human
uggcgcugccccug

SEQ ID NO: 1653473 - RNA, 22 nt, Human
uggcgugcaguggugcgaucug

SEQ ID NO: 1653474 - RNA, 20 nt, Human
uggccuucggccuccauccu

SEQ ID NO: 1653475 - RNA, 20 nt, Human
uggccuuucauauuuuagcu

SEQ ID NO: 1653476 - RNA, 15 nt, Human
uggccagaugcacca

SEQ ID NO: 1653477 - RNA, 17 nt, Human
uggccuucggccuccau

SEQ ID NO: 1653478 - RNA, 18 nt, Human
uggccuucggccuccauc

SEQ ID NO: 1653479 - RNA, 14 nt, Human
ugggccuccugugu

SEQ ID NO: 1653480 - RNA, 18 nt, Human
ugggccuucagggaguga

SEQ ID NO: 1653481 - RNA, 16 nt, Human
ugggccuccugugugu

SEQ ID NO: 1653482 - RNA, 22 nt, Human
ugggccuccugugugugcgccu

SEQ ID NO: 1653483 - RNA, 16 nt, Human
ugggagcuuuuguaga

SEQ ID NO: 1653484 - RNA, 24 nt, Human
ugggagcugccuguucagcuccag

SEQ ID NO: 1653485 - RNA, 17 nt, Human
ugggcgugagaccugcc

SEQ ID NO: 1653486 - RNA, 18 nt, Human
ugggcgugagaccugccc

SEQ ID NO: 1653487 - RNA, 19 nt, Human
ugggcgugagaccugcccc

SEQ ID NO: 1653488 - RNA, 18 nt, Human
ugggcuucaguggcagcu

SEQ ID NO: 1653489 - RNA, 19 nt, Human
ugggcuucaguggcagcug

SEQ ID NO: 1653490 - RNA, 19 nt, Human
ugggcuuggggaccagagc

SEQ ID NO: 1653491 - RNA, 20 nt, Human
ugggcuucaguggcagcugc

SEQ ID NO: 1653492 - RNA, 16 nt, Human
uggggcagcuugaggg

SEQ ID NO: 1653493 - RNA, 21 nt, Human
ugggcuuggggaccagagcug

SEQ ID NO: 1653494 - RNA, 22 nt, Human
ugggcuuggggaccagagcugc

SEQ ID NO: 1653495 - RNA, 21 nt, Human
ugggugucaagagggucugag

SEQ ID NO: 1653496 - RNA, 23 nt, Human
ugggugucaagagggucugagga

SEQ ID NO: 1653497 - RNA, 14 nt, Human
uggguguggcgcag

SEQ ID NO: 1653498 - RNA, 23 nt, Human
uggguucaagcgauucuucugcu

SEQ ID NO: 1653499 - RNA, 16 nt, Human
uggguucacugcaacc

SEQ ID NO: 1653500 - RNA, 21 nt, Human
uggguuccuuccucugagccu

SEQ ID NO: 1653501 - RNA, 22 nt, Human
uggguuccuuccucugagccuu

SEQ ID NO: 1653502 - RNA, 21 nt, Human
uggguuccagcaauucuccug

SEQ ID NO: 1653503 - RNA, 17 nt, Human
uggguuggaaaacagua

SEQ ID NO: 1653504 - RNA, 19 nt, Human
ugggguggggggggugcug

SEQ ID NO: 1653505 - RNA, 17 nt, Human
ugggguggggaccucag

SEQ ID NO: 1653506 - RNA, 21 nt, Human
ugggguggggggggugcuggg

SEQ ID NO: 1653507 - RNA, 22 nt, Human
ugggguggggggggugcugggc

SEQ ID NO: 1653508 - RNA, 17 nt, Human
uggguagacacacauga

SEQ ID NO: 1653509 - RNA, 16 nt, Human
uggguagacacacaug

SEQ ID NO: 1653510 - RNA, 16 nt, Human
uggaauacucuuauau

SEQ ID NO: 1653511 - RNA, 21 nt, Human
uggaagugugugaucuguggg

SEQ ID NO: 1653512 - RNA, 14 nt, Human
uggaagacagcucu

SEQ ID NO: 1653513 - RNA, 15 nt, Human
uggaagacagcucuu

SEQ ID NO: 1653514 - RNA, 15 nt, Human
uggaaaauaaauuau

SEQ ID NO: 1653515 - RNA, 16 nt, Human
uggaaaauaaauuauu

SEQ ID NO: 1653516 - RNA, 11 nt, Human
uggaaaauaaa

SEQ ID NO: 1653517 - RNA, 15 nt, Human
uggaaaauaaaucaa

SEQ ID NO: 1653518 - RNA, 17 nt, Human
uggaaaaauagccugcc

SEQ ID NO: 1653519 - RNA, 11 nt, Human
uggaagacagc

SEQ ID NO: 1653520 - RNA, 12 nt, Human
uggaagacagcu

SEQ ID NO: 1653521 - RNA, 14 nt, Human
uggaacucucgagc

SEQ ID NO: 1653522 - RNA, 18 nt, Human
ugcuuguuaacugagugc

SEQ ID NO: 1653523 - RNA, 14 nt, Human
ugcuuguuuccuag

SEQ ID NO: 1653524 - RNA, 12 nt, Human
ugcuuuaaacau

SEQ ID NO: 1653525 - RNA, 16 nt, Human
ugcuuucagauacugg

SEQ ID NO: 1653526 - RNA, 17 nt, Human
ugcuuucagauacugga

SEQ ID NO: 1653527 - RNA, 20 nt, Human
ugcuuucagauacuggauug

SEQ ID NO: 1653528 - RNA, 21 nt, Human
ugcuuucagauacuggauugu

SEQ ID NO: 1653529 - RNA, 12 nt, Human
ugcuuucagaua

SEQ ID NO: 1653530 - RNA, 21 nt, Human
ugcuuccagugaggcucugcc

SEQ ID NO: 1653531 - RNA, 19 nt, Human
ugcuuccagugaggcucug

SEQ ID NO: 1653532 - RNA, 20 nt, Human
ugcuuccagugaggcucugc

SEQ ID NO: 1653533 - RNA, 13 nt, Human
ugcugccucaugc

SEQ ID NO: 1653534 - RNA, 14 nt, Human
ugcugccuccagaa

SEQ ID NO: 1653535 - RNA, 18 nt, Human
ugcuuccagugaggcucu

SEQ ID NO: 1653536 - RNA, 12 nt, Human
ugcuucucacug

SEQ ID NO: 1653537 - RNA, 16 nt, Human
ugcuucuucagagacu

SEQ ID NO: 1653538 - RNA, 14 nt, Human
ugcuucuguuuuau

SEQ ID NO: 1653539 - RNA, 14 nt, Human
uggcagugggagcu

SEQ ID NO: 1653540 - RNA, 15 nt, Human
uggcagugggagcug

SEQ ID NO: 1653541 - RNA, 16 nt, Human
uggcagugggagcugc

SEQ ID NO: 1653542 - RNA, 19 nt, Human
uggcagugggagcugccug

SEQ ID NO: 1653543 - RNA, 15 nt, Human
uggcauaacauaaau

SEQ ID NO: 1653544 - RNA, 17 nt, Human
uggcauaacauaaaucu

SEQ ID NO: 1653545 - RNA, 22 nt, Human
uggccacuccagaccccuggcu

SEQ ID NO: 1653546 - RNA, 20 nt, Human
uggcagugggagcugccugu

SEQ ID NO: 1653547 - RNA, 23 nt, Human
uggcagcugcgguccacccagga

SEQ ID NO: 1653548 - RNA, 21 nt, Human
uggcagcugcgguccacccag

SEQ ID NO: 1653549 - RNA, 22 nt, Human
uggcagcugcgguccacccagg

SEQ ID NO: 1653550 - RNA, 14 nt, Human
uggcacugcuucca

SEQ ID NO: 1653551 - RNA, 16 nt, Human
uggcacugcuuccagu

SEQ ID NO: 1653552 - RNA, 18 nt, Human
uggcacugcuuccaguga

SEQ ID NO: 1653553 - RNA, 14 nt, Human
uggaugccuggugg

SEQ ID NO: 1653554 - RNA, 15 nt, Human
uggaugccugguggc

SEQ ID NO: 1653555 - RNA, 20 nt, Human
uggagaggcccggccucuca

SEQ ID NO: 1653556 - RNA, 13 nt, Human
uggagauguuuag

SEQ ID NO: 1653557 - RNA, 12 nt, Human
uggacaggcaug

SEQ ID NO: 1653558 - RNA, 16 nt, Human
uggacaggcauguucu

SEQ ID NO: 1653559 - RNA, 17 nt, Human
uggacaggcauguucuc

SEQ ID NO: 1653560 - RNA, 22 nt, Human
uggaggcaugugaugagaggaa

SEQ ID NO: 1653561 - RNA, 17 nt, Human
ugcacagcuaacaugga

SEQ ID NO: 1653562 - RNA, 23 nt, Human
ugcacagaguuguuacauuuuua

SEQ ID NO: 1653563 - RNA, 22 nt, Human
ugcacagaguuguuacauuuuu

SEQ ID NO: 1653564 - RNA, 21 nt, Human
ugcacagaguuguuacauuuu

SEQ ID NO: 1653565 - RNA, 22 nt, Human
ugaagucuuuguacagacaaca

SEQ ID NO: 1653566 - RNA, 12 nt, Human
ugaagugaaacu

SEQ ID NO: 1653567 - RNA, 16 nt, Human
ugaaggcuggguucug

SEQ ID NO: 1653568 - RNA, 19 nt, Human
ugaagucucugaagugaaa

SEQ ID NO: 1653569 - RNA, 17 nt, Human
ugaagucuuuguacaga

SEQ ID NO: 1653570 - RNA, 20 nt, Human
ugaagucuuuguacagacaa

SEQ ID NO: 1653571 - RNA, 19 nt, Human
ugcacagugcaucucagcc

SEQ ID NO: 1653572 - RNA, 20 nt, Human
ugcacagugcaucucagccc

SEQ ID NO: 1653573 - RNA, 18 nt, Human
ugcacagugcaucucagc

SEQ ID NO: 1653574 - RNA, 23 nt, Human
ugcacagcuaacauggaaguacu

SEQ ID NO: 1653575 - RNA, 18 nt, Human
ugcacagcuaacauggaa

SEQ ID NO: 1653576 - RNA, 20 nt, Human
ugcacagcuaacauggaagu

SEQ ID NO: 1653577 - RNA, 15 nt, Human
ugcacaucaaaauau

SEQ ID NO: 1653578 - RNA, 13 nt, Human
ugcagcuuuaaaa

SEQ ID NO: 1653579 - RNA, 16 nt, Human
ugcagcaauaaagcag

SEQ ID NO: 1653580 - RNA, 15 nt, Human
ugcagcaauaaagca

SEQ ID NO: 1653581 - RNA, 14 nt, Human
ugcagcaauaaagc

SEQ ID NO: 1653582 - RNA, 18 nt, Human
ugcaggaccucaggugag

SEQ ID NO: 1653583 - RNA, 15 nt, Human
ugcaggaccucaggu

SEQ ID NO: 1653584 - RNA, 16 nt, Human
ugcaggaccucaggug

SEQ ID NO: 1653585 - RNA, 22 nt, Human
ugcagcuuuaaaaaauuaaucu

SEQ ID NO: 1653586 - RNA, 14 nt, Human
ugcaggaccucagg

SEQ ID NO: 1653587 - RNA, 21 nt, Human
ugcacuugcagacucuacaga

SEQ ID NO: 1653588 - RNA, 22 nt, Human
ugcacggugaauggcuuuguau

SEQ ID NO: 1653589 - RNA, 23 nt, Human
ugcacggugaauggcuuuguaua

SEQ ID NO: 1653590 - RNA, 19 nt, Human
ugcacguacacacacauac

SEQ ID NO: 1653591 - RNA, 16 nt, Human
ugcacguacacacaca

SEQ ID NO: 1653592 - RNA, 15 nt, Human
ugcacuuuguucugg

SEQ ID NO: 1653593 - RNA, 18 nt, Human
ugcacuuuguucuggcuc

SEQ ID NO: 1653594 - RNA, 19 nt, Human
ugcacuuuguucuggcucu

SEQ ID NO: 1653595 - RNA, 20 nt, Human
ugcacuuuguucuggcucuu

SEQ ID NO: 1653596 - RNA, 16 nt, Human
ugcagauaaacaguag

SEQ ID NO: 1653597 - RNA, 17 nt, Human
ugcagauaaacaguagu

SEQ ID NO: 1653598 - RNA, 19 nt, Human
ugcauguuacauaagauaa

SEQ ID NO: 1653599 - RNA, 15 nt, Human
ugcauuauauuuauu

SEQ ID NO: 1653600 - RNA, 20 nt, Human
ugcauuauauuuauuacugu

SEQ ID NO: 1653601 - RNA, 21 nt, Human
ugcauuauauuuauuacugua

SEQ ID NO: 1653602 - RNA, 18 nt, Human
ugcauccuccgccucccg

SEQ ID NO: 1653603 - RNA, 21 nt, Human
ugcauccuccgccucccgggu

SEQ ID NO: 1653604 - RNA, 17 nt, Human
ugcaucguuucaucuuc

SEQ ID NO: 1653605 - RNA, 15 nt, Human
ugcaucguuucaucu

SEQ ID NO: 1653606 - RNA, 16 nt, Human
ugcaggcagccaggcc

SEQ ID NO: 1653607 - RNA, 17 nt, Human
ugcaggcagccaggcca

SEQ ID NO: 1653608 - RNA, 18 nt, Human
ugcaggcagccaggccac

SEQ ID NO: 1653609 - RNA, 19 nt, Human
ugcaggcagccaggccaca

SEQ ID NO: 1653610 - RNA, 22 nt, Human
ugcaucagcugcugaaacaaca

SEQ ID NO: 1653611 - RNA, 20 nt, Human
ugccaucucaccuccugcug

SEQ ID NO: 1653612 - RNA, 21 nt, Human
ugccaucucaccuccugcugg

SEQ ID NO: 1653613 - RNA, 22 nt, Human
ugccaucucaccuccugcuggg

SEQ ID NO: 1653614 - RNA, 23 nt, Human
ugccaucucaccuccugcugggc

SEQ ID NO: 1653615 - RNA, 15 nt, Human
ugcccaccuggccuc

SEQ ID NO: 1653616 - RNA, 17 nt, Human
ugcccaccuggccucug

SEQ ID NO: 1653617 - RNA, 18 nt, Human
ugcccaccuggccucugc

SEQ ID NO: 1653618 - RNA, 19 nt, Human
ugcccaccuggccucugca

SEQ ID NO: 1653619 - RNA, 10 nt, Human
ugcccagccc

SEQ ID NO: 1653620 - RNA, 11 nt, Human
ugccagggaca

SEQ ID NO: 1653621 - RNA, 22 nt, Human
ugccagggacagaggggguggc

SEQ ID NO: 1653622 - RNA, 14 nt, Human
ugccagucaccccg

SEQ ID NO: 1653623 - RNA, 22 nt, Human
ugccaucccucccuccaccucc

SEQ ID NO: 1653624 - RNA, 21 nt, Human
ugccaucccucccuccaccuc

SEQ ID NO: 1653625 - RNA, 20 nt, Human
ugccaucccucccuccaccu

SEQ ID NO: 1653626 - RNA, 19 nt, Human
ugccaucccucccuccacc

SEQ ID NO: 1653627 - RNA, 15 nt, Human
ugccaucccucccuc

SEQ ID NO: 1653628 - RNA, 13 nt, Human
ugccuucagcucu

SEQ ID NO: 1653629 - RNA, 17 nt, Human
ugccuucagcucuacag

SEQ ID NO: 1653630 - RNA, 18 nt, Human
ugccuucagcucuacagc

SEQ ID NO: 1653631 - RNA, 15 nt, Human
ugccuggcggggugg

SEQ ID NO: 1653632 - RNA, 18 nt, Human
ugccuuauggaacacucu

SEQ ID NO: 1653633 - RNA, 20 nt, Human
ugccuuauggaacacucuga

SEQ ID NO: 1653634 - RNA, 21 nt, Human
ugccuuauggaacacucugag

SEQ ID NO: 1653635 - RNA, 22 nt, Human
ugccuuauggaacacucugaga

SEQ ID NO: 1653636 - RNA, 13 nt, Human
ugcgcaggcuggc

SEQ ID NO: 1653637 - RNA, 16 nt, Human
ugcgcaggcuggcccu

SEQ ID NO: 1653638 - RNA, 17 nt, Human
ugcgcaggcuggcccug

SEQ ID NO: 1653639 - RNA, 19 nt, Human
ugcgcaggcuggcccugcc

SEQ ID NO: 1653640 - RNA, 13 nt, Human
ugcgccuacagga

SEQ ID NO: 1653641 - RNA, 23 nt, Human
ugcggugcuaucucccccagccc

SEQ ID NO: 1653642 - RNA, 22 nt, Human
ugccuucucaacuccaaacuga

SEQ ID NO: 1653643 - RNA, 17 nt, Human
ugccuucucaacuccaa

SEQ ID NO: 1653644 - RNA, 22 nt, Human
ugccugaagucacacagugagu

SEQ ID NO: 1653645 - RNA, 18 nt, Human
ugccugaagucacacagu

SEQ ID NO: 1653646 - RNA, 16 nt, Human
ugccuccuuugugagg

SEQ ID NO: 1653647 - RNA, 17 nt, Human
ugccuccuuugugagga

SEQ ID NO: 1653648 - RNA, 18 nt, Human
ugccuccuuugugaggaa

SEQ ID NO: 1653649 - RNA, 23 nt, Human
ugccuaaggacuucuuuaauuuu

SEQ ID NO: 1653650 - RNA, 19 nt, Human
ugccuaaggcugaacuugu

SEQ ID NO: 1653651 - RNA, 11 nt, Human
ugcccagcccc

SEQ ID NO: 1653652 - RNA, 12 nt, Human
ugcccagccccu

SEQ ID NO: 1653653 - RNA, 23 nt, Human
ugcccaggcuggcgugcaguggu

SEQ ID NO: 1653654 - RNA, 22 nt, Human
ugccuccccuccucugcuugcc

SEQ ID NO: 1653655 - RNA, 19 nt, Human
ugccuccccuccucugcuu

SEQ ID NO: 1653656 - RNA, 23 nt, Human
ugccuccccuccucugcuugcca

SEQ ID NO: 1653657 - RNA, 18 nt, Human
ugccuccccuccucugcu

SEQ ID NO: 1653658 - RNA, 20 nt, Human
ugcugauggugcaaugaccu

SEQ ID NO: 1653659 - RNA, 23 nt, Human
ugcugauggugcaaugaccuuuc

SEQ ID NO: 1653660 - RNA, 15 nt, Human
ugcugcaguugccag

SEQ ID NO: 1653661 - RNA, 16 nt, Human
ugcugcaguugccagu

SEQ ID NO: 1653662 - RNA, 15 nt, Human
ugcugaguuugugcu

SEQ ID NO: 1653663 - RNA, 17 nt, Human
ugcugaguuugugcugg

SEQ ID NO: 1653664 - RNA, 15 nt, Human
ugcugacagacacag

SEQ ID NO: 1653665 - RNA, 16 nt, Human
ugcugacagacacagg

SEQ ID NO: 1653666 - RNA, 19 nt, Human
ugcugacagacacaggccc

SEQ ID NO: 1653667 - RNA, 19 nt, Human
ugcuccuggcccacugcau

SEQ ID NO: 1653668 - RNA, 17 nt, Human
ugcugaaugguuuucaa

SEQ ID NO: 1653669 - RNA, 18 nt, Human
ugcugaaugguuuucaaa

SEQ ID NO: 1653670 - RNA, 22 nt, Human
ugcugaaugguuuucaaaauaa

SEQ ID NO: 1653671 - RNA, 18 nt, Human
ugcugaauacagaggcaa

SEQ ID NO: 1653672 - RNA, 23 nt, Human
ugcugaauacagaggcaacugca

SEQ ID NO: 1653673 - RNA, 17 nt, Human
ugcugaaacaacaaaua

SEQ ID NO: 1653674 - RNA, 15 nt, Human
ugcgugcauaccacu

SEQ ID NO: 1653675 - RNA, 19 nt, Human
ugcuagaacucccuuucaa

SEQ ID NO: 1653676 - RNA, 16 nt, Human
ugcuaggaacacuccu

SEQ ID NO: 1653677 - RNA, 17 nt, Human
ugcuaggaacacuccuu

SEQ ID NO: 1653678 - RNA, 19 nt, Human
ugcuaggaacacuccuuca

SEQ ID NO: 1653679 - RNA, 20 nt, Human
ugcuagaacucccuuucaac

SEQ ID NO: 1653680 - RNA, 21 nt, Human
ugcuagaacucccuuucaaca

SEQ ID NO: 1653681 - RNA, 19 nt, Human
ugcuccucuccccagcaag

SEQ ID NO: 1653682 - RNA, 11 nt, Human
ugcucauggaa

SEQ ID NO: 1653683 - RNA, 14 nt, Human
ugcucaggagcccu

SEQ ID NO: 1653684 - RNA, 20 nt, Human
ugcuaggaacacuccuucac

SEQ ID NO: 1653685 - RNA, 19 nt, Human
ucuugucucagauuuuauu

SEQ ID NO: 1653686 - RNA, 18 nt, Human
ucuuuaaaaaaaaaauug

SEQ ID NO: 1653687 - RNA, 21 nt, Human
ucuuguuuuuuuuuuccacuu

SEQ ID NO: 1653688 - RNA, 18 nt, Human
ucuuguuuuuuuuuucca

SEQ ID NO: 1653689 - RNA, 19 nt, Human
ucuuuaaaaaaaaaauugg

SEQ ID NO: 1653690 - RNA, 15 nt, Human
ucuugccuuuuucau

SEQ ID NO: 1653691 - RNA, 11 nt, Human
ucuugcucugc

SEQ ID NO: 1653692 - RNA, 12 nt, Human
ucuugcucugcu

SEQ ID NO: 1653693 - RNA, 13 nt, Human
ucuugcucugcug

SEQ ID NO: 1653694 - RNA, 22 nt, Human
ucuuguauuaagaaugaaauac

SEQ ID NO: 1653695 - RNA, 21 nt, Human
ucuugaauuguaaggaaugau

SEQ ID NO: 1653696 - RNA, 16 nt, Human
ucuucuccacuggaug

SEQ ID NO: 1653697 - RNA, 21 nt, Human
ucuucucagaaggcaaaugac

SEQ ID NO: 1653698 - RNA, 12 nt, Human
ucuucuccaggc

SEQ ID NO: 1653699 - RNA, 13 nt, Human
ucuucuccaggcu

SEQ ID NO: 1653700 - RNA, 14 nt, Human
ucuucuccaggcug

SEQ ID NO: 1653701 - RNA, 15 nt, Human
ucuucuccaggcugu

SEQ ID NO: 1653702 - RNA, 16 nt, Human
ucuugaacuccuggcc

SEQ ID NO: 1653703 - RNA, 17 nt, Human
ucuugaacuccuggccu

SEQ ID NO: 1653704 - RNA, 18 nt, Human
ucuugaacuccuggccuc

SEQ ID NO: 1653705 - RNA, 14 nt, Human
ucuuagugugugca

SEQ ID NO: 1653706 - RNA, 16 nt, Human
ucuuaguggauguucu

SEQ ID NO: 1653707 - RNA, 15 nt, Human
ucuuauacauuugau

SEQ ID NO: 1653708 - RNA, 16 nt, Human
ucuuaaaauguuucaa

SEQ ID NO: 1653709 - RNA, 13 nt, Human
ucuuaugggcugg

SEQ ID NO: 1653710 - RNA, 15 nt, Human
ucuucaguaagccgu

SEQ ID NO: 1653711 - RNA, 14 nt, Human
ucuuccaggcuggg

SEQ ID NO: 1653712 - RNA, 21 nt, Human
ucuuccacaagagcccaggcc

SEQ ID NO: 1653713 - RNA, 16 nt, Human
ucuucaguaagccgug

SEQ ID NO: 1653714 - RNA, 13 nt, Human
ucuucuccacugg

SEQ ID NO: 1653715 - RNA, 23 nt, Human
ucuucucagaaggcaaaugacuu

SEQ ID NO: 1653716 - RNA, 19 nt, Human
ucuucuccacuuucuagcc

SEQ ID NO: 1653717 - RNA, 21 nt, Human
ucuucuccacuuucuagccag

SEQ ID NO: 1653718 - RNA, 17 nt, Human
ucuggcucuuccaggcu

SEQ ID NO: 1653719 - RNA, 15 nt, Human
ucuggcucuuccagg

SEQ ID NO: 1653720 - RNA, 16 nt, Human
ucuggcucuuccaggc

SEQ ID NO: 1653721 - RNA, 13 nt, Human
ucugggacacagu

SEQ ID NO: 1653722 - RNA, 12 nt, Human
ucugggacacag

SEQ ID NO: 1653723 - RNA, 23 nt, Human
ucuguacagagcccacgccccca

SEQ ID NO: 1653724 - RNA, 23 nt, Human
ucuggagcccacuguacuugcuc

SEQ ID NO: 1653725 - RNA, 17 nt, Human
ucuggcuaugcauuuga

SEQ ID NO: 1653726 - RNA, 14 nt, Human
ucuggcuaugcauu

SEQ ID NO: 1653727 - RNA, 18 nt, Human
ucuggagguacgaaaaga

SEQ ID NO: 1653728 - RNA, 22 nt, Human
ucuguggguuucuaaagcugcc

SEQ ID NO: 1653729 - RNA, 19 nt, Human
ucuguccgagcuuugaaaa

SEQ ID NO: 1653730 - RNA, 17 nt, Human
ucuguacgucugacagg

SEQ ID NO: 1653731 - RNA, 18 nt, Human
ucuguacgucugacaggc

SEQ ID NO: 1653732 - RNA, 23 nt, Human
ucuguggguuucuaaagcugcca

SEQ ID NO: 1653733 - RNA, 18 nt, Human
ucuuaaaaaguggaaaaa

SEQ ID NO: 1653734 - RNA, 17 nt, Human
ucuguuuuaugacuuca

SEQ ID NO: 1653735 - RNA, 22 nt, Human
ucuguuuuauaauuuugugaag

SEQ ID NO: 1653736 - RNA, 13 nt, Human
ucuguuuuaugac

SEQ ID NO: 1653737 - RNA, 15 nt, Human
ucuguuuuaugacuu

SEQ ID NO: 1653738 - RNA, 16 nt, Human
ucuguuuuaugacuuc

SEQ ID NO: 1653739 - RNA, 15 nt, Human
ucuguuauauaaaug

SEQ ID NO: 1653740 - RNA, 18 nt, Human
ucuguuauauaaaugguu

SEQ ID NO: 1653741 - RNA, 19 nt, Human
ucuuuugccguuauuaaaa

SEQ ID NO: 1653742 - RNA, 17 nt, Human
ucuuuugccguuauuaa

SEQ ID NO: 1653743 - RNA, 21 nt, Human
ucuuuucucccuuuuaauccu

SEQ ID NO: 1653744 - RNA, 17 nt, Human
ucuuucacauuuaaaua

SEQ ID NO: 1653745 - RNA, 16 nt, Human
ucuuuuugcuuugcuu

SEQ ID NO: 1653746 - RNA, 15 nt, Human
ugaaaagaaaaauga

SEQ ID NO: 1653747 - RNA, 19 nt, Human
ugaaaacuuuaugcuaagu

SEQ ID NO: 1653748 - RNA, 15 nt, Human
ugaaaagacuccaaa

SEQ ID NO: 1653749 - RNA, 16 nt, Human
ugaaaagacuccaaag

SEQ ID NO: 1653750 - RNA, 17 nt, Human
ugaaaagacuccaaaga

SEQ ID NO: 1653751 - RNA, 19 nt, Human
ugaaaagacuccaaagaaa

SEQ ID NO: 1653752 - RNA, 23 nt, Human
ugaaaugaggucagagccugcag

SEQ ID NO: 1653753 - RNA, 21 nt, Human
ugaaaugaggucagagccugc

SEQ ID NO: 1653754 - RNA, 22 nt, Human
ugaaaugaggucagagccugca

SEQ ID NO: 1653755 - RNA, 19 nt, Human
ugaaaugaggucagagccu

SEQ ID NO: 1653756 - RNA, 20 nt, Human
ugaaaugaggucagagccug

SEQ ID NO: 1653757 - RNA, 17 nt, Human
ugaaaucuuuuugcuuu

SEQ ID NO: 1653758 - RNA, 16 nt, Human
ugaaagggcccagaga

SEQ ID NO: 1653759 - RNA, 17 nt, Human
ugaaagggcccagagag

SEQ ID NO: 1653760 - RNA, 18 nt, Human
ugaaagggcccagagagg

SEQ ID NO: 1653761 - RNA, 13 nt, Human
ugaaagauucaau

SEQ ID NO: 1653762 - RNA, 12 nt, Human
ugaaaggaaaga

SEQ ID NO: 1653763 - RNA, 17 nt, Human
ugaaaggaaagaggcuc

SEQ ID NO: 1653764 - RNA, 18 nt, Human
ugaaagcagggacuugaa

SEQ ID NO: 1653765 - RNA, 19 nt, Human
ugaaagcagggacuugaac

SEQ ID NO: 1653766 - RNA, 23 nt, Human
ugaaagcagggacuugaacccau

SEQ ID NO: 1653767 - RNA, 22 nt, Human
ugaaagauggcugugccucugc

SEQ ID NO: 1653768 - RNA, 23 nt, Human
ugaaagauggcugugccucugcc

SEQ ID NO: 1653769 - RNA, 21 nt, Human
ugaaagauggcugugccucug

SEQ ID NO: 1653770 - RNA, 18 nt, Human
ugaaacccugucucuacu

SEQ ID NO: 1653771 - RNA, 22 nt, Human
ugaaaagacuccaaagaaaugu

SEQ ID NO: 1653772 - RNA, 17 nt, Human
ugaacugaacucugaca

SEQ ID NO: 1653773 - RNA, 19 nt, Human
ugaacugaacucugacaac

SEQ ID NO: 1653774 - RNA, 13 nt, Human
ugaacugauaaag

SEQ ID NO: 1653775 - RNA, 15 nt, Human
ugaacugauaaagau

SEQ ID NO: 1653776 - RNA, 14 nt, Human
ugaacugaacucug

SEQ ID NO: 1653777 - RNA, 18 nt, Human
ugaacucuucaaucucuu

SEQ ID NO: 1653778 - RNA, 20 nt, Human
ugaaccacaucuugcucugc

SEQ ID NO: 1653779 - RNA, 21 nt, Human
ugaaccacaucuugcucugcu

SEQ ID NO: 1653780 - RNA, 22 nt, Human
ugaaccacaucuugcucugcug

SEQ ID NO: 1653781 - RNA, 15 nt, Human
ugaacucuucaaucu

SEQ ID NO: 1653782 - RNA, 19 nt, Human
ugaaauggacuuuuguaca

SEQ ID NO: 1653783 - RNA, 14 nt, Human
ugaacacaucagcu

SEQ ID NO: 1653784 - RNA, 18 nt, Human
ugaacacuccaauuaagg

SEQ ID NO: 1653785 - RNA, 19 nt, Human
ugaacacuccaauuaagga

SEQ ID NO: 1653786 - RNA, 22 nt, Human
ugaacacuccaauuaaggauuu

SEQ ID NO: 1653787 - RNA, 23 nt, Human
ugaacacuccaauuaaggauuuu

SEQ ID NO: 1653788 - RNA, 17 nt, Human
ugaagauguagaggaga

SEQ ID NO: 1653789 - RNA, 20 nt, Human
ugaaggcucgagcaugccug

SEQ ID NO: 1653790 - RNA, 21 nt, Human
ugaaggcucgagcaugccugg

SEQ ID NO: 1653791 - RNA, 21 nt, Human
ugaaguccaagcauuuagaug

SEQ ID NO: 1653792 - RNA, 22 nt, Human
ugaaguccaagcauuuagaugu

SEQ ID NO: 1653793 - RNA, 17 nt, Human
ugaagacuuuucuuuca

SEQ ID NO: 1653794 - RNA, 22 nt, Human
ugaagacuuuucuuucagccaa

SEQ ID NO: 1653795 - RNA, 14 nt, Human
ugaagacuuuucuu

SEQ ID NO: 1653796 - RNA, 23 nt, Human
ugaacuggguacuuguggacaca

SEQ ID NO: 1653797 - RNA, 19 nt, Human
ugaacuggguacuugugga

SEQ ID NO: 1653798 - RNA, 14 nt, Human
ugaacuuggcgcug

SEQ ID NO: 1653799 - RNA, 12 nt, Human
ugaacuugguuc

SEQ ID NO: 1653800 - RNA, 14 nt, Human
ugaagacagagcua

SEQ ID NO: 1653801 - RNA, 16 nt, Human
ugaagacagagcuaca

SEQ ID NO: 1653802 - RNA, 22 nt, Human
ugaacuuguaaaggaauuuaaa

SEQ ID NO: 1653803 - RNA, 22 nt, Human
ucucccccagccccauccucug

SEQ ID NO: 1653804 - RNA, 18 nt, Human
ucucccccagccccaucc

SEQ ID NO: 1653805 - RNA, 20 nt, Human
ucucccccagccccauccuc

SEQ ID NO: 1653806 - RNA, 14 nt, Human
ucucccccagcccc

SEQ ID NO: 1653807 - RNA, 15 nt, Human
ucucccccagcccca

SEQ ID NO: 1653808 - RNA, 17 nt, Human
ucucccccagccccauc

SEQ ID NO: 1653809 - RNA, 15 nt, Human
ucucaggucccugca

SEQ ID NO: 1653810 - RNA, 21 nt, Human
ucucagugucaaugcagcccc

SEQ ID NO: 1653811 - RNA, 22 nt, Human
ucuccugccucagccucccaaa

SEQ ID NO: 1653812 - RNA, 18 nt, Human
ucuccugggcagcugccu

SEQ ID NO: 1653813 - RNA, 17 nt, Human
ucuccugggcagcugcc

SEQ ID NO: 1653814 - RNA, 16 nt, Human
ucuccugggcagcugc

SEQ ID NO: 1653815 - RNA, 15 nt, Human
ucuccugggcagcug

SEQ ID NO: 1653816 - RNA, 14 nt, Human
ucuccugggcagcu

SEQ ID NO: 1653817 - RNA, 13 nt, Human
ucuccugggcagc

SEQ ID NO: 1653818 - RNA, 15 nt, Human
ucucucgugaguaua

SEQ ID NO: 1653819 - RNA, 14 nt, Human
ucucugaggacacu

SEQ ID NO: 1653820 - RNA, 13 nt, Human
ucucugaggacac

SEQ ID NO: 1653821 - RNA, 19 nt, Human
ucucuaguuugauuaaauu

SEQ ID NO: 1653822 - RNA, 18 nt, Human
ucucuaguuugauuaaau

SEQ ID NO: 1653823 - RNA, 13 nt, Human
ucucuaggaaaua

SEQ ID NO: 1653824 - RNA, 19 nt, Human
ucucuaggaaauauuuauu

SEQ ID NO: 1653825 - RNA, 13 nt, Human
ucuccuguaccuc

SEQ ID NO: 1653826 - RNA, 15 nt, Human
ucucuacaaaaagca

SEQ ID NO: 1653827 - RNA, 21 nt, Human
ucuccugggcagcugccuccc

SEQ ID NO: 1653828 - RNA, 20 nt, Human
ucuccugggcagcugccucc

SEQ ID NO: 1653829 - RNA, 19 nt, Human
ucuccugggcagcugccuc

SEQ ID NO: 1653830 - RNA, 14 nt, Human
ucugacccaugcug

SEQ ID NO: 1653831 - RNA, 21 nt, Human
ucugaacuuggcgcugccccu

SEQ ID NO: 1653832 - RNA, 20 nt, Human
ucugaacuuggcgcugcccc

SEQ ID NO: 1653833 - RNA, 16 nt, Human
ucugacaucucugcaa

SEQ ID NO: 1653834 - RNA, 20 nt, Human
ucugagcauuagauuucuca

SEQ ID NO: 1653835 - RNA, 19 nt, Human
ucugacccaugcugcccug

SEQ ID NO: 1653836 - RNA, 15 nt, Human
ucugacccaugcugc

SEQ ID NO: 1653837 - RNA, 16 nt, Human
ucugacccaugcugcc

SEQ ID NO: 1653838 - RNA, 17 nt, Human
ucugacccaugcugccc

SEQ ID NO: 1653839 - RNA, 18 nt, Human
ucugacccaugcugcccu

SEQ ID NO: 1653840 - RNA, 23 nt, Human
ucugauucccaagcucugcuccu

SEQ ID NO: 1653841 - RNA, 19 nt, Human
ucugcacaagcugcacccu

SEQ ID NO: 1653842 - RNA, 14 nt, Human
ucugcacaagcugc

SEQ ID NO: 1653843 - RNA, 20 nt, Human
ucugaggaauucuguauaga

SEQ ID NO: 1653844 - RNA, 20 nt, Human
ucugaggacacuaaccacgc

SEQ ID NO: 1653845 - RNA, 23 nt, Human
ucugaggacacuaaccacgcugg

SEQ ID NO: 1653846 - RNA, 22 nt, Human
ucugagcauuagauuucucauu

SEQ ID NO: 1653847 - RNA, 16 nt, Human
ucugaggaauccagac

SEQ ID NO: 1653848 - RNA, 17 nt, Human
ucugaggaauccagacc

SEQ ID NO: 1653849 - RNA, 14 nt, Human
ucugaaauuuccug

SEQ ID NO: 1653850 - RNA, 23 nt, Human
ucugaaaauguauguguaaguau

SEQ ID NO: 1653851 - RNA, 13 nt, Human
ucugaaagggacg

SEQ ID NO: 1653852 - RNA, 15 nt, Human
ucucuuuucaaaaca

SEQ ID NO: 1653853 - RNA, 16 nt, Human
ucucuuuucaaaacau

SEQ ID NO: 1653854 - RNA, 16 nt, Human
ucugaaaauguaugug

SEQ ID NO: 1653855 - RNA, 13 nt, Human
ucucuucuccacu

SEQ ID NO: 1653856 - RNA, 14 nt, Human
ucucuucuccacug

SEQ ID NO: 1653857 - RNA, 15 nt, Human
ucucuucuccacugg

SEQ ID NO: 1653858 - RNA, 16 nt, Human
ucucuucuccacugga

SEQ ID NO: 1653859 - RNA, 11 nt, Human
ucucuucucca

SEQ ID NO: 1653860 - RNA, 11 nt, Human
ucucugcaggu

SEQ ID NO: 1653861 - RNA, 19 nt, Human
ucucugcaaucuucucaga

SEQ ID NO: 1653862 - RNA, 18 nt, Human
ucucuucacagucacauu

SEQ ID NO: 1653863 - RNA, 17 nt, Human
ucgcaauguaagacucg

SEQ ID NO: 1653864 - RNA, 19 nt, Human
ucgcccaggcuggagugca

SEQ ID NO: 1653865 - RNA, 12 nt, Human
ucgcccaggcug

SEQ ID NO: 1653866 - RNA, 14 nt, Human
ucgcccaggcugga

SEQ ID NO: 1653867 - RNA, 14 nt, Human
uccuuuuggaguca

SEQ ID NO: 1653868 - RNA, 23 nt, Human
uccuuuuggagucagacagaugu

SEQ ID NO: 1653869 - RNA, 15 nt, Human
ucgaguuacagacaa

SEQ ID NO: 1653870 - RNA, 17 nt, Human
ucgaguuacagacaaag

SEQ ID NO: 1653871 - RNA, 15 nt, Human
uccugguguggaaga

SEQ ID NO: 1653872 - RNA, 10 nt, Human
ucccucccuu

SEQ ID NO: 1653873 - RNA, 22 nt, Human
uccuggcaugggaaugaauguc

SEQ ID NO: 1653874 - RNA, 17 nt, Human
uccuggcccacugcauc

SEQ ID NO: 1653875 - RNA, 16 nt, Human
uccuucaaagcaaaug

SEQ ID NO: 1653876 - RNA, 14 nt, Human
uccuuaccagcaga

SEQ ID NO: 1653877 - RNA, 15 nt, Human
uccuugcaucaauuu

SEQ ID NO: 1653878 - RNA, 12 nt, Human
uccuucuguccu

SEQ ID NO: 1653879 - RNA, 19 nt, Human
uccuucuguccuacucugu

SEQ ID NO: 1653880 - RNA, 17 nt, Human
ucucagaaucucaaaua

SEQ ID NO: 1653881 - RNA, 21 nt, Human
ucucagaaucucaaauaacua

SEQ ID NO: 1653882 - RNA, 19 nt, Human
ucucagaaggcaaaugacu

SEQ ID NO: 1653883 - RNA, 20 nt, Human
ucucagaaggcaaaugacuu

SEQ ID NO: 1653884 - RNA, 21 nt, Human
ucucagaaggcaaaugacuuu

SEQ ID NO: 1653885 - RNA, 22 nt, Human
ucucagaaggcaaaugacuuug

SEQ ID NO: 1653886 - RNA, 18 nt, Human
ucucacuguugcccaggc

SEQ ID NO: 1653887 - RNA, 19 nt, Human
ucucacuguugcccaggcu

SEQ ID NO: 1653888 - RNA, 20 nt, Human
ucucacuguugcccaggcug

SEQ ID NO: 1653889 - RNA, 21 nt, Human
ucucacuguugcccaggcugg

SEQ ID NO: 1653890 - RNA, 18 nt, Human
ucucacucugucgcccag

SEQ ID NO: 1653891 - RNA, 22 nt, Human
ucucacucugucgcccagucug

SEQ ID NO: 1653892 - RNA, 17 nt, Human
ucucacucugucgccca

SEQ ID NO: 1653893 - RNA, 22 nt, Human
ucucaaacucuugaccucaggu

SEQ ID NO: 1653894 - RNA, 13 nt, Human
ucucaaacucuug

SEQ ID NO: 1653895 - RNA, 21 nt, Human
ucucaaacucuugaccucagg

SEQ ID NO: 1653896 - RNA, 17 nt, Human
ucucaaccaccuuucag

SEQ ID NO: 1653897 - RNA, 22 nt, Human
ucuacugaggugcuauguucuu

SEQ ID NO: 1653898 - RNA, 22 nt, Human
ucuagggaaaaaccagcgugug

SEQ ID NO: 1653899 - RNA, 21 nt, Human
ucuacacugugcugagucuga

SEQ ID NO: 1653900 - RNA, 15 nt, Human
ucuacacugugcuga

SEQ ID NO: 1653901 - RNA, 18 nt, Human
ucuacugaggugcuaugu

SEQ ID NO: 1653902 - RNA, 19 nt, Human
ucuacugaggugcuauguu

SEQ ID NO: 1653903 - RNA, 12 nt, Human
ucuacacugugc

SEQ ID NO: 1653904 - RNA, 14 nt, Human
ucuacacugugcug

SEQ ID NO: 1653905 - RNA, 17 nt, Human
ucuacacuccagugaga

SEQ ID NO: 1653906 - RNA, 16 nt, Human
ucuaacuucaccauau

SEQ ID NO: 1653907 - RNA, 15 nt, Human
ucuaacuucaccaua

SEQ ID NO: 1653908 - RNA, 22 nt, Human
ucuaacuucaccauauuaccac

SEQ ID NO: 1653909 - RNA, 21 nt, Human
ucuacacuaagagagaaugag

SEQ ID NO: 1653910 - RNA, 16 nt, Human
ucuaaauucuuucauu

SEQ ID NO: 1653911 - RNA, 16 nt, Human
ucaagcgauucuucug

SEQ ID NO: 1653912 - RNA, 17 nt, Human
ucaagcgauucuucugc

SEQ ID NO: 1653913 - RNA, 18 nt, Human
ucaaggauccugagccag

SEQ ID NO: 1653914 - RNA, 19 nt, Human
ucaaggauccugagccaga

SEQ ID NO: 1653915 - RNA, 23 nt, Human
ucaaggauccugagccagauuuc

SEQ ID NO: 1653916 - RNA, 20 nt, Human
ucaaggauccugagccagau

SEQ ID NO: 1653917 - RNA, 22 nt, Human
ucaagugauucuccugccucag

SEQ ID NO: 1653918 - RNA, 16 nt, Human
ucaaacuuuacuaugg

SEQ ID NO: 1653919 - RNA, 22 nt, Human
ucaaacucuugaccucagguga

SEQ ID NO: 1653920 - RNA, 13 nt, Human
ucaaacuuuacua

SEQ ID NO: 1653921 - RNA, 15 nt, Human
ucaaacuuuacuaug

SEQ ID NO: 1653922 - RNA, 13 nt, Human
ucaaccuccuggg

SEQ ID NO: 1653923 - RNA, 14 nt, Human
ucaaccuccugggc

SEQ ID NO: 1653924 - RNA, 19 nt, Human
ucaacuccaaacugacucu

SEQ ID NO: 1653925 - RNA, 19 nt, Human
ucaauuacaggaaguacug

SEQ ID NO: 1653926 - RNA, 20 nt, Human
ucaauuacaggaaguacugg

SEQ ID NO: 1653927 - RNA, 21 nt, Human
ucacacaguauuacuucugcu

SEQ ID NO: 1653928 - RNA, 22 nt, Human
ucacacaguauuacuucugcua

SEQ ID NO: 1653929 - RNA, 13 nt, Human
ucacacagugagu

SEQ ID NO: 1653930 - RNA, 21 nt, Human
ucacacaugagcaucaggcca

SEQ ID NO: 1653931 - RNA, 22 nt, Human
ucacacagugagucgaggacag

SEQ ID NO: 1653932 - RNA, 23 nt, Human
ucacacagugagucgaggacagg

SEQ ID NO: 1653933 - RNA, 11 nt, Human
ucacaggcagg

SEQ ID NO: 1653934 - RNA, 23 nt, Human
ucacaggacagcccuucuuucca

SEQ ID NO: 1653935 - RNA, 19 nt, Human
ucacaggaaguagaggagg

SEQ ID NO: 1653936 - RNA, 13 nt, Human
ucaauaggaaaaa

SEQ ID NO: 1653937 - RNA, 17 nt, Human
ucaauaggaaaaacuga

SEQ ID NO: 1653938 - RNA, 14 nt, Human
ucaauaggaaaaac

SEQ ID NO: 1653939 - RNA, 14 nt, Human
ucaaugcacugaca

SEQ ID NO: 1653940 - RNA, 13 nt, Human
ucaauuacaggaa

SEQ ID NO: 1653941 - RNA, 18 nt, Human
ucaauuacaggaaguacu

SEQ ID NO: 1653942 - RNA, 18 nt, Human
ucaaugcacugacauugu

SEQ ID NO: 1653943 - RNA, 17 nt, Human
ucaaugcuauaacuaug

SEQ ID NO: 1653944 - RNA, 13 nt, Human
ucaaugcagcccc

SEQ ID NO: 1653945 - RNA, 21 nt, Human
uauuuucaacgcagcccugcu

SEQ ID NO: 1653946 - RNA, 15 nt, Human
uauuuuauguugcau

SEQ ID NO: 1653947 - RNA, 16 nt, Human
uauuuuauguugcaua

SEQ ID NO: 1653948 - RNA, 12 nt, Human
uauuuuaugauc

SEQ ID NO: 1653949 - RNA, 22 nt, Human
uauuuuuuucugaauuauuuuc

SEQ ID NO: 1653950 - RNA, 16 nt, Human
uauuuuuuucugaaau

SEQ ID NO: 1653951 - RNA, 17 nt, Human
uauuuuuuucugaaauu

SEQ ID NO: 1653952 - RNA, 15 nt, Human
uauuuuuuuacuaau

SEQ ID NO: 1653953 - RNA, 15 nt, Human
ucaaacgugaaaaug

SEQ ID NO: 1653954 - RNA, 16 nt, Human
ucaaacgugaaaaugc

SEQ ID NO: 1653955 - RNA, 14 nt, Human
ucaaacucuuaaaa

SEQ ID NO: 1653956 - RNA, 22 nt, Human
ucaaaacgguuuuacugcagcu

SEQ ID NO: 1653957 - RNA, 23 nt, Human
ucaaacggccucacuaggcuucu

SEQ ID NO: 1653958 - RNA, 13 nt, Human
ucaaaacugcacu

SEQ ID NO: 1653959 - RNA, 17 nt, Human
uaucugaagucagaucu

SEQ ID NO: 1653960 - RNA, 18 nt, Human
uaucugaagucagaucug

SEQ ID NO: 1653961 - RNA, 15 nt, Human
uaucugaggaauucu

SEQ ID NO: 1653962 - RNA, 18 nt, Human
uaucugacaucucugcaa

SEQ ID NO: 1653963 - RNA, 16 nt, Human
uaucugaggaauucug

SEQ ID NO: 1653964 - RNA, 23 nt, Human
uauuuauuaaaugcccagccccu

SEQ ID NO: 1653965 - RNA, 14 nt, Human
uaucugaaaaugua

SEQ ID NO: 1653966 - RNA, 15 nt, Human
uaucugaaaauguau

SEQ ID NO: 1653967 - RNA, 20 nt, Human
uaucugaaaauguaugugua

SEQ ID NO: 1653968 - RNA, 13 nt, Human
uauuuauuacugu

SEQ ID NO: 1653969 - RNA, 22 nt, Human
uauuucuaugaaauauuauguu

SEQ ID NO: 1653970 - RNA, 21 nt, Human
uauuucuaugaaauauuaugu

SEQ ID NO: 1653971 - RNA, 16 nt, Human
ucacgccacugcacua

SEQ ID NO: 1653972 - RNA, 13 nt, Human
ucacgccacugca

SEQ ID NO: 1653973 - RNA, 14 nt, Human
ucacgccacugcac

SEQ ID NO: 1653974 - RNA, 19 nt, Human
ucacgccuguaauccuagc

SEQ ID NO: 1653975 - RNA, 20 nt, Human
ucacgccuguaauccuagca

SEQ ID NO: 1653976 - RNA, 14 nt, Human
ucaccuuugucccc

SEQ ID NO: 1653977 - RNA, 15 nt, Human
ucaccuuugucccca

SEQ ID NO: 1653978 - RNA, 17 nt, Human
ucaccuuuguccccacc

SEQ ID NO: 1653979 - RNA, 18 nt, Human
ucaccuuuguccccaccg

SEQ ID NO: 1653980 - RNA, 22 nt, Human
ucaccuuuguccccaccgcaga

SEQ ID NO: 1653981 - RNA, 12 nt, Human
ucacaggcaggu

SEQ ID NO: 1653982 - RNA, 15 nt, Human
ucacaggcaggucca

SEQ ID NO: 1653983 - RNA, 13 nt, Human
ucaccuuuauucu

SEQ ID NO: 1653984 - RNA, 14 nt, Human
ucaccuuucccauc

SEQ ID NO: 1653985 - RNA, 12 nt, Human
ucaccuuugucc

SEQ ID NO: 1653986 - RNA, 13 nt, Human
ucacggcucacug

SEQ ID NO: 1653987 - RNA, 15 nt, Human
ucacggcucacugca

SEQ ID NO: 1653988 - RNA, 20 nt, Human
ucacggcucacugcagccuc

SEQ ID NO: 1653989 - RNA, 14 nt, Human
ucacggaagagccu

SEQ ID NO: 1653990 - RNA, 16 nt, Human
ucacggaagagccuug

SEQ ID NO: 1653991 - RNA, 17 nt, Human
ucacggaagagccuugc

SEQ ID NO: 1653992 - RNA, 18 nt, Human
ucacuccuaccugguaau

SEQ ID NO: 1653993 - RNA, 13 nt, Human
ucacuccuugaaa

SEQ ID NO: 1653994 - RNA, 23 nt, Human
ucacucuccuuggugucgggcau

SEQ ID NO: 1653995 - RNA, 12 nt, Human
ucacucuggcag

SEQ ID NO: 1653996 - RNA, 13 nt, Human
ucacucuggcagc

SEQ ID NO: 1653997 - RNA, 19 nt, Human
ucacucuacuuagcauguc

SEQ ID NO: 1653998 - RNA, 20 nt, Human
ucacucuacuuagcaugucc

SEQ ID NO: 1653999 - RNA, 18 nt, Human
ucacucuccauuuaauaa

SEQ ID NO: 1654000 - RNA, 12 nt, Human
ucacucuccuug

SEQ ID NO: 1654001 - RNA, 14 nt, Human
ucacucuccuuggu

SEQ ID NO: 1654002 - RNA, 14 nt, Human
ucacucuggcagcu

SEQ ID NO: 1654003 - RNA, 15 nt, Human
ucacucuggcagcuc

SEQ ID NO: 1654004 - RNA, 16 nt, Human
ucacucuggcagcuca

SEQ ID NO: 1654005 - RNA, 17 nt, Human
ucacucuggcagcucag

SEQ ID NO: 1654006 - RNA, 18 nt, Human
ucacucuggcagcucaga

SEQ ID NO: 1654007 - RNA, 19 nt, Human
ucacucuggcagcucagag

SEQ ID NO: 1654008 - RNA, 20 nt, Human
ucacucuggcagcucagaga

SEQ ID NO: 1654009 - RNA, 22 nt, Human
ucacucuggcagcucagagagg

SEQ ID NO: 1654010 - RNA, 21 nt, Human
ucagaggggaauaaacuguug

SEQ ID NO: 1654011 - RNA, 22 nt, Human
ucagaguugaugguuguacaua

SEQ ID NO: 1654012 - RNA, 15 nt, Human
ucagauaacuguuau

SEQ ID NO: 1654013 - RNA, 13 nt, Human
ucagauaacuguu

SEQ ID NO: 1654014 - RNA, 19 nt, Human
ucagcacgauuucuguuua

SEQ ID NO: 1654015 - RNA, 22 nt, Human
ucagauaacuguuauuuauaau

SEQ ID NO: 1654016 - RNA, 22 nt, Human
ucagacauagaauuaacacaug

SEQ ID NO: 1654017 - RNA, 15 nt, Human
ucagacagcugccug

SEQ ID NO: 1654018 - RNA, 16 nt, Human
ucagacagcugccugg

SEQ ID NO: 1654019 - RNA, 17 nt, Human
ucagacagcugccuggg

SEQ ID NO: 1654020 - RNA, 18 nt, Human
ucagacagcugccuggga

SEQ ID NO: 1654021 - RNA, 19 nt, Human
ucagacagcugccugggau

SEQ ID NO: 1654022 - RNA, 20 nt, Human
ucagacagcugccugggauc

SEQ ID NO: 1654023 - RNA, 19 nt, Human
ucagacauagaauuaacac

SEQ ID NO: 1654024 - RNA, 22 nt, Human
ucacucugucgcccagucugga

SEQ ID NO: 1654025 - RNA, 19 nt, Human
ucacucugucgcccagucu

SEQ ID NO: 1654026 - RNA, 12 nt, Human
ucacucugucgc

SEQ ID NO: 1654027 - RNA, 16 nt, Human
ucacucugucgcccag

SEQ ID NO: 1654028 - RNA, 20 nt, Human
ucacugcuuaacuucacaua

SEQ ID NO: 1654029 - RNA, 18 nt, Human
ucacugcuuaacuucaca

SEQ ID NO: 1654030 - RNA, 17 nt, Human
ucacugcuuaacuucac

SEQ ID NO: 1654031 - RNA, 15 nt, Human
ucacugcuuaacuuc

SEQ ID NO: 1654032 - RNA, 17 nt, Human
ucacuugucaauaaaau

SEQ ID NO: 1654033 - RNA, 12 nt, Human
ucacuuuuauuu

SEQ ID NO: 1654034 - RNA, 22 nt, Human
ucacuuuuauuuagcaccaggg

SEQ ID NO: 1654035 - RNA, 13 nt, Human
ucacuuuuuucca

SEQ ID NO: 1654036 - RNA, 15 nt, Human
ucacuuuuuuccaca

SEQ ID NO: 1654037 - RNA, 16 nt, Human
ucacuuuuuuccacau

SEQ ID NO: 1654038 - RNA, 13 nt, Human
ucccuaauaaagc

SEQ ID NO: 1654039 - RNA, 14 nt, Human
ucccuaauaaagcu

SEQ ID NO: 1654040 - RNA, 15 nt, Human
ucccuacuguaauuu

SEQ ID NO: 1654041 - RNA, 17 nt, Human
ucccucccucuuucccu

SEQ ID NO: 1654042 - RNA, 15 nt, Human
ucccuacuuccugug

SEQ ID NO: 1654043 - RNA, 16 nt, Human
ucccuacuuccuguga

SEQ ID NO: 1654044 - RNA, 15 nt, Human
ucccucccucuuucc

SEQ ID NO: 1654045 - RNA, 11 nt, Human
ucccuaauaaa

SEQ ID NO: 1654046 - RNA, 12 nt, Human
ucccuaauaaag

SEQ ID NO: 1654047 - RNA, 21 nt, Human
uccccuuccuaauuccacagc

SEQ ID NO: 1654048 - RNA, 22 nt, Human
uccccuuccuaauuccacagcu

SEQ ID NO: 1654049 - RNA, 18 nt, Human
uccccuguuuguuucuga

SEQ ID NO: 1654050 - RNA, 24 nt, Human
uccccugcuggguguggcgcagca

SEQ ID NO: 1654051 - RNA, 19 nt, Human
uccccuguagagugggagc

SEQ ID NO: 1654052 - RNA, 15 nt, Human
uccccuguucacucu

SEQ ID NO: 1654053 - RNA, 22 nt, Human
uccccuguagagugggagcuga

SEQ ID NO: 1654054 - RNA, 23 nt, Human
uccccuguccccgcacugggcuu

SEQ ID NO: 1654055 - RNA, 14 nt, Human
uccccugcugggug

SEQ ID NO: 1654056 - RNA, 15 nt, Human
uccccugcugggugu

SEQ ID NO: 1654057 - RNA, 20 nt, Human
uccccugcuggguguggcgc

SEQ ID NO: 1654058 - RNA, 21 nt, Human
uccccugcuggguguggcgca

SEQ ID NO: 1654059 - RNA, 17 nt, Human
ucccccaucucuucugg

SEQ ID NO: 1654060 - RNA, 13 nt, Human
ucccccugcccca

SEQ ID NO: 1654061 - RNA, 13 nt, Human
ucccccucuggcu

SEQ ID NO: 1654062 - RNA, 13 nt, Human
uccccaggaggcc

SEQ ID NO: 1654063 - RNA, 20 nt, Human
uccccgcacugggcuugggg

SEQ ID NO: 1654064 - RNA, 21 nt, Human
ucccccuuccauggacuuugu

SEQ ID NO: 1654065 - RNA, 22 nt, Human
ucccaaggcucugagcaaaugu

SEQ ID NO: 1654066 - RNA, 13 nt, Human
ucccaccucagcc

SEQ ID NO: 1654067 - RNA, 14 nt, Human
ucccaccucagccu

SEQ ID NO: 1654068 - RNA, 15 nt, Human
ucccaccucagccuc

SEQ ID NO: 1654069 - RNA, 20 nt, Human
ucccaggcauuccccaggag

SEQ ID NO: 1654070 - RNA, 21 nt, Human
ucccaggcauuccccaggagg

SEQ ID NO: 1654071 - RNA, 20 nt, Human
ucccaggcgccccuuccccc

SEQ ID NO: 1654072 - RNA, 18 nt, Human
ucccaggcgccccuuccc

SEQ ID NO: 1654073 - RNA, 21 nt, Human
ucccaggcgccccuucccccu

SEQ ID NO: 1654074 - RNA, 15 nt, Human
ucccaggcugagccu

SEQ ID NO: 1654075 - RNA, 23 nt, Human
ucccaggcauuccccaggaggcc

SEQ ID NO: 1654076 - RNA, 22 nt, Human
ucccaggcauuccccaggaggc

SEQ ID NO: 1654077 - RNA, 21 nt, Human
ucccaucugugaaaggaaaga

SEQ ID NO: 1654078 - RNA, 16 nt, Human
ucccaggcugagccuc

SEQ ID NO: 1654079 - RNA, 18 nt, Human
ucccaggcugagccucag

SEQ ID NO: 1654080 - RNA, 20 nt, Human
ucccaucucacacaugagca

SEQ ID NO: 1654081 - RNA, 23 nt, Human
ucccaucucacacaugagcauca

SEQ ID NO: 1654082 - RNA, 14 nt, Human
uccauggacuuugu

SEQ ID NO: 1654083 - RNA, 15 nt, Human
uccauggacuuuguu

SEQ ID NO: 1654084 - RNA, 16 nt, Human
uccauccaggccauuc

SEQ ID NO: 1654085 - RNA, 23 nt, Human
uccagcucaccagccccagugcc

SEQ ID NO: 1654086 - RNA, 18 nt, Human
ucccaaggcucugagcaa

SEQ ID NO: 1654087 - RNA, 17 nt, Human
ucccaagcucugcuccu

SEQ ID NO: 1654088 - RNA, 12 nt, Human
ucccaagcucug

SEQ ID NO: 1654089 - RNA, 13 nt, Human
ucccaagcucugc

SEQ ID NO: 1654090 - RNA, 14 nt, Human
ucccaagcucugcu

SEQ ID NO: 1654091 - RNA, 15 nt, Human
ucccaagcucugcuc

SEQ ID NO: 1654092 - RNA, 16 nt, Human
ucccaacucaccccag

SEQ ID NO: 1654093 - RNA, 14 nt, Human
ucccaacucacccc

SEQ ID NO: 1654094 - RNA, 15 nt, Human
ucccaacucacccca

SEQ ID NO: 1654095 - RNA, 13 nt, Human
ucccaacucaccc

SEQ ID NO: 1654096 - RNA, 16 nt, Human
ucccaaauuucauacc

SEQ ID NO: 1654097 - RNA, 22 nt, Human
ucauucagauaugauucaaaug

SEQ ID NO: 1654098 - RNA, 14 nt, Human
ucauuucuuugagu

SEQ ID NO: 1654099 - RNA, 16 nt, Human
ucauuucugcaucagc

SEQ ID NO: 1654100 - RNA, 22 nt, Human
ucauuucugcaucagcugcuga

SEQ ID NO: 1654101 - RNA, 19 nt, Human
uccaaacuaccuuccaguu

SEQ ID NO: 1654102 - RNA, 17 nt, Human
uccaaaauaaaacuuuu

SEQ ID NO: 1654103 - RNA, 16 nt, Human
uccaaaauaaaacuuu

SEQ ID NO: 1654104 - RNA, 23 nt, Human
uccaaacugacucuuaagaagac

SEQ ID NO: 1654105 - RNA, 12 nt, Human
uccaaagaaaug

SEQ ID NO: 1654106 - RNA, 14 nt, Human
uccaagaauuucua

SEQ ID NO: 1654107 - RNA, 22 nt, Human
uccaagaagcccaggaaaggcu

SEQ ID NO: 1654108 - RNA, 20 nt, Human
uccaagaagcccaggaaagg

SEQ ID NO: 1654109 - RNA, 19 nt, Human
uccaagaccuucuccuuca

SEQ ID NO: 1654110 - RNA, 13 nt, Human
uccaagcaaaugu

SEQ ID NO: 1654111 - RNA, 17 nt, Human
uccaagcauuuagaugu

SEQ ID NO: 1654112 - RNA, 23 nt, Human
uccaagcauaccaacacgagcag

SEQ ID NO: 1654113 - RNA, 20 nt, Human
uccagcagauuauucacuga

SEQ ID NO: 1654114 - RNA, 22 nt, Human
uccagcagauuauucacugauu

SEQ ID NO: 1654115 - RNA, 23 nt, Human
uccagccaaagccuccuccagcc

SEQ ID NO: 1654116 - RNA, 16 nt, Human
uccagauccuggaaau

SEQ ID NO: 1654117 - RNA, 17 nt, Human
uccagauccuggaaauc

SEQ ID NO: 1654118 - RNA, 14 nt, Human
uccagauccuggaa

SEQ ID NO: 1654119 - RNA, 14 nt, Human
uccacuuggucugu

SEQ ID NO: 1654120 - RNA, 13 nt, Human
uccaccugccagg

SEQ ID NO: 1654121 - RNA, 12 nt, Human
uccacuuggucu

SEQ ID NO: 1654122 - RNA, 13 nt, Human
uccacuuggucug

SEQ ID NO: 1654123 - RNA, 14 nt, Human
uccaccuacaugag

SEQ ID NO: 1654124 - RNA, 12 nt, Human
uccaccucccug

SEQ ID NO: 1654125 - RNA, 12 nt, Human
uccaccugccag

SEQ ID NO: 1654126 - RNA, 23 nt, Human
uccaccucccugcaauaaaaugg

SEQ ID NO: 1654127 - RNA, 15 nt, Human
uccacaagagcccag

SEQ ID NO: 1654128 - RNA, 14 nt, Human
uccacaagagccca

SEQ ID NO: 1654129 - RNA, 14 nt, Human
uccacaacacacag

SEQ ID NO: 1654130 - RNA, 20 nt, Human
uccaagcauuuagauguaua

SEQ ID NO: 1654131 - RNA, 21 nt, Human
ucauacccacccccacccaag

SEQ ID NO: 1654132 - RNA, 20 nt, Human
ucauacccacccccacccaa

SEQ ID NO: 1654133 - RNA, 14 nt, Human
ucauacccaccccc

SEQ ID NO: 1654134 - RNA, 15 nt, Human
ucauacccaccccca

SEQ ID NO: 1654135 - RNA, 16 nt, Human
ucauuaggugugacug

SEQ ID NO: 1654136 - RNA, 16 nt, Human
ucauuauuuuauuaug

SEQ ID NO: 1654137 - RNA, 18 nt, Human
ucauuauuuuauuaugaa

SEQ ID NO: 1654138 - RNA, 19 nt, Human
ucauuauuuuauuaugaaa

SEQ ID NO: 1654139 - RNA, 22 nt, Human
ucauuauuuuauuaugaaacuu

SEQ ID NO: 1654140 - RNA, 14 nt, Human
ucauuauuuuauua

SEQ ID NO: 1654141 - RNA, 15 nt, Human
ucauuauuuuauuau

SEQ ID NO: 1654142 - RNA, 13 nt, Human
ucauuauuuuauu

SEQ ID NO: 1654143 - RNA, 22 nt, Human
ucauuaggugugacugaauuuc

SEQ ID NO: 1654144 - RNA, 21 nt, Human
ucauuaggugugacugaauuu

SEQ ID NO: 1654145 - RNA, 18 nt, Human
ucauuaggugugacugaa

SEQ ID NO: 1654146 - RNA, 24 nt, Human
ucagucugauucccaagcucugcu

SEQ ID NO: 1654147 - RNA, 15 nt, Human
ucagucuggcccuuc

SEQ ID NO: 1654148 - RNA, 23 nt, Human
ucagugguuggcaauuguuucaa

SEQ ID NO: 1654149 - RNA, 11 nt, Human
ucaguguacau

SEQ ID NO: 1654150 - RNA, 13 nt, Human
ucagugugacuga

SEQ ID NO: 1654151 - RNA, 17 nt, Human
ucagugugacugaucuc

SEQ ID NO: 1654152 - RNA, 13 nt, Human
ucauacccacccc

SEQ ID NO: 1654153 - RNA, 15 nt, Human
ucauaauuauuauuu

SEQ ID NO: 1654154 - RNA, 17 nt, Human
ucaguuguuaguguguc

SEQ ID NO: 1654155 - RNA, 15 nt, Human
ucaguuacucuucag

SEQ ID NO: 1654156 - RNA, 11 nt, Human
uaaaaaacacu

SEQ ID NO: 1654157 - RNA, 12 nt, Human
uaaaaaacacug

SEQ ID NO: 1654158 - RNA, 20 nt, Human
uaaaaaacugcugacuguuu

SEQ ID NO: 1654159 - RNA, 23 nt, Human
uaaaaaacugcugacuguuuucu

SEQ ID NO: 1654160 - RNA, 16 nt, Human
uaaaaaagaaacauuu

SEQ ID NO: 1654161 - RNA, 23 nt, Human
guuuuuauggcuuuugugcauua

SEQ ID NO: 1654162 - RNA, 22 nt, Human
guuuuuauggcuuuugugcauu

SEQ ID NO: 1654163 - RNA, 19 nt, Human
guuuuuauggcuuuugugc

SEQ ID NO: 1654164 - RNA, 12 nt, Human
guuuucucuuga

SEQ ID NO: 1654165 - RNA, 19 nt, Human
guuuucucuugagagggug

SEQ ID NO: 1654166 - RNA, 12 nt, Human
guuuguuuaguc

SEQ ID NO: 1654167 - RNA, 16 nt, Human
guuuguugugaggauu

SEQ ID NO: 1654168 - RNA, 17 nt, Human
guuuucaguguacaugg

SEQ ID NO: 1654169 - RNA, 16 nt, Human
guuuucaguguacaug

SEQ ID NO: 1654170 - RNA, 18 nt, Human
guuuucaggcuagaugua

SEQ ID NO: 1654171 - RNA, 20 nt, Human
guuuuccagguuuaagcugu

SEQ ID NO: 1654172 - RNA, 16 nt, Human
guuuucauuaucucaa

SEQ ID NO: 1654173 - RNA, 14 nt, Human
guuucuuuguaaug

SEQ ID NO: 1654174 - RNA, 17 nt, Human
guuucuuuguaaugaaa

SEQ ID NO: 1654175 - RNA, 16 nt, Human
guuugaaccaagaacu

SEQ ID NO: 1654176 - RNA, 20 nt, Human
guuucuaaagcugccagccg

SEQ ID NO: 1654177 - RNA, 16 nt, Human
guuucuaaagcugcca

SEQ ID NO: 1654178 - RNA, 14 nt, Human
guuucuaaagcugc

SEQ ID NO: 1654179 - RNA, 15 nt, Human
guuucuaaagcugcc

SEQ ID NO: 1654180 - RNA, 22 nt, Human
guuugauuaaauucuugcaaag

SEQ ID NO: 1654181 - RNA, 19 nt, Human
guuugauuaaauucuugca

SEQ ID NO: 1654182 - RNA, 17 nt, Human
guuugauuaaauucuug

SEQ ID NO: 1654183 - RNA, 16 nt, Human
guuugagguuuuuaag

SEQ ID NO: 1654184 - RNA, 19 nt, Human
guuugagguuuuuaagccu

SEQ ID NO: 1654185 - RNA, 18 nt, Human
guuuguuccccaagacau

SEQ ID NO: 1654186 - RNA, 19 nt, Human
guuuguggaaaaugaaaau

SEQ ID NO: 1654187 - RNA, 23 nt, Human
guuugugcugguguaugugugaa

SEQ ID NO: 1654188 - RNA, 20 nt, Human
guuuguaaauuaacuuuuau

SEQ ID NO: 1654189 - RNA, 19 nt, Human
guuuguaaauuaacuuuua

SEQ ID NO: 1654190 - RNA, 17 nt, Human
guuuguaaauuaacuuu

SEQ ID NO: 1654191 - RNA, 22 nt, Human
guuuccugcccugggaggcagu

SEQ ID NO: 1654192 - RNA, 16 nt, Human
guuuccuuauauuaug

SEQ ID NO: 1654193 - RNA, 21 nt, Human
guuuccuggcacugcuuccag

SEQ ID NO: 1654194 - RNA, 22 nt, Human
guuuccuggcacugcuuccagu

SEQ ID NO: 1654195 - RNA, 13 nt, Human
guuuccugcccug

SEQ ID NO: 1654196 - RNA, 17 nt, Human
guuuccugcccugggag

SEQ ID NO: 1654197 - RNA, 16 nt, Human
guuuccuggcacugcu

SEQ ID NO: 1654198 - RNA, 20 nt, Human
guuuccuggcacugcuucca

SEQ ID NO: 1654199 - RNA, 18 nt, Human
guuucagaaauguguuau

SEQ ID NO: 1654200 - RNA, 14 nt, Human
guuucagaaaugug

SEQ ID NO: 1654201 - RNA, 21 nt, Human
gguuggccccugcccggcugc

SEQ ID NO: 1654202 - RNA, 13 nt, Human
guuuagaaagcuu

SEQ ID NO: 1654203 - RNA, 17 nt, Human
guuuagaaagcuugccc

SEQ ID NO: 1654204 - RNA, 14 nt, Human
guuuagucuugucu

SEQ ID NO: 1654205 - RNA, 18 nt, Human
guuuagucuugucucaga

SEQ ID NO: 1654206 - RNA, 16 nt, Human
guuuaguaaucauauu

SEQ ID NO: 1654207 - RNA, 13 nt, Human
uaaaaugagaaau

SEQ ID NO: 1654208 - RNA, 15 nt, Human
uaaaaugagaaaucu

SEQ ID NO: 1654209 - RNA, 16 nt, Human
uaaaaugagaaaucua

SEQ ID NO: 1654210 - RNA, 19 nt, Human
uaaaauccauacauuugug

SEQ ID NO: 1654211 - RNA, 18 nt, Human
uaaaauccauacauuugu

SEQ ID NO: 1654212 - RNA, 17 nt, Human
uaaaagggacugagaaa

SEQ ID NO: 1654213 - RNA, 19 nt, Human
uaaaagggacugagaaauu

SEQ ID NO: 1654214 - RNA, 20 nt, Human
uaaaagggacugagaaauuu

SEQ ID NO: 1654215 - RNA, 21 nt, Human
uaaaagggacugagaaauuua

SEQ ID NO: 1654216 - RNA, 15 nt, Human
uaaaaaugguuuaaa

SEQ ID NO: 1654217 - RNA, 14 nt, Human
uaaaagaugaaaau

SEQ ID NO: 1654218 - RNA, 20 nt, Human
uaaacugcccccucugcccu

SEQ ID NO: 1654219 - RNA, 21 nt, Human
uaaacugcccccucugcccug

SEQ ID NO: 1654220 - RNA, 22 nt, Human
uaaacugcccccucugcccugc

SEQ ID NO: 1654221 - RNA, 23 nt, Human
uaaacugcccccucugcccugcg

SEQ ID NO: 1654222 - RNA, 19 nt, Human
uaaacuuaaucuaaaugga

SEQ ID NO: 1654223 - RNA, 18 nt, Human
uaaacuuaaucuaaaugg

SEQ ID NO: 1654224 - RNA, 14 nt, Human
uaaacuuaaucuaa

SEQ ID NO: 1654225 - RNA, 16 nt, Human
uaaacuuuaccuuuuu

SEQ ID NO: 1654226 - RNA, 22 nt, Human
uaaacuuuaccuuuuuuauaca

SEQ ID NO: 1654227 - RNA, 12 nt, Human
uaaacuuucaca

SEQ ID NO: 1654228 - RNA, 13 nt, Human
uaaacuuucacac

SEQ ID NO: 1654229 - RNA, 21 nt, Human
uaaacacucuugaaaaaugca

SEQ ID NO: 1654230 - RNA, 19 nt, Human
uaaacaagaccacguuucu

SEQ ID NO: 1654231 - RNA, 23 nt, Human
uaaacaagaccacguuucuaaag

SEQ ID NO: 1654232 - RNA, 18 nt, Human
uaaacaagaccacguuuc

SEQ ID NO: 1654233 - RNA, 17 nt, Human
uaaaauggguuuuacug

SEQ ID NO: 1654234 - RNA, 13 nt, Human
uaaacuuuucuga

SEQ ID NO: 1654235 - RNA, 14 nt, Human
uaaacuuuucugau

SEQ ID NO: 1654236 - RNA, 15 nt, Human
uaaacuuuucugaua

SEQ ID NO: 1654237 - RNA, 20 nt, Human
uaaacuuuuuucuuacuguc

SEQ ID NO: 1654238 - RNA, 13 nt, Human
uaaaguugaauuu

SEQ ID NO: 1654239 - RNA, 14 nt, Human
uaaaguugaauuua

SEQ ID NO: 1654240 - RNA, 15 nt, Human
uaaaguugaauuuau

SEQ ID NO: 1654241 - RNA, 17 nt, Human
uaaaguugaauuuauug

SEQ ID NO: 1654242 - RNA, 19 nt, Human
uaaaguugaauuuauuggc

SEQ ID NO: 1654243 - RNA, 21 nt, Human
uaaaguugaauuuauuggcuu

SEQ ID NO: 1654244 - RNA, 23 nt, Human
uaaaguugaauuuauuggcuuuu

SEQ ID NO: 1654245 - RNA, 21 nt, Human
uaaaguguauuuuuuuacuaa

SEQ ID NO: 1654246 - RNA, 23 nt, Human
uaaaguguauuuuuuuacuaaua

SEQ ID NO: 1654247 - RNA, 22 nt, Human
uaaaguguauuuuuuuacuaau

SEQ ID NO: 1654248 - RNA, 14 nt, Human
uaaaguuuguugaa

SEQ ID NO: 1654249 - RNA, 13 nt, Human
uaaaguuucuguu

SEQ ID NO: 1654250 - RNA, 17 nt, Human
uaaauaaaaauaauccu

SEQ ID NO: 1654251 - RNA, 15 nt, Human
uaaauccauuuggaa

SEQ ID NO: 1654252 - RNA, 16 nt, Human
uaaauccauuuggaaa

SEQ ID NO: 1654253 - RNA, 14 nt, Human
uaaauccauuugga

SEQ ID NO: 1654254 - RNA, 19 nt, Human
uaaaucaaguuggcuucua

SEQ ID NO: 1654255 - RNA, 20 nt, Human
uaaaucagacuaugaaguuu

SEQ ID NO: 1654256 - RNA, 19 nt, Human
uaaaucagccguguaacca

SEQ ID NO: 1654257 - RNA, 16 nt, Human
uaaauauauuuuaaga

SEQ ID NO: 1654258 - RNA, 22 nt, Human
uaaauauauuuuaagacgaaac

SEQ ID NO: 1654259 - RNA, 18 nt, Human
uaaauauaugcuaagucu

SEQ ID NO: 1654260 - RNA, 18 nt, Human
uaaauccauuuggaaauc

SEQ ID NO: 1654261 - RNA, 19 nt, Human
uaaauccauuuggaaaucu

SEQ ID NO: 1654262 - RNA, 22 nt, Human
uaaauccauuuggaaaucuuua

SEQ ID NO: 1654263 - RNA, 23 nt, Human
uaaauccauuuggaaaucuuuaa

SEQ ID NO: 1654264 - RNA, 16 nt, Human
uaaaucccauuauuca

SEQ ID NO: 1654265 - RNA, 17 nt, Human
uaaaucccauuauucaa

SEQ ID NO: 1654266 - RNA, 19 nt, Human
uaaaucccauuauucaaag

SEQ ID NO: 1654267 - RNA, 15 nt, Human
uaaauugcuccuuga

SEQ ID NO: 1654268 - RNA, 14 nt, Human
uaaauuuaguauuu

SEQ ID NO: 1654269 - RNA, 13 nt, Human
uaacagaaaugua

SEQ ID NO: 1654270 - RNA, 15 nt, Human
uaacagaaauguaca

SEQ ID NO: 1654271 - RNA, 14 nt, Human
uaacagaaauguac

SEQ ID NO: 1654272 - RNA, 19 nt, Human
uaaccagcagaaaugccuu

SEQ ID NO: 1654273 - RNA, 16 nt, Human
uaaccagcagaaaugc

SEQ ID NO: 1654274 - RNA, 14 nt, Human
uaaccagcagaaau

SEQ ID NO: 1654275 - RNA, 18 nt, Human
uaacauguuaaaccaugg

SEQ ID NO: 1654276 - RNA, 17 nt, Human
uaacauguuaaaccaug

SEQ ID NO: 1654277 - RNA, 19 nt, Human
uaacaggcagauacaggaa

SEQ ID NO: 1654278 - RNA, 16 nt, Human
uaacugagugccuuuu

SEQ ID NO: 1654279 - RNA, 17 nt, Human
uaacugagugccuuuug

SEQ ID NO: 1654280 - RNA, 20 nt, Human
uaacuuuuauaaacuuuacc

SEQ ID NO: 1654281 - RNA, 21 nt, Human
uaagcauauauuuuuauauuu

SEQ ID NO: 1654282 - RNA, 22 nt, Human
uaagcauauauuuuuauauuua

SEQ ID NO: 1654283 - RNA, 19 nt, Human
uaagcauauauuuuuauau

SEQ ID NO: 1654284 - RNA, 23 nt, Human
uaagcauauauuuuuauauuuac

SEQ ID NO: 1654285 - RNA, 15 nt, Human
uaagcaugcacaaau

SEQ ID NO: 1654286 - RNA, 16 nt, Human
uaagcauuccaacuau

SEQ ID NO: 1654287 - RNA, 18 nt, Human
uaagcauuccaacuaucu

SEQ ID NO: 1654288 - RNA, 20 nt, Human
uaagcauuccaacuaucuca

SEQ ID NO: 1654289 - RNA, 13 nt, Human
uaagccagacauc

SEQ ID NO: 1654290 - RNA, 15 nt, Human
uaaggcaaucauggu

SEQ ID NO: 1654291 - RNA, 16 nt, Human
uaaggauguucuagca

SEQ ID NO: 1654292 - RNA, 23 nt, Human
uaaggaugcuuguacauaaugcg

SEQ ID NO: 1654293 - RNA, 22 nt, Human
uaaggaugcuuguacauaaugc

SEQ ID NO: 1654294 - RNA, 21 nt, Human
uaaggaugcuuguacauaaug

SEQ ID NO: 1654295 - RNA, 20 nt, Human
uaaggaugcuuguacauaau

SEQ ID NO: 1654296 - RNA, 14 nt, Human
uaagccuuuggaaa

SEQ ID NO: 1654297 - RNA, 17 nt, Human
uaagccuuuggaaacag

SEQ ID NO: 1654298 - RNA, 21 nt, Human
uaagccuuuggaaacagcucg

SEQ ID NO: 1654299 - RNA, 19 nt, Human
uaaggaugcuuguacauaa

SEQ ID NO: 1654300 - RNA, 20 nt, Human
uaagccagacaucaacagau

SEQ ID NO: 1654301 - RNA, 21 nt, Human
uaagccagacaucaacagaua

SEQ ID NO: 1654302 - RNA, 16 nt, Human
uaagauaaaugugcug

SEQ ID NO: 1654303 - RNA, 17 nt, Human
uaagauaaaugugcuga

SEQ ID NO: 1654304 - RNA, 14 nt, Human
uaagauaaaugugc

SEQ ID NO: 1654305 - RNA, 12 nt, Human
uaagagggaggg

SEQ ID NO: 1654306 - RNA, 22 nt, Human
uaagagggagggagggcuccag

SEQ ID NO: 1654307 - RNA, 23 nt, Human
uaagagggagggagggcuccaga

SEQ ID NO: 1654308 - RNA, 23 nt, Human
uaagagggauuagggagagaaga

SEQ ID NO: 1654309 - RNA, 17 nt, Human
uaagagagucuauuuac

SEQ ID NO: 1654310 - RNA, 22 nt, Human
uaagaggcagggucucacucug

SEQ ID NO: 1654311 - RNA, 22 nt, Human
uaagaaccuuuugagugccuua

SEQ ID NO: 1654312 - RNA, 22 nt, Human
uaacuuuuauaaacuuuaccuu

SEQ ID NO: 1654313 - RNA, 21 nt, Human
uaacuuuuauaaacuuuaccu

SEQ ID NO: 1654314 - RNA, 12 nt, Human
uaaucuaaaugg

SEQ ID NO: 1654315 - RNA, 11 nt, Human
uaaucuaaaug

SEQ ID NO: 1654316 - RNA, 17 nt, Human
uaaugaugucguuugaa

SEQ ID NO: 1654317 - RNA, 23 nt, Human
uaaugaugucguuugaaucacag

SEQ ID NO: 1654318 - RNA, 19 nt, Human
uaaugccacuaaauugaca

SEQ ID NO: 1654319 - RNA, 12 nt, Human
uaauauuaaagc

SEQ ID NO: 1654320 - RNA, 13 nt, Human
uaauauuaaagcc

SEQ ID NO: 1654321 - RNA, 14 nt, Human
uaauauuaaagcca

SEQ ID NO: 1654322 - RNA, 15 nt, Human
uaauauuaaagccau

SEQ ID NO: 1654323 - RNA, 23 nt, Human
uaauccucucaaccaccuuucag

SEQ ID NO: 1654324 - RNA, 13 nt, Human
uaaucgaccugcc

SEQ ID NO: 1654325 - RNA, 14 nt, Human
uaaucgaccugccu

SEQ ID NO: 1654326 - RNA, 16 nt, Human
uaaucgaccugccucg

SEQ ID NO: 1654327 - RNA, 16 nt, Human
uaaucguguccccuau

SEQ ID NO: 1654328 - RNA, 14 nt, Human
uaauacaccacuac

SEQ ID NO: 1654329 - RNA, 21 nt, Human
uaauaguucagguaacaggca

SEQ ID NO: 1654330 - RNA, 15 nt, Human
uaauaauuauaugcu

SEQ ID NO: 1654331 - RNA, 16 nt, Human
uaauaauuauaugcua

SEQ ID NO: 1654332 - RNA, 19 nt, Human
uaauaauuauaugcuauuu

SEQ ID NO: 1654333 - RNA, 20 nt, Human
uaauaauuauaugcuauuuc

SEQ ID NO: 1654334 - RNA, 22 nt, Human
uaauaauuauaugcuauuucua

SEQ ID NO: 1654335 - RNA, 23 nt, Human
uaauaauuauaugcuauuucuau

SEQ ID NO: 1654336 - RNA, 15 nt, Human
uaauaauguuucaaa

SEQ ID NO: 1654337 - RNA, 20 nt, Human
uaagugguacuaacuuuccu

SEQ ID NO: 1654338 - RNA, 11 nt, Human
uaauaaagcug

SEQ ID NO: 1654339 - RNA, 16 nt, Human
uaauaaagaucaugua

SEQ ID NO: 1654340 - RNA, 17 nt, Human
uaauaaagaucauguaa

SEQ ID NO: 1654341 - RNA, 20 nt, Human
uaauaaggaaaaguuuaaua

SEQ ID NO: 1654342 - RNA, 22 nt, Human
uaauaaccaaaugcaaugugaa

SEQ ID NO: 1654343 - RNA, 22 nt, Human
uaauuggaaaggcagcucuaaa

SEQ ID NO: 1654344 - RNA, 15 nt, Human
uaauuugguuuucac

SEQ ID NO: 1654345 - RNA, 17 nt, Human
uaauuugguuuucacau

SEQ ID NO: 1654346 - RNA, 18 nt, Human
uaauuugguuuucacauu

SEQ ID NO: 1654347 - RNA, 20 nt, Human
uaauuuguaguguuggagaa

SEQ ID NO: 1654348 - RNA, 18 nt, Human
uaauuugugauacaaugc

SEQ ID NO: 1654349 - RNA, 15 nt, Human
uaauuugugauacaa

SEQ ID NO: 1654350 - RNA, 14 nt, Human
uaauuugugauaca

SEQ ID NO: 1654351 - RNA, 23 nt, Human
uaauuuguaguguuggagaagaa

SEQ ID NO: 1654352 - RNA, 22 nt, Human
uaauuugugauacaaugcugug

SEQ ID NO: 1654353 - RNA, 19 nt, Human
uaauuugugauacaaugcu

SEQ ID NO: 1654354 - RNA, 18 nt, Human
uaauucuuagcucauucu

SEQ ID NO: 1654355 - RNA, 22 nt, Human
uaauugacaggauuauuggaaa

SEQ ID NO: 1654356 - RNA, 20 nt, Human
uaauugacaggauuauugga

SEQ ID NO: 1654357 - RNA, 19 nt, Human
uaaugcgcaggcuggcccu

SEQ ID NO: 1654358 - RNA, 22 nt, Human
uaaugcgcaggcuggcccugcc

SEQ ID NO: 1654359 - RNA, 14 nt, Human
uaaugcgugcauac

SEQ ID NO: 1654360 - RNA, 23 nt, Human
uaaugcgcaggcuggcccugccc

SEQ ID NO: 1654361 - RNA, 14 nt, Human
uaauguuucaaaca

SEQ ID NO: 1654362 - RNA, 15 nt, Human
uaauguuucaaacau

SEQ ID NO: 1654363 - RNA, 12 nt, Human
uaauuaacaugu

SEQ ID NO: 1654364 - RNA, 14 nt, Human
uaauuaacauguua

SEQ ID NO: 1654365 - RNA, 15 nt, Human
uaauuaacauguuaa

SEQ ID NO: 1654366 - RNA, 17 nt, Human
uaauuaacauguuaaac

SEQ ID NO: 1654367 - RNA, 18 nt, Human
uaauuaacauguuaaacc

SEQ ID NO: 1654368 - RNA, 19 nt, Human
uaauuaacauguuaaacca

SEQ ID NO: 1654369 - RNA, 20 nt, Human
uaauuaacauguuaaaccau

SEQ ID NO: 1654370 - RNA, 17 nt, Human
uaauuaaaacacaacau

SEQ ID NO: 1654371 - RNA, 20 nt, Human
uaauuaaaagaauauuuuaa

SEQ ID NO: 1654372 - RNA, 17 nt, Human
uacacaaugguuuucuu

SEQ ID NO: 1654373 - RNA, 21 nt, Human
uacacaaugguuuucuugugu

SEQ ID NO: 1654374 - RNA, 23 nt, Human
uacacaaugguuuucuugugugu

SEQ ID NO: 1654375 - RNA, 21 nt, Human
uacacacacacgcgugcacac

SEQ ID NO: 1654376 - RNA, 15 nt, Human
uacacacacauacac

SEQ ID NO: 1654377 - RNA, 14 nt, Human
uacacuguuucaaa

SEQ ID NO: 1654378 - RNA, 16 nt, Human
uacacugugcugaguc

SEQ ID NO: 1654379 - RNA, 22 nt, Human
uacacacugcauguuugugauu

SEQ ID NO: 1654380 - RNA, 19 nt, Human
uacaauuuuguuucuguac

SEQ ID NO: 1654381 - RNA, 21 nt, Human
uacaauuuuguuucuguacuu

SEQ ID NO: 1654382 - RNA, 19 nt, Human
uacaagagcuuaacagugu

SEQ ID NO: 1654383 - RNA, 18 nt, Human
uacaauuuuguuucugua

SEQ ID NO: 1654384 - RNA, 15 nt, Human
uacaagacacaguga

SEQ ID NO: 1654385 - RNA, 13 nt, Human
uaauuuugaaaaa

SEQ ID NO: 1654386 - RNA, 17 nt, Human
uaauuuugaaaaacugc

SEQ ID NO: 1654387 - RNA, 12 nt, Human
uaauuuuggaau

SEQ ID NO: 1654388 - RNA, 13 nt, Human
uaauuuuggaauu

SEQ ID NO: 1654389 - RNA, 15 nt, Human
uacaggcauagaguu

SEQ ID NO: 1654390 - RNA, 19 nt, Human
uacaggaaaagcugcugac

SEQ ID NO: 1654391 - RNA, 16 nt, Human
uacaggcacccaccau

SEQ ID NO: 1654392 - RNA, 23 nt, Human
uacagcuugaccgugaggccaga

SEQ ID NO: 1654393 - RNA, 17 nt, Human
uacaggaaaagcugcug

SEQ ID NO: 1654394 - RNA, 18 nt, Human
uacaggaaaagcugcuga

SEQ ID NO: 1654395 - RNA, 22 nt, Human
uacagcuugaccgugaggccag

SEQ ID NO: 1654396 - RNA, 18 nt, Human
uacagaaaaguugaauuu

SEQ ID NO: 1654397 - RNA, 22 nt, Human
uacagaaaaguugaauuuuaca

SEQ ID NO: 1654398 - RNA, 13 nt, Human
uacacuuuaugca

SEQ ID NO: 1654399 - RNA, 19 nt, Human
uacacuguuucaaacuuua

SEQ ID NO: 1654400 - RNA, 18 nt, Human
uacacuguuucaaacuuu

SEQ ID NO: 1654401 - RNA, 17 nt, Human
uacacuguuucaaacuu

SEQ ID NO: 1654402 - RNA, 24 nt, Human
uacagcaaggagauuuacaacugg

SEQ ID NO: 1654403 - RNA, 13 nt, Human
uacagaauuuuau

SEQ ID NO: 1654404 - RNA, 18 nt, Human
uacagaaucuaacuggug

SEQ ID NO: 1654405 - RNA, 15 nt, Human
uacccaaauuaagag

SEQ ID NO: 1654406 - RNA, 12 nt, Human
uacccaccccca

SEQ ID NO: 1654407 - RNA, 15 nt, Human
uacccacccccaccc

SEQ ID NO: 1654408 - RNA, 23 nt, Human
uacccacccccacccaagggccu

SEQ ID NO: 1654409 - RNA, 17 nt, Human
uacccacccccacccaa

SEQ ID NO: 1654410 - RNA, 19 nt, Human
uacccacccccacccaagg

SEQ ID NO: 1654411 - RNA, 11 nt, Human
uacccacugcu

SEQ ID NO: 1654412 - RNA, 12 nt, Human
uacccacugcuc

SEQ ID NO: 1654413 - RNA, 13 nt, Human
uacccacugcucu

SEQ ID NO: 1654414 - RNA, 14 nt, Human
uacccacugcucug

SEQ ID NO: 1654415 - RNA, 15 nt, Human
uacccacugcucugg

SEQ ID NO: 1654416 - RNA, 18 nt, Human
uacccagcgagcccuggu

SEQ ID NO: 1654417 - RNA, 22 nt, Human
uacccaggugcuaggaacacuc

SEQ ID NO: 1654418 - RNA, 13 nt, Human
uaccacagacaua

SEQ ID NO: 1654419 - RNA, 23 nt, Human
uaccauuuugggguacccacugc

SEQ ID NO: 1654420 - RNA, 15 nt, Human
uaccaccacgcccgg

SEQ ID NO: 1654421 - RNA, 23 nt, Human
uaccacaggaaccacaagacugc

SEQ ID NO: 1654422 - RNA, 18 nt, Human
uacaguuccuagguauaa

SEQ ID NO: 1654423 - RNA, 18 nt, Human
uacauaagauaaaugugc

SEQ ID NO: 1654424 - RNA, 19 nt, Human
uacauaagauaaaugugcu

SEQ ID NO: 1654425 - RNA, 23 nt, Human
uacaguuacucagaauucucuag

SEQ ID NO: 1654426 - RNA, 19 nt, Human
uacaguuacucagaauucu

SEQ ID NO: 1654427 - RNA, 22 nt, Human
uacauaagauaaaugugcugaa

SEQ ID NO: 1654428 - RNA, 16 nt, Human
uaccaacacgagcagg

SEQ ID NO: 1654429 - RNA, 21 nt, Human
uacaugagguacugagaguga

SEQ ID NO: 1654430 - RNA, 22 nt, Human
uacaugagguacugagagugaa

SEQ ID NO: 1654431 - RNA, 17 nt, Human
uacauuuguauaaaaua

SEQ ID NO: 1654432 - RNA, 11 nt, Human
uacauuugugu

SEQ ID NO: 1654433 - RNA, 16 nt, Human
uacauuuguauaaaau

SEQ ID NO: 1654434 - RNA, 17 nt, Human
uacugcauaugaaagga

SEQ ID NO: 1654435 - RNA, 21 nt, Human
uacuguaucaugacaaagacu

SEQ ID NO: 1654436 - RNA, 19 nt, Human
uacuuguggacacagcucu

SEQ ID NO: 1654437 - RNA, 15 nt, Human
uacuuguggacacag

SEQ ID NO: 1654438 - RNA, 18 nt, Human
uacuuguggacacagcuc

SEQ ID NO: 1654439 - RNA, 21 nt, Human
uacuugcucuugaugccuggc

SEQ ID NO: 1654440 - RNA, 15 nt, Human
uagaaauauaauuga

SEQ ID NO: 1654441 - RNA, 20 nt, Human
uagaaauaucugaaaaugua

SEQ ID NO: 1654442 - RNA, 21 nt, Human
uagaaauaucugaaaauguau

SEQ ID NO: 1654443 - RNA, 23 nt, Human
uagaaauaucugaaaauguaugu

SEQ ID NO: 1654444 - RNA, 22 nt, Human
uacucagaauucucuaguuuga

SEQ ID NO: 1654445 - RNA, 16 nt, Human
uacucagaauucucua

SEQ ID NO: 1654446 - RNA, 14 nt, Human
uacucaccucaccc

SEQ ID NO: 1654447 - RNA, 13 nt, Human
uacuacuccugua

SEQ ID NO: 1654448 - RNA, 12 nt, Human
uacucaccucac

SEQ ID NO: 1654449 - RNA, 20 nt, Human
uacuacaguccucccaucuc

SEQ ID NO: 1654450 - RNA, 20 nt, Human
uacuacaguuuguuaguaug

SEQ ID NO: 1654451 - RNA, 14 nt, Human
uacucccaucugug

SEQ ID NO: 1654452 - RNA, 16 nt, Human
uacucccaucugugaa

SEQ ID NO: 1654453 - RNA, 17 nt, Human
uacucccaucugugaaa

SEQ ID NO: 1654454 - RNA, 15 nt, Human
uacugaggugcuaug

SEQ ID NO: 1654455 - RNA, 23 nt, Human
uacugauguuccuagugaaagag

SEQ ID NO: 1654456 - RNA, 19 nt, Human
uaccuuugacaaagguaaa

SEQ ID NO: 1654457 - RNA, 20 nt, Human
uaccuuuguauucucuccug

SEQ ID NO: 1654458 - RNA, 20 nt, Human
uaccuuuuuuauacauaaac

SEQ ID NO: 1654459 - RNA, 19 nt, Human
uaccuuuuuuauacauaaa

SEQ ID NO: 1654460 - RNA, 18 nt, Human
uaccuuuuuuauacauaa

SEQ ID NO: 1654461 - RNA, 22 nt, Human
uacccaucccauaugccugggc

SEQ ID NO: 1654462 - RNA, 17 nt, Human
uacuaauagacaauuua

SEQ ID NO: 1654463 - RNA, 15 nt, Human
uacuaauagacaauu

SEQ ID NO: 1654464 - RNA, 13 nt, Human
uacuaacuuuccu

SEQ ID NO: 1654465 - RNA, 12 nt, Human
uacuacaguccu

SEQ ID NO: 1654466 - RNA, 17 nt, Human
uacuacaguccucccau

SEQ ID NO: 1654467 - RNA, 18 nt, Human
uacuaaccagcagaaaug

SEQ ID NO: 1654468 - RNA, 19 nt, Human
uacuaaccagcagaaaugc

SEQ ID NO: 1654469 - RNA, 22 nt, Human
uaccuuuuuuauacauaaacaa

SEQ ID NO: 1654470 - RNA, 23 nt, Human
uaccuuuguucccaaauuucaua

SEQ ID NO: 1654471 - RNA, 18 nt, Human
uagauaauacaccacuac

SEQ ID NO: 1654472 - RNA, 12 nt, Human
uagauguauaua

SEQ ID NO: 1654473 - RNA, 16 nt, Human
uagauguauguacuuc

SEQ ID NO: 1654474 - RNA, 20 nt, Human
uagauguauguacuucaugc

SEQ ID NO: 1654475 - RNA, 16 nt, Human
uagcacuuugggaggc

SEQ ID NO: 1654476 - RNA, 19 nt, Human
uagcagagaaugaaagggc

SEQ ID NO: 1654477 - RNA, 23 nt, Human
uagcagagaaugaaagggcccag

SEQ ID NO: 1654478 - RNA, 20 nt, Human
uagcagggcauggcugggaa

SEQ ID NO: 1654479 - RNA, 13 nt, Human
uagacuggugacu

SEQ ID NO: 1654480 - RNA, 14 nt, Human
uagacuggugacug

SEQ ID NO: 1654481 - RNA, 17 nt, Human
uagacuggugacugauu

SEQ ID NO: 1654482 - RNA, 18 nt, Human
uagacuggugacugauuc

SEQ ID NO: 1654483 - RNA, 12 nt, Human
uagaaccaggca

SEQ ID NO: 1654484 - RNA, 23 nt, Human
uagaaccaggcaacuugggaacu

SEQ ID NO: 1654485 - RNA, 15 nt, Human
uagagaguguugaaa

SEQ ID NO: 1654486 - RNA, 14 nt, Human
uagagaguguugaa

SEQ ID NO: 1654487 - RNA, 16 nt, Human
uagagagagaccacuu

SEQ ID NO: 1654488 - RNA, 21 nt, Human
uagagguucaaagauauuuug

SEQ ID NO: 1654489 - RNA, 16 nt, Human
uagagguucaaagaua

SEQ ID NO: 1654490 - RNA, 19 nt, Human
uagagguucaaagauauuu

SEQ ID NO: 1654491 - RNA, 17 nt, Human
uagaguuuagcuggaaa

SEQ ID NO: 1654492 - RNA, 18 nt, Human
uagaguuuagcuggaaaa

SEQ ID NO: 1654493 - RNA, 13 nt, Human
uagccccauaauu

SEQ ID NO: 1654494 - RNA, 18 nt, Human
uagcccucacccuggggc

SEQ ID NO: 1654495 - RNA, 14 nt, Human
uagcccaaaaccaa

SEQ ID NO: 1654496 - RNA, 11 nt, Human
uagcugggacu

SEQ ID NO: 1654497 - RNA, 22 nt, Human
uagcugggagaaagagagagcu

SEQ ID NO: 1654498 - RNA, 18 nt, Human
uagcugggacuacaggug

SEQ ID NO: 1654499 - RNA, 12 nt, Human
uagcugggacua

SEQ ID NO: 1654500 - RNA, 20 nt, Human
uagcugggacuacaggcacc

SEQ ID NO: 1654501 - RNA, 21 nt, Human
uagcucuaggagggcuggcaa

SEQ ID NO: 1654502 - RNA, 22 nt, Human
uagcucauucuccuuguguuac

SEQ ID NO: 1654503 - RNA, 17 nt, Human
uagccugccucuucucu

SEQ ID NO: 1654504 - RNA, 13 nt, Human
uaggaacacuccu

SEQ ID NO: 1654505 - RNA, 14 nt, Human
uaggaacacuccuu

SEQ ID NO: 1654506 - RNA, 21 nt, Human
uaggaacuuaaauaaugugaa

SEQ ID NO: 1654507 - RNA, 17 nt, Human
uaggaacacuccuucac

SEQ ID NO: 1654508 - RNA, 13 nt, Human
uaggaagacuuug

SEQ ID NO: 1654509 - RNA, 14 nt, Human
uaggaagacuuugg

SEQ ID NO: 1654510 - RNA, 15 nt, Human
uaggaagacuuugga

SEQ ID NO: 1654511 - RNA, 16 nt, Human
uaggaagacuuuggaa

SEQ ID NO: 1654512 - RNA, 17 nt, Human
uaggaagacuuuggaaa

SEQ ID NO: 1654513 - RNA, 15 nt, Human
uaggaagguuaaugu

SEQ ID NO: 1654514 - RNA, 14 nt, Human
uaggaauuguguuu

SEQ ID NO: 1654515 - RNA, 16 nt, Human
uaggaauuguguuuau

SEQ ID NO: 1654516 - RNA, 23 nt, Human
uaggaauugacccacaagaaaug

SEQ ID NO: 1654517 - RNA, 20 nt, Human
uaggaauugacccacaagaa

SEQ ID NO: 1654518 - RNA, 14 nt, Human
uaggccuggccaga

SEQ ID NO: 1654519 - RNA, 13 nt, Human
uaggccuggccag

SEQ ID NO: 1654520 - RNA, 13 nt, Human
uaggccaugggac

SEQ ID NO: 1654521 - RNA, 16 nt, Human
uaggccaugggacagg

SEQ ID NO: 1654522 - RNA, 16 nt, Human
uauaugcuauuucuau

SEQ ID NO: 1654523 - RNA, 18 nt, Human
uauaugcuauuucuauau

SEQ ID NO: 1654524 - RNA, 20 nt, Human
uauaugcucugcauguuaca

SEQ ID NO: 1654525 - RNA, 13 nt, Human
uauauuuuaagac

SEQ ID NO: 1654526 - RNA, 14 nt, Human
uauauuuuaagacg

SEQ ID NO: 1654527 - RNA, 18 nt, Human
uauauuuuuauauuuacu

SEQ ID NO: 1654528 - RNA, 13 nt, Human
uauauuugaaaua

SEQ ID NO: 1654529 - RNA, 14 nt, Human
uauauuugaaauau

SEQ ID NO: 1654530 - RNA, 20 nt, Human
uauauuuauuacuguaagaa

SEQ ID NO: 1654531 - RNA, 23 nt, Human
uauauuuauuacuguaagaaaau

SEQ ID NO: 1654532 - RNA, 15 nt, Human
uaucuaaauguugaa

SEQ ID NO: 1654533 - RNA, 19 nt, Human
uaucgucacugcuuaacuu

SEQ ID NO: 1654534 - RNA, 21 nt, Human
uaucaugucaaacgugaaaau

SEQ ID NO: 1654535 - RNA, 17 nt, Human
uaucaugugaaaucauu

SEQ ID NO: 1654536 - RNA, 22 nt, Human
uaucaugugaaaucauucauuu

SEQ ID NO: 1654537 - RNA, 16 nt, Human
uaucaugacaaagacu

SEQ ID NO: 1654538 - RNA, 16 nt, Human
uaucaugucaaacgug

SEQ ID NO: 1654539 - RNA, 17 nt, Human
uaucaugacaaagacug

SEQ ID NO: 1654540 - RNA, 22 nt, Human
uaucaucaguauugaagcauuu

SEQ ID NO: 1654541 - RNA, 17 nt, Human
uaucaggugcugccauc

SEQ ID NO: 1654542 - RNA, 19 nt, Human
uauauuuuuauauuuacua

SEQ ID NO: 1654543 - RNA, 19 nt, Human
uauauuuuuuguuaaauga

SEQ ID NO: 1654544 - RNA, 14 nt, Human
uagugaugguuccc

SEQ ID NO: 1654545 - RNA, 18 nt, Human
uagugaugguuccccugu

SEQ ID NO: 1654546 - RNA, 18 nt, Human
uagucaaauugugugaaa

SEQ ID NO: 1654547 - RNA, 18 nt, Human
uaguggauggaaggggcu

SEQ ID NO: 1654548 - RNA, 15 nt, Human
uaguggauggaaggg

SEQ ID NO: 1654549 - RNA, 15 nt, Human
uaguggauguucuga

SEQ ID NO: 1654550 - RNA, 13 nt, Human
uaguuucuccaag

SEQ ID NO: 1654551 - RNA, 23 nt, Human
uaguuugauuaaauucuugcaaa

SEQ ID NO: 1654552 - RNA, 12 nt, Human
uaguuugcaguu

SEQ ID NO: 1654553 - RNA, 21 nt, Human
uaguuguaccgcaaugugacu

SEQ ID NO: 1654554 - RNA, 14 nt, Human
uaguuuauaaaaga

SEQ ID NO: 1654555 - RNA, 15 nt, Human
uaguuuuauaugcuu

SEQ ID NO: 1654556 - RNA, 20 nt, Human
uauaaugaaugaaacauuuu

SEQ ID NO: 1654557 - RNA, 18 nt, Human
uauaaugaaugaaacauu

SEQ ID NO: 1654558 - RNA, 18 nt, Human
uauaacaaugcuguauuu

SEQ ID NO: 1654559 - RNA, 18 nt, Human
uauaaaucgcuuuugaua

SEQ ID NO: 1654560 - RNA, 19 nt, Human
uauaaaucgcuuuugauaa

SEQ ID NO: 1654561 - RNA, 20 nt, Human
uauaaaucgcuuuugauaau

SEQ ID NO: 1654562 - RNA, 14 nt, Human
uauaauguaagcuc

SEQ ID NO: 1654563 - RNA, 19 nt, Human
uauaauguaagcucuacug

SEQ ID NO: 1654564 - RNA, 20 nt, Human
uauaauguaagcucuacuga

SEQ ID NO: 1654565 - RNA, 17 nt, Human
uauaauucuacuuugag

SEQ ID NO: 1654566 - RNA, 20 nt, Human
uauacucuuauagacaacau

SEQ ID NO: 1654567 - RNA, 17 nt, Human
uauacccccugcaaagc

SEQ ID NO: 1654568 - RNA, 13 nt, Human
ggaagagccuugc

SEQ ID NO: 1654569 - RNA, 17 nt, Human
ggaagcacagcuucauu

SEQ ID NO: 1654570 - RNA, 13 nt, Human
ggaagcacaugcc

SEQ ID NO: 1654571 - RNA, 14 nt, Human
ggaagcacaugccu

SEQ ID NO: 1654572 - RNA, 15 nt, Human
ggaagcacaugccuc

SEQ ID NO: 1654573 - RNA, 17 nt, Human
ggaagcacaugccucuc

SEQ ID NO: 1654574 - RNA, 13 nt, Human
ggaagccagcagg

SEQ ID NO: 1654575 - RNA, 14 nt, Human
ggaagccagcaggc

SEQ ID NO: 1654576 - RNA, 22 nt, Human
ggaagccaaaccucugugagca

SEQ ID NO: 1654577 - RNA, 15 nt, Human
ggaagccagcaggcu

SEQ ID NO: 1654578 - RNA, 16 nt, Human
ggaagccagcaggcuc

SEQ ID NO: 1654579 - RNA, 17 nt, Human
ggaagccagcaggcucu

SEQ ID NO: 1654580 - RNA, 18 nt, Human
ggaagccagcaggcucuc

SEQ ID NO: 1654581 - RNA, 13 nt, Human
ggaagcagcuuuc

SEQ ID NO: 1654582 - RNA, 23 nt, Human
ggaagcacaugccucucucaggc

SEQ ID NO: 1654583 - RNA, 21 nt, Human
ggaagcacaugccucucucag

SEQ ID NO: 1654584 - RNA, 22 nt, Human
ggaagcacaugccucucucagg

SEQ ID NO: 1654585 - RNA, 15 nt, Human
ggaaaaucagccugc

SEQ ID NO: 1654586 - RNA, 19 nt, Human
ggaaaaguuuaauauuaaa

SEQ ID NO: 1654587 - RNA, 14 nt, Human
ggaaaauaaauuau

SEQ ID NO: 1654588 - RNA, 12 nt, Human
ggaaauauuuau

SEQ ID NO: 1654589 - RNA, 13 nt, Human
ggaaauauuuauu

SEQ ID NO: 1654590 - RNA, 15 nt, Human
ggaaauauuuauuuu

SEQ ID NO: 1654591 - RNA, 17 nt, Human
ggaaauauuuauuuuaa

SEQ ID NO: 1654592 - RNA, 18 nt, Human
ggaaauauuuauuuuaau

SEQ ID NO: 1654593 - RNA, 23 nt, Human
ggaacuagacucccaagcuggac

SEQ ID NO: 1654594 - RNA, 21 nt, Human
ggaacgcguugaaauuguaau

SEQ ID NO: 1654595 - RNA, 17 nt, Human
ggaacgcguugaaauug

SEQ ID NO: 1654596 - RNA, 19 nt, Human
ggaacagacuggaagcaca

SEQ ID NO: 1654597 - RNA, 20 nt, Human
ggaacagacuggaagcacag

SEQ ID NO: 1654598 - RNA, 16 nt, Human
ggaaaucaaauaugca

SEQ ID NO: 1654599 - RNA, 14 nt, Human
gcuuugggcugccc

SEQ ID NO: 1654600 - RNA, 20 nt, Human
gcuuuaauaucaucaguauu

SEQ ID NO: 1654601 - RNA, 22 nt, Human
gcuuuaauaucaucaguauuga

SEQ ID NO: 1654602 - RNA, 23 nt, Human
gcuuuaauaucaucaguauugaa

SEQ ID NO: 1654603 - RNA, 13 nt, Human
ggaaaaauagccu

SEQ ID NO: 1654604 - RNA, 14 nt, Human
ggaaaaacugauuu

SEQ ID NO: 1654605 - RNA, 22 nt, Human
ggaaaaccaagccguggcuucc

SEQ ID NO: 1654606 - RNA, 15 nt, Human
ggaaaaauagccugc

SEQ ID NO: 1654607 - RNA, 18 nt, Human
gcuuugggcugcccuggu

SEQ ID NO: 1654608 - RNA, 15 nt, Human
gcuuugggcugcccu

SEQ ID NO: 1654609 - RNA, 16 nt, Human
gcuuugggcugcccug

SEQ ID NO: 1654610 - RNA, 17 nt, Human
gcuuuuaaaaaaaaaua

SEQ ID NO: 1654611 - RNA, 14 nt, Human
gcuuuuacuuaaac

SEQ ID NO: 1654612 - RNA, 20 nt, Human
ggaaaaaauaacaaugaaag

SEQ ID NO: 1654613 - RNA, 17 nt, Human
gcuucucacugccaugc

SEQ ID NO: 1654614 - RNA, 21 nt, Human
gcuuccagugaggcucugccc

SEQ ID NO: 1654615 - RNA, 19 nt, Human
gcuuccagugaggcucugc

SEQ ID NO: 1654616 - RNA, 20 nt, Human
gcuuccagugaggcucugcc

SEQ ID NO: 1654617 - RNA, 13 nt, Human
gcuguucagcugg

SEQ ID NO: 1654618 - RNA, 23 nt, Human
gcuguucacagccagacuggcac

SEQ ID NO: 1654619 - RNA, 15 nt, Human
gcuguucacagccag

SEQ ID NO: 1654620 - RNA, 16 nt, Human
gcuguucacagccaga

SEQ ID NO: 1654621 - RNA, 16 nt, Human
gcuucuguugcugccu

SEQ ID NO: 1654622 - RNA, 22 nt, Human
gcuugcagagaugaggccgcca

SEQ ID NO: 1654623 - RNA, 16 nt, Human
gcuugccaucccuccc

SEQ ID NO: 1654624 - RNA, 14 nt, Human
gcuuggaggaagga

SEQ ID NO: 1654625 - RNA, 15 nt, Human
gcuuggaggaaggaa

SEQ ID NO: 1654626 - RNA, 13 nt, Human
gcuuggaggaagg

SEQ ID NO: 1654627 - RNA, 18 nt, Human
gcuugcccuguuaaaaga

SEQ ID NO: 1654628 - RNA, 21 nt, Human
gcuugccaucccucccuccac

SEQ ID NO: 1654629 - RNA, 18 nt, Human
gcuugccaucccucccuc

SEQ ID NO: 1654630 - RNA, 17 nt, Human
gcuugcccuggugccuc

SEQ ID NO: 1654631 - RNA, 19 nt, Human
gcuugcccuggugccucac

SEQ ID NO: 1654632 - RNA, 16 nt, Human
gcuggggccaggcugg

SEQ ID NO: 1654633 - RNA, 19 nt, Human
gcuggggccaggcuggguc

SEQ ID NO: 1654634 - RNA, 18 nt, Human
gcugggcuucaguggcag

SEQ ID NO: 1654635 - RNA, 19 nt, Human
gcugggcuucaguggcagc

SEQ ID NO: 1654636 - RNA, 12 nt, Human
gcuggggccagu

SEQ ID NO: 1654637 - RNA, 23 nt, Human
gcugggggaagaagcucucuccu

SEQ ID NO: 1654638 - RNA, 13 nt, Human
gcugggggccuca

SEQ ID NO: 1654639 - RNA, 15 nt, Human
gcuggucccacucag

SEQ ID NO: 1654640 - RNA, 19 nt, Human
gcuggucccacucagucca

SEQ ID NO: 1654641 - RNA, 19 nt, Human
gcugggggccucagugcca

SEQ ID NO: 1654642 - RNA, 20 nt, Human
gcugggggccucagugccac

SEQ ID NO: 1654643 - RNA, 16 nt, Human
gcugggagcucugcag

SEQ ID NO: 1654644 - RNA, 15 nt, Human
gcugggagcucugca

SEQ ID NO: 1654645 - RNA, 17 nt, Human
gcugggauuacaggcgu

SEQ ID NO: 1654646 - RNA, 18 nt, Human
gcugggauuacaggcgug

SEQ ID NO: 1654647 - RNA, 19 nt, Human
gcugggauuacaggcuccu

SEQ ID NO: 1654648 - RNA, 20 nt, Human
gcugggauuacaggcuccug

SEQ ID NO: 1654649 - RNA, 21 nt, Human
gcugggauuacaggcuccugc

SEQ ID NO: 1654650 - RNA, 17 nt, Human
gcugggcuucaguggca

SEQ ID NO: 1654651 - RNA, 19 nt, Human
gcugggagagccuuccagg

SEQ ID NO: 1654652 - RNA, 22 nt, Human
gcugggagagccuuccaggggu

SEQ ID NO: 1654653 - RNA, 12 nt, Human
gcugggagagcc

SEQ ID NO: 1654654 - RNA, 13 nt, Human
gcugggagagccu

SEQ ID NO: 1654655 - RNA, 17 nt, Human
gcugggagagccuucca

SEQ ID NO: 1654656 - RNA, 18 nt, Human
gcugggagagccuuccag

SEQ ID NO: 1654657 - RNA, 19 nt, Human
gcugucccuuacgugaguc

SEQ ID NO: 1654658 - RNA, 22 nt, Human
gcugucccuuacgugaguccug

SEQ ID NO: 1654659 - RNA, 21 nt, Human
gcugucccuuacgugaguccu

SEQ ID NO: 1654660 - RNA, 17 nt, Human
gcugucaauuacaggaa

SEQ ID NO: 1654661 - RNA, 19 nt, Human
gcugucaauuacaggaagu

SEQ ID NO: 1654662 - RNA, 22 nt, Human
gcugucaauuacaggaaguacu

SEQ ID NO: 1654663 - RNA, 23 nt, Human
gcugucaauuacaggaaguacug

SEQ ID NO: 1654664 - RNA, 24 nt, Human
gcuggugcccugcuuucagauacu

SEQ ID NO: 1654665 - RNA, 22 nt, Human
gcuggugcccugcuuucagaua

SEQ ID NO: 1654666 - RNA, 20 nt, Human
gcuggucccacucaguccau

SEQ ID NO: 1654667 - RNA, 18 nt, Human
gcuggugucaccugaaga

SEQ ID NO: 1654668 - RNA, 21 nt, Human
gcugguuagagguucccuuug

SEQ ID NO: 1654669 - RNA, 15 nt, Human
gcugguucaggguug

SEQ ID NO: 1654670 - RNA, 16 nt, Human
gcugucaauuacagga

SEQ ID NO: 1654671 - RNA, 22 nt, Human
gcugguucaggguuggccccug

SEQ ID NO: 1654672 - RNA, 22 nt, Human
gcuguauuuuaaaagaaugauu

SEQ ID NO: 1654673 - RNA, 12 nt, Human
gcuggcccugcc

SEQ ID NO: 1654674 - RNA, 13 nt, Human
gcuggcccugccc

SEQ ID NO: 1654675 - RNA, 17 nt, Human
gcuggccgggagccuga

SEQ ID NO: 1654676 - RNA, 20 nt, Human
gcugggacaugggaaagggg

SEQ ID NO: 1654677 - RNA, 19 nt, Human
gcugggacuacagguguga

SEQ ID NO: 1654678 - RNA, 13 nt, Human
gcugggacuacag

SEQ ID NO: 1654679 - RNA, 18 nt, Human
gcugggacuacaggcacc

SEQ ID NO: 1654680 - RNA, 19 nt, Human
gcugggacuacaggcaccc

SEQ ID NO: 1654681 - RNA, 20 nt, Human
gcugggacuacaggcaccca

SEQ ID NO: 1654682 - RNA, 18 nt, Human
gcuggaccuugaacuggg

SEQ ID NO: 1654683 - RNA, 17 nt, Human
gcugcuugggcuucauc

SEQ ID NO: 1654684 - RNA, 22 nt, Human
gcugcuugggcuucauccuccu

SEQ ID NO: 1654685 - RNA, 21 nt, Human
gcuggaccuugaacuggguac

SEQ ID NO: 1654686 - RNA, 22 nt, Human
gcuggaccuugaacuggguacu

SEQ ID NO: 1654687 - RNA, 13 nt, Human
gcugcuucaagga

SEQ ID NO: 1654688 - RNA, 19 nt, Human
gcugcgguccacccaggag

SEQ ID NO: 1654689 - RNA, 17 nt, Human
gcugcgguccacccagg

SEQ ID NO: 1654690 - RNA, 18 nt, Human
gcugcgguccacccagga

SEQ ID NO: 1654691 - RNA, 23 nt, Human
gcugcuucaaggauccugagcca

SEQ ID NO: 1654692 - RNA, 21 nt, Human
gcugcuucaaggauccugagc

SEQ ID NO: 1654693 - RNA, 22 nt, Human
gcugcuucaaggauccugagcc

SEQ ID NO: 1654694 - RNA, 16 nt, Human
gcugcuugggcuucau

SEQ ID NO: 1654695 - RNA, 17 nt, Human
gcugcccuuucugggca

SEQ ID NO: 1654696 - RNA, 23 nt, Human
gcugcccuggugcugccacacuu

SEQ ID NO: 1654697 - RNA, 12 nt, Human
gcugcccuguga

SEQ ID NO: 1654698 - RNA, 14 nt, Human
gcugcccugugagu

SEQ ID NO: 1654699 - RNA, 20 nt, Human
gcugcccuggugcugccaca

SEQ ID NO: 1654700 - RNA, 22 nt, Human
gcugcccuggugcugccacacu

SEQ ID NO: 1654701 - RNA, 11 nt, Human
gcugcccugug

SEQ ID NO: 1654702 - RNA, 18 nt, Human
gcugcccuggugcugcca

SEQ ID NO: 1654703 - RNA, 19 nt, Human
gcugcccuggugcugccac

SEQ ID NO: 1654704 - RNA, 22 nt, Human
gcuagcagcagggagggcuucu

SEQ ID NO: 1654705 - RNA, 18 nt, Human
gcuagauguauguacuuc

SEQ ID NO: 1654706 - RNA, 14 nt, Human
ggccaggccagagg

SEQ ID NO: 1654707 - RNA, 16 nt, Human
ggccaggccagaggga

SEQ ID NO: 1654708 - RNA, 18 nt, Human
ggccaggcugggucgccc

SEQ ID NO: 1654709 - RNA, 22 nt, Human
ggccaggcugggucgcccugga

SEQ ID NO: 1654710 - RNA, 11 nt, Human
ggccaggcugg

SEQ ID NO: 1654711 - RNA, 16 nt, Human
ggccaggagccuccug

SEQ ID NO: 1654712 - RNA, 16 nt, Human
ggccacugugaagaga

SEQ ID NO: 1654713 - RNA, 14 nt, Human
ggccaggagccucc

SEQ ID NO: 1654714 - RNA, 11 nt, Human
ggccacuguga

SEQ ID NO: 1654715 - RNA, 17 nt, Human
ggcagguuggugggggc

SEQ ID NO: 1654716 - RNA, 15 nt, Human
ggcagguuggugggg

SEQ ID NO: 1654717 - RNA, 23 nt, Human
ggcauguucucugaggacacuaa

SEQ ID NO: 1654718 - RNA, 16 nt, Human
ggccaccugcggugcu

SEQ ID NO: 1654719 - RNA, 22 nt, Human
ggccaccugcggugcuaucucc

SEQ ID NO: 1654720 - RNA, 16 nt, Human
ggcauuccccaggagg

SEQ ID NO: 1654721 - RNA, 15 nt, Human
ggcauuccccaggag

SEQ ID NO: 1654722 - RNA, 16 nt, Human
ggccacaagacccuug

SEQ ID NO: 1654723 - RNA, 17 nt, Human
ggccacaagacccuugu

SEQ ID NO: 1654724 - RNA, 16 nt, Human
ggccccucaggguccc

SEQ ID NO: 1654725 - RNA, 19 nt, Human
ggccccucagggucccugg

SEQ ID NO: 1654726 - RNA, 20 nt, Human
ggccccucagggucccuggu

SEQ ID NO: 1654727 - RNA, 21 nt, Human
ggccccucagggucccuggug

SEQ ID NO: 1654728 - RNA, 17 nt, Human
ggccccugccacccugg

SEQ ID NO: 1654729 - RNA, 18 nt, Human
ggccccugccacccuggg

SEQ ID NO: 1654730 - RNA, 13 nt, Human
ggccccugcccgg

SEQ ID NO: 1654731 - RNA, 13 nt, Human
ggccccugccacc

SEQ ID NO: 1654732 - RNA, 16 nt, Human
ggccccugccacccug

SEQ ID NO: 1654733 - RNA, 12 nt, Human
ggccccugccac

SEQ ID NO: 1654734 - RNA, 12 nt, Human
ggccaggcuggu

SEQ ID NO: 1654735 - RNA, 13 nt, Human
ggccaugggccuc

SEQ ID NO: 1654736 - RNA, 22 nt, Human
ggccaugggacagggaggacgc

SEQ ID NO: 1654737 - RNA, 21 nt, Human
ggaucagucugauucccaagc

SEQ ID NO: 1654738 - RNA, 19 nt, Human
ggcaacccccagccugcua

SEQ ID NO: 1654739 - RNA, 18 nt, Human
ggcaacugcauuggcuuu

SEQ ID NO: 1654740 - RNA, 18 nt, Human
ggcaacuugggaacuaga

SEQ ID NO: 1654741 - RNA, 23 nt, Human
ggcaacuugggaacuagacuccc

SEQ ID NO: 1654742 - RNA, 15 nt, Human
ggcaaggcugucaau

SEQ ID NO: 1654743 - RNA, 19 nt, Human
ggcaacugcauuggcuuug

SEQ ID NO: 1654744 - RNA, 16 nt, Human
ggcaaggcugucaauu

SEQ ID NO: 1654745 - RNA, 17 nt, Human
ggcacccggccccugcu

SEQ ID NO: 1654746 - RNA, 15 nt, Human
ggcacccggccccug

SEQ ID NO: 1654747 - RNA, 16 nt, Human
ggcacccggccccugc

SEQ ID NO: 1654748 - RNA, 22 nt, Human
ggcagagcagagaccaucccug

SEQ ID NO: 1654749 - RNA, 20 nt, Human
ggcagagcagagaccauccc

SEQ ID NO: 1654750 - RNA, 15 nt, Human
ggcagagcagagacc

SEQ ID NO: 1654751 - RNA, 16 nt, Human
ggcagagcagagacca

SEQ ID NO: 1654752 - RNA, 17 nt, Human
ggcagaggaaagcaaag

SEQ ID NO: 1654753 - RNA, 23 nt, Human
ggcagaguugaagacagagcuac

SEQ ID NO: 1654754 - RNA, 23 nt, Human
ggcagauacaggaaaagcugcug

SEQ ID NO: 1654755 - RNA, 14 nt, Human
ggcaggaaggcuga

SEQ ID NO: 1654756 - RNA, 13 nt, Human
ggcagguccaggg

SEQ ID NO: 1654757 - RNA, 23 nt, Human
ggcaggucuugaacuccuggccu

SEQ ID NO: 1654758 - RNA, 13 nt, Human
ggcagcucagaga

SEQ ID NO: 1654759 - RNA, 22 nt, Human
ggcagcucaccucucccuugga

SEQ ID NO: 1654760 - RNA, 18 nt, Human
ggcagcucaccucucccu

SEQ ID NO: 1654761 - RNA, 21 nt, Human
ggcagcucaccucucccuugg

SEQ ID NO: 1654762 - RNA, 21 nt, Human
ggcagcuugaggguugggcug

SEQ ID NO: 1654763 - RNA, 21 nt, Human
ggcagcugcgguccacccagg

SEQ ID NO: 1654764 - RNA, 22 nt, Human
ggcagcugccuccccuccucug

SEQ ID NO: 1654765 - RNA, 19 nt, Human
ggcagcugcgguccaccca

SEQ ID NO: 1654766 - RNA, 21 nt, Human
ggcagcugccuccccuccucu

SEQ ID NO: 1654767 - RNA, 18 nt, Human
ggcagcugccuccccucc

SEQ ID NO: 1654768 - RNA, 12 nt, Human
ggagcccuggga

SEQ ID NO: 1654769 - RNA, 13 nt, Human
ggagcccugggag

SEQ ID NO: 1654770 - RNA, 20 nt, Human
ggagcaaaaucgaugcagug

SEQ ID NO: 1654771 - RNA, 20 nt, Human
ggagauuuacaacuggggga

SEQ ID NO: 1654772 - RNA, 15 nt, Human
ggagaggggcacagg

SEQ ID NO: 1654773 - RNA, 21 nt, Human
ggagaccccuuggggagcagg

SEQ ID NO: 1654774 - RNA, 21 nt, Human
ggacugccagucccccugccc

SEQ ID NO: 1654775 - RNA, 17 nt, Human
ggagagcuagcagcagg

SEQ ID NO: 1654776 - RNA, 21 nt, Human
ggagagcuagcagcagggagg

SEQ ID NO: 1654777 - RNA, 11 nt, Human
ggacucugccu

SEQ ID NO: 1654778 - RNA, 15 nt, Human
ggacuccucugucca

SEQ ID NO: 1654779 - RNA, 14 nt, Human
ggacuccucugucc

SEQ ID NO: 1654780 - RNA, 12 nt, Human
ggacuccucugu

SEQ ID NO: 1654781 - RNA, 20 nt, Human
ggaagccagcaggcucucag

SEQ ID NO: 1654782 - RNA, 11 nt, Human
ggagugacaga

SEQ ID NO: 1654783 - RNA, 16 nt, Human
ggagugacagaggcag

SEQ ID NO: 1654784 - RNA, 20 nt, Human
ggagucccaccuuggcugca

SEQ ID NO: 1654785 - RNA, 21 nt, Human
ggagucccaccuuggcugcag

SEQ ID NO: 1654786 - RNA, 17 nt, Human
ggagggcuccagacaca

SEQ ID NO: 1654787 - RNA, 14 nt, Human
ggagggcuccagac

SEQ ID NO: 1654788 - RNA, 15 nt, Human
ggagggcuccagaca

SEQ ID NO: 1654789 - RNA, 16 nt, Human
ggaucacagccucuga

SEQ ID NO: 1654790 - RNA, 23 nt, Human
ggagugaguugauagcacagacc

SEQ ID NO: 1654791 - RNA, 17 nt, Human
ggagugacagaggcagc

SEQ ID NO: 1654792 - RNA, 18 nt, Human
ggagugacagaggcagcc

SEQ ID NO: 1654793 - RNA, 19 nt, Human
ggagugacagaggcagccc

SEQ ID NO: 1654794 - RNA, 21 nt, Human
ggagugacagaggcagcccca

SEQ ID NO: 1654795 - RNA, 12 nt, Human
ggagugagcugg

SEQ ID NO: 1654796 - RNA, 14 nt, Human
ggagugagcugguu

SEQ ID NO: 1654797 - RNA, 21 nt, Human
ggagugaguugauagcacaga

SEQ ID NO: 1654798 - RNA, 12 nt, Human
ggagggcuccag

SEQ ID NO: 1654799 - RNA, 13 nt, Human
ggagggcuccaga

SEQ ID NO: 1654800 - RNA, 12 nt, Human
ggagggagggcu

SEQ ID NO: 1654801 - RNA, 15 nt, Human
ggaggauguucuggg

SEQ ID NO: 1654802 - RNA, 23 nt, Human
ggaggaucacuugaguccagaag

SEQ ID NO: 1654803 - RNA, 17 nt, Human
ggaggaucucuugagcc

SEQ ID NO: 1654804 - RNA, 21 nt, Human
ggaggaucucuugagccuggg

SEQ ID NO: 1654805 - RNA, 20 nt, Human
ggaggacgcucucuggccuu

SEQ ID NO: 1654806 - RNA, 21 nt, Human
ggaggacgcucucuggccuuc

SEQ ID NO: 1654807 - RNA, 19 nt, Human
ggaggacgcucucuggccu

SEQ ID NO: 1654808 - RNA, 14 nt, Human
gggccccagaggcu

SEQ ID NO: 1654809 - RNA, 13 nt, Human
gggccccugccuc

SEQ ID NO: 1654810 - RNA, 15 nt, Human
gggccccugccucuc

SEQ ID NO: 1654811 - RNA, 17 nt, Human
gggccccugccucucug

SEQ ID NO: 1654812 - RNA, 18 nt, Human
gggccccugccucucugc

SEQ ID NO: 1654813 - RNA, 19 nt, Human
gggccccugccucucugca

SEQ ID NO: 1654814 - RNA, 21 nt, Human
gggccccugccucucugcagg

SEQ ID NO: 1654815 - RNA, 22 nt, Human
gggccccugccucucugcaggu

SEQ ID NO: 1654816 - RNA, 13 nt, Human
gggcccugccucc

SEQ ID NO: 1654817 - RNA, 13 nt, Human
gggccuggccuga

SEQ ID NO: 1654818 - RNA, 19 nt, Human
gggccuggccugagcuggg

SEQ ID NO: 1654819 - RNA, 14 nt, Human
gggccuggccugag

SEQ ID NO: 1654820 - RNA, 18 nt, Human
gggccuggccugagcugg

SEQ ID NO: 1654821 - RNA, 17 nt, Human
gggccuggcucaggugg

SEQ ID NO: 1654822 - RNA, 13 nt, Human
gggccuggcuccc

SEQ ID NO: 1654823 - RNA, 15 nt, Human
gggcauggccaggug

SEQ ID NO: 1654824 - RNA, 17 nt, Human
gggcauggccagguggc

SEQ ID NO: 1654825 - RNA, 20 nt, Human
gggcauggccagguggccac

SEQ ID NO: 1654826 - RNA, 12 nt, Human
gggcaugacacg

SEQ ID NO: 1654827 - RNA, 23 nt, Human
gggccacagagaaaguacuucuc

SEQ ID NO: 1654828 - RNA, 16 nt, Human
gggccacagagaaagu

SEQ ID NO: 1654829 - RNA, 17 nt, Human
gggcccagagagggugg

SEQ ID NO: 1654830 - RNA, 23 nt, Human
gggauccuggaguucugguuccu

SEQ ID NO: 1654831 - RNA, 18 nt, Human
gggcaacccuggugacca

SEQ ID NO: 1654832 - RNA, 15 nt, Human
gggauccuccaggug

SEQ ID NO: 1654833 - RNA, 16 nt, Human
gggauccuccaggugc

SEQ ID NO: 1654834 - RNA, 21 nt, Human
gggauaugauuuaaaucagcc

SEQ ID NO: 1654835 - RNA, 13 nt, Human
gggauagagagag

SEQ ID NO: 1654836 - RNA, 13 nt, Human
gggacugagaaau

SEQ ID NO: 1654837 - RNA, 17 nt, Human
gggaggugggauccucc

SEQ ID NO: 1654838 - RNA, 16 nt, Human
gggaggugaccccagg

SEQ ID NO: 1654839 - RNA, 18 nt, Human
gggagugacagaggcagc

SEQ ID NO: 1654840 - RNA, 11 nt, Human
gggagugagcu

SEQ ID NO: 1654841 - RNA, 14 nt, Human
gggagugagcuggu

SEQ ID NO: 1654842 - RNA, 17 nt, Human
gggcagguugguggggg

SEQ ID NO: 1654843 - RNA, 11 nt, Human
gggcagagcag

SEQ ID NO: 1654844 - RNA, 12 nt, Human
gggcagagcaga

SEQ ID NO: 1654845 - RNA, 13 nt, Human
gggcacugguggc

SEQ ID NO: 1654846 - RNA, 16 nt, Human
gggcacugguggcccg

SEQ ID NO: 1654847 - RNA, 20 nt, Human
gggcacucagaagacacuga

SEQ ID NO: 1654848 - RNA, 14 nt, Human
gggcagaaggaaga

SEQ ID NO: 1654849 - RNA, 18 nt, Human
gggcagaaggaagacuuc

SEQ ID NO: 1654850 - RNA, 14 nt, Human
gggcaccggggccu

SEQ ID NO: 1654851 - RNA, 16 nt, Human
gggcacucagaagaca

SEQ ID NO: 1654852 - RNA, 19 nt, Human
gggcacucagaagacacug

SEQ ID NO: 1654853 - RNA, 13 nt, Human
gggcacagggucu

SEQ ID NO: 1654854 - RNA, 16 nt, Human
gggcacagggucucua

SEQ ID NO: 1654855 - RNA, 23 nt, Human
gggcacaccgggcacucagaaga

SEQ ID NO: 1654856 - RNA, 18 nt, Human
gggcacagaaaauggaag

SEQ ID NO: 1654857 - RNA, 20 nt, Human
gggcacagaaaauggaagac

SEQ ID NO: 1654858 - RNA, 21 nt, Human
gggcacagaaaauggaagaca

SEQ ID NO: 1654859 - RNA, 11 nt, Human
ggcugcuucaa

SEQ ID NO: 1654860 - RNA, 12 nt, Human
ggcugcuucaag

SEQ ID NO: 1654861 - RNA, 14 nt, Human
ggcugcuucaagga

SEQ ID NO: 1654862 - RNA, 22 nt, Human
ggcugcuucaaggauccugagc

SEQ ID NO: 1654863 - RNA, 12 nt, Human
ggcugcagggag

SEQ ID NO: 1654864 - RNA, 13 nt, Human
ggcugcagggagu

SEQ ID NO: 1654865 - RNA, 14 nt, Human
ggcugcugaaggcu

SEQ ID NO: 1654866 - RNA, 18 nt, Human
ggcugcugaaggcucgag

SEQ ID NO: 1654867 - RNA, 15 nt, Human
ggcugcugaaggcuc

SEQ ID NO: 1654868 - RNA, 17 nt, Human
ggcugcugaaggcucga

SEQ ID NO: 1654869 - RNA, 15 nt, Human
ggcugggcagaggaa

SEQ ID NO: 1654870 - RNA, 19 nt, Human
ggcugggcagaggaaagca

SEQ ID NO: 1654871 - RNA, 13 nt, Human
ggcugggcagagg

SEQ ID NO: 1654872 - RNA, 14 nt, Human
ggcugggcagagga

SEQ ID NO: 1654873 - RNA, 20 nt, Human
ggcugggagagccuuccagg

SEQ ID NO: 1654874 - RNA, 23 nt, Human
ggcugggagagccuuccaggggu

SEQ ID NO: 1654875 - RNA, 19 nt, Human
ggcugggagagccuuccag

SEQ ID NO: 1654876 - RNA, 23 nt, Human
ggcugcuucaaggauccugagcc

SEQ ID NO: 1654877 - RNA, 24 nt, Human
ggcugcaaaggguaucaggugcug

SEQ ID NO: 1654878 - RNA, 17 nt, Human
ggcugcaccggcuggcc

SEQ ID NO: 1654879 - RNA, 18 nt, Human
ggcugcaccggcuggccu

SEQ ID NO: 1654880 - RNA, 19 nt, Human
ggcugcaccggcuggccug

SEQ ID NO: 1654881 - RNA, 18 nt, Human
ggcugcaaaggguaucag

SEQ ID NO: 1654882 - RNA, 22 nt, Human
ggcugaugccaaguuguuugag

SEQ ID NO: 1654883 - RNA, 22 nt, Human
ggcugcaaaggguaucaggugc

SEQ ID NO: 1654884 - RNA, 23 nt, Human
ggcugcaaaggguaucaggugcu

SEQ ID NO: 1654885 - RNA, 21 nt, Human
ggcugaugccaaguuguuuga

SEQ ID NO: 1654886 - RNA, 13 nt, Human
ggcucuggagccc

SEQ ID NO: 1654887 - RNA, 14 nt, Human
ggcucuggagccca

SEQ ID NO: 1654888 - RNA, 20 nt, Human
ggccccugcccggcugcgga

SEQ ID NO: 1654889 - RNA, 16 nt, Human
ggccccugcccggcug

SEQ ID NO: 1654890 - RNA, 17 nt, Human
ggccccugcccggcugc

SEQ ID NO: 1654891 - RNA, 13 nt, Human
ggcugagguggga

SEQ ID NO: 1654892 - RNA, 15 nt, Human
ggcugaggugggagg

SEQ ID NO: 1654893 - RNA, 13 nt, Human
gggaaugaagaua

SEQ ID NO: 1654894 - RNA, 17 nt, Human
gggaagggggcugggac

SEQ ID NO: 1654895 - RNA, 14 nt, Human
gggaagggggcugg

SEQ ID NO: 1654896 - RNA, 16 nt, Human
gggaagggggcuggga

SEQ ID NO: 1654897 - RNA, 22 nt, Human
gggaaggcagggagggccuggg

SEQ ID NO: 1654898 - RNA, 23 nt, Human
gggaaggauacaaaagcauguga

SEQ ID NO: 1654899 - RNA, 21 nt, Human
gggaaggauacaaaagcaugu

SEQ ID NO: 1654900 - RNA, 17 nt, Human
ggcuuuucugauccagu

SEQ ID NO: 1654901 - RNA, 14 nt, Human
ggcuuuugugcauu

SEQ ID NO: 1654902 - RNA, 23 nt, Human
gggacaaggacuaggguccuggg

SEQ ID NO: 1654903 - RNA, 17 nt, Human
gggaauuucuucaacuc

SEQ ID NO: 1654904 - RNA, 14 nt, Human
gggaccccugagcu

SEQ ID NO: 1654905 - RNA, 17 nt, Human
gggacuacaggcaccca

SEQ ID NO: 1654906 - RNA, 16 nt, Human
gggacucaaugcacug

SEQ ID NO: 1654907 - RNA, 12 nt, Human
gggaccucaggc

SEQ ID NO: 1654908 - RNA, 13 nt, Human
gggaccucaggcc

SEQ ID NO: 1654909 - RNA, 15 nt, Human
gggaccucaggccug

SEQ ID NO: 1654910 - RNA, 18 nt, Human
ggcugggcuucaguggca

SEQ ID NO: 1654911 - RNA, 13 nt, Human
ggcugggcuucag

SEQ ID NO: 1654912 - RNA, 17 nt, Human
ggcugggcuucaguggc

SEQ ID NO: 1654913 - RNA, 17 nt, Human
ggcugggcucccuuccc

SEQ ID NO: 1654914 - RNA, 18 nt, Human
ggcugggcucccuuccca

SEQ ID NO: 1654915 - RNA, 12 nt, Human
ggcugggcuuca

SEQ ID NO: 1654916 - RNA, 21 nt, Human
ggcuuagucacugagacagcc

SEQ ID NO: 1654917 - RNA, 14 nt, Human
ggcuuuucacugcu

SEQ ID NO: 1654918 - RNA, 15 nt, Human
ggcuuuucacugcug

SEQ ID NO: 1654919 - RNA, 17 nt, Human
ggcuuuucacugcuggc

SEQ ID NO: 1654920 - RNA, 12 nt, Human
ggcuuuucugau

SEQ ID NO: 1654921 - RNA, 19 nt, Human
ggcuuuucacugcuggcug

SEQ ID NO: 1654922 - RNA, 22 nt, Human
ggcuuuucacugcuggcugccu

SEQ ID NO: 1654923 - RNA, 13 nt, Human
ggcuuuucugauc

SEQ ID NO: 1654924 - RNA, 16 nt, Human
ggcuuuucugauccag

SEQ ID NO: 1654925 - RNA, 10 nt, Human
ggcuuuugug

SEQ ID NO: 1654926 - RNA, 21 nt, Human
ggcuuggggaccagagcugcc

SEQ ID NO: 1654927 - RNA, 22 nt, Human
ggcuugaguuuaaauuguaaua

SEQ ID NO: 1654928 - RNA, 18 nt, Human
gguagcauuuguguugaa

SEQ ID NO: 1654929 - RNA, 23 nt, Human
gguagaaauaucugaaaauguau

SEQ ID NO: 1654930 - RNA, 22 nt, Human
gguagaagcccuucuaccuucc

SEQ ID NO: 1654931 - RNA, 11 nt, Human
gguacccacug

SEQ ID NO: 1654932 - RNA, 16 nt, Human
gguacccacugcucug

SEQ ID NO: 1654933 - RNA, 13 nt, Human
gguacccacugcu

SEQ ID NO: 1654934 - RNA, 20 nt, Human
gguacuuguggacacagcuc

SEQ ID NO: 1654935 - RNA, 22 nt, Human
gguagaaauaucugaaaaugua

SEQ ID NO: 1654936 - RNA, 16 nt, Human
gguacuuguggacaca

SEQ ID NO: 1654937 - RNA, 17 nt, Human
gguacuuguggacacag

SEQ ID NO: 1654938 - RNA, 15 nt, Human
ggucccaccccacac

SEQ ID NO: 1654939 - RNA, 16 nt, Human
ggucccaccccacaca

SEQ ID NO: 1654940 - RNA, 11 nt, Human
ggucagagccu

SEQ ID NO: 1654941 - RNA, 16 nt, Human
ggucacaggacucugc

SEQ ID NO: 1654942 - RNA, 18 nt, Human
ggucacaggacucugccu

SEQ ID NO: 1654943 - RNA, 12 nt, Human
ggucacucuggc

SEQ ID NO: 1654944 - RNA, 17 nt, Human
gggugcugggccccugc

SEQ ID NO: 1654945 - RNA, 18 nt, Human
gggugcugggccccugcc

SEQ ID NO: 1654946 - RNA, 22 nt, Human
ggguucaagcgauucuucugcu

SEQ ID NO: 1654947 - RNA, 23 nt, Human
ggguucaagcgauucuucugcuu

SEQ ID NO: 1654948 - RNA, 16 nt, Human
ggguuggccccugccc

SEQ ID NO: 1654949 - RNA, 19 nt, Human
ggguucuuucuuccucugc

SEQ ID NO: 1654950 - RNA, 17 nt, Human
ggguucuuucuuccucu

SEQ ID NO: 1654951 - RNA, 17 nt, Human
ggguucuacccaggugc

SEQ ID NO: 1654952 - RNA, 19 nt, Human
ggguuccuuccucugagcc

SEQ ID NO: 1654953 - RNA, 11 nt, Human
ggguuccugca

SEQ ID NO: 1654954 - RNA, 20 nt, Human
ggguuccuuccucugagccu

SEQ ID NO: 1654955 - RNA, 21 nt, Human
ggguuccuuccucugagccuu

SEQ ID NO: 1654956 - RNA, 12 nt, Human
ggguucuaccca

SEQ ID NO: 1654957 - RNA, 17 nt, Human
gggugaagugaagacaa

SEQ ID NO: 1654958 - RNA, 19 nt, Human
gggugacagagcaagugag

SEQ ID NO: 1654959 - RNA, 17 nt, Human
ggggcugaggugggagg

SEQ ID NO: 1654960 - RNA, 16 nt, Human
ggggcaacccugguga

SEQ ID NO: 1654961 - RNA, 11 nt, Human
gggccugggcc

SEQ ID NO: 1654962 - RNA, 16 nt, Human
ggggaaaaucagccug

SEQ ID NO: 1654963 - RNA, 17 nt, Human
ggggaaaaucagccugc

SEQ ID NO: 1654964 - RNA, 19 nt, Human
ggggaaaaucagccugcuc

SEQ ID NO: 1654965 - RNA, 11 nt, Human
ggggauucuua

SEQ ID NO: 1654966 - RNA, 15 nt, Human
ggggauucuuaaagu

SEQ ID NO: 1654967 - RNA, 18 nt, Human
ggggaggggcugugggcg

SEQ ID NO: 1654968 - RNA, 21 nt, Human
ggggaaaaucagccugcucca

SEQ ID NO: 1654969 - RNA, 24 nt, Human
ggggaaaaucagccugcuccagcu

SEQ ID NO: 1654970 - RNA, 17 nt, Human
ggguaagugagagaggg

SEQ ID NO: 1654971 - RNA, 14 nt, Human
gggucucacucugu

SEQ ID NO: 1654972 - RNA, 12 nt, Human
gggucugaggaa

SEQ ID NO: 1654973 - RNA, 21 nt, Human
gggucugaggaauccagaccc

SEQ ID NO: 1654974 - RNA, 22 nt, Human
gggggaggugggauccuccagg

SEQ ID NO: 1654975 - RNA, 23 nt, Human
ggggcugcaccggcuggccuggc

SEQ ID NO: 1654976 - RNA, 19 nt, Human
ggggcugaggugggaggau

SEQ ID NO: 1654977 - RNA, 12 nt, Human
ggggcugcaccg

SEQ ID NO: 1654978 - RNA, 21 nt, Human
ggggcugcaccggcuggccug

SEQ ID NO: 1654979 - RNA, 22 nt, Human
ggggcugcaccggcuggccugg

SEQ ID NO: 1654980 - RNA, 20 nt, Human
gggguggggggggugcuggg

SEQ ID NO: 1654981 - RNA, 17 nt, Human
gggguggggaccucagg

SEQ ID NO: 1654982 - RNA, 18 nt, Human
ggggugcugggccccugc

SEQ ID NO: 1654983 - RNA, 12 nt, Human
gggguggccucc

SEQ ID NO: 1654984 - RNA, 17 nt, Human
gggggaucacagccucu

SEQ ID NO: 1654985 - RNA, 17 nt, Human
gguuaggcauuguggga

SEQ ID NO: 1654986 - RNA, 21 nt, Human
gguuaguggauggaaggggcu

SEQ ID NO: 1654987 - RNA, 22 nt, Human
gguuaguggauggaaggggcug

SEQ ID NO: 1654988 - RNA, 20 nt, Human
gguuaucugaagucagaucu

SEQ ID NO: 1654989 - RNA, 13 nt, Human
gguuauggagagg

SEQ ID NO: 1654990 - RNA, 21 nt, Human
gguuacccaguuagcucucaa

SEQ ID NO: 1654991 - RNA, 13 nt, Human
gguuaagucuguu

SEQ ID NO: 1654992 - RNA, 16 nt, Human
gguuaagucuguuuua

SEQ ID NO: 1654993 - RNA, 23 nt, Human
gguuaagucuguuuuaugacuuc

SEQ ID NO: 1654994 - RNA, 14 nt, Human
gguucuuucuuccu

SEQ ID NO: 1654995 - RNA, 16 nt, Human
gguucuuucuuccucu

SEQ ID NO: 1654996 - RNA, 22 nt, Human
gguucuuguauuaagaaugaaa

SEQ ID NO: 1654997 - RNA, 14 nt, Human
gguucuuguauuaa

SEQ ID NO: 1654998 - RNA, 13 nt, Human
gguugagguuuca

SEQ ID NO: 1654999 - RNA, 13 nt, Human
gguucaaagauau

SEQ ID NO: 1655000 - RNA, 21 nt, Human
gguucaaagauauuuugcuuu

SEQ ID NO: 1655001 - RNA, 16 nt, Human
gguggugaccucugcc

SEQ ID NO: 1655002 - RNA, 14 nt, Human
gguggugaccucug

SEQ ID NO: 1655003 - RNA, 15 nt, Human
gguggugaccucugc

SEQ ID NO: 1655004 - RNA, 12 nt, Human
gguggcuggguu

SEQ ID NO: 1655005 - RNA, 16 nt, Human
gguguaugugugaagu

SEQ ID NO: 1655006 - RNA, 17 nt, Human
ggugucaagagggucug

SEQ ID NO: 1655007 - RNA, 19 nt, Human
ggugucaagagggucugag

SEQ ID NO: 1655008 - RNA, 19 nt, Human
ggugucaccugaagacuca

SEQ ID NO: 1655009 - RNA, 18 nt, Human
ggugguuucagaaaugug

SEQ ID NO: 1655010 - RNA, 17 nt, Human
ggugguuucagaaaugu

SEQ ID NO: 1655011 - RNA, 21 nt, Human
ggugguuauggagaggguguc

SEQ ID NO: 1655012 - RNA, 18 nt, Human
ggugguuuucuguucuuu

SEQ ID NO: 1655013 - RNA, 15 nt, Human
ggugguuuucuguuc

SEQ ID NO: 1655014 - RNA, 17 nt, Human
ggucccaccccacacac

SEQ ID NO: 1655015 - RNA, 21 nt, Human
ggucucacuauguugcccagg

SEQ ID NO: 1655016 - RNA, 22 nt, Human
ggucucacucugucgcccaguc

SEQ ID NO: 1655017 - RNA, 23 nt, Human
ggucucacucugucgcccagucu

SEQ ID NO: 1655018 - RNA, 14 nt, Human
ggugacuuuggaua

SEQ ID NO: 1655019 - RNA, 18 nt, Human
ggugacuuuggauaauaa

SEQ ID NO: 1655020 - RNA, 19 nt, Human
ggugacuuuggauaauaag

SEQ ID NO: 1655021 - RNA, 20 nt, Human
ggugacuuuggauaauaagg

SEQ ID NO: 1655022 - RNA, 21 nt, Human
ggugacuuuggauaauaagga

SEQ ID NO: 1655023 - RNA, 22 nt, Human
ggugaccagcaccaucucuccu

SEQ ID NO: 1655024 - RNA, 14 nt, Human
ggucugacccacug

SEQ ID NO: 1655025 - RNA, 15 nt, Human
ggugcugccauccag

SEQ ID NO: 1655026 - RNA, 21 nt, Human
ggugcuaucucccccagcccc

SEQ ID NO: 1655027 - RNA, 21 nt, Human
ggugcugccauccagguucag

SEQ ID NO: 1655028 - RNA, 19 nt, Human
gguggcagugggagcugcc

SEQ ID NO: 1655029 - RNA, 22 nt, Human
gguggcagugggagcugccugu

SEQ ID NO: 1655030 - RNA, 23 nt, Human
gguggccucccaacucaccccag

SEQ ID NO: 1655031 - RNA, 20 nt, Human
gguggccacuccagaccccu

SEQ ID NO: 1655032 - RNA, 21 nt, Human
gguggccacuccagaccccug

SEQ ID NO: 1655033 - RNA, 22 nt, Human
gguggccacuccagaccccugg

SEQ ID NO: 1655034 - RNA, 23 nt, Human
gguggccacuccagaccccuggc

SEQ ID NO: 1655035 - RNA, 22 nt, Human
gguggccucccaacucacccca

SEQ ID NO: 1655036 - RNA, 15 nt, Human
ggugagaagcagagg

SEQ ID NO: 1655037 - RNA, 16 nt, Human
ggugagaggggaacag

SEQ ID NO: 1655038 - RNA, 16 nt, Human
ggugcuaucuccccca

SEQ ID NO: 1655039 - RNA, 17 nt, Human
ggugcuaucucccccag

SEQ ID NO: 1655040 - RNA, 19 nt, Human
ggugcuaucucccccagcc

SEQ ID NO: 1655041 - RNA, 20 nt, Human
ggugcuaucucccccagccc

SEQ ID NO: 1655042 - RNA, 15 nt, Human
ggugcgaucuggguu

SEQ ID NO: 1655043 - RNA, 23 nt, Human
ggugcuacaaaaacacagcaagg

SEQ ID NO: 1655044 - RNA, 22 nt, Human
gcccaucugggggccucuucug

SEQ ID NO: 1655045 - RNA, 16 nt, Human
gccccagugcccacag

SEQ ID NO: 1655046 - RNA, 17 nt, Human
gccccagugcccacagg

SEQ ID NO: 1655047 - RNA, 21 nt, Human
gccccagugcccacaggauca

SEQ ID NO: 1655048 - RNA, 23 nt, Human
gccccauccucuguacagagccc

SEQ ID NO: 1655049 - RNA, 17 nt, Human
gccccauucugccugcc

SEQ ID NO: 1655050 - RNA, 18 nt, Human
gccccauucugccugccc

SEQ ID NO: 1655051 - RNA, 20 nt, Human
gccccauucugccugcccag

SEQ ID NO: 1655052 - RNA, 21 nt, Human
gccccauucugccugcccagg

SEQ ID NO: 1655053 - RNA, 15 nt, Human
gcccaguugggugga

SEQ ID NO: 1655054 - RNA, 22 nt, Human
gcccagucuggaaugcaguggu

SEQ ID NO: 1655055 - RNA, 16 nt, Human
gcccaggcuggcgugc

SEQ ID NO: 1655056 - RNA, 14 nt, Human
gcccaggcuggcgu

SEQ ID NO: 1655057 - RNA, 15 nt, Human
gcccaggcuggcgug

SEQ ID NO: 1655058 - RNA, 17 nt, Human
gcccaggccugccuguu

SEQ ID NO: 1655059 - RNA, 11 nt, Human
gcccaggcugg

SEQ ID NO: 1655060 - RNA, 12 nt, Human
gcccaggaaagg

SEQ ID NO: 1655061 - RNA, 15 nt, Human
gcccaggaaaggcuc

SEQ ID NO: 1655062 - RNA, 16 nt, Human
gcccaggaaaggcucc

SEQ ID NO: 1655063 - RNA, 18 nt, Human
gcccaggccuccuacagc

SEQ ID NO: 1655064 - RNA, 14 nt, Human
gccccgcccaggcu

SEQ ID NO: 1655065 - RNA, 22 nt, Human
gccccauucugccugcccaggc

SEQ ID NO: 1655066 - RNA, 23 nt, Human
gccccauucugccugcccaggcc

SEQ ID NO: 1655067 - RNA, 23 nt, Human
gccccgaggccuucucugaagga

SEQ ID NO: 1655068 - RNA, 17 nt, Human
gccccgucccccucugg

SEQ ID NO: 1655069 - RNA, 21 nt, Human
gccccgucccccucuggcucc

SEQ ID NO: 1655070 - RNA, 17 nt, Human
gccccgugggguuccuc

SEQ ID NO: 1655071 - RNA, 23 nt, Human
gccccucaacucuccuccagagu

SEQ ID NO: 1655072 - RNA, 19 nt, Human
gccccucagggucccuggu

SEQ ID NO: 1655073 - RNA, 21 nt, Human
gccccucagggucccuggugg

SEQ ID NO: 1655074 - RNA, 17 nt, Human
gccccuucccccuccaa

SEQ ID NO: 1655075 - RNA, 13 nt, Human
gccccugcacaaa

SEQ ID NO: 1655076 - RNA, 23 nt, Human
gccccuggcagccccuguucugg

SEQ ID NO: 1655077 - RNA, 19 nt, Human
gccccugcacuccagccug

SEQ ID NO: 1655078 - RNA, 19 nt, Human
gccccuucugacccaugcu

SEQ ID NO: 1655079 - RNA, 20 nt, Human
gccccuucugacccaugcug

SEQ ID NO: 1655080 - RNA, 13 nt, Human
gcccggcuccagg

SEQ ID NO: 1655081 - RNA, 14 nt, Human
gcccggcuccaggc

SEQ ID NO: 1655082 - RNA, 15 nt, Human
gcccggcuccaggcu

SEQ ID NO: 1655083 - RNA, 12 nt, Human
gcccgggcucug

SEQ ID NO: 1655084 - RNA, 13 nt, Human
gcccgggcucugc

SEQ ID NO: 1655085 - RNA, 14 nt, Human
gcccgggcucugcc

SEQ ID NO: 1655086 - RNA, 15 nt, Human
gcccgggcucugccu

SEQ ID NO: 1655087 - RNA, 18 nt, Human
gcccgggcucugccuccc

SEQ ID NO: 1655088 - RNA, 15 nt, Human
gcccucccugccccu

SEQ ID NO: 1655089 - RNA, 21 nt, Human
gcccgggcucugccucccauc

SEQ ID NO: 1655090 - RNA, 19 nt, Human
gcccgggcucugccuccca

SEQ ID NO: 1655091 - RNA, 20 nt, Human
gcccgggcucugccucccau

SEQ ID NO: 1655092 - RNA, 16 nt, Human
gcccucuccugggcag

SEQ ID NO: 1655093 - RNA, 15 nt, Human
gcccucuccugggca

SEQ ID NO: 1655094 - RNA, 22 nt, Human
gcccucugcccacucccugcaa

SEQ ID NO: 1655095 - RNA, 21 nt, Human
gcccucuccugggcagcugcc

SEQ ID NO: 1655096 - RNA, 19 nt, Human
gcccucuccugggcagcug

SEQ ID NO: 1655097 - RNA, 18 nt, Human
gcccucuccugggcagcu

SEQ ID NO: 1655098 - RNA, 19 nt, Human
gcccacaggaucagucuga

SEQ ID NO: 1655099 - RNA, 13 nt, Human
gcccacaggauca

SEQ ID NO: 1655100 - RNA, 18 nt, Human
gcccacaggaucagucug

SEQ ID NO: 1655101 - RNA, 15 nt, Human
gcccaccccucaaca

SEQ ID NO: 1655102 - RNA, 16 nt, Human
gccauuuguguuuaua

SEQ ID NO: 1655103 - RNA, 16 nt, Human
gcccaaagaugcagcc

SEQ ID NO: 1655104 - RNA, 16 nt, Human
gcccacagcuguauga

SEQ ID NO: 1655105 - RNA, 20 nt, Human
gccauuucuuccacaagagc

SEQ ID NO: 1655106 - RNA, 22 nt, Human
gccauuucuuccacaagagccc

SEQ ID NO: 1655107 - RNA, 17 nt, Human
gccauuucuuccacaag

SEQ ID NO: 1655108 - RNA, 22 nt, Human
gccaugggacagggaggacgcu

SEQ ID NO: 1655109 - RNA, 22 nt, Human
gccauuuaaagcuuauuaaaac

SEQ ID NO: 1655110 - RNA, 16 nt, Human
gccaucccucccucca

SEQ ID NO: 1655111 - RNA, 15 nt, Human
gccaucccucccucc

SEQ ID NO: 1655112 - RNA, 14 nt, Human
gccaugggacaggg

SEQ ID NO: 1655113 - RNA, 19 nt, Human
gccaugggacagggaggac

SEQ ID NO: 1655114 - RNA, 20 nt, Human
gccaggaagccagcaggcuc

SEQ ID NO: 1655115 - RNA, 19 nt, Human
gccaggaagccagcaggcu

SEQ ID NO: 1655116 - RNA, 11 nt, Human
gccaggaagcc

SEQ ID NO: 1655117 - RNA, 17 nt, Human
gccaggaagccagcagg

SEQ ID NO: 1655118 - RNA, 18 nt, Human
gccaggaagccagcaggc

SEQ ID NO: 1655119 - RNA, 23 nt, Human
gccaggggaaaaucagccugcuc

SEQ ID NO: 1655120 - RNA, 17 nt, Human
gccaggggaaaaucagc

SEQ ID NO: 1655121 - RNA, 21 nt, Human
gccaggggaaaaucagccugc

SEQ ID NO: 1655122 - RNA, 22 nt, Human
gccaggggaaaaucagccugcu

SEQ ID NO: 1655123 - RNA, 18 nt, Human
gccagguggccacuccag

SEQ ID NO: 1655124 - RNA, 19 nt, Human
gccauccagguucagcuug

SEQ ID NO: 1655125 - RNA, 20 nt, Human
gccauccagguucagcuugu

SEQ ID NO: 1655126 - RNA, 13 nt, Human
gccaucccagccc

SEQ ID NO: 1655127 - RNA, 14 nt, Human
gccaucccagcccc

SEQ ID NO: 1655128 - RNA, 15 nt, Human
gccaucccagcccca

SEQ ID NO: 1655129 - RNA, 16 nt, Human
gccaucccagccccaa

SEQ ID NO: 1655130 - RNA, 17 nt, Human
gccaucccagccccaau

SEQ ID NO: 1655131 - RNA, 14 nt, Human
gccaucccucccuc

SEQ ID NO: 1655132 - RNA, 13 nt, Human
gccaucccucccu

SEQ ID NO: 1655133 - RNA, 11 nt, Human
gccaucccucc

SEQ ID NO: 1655134 - RNA, 17 nt, Human
gccagauucuuuccuga

SEQ ID NO: 1655135 - RNA, 19 nt, Human
gccagauucuuuccugagg

SEQ ID NO: 1655136 - RNA, 19 nt, Human
gccagagggagugacagag

SEQ ID NO: 1655137 - RNA, 20 nt, Human
gccagagggagugacagagg

SEQ ID NO: 1655138 - RNA, 16 nt, Human
gccagauucuuuccug

SEQ ID NO: 1655139 - RNA, 21 nt, Human
gccagccgagauagccaaggc

SEQ ID NO: 1655140 - RNA, 20 nt, Human
gccagccgagauagccaagg

SEQ ID NO: 1655141 - RNA, 12 nt, Human
gccagccuugac

SEQ ID NO: 1655142 - RNA, 14 nt, Human
gccagccuugacca

SEQ ID NO: 1655143 - RNA, 20 nt, Human
gccagccuugaccauucucc

SEQ ID NO: 1655144 - RNA, 21 nt, Human
gccagccuugaccauucucca

SEQ ID NO: 1655145 - RNA, 22 nt, Human
gccagccuugaccauucuccac

SEQ ID NO: 1655146 - RNA, 14 nt, Human
gccagcugcuuggg

SEQ ID NO: 1655147 - RNA, 16 nt, Human
gccagcugcuugggcu

SEQ ID NO: 1655148 - RNA, 15 nt, Human
gccagcugcuugggc

SEQ ID NO: 1655149 - RNA, 12 nt, Human
gccagagacaca

SEQ ID NO: 1655150 - RNA, 15 nt, Human
gccagagacacaagc

SEQ ID NO: 1655151 - RNA, 18 nt, Human
gccagagggagugacaga

SEQ ID NO: 1655152 - RNA, 16 nt, Human
gccacuccagaccccu

SEQ ID NO: 1655153 - RNA, 18 nt, Human
gccacuccagaccccugg

SEQ ID NO: 1655154 - RNA, 19 nt, Human
gccacuccagaccccuggc

SEQ ID NO: 1655155 - RNA, 19 nt, Human
gccacugcaccgggccaca

SEQ ID NO: 1655156 - RNA, 17 nt, Human
gccacugcaccgggcca

SEQ ID NO: 1655157 - RNA, 18 nt, Human
gccacugcaccgggccac

SEQ ID NO: 1655158 - RNA, 14 nt, Human
gccacggccaggcc

SEQ ID NO: 1655159 - RNA, 15 nt, Human
gccacggccaggcca

SEQ ID NO: 1655160 - RNA, 21 nt, Human
gccacuauuguuagucucuug

SEQ ID NO: 1655161 - RNA, 17 nt, Human
gccacggccaggccaga

SEQ ID NO: 1655162 - RNA, 16 nt, Human
gccacggccaggccag

SEQ ID NO: 1655163 - RNA, 22 nt, Human
gccacguucuuacuaguuuccc

SEQ ID NO: 1655164 - RNA, 14 nt, Human
gcgugagccacugc

SEQ ID NO: 1655165 - RNA, 16 nt, Human
gcgugagaccugcccc

SEQ ID NO: 1655166 - RNA, 16 nt, Human
gcgugagccacugcac

SEQ ID NO: 1655167 - RNA, 15 nt, Human
gcgugagccacugca

SEQ ID NO: 1655168 - RNA, 17 nt, Human
gcuaacauggaaguacu

SEQ ID NO: 1655169 - RNA, 18 nt, Human
gcuaacauggaaguacua

SEQ ID NO: 1655170 - RNA, 13 nt, Human
gcuagacugguga

SEQ ID NO: 1655171 - RNA, 15 nt, Human
gcuagacuggugacu

SEQ ID NO: 1655172 - RNA, 16 nt, Human
gcuagacuggugacug

SEQ ID NO: 1655173 - RNA, 19 nt, Human
gcuagacuggugacugauu

SEQ ID NO: 1655174 - RNA, 20 nt, Human
gcuagacuggugacugauuc

SEQ ID NO: 1655175 - RNA, 22 nt, Human
gcuagacuggugacugauucuu

SEQ ID NO: 1655176 - RNA, 21 nt, Human
gcuagacgagcaggcuucuuc

SEQ ID NO: 1655177 - RNA, 22 nt, Human
gcuagacgagcaggcuucuucc

SEQ ID NO: 1655178 - RNA, 20 nt, Human
gcgccuacaggagugagcac

SEQ ID NO: 1655179 - RNA, 21 nt, Human
gcgccuacaggagugagcacu

SEQ ID NO: 1655180 - RNA, 14 nt, Human
gcgcugccccuggc

SEQ ID NO: 1655181 - RNA, 17 nt, Human
gcgcugccccuggcagc

SEQ ID NO: 1655182 - RNA, 19 nt, Human
gcggaaugaaccacaucuu

SEQ ID NO: 1655183 - RNA, 19 nt, Human
gcggacagccacggccagg

SEQ ID NO: 1655184 - RNA, 23 nt, Human
gcggacagccacggccaggccag

SEQ ID NO: 1655185 - RNA, 19 nt, Human
gcggggacagcuccuucug

SEQ ID NO: 1655186 - RNA, 23 nt, Human
gcggggacagcuccuucuguccu

SEQ ID NO: 1655187 - RNA, 23 nt, Human
gcgguccacccaggagccccgag

SEQ ID NO: 1655188 - RNA, 12 nt, Human
gccuuuuucauu

SEQ ID NO: 1655189 - RNA, 16 nt, Human
gccuuuuucauuauuu

SEQ ID NO: 1655190 - RNA, 20 nt, Human
gccuuuuucauuauuuuauu

SEQ ID NO: 1655191 - RNA, 22 nt, Human
gccuuuuucauuauuuuauuau

SEQ ID NO: 1655192 - RNA, 23 nt, Human
gccuuuuucauuauuuuauuaug

SEQ ID NO: 1655193 - RNA, 18 nt, Human
gccuuggggcugaugcag

SEQ ID NO: 1655194 - RNA, 19 nt, Human
gccuucggccuccauccug

SEQ ID NO: 1655195 - RNA, 16 nt, Human
gccuucagcucuacag

SEQ ID NO: 1655196 - RNA, 13 nt, Human
gccuucagcucua

SEQ ID NO: 1655197 - RNA, 18 nt, Human
gccuucggccuccauccu

SEQ ID NO: 1655198 - RNA, 16 nt, Human
gccuuagaaccuuucu

SEQ ID NO: 1655199 - RNA, 20 nt, Human
gccuuagaagucacacagua

SEQ ID NO: 1655200 - RNA, 17 nt, Human
gccuuagaaccuuucuu

SEQ ID NO: 1655201 - RNA, 23 nt, Human
gccuuauggaacacucugagacu

SEQ ID NO: 1655202 - RNA, 21 nt, Human
gccuuauggaacacucugaga

SEQ ID NO: 1655203 - RNA, 22 nt, Human
gccuuauggaacacucugagac

SEQ ID NO: 1655204 - RNA, 15 nt, Human
gccugguggcagcug

SEQ ID NO: 1655205 - RNA, 16 nt, Human
gccugguggcagcugc

SEQ ID NO: 1655206 - RNA, 17 nt, Human
gccugguggcagcugcg

SEQ ID NO: 1655207 - RNA, 18 nt, Human
gccuguaaucacagcuac

SEQ ID NO: 1655208 - RNA, 15 nt, Human
gccucugcauucagg

SEQ ID NO: 1655209 - RNA, 12 nt, Human
gccucugcauuc

SEQ ID NO: 1655210 - RNA, 21 nt, Human
gccucugcacuccccugcugg

SEQ ID NO: 1655211 - RNA, 15 nt, Human
gccugaagucacaca

SEQ ID NO: 1655212 - RNA, 15 nt, Human
gccucugacacacag

SEQ ID NO: 1655213 - RNA, 16 nt, Human
gccucugacacacagc

SEQ ID NO: 1655214 - RNA, 16 nt, Human
gccucugcacuccccu

SEQ ID NO: 1655215 - RNA, 17 nt, Human
gccucugcacuccccug

SEQ ID NO: 1655216 - RNA, 18 nt, Human
gccucugcacuccccugc

SEQ ID NO: 1655217 - RNA, 19 nt, Human
gccucugcacuccccugcu

SEQ ID NO: 1655218 - RNA, 20 nt, Human
gccucugcacuccccugcug

SEQ ID NO: 1655219 - RNA, 14 nt, Human
gccuggacccugug

SEQ ID NO: 1655220 - RNA, 11 nt, Human
gccugcccagg

SEQ ID NO: 1655221 - RNA, 12 nt, Human
gccugcccaggc

SEQ ID NO: 1655222 - RNA, 10 nt, Human
gccucucugc

SEQ ID NO: 1655223 - RNA, 14 nt, Human
gccucucugcaggu

SEQ ID NO: 1655224 - RNA, 16 nt, Human
gccucucugcaggucc

SEQ ID NO: 1655225 - RNA, 17 nt, Human
gccucucugcagguccc

SEQ ID NO: 1655226 - RNA, 18 nt, Human
gccucucugcaggucccu

SEQ ID NO: 1655227 - RNA, 15 nt, Human
gccucucccaucacu

SEQ ID NO: 1655228 - RNA, 12 nt, Human
gccucagccucc

SEQ ID NO: 1655229 - RNA, 14 nt, Human
gccucagccuccca

SEQ ID NO: 1655230 - RNA, 22 nt, Human
gccucagccucccaaagugcug

SEQ ID NO: 1655231 - RNA, 18 nt, Human
gccucccgaauagcuggg

SEQ ID NO: 1655232 - RNA, 19 nt, Human
gccucccgaauagcuggga

SEQ ID NO: 1655233 - RNA, 14 nt, Human
gccuccccuccucu

SEQ ID NO: 1655234 - RNA, 13 nt, Human
gccuccccuccuc

SEQ ID NO: 1655235 - RNA, 12 nt, Human
gccuccccuccu

SEQ ID NO: 1655236 - RNA, 11 nt, Human
gccuccccucc

SEQ ID NO: 1655237 - RNA, 21 nt, Human
gccucccgaguagcugggacu

SEQ ID NO: 1655238 - RNA, 23 nt, Human
gccucccgaguagcugggacuac

SEQ ID NO: 1655239 - RNA, 20 nt, Human
gccucccgaauagcugggac

SEQ ID NO: 1655240 - RNA, 21 nt, Human
gccucccgaauagcugggacu

SEQ ID NO: 1655241 - RNA, 16 nt, Human
gccuccccuccucugc

SEQ ID NO: 1655242 - RNA, 14 nt, Human
gccuaaggacuucu

SEQ ID NO: 1655243 - RNA, 15 nt, Human
gccuaaggacuucuu

SEQ ID NO: 1655244 - RNA, 18 nt, Human
gccuaaggacuucuuuaa

SEQ ID NO: 1655245 - RNA, 14 nt, Human
gccuaaggcugaac

SEQ ID NO: 1655246 - RNA, 12 nt, Human
gccuaaggacuu

SEQ ID NO: 1655247 - RNA, 13 nt, Human
gccuaaggacuuc

SEQ ID NO: 1655248 - RNA, 17 nt, Human
gccuauuuuaauaaaca

SEQ ID NO: 1655249 - RNA, 22 nt, Human
gccucaagugauucuccugccu

SEQ ID NO: 1655250 - RNA, 24 nt, Human
gccucaagugauucuccugccuca

SEQ ID NO: 1655251 - RNA, 18 nt, Human
gccucagcauccuggcac

SEQ ID NO: 1655252 - RNA, 21 nt, Human
gccucagcauccuggcacccg

SEQ ID NO: 1655253 - RNA, 11 nt, Human
gccguggcuuc

SEQ ID NO: 1655254 - RNA, 12 nt, Human
gccguggcuucc

SEQ ID NO: 1655255 - RNA, 13 nt, Human
gccguggcuuccc

SEQ ID NO: 1655256 - RNA, 15 nt, Human
gccguggcuucccgc

SEQ ID NO: 1655257 - RNA, 11 nt, Human
gccuaaaucca

SEQ ID NO: 1655258 - RNA, 18 nt, Human
gccgucuaccugaggggc

SEQ ID NO: 1655259 - RNA, 20 nt, Human
gccgucuaccugaggggccu

SEQ ID NO: 1655260 - RNA, 22 nt, Human
gccgucuaccugaggggccucu

SEQ ID NO: 1655261 - RNA, 23 nt, Human
gccgucuaccugaggggccucuu

SEQ ID NO: 1655262 - RNA, 17 nt, Human
gccgagauagccaaggc

SEQ ID NO: 1655263 - RNA, 19 nt, Human
gccgagauagccaaggcca

SEQ ID NO: 1655264 - RNA, 15 nt, Human
gccgcagcccugcag

SEQ ID NO: 1655265 - RNA, 16 nt, Human
gccgcagcccugcaga

SEQ ID NO: 1655266 - RNA, 17 nt, Human
gccgcagcccugcagag

SEQ ID NO: 1655267 - RNA, 19 nt, Human
gccgcagcccugcagaggg

SEQ ID NO: 1655268 - RNA, 16 nt, Human
gccgagauagccaagg

SEQ ID NO: 1655269 - RNA, 22 nt, Human
gcccuuccucuccacugccuuc

SEQ ID NO: 1655270 - RNA, 13 nt, Human
gcccuucucucca

SEQ ID NO: 1655271 - RNA, 19 nt, Human
gcccuucuuuccacagaag

SEQ ID NO: 1655272 - RNA, 16 nt, Human
gcauuuuacuguacag

SEQ ID NO: 1655273 - RNA, 17 nt, Human
gcauuuuacuguacaga

SEQ ID NO: 1655274 - RNA, 13 nt, Human
gcauuuuauaaau

SEQ ID NO: 1655275 - RNA, 23 nt, Human
gcauuugcugaauacagaggcaa

SEQ ID NO: 1655276 - RNA, 21 nt, Human
gcauuuggugguuucagaaau

SEQ ID NO: 1655277 - RNA, 18 nt, Human
gcauucucacuccuaccu

SEQ ID NO: 1655278 - RNA, 13 nt, Human
gcauucucacucc

SEQ ID NO: 1655279 - RNA, 15 nt, Human
gcauucucacuccua

SEQ ID NO: 1655280 - RNA, 12 nt, Human
gcauuccccagg

SEQ ID NO: 1655281 - RNA, 12 nt, Human
gcauuccccacu

SEQ ID NO: 1655282 - RNA, 21 nt, Human
gccaaacucaccugccccuca

SEQ ID NO: 1655283 - RNA, 19 nt, Human
gccaaacucaccugccccu

SEQ ID NO: 1655284 - RNA, 14 nt, Human
gccaaaggaagcac

SEQ ID NO: 1655285 - RNA, 16 nt, Human
gccaaaggaagcacau

SEQ ID NO: 1655286 - RNA, 20 nt, Human
gccaaaggaagcacaugccu

SEQ ID NO: 1655287 - RNA, 22 nt, Human
gcauuuugcuaaaugugaauga

SEQ ID NO: 1655288 - RNA, 20 nt, Human
gcauuagauuucucauuugc

SEQ ID NO: 1655289 - RNA, 17 nt, Human
gcauguuugugauugac

SEQ ID NO: 1655290 - RNA, 15 nt, Human
gcaugcugucccuua

SEQ ID NO: 1655291 - RNA, 15 nt, Human
gcaugaauuugugaa

SEQ ID NO: 1655292 - RNA, 12 nt, Human
gcaucacaguuu

SEQ ID NO: 1655293 - RNA, 16 nt, Human
gcaucaggccaggccc

SEQ ID NO: 1655294 - RNA, 17 nt, Human
gcaucaggccaggcccu

SEQ ID NO: 1655295 - RNA, 15 nt, Human
gcaucaggccaggcc

SEQ ID NO: 1655296 - RNA, 17 nt, Human
gcaugccuggauggggc

SEQ ID NO: 1655297 - RNA, 22 nt, Human
gcaugccuggauggggcugcac

SEQ ID NO: 1655298 - RNA, 17 nt, Human
gcaugaauuugugaagg

SEQ ID NO: 1655299 - RNA, 20 nt, Human
gcaugacacgaauauugcug

SEQ ID NO: 1655300 - RNA, 12 nt, Human
gcaggucccuaa

SEQ ID NO: 1655301 - RNA, 13 nt, Human
gcaggucccuaau

SEQ ID NO: 1655302 - RNA, 10 nt, Human
gcaggucccu

SEQ ID NO: 1655303 - RNA, 11 nt, Human
gcaggucccua

SEQ ID NO: 1655304 - RNA, 23 nt, Human
gcagugcuuccaaggauggacca

SEQ ID NO: 1655305 - RNA, 16 nt, Human
gcagugggagcugccu

SEQ ID NO: 1655306 - RNA, 18 nt, Human
gcagggagggccugggcc

SEQ ID NO: 1655307 - RNA, 22 nt, Human
gcagggagggccugggccccag

SEQ ID NO: 1655308 - RNA, 16 nt, Human
gcagggagggcuucug

SEQ ID NO: 1655309 - RNA, 14 nt, Human
gcagggcucagcgg

SEQ ID NO: 1655310 - RNA, 12 nt, Human
gcagggcucagc

SEQ ID NO: 1655311 - RNA, 20 nt, Human
gcaggauucuuccucccucc

SEQ ID NO: 1655312 - RNA, 14 nt, Human
gcagggagggccug

SEQ ID NO: 1655313 - RNA, 17 nt, Human
gcagggagggccugggc

SEQ ID NO: 1655314 - RNA, 15 nt, Human
gcaggcuacugucag

SEQ ID NO: 1655315 - RNA, 19 nt, Human
gcauauuuauaaaaauaaa

SEQ ID NO: 1655316 - RNA, 21 nt, Human
gcaucaagaugugacauguuu

SEQ ID NO: 1655317 - RNA, 17 nt, Human
gcauauucaggaagcuc

SEQ ID NO: 1655318 - RNA, 18 nt, Human
gcauauucaggaagcuca

SEQ ID NO: 1655319 - RNA, 20 nt, Human
gcauauucaggaagcucagg

SEQ ID NO: 1655320 - RNA, 14 nt, Human
gcauauauuuuuau

SEQ ID NO: 1655321 - RNA, 15 nt, Human
gcauauauuuuuaua

SEQ ID NO: 1655322 - RNA, 11 nt, Human
gcauauauuuu

SEQ ID NO: 1655323 - RNA, 16 nt, Human
gcauauauuuuuauau

SEQ ID NO: 1655324 - RNA, 20 nt, Human
gcauauauuuuuauauuuac

SEQ ID NO: 1655325 - RNA, 18 nt, Human
gcauauuauuuuauguug

SEQ ID NO: 1655326 - RNA, 23 nt, Human
gcauauuauuuuauguugcauag

SEQ ID NO: 1655327 - RNA, 15 nt, Human
gcauauucaggaagc

SEQ ID NO: 1655328 - RNA, 17 nt, Human
gcagugggagcugccug

SEQ ID NO: 1655329 - RNA, 18 nt, Human
gcagugggagcugccugu

SEQ ID NO: 1655330 - RNA, 18 nt, Human
gcauagauucccugagca

SEQ ID NO: 1655331 - RNA, 13 nt, Human
gcaguucugaaga

SEQ ID NO: 1655332 - RNA, 14 nt, Human
gcaguucugaagaa

SEQ ID NO: 1655333 - RNA, 21 nt, Human
gcauaggugaucucauuuaau

SEQ ID NO: 1655334 - RNA, 17 nt, Human
gcacugaggaccagcca

SEQ ID NO: 1655335 - RNA, 19 nt, Human
gcacuaaggugugcucuga

SEQ ID NO: 1655336 - RNA, 18 nt, Human
gcacuaaggugugcucug

SEQ ID NO: 1655337 - RNA, 17 nt, Human
gcacuaaggugugcucu

SEQ ID NO: 1655338 - RNA, 18 nt, Human
gcacccggccccugcugg

SEQ ID NO: 1655339 - RNA, 22 nt, Human
gcacugggcuuggggaccagag

SEQ ID NO: 1655340 - RNA, 23 nt, Human
gcacugggcuuggggaccagagc

SEQ ID NO: 1655341 - RNA, 15 nt, Human
gcacugucaagauga

SEQ ID NO: 1655342 - RNA, 12 nt, Human
gcagaaggaaga

SEQ ID NO: 1655343 - RNA, 13 nt, Human
gcagaaggaagac

SEQ ID NO: 1655344 - RNA, 14 nt, Human
gcagaaggaagacu

SEQ ID NO: 1655345 - RNA, 14 nt, Human
gcagaagacaguau

SEQ ID NO: 1655346 - RNA, 14 nt, Human
gcacccggccccug

SEQ ID NO: 1655347 - RNA, 15 nt, Human
gcacccggccccugc

SEQ ID NO: 1655348 - RNA, 17 nt, Human
gcacccggccccugcug

SEQ ID NO: 1655349 - RNA, 14 nt, Human
gcaccuccugccuc

SEQ ID NO: 1655350 - RNA, 15 nt, Human
gcaccuccugccucg

SEQ ID NO: 1655351 - RNA, 19 nt, Human
gcaccacugcacuccagcc

SEQ ID NO: 1655352 - RNA, 20 nt, Human
gcaccacugcacuccagccu

SEQ ID NO: 1655353 - RNA, 21 nt, Human
gcacagcuucauuuccugugu

SEQ ID NO: 1655354 - RNA, 16 nt, Human
gcacagcuucauuucc

SEQ ID NO: 1655355 - RNA, 19 nt, Human
gcacagcuaacauggaagu

SEQ ID NO: 1655356 - RNA, 13 nt, Human
gcaaugaccuuuc

SEQ ID NO: 1655357 - RNA, 14 nt, Human
gcaaugaccuuuca

SEQ ID NO: 1655358 - RNA, 15 nt, Human
gcaaugaccuuucaa

SEQ ID NO: 1655359 - RNA, 20 nt, Human
gcacagccucuuagaugcag

SEQ ID NO: 1655360 - RNA, 15 nt, Human
gcagccgugccuuca

SEQ ID NO: 1655361 - RNA, 17 nt, Human
gcagccgugccuucagc

SEQ ID NO: 1655362 - RNA, 14 nt, Human
gcagccgugccuuc

SEQ ID NO: 1655363 - RNA, 19 nt, Human
gcagccucaaccuccuggg

SEQ ID NO: 1655364 - RNA, 20 nt, Human
gcagccucaaccuccugggc

SEQ ID NO: 1655365 - RNA, 14 nt, Human
gcagccuggacccu

SEQ ID NO: 1655366 - RNA, 21 nt, Human
gcagccucaaccuccugggcu

SEQ ID NO: 1655367 - RNA, 22 nt, Human
gcagccucaaccuccugggcua

SEQ ID NO: 1655368 - RNA, 18 nt, Human
gcagccgugccuucagcu

SEQ ID NO: 1655369 - RNA, 20 nt, Human
gcaggaguuucguuuucaaa

SEQ ID NO: 1655370 - RNA, 21 nt, Human
gcaggaguuucguuuucaaaa

SEQ ID NO: 1655371 - RNA, 20 nt, Human
gcaggaggaucacuugaguc

SEQ ID NO: 1655372 - RNA, 18 nt, Human
gcagaaggaagacuucau

SEQ ID NO: 1655373 - RNA, 19 nt, Human
gcagagaaugaaagggccc

SEQ ID NO: 1655374 - RNA, 20 nt, Human
gcagagaaugaaagggccca

SEQ ID NO: 1655375 - RNA, 21 nt, Human
gcagagaaugaaagggcccag

SEQ ID NO: 1655376 - RNA, 22 nt, Human
gcagagaaugaaagggcccaga

SEQ ID NO: 1655377 - RNA, 23 nt, Human
gcagagaaugaaagggcccagag

SEQ ID NO: 1655378 - RNA, 21 nt, Human
gcagagaauucucuuauccaa

SEQ ID NO: 1655379 - RNA, 15 nt, Human
gcagaguugaagaca

SEQ ID NO: 1655380 - RNA, 14 nt, Human
gcagagaccauccc

SEQ ID NO: 1655381 - RNA, 15 nt, Human
gcagagaccaucccu

SEQ ID NO: 1655382 - RNA, 17 nt, Human
gcagagaccaucccuga

SEQ ID NO: 1655383 - RNA, 19 nt, Human
gcagagaccaucccugaag

SEQ ID NO: 1655384 - RNA, 12 nt, Human
gcagcaauaaag

SEQ ID NO: 1655385 - RNA, 20 nt, Human
gcagaguugaagacagagcu

SEQ ID NO: 1655386 - RNA, 19 nt, Human
gcagaguugaagacagagc

SEQ ID NO: 1655387 - RNA, 16 nt, Human
gcagaguugaagacag

SEQ ID NO: 1655388 - RNA, 17 nt, Human
gcagaguugaagacaga

SEQ ID NO: 1655389 - RNA, 16 nt, Human
gauugggaauccgccc

SEQ ID NO: 1655390 - RNA, 12 nt, Human
gauuuaaaucag

SEQ ID NO: 1655391 - RNA, 21 nt, Human
gauuucuguuuagauaauaca

SEQ ID NO: 1655392 - RNA, 22 nt, Human
gauuucuguuuagauaauacac

SEQ ID NO: 1655393 - RNA, 17 nt, Human
gauugcaacaggcuggg

SEQ ID NO: 1655394 - RNA, 18 nt, Human
gauugcaacaggcugggc

SEQ ID NO: 1655395 - RNA, 18 nt, Human
gauugcuugagcucagga

SEQ ID NO: 1655396 - RNA, 16 nt, Human
gauucccaagcucugc

SEQ ID NO: 1655397 - RNA, 17 nt, Human
gauucccaagcucugcu

SEQ ID NO: 1655398 - RNA, 19 nt, Human
gauucuuuccugaggcugg

SEQ ID NO: 1655399 - RNA, 18 nt, Human
gauucccaagcucugcuc

SEQ ID NO: 1655400 - RNA, 20 nt, Human
gauucuuuccugaggcuggg

SEQ ID NO: 1655401 - RNA, 22 nt, Human
gauucuuuccugaggcugggcu

SEQ ID NO: 1655402 - RNA, 16 nt, Human
gauugcaacaggcugg

SEQ ID NO: 1655403 - RNA, 15 nt, Human
gauucccaagcucug

SEQ ID NO: 1655404 - RNA, 13 nt, Human
gauuacaagcgug

SEQ ID NO: 1655405 - RNA, 21 nt, Human
gauuacaagcgugagccacug

SEQ ID NO: 1655406 - RNA, 13 nt, Human
gauucagacagcu

SEQ ID NO: 1655407 - RNA, 14 nt, Human
gauucagacagcug

SEQ ID NO: 1655408 - RNA, 17 nt, Human
gauucagacagcugccu

SEQ ID NO: 1655409 - RNA, 18 nt, Human
gauucagacagcugccug

SEQ ID NO: 1655410 - RNA, 14 nt, Human
gauguucugggaca

SEQ ID NO: 1655411 - RNA, 22 nt, Human
gauuaaguaaugauaacuggaa

SEQ ID NO: 1655412 - RNA, 21 nt, Human
gauguuuuaaggaugcuugua

SEQ ID NO: 1655413 - RNA, 14 nt, Human
gauuaaguaaugau

SEQ ID NO: 1655414 - RNA, 22 nt, Human
gaugcgggccagugcuccagcc

SEQ ID NO: 1655415 - RNA, 18 nt, Human
gauguucuagcauggcug

SEQ ID NO: 1655416 - RNA, 20 nt, Human
gaugccugugaacugaacuc

SEQ ID NO: 1655417 - RNA, 17 nt, Human
gaugccugguggcagcu

SEQ ID NO: 1655418 - RNA, 20 nt, Human
gaugcgggccagugcuccag

SEQ ID NO: 1655419 - RNA, 16 nt, Human
gaugcuagaacucccu

SEQ ID NO: 1655420 - RNA, 18 nt, Human
gcaaacuuuauuuugugu

SEQ ID NO: 1655421 - RNA, 16 nt, Human
gcaaaccaucauugaa

SEQ ID NO: 1655422 - RNA, 17 nt, Human
gcaaaccaucauugaaa

SEQ ID NO: 1655423 - RNA, 19 nt, Human
gcaaaccaucauugaaauc

SEQ ID NO: 1655424 - RNA, 20 nt, Human
gcaaaccaucauugaaaucu

SEQ ID NO: 1655425 - RNA, 21 nt, Human
gcaaaccaucauugaaaucuu

SEQ ID NO: 1655426 - RNA, 23 nt, Human
gcaaaguucccuacuuccuguga

SEQ ID NO: 1655427 - RNA, 20 nt, Human
gcaaacuuuauuuuguguuu

SEQ ID NO: 1655428 - RNA, 12 nt, Human
gcaaaugugaau

SEQ ID NO: 1655429 - RNA, 23 nt, Human
gcaaaugugaaucauuuuaccuu

SEQ ID NO: 1655430 - RNA, 13 nt, Human
gcaaaugacuuug

SEQ ID NO: 1655431 - RNA, 12 nt, Human
gcaaaugacuuu

SEQ ID NO: 1655432 - RNA, 18 nt, Human
gcaacugcauuggcuuug

SEQ ID NO: 1655433 - RNA, 17 nt, Human
gcaauccugcaagaaca

SEQ ID NO: 1655434 - RNA, 17 nt, Human
gcaaugaagucucugaa

SEQ ID NO: 1655435 - RNA, 19 nt, Human
gcaaugaagucucugaagu

SEQ ID NO: 1655436 - RNA, 21 nt, Human
gcaagggaauuucuucaacuc

SEQ ID NO: 1655437 - RNA, 14 nt, Human
gcaaggcugucaau

SEQ ID NO: 1655438 - RNA, 18 nt, Human
gcaaggcugucaauuaca

SEQ ID NO: 1655439 - RNA, 18 nt, Human
gcaagcaagaaacacugg

SEQ ID NO: 1655440 - RNA, 15 nt, Human
gcaagcaccuccugc

SEQ ID NO: 1655441 - RNA, 16 nt, Human
gcaagcaccuccugcc

SEQ ID NO: 1655442 - RNA, 18 nt, Human
gcaagcaccuccugccuc

SEQ ID NO: 1655443 - RNA, 20 nt, Human
gcaagcaccuccugccucga

SEQ ID NO: 1655444 - RNA, 22 nt, Human
gcaacuuuguauaaaagggacu

SEQ ID NO: 1655445 - RNA, 12 nt, Human
gcaagauguggg

SEQ ID NO: 1655446 - RNA, 16 nt, Human
gcaagaugugggcagu

SEQ ID NO: 1655447 - RNA, 23 nt, Human
gauccuaaugaaugcauaaaaug

SEQ ID NO: 1655448 - RNA, 18 nt, Human
gauccuaggcauuugcug

SEQ ID NO: 1655449 - RNA, 14 nt, Human
gauccuccaggugc

SEQ ID NO: 1655450 - RNA, 16 nt, Human
gauccucccaccucag

SEQ ID NO: 1655451 - RNA, 17 nt, Human
gauccucccaccucagc

SEQ ID NO: 1655452 - RNA, 18 nt, Human
gauccucccaccucagcc

SEQ ID NO: 1655453 - RNA, 13 nt, Human
gaucauccacugu

SEQ ID NO: 1655454 - RNA, 16 nt, Human
gaucauccacugugcc

SEQ ID NO: 1655455 - RNA, 13 nt, Human
gaucuaggaagac

SEQ ID NO: 1655456 - RNA, 14 nt, Human
gaucuaggaagacu

SEQ ID NO: 1655457 - RNA, 18 nt, Human
gaucuaggaagacuuugg

SEQ ID NO: 1655458 - RNA, 17 nt, Human
gaucuaguucacucucc

SEQ ID NO: 1655459 - RNA, 20 nt, Human
gaucuaggaagacuuuggaa

SEQ ID NO: 1655460 - RNA, 16 nt, Human
gauccucccaggcuuc

SEQ ID NO: 1655461 - RNA, 13 nt, Human
gauccugagccag

SEQ ID NO: 1655462 - RNA, 12 nt, Human
gauccugagcca

SEQ ID NO: 1655463 - RNA, 14 nt, Human
gauccuggaaauca

SEQ ID NO: 1655464 - RNA, 16 nt, Human
gaugagaggaaaucac

SEQ ID NO: 1655465 - RNA, 14 nt, Human
gaugcagugcuucc

SEQ ID NO: 1655466 - RNA, 15 nt, Human
gaugccugguggcag

SEQ ID NO: 1655467 - RNA, 16 nt, Human
gaugccugguggcagc

SEQ ID NO: 1655468 - RNA, 18 nt, Human
gaugaccuugaaugaugc

SEQ ID NO: 1655469 - RNA, 20 nt, Human
gaugaccuugaaugaugcca

SEQ ID NO: 1655470 - RNA, 14 nt, Human
gaugagaggaaauc

SEQ ID NO: 1655471 - RNA, 15 nt, Human
gaugcaccagcccuu

SEQ ID NO: 1655472 - RNA, 23 nt, Human
gaugcaccagcccuuagcaggga

SEQ ID NO: 1655473 - RNA, 22 nt, Human
gaucuucuguggguuucuaaag

SEQ ID NO: 1655474 - RNA, 19 nt, Human
gaucuucuuuauaauucua

SEQ ID NO: 1655475 - RNA, 15 nt, Human
gaugaaaugagguca

SEQ ID NO: 1655476 - RNA, 21 nt, Human
gaugaaaugaggucagagccu

SEQ ID NO: 1655477 - RNA, 16 nt, Human
gaugaaauguaaauac

SEQ ID NO: 1655478 - RNA, 13 nt, Human
gaucuuuaaaaua

SEQ ID NO: 1655479 - RNA, 16 nt, Human
gaucacauguggacuu

SEQ ID NO: 1655480 - RNA, 23 nt, Human
gaucacggcucacugcagccuca

SEQ ID NO: 1655481 - RNA, 23 nt, Human
gaucagcuuauugucuagugaaa

SEQ ID NO: 1655482 - RNA, 18 nt, Human
gauauaugcucugcaugu

SEQ ID NO: 1655483 - RNA, 20 nt, Human
gauagugucccacggugccu

SEQ ID NO: 1655484 - RNA, 18 nt, Human
gauaauucuagcuuugag

SEQ ID NO: 1655485 - RNA, 17 nt, Human
gauaauuauugguaauu

SEQ ID NO: 1655486 - RNA, 21 nt, Human
gauaaucaacugggcugaaca

SEQ ID NO: 1655487 - RNA, 17 nt, Human
gauaaucaacugggcug

SEQ ID NO: 1655488 - RNA, 16 nt, Human
gauacaaaagcaugug

SEQ ID NO: 1655489 - RNA, 17 nt, Human
gauacaaaagcauguga

SEQ ID NO: 1655490 - RNA, 17 nt, Human
gauaggucagugcaaau

SEQ ID NO: 1655491 - RNA, 20 nt, Human
gauaauaaggaaaaguuuaa

SEQ ID NO: 1655492 - RNA, 21 nt, Human
gauaauaaggaaaaguuuaau

SEQ ID NO: 1655493 - RNA, 24 nt, Human
gauaauacaccacuacauucuguu

SEQ ID NO: 1655494 - RNA, 23 nt, Human
gauaauacaccacuacauucugu

SEQ ID NO: 1655495 - RNA, 12 nt, Human
gauaauacacca

SEQ ID NO: 1655496 - RNA, 22 nt, Human
gauaauaaggaaaaguuuaaua

SEQ ID NO: 1655497 - RNA, 13 nt, Human
gaguucugguucc

SEQ ID NO: 1655498 - RNA, 13 nt, Human
gauaaacaguagu

SEQ ID NO: 1655499 - RNA, 12 nt, Human
gaguguugaaac

SEQ ID NO: 1655500 - RNA, 15 nt, Human
gacuucauuaauaau

SEQ ID NO: 1655501 - RNA, 13 nt, Human
gaaugcuuuagga

SEQ ID NO: 1655502 - RNA, 14 nt, Human
gaaugcauaaaaug

SEQ ID NO: 1655503 - RNA, 17 nt, Human
gaaugaagauacugaaa

SEQ ID NO: 1655504 - RNA, 18 nt, Human
gaaugaagauacugaaau

SEQ ID NO: 1655505 - RNA, 21 nt, Human
gaaugaagauacugaaauaaa

SEQ ID NO: 1655506 - RNA, 19 nt, Human
gaaugaagauacugaaaua

SEQ ID NO: 1655507 - RNA, 22 nt, Human
gaaugaaccacaucuugcucug

SEQ ID NO: 1655508 - RNA, 23 nt, Human
gaaugaaccacaucuugcucugc

SEQ ID NO: 1655509 - RNA, 20 nt, Human
gaaugguccgugcuaaggac

SEQ ID NO: 1655510 - RNA, 22 nt, Human
gaaugguccgugcuaaggacuu

SEQ ID NO: 1655511 - RNA, 23 nt, Human
gaaugguccgugcuaaggacuug

SEQ ID NO: 1655512 - RNA, 22 nt, Human
gaaugguuuucaaaauaaaaau

SEQ ID NO: 1655513 - RNA, 14 nt, Human
gaaugucaguguga

SEQ ID NO: 1655514 - RNA, 15 nt, Human
gaauuguguuuauaa

SEQ ID NO: 1655515 - RNA, 23 nt, Human
gaauuguguuuauaauuuuaaau

SEQ ID NO: 1655516 - RNA, 22 nt, Human
gaauuuaaauagcuuuuuucuc

SEQ ID NO: 1655517 - RNA, 22 nt, Human
gaauuguaaggaaugauuaauu

SEQ ID NO: 1655518 - RNA, 14 nt, Human
gaauuuauuggcuu

SEQ ID NO: 1655519 - RNA, 16 nt, Human
gaauuuauuggcuuuu

SEQ ID NO: 1655520 - RNA, 20 nt, Human
gaauuuauuggcuuuucuga

SEQ ID NO: 1655521 - RNA, 21 nt, Human
gaauuuauuggcuuuucugau

SEQ ID NO: 1655522 - RNA, 22 nt, Human
gaauuuauuggcuuuucugauc

SEQ ID NO: 1655523 - RNA, 15 nt, Human
gaauuucccaaagca

SEQ ID NO: 1655524 - RNA, 20 nt, Human
gaaugucagugugacugauc

SEQ ID NO: 1655525 - RNA, 21 nt, Human
gaaugucagugugacugaucu

SEQ ID NO: 1655526 - RNA, 17 nt, Human
gaauucucuaguuugau

SEQ ID NO: 1655527 - RNA, 17 nt, Human
gaauucucagaaucuca

SEQ ID NO: 1655528 - RNA, 14 nt, Human
gaauugaaaaacca

SEQ ID NO: 1655529 - RNA, 14 nt, Human
gaauugaagcagga

SEQ ID NO: 1655530 - RNA, 19 nt, Human
gaauucucuaguuugauua

SEQ ID NO: 1655531 - RNA, 11 nt, Human
gaauucuguau

SEQ ID NO: 1655532 - RNA, 15 nt, Human
gaaguacuggagaaa

SEQ ID NO: 1655533 - RNA, 18 nt, Human
gaaguacuauaauuuacc

SEQ ID NO: 1655534 - RNA, 22 nt, Human
gaaguaauaugcacacauuuuu

SEQ ID NO: 1655535 - RNA, 16 nt, Human
gaagggggcugggaca

SEQ ID NO: 1655536 - RNA, 19 nt, Human
gaagggggcugggacaugg

SEQ ID NO: 1655537 - RNA, 18 nt, Human
gaagucuuagauguauau

SEQ ID NO: 1655538 - RNA, 21 nt, Human
gaaguuucugccgcagcccug

SEQ ID NO: 1655539 - RNA, 15 nt, Human
gaagucuuagaugua

SEQ ID NO: 1655540 - RNA, 20 nt, Human
gaaguuucugccgcagcccu

SEQ ID NO: 1655541 - RNA, 12 nt, Human
gaaguccaagca

SEQ ID NO: 1655542 - RNA, 22 nt, Human
gaaguccaagcauuuagaugua

SEQ ID NO: 1655543 - RNA, 16 nt, Human
gaagucucugaaguga

SEQ ID NO: 1655544 - RNA, 21 nt, Human
gaagucucugaagugaaacug

SEQ ID NO: 1655545 - RNA, 16 nt, Human
gaaguauccuucagcc

SEQ ID NO: 1655546 - RNA, 14 nt, Human
gaaguauccuucag

SEQ ID NO: 1655547 - RNA, 20 nt, Human
gaaguuugagaucagccugg

SEQ ID NO: 1655548 - RNA, 18 nt, Human
gaauaacauguaauuaag

SEQ ID NO: 1655549 - RNA, 19 nt, Human
gaauaacauguaauuaagu

SEQ ID NO: 1655550 - RNA, 17 nt, Human
gaauaauacaguaucuc

SEQ ID NO: 1655551 - RNA, 21 nt, Human
gaauacagaggcaacugcauu

SEQ ID NO: 1655552 - RNA, 20 nt, Human
gaauacucuuauaucuauau

SEQ ID NO: 1655553 - RNA, 22 nt, Human
gaauagcugggacuacaggugu

SEQ ID NO: 1655554 - RNA, 23 nt, Human
gaauagcugggacuacaggugug

SEQ ID NO: 1655555 - RNA, 15 nt, Human
gaauaccuguccccc

SEQ ID NO: 1655556 - RNA, 13 nt, Human
gaauaccuguccc

SEQ ID NO: 1655557 - RNA, 16 nt, Human
gaauauuuuaacuucc

SEQ ID NO: 1655558 - RNA, 15 nt, Human
gaacauaaaauacaa

SEQ ID NO: 1655559 - RNA, 15 nt, Human
gaacacucugagacu

SEQ ID NO: 1655560 - RNA, 16 nt, Human
gaacagugauuaccag

SEQ ID NO: 1655561 - RNA, 20 nt, Human
gaacagugauuaccagggac

SEQ ID NO: 1655562 - RNA, 23 nt, Human
gaaaauaaaucaaugcuauaacu

SEQ ID NO: 1655563 - RNA, 16 nt, Human
gaaauuguauuacaaa

SEQ ID NO: 1655564 - RNA, 13 nt, Human
gaacacucugaga

SEQ ID NO: 1655565 - RNA, 14 nt, Human
gaacacucugagac

SEQ ID NO: 1655566 - RNA, 16 nt, Human
gaaauuuauaaacuuu

SEQ ID NO: 1655567 - RNA, 17 nt, Human
gaaauuuauaaacuuuu

SEQ ID NO: 1655568 - RNA, 18 nt, Human
gaaauuguauuacaaauc

SEQ ID NO: 1655569 - RNA, 14 nt, Human
gaacaucccuccug

SEQ ID NO: 1655570 - RNA, 18 nt, Human
gaaccuuuugagugccuu

SEQ ID NO: 1655571 - RNA, 19 nt, Human
gaaccuuuugagugccuua

SEQ ID NO: 1655572 - RNA, 21 nt, Human
gaaccuuuugagugccuuaca

SEQ ID NO: 1655573 - RNA, 15 nt, Human
gaacgcguugaaauu

SEQ ID NO: 1655574 - RNA, 12 nt, Human
gaacuaaacuuu

SEQ ID NO: 1655575 - RNA, 14 nt, Human
gaacuaaacuuuca

SEQ ID NO: 1655576 - RNA, 16 nt, Human
gaacuaaacuuucaca

SEQ ID NO: 1655577 - RNA, 18 nt, Human
gaacuaaacuuucacacc

SEQ ID NO: 1655578 - RNA, 22 nt, Human
gaaccuuuugagugccuuacac

SEQ ID NO: 1655579 - RNA, 14 nt, Human
gaacuacugaggau

SEQ ID NO: 1655580 - RNA, 17 nt, Human
gaacuaaacuuucacac

SEQ ID NO: 1655581 - RNA, 19 nt, Human
gaagagaaugcacaaacag

SEQ ID NO: 1655582 - RNA, 20 nt, Human
gaagacuuuucuuucagcca

SEQ ID NO: 1655583 - RNA, 14 nt, Human
gaagacuuuggaaa

SEQ ID NO: 1655584 - RNA, 17 nt, Human
gaagacuuuggaaagag

SEQ ID NO: 1655585 - RNA, 22 nt, Human
gaacucaucuagguaaauuaca

SEQ ID NO: 1655586 - RNA, 20 nt, Human
gaacucaucuagguaaauua

SEQ ID NO: 1655587 - RNA, 21 nt, Human
gaacucaucuagguaaauuac

SEQ ID NO: 1655588 - RNA, 23 nt, Human
gaacuuugaccucugcagcaaua

SEQ ID NO: 1655589 - RNA, 11 nt, Human
gaagacuuugg

SEQ ID NO: 1655590 - RNA, 13 nt, Human
gaagacuuuggaa

SEQ ID NO: 1655591 - RNA, 12 nt, Human
gaagaacugaaa

SEQ ID NO: 1655592 - RNA, 19 nt, Human
gaagacugcauuauauuua

SEQ ID NO: 1655593 - RNA, 20 nt, Human
gaagccagcaggcucucagg

SEQ ID NO: 1655594 - RNA, 21 nt, Human
gaagccagcaggcucucaggc

SEQ ID NO: 1655595 - RNA, 22 nt, Human
gaagccagcaggcucucaggcc

SEQ ID NO: 1655596 - RNA, 13 nt, Human
gaagcccaggaaa

SEQ ID NO: 1655597 - RNA, 15 nt, Human
gaagcccaggaaagg

SEQ ID NO: 1655598 - RNA, 16 nt, Human
gaagcccaggaaaggc

SEQ ID NO: 1655599 - RNA, 19 nt, Human
gaagcccaggaaaggcucc

SEQ ID NO: 1655600 - RNA, 23 nt, Human
gaagcccuucuaccuuccugcaa

SEQ ID NO: 1655601 - RNA, 17 nt, Human
gaagcauuuacuuugug

SEQ ID NO: 1655602 - RNA, 18 nt, Human
gaagcauuuacuuugugu

SEQ ID NO: 1655603 - RNA, 20 nt, Human
gaagagguuuuaaagcuucc

SEQ ID NO: 1655604 - RNA, 20 nt, Human
gaagauaauauuaaggaaga

SEQ ID NO: 1655605 - RNA, 15 nt, Human
gaagauacugaaaua

SEQ ID NO: 1655606 - RNA, 18 nt, Human
gaagauguagaggagaaa

SEQ ID NO: 1655607 - RNA, 16 nt, Human
gacuaacuugucuuug

SEQ ID NO: 1655608 - RNA, 23 nt, Human
gacuaacuugucuuuggacccug

SEQ ID NO: 1655609 - RNA, 11 nt, Human
gacguguuaug

SEQ ID NO: 1655610 - RNA, 14 nt, Human
gacguguuaugacu

SEQ ID NO: 1655611 - RNA, 15 nt, Human
gacguguuaugacuc

SEQ ID NO: 1655612 - RNA, 11 nt, Human
gaccuuucaau

SEQ ID NO: 1655613 - RNA, 19 nt, Human
gaccuuucaauaggaaaaa

SEQ ID NO: 1655614 - RNA, 20 nt, Human
gaccuuucaauaggaaaaac

SEQ ID NO: 1655615 - RNA, 22 nt, Human
gacgcugugcugcccugcccac

SEQ ID NO: 1655616 - RNA, 13 nt, Human
gacggagucccac

SEQ ID NO: 1655617 - RNA, 14 nt, Human
gacggagucccacc

SEQ ID NO: 1655618 - RNA, 19 nt, Human
gacccuugccgucuaccug

SEQ ID NO: 1655619 - RNA, 20 nt, Human
gacccuugccgucuaccuga

SEQ ID NO: 1655620 - RNA, 23 nt, Human
gacccuugccgucuaccugaggg

SEQ ID NO: 1655621 - RNA, 15 nt, Human
gacccuugugguccc

SEQ ID NO: 1655622 - RNA, 14 nt, Human
gaccuucuccuuca

SEQ ID NO: 1655623 - RNA, 15 nt, Human
gaccuucuccuucac

SEQ ID NO: 1655624 - RNA, 16 nt, Human
gaccuucuccuucacc

SEQ ID NO: 1655625 - RNA, 20 nt, Human
gaccuucuccuucaccuuug

SEQ ID NO: 1655626 - RNA, 21 nt, Human
gaccuucuccuucaccuuugu

SEQ ID NO: 1655627 - RNA, 14 nt, Human
gaccuugaacuggg

SEQ ID NO: 1655628 - RNA, 15 nt, Human
gacuuagcugggaga

SEQ ID NO: 1655629 - RNA, 14 nt, Human
gacuucagcucugu

SEQ ID NO: 1655630 - RNA, 12 nt, Human
gacuucaucccu

SEQ ID NO: 1655631 - RNA, 20 nt, Human
gacuucaucccucuggggcu

SEQ ID NO: 1655632 - RNA, 23 nt, Human
gacuuacuguacaugaaaacaca

SEQ ID NO: 1655633 - RNA, 18 nt, Human
gacuuacuguacaugaaa

SEQ ID NO: 1655634 - RNA, 12 nt, Human
gacuuacuguac

SEQ ID NO: 1655635 - RNA, 16 nt, Human
gacuuacuguacauga

SEQ ID NO: 1655636 - RNA, 15 nt, Human
gacuuacuguacaug

SEQ ID NO: 1655637 - RNA, 23 nt, Human
gacuggccaagguuuggggaaga

SEQ ID NO: 1655638 - RNA, 14 nt, Human
gacuggcacaguuu

SEQ ID NO: 1655639 - RNA, 18 nt, Human
gacuggcacaguuuucug

SEQ ID NO: 1655640 - RNA, 22 nt, Human
gacuggcacaguuuucugagaa

SEQ ID NO: 1655641 - RNA, 11 nt, Human
gacugagaaau

SEQ ID NO: 1655642 - RNA, 21 nt, Human
gacucuacagaggccaugggc

SEQ ID NO: 1655643 - RNA, 15 nt, Human
gacucuacagaggcc

SEQ ID NO: 1655644 - RNA, 18 nt, Human
gacuacaggcacccacca

SEQ ID NO: 1655645 - RNA, 13 nt, Human
gacuacaggcacc

SEQ ID NO: 1655646 - RNA, 15 nt, Human
gacuacaggcaccca

SEQ ID NO: 1655647 - RNA, 18 nt, Human
gacuccugcaggcagcca

SEQ ID NO: 1655648 - RNA, 19 nt, Human
gacuccugcaggcagccag

SEQ ID NO: 1655649 - RNA, 20 nt, Human
gacuccugcaggcagccagg

SEQ ID NO: 1655650 - RNA, 21 nt, Human
gacuccugcaggcagccaggc

SEQ ID NO: 1655651 - RNA, 13 nt, Human
gacugauucuuca

SEQ ID NO: 1655652 - RNA, 16 nt, Human
gacugauucuucagca

SEQ ID NO: 1655653 - RNA, 24 nt, Human
gacugcauuauauuuauuacugua

SEQ ID NO: 1655654 - RNA, 20 nt, Human
gacugccagucccccugccc

SEQ ID NO: 1655655 - RNA, 13 nt, Human
gacugagaaauuu

SEQ ID NO: 1655656 - RNA, 18 nt, Human
gacugaguacguugugca

SEQ ID NO: 1655657 - RNA, 16 nt, Human
gacugaggggagggga

SEQ ID NO: 1655658 - RNA, 11 nt, Human
gacccugaggc

SEQ ID NO: 1655659 - RNA, 12 nt, Human
gacccugaggcc

SEQ ID NO: 1655660 - RNA, 16 nt, Human
gacccugaggcccaga

SEQ ID NO: 1655661 - RNA, 18 nt, Human
gacccugaggcccagagg

SEQ ID NO: 1655662 - RNA, 20 nt, Human
gacccugcccugugggcccc

SEQ ID NO: 1655663 - RNA, 22 nt, Human
gacccugcccugugggccccca

SEQ ID NO: 1655664 - RNA, 13 nt, Human
gacccaugcugcc

SEQ ID NO: 1655665 - RNA, 18 nt, Human
gacccaugcugcccugug

SEQ ID NO: 1655666 - RNA, 19 nt, Human
gacccaugcugcccuguga

SEQ ID NO: 1655667 - RNA, 20 nt, Human
gacccaugcugcccugugag

SEQ ID NO: 1655668 - RNA, 19 nt, Human
gacccacuggacucaccuc

SEQ ID NO: 1655669 - RNA, 20 nt, Human
gacccaaaaggcagaagcaa

SEQ ID NO: 1655670 - RNA, 18 nt, Human
gacccaaaaggcagaagc

SEQ ID NO: 1655671 - RNA, 19 nt, Human
gacccaaaaggcagaagca

SEQ ID NO: 1655672 - RNA, 14 nt, Human
gaccacacuccagc

SEQ ID NO: 1655673 - RNA, 16 nt, Human
gaccacacuccagcug

SEQ ID NO: 1655674 - RNA, 22 nt, Human
gaccacacuccagcugggauca

SEQ ID NO: 1655675 - RNA, 18 nt, Human
gaccacaaaacuuuucua

SEQ ID NO: 1655676 - RNA, 21 nt, Human
gaccagagcugccaccugccu

SEQ ID NO: 1655677 - RNA, 23 nt, Human
gaccagacaccuugacagggcac

SEQ ID NO: 1655678 - RNA, 24 nt, Human
gaccagacaccuugacagggcaca

SEQ ID NO: 1655679 - RNA, 20 nt, Human
gaccagcaccaucucuccuc

SEQ ID NO: 1655680 - RNA, 21 nt, Human
gaccagcaccaucucuccucc

SEQ ID NO: 1655681 - RNA, 22 nt, Human
gaccagacaccuugacagggca

SEQ ID NO: 1655682 - RNA, 16 nt, Human
gaccacugcagaagac

SEQ ID NO: 1655683 - RNA, 18 nt, Human
gaccacugcagaagacag

SEQ ID NO: 1655684 - RNA, 16 nt, Human
gacacuagaagauuuu

SEQ ID NO: 1655685 - RNA, 17 nt, Human
gacagacacaggcccgg

SEQ ID NO: 1655686 - RNA, 20 nt, Human
gacagacacaggcccggcuc

SEQ ID NO: 1655687 - RNA, 22 nt, Human
gacagacacaggcccggcucca

SEQ ID NO: 1655688 - RNA, 22 nt, Human
gacacgaauauugcugauggug

SEQ ID NO: 1655689 - RNA, 22 nt, Human
gaauuucccaaagcagugcaug

SEQ ID NO: 1655690 - RNA, 16 nt, Human
gaauuucccaaagcag

SEQ ID NO: 1655691 - RNA, 18 nt, Human
gaauuucccaaagcagug

SEQ ID NO: 1655692 - RNA, 16 nt, Human
gacagacagcccucca

SEQ ID NO: 1655693 - RNA, 12 nt, Human
gacagaggcagc

SEQ ID NO: 1655694 - RNA, 20 nt, Human
gacagagcuacacaggggaa

SEQ ID NO: 1655695 - RNA, 23 nt, Human
gacagaggcagccccauucugcc

SEQ ID NO: 1655696 - RNA, 13 nt, Human
gacagagggggug

SEQ ID NO: 1655697 - RNA, 19 nt, Human
gacagagugagacucuguc

SEQ ID NO: 1655698 - RNA, 21 nt, Human
gacagagucucacuguugccc

SEQ ID NO: 1655699 - RNA, 16 nt, Human
gacagagugagacucu

SEQ ID NO: 1655700 - RNA, 24 nt, Human
gacaggcaaugcuggcuguuggcu

SEQ ID NO: 1655701 - RNA, 23 nt, Human
gacaggcaaugcuggcuguuggc

SEQ ID NO: 1655702 - RNA, 21 nt, Human
gacaggcauguucucugagga

SEQ ID NO: 1655703 - RNA, 20 nt, Human
gacaggcaagcaccuccugc

SEQ ID NO: 1655704 - RNA, 21 nt, Human
gacaggcaagcaccuccugcc

SEQ ID NO: 1655705 - RNA, 19 nt, Human
gacaggcaaugcuggcugu

SEQ ID NO: 1655706 - RNA, 13 nt, Human
gacaggcaagcac

SEQ ID NO: 1655707 - RNA, 17 nt, Human
gacaggcaagcaccucc

SEQ ID NO: 1655708 - RNA, 18 nt, Human
gacaggcaagcaccuccu

SEQ ID NO: 1655709 - RNA, 23 nt, Human
gacaggaugguucccuugaugaa

SEQ ID NO: 1655710 - RNA, 15 nt, Human
gacagggcauggcca

SEQ ID NO: 1655711 - RNA, 20 nt, Human
gacagggcauggccaggugg

SEQ ID NO: 1655712 - RNA, 22 nt, Human
gacagggcauggccagguggcc

SEQ ID NO: 1655713 - RNA, 14 nt, Human
gacagggcauggcc

SEQ ID NO: 1655714 - RNA, 22 nt, Human
gacaggcauguucucugaggac

SEQ ID NO: 1655715 - RNA, 23 nt, Human
gacaucaacugcaucaagaugug

SEQ ID NO: 1655716 - RNA, 16 nt, Human
gacaucaacugcauca

SEQ ID NO: 1655717 - RNA, 21 nt, Human
cuugaguugauucagcucugc

SEQ ID NO: 1655718 - RNA, 20 nt, Human
cuugaguugauucagcucug

SEQ ID NO: 1655719 - RNA, 18 nt, Human
cuugaguugauucagcuc

SEQ ID NO: 1655720 - RNA, 19 nt, Human
cuugaguugauucagcucu

SEQ ID NO: 1655721 - RNA, 15 nt, Human
cuugcaauggcagcc

SEQ ID NO: 1655722 - RNA, 16 nt, Human
cuugcaauggcagccu

SEQ ID NO: 1655723 - RNA, 17 nt, Human
cuugcaauggcagccuu

SEQ ID NO: 1655724 - RNA, 18 nt, Human
cuugcaauggcagccuug

SEQ ID NO: 1655725 - RNA, 21 nt, Human
cuugcagacucuacagaggcc

SEQ ID NO: 1655726 - RNA, 17 nt, Human
cuucuggcacuuggaga

SEQ ID NO: 1655727 - RNA, 16 nt, Human
cuugagccugggaggu

SEQ ID NO: 1655728 - RNA, 15 nt, Human
cuugaggguugggcu

SEQ ID NO: 1655729 - RNA, 17 nt, Human
cuugaggguugggcugg

SEQ ID NO: 1655730 - RNA, 12 nt, Human
cuugagccuggg

SEQ ID NO: 1655731 - RNA, 15 nt, Human
cuugagccugggagg

SEQ ID NO: 1655732 - RNA, 20 nt, Human
cuuggaagcuccgcuuucua

SEQ ID NO: 1655733 - RNA, 20 nt, Human
cuugcuugauuguauggugg

SEQ ID NO: 1655734 - RNA, 17 nt, Human
cuugcucuugaugccug

SEQ ID NO: 1655735 - RNA, 18 nt, Human
cuugcucuugaugccugg

SEQ ID NO: 1655736 - RNA, 19 nt, Human
cuugcucuugaugccuggc

SEQ ID NO: 1655737 - RNA, 22 nt, Human
cuugcucugcugacagacacag

SEQ ID NO: 1655738 - RNA, 22 nt, Human
cuugcccuguuaaaagaugaaa

SEQ ID NO: 1655739 - RNA, 17 nt, Human
cuugcaugaggcuagug

SEQ ID NO: 1655740 - RNA, 13 nt, Human
cuugcaugaggcu

SEQ ID NO: 1655741 - RNA, 14 nt, Human
cuugcaugaggcua

SEQ ID NO: 1655742 - RNA, 13 nt, Human
cuugccacugccu

SEQ ID NO: 1655743 - RNA, 14 nt, Human
cuugccaucccucc

SEQ ID NO: 1655744 - RNA, 17 nt, Human
cuugccaucccucccuc

SEQ ID NO: 1655745 - RNA, 19 nt, Human
cuugccaucccucccucca

SEQ ID NO: 1655746 - RNA, 16 nt, Human
cuugccaucccucccu

SEQ ID NO: 1655747 - RNA, 15 nt, Human
cuugccaucccuccc

SEQ ID NO: 1655748 - RNA, 14 nt, Human
cuugcccuguuaaa

SEQ ID NO: 1655749 - RNA, 18 nt, Human
cuugcccuggugccucac

SEQ ID NO: 1655750 - RNA, 22 nt, Human
cuuuaaaaaauuaaucugggcc

SEQ ID NO: 1655751 - RNA, 21 nt, Human
cuuuaaaaagcuccaaaugca

SEQ ID NO: 1655752 - RNA, 17 nt, Human
cuuuaccuuuuuuauac

SEQ ID NO: 1655753 - RNA, 20 nt, Human
cuuuaccuuuuuuauacaua

SEQ ID NO: 1655754 - RNA, 19 nt, Human
cuuuaccuuuuuuauacau

SEQ ID NO: 1655755 - RNA, 13 nt, Human
cuuguuagaucua

SEQ ID NO: 1655756 - RNA, 16 nt, Human
cuuguuagaucuaguu

SEQ ID NO: 1655757 - RNA, 16 nt, Human
cuuguuaagauaguua

SEQ ID NO: 1655758 - RNA, 16 nt, Human
cuuguggucccacccc

SEQ ID NO: 1655759 - RNA, 19 nt, Human
cuuguggucccaccccaca

SEQ ID NO: 1655760 - RNA, 15 nt, Human
cuuguggucccaccc

SEQ ID NO: 1655761 - RNA, 15 nt, Human
cuugguuuguaaauu

SEQ ID NO: 1655762 - RNA, 14 nt, Human
cuugguuuguaaau

SEQ ID NO: 1655763 - RNA, 20 nt, Human
cuugguuuguaaauuaacuu

SEQ ID NO: 1655764 - RNA, 16 nt, Human
cuuggggcugaugcag

SEQ ID NO: 1655765 - RNA, 18 nt, Human
cuuggggcugaugcaguu

SEQ ID NO: 1655766 - RNA, 20 nt, Human
cuugggccacugugaagaga

SEQ ID NO: 1655767 - RNA, 22 nt, Human
cuuggagccaauggagacuguc

SEQ ID NO: 1655768 - RNA, 16 nt, Human
cuuggacucauuuuaa

SEQ ID NO: 1655769 - RNA, 16 nt, Human
cuuucuuccucugcug

SEQ ID NO: 1655770 - RNA, 19 nt, Human
cuuucuuuuuuuuuuuuga

SEQ ID NO: 1655771 - RNA, 17 nt, Human
cuuugacaaagguaaau

SEQ ID NO: 1655772 - RNA, 13 nt, Human
cuuucugaaauaa

SEQ ID NO: 1655773 - RNA, 16 nt, Human
cuuuccucuuuggucu

SEQ ID NO: 1655774 - RNA, 19 nt, Human
cuuuccucaaaacuucaga

SEQ ID NO: 1655775 - RNA, 17 nt, Human
cuuugggccuggcuccc

SEQ ID NO: 1655776 - RNA, 23 nt, Human
cuuugugaggaagccgcuggggc

SEQ ID NO: 1655777 - RNA, 23 nt, Human
cuuugggaggccaaggugggagg

SEQ ID NO: 1655778 - RNA, 16 nt, Human
cuuuguucuggcucuu

SEQ ID NO: 1655779 - RNA, 21 nt, Human
cuuuguucuggcucuuccagg

SEQ ID NO: 1655780 - RNA, 13 nt, Human
cuuuguggcuucc

SEQ ID NO: 1655781 - RNA, 12 nt, Human
cuuugugauuuu

SEQ ID NO: 1655782 - RNA, 19 nt, Human
cuuugacaaagguaaauca

SEQ ID NO: 1655783 - RNA, 13 nt, Human
cuuugaccucugc

SEQ ID NO: 1655784 - RNA, 14 nt, Human
cuuugcuugaaaga

SEQ ID NO: 1655785 - RNA, 16 nt, Human
cuuuggauaauaagga

SEQ ID NO: 1655786 - RNA, 14 nt, Human
cuuuggauaauaag

SEQ ID NO: 1655787 - RNA, 23 nt, Human
cuuuggaaagacuuuuccaaccc

SEQ ID NO: 1655788 - RNA, 12 nt, Human
cuuuggaaagac

SEQ ID NO: 1655789 - RNA, 12 nt, Human
cuuuuucauuau

SEQ ID NO: 1655790 - RNA, 13 nt, Human
cuuuuucauuauu

SEQ ID NO: 1655791 - RNA, 14 nt, Human
cuuuuucauuauuu

SEQ ID NO: 1655792 - RNA, 21 nt, Human
cuuuuucauuauuuuauuaug

SEQ ID NO: 1655793 - RNA, 15 nt, Human
cuuuuuuaaauaaau

SEQ ID NO: 1655794 - RNA, 22 nt, Human
cuuuuguucuugguuuguaaau

SEQ ID NO: 1655795 - RNA, 14 nt, Human
cuuuucugauccag

SEQ ID NO: 1655796 - RNA, 15 nt, Human
cuuuucugauccagu

SEQ ID NO: 1655797 - RNA, 11 nt, Human
cuuuucugauc

SEQ ID NO: 1655798 - RNA, 17 nt, Human
cuuuguuuuacugucuu

SEQ ID NO: 1655799 - RNA, 21 nt, Human
cuuuguuuguugucagcugaa

SEQ ID NO: 1655800 - RNA, 16 nt, Human
cuuuucugauccaguu

SEQ ID NO: 1655801 - RNA, 18 nt, Human
cuuuucugauccaguuuu

SEQ ID NO: 1655802 - RNA, 15 nt, Human
cuuuucuguuugcua

SEQ ID NO: 1655803 - RNA, 16 nt, Human
cuuuuuuagaguugau

SEQ ID NO: 1655804 - RNA, 18 nt, Human
gaaaacaugcuacacacu

SEQ ID NO: 1655805 - RNA, 16 nt, Human
gaaaacaugcuacaca

SEQ ID NO: 1655806 - RNA, 20 nt, Human
gaaaacacuguucucugccc

SEQ ID NO: 1655807 - RNA, 21 nt, Human
gaaaacacuguucucugcccu

SEQ ID NO: 1655808 - RNA, 19 nt, Human
gaaaacacuguucucugcc

SEQ ID NO: 1655809 - RNA, 14 nt, Human
gaaaacaaggauga

SEQ ID NO: 1655810 - RNA, 22 nt, Human
gaaaacacuguucucugcccuc

SEQ ID NO: 1655811 - RNA, 19 nt, Human
gaaaacaugcuacacacug

SEQ ID NO: 1655812 - RNA, 14 nt, Human
gaaaacguggcugc

SEQ ID NO: 1655813 - RNA, 22 nt, Human
gaaaagucaaggguaggguggg

SEQ ID NO: 1655814 - RNA, 19 nt, Human
gaaaauaacaauaaaagac

SEQ ID NO: 1655815 - RNA, 14 nt, Human
gaaaaguauguuag

SEQ ID NO: 1655816 - RNA, 20 nt, Human
gaaaaguauguuagugcaaa

SEQ ID NO: 1655817 - RNA, 17 nt, Human
cuucuccaggcuguauc

SEQ ID NO: 1655818 - RNA, 16 nt, Human
cuucuccacccugcuc

SEQ ID NO: 1655819 - RNA, 14 nt, Human
cuucuccacccugc

SEQ ID NO: 1655820 - RNA, 15 nt, Human
cuucuccacccugcu

SEQ ID NO: 1655821 - RNA, 20 nt, Human
cuucuccuuucacaaccuuc

SEQ ID NO: 1655822 - RNA, 22 nt, Human
cuucuccuuucacaaccuucug

SEQ ID NO: 1655823 - RNA, 14 nt, Human
cuucuccuuucaca

SEQ ID NO: 1655824 - RNA, 17 nt, Human
cuucuccuuucacaacc

SEQ ID NO: 1655825 - RNA, 22 nt, Human
cuucuccuucaccuuugucccc

SEQ ID NO: 1655826 - RNA, 18 nt, Human
cuucugcuucagccuccc

SEQ ID NO: 1655827 - RNA, 16 nt, Human
cuucugcuucagccuc

SEQ ID NO: 1655828 - RNA, 17 nt, Human
cuucugcuucagccucc

SEQ ID NO: 1655829 - RNA, 21 nt, Human
cuucugccauauucuguuggc

SEQ ID NO: 1655830 - RNA, 20 nt, Human
cuucugccauuucugagauc

SEQ ID NO: 1655831 - RNA, 15 nt, Human
cuucugccauauucu

SEQ ID NO: 1655832 - RNA, 17 nt, Human
cuucugccauauucugu

SEQ ID NO: 1655833 - RNA, 13 nt, Human
cuucgcuccugug

SEQ ID NO: 1655834 - RNA, 14 nt, Human
cuucgcuccugugu

SEQ ID NO: 1655835 - RNA, 15 nt, Human
cuucgcuccuguguc

SEQ ID NO: 1655836 - RNA, 20 nt, Human
cuuccuuggacucauuuuaa

SEQ ID NO: 1655837 - RNA, 19 nt, Human
cuuccuuggacucauuuua

SEQ ID NO: 1655838 - RNA, 20 nt, Human
cuucgggaggucgaggcagg

SEQ ID NO: 1655839 - RNA, 21 nt, Human
cuucgggaggucgaggcagga

SEQ ID NO: 1655840 - RNA, 18 nt, Human
cuucggccuccauccuga

SEQ ID NO: 1655841 - RNA, 19 nt, Human
cuucggccuccauccugag

SEQ ID NO: 1655842 - RNA, 16 nt, Human
cuucgcuccugugucu

SEQ ID NO: 1655843 - RNA, 17 nt, Human
cuucggccuccauccug

SEQ ID NO: 1655844 - RNA, 13 nt, Human
cuucauuuggaga

SEQ ID NO: 1655845 - RNA, 14 nt, Human
cuucauuuggagau

SEQ ID NO: 1655846 - RNA, 23 nt, Human
cuuccacaagagcccaggccucc

SEQ ID NO: 1655847 - RNA, 22 nt, Human
cuuccacaagagcccaggccuc

SEQ ID NO: 1655848 - RNA, 18 nt, Human
cuucauuuccugugucuu

SEQ ID NO: 1655849 - RNA, 13 nt, Human
cuucagugccuua

SEQ ID NO: 1655850 - RNA, 14 nt, Human
cuucagugccuuau

SEQ ID NO: 1655851 - RNA, 11 nt, Human
cuucagugccu

SEQ ID NO: 1655852 - RNA, 12 nt, Human
cuucagugccuu

SEQ ID NO: 1655853 - RNA, 15 nt, Human
cuucaggcucuucuc

SEQ ID NO: 1655854 - RNA, 16 nt, Human
cuucaggcucuucucc

SEQ ID NO: 1655855 - RNA, 17 nt, Human
cuucaggcucuucuccu

SEQ ID NO: 1655856 - RNA, 18 nt, Human
cuucaggcucuucuccuu

SEQ ID NO: 1655857 - RNA, 14 nt, Human
cuucaggcucuucu

SEQ ID NO: 1655858 - RNA, 11 nt, Human
cuucagcugac

SEQ ID NO: 1655859 - RNA, 18 nt, Human
cuucagcgguuuauauaa

SEQ ID NO: 1655860 - RNA, 15 nt, Human
cuucccgcucagccc

SEQ ID NO: 1655861 - RNA, 16 nt, Human
cuucccgcucagcccu

SEQ ID NO: 1655862 - RNA, 17 nt, Human
cuucccgcucagcccuc

SEQ ID NO: 1655863 - RNA, 18 nt, Human
cuucccgcucagcccucc

SEQ ID NO: 1655864 - RNA, 15 nt, Human
cuuccagugaggcuc

SEQ ID NO: 1655865 - RNA, 14 nt, Human
cuuccagugaggcu

SEQ ID NO: 1655866 - RNA, 22 nt, Human
cuuccaggggugggacacccug

SEQ ID NO: 1655867 - RNA, 24 nt, Human
cuuccaggggugggacacccugug

SEQ ID NO: 1655868 - RNA, 19 nt, Human
cuuccagauccuggaaauc

SEQ ID NO: 1655869 - RNA, 15 nt, Human
cuuagaaccuuucuu

SEQ ID NO: 1655870 - RNA, 17 nt, Human
cuuagaaauugcauuuc

SEQ ID NO: 1655871 - RNA, 15 nt, Human
cuuagaagucacaca

SEQ ID NO: 1655872 - RNA, 14 nt, Human
cuuagacagucccu

SEQ ID NO: 1655873 - RNA, 15 nt, Human
cuuagacagucccug

SEQ ID NO: 1655874 - RNA, 16 nt, Human
cuuagacagucccugc

SEQ ID NO: 1655875 - RNA, 19 nt, Human
cuuagacagucccugccaa

SEQ ID NO: 1655876 - RNA, 17 nt, Human
cuuagacagucccugcc

SEQ ID NO: 1655877 - RNA, 18 nt, Human
cuuagacagucccugcca

SEQ ID NO: 1655878 - RNA, 19 nt, Human
cuuagaugcaguucugaag

SEQ ID NO: 1655879 - RNA, 20 nt, Human
cuuagaugcaguucugaaga

SEQ ID NO: 1655880 - RNA, 16 nt, Human
cuuacuguacaugaaa

SEQ ID NO: 1655881 - RNA, 15 nt, Human
cuuacgugaguccug

SEQ ID NO: 1655882 - RNA, 19 nt, Human
cuuacuaguuucccuugca

SEQ ID NO: 1655883 - RNA, 15 nt, Human
cuuauacauuugaua

SEQ ID NO: 1655884 - RNA, 14 nt, Human
cuuauaauuuaaaa

SEQ ID NO: 1655885 - RNA, 13 nt, Human
cuuauaauuuaaa

SEQ ID NO: 1655886 - RNA, 17 nt, Human
cuuagguuggcaaaaag

SEQ ID NO: 1655887 - RNA, 20 nt, Human
cuuaggugauccacucgccu

SEQ ID NO: 1655888 - RNA, 21 nt, Human
cuuaggguuaugauuaaguaa

SEQ ID NO: 1655889 - RNA, 14 nt, Human
cuuaucaaaggaca

SEQ ID NO: 1655890 - RNA, 16 nt, Human
cuuaucaaaggacacc

SEQ ID NO: 1655891 - RNA, 15 nt, Human
cuuauuuaaugaaag

SEQ ID NO: 1655892 - RNA, 21 nt, Human
cuuaagaagacugcauuauau

SEQ ID NO: 1655893 - RNA, 16 nt, Human
cuuaaguuuauacucu

SEQ ID NO: 1655894 - RNA, 16 nt, Human
cuuaaucuaaauggaa

SEQ ID NO: 1655895 - RNA, 14 nt, Human
cuuaaucuaaaugg

SEQ ID NO: 1655896 - RNA, 18 nt, Human
cuuaaugccacuaaauug

SEQ ID NO: 1655897 - RNA, 22 nt, Human
cuuaacuucacauauugauuuc

SEQ ID NO: 1655898 - RNA, 17 nt, Human
cuuaacuucacauauug

SEQ ID NO: 1655899 - RNA, 16 nt, Human
cuuaacuucacauauu

SEQ ID NO: 1655900 - RNA, 15 nt, Human
cuuaacuucacauau

SEQ ID NO: 1655901 - RNA, 14 nt, Human
cuuaacuucacaua

SEQ ID NO: 1655902 - RNA, 12 nt, Human
cuuaacuucaca

SEQ ID NO: 1655903 - RNA, 17 nt, Human
cugguugaugccuguga

SEQ ID NO: 1655904 - RNA, 12 nt, Human
cuguuuagauaa

SEQ ID NO: 1655905 - RNA, 18 nt, Human
cuguuuguuucugaaagg

SEQ ID NO: 1655906 - RNA, 21 nt, Human
cuguuuuauuuuaauucaguu

SEQ ID NO: 1655907 - RNA, 12 nt, Human
cuguuuuaugac

SEQ ID NO: 1655908 - RNA, 13 nt, Human
cuguuuuaugacu

SEQ ID NO: 1655909 - RNA, 14 nt, Human
cuguuuuaugacuu

SEQ ID NO: 1655910 - RNA, 15 nt, Human
cuguuuuaugacuuc

SEQ ID NO: 1655911 - RNA, 14 nt, Human
cuguuuucucuuga

SEQ ID NO: 1655912 - RNA, 21 nt, Human
cuguuuguuucugaaagggac

SEQ ID NO: 1655913 - RNA, 23 nt, Human
cuguuuguuucugaaagggacgc

SEQ ID NO: 1655914 - RNA, 19 nt, Human
cuguuuuauaauuuuguga

SEQ ID NO: 1655915 - RNA, 17 nt, Human
cuguuuucucuugagag

SEQ ID NO: 1655916 - RNA, 16 nt, Human
cuguuuuaugacuuca

SEQ ID NO: 1655917 - RNA, 14 nt, Human
cugaauuuaaauag

SEQ ID NO: 1655918 - RNA, 18 nt, Human
cugaauuuaaauagcuuu

SEQ ID NO: 1655919 - RNA, 23 nt, Human
cugaauuuaaauagcuuuuuucu

SEQ ID NO: 1655920 - RNA, 19 nt, Human
cugacagacacaggcccgg

SEQ ID NO: 1655921 - RNA, 11 nt, Human
cugacaggcaa

SEQ ID NO: 1655922 - RNA, 17 nt, Human
cugacagacagcccucc

SEQ ID NO: 1655923 - RNA, 19 nt, Human
cugacagacagcccuccau

SEQ ID NO: 1655924 - RNA, 21 nt, Human
cugacagacacaggcccggcu

SEQ ID NO: 1655925 - RNA, 17 nt, Human
cugacauuguuggccaa

SEQ ID NO: 1655926 - RNA, 21 nt, Human
cugacaggcaaugcuggcugu

SEQ ID NO: 1655927 - RNA, 20 nt, Human
cugacaggcaaugcuggcug

SEQ ID NO: 1655928 - RNA, 16 nt, Human
cugacaggcaaugcug

SEQ ID NO: 1655929 - RNA, 17 nt, Human
cugacaggcaaugcugg

SEQ ID NO: 1655930 - RNA, 18 nt, Human
cugacaggcaaugcuggc

SEQ ID NO: 1655931 - RNA, 19 nt, Human
cugacaggcaaugcuggcu

SEQ ID NO: 1655932 - RNA, 21 nt, Human
cugacauuguuggccaaagcc

SEQ ID NO: 1655933 - RNA, 11 nt, Human
cugacccacug

SEQ ID NO: 1655934 - RNA, 21 nt, Human
cugaaccuggguaacuaggga

SEQ ID NO: 1655935 - RNA, 18 nt, Human
cucuuugggccuggcucc

SEQ ID NO: 1655936 - RNA, 19 nt, Human
cucuuuggucuacacugug

SEQ ID NO: 1655937 - RNA, 21 nt, Human
cucuuuggucuacacugugcu

SEQ ID NO: 1655938 - RNA, 21 nt, Human
cugaagacucauucuucugua

SEQ ID NO: 1655939 - RNA, 15 nt, Human
cugaacuuggcgcug

SEQ ID NO: 1655940 - RNA, 16 nt, Human
cugaacuuggcgcugc

SEQ ID NO: 1655941 - RNA, 21 nt, Human
cugaacuuggcgcugccccug

SEQ ID NO: 1655942 - RNA, 14 nt, Human
cugaagucacacag

SEQ ID NO: 1655943 - RNA, 16 nt, Human
cugaagucacacagug

SEQ ID NO: 1655944 - RNA, 15 nt, Human
cugaagucacacagu

SEQ ID NO: 1655945 - RNA, 14 nt, Human
cugaagucagaucu

SEQ ID NO: 1655946 - RNA, 22 nt, Human
cugaagucacugcacagugcau

SEQ ID NO: 1655947 - RNA, 17 nt, Human
cugaagucacugcacag

SEQ ID NO: 1655948 - RNA, 16 nt, Human
cugaagucacugcaca

SEQ ID NO: 1655949 - RNA, 15 nt, Human
cugaagucagaucug

SEQ ID NO: 1655950 - RNA, 16 nt, Human
cugaagucagaucugc

SEQ ID NO: 1655951 - RNA, 24 nt, Human
cugaagucuuuguacagacaacaa

SEQ ID NO: 1655952 - RNA, 21 nt, Human
cugaagucagaucugccuaag

SEQ ID NO: 1655953 - RNA, 13 nt, Human
cugaagugaaacu

SEQ ID NO: 1655954 - RNA, 17 nt, Human
cugaagugaaacugcuu

SEQ ID NO: 1655955 - RNA, 19 nt, Human
cugaagugaaacugcuugu

SEQ ID NO: 1655956 - RNA, 16 nt, Human
cugaauacagaggcaa

SEQ ID NO: 1655957 - RNA, 18 nt, Human
cucuugguccugcugcag

SEQ ID NO: 1655958 - RNA, 19 nt, Human
cucuugguccugcugcagu

SEQ ID NO: 1655959 - RNA, 13 nt, Human
cucuugagccugg

SEQ ID NO: 1655960 - RNA, 18 nt, Human
cucuugaacuccugaccu

SEQ ID NO: 1655961 - RNA, 18 nt, Human
cucuucuggguuccuucc

SEQ ID NO: 1655962 - RNA, 16 nt, Human
cucuugaccucaggug

SEQ ID NO: 1655963 - RNA, 13 nt, Human
cucuugaccucag

SEQ ID NO: 1655964 - RNA, 15 nt, Human
cucuugaccucaggu

SEQ ID NO: 1655965 - RNA, 17 nt, Human
cucuuuccaucuacccu

SEQ ID NO: 1655966 - RNA, 13 nt, Human
cucuuucccuccc

SEQ ID NO: 1655967 - RNA, 15 nt, Human
cucuuuggacacuca

SEQ ID NO: 1655968 - RNA, 18 nt, Human
cucuuuggacacucacac

SEQ ID NO: 1655969 - RNA, 13 nt, Human
cucuucuccuuuc

SEQ ID NO: 1655970 - RNA, 15 nt, Human
cucuucuccuuucac

SEQ ID NO: 1655971 - RNA, 16 nt, Human
cucuucuccuuucaca

SEQ ID NO: 1655972 - RNA, 23 nt, Human
cucuuccaggcugggagagccuu

SEQ ID NO: 1655973 - RNA, 22 nt, Human
cucuuccaggcugggagagccu

SEQ ID NO: 1655974 - RNA, 21 nt, Human
cucuuccaggcugggagagcc

SEQ ID NO: 1655975 - RNA, 15 nt, Human
cucuucuccacugga

SEQ ID NO: 1655976 - RNA, 17 nt, Human
cucuucuccacuggaug

SEQ ID NO: 1655977 - RNA, 14 nt, Human
cucuucuccacugg

SEQ ID NO: 1655978 - RNA, 19 nt, Human
cucuucuccacuggaugga

SEQ ID NO: 1655979 - RNA, 12 nt, Human
cucuucuccagg

SEQ ID NO: 1655980 - RNA, 15 nt, Human
cucuggagcccacug

SEQ ID NO: 1655981 - RNA, 19 nt, Human
cucuggagcccacuguacu

SEQ ID NO: 1655982 - RNA, 17 nt, Human
cucuggcagcucagaga

SEQ ID NO: 1655983 - RNA, 18 nt, Human
cucuggcagcucagagag

SEQ ID NO: 1655984 - RNA, 20 nt, Human
cucuguucugcacacagcac

SEQ ID NO: 1655985 - RNA, 21 nt, Human
cucuguucugcacacagcacg

SEQ ID NO: 1655986 - RNA, 19 nt, Human
cucuguucugcacacagca

SEQ ID NO: 1655987 - RNA, 20 nt, Human
cucuggcagcucagagaggg

SEQ ID NO: 1655988 - RNA, 19 nt, Human
cucuggcagcucagagagg

SEQ ID NO: 1655989 - RNA, 13 nt, Human
cucuuaaaaccca

SEQ ID NO: 1655990 - RNA, 24 nt, Human
cucuuaaaacccaagugccuuagc

SEQ ID NO: 1655991 - RNA, 19 nt, Human
cucuucaguuaagccuuug

SEQ ID NO: 1655992 - RNA, 20 nt, Human
cucuucaguuaagccuuugg

SEQ ID NO: 1655993 - RNA, 23 nt, Human
cucuucaguuaagccuuuggaaa

SEQ ID NO: 1655994 - RNA, 13 nt, Human
cucuuaagaagac

SEQ ID NO: 1655995 - RNA, 16 nt, Human
cucuccacugccuucg

SEQ ID NO: 1655996 - RNA, 23 nt, Human
cucucaggccagcugcuugggcu

SEQ ID NO: 1655997 - RNA, 13 nt, Human
cucuccauuuaau

SEQ ID NO: 1655998 - RNA, 12 nt, Human
cucuccagcccc

SEQ ID NO: 1655999 - RNA, 13 nt, Human
cucuccagccccu

SEQ ID NO: 1656000 - RNA, 13 nt, Human
cucucccaucacu

SEQ ID NO: 1656001 - RNA, 20 nt, Human
cucucccaucacuucccuac

SEQ ID NO: 1656002 - RNA, 14 nt, Human
cucucccaucacuu

SEQ ID NO: 1656003 - RNA, 18 nt, Human
cucucccaucacuucccu

SEQ ID NO: 1656004 - RNA, 12 nt, Human
cucucugcaggu

SEQ ID NO: 1656005 - RNA, 13 nt, Human
cucucugcagguc

SEQ ID NO: 1656006 - RNA, 14 nt, Human
cucucugcaggucc

SEQ ID NO: 1656007 - RNA, 16 nt, Human
cucucugcaggucccu

SEQ ID NO: 1656008 - RNA, 17 nt, Human
cucucugcaggucccua

SEQ ID NO: 1656009 - RNA, 19 nt, Human
cucucugcaggucccuaau

SEQ ID NO: 1656010 - RNA, 22 nt, Human
cucucugcaggucccuaauaaa

SEQ ID NO: 1656011 - RNA, 15 nt, Human
cucucucacuccuug

SEQ ID NO: 1656012 - RNA, 16 nt, Human
cucucucacuccuuga

SEQ ID NO: 1656013 - RNA, 12 nt, Human
cucucucaggcc

SEQ ID NO: 1656014 - RNA, 13 nt, Human
cucucucaggcca

SEQ ID NO: 1656015 - RNA, 18 nt, Human
cucuccuguaccucuuga

SEQ ID NO: 1656016 - RNA, 17 nt, Human
cucuccuguaccucuug

SEQ ID NO: 1656017 - RNA, 22 nt, Human
cucuccuguaccucuugagccu

SEQ ID NO: 1656018 - RNA, 13 nt, Human
cucuccccagcaa

SEQ ID NO: 1656019 - RNA, 15 nt, Human
cucuccuguaccucu

SEQ ID NO: 1656020 - RNA, 14 nt, Human
cucuccuguaccuc

SEQ ID NO: 1656021 - RNA, 13 nt, Human
cucuccuguaccu

SEQ ID NO: 1656022 - RNA, 21 nt, Human
cucuccugggcagcugccucc

SEQ ID NO: 1656023 - RNA, 12 nt, Human
cucuggagccca

SEQ ID NO: 1656024 - RNA, 14 nt, Human
cucuggacaggcau

SEQ ID NO: 1656025 - RNA, 15 nt, Human
cucugcuuuggaaau

SEQ ID NO: 1656026 - RNA, 14 nt, Human
cucuggaauuugaa

SEQ ID NO: 1656027 - RNA, 15 nt, Human
cucugccuccucuuc

SEQ ID NO: 1656028 - RNA, 16 nt, Human
cucugccuccucuuca

SEQ ID NO: 1656029 - RNA, 14 nt, Human
cucugccucugaca

SEQ ID NO: 1656030 - RNA, 16 nt, Human
cucugccucugacaca

SEQ ID NO: 1656031 - RNA, 23 nt, Human
cucugcccuaaugcgcaggcugg

SEQ ID NO: 1656032 - RNA, 11 nt, Human
cucugcccugc

SEQ ID NO: 1656033 - RNA, 14 nt, Human
cucugccuccucuu

SEQ ID NO: 1656034 - RNA, 12 nt, Human
cucugcccugcg

SEQ ID NO: 1656035 - RNA, 12 nt, Human
cucugcccuugg

SEQ ID NO: 1656036 - RNA, 14 nt, Human
cucugcccuccaag

SEQ ID NO: 1656037 - RNA, 15 nt, Human
cucugcccuccaaga

SEQ ID NO: 1656038 - RNA, 16 nt, Human
cucugcccuccaagac

SEQ ID NO: 1656039 - RNA, 23 nt, Human
cucugcccuccaagaccuucucc

SEQ ID NO: 1656040 - RNA, 15 nt, Human
cucugagccuuggga

SEQ ID NO: 1656041 - RNA, 16 nt, Human
cucugagcaaaugugg

SEQ ID NO: 1656042 - RNA, 12 nt, Human
cucucugcccua

SEQ ID NO: 1656043 - RNA, 13 nt, Human
cucucugcccuaa

SEQ ID NO: 1656044 - RNA, 21 nt, Human
cucucugcccuaaugcgcagg

SEQ ID NO: 1656045 - RNA, 20 nt, Human
cucugagacucgcgacaaug

SEQ ID NO: 1656046 - RNA, 17 nt, Human
cucugaugaagaggagu

SEQ ID NO: 1656047 - RNA, 22 nt, Human
cucugcaagaauugaagcagga

SEQ ID NO: 1656048 - RNA, 10 nt, Human
cucugcacaa

SEQ ID NO: 1656049 - RNA, 17 nt, Human
cucugcaaucuucucag

SEQ ID NO: 1656050 - RNA, 18 nt, Human
cucugcaaucuucucaga

SEQ ID NO: 1656051 - RNA, 23 nt, Human
cucugcaggucccuaauaaagcu

SEQ ID NO: 1656052 - RNA, 23 nt, Human
cucugcauacucauuaggauggc

SEQ ID NO: 1656053 - RNA, 14 nt, Human
cuccugugugugcg

SEQ ID NO: 1656054 - RNA, 14 nt, Human
cuccuucaccuuug

SEQ ID NO: 1656055 - RNA, 16 nt, Human
cuccuucaccuuuguc

SEQ ID NO: 1656056 - RNA, 19 nt, Human
cuccuucaccuuugucccc

SEQ ID NO: 1656057 - RNA, 21 nt, Human
cuccuucaccuuuguccccac

SEQ ID NO: 1656058 - RNA, 16 nt, Human
cuccugcaggcagcca

SEQ ID NO: 1656059 - RNA, 22 nt, Human
cuccugcaggcagccaggccac

SEQ ID NO: 1656060 - RNA, 15 nt, Human
cuccugcaggcagcc

SEQ ID NO: 1656061 - RNA, 21 nt, Human
cuccugcaggcagccaggcca

SEQ ID NO: 1656062 - RNA, 11 nt, Human
cuccugccacc

SEQ ID NO: 1656063 - RNA, 15 nt, Human
cuccugugucuugca

SEQ ID NO: 1656064 - RNA, 23 nt, Human
cuccugugucuugcaauggcagc

SEQ ID NO: 1656065 - RNA, 11 nt, Human
cuccugugugu

SEQ ID NO: 1656066 - RNA, 11 nt, Human
cuccuucuucc

SEQ ID NO: 1656067 - RNA, 21 nt, Human
cuccuugaaaacacuguucuc

SEQ ID NO: 1656068 - RNA, 14 nt, Human
cuccuucuguccua

SEQ ID NO: 1656069 - RNA, 15 nt, Human
cuccuucuguccuac

SEQ ID NO: 1656070 - RNA, 20 nt, Human
cuccuucuguccuacucugu

SEQ ID NO: 1656071 - RNA, 19 nt, Human
cucgcuauugucaccaggg

SEQ ID NO: 1656072 - RNA, 15 nt, Human
cucgcgacaaugcaa

SEQ ID NO: 1656073 - RNA, 16 nt, Human
cucgaguuacagacaa

SEQ ID NO: 1656074 - RNA, 20 nt, Human
cucgaguuacagacaaagcg

SEQ ID NO: 1656075 - RNA, 23 nt, Human
cucggccucccaaagugcuggga

SEQ ID NO: 1656076 - RNA, 22 nt, Human
cucggccucccaaagugcuggg

SEQ ID NO: 1656077 - RNA, 13 nt, Human
cucuaaauucuuu

SEQ ID NO: 1656078 - RNA, 17 nt, Human
cucuaaauucuuucauu

SEQ ID NO: 1656079 - RNA, 22 nt, Human
cucgcuauugucaccagggcug

SEQ ID NO: 1656080 - RNA, 21 nt, Human
cucgcuauugucaccagggcu

SEQ ID NO: 1656081 - RNA, 18 nt, Human
cucggacuuagcugggag

SEQ ID NO: 1656082 - RNA, 19 nt, Human
cucggacuuagcugggaga

SEQ ID NO: 1656083 - RNA, 12 nt, Human
cucggagaagag

SEQ ID NO: 1656084 - RNA, 13 nt, Human
cucggagaagagc

SEQ ID NO: 1656085 - RNA, 20 nt, Human
cucggagaagagcuguucac

SEQ ID NO: 1656086 - RNA, 14 nt, Human
cuccugaccucagg

SEQ ID NO: 1656087 - RNA, 14 nt, Human
cuccugaccuuagg

SEQ ID NO: 1656088 - RNA, 17 nt, Human
cuccugaguagcuggga

SEQ ID NO: 1656089 - RNA, 22 nt, Human
cuccugaguagcugggauuaca

SEQ ID NO: 1656090 - RNA, 13 nt, Human
cuccugcaggcag

SEQ ID NO: 1656091 - RNA, 14 nt, Human
cuccugcaggcagc

SEQ ID NO: 1656092 - RNA, 19 nt, Human
cuccucuugccacugccuc

SEQ ID NO: 1656093 - RNA, 14 nt, Human
cuccucagaucuuc

SEQ ID NO: 1656094 - RNA, 18 nt, Human
cuccuaucaccugucuug

SEQ ID NO: 1656095 - RNA, 22 nt, Human
cuccuaucagaaguuucucagc

SEQ ID NO: 1656096 - RNA, 12 nt, Human
cuccucagaucu

SEQ ID NO: 1656097 - RNA, 14 nt, Human
cucccaucacccgc

SEQ ID NO: 1656098 - RNA, 14 nt, Human
cucccaucucacac

SEQ ID NO: 1656099 - RNA, 21 nt, Human
cucccaucucacacaugagca

SEQ ID NO: 1656100 - RNA, 15 nt, Human
cucccaucucacaca

SEQ ID NO: 1656101 - RNA, 18 nt, Human
cucccaucucacacauga

SEQ ID NO: 1656102 - RNA, 12 nt, Human
cucccuucaacc

SEQ ID NO: 1656103 - RNA, 18 nt, Human
cucccuucaaccauuccc

SEQ ID NO: 1656104 - RNA, 19 nt, Human
cucccuucaaccauucccc

SEQ ID NO: 1656105 - RNA, 20 nt, Human
cucccuucaaccauucccca

SEQ ID NO: 1656106 - RNA, 10 nt, Human
cucccuuccu

SEQ ID NO: 1656107 - RNA, 23 nt, Human
cucccuucccaccucucucacuc

SEQ ID NO: 1656108 - RNA, 17 nt, Human
cucccuuucuucccuac

SEQ ID NO: 1656109 - RNA, 17 nt, Human
cucccuuggauuguccc

SEQ ID NO: 1656110 - RNA, 20 nt, Human
cucccuuggauuguccccga

SEQ ID NO: 1656111 - RNA, 13 nt, Human
cucccuuucaaca

SEQ ID NO: 1656112 - RNA, 14 nt, Human
cucccuuccucuuu

SEQ ID NO: 1656113 - RNA, 13 nt, Human
cucccuuccucuu

SEQ ID NO: 1656114 - RNA, 16 nt, Human
cucccuucucuucaca

SEQ ID NO: 1656115 - RNA, 15 nt, Human
cuccagaccccuggc

SEQ ID NO: 1656116 - RNA, 17 nt, Human
cuccagaccccuggcuu

SEQ ID NO: 1656117 - RNA, 18 nt, Human
cuccagaccccuggcuuu

SEQ ID NO: 1656118 - RNA, 19 nt, Human
cuccagaccccuggcuuuu

SEQ ID NO: 1656119 - RNA, 20 nt, Human
cuccagaccccuggcuuuuc

SEQ ID NO: 1656120 - RNA, 21 nt, Human
cuccagaccccuggcuuuuca

SEQ ID NO: 1656121 - RNA, 11 nt, Human
cuccacugccu

SEQ ID NO: 1656122 - RNA, 19 nt, Human
cuccagcucaccagcccca

SEQ ID NO: 1656123 - RNA, 20 nt, Human
cuccagcucaccagccccag

SEQ ID NO: 1656124 - RNA, 11 nt, Human
cuccacccugc

SEQ ID NO: 1656125 - RNA, 12 nt, Human
cuccacccugcu

SEQ ID NO: 1656126 - RNA, 17 nt, Human
cuccaccucccugcaau

SEQ ID NO: 1656127 - RNA, 16 nt, Human
cuccaccucccugcaa

SEQ ID NO: 1656128 - RNA, 15 nt, Human
cuccaccucccugca

SEQ ID NO: 1656129 - RNA, 14 nt, Human
cuccaccucccugc

SEQ ID NO: 1656130 - RNA, 18 nt, Human
cuccaccugccagggaca

SEQ ID NO: 1656131 - RNA, 21 nt, Human
cuccaccugccagggacagag

SEQ ID NO: 1656132 - RNA, 17 nt, Human
cuccaccugccagggac

SEQ ID NO: 1656133 - RNA, 23 nt, Human
cuccaccucccugcaauaaaaug

SEQ ID NO: 1656134 - RNA, 13 nt, Human
cuccagcuguuca

SEQ ID NO: 1656135 - RNA, 18 nt, Human
cuccagcuguucagcugg

SEQ ID NO: 1656136 - RNA, 19 nt, Human
cuccagcuguucagcuggu

SEQ ID NO: 1656137 - RNA, 18 nt, Human
cuccaucuaaacugcccc

SEQ ID NO: 1656138 - RNA, 13 nt, Human
cuccaucuccacu

SEQ ID NO: 1656139 - RNA, 20 nt, Human
cuccaucgcugucaucucag

SEQ ID NO: 1656140 - RNA, 17 nt, Human
cuccaucuaaacugccc

SEQ ID NO: 1656141 - RNA, 23 nt, Human
cuccauccugaggcuccacuugg

SEQ ID NO: 1656142 - RNA, 11 nt, Human
cuccaggcucc

SEQ ID NO: 1656143 - RNA, 15 nt, Human
cuccaggcuccuuua

SEQ ID NO: 1656144 - RNA, 21 nt, Human
cuccauccugaggcuccacuu

SEQ ID NO: 1656145 - RNA, 14 nt, Human
cuccaucuccacuc

SEQ ID NO: 1656146 - RNA, 21 nt, Human
cucccaaggggcccaaauucu

SEQ ID NO: 1656147 - RNA, 22 nt, Human
cucccaaggggcccaaauucuu

SEQ ID NO: 1656148 - RNA, 17 nt, Human
cucccaggcauucccca

SEQ ID NO: 1656149 - RNA, 19 nt, Human
cucccaggcauuccccagg

SEQ ID NO: 1656150 - RNA, 20 nt, Human
cucccaggcauuccccagga

SEQ ID NO: 1656151 - RNA, 21 nt, Human
cucccaggcauuccccaggag

SEQ ID NO: 1656152 - RNA, 22 nt, Human
cucccaggcauuccccaggagg

SEQ ID NO: 1656153 - RNA, 14 nt, Human
cucccaggcgcccc

SEQ ID NO: 1656154 - RNA, 17 nt, Human
cucccagucauuuaaua

SEQ ID NO: 1656155 - RNA, 16 nt, Human
cucauugaccugaggc

SEQ ID NO: 1656156 - RNA, 23 nt, Human
cucauucuucuguacgucugaca

SEQ ID NO: 1656157 - RNA, 13 nt, Human
cucauugaccuga

SEQ ID NO: 1656158 - RNA, 15 nt, Human
cucauugaccugagg

SEQ ID NO: 1656159 - RNA, 21 nt, Human
cucauuccaccuucccaugcc

SEQ ID NO: 1656160 - RNA, 18 nt, Human
cucauuccaccuucccau

SEQ ID NO: 1656161 - RNA, 13 nt, Human
cucauucuucugu

SEQ ID NO: 1656162 - RNA, 14 nt, Human
cucauucuucugua

SEQ ID NO: 1656163 - RNA, 14 nt, Human
cucauauuuucaug

SEQ ID NO: 1656164 - RNA, 21 nt, Human
cucaucuagguaaauuacagu

SEQ ID NO: 1656165 - RNA, 17 nt, Human
cucaucuccccaucauu

SEQ ID NO: 1656166 - RNA, 21 nt, Human
cucauuagcauuuugcuaaau

SEQ ID NO: 1656167 - RNA, 17 nt, Human
cucauuaggauggcuag

SEQ ID NO: 1656168 - RNA, 18 nt, Human
cucauuaggauggcuagu

SEQ ID NO: 1656169 - RNA, 23 nt, Human
cuaaaagguaugcaaucaaaucu

SEQ ID NO: 1656170 - RNA, 12 nt, Human
cucagggucccu

SEQ ID NO: 1656171 - RNA, 17 nt, Human
cucaggucccugcaggg

SEQ ID NO: 1656172 - RNA, 18 nt, Human
cucaggucccugcagggc

SEQ ID NO: 1656173 - RNA, 14 nt, Human
cucagggucccugg

SEQ ID NO: 1656174 - RNA, 22 nt, Human
cucagguggggucacucuggca

SEQ ID NO: 1656175 - RNA, 23 nt, Human
cucagguggggucacucuggcag

SEQ ID NO: 1656176 - RNA, 15 nt, Human
cucaggugucccugc

SEQ ID NO: 1656177 - RNA, 16 nt, Human
cucaggugucccugca

SEQ ID NO: 1656178 - RNA, 17 nt, Human
cucaggugucccugcac

SEQ ID NO: 1656179 - RNA, 18 nt, Human
cucaggugucccugcacu

SEQ ID NO: 1656180 - RNA, 19 nt, Human
cucaggugucccugcacuu

SEQ ID NO: 1656181 - RNA, 14 nt, Human
cucaggugagaagc

SEQ ID NO: 1656182 - RNA, 20 nt, Human
cucauaguaugguggcuggg

SEQ ID NO: 1656183 - RNA, 18 nt, Human
cucauaguaugguggcug

SEQ ID NO: 1656184 - RNA, 19 nt, Human
cucauaguaugguggcugg

SEQ ID NO: 1656185 - RNA, 15 nt, Human
cucauacccaccccc

SEQ ID NO: 1656186 - RNA, 23 nt, Human
cuggauuauucaaaaugauguau

SEQ ID NO: 1656187 - RNA, 17 nt, Human
cuggauuauauuaugaa

SEQ ID NO: 1656188 - RNA, 23 nt, Human
cuggauuaaacuuaaucuaaaug

SEQ ID NO: 1656189 - RNA, 13 nt, Human
cuggauuaaacuu

SEQ ID NO: 1656190 - RNA, 16 nt, Human
cuggauggggcugcac

SEQ ID NO: 1656191 - RNA, 21 nt, Human
cuggauggaggaaaaccaagc

SEQ ID NO: 1656192 - RNA, 15 nt, Human
cuggauggggcugca

SEQ ID NO: 1656193 - RNA, 19 nt, Human
cuggauuguacuuugugcu

SEQ ID NO: 1656194 - RNA, 20 nt, Human
cuggauuguacuuugugcug

SEQ ID NO: 1656195 - RNA, 17 nt, Human
cuggcacagggcagugg

SEQ ID NO: 1656196 - RNA, 18 nt, Human
cuggcacaguuuucugag

SEQ ID NO: 1656197 - RNA, 19 nt, Human
cuggcacaguuuucugaga

SEQ ID NO: 1656198 - RNA, 13 nt, Human
cuggcacugcuuc

SEQ ID NO: 1656199 - RNA, 14 nt, Human
cuggcacugcuucc

SEQ ID NO: 1656200 - RNA, 23 nt, Human
cuggcacuauaauguaagcucua

SEQ ID NO: 1656201 - RNA, 22 nt, Human
cuggccucaagugauucuccug

SEQ ID NO: 1656202 - RNA, 23 nt, Human
cuggccuagcauacguacacauu

SEQ ID NO: 1656203 - RNA, 12 nt, Human
cuggcccacugc

SEQ ID NO: 1656204 - RNA, 13 nt, Human
cuggcccacugca

SEQ ID NO: 1656205 - RNA, 17 nt, Human
cuggccuagcauacgua

SEQ ID NO: 1656206 - RNA, 22 nt, Human
cuggccagaugcaccagcccuu

SEQ ID NO: 1656207 - RNA, 21 nt, Human
cuggccagaugcaccagcccu

SEQ ID NO: 1656208 - RNA, 17 nt, Human
cuggccagaugcaccag

SEQ ID NO: 1656209 - RNA, 18 nt, Human
cuggccagaugcaccagc

SEQ ID NO: 1656210 - RNA, 19 nt, Human
cuggccagaugcaccagcc

SEQ ID NO: 1656211 - RNA, 20 nt, Human
cuggccagaugcaccagccc

SEQ ID NO: 1656212 - RNA, 15 nt, Human
cuggcacugcuucca

SEQ ID NO: 1656213 - RNA, 16 nt, Human
cuggcacugcuuccag

SEQ ID NO: 1656214 - RNA, 17 nt, Human
cuggcacugcuuccagu

SEQ ID NO: 1656215 - RNA, 18 nt, Human
cuggcacugcuuccagug

SEQ ID NO: 1656216 - RNA, 16 nt, Human
cuggccagaugcacca

SEQ ID NO: 1656217 - RNA, 16 nt, Human
cuggccaacgggguga

SEQ ID NO: 1656218 - RNA, 16 nt, Human
cuggacucaccucccc

SEQ ID NO: 1656219 - RNA, 13 nt, Human
cuggagcccacug

SEQ ID NO: 1656220 - RNA, 15 nt, Human
cuggagcccacugua

SEQ ID NO: 1656221 - RNA, 16 nt, Human
cuggagcccacuguac

SEQ ID NO: 1656222 - RNA, 17 nt, Human
cuggagcccacuguacu

SEQ ID NO: 1656223 - RNA, 20 nt, Human
cuggagcccacuguacuugc

SEQ ID NO: 1656224 - RNA, 21 nt, Human
cuggagcccacuguacuugcu

SEQ ID NO: 1656225 - RNA, 16 nt, Human
cuggagcuagaauuug

SEQ ID NO: 1656226 - RNA, 17 nt, Human
cuggagcuagaauuuga

SEQ ID NO: 1656227 - RNA, 22 nt, Human
cuggagcuagaauuugauaugu

SEQ ID NO: 1656228 - RNA, 15 nt, Human
cuggaaugcaguggu

SEQ ID NO: 1656229 - RNA, 15 nt, Human
cuggaagcacagcuu

SEQ ID NO: 1656230 - RNA, 18 nt, Human
cuggaagcacagcuucau

SEQ ID NO: 1656231 - RNA, 21 nt, Human
cuggaagugcuaauuuugaaa

SEQ ID NO: 1656232 - RNA, 23 nt, Human
cuggaauaauccuaaacauauga

SEQ ID NO: 1656233 - RNA, 21 nt, Human
cugcuuugggcugcccuggug

SEQ ID NO: 1656234 - RNA, 22 nt, Human
cugcuuugggcugcccuggugc

SEQ ID NO: 1656235 - RNA, 23 nt, Human
cugcuuugggcugcccuggugcu

SEQ ID NO: 1656236 - RNA, 19 nt, Human
cugcuuugggcugcccugg

SEQ ID NO: 1656237 - RNA, 20 nt, Human
cugcuuugggcugcccuggu

SEQ ID NO: 1656238 - RNA, 18 nt, Human
cugcuuugggcugcccug

SEQ ID NO: 1656239 - RNA, 12 nt, Human
cugcucugauga

SEQ ID NO: 1656240 - RNA, 18 nt, Human
cugcuuucagauacugga

SEQ ID NO: 1656241 - RNA, 21 nt, Human
cugcuuucagauacuggauug

SEQ ID NO: 1656242 - RNA, 18 nt, Human
cugcugaaacaacaaaua

SEQ ID NO: 1656243 - RNA, 13 nt, Human
cugcugaaacaac

SEQ ID NO: 1656244 - RNA, 17 nt, Human
cuggcuuuucacugcug

SEQ ID NO: 1656245 - RNA, 19 nt, Human
cuggcuuuucacugcuggc

SEQ ID NO: 1656246 - RNA, 20 nt, Human
cuggcuuuucacugcuggcu

SEQ ID NO: 1656247 - RNA, 22 nt, Human
cuggcuuuucacugcuggcugc

SEQ ID NO: 1656248 - RNA, 19 nt, Human
cugggaacaccauagguca

SEQ ID NO: 1656249 - RNA, 15 nt, Human
cuggcuuuucacugc

SEQ ID NO: 1656250 - RNA, 16 nt, Human
cuggcuuuucacugcu

SEQ ID NO: 1656251 - RNA, 14 nt, Human
cuggcuucacagau

SEQ ID NO: 1656252 - RNA, 20 nt, Human
cuggcuguuggcugggggcc

SEQ ID NO: 1656253 - RNA, 21 nt, Human
cuggcuggguggcaccagcag

SEQ ID NO: 1656254 - RNA, 22 nt, Human
cuggcuggguggcaccagcagc

SEQ ID NO: 1656255 - RNA, 19 nt, Human
cuggcuguuggcugggggc

SEQ ID NO: 1656256 - RNA, 14 nt, Human
cuggcugccuuaga

SEQ ID NO: 1656257 - RNA, 19 nt, Human
cuggcugccuuagaaccuu

SEQ ID NO: 1656258 - RNA, 20 nt, Human
cuggcucuuccaggcuggga

SEQ ID NO: 1656259 - RNA, 18 nt, Human
cuggcucuuccaggcugg

SEQ ID NO: 1656260 - RNA, 19 nt, Human
cuggcucuuccaggcuggg

SEQ ID NO: 1656261 - RNA, 13 nt, Human
cuggccugagcug

SEQ ID NO: 1656262 - RNA, 17 nt, Human
cuggcucuuccaggcug

SEQ ID NO: 1656263 - RNA, 15 nt, Human
cuggccugagcuggg

SEQ ID NO: 1656264 - RNA, 12 nt, Human
cugggccccugc

SEQ ID NO: 1656265 - RNA, 16 nt, Human
cugggccccugccucu

SEQ ID NO: 1656266 - RNA, 17 nt, Human
cugggccccugccucuc

SEQ ID NO: 1656267 - RNA, 10 nt, Human
cugggccccu

SEQ ID NO: 1656268 - RNA, 20 nt, Human
cugggcaaugugauaaaacc

SEQ ID NO: 1656269 - RNA, 19 nt, Human
cugggauuacaggcuccug

SEQ ID NO: 1656270 - RNA, 20 nt, Human
cugggauuacaggcuccugc

SEQ ID NO: 1656271 - RNA, 21 nt, Human
cugggauuacaggcgugagcc

SEQ ID NO: 1656272 - RNA, 21 nt, Human
cugggauuacaggcuccugcc

SEQ ID NO: 1656273 - RNA, 22 nt, Human
cugggauuacaggcuccugcca

SEQ ID NO: 1656274 - RNA, 23 nt, Human
cugggauuacaggcuccugccac

SEQ ID NO: 1656275 - RNA, 20 nt, Human
cugggaucacauguggacuu

SEQ ID NO: 1656276 - RNA, 16 nt, Human
cugggagugagcuggu

SEQ ID NO: 1656277 - RNA, 13 nt, Human
cugggagugagcu

SEQ ID NO: 1656278 - RNA, 16 nt, Human
cugggaggcagugaug

SEQ ID NO: 1656279 - RNA, 15 nt, Human
cugggaggcucugga

SEQ ID NO: 1656280 - RNA, 16 nt, Human
cugggaggcucuggag

SEQ ID NO: 1656281 - RNA, 18 nt, Human
cugggaggucaaggcugc

SEQ ID NO: 1656282 - RNA, 13 nt, Human
cugggagcucugc

SEQ ID NO: 1656283 - RNA, 14 nt, Human
cugggagcucugca

SEQ ID NO: 1656284 - RNA, 15 nt, Human
cugggagcucugcag

SEQ ID NO: 1656285 - RNA, 16 nt, Human
cugggagcuuuuguag

SEQ ID NO: 1656286 - RNA, 22 nt, Human
cugggaacccaaguccaagcau

SEQ ID NO: 1656287 - RNA, 21 nt, Human
cuggguacuuguggacacagc

SEQ ID NO: 1656288 - RNA, 23 nt, Human
cuggguacuuguggacacagcuc

SEQ ID NO: 1656289 - RNA, 21 nt, Human
cugggguggggaccucaggcc

SEQ ID NO: 1656290 - RNA, 22 nt, Human
cugggguggggaccucaggccu

SEQ ID NO: 1656291 - RNA, 23 nt, Human
cugggguggggaccucaggccug

SEQ ID NO: 1656292 - RNA, 20 nt, Human
cuggguacuuguggacacag

SEQ ID NO: 1656293 - RNA, 17 nt, Human
cugggguggggaccuca

SEQ ID NO: 1656294 - RNA, 18 nt, Human
cugggguggggaccucag

SEQ ID NO: 1656295 - RNA, 19 nt, Human
cugggguggggaccucagg

SEQ ID NO: 1656296 - RNA, 13 nt, Human
cugggggccucag

SEQ ID NO: 1656297 - RNA, 17 nt, Human
cugggggccucagugcc

SEQ ID NO: 1656298 - RNA, 18 nt, Human
cugggggccucagugcca

SEQ ID NO: 1656299 - RNA, 19 nt, Human
cugggccccugccucucug

SEQ ID NO: 1656300 - RNA, 18 nt, Human
cugggcuucaguggcagc

SEQ ID NO: 1656301 - RNA, 19 nt, Human
cugggcuucaguggcagcu

SEQ ID NO: 1656302 - RNA, 20 nt, Human
cugggcuucaguggcagcug

SEQ ID NO: 1656303 - RNA, 21 nt, Human
cugggcuucaguggcagcugc

SEQ ID NO: 1656304 - RNA, 22 nt, Human
cugggcuucaguggcagcugcu

SEQ ID NO: 1656305 - RNA, 23 nt, Human
cugggcuucaguggcagcugcuu

SEQ ID NO: 1656306 - RNA, 13 nt, Human
cugggcuugggga

SEQ ID NO: 1656307 - RNA, 17 nt, Human
cugggcuuggggaccag

SEQ ID NO: 1656308 - RNA, 20 nt, Human
cugggcuuggggaccagagc

SEQ ID NO: 1656309 - RNA, 21 nt, Human
cugggcuuggggaccagagcu

SEQ ID NO: 1656310 - RNA, 19 nt, Human
cugggcucccuucccaccu

SEQ ID NO: 1656311 - RNA, 23 nt, Human
cugguggcagugggagcugccug

SEQ ID NO: 1656312 - RNA, 20 nt, Human
cugguggcccgacagccugg

SEQ ID NO: 1656313 - RNA, 13 nt, Human
cuggguuggaaaa

SEQ ID NO: 1656314 - RNA, 18 nt, Human
cuggguuggaaaacagua

SEQ ID NO: 1656315 - RNA, 13 nt, Human
cuggguuggaggg

SEQ ID NO: 1656316 - RNA, 15 nt, Human
cugguccauagagag

SEQ ID NO: 1656317 - RNA, 17 nt, Human
cugguccauagagagca

SEQ ID NO: 1656318 - RNA, 19 nt, Human
cuggguucuacccaggugc

SEQ ID NO: 1656319 - RNA, 18 nt, Human
cugguccauagagagcaa

SEQ ID NO: 1656320 - RNA, 21 nt, Human
cugguccauagagagcaagac

SEQ ID NO: 1656321 - RNA, 15 nt, Human
cuggucccacucagu

SEQ ID NO: 1656322 - RNA, 18 nt, Human
cuggucccacucagucca

SEQ ID NO: 1656323 - RNA, 21 nt, Human
cuggucccagccagcaguuca

SEQ ID NO: 1656324 - RNA, 13 nt, Human
cugcccugcccac

SEQ ID NO: 1656325 - RNA, 14 nt, Human
cugcccugcccacc

SEQ ID NO: 1656326 - RNA, 15 nt, Human
cugcccugcccaccu

SEQ ID NO: 1656327 - RNA, 16 nt, Human
cugcccugcccaccug

SEQ ID NO: 1656328 - RNA, 11 nt, Human
cugcccggcug

SEQ ID NO: 1656329 - RNA, 15 nt, Human
cugcccggcugcgga

SEQ ID NO: 1656330 - RNA, 19 nt, Human
cugcccaggccugccuguu

SEQ ID NO: 1656331 - RNA, 18 nt, Human
cugcccaggccugccugu

SEQ ID NO: 1656332 - RNA, 14 nt, Human
cugccccuggcagc

SEQ ID NO: 1656333 - RNA, 15 nt, Human
cugccccuggcagcc

SEQ ID NO: 1656334 - RNA, 16 nt, Human
cugccccuggcagccc

SEQ ID NO: 1656335 - RNA, 17 nt, Human
cugccccuggcagcccc

SEQ ID NO: 1656336 - RNA, 19 nt, Human
cugcccaaccugcucuccu

SEQ ID NO: 1656337 - RNA, 13 nt, Human
cugcccaggcccc

SEQ ID NO: 1656338 - RNA, 17 nt, Human
cugcccaaccugcucuc

SEQ ID NO: 1656339 - RNA, 16 nt, Human
cugccauuucugagau

SEQ ID NO: 1656340 - RNA, 17 nt, Human
cugccaugccagcuuau

SEQ ID NO: 1656341 - RNA, 19 nt, Human
cugccaugccagcuuaucu

SEQ ID NO: 1656342 - RNA, 19 nt, Human
cugccagccgagauagcca

SEQ ID NO: 1656343 - RNA, 15 nt, Human
cugccaggaagccag

SEQ ID NO: 1656344 - RNA, 16 nt, Human
cugccaggaagccagc

SEQ ID NO: 1656345 - RNA, 18 nt, Human
cugccaggaagccagcag

SEQ ID NO: 1656346 - RNA, 19 nt, Human
cugccaggaagccagcagg

SEQ ID NO: 1656347 - RNA, 13 nt, Human
cugccacacuuca

SEQ ID NO: 1656348 - RNA, 17 nt, Human
cugccacacuucaggcu

SEQ ID NO: 1656349 - RNA, 22 nt, Human
cugccacacuucaggcucuucu

SEQ ID NO: 1656350 - RNA, 19 nt, Human
cugccaccacgcccggcua

SEQ ID NO: 1656351 - RNA, 15 nt, Human
cugccacccugggga

SEQ ID NO: 1656352 - RNA, 16 nt, Human
cugccacccuggggag

SEQ ID NO: 1656353 - RNA, 20 nt, Human
cugccacccuggggagaaag

SEQ ID NO: 1656354 - RNA, 20 nt, Human
cugcggaaugaaccacaucu

SEQ ID NO: 1656355 - RNA, 15 nt, Human
cugcgguccacccag

SEQ ID NO: 1656356 - RNA, 21 nt, Human
cugcggaaugaaccacaucuu

SEQ ID NO: 1656357 - RNA, 17 nt, Human
cugcgguccacccagga

SEQ ID NO: 1656358 - RNA, 16 nt, Human
cugcgguccacccagg

SEQ ID NO: 1656359 - RNA, 14 nt, Human
cugcuccagcuguu

SEQ ID NO: 1656360 - RNA, 15 nt, Human
cugcuccagcuguuc

SEQ ID NO: 1656361 - RNA, 16 nt, Human
cugcuccucuccccag

SEQ ID NO: 1656362 - RNA, 17 nt, Human
cugcuccucuccccagc

SEQ ID NO: 1656363 - RNA, 18 nt, Human
cugcuccucuccccagca

SEQ ID NO: 1656364 - RNA, 12 nt, Human
cugccucucugc

SEQ ID NO: 1656365 - RNA, 13 nt, Human
cugccucucugca

SEQ ID NO: 1656366 - RNA, 14 nt, Human
cugccucucugcag

SEQ ID NO: 1656367 - RNA, 12 nt, Human
cugccucuuccu

SEQ ID NO: 1656368 - RNA, 13 nt, Human
cugccucuucucu

SEQ ID NO: 1656369 - RNA, 14 nt, Human
cugccucuucucua

SEQ ID NO: 1656370 - RNA, 13 nt, Human
cugccugcccagg

SEQ ID NO: 1656371 - RNA, 14 nt, Human
cugccugcccaggc

SEQ ID NO: 1656372 - RNA, 15 nt, Human
cugccugcccaggcc

SEQ ID NO: 1656373 - RNA, 14 nt, Human
cugccucagccucc

SEQ ID NO: 1656374 - RNA, 13 nt, Human
cugccucagccuc

SEQ ID NO: 1656375 - RNA, 15 nt, Human
cugcccugggaggca

SEQ ID NO: 1656376 - RNA, 22 nt, Human
cugcccugggaggcagugaugg

SEQ ID NO: 1656377 - RNA, 12 nt, Human
cugcccugggag

SEQ ID NO: 1656378 - RNA, 13 nt, Human
cugcccugggagg

SEQ ID NO: 1656379 - RNA, 11 nt, Human
cugcccuggga

SEQ ID NO: 1656380 - RNA, 22 nt, Human
cugccuaaggacuucuuuaauu

SEQ ID NO: 1656381 - RNA, 20 nt, Human
cugccuaaggacuucuuuaa

SEQ ID NO: 1656382 - RNA, 21 nt, Human
cugccuaaggacuucuuuaau

SEQ ID NO: 1656383 - RNA, 15 nt, Human
cugccuaagugcagc

SEQ ID NO: 1656384 - RNA, 12 nt, Human
cugacccacugc

SEQ ID NO: 1656385 - RNA, 15 nt, Human
cugagugccuuuugg

SEQ ID NO: 1656386 - RNA, 16 nt, Human
cugagugccuuuuggu

SEQ ID NO: 1656387 - RNA, 22 nt, Human
cugagugggggaucacagccuc

SEQ ID NO: 1656388 - RNA, 13 nt, Human
cugauaaagauga

SEQ ID NO: 1656389 - RNA, 14 nt, Human
cugagugccuuuug

SEQ ID NO: 1656390 - RNA, 17 nt, Human
cugagucugaaggcugg

SEQ ID NO: 1656391 - RNA, 13 nt, Human
cugagucugaagg

SEQ ID NO: 1656392 - RNA, 14 nt, Human
cugagucugaaggc

SEQ ID NO: 1656393 - RNA, 15 nt, Human
cugagucugaaggcu

SEQ ID NO: 1656394 - RNA, 16 nt, Human
cugagucugaaggcug

SEQ ID NO: 1656395 - RNA, 20 nt, Human
cugauccaguuuuguuugga

SEQ ID NO: 1656396 - RNA, 20 nt, Human
cugauagaggaagccugauu

SEQ ID NO: 1656397 - RNA, 21 nt, Human
cugauaaagaugagugagcau

SEQ ID NO: 1656398 - RNA, 14 nt, Human
cugaucucucguga

SEQ ID NO: 1656399 - RNA, 22 nt, Human
cugauucccaagcucugcuccu

SEQ ID NO: 1656400 - RNA, 19 nt, Human
cugauucccaagcucugcu

SEQ ID NO: 1656401 - RNA, 20 nt, Human
cugauucccaagcucugcuc

SEQ ID NO: 1656402 - RNA, 15 nt, Human
cugauucccaagcuc

SEQ ID NO: 1656403 - RNA, 17 nt, Human
cugauucccaagcucug

SEQ ID NO: 1656404 - RNA, 18 nt, Human
cugauucccaagcucugc

SEQ ID NO: 1656405 - RNA, 13 nt, Human
cugauguuccuag

SEQ ID NO: 1656406 - RNA, 18 nt, Human
cugauguuccuagugaaa

SEQ ID NO: 1656407 - RNA, 20 nt, Human
cugauguuccuagugaaaga

SEQ ID NO: 1656408 - RNA, 21 nt, Human
cugauguuccuagugaaagag

SEQ ID NO: 1656409 - RNA, 15 nt, Human
cugcagggacugcca

SEQ ID NO: 1656410 - RNA, 17 nt, Human
cugcagggacugccagu

SEQ ID NO: 1656411 - RNA, 16 nt, Human
cugcagggccaagcac

SEQ ID NO: 1656412 - RNA, 22 nt, Human
cugcagggaguccgaaagggac

SEQ ID NO: 1656413 - RNA, 22 nt, Human
cugcagccucaaccuccugggc

SEQ ID NO: 1656414 - RNA, 19 nt, Human
cugcagccucaaccuccug

SEQ ID NO: 1656415 - RNA, 20 nt, Human
cugcagccucaaccuccugg

SEQ ID NO: 1656416 - RNA, 11 nt, Human
cugcagccuca

SEQ ID NO: 1656417 - RNA, 14 nt, Human
cugcacuugcagac

SEQ ID NO: 1656418 - RNA, 16 nt, Human
cugcacuugcagacuc

SEQ ID NO: 1656419 - RNA, 17 nt, Human
cugcacuugcagacucu

SEQ ID NO: 1656420 - RNA, 17 nt, Human
cugcaccggcuggccug

SEQ ID NO: 1656421 - RNA, 18 nt, Human
cugcaccggcuggccugg

SEQ ID NO: 1656422 - RNA, 19 nt, Human
cugcaccggcuggccuggc

SEQ ID NO: 1656423 - RNA, 20 nt, Human
cugcaccggcuggccuggcc

SEQ ID NO: 1656424 - RNA, 20 nt, Human
cugcagagcaggaaacauga

SEQ ID NO: 1656425 - RNA, 23 nt, Human
cugcagaagacaguauggcagcu

SEQ ID NO: 1656426 - RNA, 13 nt, Human
cugcagaagacag

SEQ ID NO: 1656427 - RNA, 21 nt, Human
cugcacagugcaucucagccc

SEQ ID NO: 1656428 - RNA, 22 nt, Human
cugcacagugcaucucagccca

SEQ ID NO: 1656429 - RNA, 17 nt, Human
cugcacccucaggcagg

SEQ ID NO: 1656430 - RNA, 18 nt, Human
cugcacccucaggcaggu

SEQ ID NO: 1656431 - RNA, 18 nt, Human
cugcacagugcaucucag

SEQ ID NO: 1656432 - RNA, 18 nt, Human
cugcacaagcugcacccu

SEQ ID NO: 1656433 - RNA, 13 nt, Human
cugcacaagcugc

SEQ ID NO: 1656434 - RNA, 14 nt, Human
cugcacaagcugca

SEQ ID NO: 1656435 - RNA, 15 nt, Human
cugcacaagcugcac

SEQ ID NO: 1656436 - RNA, 16 nt, Human
cugcacaagcugcacc

SEQ ID NO: 1656437 - RNA, 15 nt, Human
cugauucuucagcaa

SEQ ID NO: 1656438 - RNA, 18 nt, Human
cugcacaaagcccuucca

SEQ ID NO: 1656439 - RNA, 20 nt, Human
cugcacaaagcccuuccaug

SEQ ID NO: 1656440 - RNA, 21 nt, Human
cugcacaaagcccuuccaugu

SEQ ID NO: 1656441 - RNA, 13 nt, Human
cugcacaaagccc

SEQ ID NO: 1656442 - RNA, 22 nt, Human
cugcaaucuucucagaaggcaa

SEQ ID NO: 1656443 - RNA, 18 nt, Human
cugcaaugaagucucuga

SEQ ID NO: 1656444 - RNA, 21 nt, Human
cugcaaugaagucucugaagu

SEQ ID NO: 1656445 - RNA, 12 nt, Human
ccuaccugguaa

SEQ ID NO: 1656446 - RNA, 14 nt, Human
ccuaauuccacagc

SEQ ID NO: 1656447 - RNA, 15 nt, Human
ccuaauuccacagcu

SEQ ID NO: 1656448 - RNA, 16 nt, Human
ccuaauuccacagcug

SEQ ID NO: 1656449 - RNA, 17 nt, Human
ccuaauuccacagcugc

SEQ ID NO: 1656450 - RNA, 12 nt, Human
ccuaaagagaua

SEQ ID NO: 1656451 - RNA, 14 nt, Human
ccuaaaguguauuu

SEQ ID NO: 1656452 - RNA, 15 nt, Human
ccguggcuucccgcu

SEQ ID NO: 1656453 - RNA, 21 nt, Human
ccguggcuucccgcucagccc

SEQ ID NO: 1656454 - RNA, 23 nt, Human
ccguggcuucccgcucagcccuc

SEQ ID NO: 1656455 - RNA, 13 nt, Human
ccgugcuaaggac

SEQ ID NO: 1656456 - RNA, 16 nt, Human
ccgugccuucagcucu

SEQ ID NO: 1656457 - RNA, 17 nt, Human
ccgugccuucagcucua

SEQ ID NO: 1656458 - RNA, 14 nt, Human
ccgugccuucagcu

SEQ ID NO: 1656459 - RNA, 15 nt, Human
ccgugccuucagcuc

SEQ ID NO: 1656460 - RNA, 19 nt, Human
ccgggccuggagaacuaga

SEQ ID NO: 1656461 - RNA, 20 nt, Human
ccgggcacucagaagacacu

SEQ ID NO: 1656462 - RNA, 12 nt, Human
ccggcugcccuu

SEQ ID NO: 1656463 - RNA, 12 nt, Human
ccggcuggccug

SEQ ID NO: 1656464 - RNA, 13 nt, Human
ccggcuggccugg

SEQ ID NO: 1656465 - RNA, 15 nt, Human
ccggcuggccuggcc

SEQ ID NO: 1656466 - RNA, 15 nt, Human
ccgggcacucagaag

SEQ ID NO: 1656467 - RNA, 11 nt, Human
ccggaagccaa

SEQ ID NO: 1656468 - RNA, 22 nt, Human
ccggaagccaaaccucugugag

SEQ ID NO: 1656469 - RNA, 17 nt, Human
ccuaucagaaguuucuc

SEQ ID NO: 1656470 - RNA, 17 nt, Human
ccucacaguccuuacca

SEQ ID NO: 1656471 - RNA, 15 nt, Human
ccucaccccacugug

SEQ ID NO: 1656472 - RNA, 21 nt, Human
ccucacccacccuuuuuuaaa

SEQ ID NO: 1656473 - RNA, 12 nt, Human
ccucaccccacu

SEQ ID NO: 1656474 - RNA, 20 nt, Human
ccucacaguccuuaccagca

SEQ ID NO: 1656475 - RNA, 22 nt, Human
ccucacaguccuuaccagcaga

SEQ ID NO: 1656476 - RNA, 17 nt, Human
ccucaccuuucccaucu

SEQ ID NO: 1656477 - RNA, 17 nt, Human
ccccucagggucccugg

SEQ ID NO: 1656478 - RNA, 18 nt, Human
ccccucagggucccuggu

SEQ ID NO: 1656479 - RNA, 20 nt, Human
ccccucagggucccuggugg

SEQ ID NO: 1656480 - RNA, 21 nt, Human
cccugguuuccugcccuggga

SEQ ID NO: 1656481 - RNA, 21 nt, Human
cccugguggcagugggagcug

SEQ ID NO: 1656482 - RNA, 16 nt, Human
cccugguggcaguggg

SEQ ID NO: 1656483 - RNA, 19 nt, Human
cccugguggcagugggagc

SEQ ID NO: 1656484 - RNA, 22 nt, Human
cccugguuuccugcccugggag

SEQ ID NO: 1656485 - RNA, 23 nt, Human
cccugguuuccugcccugggagg

SEQ ID NO: 1656486 - RNA, 21 nt, Human
cccuguagagugggagcugag

SEQ ID NO: 1656487 - RNA, 16 nt, Human
cccugugggcccccaa

SEQ ID NO: 1656488 - RNA, 18 nt, Human
cccugugggcccccaaau

SEQ ID NO: 1656489 - RNA, 15 nt, Human
cccuguuuguuucug

SEQ ID NO: 1656490 - RNA, 16 nt, Human
cccuguuuguuucuga

SEQ ID NO: 1656491 - RNA, 16 nt, Human
cccccaucucuucugg

SEQ ID NO: 1656492 - RNA, 12 nt, Human
cccccagcccca

SEQ ID NO: 1656493 - RNA, 16 nt, Human
ccccgucccccucugg

SEQ ID NO: 1656494 - RNA, 20 nt, Human
ccccgucccccucuggcucc

SEQ ID NO: 1656495 - RNA, 21 nt, Human
ccccgucucugguuccucccc

SEQ ID NO: 1656496 - RNA, 13 nt, Human
cccccucugcccu

SEQ ID NO: 1656497 - RNA, 14 nt, Human
cccccucugcccug

SEQ ID NO: 1656498 - RNA, 16 nt, Human
cccccucugcccugcg

SEQ ID NO: 1656499 - RNA, 21 nt, Human
cccccgcugucagccauuccu

SEQ ID NO: 1656500 - RNA, 12 nt, Human
ccccacugguga

SEQ ID NO: 1656501 - RNA, 13 nt, Human
ccccacuggugac

SEQ ID NO: 1656502 - RNA, 14 nt, Human
ccccacuggugaca

SEQ ID NO: 1656503 - RNA, 13 nt, Human
ccccaggaggcca

SEQ ID NO: 1656504 - RNA, 14 nt, Human
ccccaggaggccag

SEQ ID NO: 1656505 - RNA, 15 nt, Human
ccccaggaggccagc

SEQ ID NO: 1656506 - RNA, 21 nt, Human
ccccaggaggccagccuugac

SEQ ID NO: 1656507 - RNA, 22 nt, Human
ccccaggaggccagccuugacc

SEQ ID NO: 1656508 - RNA, 23 nt, Human
cccccaaccaaguggcucccaca

SEQ ID NO: 1656509 - RNA, 19 nt, Human
cccuuuuuuggcugcugaa

SEQ ID NO: 1656510 - RNA, 17 nt, Human
ccgagaaggaagccucc

SEQ ID NO: 1656511 - RNA, 19 nt, Human
ccgagauagccaaggccaa

SEQ ID NO: 1656512 - RNA, 22 nt, Human
ccgagauagccaaggccaaagg

SEQ ID NO: 1656513 - RNA, 17 nt, Human
cccuuuuuuggcugcug

SEQ ID NO: 1656514 - RNA, 18 nt, Human
cccuuuuuuggcugcuga

SEQ ID NO: 1656515 - RNA, 11 nt, Human
cccuuuuccuu

SEQ ID NO: 1656516 - RNA, 13 nt, Human
cccuuuucuguuu

SEQ ID NO: 1656517 - RNA, 22 nt, Human
ccgagucucuucuccacuggau

SEQ ID NO: 1656518 - RNA, 18 nt, Human
ccgagaucacgccacugc

SEQ ID NO: 1656519 - RNA, 20 nt, Human
cccuuguggucccaccccac

SEQ ID NO: 1656520 - RNA, 18 nt, Human
cccuuguggucccacccc

SEQ ID NO: 1656521 - RNA, 18 nt, Human
cccuuggggagcaggcuc

SEQ ID NO: 1656522 - RNA, 14 nt, Human
cccuugugguccca

SEQ ID NO: 1656523 - RNA, 16 nt, Human
cccuuguggucccacc

SEQ ID NO: 1656524 - RNA, 22 nt, Human
cccuuucugggcaccggggccu

SEQ ID NO: 1656525 - RNA, 20 nt, Human
cccuuugacgccaucccagc

SEQ ID NO: 1656526 - RNA, 22 nt, Human
cccuugccgucuaccugagggg

SEQ ID NO: 1656527 - RNA, 17 nt, Human
cccuugccgucuaccug

SEQ ID NO: 1656528 - RNA, 18 nt, Human
cccuugccgucuaccuga

SEQ ID NO: 1656529 - RNA, 13 nt, Human
cccuuccucucca

SEQ ID NO: 1656530 - RNA, 17 nt, Human
cccuuaccacugcucug

SEQ ID NO: 1656531 - RNA, 21 nt, Human
cccuuaccacugcucugauga

SEQ ID NO: 1656532 - RNA, 19 nt, Human
cccuuaccucggugccuuc

SEQ ID NO: 1656533 - RNA, 16 nt, Human
cccuuccucuccacug

SEQ ID NO: 1656534 - RNA, 17 nt, Human
cccuuccucuccacugc

SEQ ID NO: 1656535 - RNA, 21 nt, Human
cccuuccucuccacugccuuc

SEQ ID NO: 1656536 - RNA, 20 nt, Human
cccuuccucuccacugccuu

SEQ ID NO: 1656537 - RNA, 16 nt, Human
cccuugaugaagaagu

SEQ ID NO: 1656538 - RNA, 22 nt, Human
ccucugcacuccccugcugggu

SEQ ID NO: 1656539 - RNA, 14 nt, Human
ccucugcacucccc

SEQ ID NO: 1656540 - RNA, 15 nt, Human
ccucugcacuccccu

SEQ ID NO: 1656541 - RNA, 20 nt, Human
ccucugcacuccccugcugg

SEQ ID NO: 1656542 - RNA, 21 nt, Human
ccucugcacuccccugcuggg

SEQ ID NO: 1656543 - RNA, 20 nt, Human
ccucugcacaagcugcaccc

SEQ ID NO: 1656544 - RNA, 17 nt, Human
ccucugcacaagcugca

SEQ ID NO: 1656545 - RNA, 19 nt, Human
ccucugcacaagcugcacc

SEQ ID NO: 1656546 - RNA, 17 nt, Human
ccucugacacacagcuc

SEQ ID NO: 1656547 - RNA, 18 nt, Human
ccucugacacacagcucu

SEQ ID NO: 1656548 - RNA, 11 nt, Human
ccucugcacaa

SEQ ID NO: 1656549 - RNA, 15 nt, Human
ccucugcacaagcug

SEQ ID NO: 1656550 - RNA, 16 nt, Human
ccucuggcuccagcug

SEQ ID NO: 1656551 - RNA, 17 nt, Human
ccucuggcuccagcugg

SEQ ID NO: 1656552 - RNA, 12 nt, Human
ccucugggacug

SEQ ID NO: 1656553 - RNA, 21 nt, Human
ccucugcuugccaucccuccc

SEQ ID NO: 1656554 - RNA, 20 nt, Human
ccucugcuugccaucccucc

SEQ ID NO: 1656555 - RNA, 18 nt, Human
ccuccuuaucaaaggaca

SEQ ID NO: 1656556 - RNA, 20 nt, Human
ccuccuuaucaaaggacacc

SEQ ID NO: 1656557 - RNA, 23 nt, Human
ccuccugugugugcgccuacagg

SEQ ID NO: 1656558 - RNA, 12 nt, Human
ccucuccacugc

SEQ ID NO: 1656559 - RNA, 13 nt, Human
ccucuccacugcc

SEQ ID NO: 1656560 - RNA, 14 nt, Human
ccucuccacugccu

SEQ ID NO: 1656561 - RNA, 16 nt, Human
ccucuccacugccuuc

SEQ ID NO: 1656562 - RNA, 19 nt, Human
ccucuccacugccuucgau

SEQ ID NO: 1656563 - RNA, 12 nt, Human
ccucucccauca

SEQ ID NO: 1656564 - RNA, 23 nt, Human
ccucugaaaaccaauguucucuc

SEQ ID NO: 1656565 - RNA, 16 nt, Human
ccucugacacacagcu

SEQ ID NO: 1656566 - RNA, 13 nt, Human
ccucuccugggca

SEQ ID NO: 1656567 - RNA, 12 nt, Human
ccucuccugggc

SEQ ID NO: 1656568 - RNA, 11 nt, Human
ccucuccuggg

SEQ ID NO: 1656569 - RNA, 13 nt, Human
ccucucugcccua

SEQ ID NO: 1656570 - RNA, 14 nt, Human
ccucuccugggcag

SEQ ID NO: 1656571 - RNA, 13 nt, Human
ccuccuggacucc

SEQ ID NO: 1656572 - RNA, 17 nt, Human
ccuccugggaaugaagc

SEQ ID NO: 1656573 - RNA, 13 nt, Human
ccuccugggcuaa

SEQ ID NO: 1656574 - RNA, 13 nt, Human
ccuccugugugug

SEQ ID NO: 1656575 - RNA, 15 nt, Human
ccuccugugugugcg

SEQ ID NO: 1656576 - RNA, 22 nt, Human
ccuccugugugugcgccuacag

SEQ ID NO: 1656577 - RNA, 14 nt, Human
ccuccuccuggacu

SEQ ID NO: 1656578 - RNA, 13 nt, Human
ccuccugccucga

SEQ ID NO: 1656579 - RNA, 11 nt, Human
ccuccucugcu

SEQ ID NO: 1656580 - RNA, 16 nt, Human
ccucccggugcccaag

SEQ ID NO: 1656581 - RNA, 13 nt, Human
ccucccucccucu

SEQ ID NO: 1656582 - RNA, 15 nt, Human
ccucccucccucuuu

SEQ ID NO: 1656583 - RNA, 13 nt, Human
ccucccggugccc

SEQ ID NO: 1656584 - RNA, 18 nt, Human
ccuccccuccucugcuug

SEQ ID NO: 1656585 - RNA, 17 nt, Human
ccuccccuccucugcuu

SEQ ID NO: 1656586 - RNA, 13 nt, Human
ccucccugccccu

SEQ ID NO: 1656587 - RNA, 16 nt, Human
ccucccucccucuuuc

SEQ ID NO: 1656588 - RNA, 16 nt, Human
ccucccugcaauaaaa

SEQ ID NO: 1656589 - RNA, 12 nt, Human
ccucccugcaau

SEQ ID NO: 1656590 - RNA, 11 nt, Human
ccucaggccug

SEQ ID NO: 1656591 - RNA, 14 nt, Human
ccucaggccugggg

SEQ ID NO: 1656592 - RNA, 21 nt, Human
ccucaggccugggggcugggc

SEQ ID NO: 1656593 - RNA, 23 nt, Human
ccucaggccugggggcugggcag

SEQ ID NO: 1656594 - RNA, 14 nt, Human
ccucagggucccug

SEQ ID NO: 1656595 - RNA, 16 nt, Human
ccucagcauccuggca

SEQ ID NO: 1656596 - RNA, 17 nt, Human
ccucagcauccuggcac

SEQ ID NO: 1656597 - RNA, 22 nt, Human
ccucacuaucccggcugcccuu

SEQ ID NO: 1656598 - RNA, 21 nt, Human
ccucacuaggcuucugguuga

SEQ ID NO: 1656599 - RNA, 21 nt, Human
ccucacuaucccggcugcccu

SEQ ID NO: 1656600 - RNA, 20 nt, Human
ccucagaaaacaaggaugaa

SEQ ID NO: 1656601 - RNA, 22 nt, Human
ccucaggugauccacccaccuc

SEQ ID NO: 1656602 - RNA, 17 nt, Human
ccucaggugauccaccc

SEQ ID NO: 1656603 - RNA, 19 nt, Human
ccucaggugauccacccac

SEQ ID NO: 1656604 - RNA, 22 nt, Human
ccucagguaaucgaccugccuc

SEQ ID NO: 1656605 - RNA, 23 nt, Human
ccucagguaaucgaccugccucg

SEQ ID NO: 1656606 - RNA, 16 nt, Human
ccucaggugagaagca

SEQ ID NO: 1656607 - RNA, 21 nt, Human
ccucagguaaucgaccugccu

SEQ ID NO: 1656608 - RNA, 15 nt, Human
ccucagggucccugg

SEQ ID NO: 1656609 - RNA, 15 nt, Human
ccucagucuggcccu

SEQ ID NO: 1656610 - RNA, 19 nt, Human
ccucagucuggcccuuccu

SEQ ID NO: 1656611 - RNA, 14 nt, Human
ccucagucucccuc

SEQ ID NO: 1656612 - RNA, 15 nt, Human
ccuccccuccucugc

SEQ ID NO: 1656613 - RNA, 23 nt, Human
ccugacaacacucauugaccuga

SEQ ID NO: 1656614 - RNA, 12 nt, Human
ccugaggcccag

SEQ ID NO: 1656615 - RNA, 13 nt, Human
ccugaggcccaga

SEQ ID NO: 1656616 - RNA, 14 nt, Human
ccugaggcccagag

SEQ ID NO: 1656617 - RNA, 12 nt, Human
ccugacaacacu

SEQ ID NO: 1656618 - RNA, 14 nt, Human
ccugacaacacuca

SEQ ID NO: 1656619 - RNA, 15 nt, Human
ccugacaacacucau

SEQ ID NO: 1656620 - RNA, 16 nt, Human
ccugacaacacucauu

SEQ ID NO: 1656621 - RNA, 23 nt, Human
ccugaggcccuucucuccagccc

SEQ ID NO: 1656622 - RNA, 21 nt, Human
ccugaggcccuucucuccagc

SEQ ID NO: 1656623 - RNA, 22 nt, Human
ccugaggcccuucucuccagcc

SEQ ID NO: 1656624 - RNA, 16 nt, Human
ccugaggcccuucucu

SEQ ID NO: 1656625 - RNA, 17 nt, Human
ccugaggcccuucucuc

SEQ ID NO: 1656626 - RNA, 19 nt, Human
ccugaggcccuucucucca

SEQ ID NO: 1656627 - RNA, 20 nt, Human
ccugaggcccuucucuccag

SEQ ID NO: 1656628 - RNA, 17 nt, Human
ccugaugcuucuucaga

SEQ ID NO: 1656629 - RNA, 18 nt, Human
ccugaugcuucuucagag

SEQ ID NO: 1656630 - RNA, 12 nt, Human
ccugauuaaaga

SEQ ID NO: 1656631 - RNA, 13 nt, Human
ccugauuaaagaa

SEQ ID NO: 1656632 - RNA, 23 nt, Human
ccugauugugucucuugguccug

SEQ ID NO: 1656633 - RNA, 14 nt, Human
ccugaugcuucuuc

SEQ ID NO: 1656634 - RNA, 18 nt, Human
ccugaggcuccacuuggu

SEQ ID NO: 1656635 - RNA, 20 nt, Human
ccugaggcuccacuuggucu

SEQ ID NO: 1656636 - RNA, 17 nt, Human
ccucuguccaggcacug

SEQ ID NO: 1656637 - RNA, 14 nt, Human
ccucuguacagagc

SEQ ID NO: 1656638 - RNA, 15 nt, Human
ccucuguacagagcc

SEQ ID NO: 1656639 - RNA, 16 nt, Human
ccucuguacagagccc

SEQ ID NO: 1656640 - RNA, 17 nt, Human
ccucuguacagagccca

SEQ ID NO: 1656641 - RNA, 18 nt, Human
ccucuguacagagcccac

SEQ ID NO: 1656642 - RNA, 23 nt, Human
ccucuguacagagcccacgcccc

SEQ ID NO: 1656643 - RNA, 21 nt, Human
ccucuguucugcacacagcac

SEQ ID NO: 1656644 - RNA, 14 nt, Human
ccucuuagaaaaac

SEQ ID NO: 1656645 - RNA, 15 nt, Human
ccucuuaugggcugg

SEQ ID NO: 1656646 - RNA, 16 nt, Human
ccucuuaugggcuggg

SEQ ID NO: 1656647 - RNA, 14 nt, Human
ccucuuaugggcug

SEQ ID NO: 1656648 - RNA, 23 nt, Human
ccucuuagaugcaguucugaaga

SEQ ID NO: 1656649 - RNA, 14 nt, Human
ccugaaggccccgc

SEQ ID NO: 1656650 - RNA, 19 nt, Human
ccugaagucacacagugag

SEQ ID NO: 1656651 - RNA, 13 nt, Human
ccugaaggccccg

SEQ ID NO: 1656652 - RNA, 15 nt, Human
ccugaagucacacag

SEQ ID NO: 1656653 - RNA, 16 nt, Human
ccugaagucacacagu

SEQ ID NO: 1656654 - RNA, 17 nt, Human
ccugaagucacacagug

SEQ ID NO: 1656655 - RNA, 20 nt, Human
ccugaacaggauauucucac

SEQ ID NO: 1656656 - RNA, 22 nt, Human
ccugaagcuaucguaaaauuaa

SEQ ID NO: 1656657 - RNA, 23 nt, Human
ccugaagcuaucguaaaauuaag

SEQ ID NO: 1656658 - RNA, 21 nt, Human
ccugaagacucauucuucugu

SEQ ID NO: 1656659 - RNA, 20 nt, Human
ccugaagcuaucguaaaauu

SEQ ID NO: 1656660 - RNA, 17 nt, Human
ccucuuaugggcugggu

SEQ ID NO: 1656661 - RNA, 15 nt, Human
ccucuuccucccuca

SEQ ID NO: 1656662 - RNA, 16 nt, Human
ccucuuccucccucau

SEQ ID NO: 1656663 - RNA, 19 nt, Human
ccucuuccucccucauucc

SEQ ID NO: 1656664 - RNA, 22 nt, Human
ccucuuuggucuacacugugcu

SEQ ID NO: 1656665 - RNA, 18 nt, Human
ccugaaagaggaaugaag

SEQ ID NO: 1656666 - RNA, 23 nt, Human
ccugaaagaggaaugaaguacuc

SEQ ID NO: 1656667 - RNA, 21 nt, Human
ccuggcagccgugccuucagc

SEQ ID NO: 1656668 - RNA, 15 nt, Human
ccugcuuucagauac

SEQ ID NO: 1656669 - RNA, 16 nt, Human
ccugcuuucagauacu

SEQ ID NO: 1656670 - RNA, 21 nt, Human
ccugcuuucagauacuggauu

SEQ ID NO: 1656671 - RNA, 17 nt, Human
ccugcuuugggcugccc

SEQ ID NO: 1656672 - RNA, 18 nt, Human
ccugcuuugggcugcccu

SEQ ID NO: 1656673 - RNA, 19 nt, Human
ccugcuuugggcugcccug

SEQ ID NO: 1656674 - RNA, 20 nt, Human
ccugcuuuuuauggccugug

SEQ ID NO: 1656675 - RNA, 13 nt, Human
ccugcugguucag

SEQ ID NO: 1656676 - RNA, 19 nt, Human
ccugcugguucaggguugg

SEQ ID NO: 1656677 - RNA, 18 nt, Human
ccugcaacaccuuguuuc

SEQ ID NO: 1656678 - RNA, 19 nt, Human
ccugcaacaccuuguuucc

SEQ ID NO: 1656679 - RNA, 16 nt, Human
ccugcaaccugauugu

SEQ ID NO: 1656680 - RNA, 23 nt, Human
ccugcgucucauacucaccucac

SEQ ID NO: 1656681 - RNA, 17 nt, Human
ccugcuaauuccccaga

SEQ ID NO: 1656682 - RNA, 12 nt, Human
ccugcuccagcu

SEQ ID NO: 1656683 - RNA, 13 nt, Human
ccugcuccagcug

SEQ ID NO: 1656684 - RNA, 14 nt, Human
ccugcuccagcugu

SEQ ID NO: 1656685 - RNA, 22 nt, Human
ccugcuccagcuguucagcugg

SEQ ID NO: 1656686 - RNA, 14 nt, Human
ccuggacuccugca

SEQ ID NO: 1656687 - RNA, 17 nt, Human
ccuggacugugugcuca

SEQ ID NO: 1656688 - RNA, 20 nt, Human
ccuggacugugugcucagga

SEQ ID NO: 1656689 - RNA, 13 nt, Human
ccuggacccugug

SEQ ID NO: 1656690 - RNA, 14 nt, Human
ccuggacccugugg

SEQ ID NO: 1656691 - RNA, 20 nt, Human
ccuggcacugcuuccaguga

SEQ ID NO: 1656692 - RNA, 17 nt, Human
ccuggcacugcuuccag

SEQ ID NO: 1656693 - RNA, 16 nt, Human
ccuggcagccccuguu

SEQ ID NO: 1656694 - RNA, 21 nt, Human
ccuggcacugcuuccagugag

SEQ ID NO: 1656695 - RNA, 12 nt, Human
ccuggcagccgu

SEQ ID NO: 1656696 - RNA, 18 nt, Human
ccuggcagccgugccuuc

SEQ ID NO: 1656697 - RNA, 19 nt, Human
ccuggcagccgugccuuca

SEQ ID NO: 1656698 - RNA, 16 nt, Human
ccuggcaugggaauga

SEQ ID NO: 1656699 - RNA, 17 nt, Human
ccuggcaugggaaugaa

SEQ ID NO: 1656700 - RNA, 12 nt, Human
ccuggcggggug

SEQ ID NO: 1656701 - RNA, 14 nt, Human
ccuggccuuucaua

SEQ ID NO: 1656702 - RNA, 14 nt, Human
ccuggccccucagg

SEQ ID NO: 1656703 - RNA, 16 nt, Human
ccuggccccucagggu

SEQ ID NO: 1656704 - RNA, 15 nt, Human
ccuggccuuucauau

SEQ ID NO: 1656705 - RNA, 18 nt, Human
ccuggcaugggaaugaau

SEQ ID NO: 1656706 - RNA, 23 nt, Human
ccuggcaugggaaugaaugucag

SEQ ID NO: 1656707 - RNA, 13 nt, Human
ccugggaggcagu

SEQ ID NO: 1656708 - RNA, 13 nt, Human
ccugggaggcucu

SEQ ID NO: 1656709 - RNA, 21 nt, Human
ccugggaggcucuggagccca

SEQ ID NO: 1656710 - RNA, 20 nt, Human
ccugggaggucaaggcugca

SEQ ID NO: 1656711 - RNA, 16 nt, Human
ccugggaucccucauc

SEQ ID NO: 1656712 - RNA, 20 nt, Human
ccugggaucccucauccuca

SEQ ID NO: 1656713 - RNA, 12 nt, Human
ccugggcagaag

SEQ ID NO: 1656714 - RNA, 14 nt, Human
ccugggcagaagga

SEQ ID NO: 1656715 - RNA, 15 nt, Human
ccugggcagaaggaa

SEQ ID NO: 1656716 - RNA, 18 nt, Human
ccugggcagcugccuccc

SEQ ID NO: 1656717 - RNA, 17 nt, Human
ccugggcagcugccucc

SEQ ID NO: 1656718 - RNA, 16 nt, Human
ccugggcagcugccuc

SEQ ID NO: 1656719 - RNA, 15 nt, Human
ccugggcagcugccu

SEQ ID NO: 1656720 - RNA, 22 nt, Human
ccugugagcuaggaauuguguu

SEQ ID NO: 1656721 - RNA, 20 nt, Human
ccugugaguacuacaguccu

SEQ ID NO: 1656722 - RNA, 17 nt, Human
ccugucccccugacaac

SEQ ID NO: 1656723 - RNA, 18 nt, Human
ccuguccccgcacugggc

SEQ ID NO: 1656724 - RNA, 19 nt, Human
ccugugccucugggacugg

SEQ ID NO: 1656725 - RNA, 15 nt, Human
ccugugccucuggga

SEQ ID NO: 1656726 - RNA, 17 nt, Human
ccugugccucugggacu

SEQ ID NO: 1656727 - RNA, 22 nt, Human
ccugugauggggcccugccucc

SEQ ID NO: 1656728 - RNA, 20 nt, Human
ccugugauggggcccugccu

SEQ ID NO: 1656729 - RNA, 21 nt, Human
ccugugauggggcccugccuc

SEQ ID NO: 1656730 - RNA, 17 nt, Human
ccugugauggggcccug

SEQ ID NO: 1656731 - RNA, 18 nt, Human
ccugugauggggcccugc

SEQ ID NO: 1656732 - RNA, 19 nt, Human
ccugugauggggcccugcc

SEQ ID NO: 1656733 - RNA, 22 nt, Human
ccugggcagcugccuccccucc

SEQ ID NO: 1656734 - RNA, 21 nt, Human
ccuguagagugggagcugagu

SEQ ID NO: 1656735 - RNA, 23 nt, Human
ccuguagagugggagcugagugg

SEQ ID NO: 1656736 - RNA, 14 nt, Human
ccugguggcagcuc

SEQ ID NO: 1656737 - RNA, 16 nt, Human
ccugguggcagcucac

SEQ ID NO: 1656738 - RNA, 17 nt, Human
ccugguggcagcucacc

SEQ ID NO: 1656739 - RNA, 18 nt, Human
ccugguggcagcucaccu

SEQ ID NO: 1656740 - RNA, 20 nt, Human
ccuguaauccuagcacuuug

SEQ ID NO: 1656741 - RNA, 12 nt, Human
ccugguggcagc

SEQ ID NO: 1656742 - RNA, 13 nt, Human
ccugguggcagcu

SEQ ID NO: 1656743 - RNA, 18 nt, Human
ccuggugcugccacacuu

SEQ ID NO: 1656744 - RNA, 21 nt, Human
ccuggugcugccacacuucag

SEQ ID NO: 1656745 - RNA, 15 nt, Human
ccuggugcugccaca

SEQ ID NO: 1656746 - RNA, 20 nt, Human
ccugggcagcugccuccccu

SEQ ID NO: 1656747 - RNA, 20 nt, Human
ccuucagugccuuauggaac

SEQ ID NO: 1656748 - RNA, 15 nt, Human
ccuucagugccuuau

SEQ ID NO: 1656749 - RNA, 10 nt, Human
ccuucagugc

SEQ ID NO: 1656750 - RNA, 13 nt, Human
ccuucagugccuu

SEQ ID NO: 1656751 - RNA, 14 nt, Human
ccuucagugccuua

SEQ ID NO: 1656752 - RNA, 15 nt, Human
ccuuccagggguggg

SEQ ID NO: 1656753 - RNA, 16 nt, Human
ccuuccagggguggga

SEQ ID NO: 1656754 - RNA, 19 nt, Human
ccuuccaugucgccucugc

SEQ ID NO: 1656755 - RNA, 20 nt, Human
ccuuccaugucgccucugca

SEQ ID NO: 1656756 - RNA, 21 nt, Human
ccuuccaugucgccucugcau

SEQ ID NO: 1656757 - RNA, 23 nt, Human
ccuuccaugucgccucugcauuc

SEQ ID NO: 1656758 - RNA, 18 nt, Human
ccuuccaggggugggaca

SEQ ID NO: 1656759 - RNA, 22 nt, Human
ccuuccaggggugggacacccu

SEQ ID NO: 1656760 - RNA, 20 nt, Human
ccuucgauacaccgggccug

SEQ ID NO: 1656761 - RNA, 22 nt, Human
ccuucgauacaccgggccugga

SEQ ID NO: 1656762 - RNA, 23 nt, Human
ccuucgauacaccgggccuggag

SEQ ID NO: 1656763 - RNA, 13 nt, Human
ccuucgccaccug

SEQ ID NO: 1656764 - RNA, 14 nt, Human
ccuuccucuuucca

SEQ ID NO: 1656765 - RNA, 14 nt, Human
ccuuaccagcagag

SEQ ID NO: 1656766 - RNA, 17 nt, Human
ccuuaccagcagagcac

SEQ ID NO: 1656767 - RNA, 15 nt, Human
ccuuaccagcagagc

SEQ ID NO: 1656768 - RNA, 16 nt, Human
ccuuaccagcagagca

SEQ ID NO: 1656769 - RNA, 20 nt, Human
ccuuaccucggugccuuccu

SEQ ID NO: 1656770 - RNA, 14 nt, Human
ccuuaccugccagg

SEQ ID NO: 1656771 - RNA, 15 nt, Human
ccuucaaagcaaaug

SEQ ID NO: 1656772 - RNA, 19 nt, Human
ccuucaaagcaaaugucuu

SEQ ID NO: 1656773 - RNA, 14 nt, Human
ccuucaaccauucc

SEQ ID NO: 1656774 - RNA, 21 nt, Human
ccuuagacagucccugccaau

SEQ ID NO: 1656775 - RNA, 18 nt, Human
ccuuagacagucccugcc

SEQ ID NO: 1656776 - RNA, 19 nt, Human
ccuuagacagucccugcca

SEQ ID NO: 1656777 - RNA, 14 nt, Human
ccuuagaaccuuuc

SEQ ID NO: 1656778 - RNA, 15 nt, Human
ccuuagaaccuuucu

SEQ ID NO: 1656779 - RNA, 16 nt, Human
ccuuagaaccuuucuu

SEQ ID NO: 1656780 - RNA, 18 nt, Human
ccuuagaaccuuucuuac

SEQ ID NO: 1656781 - RNA, 16 nt, Human
ccuuagacagucccug

SEQ ID NO: 1656782 - RNA, 17 nt, Human
ccuuagacagucccugc

SEQ ID NO: 1656783 - RNA, 19 nt, Human
ccuucagugccuuauggaa

SEQ ID NO: 1656784 - RNA, 11 nt, Human
ccuuuggcuuc

SEQ ID NO: 1656785 - RNA, 13 nt, Human
ccuugacagggca

SEQ ID NO: 1656786 - RNA, 14 nt, Human
ccuugacagggcac

SEQ ID NO: 1656787 - RNA, 15 nt, Human
ccuugacagggcaca

SEQ ID NO: 1656788 - RNA, 17 nt, Human
ccuugacagggcacacc

SEQ ID NO: 1656789 - RNA, 19 nt, Human
ccuugaccauucuccaccu

SEQ ID NO: 1656790 - RNA, 20 nt, Human
ccuugaccauucuccaccug

SEQ ID NO: 1656791 - RNA, 22 nt, Human
ccuugaccauucuccaccugcc

SEQ ID NO: 1656792 - RNA, 21 nt, Human
ccuugaccauucuccaccugc

SEQ ID NO: 1656793 - RNA, 22 nt, Human
ccuugaguugauucagcucugc

SEQ ID NO: 1656794 - RNA, 23 nt, Human
ccuugaguugauucagcucugca

SEQ ID NO: 1656795 - RNA, 14 nt, Human
ccuucuuuuucuuc

SEQ ID NO: 1656796 - RNA, 16 nt, Human
ccuucuuuuucuucuu

SEQ ID NO: 1656797 - RNA, 15 nt, Human
ccuugaaaacacugu

SEQ ID NO: 1656798 - RNA, 13 nt, Human
ccuucgcuccugu

SEQ ID NO: 1656799 - RNA, 14 nt, Human
ccuucgcuccugug

SEQ ID NO: 1656800 - RNA, 15 nt, Human
ccuucgcuccugugu

SEQ ID NO: 1656801 - RNA, 18 nt, Human
ccuucgcuccugugucuu

SEQ ID NO: 1656802 - RNA, 19 nt, Human
ccuugaaaacacuguucuc

SEQ ID NO: 1656803 - RNA, 21 nt, Human
ccuugaaaacacuguucucug

SEQ ID NO: 1656804 - RNA, 22 nt, Human
ccuugaaaacacuguucucugc

SEQ ID NO: 1656805 - RNA, 14 nt, Human
ccuugaacugggua

SEQ ID NO: 1656806 - RNA, 17 nt, Human
ccuugaacuuugaccuc

SEQ ID NO: 1656807 - RNA, 16 nt, Human
ccuugaacuggguacu

SEQ ID NO: 1656808 - RNA, 17 nt, Human
ccuugaaugaugccaug

SEQ ID NO: 1656809 - RNA, 19 nt, Human
ccuugaacuuugaccucug

SEQ ID NO: 1656810 - RNA, 20 nt, Human
ccuugaaaacuuuaugcuaa

SEQ ID NO: 1656811 - RNA, 22 nt, Human
cguuccuucaaagcaaaugucu

SEQ ID NO: 1656812 - RNA, 13 nt, Human
cguugaaauugua

SEQ ID NO: 1656813 - RNA, 18 nt, Human
cguugaaauuguaauuau

SEQ ID NO: 1656814 - RNA, 21 nt, Human
cguuucuaaaggcuaccuuug

SEQ ID NO: 1656815 - RNA, 19 nt, Human
cguuucuaaaggcuaccuu

SEQ ID NO: 1656816 - RNA, 20 nt, Human
cguuucuaugacacaugcaa

SEQ ID NO: 1656817 - RNA, 13 nt, Human
cgugccuucagcu

SEQ ID NO: 1656818 - RNA, 15 nt, Human
cgugccuucagcucu

SEQ ID NO: 1656819 - RNA, 16 nt, Human
cgugccuucagcucua

SEQ ID NO: 1656820 - RNA, 18 nt, Human
cgugccuucagcucuaca

SEQ ID NO: 1656821 - RNA, 12 nt, Human
cgugccuggcca

SEQ ID NO: 1656822 - RNA, 16 nt, Human
cgugccuggccacgcc

SEQ ID NO: 1656823 - RNA, 23 nt, Human
cguucauggaacgcguugaaauu

SEQ ID NO: 1656824 - RNA, 22 nt, Human
cguucauggaacgcguugaaau

SEQ ID NO: 1656825 - RNA, 17 nt, Human
cguggcugcuucaagga

SEQ ID NO: 1656826 - RNA, 12 nt, Human
cguggcugcuuc

SEQ ID NO: 1656827 - RNA, 14 nt, Human
cguggcugcuucaa

SEQ ID NO: 1656828 - RNA, 15 nt, Human
cguggcugcuucaag

SEQ ID NO: 1656829 - RNA, 14 nt, Human
cgucccccucuggc

SEQ ID NO: 1656830 - RNA, 21 nt, Human
cgucccccucuggcuccagcu

SEQ ID NO: 1656831 - RNA, 22 nt, Human
cguauaugucucaggucccugc

SEQ ID NO: 1656832 - RNA, 19 nt, Human
cguauguggcaaaauguua

SEQ ID NO: 1656833 - RNA, 16 nt, Human
cgucaacucauauuuu

SEQ ID NO: 1656834 - RNA, 20 nt, Human
cgucaacucauauuuucaug

SEQ ID NO: 1656835 - RNA, 16 nt, Human
cguauaaaagccuguu

SEQ ID NO: 1656836 - RNA, 17 nt, Human
cguauaaaagccuguuu

SEQ ID NO: 1656837 - RNA, 21 nt, Human
cguauaaaagccuguuuaaga

SEQ ID NO: 1656838 - RNA, 22 nt, Human
cguauaaaagccuguuuaagag

SEQ ID NO: 1656839 - RNA, 23 nt, Human
cggugcuaucucccccagcccca

SEQ ID NO: 1656840 - RNA, 12 nt, Human
cgugacaacacu

SEQ ID NO: 1656841 - RNA, 20 nt, Human
cgugcacacaccagagccca

SEQ ID NO: 1656842 - RNA, 21 nt, Human
cgugcacacaccagagcccac

SEQ ID NO: 1656843 - RNA, 18 nt, Human
cgugcauaccacuuuugu

SEQ ID NO: 1656844 - RNA, 14 nt, Human
cgugcauaccacuu

SEQ ID NO: 1656845 - RNA, 22 nt, Human
cgugcacacaccagagcccacc

SEQ ID NO: 1656846 - RNA, 19 nt, Human
cgugcauaccacuuuuguu

SEQ ID NO: 1656847 - RNA, 23 nt, Human
cgugcauaccacuuuuguucuug

SEQ ID NO: 1656848 - RNA, 22 nt, Human
cgucccccucuggcuccagcug

SEQ ID NO: 1656849 - RNA, 11 nt, Human
cguccccuguc

SEQ ID NO: 1656850 - RNA, 14 nt, Human
cguccccugucccc

SEQ ID NO: 1656851 - RNA, 13 nt, Human
cgucugacaggca

SEQ ID NO: 1656852 - RNA, 14 nt, Human
cgucugacaggcaa

SEQ ID NO: 1656853 - RNA, 14 nt, Human
cgucuaccugaggg

SEQ ID NO: 1656854 - RNA, 13 nt, Human
cgcguugaaauug

SEQ ID NO: 1656855 - RNA, 20 nt, Human
cgcgugcacacaccagagcc

SEQ ID NO: 1656856 - RNA, 16 nt, Human
cgcgugcacacaccag

SEQ ID NO: 1656857 - RNA, 19 nt, Human
cgcgugcacacaccagagc

SEQ ID NO: 1656858 - RNA, 22 nt, Human
cgcguugaaauuguaauuauau

SEQ ID NO: 1656859 - RNA, 21 nt, Human
cgcuaagagggagggagggcu

SEQ ID NO: 1656860 - RNA, 17 nt, Human
cgcguugaaauuguaau

SEQ ID NO: 1656861 - RNA, 21 nt, Human
cgcguugaaauuguaauuaua

SEQ ID NO: 1656862 - RNA, 14 nt, Human
cgcuaagagggagg

SEQ ID NO: 1656863 - RNA, 15 nt, Human
cgcuaagagggaggg

SEQ ID NO: 1656864 - RNA, 16 nt, Human
cgcuaagagggaggga

SEQ ID NO: 1656865 - RNA, 13 nt, Human
cgcagacaggacc

SEQ ID NO: 1656866 - RNA, 14 nt, Human
cgcagacaggacca

SEQ ID NO: 1656867 - RNA, 19 nt, Human
cgcccaggcuggagugcaa

SEQ ID NO: 1656868 - RNA, 20 nt, Human
cgcccaggcuggagugcaau

SEQ ID NO: 1656869 - RNA, 12 nt, Human
cgcccaggcugg

SEQ ID NO: 1656870 - RNA, 15 nt, Human
cgcccccacugguga

SEQ ID NO: 1656871 - RNA, 16 nt, Human
cgcgacaaugcaaacc

SEQ ID NO: 1656872 - RNA, 17 nt, Human
cgcgacaaugcaaacca

SEQ ID NO: 1656873 - RNA, 12 nt, Human
ccuuggcugcag

SEQ ID NO: 1656874 - RNA, 13 nt, Human
ccuuggcugcagg

SEQ ID NO: 1656875 - RNA, 14 nt, Human
ccuuggcugcaggg

SEQ ID NO: 1656876 - RNA, 20 nt, Human
ccuuguggucccaccccaca

SEQ ID NO: 1656877 - RNA, 16 nt, Human
ccuuguggucccaccc

SEQ ID NO: 1656878 - RNA, 19 nt, Human
ccuuguggucccaccccac

SEQ ID NO: 1656879 - RNA, 13 nt, Human
ccuuuaagagaaa

SEQ ID NO: 1656880 - RNA, 16 nt, Human
ccuuucucuuucguua

SEQ ID NO: 1656881 - RNA, 14 nt, Human
ccuuuaagagaaau

SEQ ID NO: 1656882 - RNA, 14 nt, Human
ccuuugacaaaggu

SEQ ID NO: 1656883 - RNA, 16 nt, Human
ccuuugcuugaaagaa

SEQ ID NO: 1656884 - RNA, 20 nt, Human
ccuuuguauucucuccugua

SEQ ID NO: 1656885 - RNA, 18 nt, Human
ccuuuguauucucuccug

SEQ ID NO: 1656886 - RNA, 15 nt, Human
ccuuuguauucucuc

SEQ ID NO: 1656887 - RNA, 14 nt, Human
cgaggacagggagg

SEQ ID NO: 1656888 - RNA, 13 nt, Human
cgaggacagggag

SEQ ID NO: 1656889 - RNA, 12 nt, Human
cgaggacaggga

SEQ ID NO: 1656890 - RNA, 18 nt, Human
cgaggccuucucugaagg

SEQ ID NO: 1656891 - RNA, 19 nt, Human
cgaggccuucucugaagga

SEQ ID NO: 1656892 - RNA, 19 nt, Human
cgaucuggguucacugcaa

SEQ ID NO: 1656893 - RNA, 21 nt, Human
cgauucuucugcuucagccuc

SEQ ID NO: 1656894 - RNA, 13 nt, Human
cgauucuucugcu

SEQ ID NO: 1656895 - RNA, 19 nt, Human
cgauucuucugcuucagcc

SEQ ID NO: 1656896 - RNA, 12 nt, Human
cgauuucuguuu

SEQ ID NO: 1656897 - RNA, 11 nt, Human
cgcaaugugac

SEQ ID NO: 1656898 - RNA, 20 nt, Human
cggaaugaaccacaucuugc

SEQ ID NO: 1656899 - RNA, 15 nt, Human
cggacagccacggcc

SEQ ID NO: 1656900 - RNA, 16 nt, Human
cggacagccacggcca

SEQ ID NO: 1656901 - RNA, 18 nt, Human
cggacagccacggccagg

SEQ ID NO: 1656902 - RNA, 17 nt, Human
cggaaagcccugugcuc

SEQ ID NO: 1656903 - RNA, 17 nt, Human
cgcuauugucaccaggg

SEQ ID NO: 1656904 - RNA, 13 nt, Human
cgcuccugugucu

SEQ ID NO: 1656905 - RNA, 13 nt, Human
cggaugauuucua

SEQ ID NO: 1656906 - RNA, 14 nt, Human
cggaugauuucuau

SEQ ID NO: 1656907 - RNA, 20 nt, Human
cggacagccacggccaggcc

SEQ ID NO: 1656908 - RNA, 21 nt, Human
cgggaggauguucugggacac

SEQ ID NO: 1656909 - RNA, 22 nt, Human
cgggagccugaucaccugcccu

SEQ ID NO: 1656910 - RNA, 21 nt, Human
cgggagccugaucaccugccc

SEQ ID NO: 1656911 - RNA, 20 nt, Human
cgggaggauguucugggaca

SEQ ID NO: 1656912 - RNA, 16 nt, Human
cgggaggucgaggcag

SEQ ID NO: 1656913 - RNA, 17 nt, Human
cgggaggucgaggcagg

SEQ ID NO: 1656914 - RNA, 15 nt, Human
cgggcaugacacgaa

SEQ ID NO: 1656915 - RNA, 12 nt, Human
cgggcaugacac

SEQ ID NO: 1656916 - RNA, 15 nt, Human
cggccuuuggcuuca

SEQ ID NO: 1656917 - RNA, 15 nt, Human
cggcuggccuggccc

SEQ ID NO: 1656918 - RNA, 16 nt, Human
cggcuggccuggcccc

SEQ ID NO: 1656919 - RNA, 18 nt, Human
cggcuggccuggccccuc

SEQ ID NO: 1656920 - RNA, 19 nt, Human
cggcuggccuggccccuca

SEQ ID NO: 1656921 - RNA, 16 nt, Human
cggccuccauccugag

SEQ ID NO: 1656922 - RNA, 17 nt, Human
cggccuccauccugagg

SEQ ID NO: 1656923 - RNA, 17 nt, Human
cccaugcugcccuguga

SEQ ID NO: 1656924 - RNA, 18 nt, Human
cccaugcugcccugugag

SEQ ID NO: 1656925 - RNA, 15 nt, Human
cccaugcugcccugu

SEQ ID NO: 1656926 - RNA, 16 nt, Human
cccaugcugcccugug

SEQ ID NO: 1656927 - RNA, 15 nt, Human
cccagugcccacagg

SEQ ID NO: 1656928 - RNA, 20 nt, Human
cccagugcccacaggaucag

SEQ ID NO: 1656929 - RNA, 18 nt, Human
cccagugccgagaaggaa

SEQ ID NO: 1656930 - RNA, 13 nt, Human
cccauucugccug

SEQ ID NO: 1656931 - RNA, 22 nt, Human
ccccaaauggaaaugggcagag

SEQ ID NO: 1656932 - RNA, 13 nt, Human
ccccaagccuggc

SEQ ID NO: 1656933 - RNA, 14 nt, Human
ccccaagccuggca

SEQ ID NO: 1656934 - RNA, 14 nt, Human
ccccacccaagggc

SEQ ID NO: 1656935 - RNA, 20 nt, Human
ccccacccaagggccuggcc

SEQ ID NO: 1656936 - RNA, 21 nt, Human
ccccacccaagggccuggccu

SEQ ID NO: 1656937 - RNA, 17 nt, Human
ccccaggaggccagccu

SEQ ID NO: 1656938 - RNA, 22 nt, Human
ccccucagggucccugguggca

SEQ ID NO: 1656939 - RNA, 18 nt, Human
cccaagggccuggccuga

SEQ ID NO: 1656940 - RNA, 19 nt, Human
cccaagggccuggccugag

SEQ ID NO: 1656941 - RNA, 23 nt, Human
cccaagggccuggccugagcugg

SEQ ID NO: 1656942 - RNA, 20 nt, Human
cccagagggccugcaaggga

SEQ ID NO: 1656943 - RNA, 20 nt, Human
cccagauugcaacaggcugg

SEQ ID NO: 1656944 - RNA, 21 nt, Human
cccagauugcaacaggcuggg

SEQ ID NO: 1656945 - RNA, 22 nt, Human
cccagauugcaacaggcugggc

SEQ ID NO: 1656946 - RNA, 16 nt, Human
cccagcaagugagagc

SEQ ID NO: 1656947 - RNA, 18 nt, Human
cccagcaagugagagcug

SEQ ID NO: 1656948 - RNA, 18 nt, Human
cccagccccuucugaccc

SEQ ID NO: 1656949 - RNA, 12 nt, Human
cccagccugcua

SEQ ID NO: 1656950 - RNA, 19 nt, Human
cccagcaagugagagcugg

SEQ ID NO: 1656951 - RNA, 20 nt, Human
cccagcaagugagagcuggg

SEQ ID NO: 1656952 - RNA, 21 nt, Human
cccagcaagugagagcugggu

SEQ ID NO: 1656953 - RNA, 22 nt, Human
cccagcaagugagagcugggug

SEQ ID NO: 1656954 - RNA, 23 nt, Human
cccagcaagugagagcugggugu

SEQ ID NO: 1656955 - RNA, 23 nt, Human
cccagauugcaacaggcugggcu

SEQ ID NO: 1656956 - RNA, 11 nt, Human
cccagccccuu

SEQ ID NO: 1656957 - RNA, 19 nt, Human
cccagcgagcccugguggc

SEQ ID NO: 1656958 - RNA, 23 nt, Human
cccagcgagcccugguggcagug

SEQ ID NO: 1656959 - RNA, 17 nt, Human
cccagcgagcccuggug

SEQ ID NO: 1656960 - RNA, 18 nt, Human
cccagcgagcccuggugg

SEQ ID NO: 1656961 - RNA, 22 nt, Human
cccaggcauuccccaggaggcc

SEQ ID NO: 1656962 - RNA, 23 nt, Human
cccaggcauuccccaggaggcca

SEQ ID NO: 1656963 - RNA, 17 nt, Human
cccaggcaggucuugaa

SEQ ID NO: 1656964 - RNA, 20 nt, Human
cccaggcauuccccaggagg

SEQ ID NO: 1656965 - RNA, 21 nt, Human
cccaggcauuccccaggaggc

SEQ ID NO: 1656966 - RNA, 11 nt, Human
cccaggccccu

SEQ ID NO: 1656967 - RNA, 16 nt, Human
cccaggccccugccac

SEQ ID NO: 1656968 - RNA, 18 nt, Human
cccaggccccugccaccc

SEQ ID NO: 1656969 - RNA, 21 nt, Human
cccaggccccugccacccugg

SEQ ID NO: 1656970 - RNA, 22 nt, Human
cccaggccccugccacccuggg

SEQ ID NO: 1656971 - RNA, 11 nt, Human
cccaggcaggu

SEQ ID NO: 1656972 - RNA, 13 nt, Human
cccaggcaggucu

SEQ ID NO: 1656973 - RNA, 21 nt, Human
cccaggagccccgaggccuuc

SEQ ID NO: 1656974 - RNA, 13 nt, Human
cccaggaggccag

SEQ ID NO: 1656975 - RNA, 22 nt, Human
cccaggaggccagccuugacca

SEQ ID NO: 1656976 - RNA, 15 nt, Human
cccaggccugccugu

SEQ ID NO: 1656977 - RNA, 16 nt, Human
cccaggccugccuguu

SEQ ID NO: 1656978 - RNA, 18 nt, Human
cccaggcgccccuucccc

SEQ ID NO: 1656979 - RNA, 14 nt, Human
cccaggcugagccu

SEQ ID NO: 1656980 - RNA, 15 nt, Human
cccaggcugagccuc

SEQ ID NO: 1656981 - RNA, 17 nt, Human
cccaggccuccuacagc

SEQ ID NO: 1656982 - RNA, 18 nt, Human
cccaggccuccuacagcu

SEQ ID NO: 1656983 - RNA, 13 nt, Human
cccagugcccaca

SEQ ID NO: 1656984 - RNA, 20 nt, Human
cccagucuggaaugcagugg

SEQ ID NO: 1656985 - RNA, 23 nt, Human
cccaggugcuaggaacacuccuu

SEQ ID NO: 1656986 - RNA, 22 nt, Human
cccaggugcuaggaacacuccu

SEQ ID NO: 1656987 - RNA, 13 nt, Human
cccaggugccagu

SEQ ID NO: 1656988 - RNA, 21 nt, Human
cccacaaaggagagcuagcag

SEQ ID NO: 1656989 - RNA, 13 nt, Human
ccauggacuuugu

SEQ ID NO: 1656990 - RNA, 14 nt, Human
ccauggacuuuguu

SEQ ID NO: 1656991 - RNA, 15 nt, Human
ccauucuccaccugc

SEQ ID NO: 1656992 - RNA, 16 nt, Human
ccauucuccaccugcc

SEQ ID NO: 1656993 - RNA, 21 nt, Human
ccauucugccugcccaggccc

SEQ ID NO: 1656994 - RNA, 19 nt, Human
ccauucugccugcccaggc

SEQ ID NO: 1656995 - RNA, 20 nt, Human
ccauucugccugcccaggcc

SEQ ID NO: 1656996 - RNA, 17 nt, Human
ccauucuccaccugcca

SEQ ID NO: 1656997 - RNA, 18 nt, Human
ccauucuccaccugccag

SEQ ID NO: 1656998 - RNA, 17 nt, Human
ccauucugccugcccag

SEQ ID NO: 1656999 - RNA, 18 nt, Human
ccauucugccugcccagg

SEQ ID NO: 1657000 - RNA, 16 nt, Human
cccaaagcagugcaug

SEQ ID NO: 1657001 - RNA, 12 nt, Human
cccaaagaugca

SEQ ID NO: 1657002 - RNA, 15 nt, Human
cccaaagaugcagcc

SEQ ID NO: 1657003 - RNA, 22 nt, Human
ccauuuugggguacccacugcu

SEQ ID NO: 1657004 - RNA, 23 nt, Human
ccauuuuggauucuuauggacaa

SEQ ID NO: 1657005 - RNA, 20 nt, Human
ccauuuugggguacccacug

SEQ ID NO: 1657006 - RNA, 18 nt, Human
cccaaaaggcagaagcaa

SEQ ID NO: 1657007 - RNA, 13 nt, Human
cccaaaaggcaga

SEQ ID NO: 1657008 - RNA, 20 nt, Human
ccauccucuguacagagccc

SEQ ID NO: 1657009 - RNA, 22 nt, Human
ccaucauugaaaucuuuuugcu

SEQ ID NO: 1657010 - RNA, 12 nt, Human
ccauccucugua

SEQ ID NO: 1657011 - RNA, 19 nt, Human
ccauccucuguacagagcc

SEQ ID NO: 1657012 - RNA, 12 nt, Human
ccauacuaauua

SEQ ID NO: 1657013 - RNA, 13 nt, Human
ccauacuaauuau

SEQ ID NO: 1657014 - RNA, 23 nt, Human
ccauacuaauuauacccccugca

SEQ ID NO: 1657015 - RNA, 20 nt, Human
ccagugaggcucugcccuug

SEQ ID NO: 1657016 - RNA, 18 nt, Human
ccagugaggcucugcccu

SEQ ID NO: 1657017 - RNA, 19 nt, Human
ccagugaggcucugcccuu

SEQ ID NO: 1657018 - RNA, 13 nt, Human
ccaucaccagaca

SEQ ID NO: 1657019 - RNA, 19 nt, Human
ccaucaauaaaaaauuaug

SEQ ID NO: 1657020 - RNA, 20 nt, Human
ccaucaauaaaaaauuauga

SEQ ID NO: 1657021 - RNA, 18 nt, Human
ccaucaaggguacacugc

SEQ ID NO: 1657022 - RNA, 15 nt, Human
ccaugcugcccugug

SEQ ID NO: 1657023 - RNA, 14 nt, Human
ccaugcugcccugu

SEQ ID NO: 1657024 - RNA, 13 nt, Human
ccaugcuccuggc

SEQ ID NO: 1657025 - RNA, 11 nt, Human
ccaugcugccc

SEQ ID NO: 1657026 - RNA, 13 nt, Human
ccaugcugcccug

SEQ ID NO: 1657027 - RNA, 19 nt, Human
ccaugauuaaccacuucag

SEQ ID NO: 1657028 - RNA, 21 nt, Human
ccaugauuaaccacuucagcu

SEQ ID NO: 1657029 - RNA, 18 nt, Human
ccaugauguuuuccauga

SEQ ID NO: 1657030 - RNA, 16 nt, Human
ccaugauguuuagaaa

SEQ ID NO: 1657031 - RNA, 14 nt, Human
ccaugaagauguag

SEQ ID NO: 1657032 - RNA, 17 nt, Human
ccagcuggggccaggcu

SEQ ID NO: 1657033 - RNA, 18 nt, Human
ccagcuggggccaggcug

SEQ ID NO: 1657034 - RNA, 19 nt, Human
ccagcuggggccaggcugg

SEQ ID NO: 1657035 - RNA, 20 nt, Human
ccagcuggggccaggcuggg

SEQ ID NO: 1657036 - RNA, 21 nt, Human
ccagcuggggccaggcugggu

SEQ ID NO: 1657037 - RNA, 22 nt, Human
ccagcuggggccaggcuggguc

SEQ ID NO: 1657038 - RNA, 23 nt, Human
ccagcuggggccaggcugggucg

SEQ ID NO: 1657039 - RNA, 20 nt, Human
ccaggaauggagccugcacg

SEQ ID NO: 1657040 - RNA, 22 nt, Human
ccaggaagccagcaggcucuca

SEQ ID NO: 1657041 - RNA, 14 nt, Human
ccagcucuggucca

SEQ ID NO: 1657042 - RNA, 17 nt, Human
ccagcucugguccauag

SEQ ID NO: 1657043 - RNA, 21 nt, Human
ccagcucugguccauagagag

SEQ ID NO: 1657044 - RNA, 22 nt, Human
ccagcucugguccauagagagc

SEQ ID NO: 1657045 - RNA, 20 nt, Human
ccagcugcuugggcuucauc

SEQ ID NO: 1657046 - RNA, 23 nt, Human
ccagcugcuugggcuucauccuc

SEQ ID NO: 1657047 - RNA, 13 nt, Human
ccagcugcuuggg

SEQ ID NO: 1657048 - RNA, 22 nt, Human
ccagagcccaccuuggcucaag

SEQ ID NO: 1657049 - RNA, 16 nt, Human
ccagagcccaccuugg

SEQ ID NO: 1657050 - RNA, 19 nt, Human
ccagccuugaccauucucc

SEQ ID NO: 1657051 - RNA, 20 nt, Human
ccagccuugaccauucucca

SEQ ID NO: 1657052 - RNA, 11 nt, Human
ccagcucuggu

SEQ ID NO: 1657053 - RNA, 12 nt, Human
ccagcucugguc

SEQ ID NO: 1657054 - RNA, 13 nt, Human
ccagcucuggucc

SEQ ID NO: 1657055 - RNA, 22 nt, Human
ccagccuugaccauucuccacc

SEQ ID NO: 1657056 - RNA, 14 nt, Human
ccagcgagcccugg

SEQ ID NO: 1657057 - RNA, 15 nt, Human
ccagcgagcccuggu

SEQ ID NO: 1657058 - RNA, 16 nt, Human
ccagcgagcccuggug

SEQ ID NO: 1657059 - RNA, 13 nt, Human
ccaggcauggugg

SEQ ID NO: 1657060 - RNA, 17 nt, Human
ccaggcauuccccagga

SEQ ID NO: 1657061 - RNA, 14 nt, Human
ccaggcauucccca

SEQ ID NO: 1657062 - RNA, 21 nt, Human
ccaggccacaagacccuugug

SEQ ID NO: 1657063 - RNA, 24 nt, Human
ccaggcauuccccaggaggccagc

SEQ ID NO: 1657064 - RNA, 23 nt, Human
ccaggcauuccccaggaggccag

SEQ ID NO: 1657065 - RNA, 22 nt, Human
ccaggcauuccccaggaggcca

SEQ ID NO: 1657066 - RNA, 14 nt, Human
ccaggaggccagcc

SEQ ID NO: 1657067 - RNA, 13 nt, Human
ccaggaggccagc

SEQ ID NO: 1657068 - RNA, 12 nt, Human
ccaggaggccag

SEQ ID NO: 1657069 - RNA, 13 nt, Human
ccaggagccuccu

SEQ ID NO: 1657070 - RNA, 14 nt, Human
ccaggagccuccug

SEQ ID NO: 1657071 - RNA, 18 nt, Human
ccaggagccuccugcccu

SEQ ID NO: 1657072 - RNA, 16 nt, Human
ccaggagccccgaggc

SEQ ID NO: 1657073 - RNA, 19 nt, Human
ccaggagccuccugcccuu

SEQ ID NO: 1657074 - RNA, 15 nt, Human
ccaggagccccgagg

SEQ ID NO: 1657075 - RNA, 16 nt, Human
ccaggagcagccacau

SEQ ID NO: 1657076 - RNA, 19 nt, Human
ccaggcuuuuuuaucaugu

SEQ ID NO: 1657077 - RNA, 12 nt, Human
ccagggaagggg

SEQ ID NO: 1657078 - RNA, 20 nt, Human
ccaggcuguaucccaugagc

SEQ ID NO: 1657079 - RNA, 21 nt, Human
ccaggcuggucucgaacuccu

SEQ ID NO: 1657080 - RNA, 19 nt, Human
ccaggcuggucucaaacuc

SEQ ID NO: 1657081 - RNA, 13 nt, Human
ccaggccccugcc

SEQ ID NO: 1657082 - RNA, 19 nt, Human
ccaggugcuaggaacacuc

SEQ ID NO: 1657083 - RNA, 17 nt, Human
ccaggugccaguuaugg

SEQ ID NO: 1657084 - RNA, 15 nt, Human
ccagguucagcuugu

SEQ ID NO: 1657085 - RNA, 21 nt, Human
ccaggugcuaggaacacuccu

SEQ ID NO: 1657086 - RNA, 14 nt, Human
ccagguucagcuug

SEQ ID NO: 1657087 - RNA, 13 nt, Human
ccaguaucuugaa

SEQ ID NO: 1657088 - RNA, 20 nt, Human
ccagugaaaucaguuacucu

SEQ ID NO: 1657089 - RNA, 14 nt, Human
ccacgguguucugu

SEQ ID NO: 1657090 - RNA, 23 nt, Human
ccacggccaggccagagggagug

SEQ ID NO: 1657091 - RNA, 18 nt, Human
ccacgcuggagugcagug

SEQ ID NO: 1657092 - RNA, 19 nt, Human
ccacgcuggagugcaguga

SEQ ID NO: 1657093 - RNA, 16 nt, Human
ccacggccaggccaga

SEQ ID NO: 1657094 - RNA, 18 nt, Human
ccacggccaggccagagg

SEQ ID NO: 1657095 - RNA, 16 nt, Human
ccacgcuggagugcag

SEQ ID NO: 1657096 - RNA, 15 nt, Human
ccacccccacccaag

SEQ ID NO: 1657097 - RNA, 15 nt, Human
ccaccccacacacgc

SEQ ID NO: 1657098 - RNA, 14 nt, Human
ccacuacauucugu

SEQ ID NO: 1657099 - RNA, 15 nt, Human
ccacuacauucuguu

SEQ ID NO: 1657100 - RNA, 11 nt, Human
ccacuacauuc

SEQ ID NO: 1657101 - RNA, 15 nt, Human
ccacuagacccacug

SEQ ID NO: 1657102 - RNA, 17 nt, Human
ccacuagacccacugga

SEQ ID NO: 1657103 - RNA, 17 nt, Human
ccacuacauucuguuaa

SEQ ID NO: 1657104 - RNA, 16 nt, Human
ccacuacauucuguua

SEQ ID NO: 1657105 - RNA, 21 nt, Human
ccacuccagaccccuggcuuu

SEQ ID NO: 1657106 - RNA, 22 nt, Human
ccacuccagaccccuggcuuuu

SEQ ID NO: 1657107 - RNA, 18 nt, Human
ccacucaguccauagcag

SEQ ID NO: 1657108 - RNA, 20 nt, Human
ccacuccagaccccuggcuu

SEQ ID NO: 1657109 - RNA, 15 nt, Human
ccagaccccuggcuu

SEQ ID NO: 1657110 - RNA, 16 nt, Human
ccagaccccuggcuuu

SEQ ID NO: 1657111 - RNA, 17 nt, Human
ccagaccccuggcuuuu

SEQ ID NO: 1657112 - RNA, 18 nt, Human
ccagaccccuggcuuuuc

SEQ ID NO: 1657113 - RNA, 14 nt, Human
ccagaccccuggcu

SEQ ID NO: 1657114 - RNA, 21 nt, Human
ccagaauuucccaaagcagug

SEQ ID NO: 1657115 - RNA, 21 nt, Human
ccagacaccuugacagggcac

SEQ ID NO: 1657116 - RNA, 16 nt, Human
ccagaaugcuuuagga

SEQ ID NO: 1657117 - RNA, 23 nt, Human
ccagaauggucuuucuaaugugu

SEQ ID NO: 1657118 - RNA, 13 nt, Human
ccagaauuucaaa

SEQ ID NO: 1657119 - RNA, 12 nt, Human
ccagaauuuccc

SEQ ID NO: 1657120 - RNA, 19 nt, Human
ccagaauuucccaaagcag

SEQ ID NO: 1657121 - RNA, 23 nt, Human
ccagaaguuugagaucagccugg

SEQ ID NO: 1657122 - RNA, 22 nt, Human
ccagaaguuugagaucagccug

SEQ ID NO: 1657123 - RNA, 18 nt, Human
ccagaauuucccaaagca

SEQ ID NO: 1657124 - RNA, 21 nt, Human
ccacuuagaaauugcauuucc

SEQ ID NO: 1657125 - RNA, 13 nt, Human
ccacuucagcuga

SEQ ID NO: 1657126 - RNA, 14 nt, Human
ccacuucagcugac

SEQ ID NO: 1657127 - RNA, 19 nt, Human
ccacuuagaaauugcauuu

SEQ ID NO: 1657128 - RNA, 13 nt, Human
ccacugcagaaga

SEQ ID NO: 1657129 - RNA, 18 nt, Human
ccacugcagaagacagua

SEQ ID NO: 1657130 - RNA, 23 nt, Human
ccacccaggagccccgaggccuu

SEQ ID NO: 1657131 - RNA, 17 nt, Human
ccacccccacccaaggg

SEQ ID NO: 1657132 - RNA, 16 nt, Human
ccaauauucauagcag

SEQ ID NO: 1657133 - RNA, 20 nt, Human
ccacaucuugcucugcugac

SEQ ID NO: 1657134 - RNA, 19 nt, Human
ccacaucuugcucugcuga

SEQ ID NO: 1657135 - RNA, 18 nt, Human
ccacaucuugcucugcug

SEQ ID NO: 1657136 - RNA, 17 nt, Human
ccacaucuugcucugcu

SEQ ID NO: 1657137 - RNA, 16 nt, Human
ccacaugugcacaugc

SEQ ID NO: 1657138 - RNA, 16 nt, Human
ccacauuccugaugcu

SEQ ID NO: 1657139 - RNA, 15 nt, Human
ccaccaacccucaga

SEQ ID NO: 1657140 - RNA, 21 nt, Human
ccaccaacauacucccaucug

SEQ ID NO: 1657141 - RNA, 20 nt, Human
ccacacccagcccacuucug

SEQ ID NO: 1657142 - RNA, 15 nt, Human
ccacacccagcccac

SEQ ID NO: 1657143 - RNA, 21 nt, Human
ccacacccagcccacuucugc

SEQ ID NO: 1657144 - RNA, 22 nt, Human
ccacacccagcccacuucugcc

SEQ ID NO: 1657145 - RNA, 17 nt, Human
ccacaggcccuuccucu

SEQ ID NO: 1657146 - RNA, 18 nt, Human
ccacaggcccuuccucuc

SEQ ID NO: 1657147 - RNA, 19 nt, Human
ccacaggcccuuccucucc

SEQ ID NO: 1657148 - RNA, 22 nt, Human
ccacaggcccuuccucuccacu

SEQ ID NO: 1657149 - RNA, 23 nt, Human
ccacaggcccuuccucuccacug

SEQ ID NO: 1657150 - RNA, 15 nt, Human
ccacaggcccuuccu

SEQ ID NO: 1657151 - RNA, 16 nt, Human
ccacaggcccuuccuc

SEQ ID NO: 1657152 - RNA, 16 nt, Human
ccacaggaucagucug

SEQ ID NO: 1657153 - RNA, 12 nt, Human
ccacacuccagc

SEQ ID NO: 1657154 - RNA, 20 nt, Human
ccacaggaaccacaagacug

SEQ ID NO: 1657155 - RNA, 23 nt, Human
cauuguauucagaguugaugguu

SEQ ID NO: 1657156 - RNA, 13 nt, Human
cauugugggaagg

SEQ ID NO: 1657157 - RNA, 17 nt, Human
cauuguuggccaaagcc

SEQ ID NO: 1657158 - RNA, 18 nt, Human
cauuguuggccaaagcca

SEQ ID NO: 1657159 - RNA, 15 nt, Human
cauuguagagcuucu

SEQ ID NO: 1657160 - RNA, 16 nt, Human
cauuguagagcuucug

SEQ ID NO: 1657161 - RNA, 17 nt, Human
cauuguagagcuucugg

SEQ ID NO: 1657162 - RNA, 19 nt, Human
cauuguagagcuucuggca

SEQ ID NO: 1657163 - RNA, 21 nt, Human
cauuguagagcuucuggcacu

SEQ ID NO: 1657164 - RNA, 14 nt, Human
cacccaagggccug

SEQ ID NO: 1657165 - RNA, 15 nt, Human
cacccaagggccugg

SEQ ID NO: 1657166 - RNA, 12 nt, Human
cauuuccugugu

SEQ ID NO: 1657167 - RNA, 13 nt, Human
cauuuccuguguc

SEQ ID NO: 1657168 - RNA, 16 nt, Human
cauuuaaaagauacag

SEQ ID NO: 1657169 - RNA, 15 nt, Human
cauuuaaaagauaca

SEQ ID NO: 1657170 - RNA, 12 nt, Human
cauuuaaaagau

SEQ ID NO: 1657171 - RNA, 15 nt, Human
cauuuaauaauuaua

SEQ ID NO: 1657172 - RNA, 16 nt, Human
cauuuaauaauuauau

SEQ ID NO: 1657173 - RNA, 17 nt, Human
cauuuaauaauuauaug

SEQ ID NO: 1657174 - RNA, 19 nt, Human
cauuuaauaauuauaugcu

SEQ ID NO: 1657175 - RNA, 12 nt, Human
cauuuaauaauu

SEQ ID NO: 1657176 - RNA, 14 nt, Human
cauuuaauaauuau

SEQ ID NO: 1657177 - RNA, 21 nt, Human
cauuuaaaagauacaguuacu

SEQ ID NO: 1657178 - RNA, 13 nt, Human
cauuuccugacag

SEQ ID NO: 1657179 - RNA, 20 nt, Human
cauuuccugacagaaggacu

SEQ ID NO: 1657180 - RNA, 23 nt, Human
cauuuaauaauuauaugcuauuu

SEQ ID NO: 1657181 - RNA, 17 nt, Human
cauuuaggccaugggac

SEQ ID NO: 1657182 - RNA, 19 nt, Human
cauuuuagggguagcauuu

SEQ ID NO: 1657183 - RNA, 11 nt, Human
cauuuuauaaa

SEQ ID NO: 1657184 - RNA, 13 nt, Human
cauuuuauaaauc

SEQ ID NO: 1657185 - RNA, 17 nt, Human
cauuuuauaaaucgcuu

SEQ ID NO: 1657186 - RNA, 18 nt, Human
cauuuuauaaaucgcuuu

SEQ ID NO: 1657187 - RNA, 21 nt, Human
cauuuuauaaaucgcuuuuga

SEQ ID NO: 1657188 - RNA, 23 nt, Human
cauuuuauaaaucgcuuuugaua

SEQ ID NO: 1657189 - RNA, 19 nt, Human
ccaaacauccuacaagaca

SEQ ID NO: 1657190 - RNA, 20 nt, Human
ccaaacauccuacaagacac

SEQ ID NO: 1657191 - RNA, 17 nt, Human
ccaaacucaccugcccc

SEQ ID NO: 1657192 - RNA, 23 nt, Human
cauuuuucuuagggaaggauaca

SEQ ID NO: 1657193 - RNA, 20 nt, Human
cauuugaaaauuuugauguu

SEQ ID NO: 1657194 - RNA, 22 nt, Human
cauuugaaaauuuugauguuuu

SEQ ID NO: 1657195 - RNA, 20 nt, Human
cauuugagcagggcucagcg

SEQ ID NO: 1657196 - RNA, 17 nt, Human
cauuugagcagggcuca

SEQ ID NO: 1657197 - RNA, 18 nt, Human
cauuugagcagggcucag

SEQ ID NO: 1657198 - RNA, 22 nt, Human
cauuuguuugaacugauaaaga

SEQ ID NO: 1657199 - RNA, 20 nt, Human
cauuuguuugaacugauaaa

SEQ ID NO: 1657200 - RNA, 13 nt, Human
cauuugcugaaua

SEQ ID NO: 1657201 - RNA, 17 nt, Human
cauuuguuugaacugau

SEQ ID NO: 1657202 - RNA, 13 nt, Human
cauuugcuccuuu

SEQ ID NO: 1657203 - RNA, 14 nt, Human
cauuugcuccuuuc

SEQ ID NO: 1657204 - RNA, 13 nt, Human
cauuugcucaugg

SEQ ID NO: 1657205 - RNA, 18 nt, Human
cauuugcucauggaauug

SEQ ID NO: 1657206 - RNA, 14 nt, Human
ccaagcaaguauua

SEQ ID NO: 1657207 - RNA, 22 nt, Human
ccaauaguuguugauuggcagg

SEQ ID NO: 1657208 - RNA, 20 nt, Human
ccaagucaagugaaaaagga

SEQ ID NO: 1657209 - RNA, 18 nt, Human
ccaaggugggaggauugc

SEQ ID NO: 1657210 - RNA, 13 nt, Human
ccaaggugggagg

SEQ ID NO: 1657211 - RNA, 23 nt, Human
ccaagguuuggggaagaacgaag

SEQ ID NO: 1657212 - RNA, 22 nt, Human
ccaaggggaauguuugccucug

SEQ ID NO: 1657213 - RNA, 19 nt, Human
ccaagggccuggccugagc

SEQ ID NO: 1657214 - RNA, 16 nt, Human
ccaagggccuggccug

SEQ ID NO: 1657215 - RNA, 18 nt, Human
ccaagggccuggccugag

SEQ ID NO: 1657216 - RNA, 15 nt, Human
ccaagggccuggccu

SEQ ID NO: 1657217 - RNA, 18 nt, Human
ccaaggccaaaggaagca

SEQ ID NO: 1657218 - RNA, 21 nt, Human
ccaaggccaaaggaagcacau

SEQ ID NO: 1657219 - RNA, 15 nt, Human
ccaagccuggcaagg

SEQ ID NO: 1657220 - RNA, 13 nt, Human
ccaagccguggcu

SEQ ID NO: 1657221 - RNA, 22 nt, Human
ccaagccuacuuuugccauuga

SEQ ID NO: 1657222 - RNA, 14 nt, Human
ccaagcucccaggc

SEQ ID NO: 1657223 - RNA, 15 nt, Human
ccaagcucccaggca

SEQ ID NO: 1657224 - RNA, 16 nt, Human
ccaagcucccaggcau

SEQ ID NO: 1657225 - RNA, 22 nt, Human
ccaagcucccaggcauucccca

SEQ ID NO: 1657226 - RNA, 17 nt, Human
ccaaggccaaaggaagc

SEQ ID NO: 1657227 - RNA, 17 nt, Human
ccaagcauuuagaugua

SEQ ID NO: 1657228 - RNA, 22 nt, Human
ccaagcauaccaacacgagcag

SEQ ID NO: 1657229 - RNA, 14 nt, Human
ccaacccucagagc

SEQ ID NO: 1657230 - RNA, 15 nt, Human
ccaacccucagagcc

SEQ ID NO: 1657231 - RNA, 15 nt, Human
ccaagaagcccagga

SEQ ID NO: 1657232 - RNA, 12 nt, Human
ccaacccucauc

SEQ ID NO: 1657233 - RNA, 20 nt, Human
ccaagaauagaugcugacug

SEQ ID NO: 1657234 - RNA, 19 nt, Human
ccaagaauagaugcugacu

SEQ ID NO: 1657235 - RNA, 19 nt, Human
ccaagaagcccaggaaagg

SEQ ID NO: 1657236 - RNA, 20 nt, Human
ccaagaagcccaggaaaggc

SEQ ID NO: 1657237 - RNA, 23 nt, Human
ccaagcagagguugggaggccau

SEQ ID NO: 1657238 - RNA, 20 nt, Human
ccaaacucaccugccccuca

SEQ ID NO: 1657239 - RNA, 17 nt, Human
ccaaagccuccuccagc

SEQ ID NO: 1657240 - RNA, 22 nt, Human
ccaaagccuccuccagccgcca

SEQ ID NO: 1657241 - RNA, 23 nt, Human
ccaaagcagugcaugcugucccu

SEQ ID NO: 1657242 - RNA, 19 nt, Human
ccaaagccaaagcuaggcc

SEQ ID NO: 1657243 - RNA, 22 nt, Human
ccaaacugacucuuaagaagac

SEQ ID NO: 1657244 - RNA, 19 nt, Human
ccaaagcagugcaugcugu

SEQ ID NO: 1657245 - RNA, 21 nt, Human
ccaaagcuaggccuggccaga

SEQ ID NO: 1657246 - RNA, 16 nt, Human
ccaaagcuaggccugg

SEQ ID NO: 1657247 - RNA, 17 nt, Human
ccaaagcuaggccuggc

SEQ ID NO: 1657248 - RNA, 15 nt, Human
ccaaagcuaggccug

SEQ ID NO: 1657249 - RNA, 15 nt, Human
ccaaaggaagcacau

SEQ ID NO: 1657250 - RNA, 23 nt, Human
ccaaaggaagcacaugccucucu

SEQ ID NO: 1657251 - RNA, 20 nt, Human
ccaaccaaguggcucccaca

SEQ ID NO: 1657252 - RNA, 13 nt, Human
ccaacaucaacau

SEQ ID NO: 1657253 - RNA, 21 nt, Human
ccaacauacucccaucuguga

SEQ ID NO: 1657254 - RNA, 22 nt, Human
ccaacauacucccaucugugaa

SEQ ID NO: 1657255 - RNA, 17 nt, Human
ccaacauacucccaucu

SEQ ID NO: 1657256 - RNA, 18 nt, Human
ccaacauacucccaucug

SEQ ID NO: 1657257 - RNA, 19 nt, Human
ccaacauacucccaucugu

SEQ ID NO: 1657258 - RNA, 20 nt, Human
ccaacauacucccaucugug

SEQ ID NO: 1657259 - RNA, 16 nt, Human
ccaacauacucccauc

SEQ ID NO: 1657260 - RNA, 18 nt, Human
ccaaaguacacuguuuca

SEQ ID NO: 1657261 - RNA, 15 nt, Human
ccaaaguacacuguu

SEQ ID NO: 1657262 - RNA, 20 nt, Human
ccaaaguacacuguuucaaa

SEQ ID NO: 1657263 - RNA, 23 nt, Human
ccaaauuucauaccuaucaucuu

SEQ ID NO: 1657264 - RNA, 20 nt, Human
cugagacucgcgacaaugca

SEQ ID NO: 1657265 - RNA, 17 nt, Human
cugagacucgcgacaau

SEQ ID NO: 1657266 - RNA, 19 nt, Human
cugagacucgcgacaaugc

SEQ ID NO: 1657267 - RNA, 17 nt, Human
cugcccuggugcugcca

SEQ ID NO: 1657268 - RNA, 16 nt, Human
cugcccuggugcugcc

SEQ ID NO: 1657269 - RNA, 18 nt, Human
cugcccuggugcugccac

SEQ ID NO: 1657270 - RNA, 19 nt, Human
cugcccuggugcugccaca

SEQ ID NO: 1657271 - RNA, 16 nt, Human
cugcccccucugcccu

SEQ ID NO: 1657272 - RNA, 17 nt, Human
cugcccccucugcccug

SEQ ID NO: 1657273 - RNA, 18 nt, Human
cugcccccucugcccugc

SEQ ID NO: 1657274 - RNA, 19 nt, Human
cugcccccucugcccugcg

SEQ ID NO: 1657275 - RNA, 14 nt, Human
cugccccucaacuc

SEQ ID NO: 1657276 - RNA, 22 nt, Human
cugccccucaacucuccuccag

SEQ ID NO: 1657277 - RNA, 20 nt, Human
cugcccuggugcugccacac

SEQ ID NO: 1657278 - RNA, 21 nt, Human
cugcccuggugcugccacacu

SEQ ID NO: 1657279 - RNA, 22 nt, Human
cugcccugguuuccugcccugg

SEQ ID NO: 1657280 - RNA, 23 nt, Human
cugcccugguuuccugcccuggg

SEQ ID NO: 1657281 - RNA, 12 nt, Human
cugcccugugag

SEQ ID NO: 1657282 - RNA, 13 nt, Human
cugcccugugagu

SEQ ID NO: 1657283 - RNA, 15 nt, Human
cugcccugugggccc

SEQ ID NO: 1657284 - RNA, 16 nt, Human
cugcccugugggcccc

SEQ ID NO: 1657285 - RNA, 18 nt, Human
cugcccugugggccccca

SEQ ID NO: 1657286 - RNA, 14 nt, Human
cugcccccucugcc

SEQ ID NO: 1657287 - RNA, 15 nt, Human
cugcccccucugccc

SEQ ID NO: 1657288 - RNA, 19 nt, Human
cugccccagggcucccggc

SEQ ID NO: 1657289 - RNA, 12 nt, Human
cugccauccagg

SEQ ID NO: 1657290 - RNA, 11 nt, Human
cugccagggac

SEQ ID NO: 1657291 - RNA, 12 nt, Human
cugccagggaca

SEQ ID NO: 1657292 - RNA, 15 nt, Human
cugccagggacagag

SEQ ID NO: 1657293 - RNA, 20 nt, Human
cugccauauucuguuggcca

SEQ ID NO: 1657294 - RNA, 21 nt, Human
cugccauauucuguuggccag

SEQ ID NO: 1657295 - RNA, 22 nt, Human
cugccauauucuguuggccagu

SEQ ID NO: 1657296 - RNA, 23 nt, Human
cugccauauucuguuggccagug

SEQ ID NO: 1657297 - RNA, 14 nt, Human
cugcauuugugaaa

SEQ ID NO: 1657298 - RNA, 15 nt, Human
cugcauuugugaaau

SEQ ID NO: 1657299 - RNA, 17 nt, Human
cugcauuugugaaauga

SEQ ID NO: 1657300 - RNA, 22 nt, Human
cugcauuugugaaaugauggug

SEQ ID NO: 1657301 - RNA, 15 nt, Human
cugccaaugggagcu

SEQ ID NO: 1657302 - RNA, 17 nt, Human
cugccaaugggagcuca

SEQ ID NO: 1657303 - RNA, 20 nt, Human
cugcauucaggaucaaaccc

SEQ ID NO: 1657304 - RNA, 13 nt, Human
cugcauuugugaa

SEQ ID NO: 1657305 - RNA, 22 nt, Human
cugcauuuaaaagauacaguua

SEQ ID NO: 1657306 - RNA, 20 nt, Human
cugcauuuaaaagauacagu

SEQ ID NO: 1657307 - RNA, 15 nt, Human
cugcauguuugugau

SEQ ID NO: 1657308 - RNA, 13 nt, Human
cugcauguuacau

SEQ ID NO: 1657309 - RNA, 17 nt, Human
cugcuuuuuauggccug

SEQ ID NO: 1657310 - RNA, 22 nt, Human
cugcuuuuuaaagaaugcucuu

SEQ ID NO: 1657311 - RNA, 14 nt, Human
cugcuucagccucc

SEQ ID NO: 1657312 - RNA, 16 nt, Human
cugcuucagccucccg

SEQ ID NO: 1657313 - RNA, 17 nt, Human
cugcuuaacuucacaua

SEQ ID NO: 1657314 - RNA, 15 nt, Human
cugcuuaacuucaca

SEQ ID NO: 1657315 - RNA, 13 nt, Human
cugcuucagccuc

SEQ ID NO: 1657316 - RNA, 13 nt, Human
cugcuuaacuuca

SEQ ID NO: 1657317 - RNA, 13 nt, Human
cuggacugugugc

SEQ ID NO: 1657318 - RNA, 17 nt, Human
cuggaacacuaaugagg

SEQ ID NO: 1657319 - RNA, 18 nt, Human
cugcuuuuuauggccugu

SEQ ID NO: 1657320 - RNA, 23 nt, Human
cugcuucagccucccgaguagcu

SEQ ID NO: 1657321 - RNA, 16 nt, Human
cuggaaauauuaagaa

SEQ ID NO: 1657322 - RNA, 21 nt, Human
cuggaaaucaggguuaguauu

SEQ ID NO: 1657323 - RNA, 15 nt, Human
cugcugacagacaca

SEQ ID NO: 1657324 - RNA, 18 nt, Human
cugcugacagacacaggc

SEQ ID NO: 1657325 - RNA, 19 nt, Human
cugcugacagacacaggcc

SEQ ID NO: 1657326 - RNA, 20 nt, Human
cugcugacagacacaggccc

SEQ ID NO: 1657327 - RNA, 21 nt, Human
cugcugacagacacaggcccg

SEQ ID NO: 1657328 - RNA, 23 nt, Human
cugcugacagacacaggcccggc

SEQ ID NO: 1657329 - RNA, 11 nt, Human
cugcugacagu

SEQ ID NO: 1657330 - RNA, 15 nt, Human
cugcuacagagcaga

SEQ ID NO: 1657331 - RNA, 16 nt, Human
cugcuaauuccccaga

SEQ ID NO: 1657332 - RNA, 16 nt, Human
cugccuguugggccag

SEQ ID NO: 1657333 - RNA, 14 nt, Human
cugccuguugggcc

SEQ ID NO: 1657334 - RNA, 18 nt, Human
cugccuguugggccagga

SEQ ID NO: 1657335 - RNA, 19 nt, Human
cugccuguugggccaggag

SEQ ID NO: 1657336 - RNA, 14 nt, Human
cugccuguucagcu

SEQ ID NO: 1657337 - RNA, 15 nt, Human
cugccuguucagcuc

SEQ ID NO: 1657338 - RNA, 23 nt, Human
cugccugggaucccucauccuca

SEQ ID NO: 1657339 - RNA, 15 nt, Human
cugccucgaacuggc

SEQ ID NO: 1657340 - RNA, 17 nt, Human
cugccucgaacuggcug

SEQ ID NO: 1657341 - RNA, 18 nt, Human
cugccucgaacuggcugc

SEQ ID NO: 1657342 - RNA, 19 nt, Human
cugccucgaacuggcugca

SEQ ID NO: 1657343 - RNA, 19 nt, Human
cugcccugugggcccccaa

SEQ ID NO: 1657344 - RNA, 19 nt, Human
cugugcuccauggcugcca

SEQ ID NO: 1657345 - RNA, 14 nt, Human
cugugcucuggaca

SEQ ID NO: 1657346 - RNA, 15 nt, Human
cugugcucuggacag

SEQ ID NO: 1657347 - RNA, 16 nt, Human
cugugagaugcuagaa

SEQ ID NO: 1657348 - RNA, 21 nt, Human
cugugagaugcuagaacuccc

SEQ ID NO: 1657349 - RNA, 15 nt, Human
cugugaagagaacca

SEQ ID NO: 1657350 - RNA, 18 nt, Human
cugugaacuugaaauuug

SEQ ID NO: 1657351 - RNA, 19 nt, Human
cugucgagaaacagccugu

SEQ ID NO: 1657352 - RNA, 16 nt, Human
cugucgcccaggcugg

SEQ ID NO: 1657353 - RNA, 13 nt, Human
cugucgcccaguc

SEQ ID NO: 1657354 - RNA, 15 nt, Human
cugucgcccagucug

SEQ ID NO: 1657355 - RNA, 22 nt, Human
cuguacuugcucuugaugccug

SEQ ID NO: 1657356 - RNA, 23 nt, Human
cuguacuugcucuugaugccugg

SEQ ID NO: 1657357 - RNA, 14 nt, Human
cuguacuuuuuggc

SEQ ID NO: 1657358 - RNA, 15 nt, Human
cuguacuuuuuggca

SEQ ID NO: 1657359 - RNA, 21 nt, Human
cuguaggaagguuaauguuca

SEQ ID NO: 1657360 - RNA, 12 nt, Human
cuguccugccua

SEQ ID NO: 1657361 - RNA, 20 nt, Human
cugucauuugagcagggcuc

SEQ ID NO: 1657362 - RNA, 17 nt, Human
cugucauuugagcaggg

SEQ ID NO: 1657363 - RNA, 18 nt, Human
cugucauuugagcagggc

SEQ ID NO: 1657364 - RNA, 23 nt, Human
cugucagcuccccucggagaaga

SEQ ID NO: 1657365 - RNA, 16 nt, Human
cugucauuugagcagg

SEQ ID NO: 1657366 - RNA, 18 nt, Human
cugucagccauuccuguu

SEQ ID NO: 1657367 - RNA, 21 nt, Human
cugucagcuccccucggagaa

SEQ ID NO: 1657368 - RNA, 22 nt, Human
cugguuuccugcccugggaggc

SEQ ID NO: 1657369 - RNA, 18 nt, Human
cugguuuccugcccuggg

SEQ ID NO: 1657370 - RNA, 21 nt, Human
cugguuuccugcccugggagg

SEQ ID NO: 1657371 - RNA, 23 nt, Human
cuggguuccuuccucugagccuu

SEQ ID NO: 1657372 - RNA, 14 nt, Human
cuggguucuaccca

SEQ ID NO: 1657373 - RNA, 15 nt, Human
cuggugacuuuccuc

SEQ ID NO: 1657374 - RNA, 20 nt, Human
cuggugacuuuccucuuugg

SEQ ID NO: 1657375 - RNA, 21 nt, Human
cuggugacuuuccucuuuggu

SEQ ID NO: 1657376 - RNA, 18 nt, Human
cuggguuccuuccucuga

SEQ ID NO: 1657377 - RNA, 22 nt, Human
cuggguuccuuccucugagccu

SEQ ID NO: 1657378 - RNA, 13 nt, Human
cuggguuccugca

SEQ ID NO: 1657379 - RNA, 22 nt, Human
cuggguuccagcaauucuccug

SEQ ID NO: 1657380 - RNA, 15 nt, Human
cuggguucacugcaa

SEQ ID NO: 1657381 - RNA, 14 nt, Human
cuggguucacugca

SEQ ID NO: 1657382 - RNA, 23 nt, Human
cuggguggcaccagcagccugga

SEQ ID NO: 1657383 - RNA, 22 nt, Human
cuggguggcaccagcagccugg

SEQ ID NO: 1657384 - RNA, 16 nt, Human
cuggguguggcgcagc

SEQ ID NO: 1657385 - RNA, 17 nt, Human
cuggguguggcgcagca

SEQ ID NO: 1657386 - RNA, 23 nt, Human
cuggugacuuuccucuuuggucu

SEQ ID NO: 1657387 - RNA, 18 nt, Human
cuggggccaggcuggguc

SEQ ID NO: 1657388 - RNA, 16 nt, Human
cuggggccgaaagaac

SEQ ID NO: 1657389 - RNA, 18 nt, Human
cugggcagaaggaagacu

SEQ ID NO: 1657390 - RNA, 19 nt, Human
cugggcagcugccuccccu

SEQ ID NO: 1657391 - RNA, 16 nt, Human
cugggcagcugccucc

SEQ ID NO: 1657392 - RNA, 15 nt, Human
cuggggaaccugacc

SEQ ID NO: 1657393 - RNA, 16 nt, Human
cuggggaaccugaccc

SEQ ID NO: 1657394 - RNA, 17 nt, Human
cuggggaaccugacccc

SEQ ID NO: 1657395 - RNA, 21 nt, Human
cugggcagcugccuccccucc

SEQ ID NO: 1657396 - RNA, 20 nt, Human
cugggcagcugccuccccuc

SEQ ID NO: 1657397 - RNA, 22 nt, Human
cugggcagcugccuccccuccu

SEQ ID NO: 1657398 - RNA, 17 nt, Human
cugggcagaaggaagac

SEQ ID NO: 1657399 - RNA, 16 nt, Human
cuggacugugugcuca

SEQ ID NO: 1657400 - RNA, 12 nt, Human
cuggcagcucag

SEQ ID NO: 1657401 - RNA, 13 nt, Human
cuggcagcucaga

SEQ ID NO: 1657402 - RNA, 14 nt, Human
cuggcagcucagag

SEQ ID NO: 1657403 - RNA, 13 nt, Human
cuggccccucagg

SEQ ID NO: 1657404 - RNA, 15 nt, Human
cuggcagcucagaga

SEQ ID NO: 1657405 - RNA, 17 nt, Human
cuggccccucagggucc

SEQ ID NO: 1657406 - RNA, 18 nt, Human
cuggccccucaggguccc

SEQ ID NO: 1657407 - RNA, 20 nt, Human
cuggccccucagggucccug

SEQ ID NO: 1657408 - RNA, 21 nt, Human
cuggccccucagggucccugg

SEQ ID NO: 1657409 - RNA, 15 nt, Human
cuggcucccacaggc

SEQ ID NO: 1657410 - RNA, 13 nt, Human
cuggcuccagcug

SEQ ID NO: 1657411 - RNA, 14 nt, Human
cuggcuccagcugg

SEQ ID NO: 1657412 - RNA, 18 nt, Human
cuggcuccagcuggccgg

SEQ ID NO: 1657413 - RNA, 20 nt, Human
cuggcuccagcuggccggga

SEQ ID NO: 1657414 - RNA, 12 nt, Human
cugggacacagu

SEQ ID NO: 1657415 - RNA, 13 nt, Human
cugggacacaguu

SEQ ID NO: 1657416 - RNA, 10 nt, Human
cugggacagg

SEQ ID NO: 1657417 - RNA, 20 nt, Human
cuucagagacuccugcaggc

SEQ ID NO: 1657418 - RNA, 18 nt, Human
cuucagagacuccugcag

SEQ ID NO: 1657419 - RNA, 19 nt, Human
cuucagagacuccugcagg

SEQ ID NO: 1657420 - RNA, 17 nt, Human
cuucagagacuccugca

SEQ ID NO: 1657421 - RNA, 15 nt, Human
cuucacuguaaaaua

SEQ ID NO: 1657422 - RNA, 22 nt, Human
cuuccagugaggcucugcccuu

SEQ ID NO: 1657423 - RNA, 23 nt, Human
cuuccagugaggcucugcccuug

SEQ ID NO: 1657424 - RNA, 21 nt, Human
cuuccagugaggcucugcccu

SEQ ID NO: 1657425 - RNA, 20 nt, Human
cuucauaccuacauguauuu

SEQ ID NO: 1657426 - RNA, 11 nt, Human
cuuccauaauc

SEQ ID NO: 1657427 - RNA, 21 nt, Human
cuuccauaaucuggacuccuc

SEQ ID NO: 1657428 - RNA, 11 nt, Human
cuucccaccuc

SEQ ID NO: 1657429 - RNA, 21 nt, Human
cuucccaccucucucacuccu

SEQ ID NO: 1657430 - RNA, 23 nt, Human
cuucccaccucucucacuccuug

SEQ ID NO: 1657431 - RNA, 12 nt, Human
cugugcugaguc

SEQ ID NO: 1657432 - RNA, 14 nt, Human
cugugcugagucug

SEQ ID NO: 1657433 - RNA, 19 nt, Human
cugugcugagucugaaggc

SEQ ID NO: 1657434 - RNA, 23 nt, Human
cuuauuguagcauccuggaauau

SEQ ID NO: 1657435 - RNA, 21 nt, Human
cuucaccuuuguccccaccgc

SEQ ID NO: 1657436 - RNA, 20 nt, Human
cuuauuguagcauccuggaa

SEQ ID NO: 1657437 - RNA, 22 nt, Human
cuucaccuuuguccccaccgca

SEQ ID NO: 1657438 - RNA, 15 nt, Human
cuucacggaagagcc

SEQ ID NO: 1657439 - RNA, 19 nt, Human
cuucacggaagagccuugc

SEQ ID NO: 1657440 - RNA, 17 nt, Human
cuuauggaacacucuga

SEQ ID NO: 1657441 - RNA, 19 nt, Human
cuuauggaacacucugaga

SEQ ID NO: 1657442 - RNA, 20 nt, Human
cuuauggaacacucugagac

SEQ ID NO: 1657443 - RNA, 21 nt, Human
cuuauggaacacucugagacu

SEQ ID NO: 1657444 - RNA, 13 nt, Human
cuuauggaacacu

SEQ ID NO: 1657445 - RNA, 16 nt, Human
cuuauggaacacucug

SEQ ID NO: 1657446 - RNA, 19 nt, Human
cuugaauuguaaggaauga

SEQ ID NO: 1657447 - RNA, 14 nt, Human
cuugacagggcaca

SEQ ID NO: 1657448 - RNA, 15 nt, Human
cuugacagggcacac

SEQ ID NO: 1657449 - RNA, 13 nt, Human
cuugacagggcac

SEQ ID NO: 1657450 - RNA, 20 nt, Human
cuugacagggcacaccgggc

SEQ ID NO: 1657451 - RNA, 12 nt, Human
cuugaugaagaa

SEQ ID NO: 1657452 - RNA, 20 nt, Human
cuugccuuuuucauuauuuu

SEQ ID NO: 1657453 - RNA, 22 nt, Human
cuugccuuuuucauuauuuuau

SEQ ID NO: 1657454 - RNA, 23 nt, Human
cuugccuuuuucauuauuuuauu

SEQ ID NO: 1657455 - RNA, 14 nt, Human
cuugccuuuuucau

SEQ ID NO: 1657456 - RNA, 15 nt, Human
cuugccuuuuucauu

SEQ ID NO: 1657457 - RNA, 13 nt, Human
cuugaugccuggc

SEQ ID NO: 1657458 - RNA, 12 nt, Human
cuugaugccugg

SEQ ID NO: 1657459 - RNA, 13 nt, Human
cuugaugaagaag

SEQ ID NO: 1657460 - RNA, 12 nt, Human
cuuggcgcugcc

SEQ ID NO: 1657461 - RNA, 14 nt, Human
cuuggcgcugcccc

SEQ ID NO: 1657462 - RNA, 17 nt, Human
cuuggcgcugccccugg

SEQ ID NO: 1657463 - RNA, 20 nt, Human
cuuggcgcugccccuggcag

SEQ ID NO: 1657464 - RNA, 17 nt, Human
cuucuagaaccaggcaa

SEQ ID NO: 1657465 - RNA, 13 nt, Human
cuucuagaaccag

SEQ ID NO: 1657466 - RNA, 17 nt, Human
cuuccugcaacaccuug

SEQ ID NO: 1657467 - RNA, 22 nt, Human
cuucuaaguaaaaccacagcag

SEQ ID NO: 1657468 - RNA, 23 nt, Human
cuucuaaguaaaaccacagcagu

SEQ ID NO: 1657469 - RNA, 17 nt, Human
cuucuguugcugccuca

SEQ ID NO: 1657470 - RNA, 18 nt, Human
cuucuguugcugccucau

SEQ ID NO: 1657471 - RNA, 19 nt, Human
cuucuguugcugccucaug

SEQ ID NO: 1657472 - RNA, 20 nt, Human
cuucuguugcugccucaugc

SEQ ID NO: 1657473 - RNA, 23 nt, Human
cuucuucagagacuccugcaggc

SEQ ID NO: 1657474 - RNA, 21 nt, Human
cuucuguugcugccucaugcu

SEQ ID NO: 1657475 - RNA, 20 nt, Human
cuucugacccaugcugcccu

SEQ ID NO: 1657476 - RNA, 21 nt, Human
cuucugacccaugcugcccug

SEQ ID NO: 1657477 - RNA, 22 nt, Human
cuucugacccaugcugcccugu

SEQ ID NO: 1657478 - RNA, 23 nt, Human
cuucugacccaugcugcccugug

SEQ ID NO: 1657479 - RNA, 13 nt, Human
gaaacuuuuggaa

SEQ ID NO: 1657480 - RNA, 15 nt, Human
gaaacuuuuggaagg

SEQ ID NO: 1657481 - RNA, 21 nt, Human
gaaagaaaauaccaaggaaca

SEQ ID NO: 1657482 - RNA, 20 nt, Human
gaaagacuaucuaaauguug

SEQ ID NO: 1657483 - RNA, 14 nt, Human
gaaagacuauucaa

SEQ ID NO: 1657484 - RNA, 15 nt, Human
gaaagacuauucaaa

SEQ ID NO: 1657485 - RNA, 22 nt, Human
gaaaggcuccaggagcagccac

SEQ ID NO: 1657486 - RNA, 21 nt, Human
gaaaggcuccaggagcagcca

SEQ ID NO: 1657487 - RNA, 17 nt, Human
gaaagacuauucaaaca

SEQ ID NO: 1657488 - RNA, 18 nt, Human
gaaauauuuauuuuaaua

SEQ ID NO: 1657489 - RNA, 22 nt, Human
gaaauauuuauuuuaauaaugu

SEQ ID NO: 1657490 - RNA, 18 nt, Human
gaaaucaaauaugcaaag

SEQ ID NO: 1657491 - RNA, 21 nt, Human
gaaaucaaauaugcaaagcac

SEQ ID NO: 1657492 - RNA, 19 nt, Human
gaaaucaaauaugcaaagc

SEQ ID NO: 1657493 - RNA, 20 nt, Human
gaaaucaaauaugcaaagca

SEQ ID NO: 1657494 - RNA, 22 nt, Human
gaaagggacuuggaagcuccgc

SEQ ID NO: 1657495 - RNA, 20 nt, Human
gaaagggacgcuacccggga

SEQ ID NO: 1657496 - RNA, 19 nt, Human
gaaagggacuuggaagcuc

SEQ ID NO: 1657497 - RNA, 17 nt, Human
gaaauauuuauuuuaau

SEQ ID NO: 1657498 - RNA, 15 nt, Human
gaaaauguaugugua

SEQ ID NO: 1657499 - RNA, 19 nt, Human
gaaaauggacguguuauga

SEQ ID NO: 1657500 - RNA, 23 nt, Human
gaaaauggacguguuaugacucc

SEQ ID NO: 1657501 - RNA, 18 nt, Human
gaaaagaaaaaugagccu

SEQ ID NO: 1657502 - RNA, 23 nt, Human
gaaaaugcuguauuagucacaga

SEQ ID NO: 1657503 - RNA, 21 nt, Human
gaaaauggaagacagcucuua

SEQ ID NO: 1657504 - RNA, 14 nt, Human
gaaaaacugauuuu

SEQ ID NO: 1657505 - RNA, 14 nt, Human
gaaaauuuuaaaaa

SEQ ID NO: 1657506 - RNA, 12 nt, Human
gaaaauuugaau

SEQ ID NO: 1657507 - RNA, 21 nt, Human
cuuuuuuuuuuuugagacaga

SEQ ID NO: 1657508 - RNA, 20 nt, Human
cuuuuuuuuuuuugagacag

SEQ ID NO: 1657509 - RNA, 13 nt, Human
cuuuugugcauua

SEQ ID NO: 1657510 - RNA, 12 nt, Human
cuuuugugcauu

SEQ ID NO: 1657511 - RNA, 23 nt, Human
cuuuuuuggcugcugaaggcucg

SEQ ID NO: 1657512 - RNA, 15 nt, Human
cuuuuggcauuuuac

SEQ ID NO: 1657513 - RNA, 16 nt, Human
cuuuugguuaagucug

SEQ ID NO: 1657514 - RNA, 20 nt, Human
cuuuugguuaagucuguuuu

SEQ ID NO: 1657515 - RNA, 19 nt, Human
cuuuuguagaagucacauu

SEQ ID NO: 1657516 - RNA, 18 nt, Human
cuuuugucuaugggacuc

SEQ ID NO: 1657517 - RNA, 13 nt, Human
cuuuuggagucag

SEQ ID NO: 1657518 - RNA, 18 nt, Human
cuuuuggaagguauuuaa

SEQ ID NO: 1657519 - RNA, 16 nt, Human
cuuuugccguuauuaa

SEQ ID NO: 1657520 - RNA, 23 nt, Human
cuuuugcccacacuugggagcaa

SEQ ID NO: 1657521 - RNA, 13 nt, Human
cuuuugccauuga

SEQ ID NO: 1657522 - RNA, 14 nt, Human
cuuucacaaccuuc

SEQ ID NO: 1657523 - RNA, 16 nt, Human
cuuucacaaccuucug

SEQ ID NO: 1657524 - RNA, 23 nt, Human
cuuucagccaagaauucuuaaau

SEQ ID NO: 1657525 - RNA, 20 nt, Human
cuuucagccaagaauucuua

SEQ ID NO: 1657526 - RNA, 22 nt, Human
cuuuccugaggcugggcucccu

SEQ ID NO: 1657527 - RNA, 14 nt, Human
cuuugggcugcccu

SEQ ID NO: 1657528 - RNA, 15 nt, Human
cuuugggcugcccug

SEQ ID NO: 1657529 - RNA, 19 nt, Human
cuuugggcugcccuggugc

SEQ ID NO: 1657530 - RNA, 20 nt, Human
cuuugggcugcccuggugcu

SEQ ID NO: 1657531 - RNA, 21 nt, Human
cuuugggcugcccuggugcug

SEQ ID NO: 1657532 - RNA, 15 nt, Human
cuuuguaaauuguca

SEQ ID NO: 1657533 - RNA, 13 nt, Human
cuuuguaaugaaa

SEQ ID NO: 1657534 - RNA, 15 nt, Human
cuuucuagccagagg

SEQ ID NO: 1657535 - RNA, 22 nt, Human
cuuugauauuuucaacgcagcc

SEQ ID NO: 1657536 - RNA, 16 nt, Human
cuuucuagccagagga

SEQ ID NO: 1657537 - RNA, 11 nt, Human
cuuuguauaga

SEQ ID NO: 1657538 - RNA, 20 nt, Human
cuuuguauagaaccucuuug

SEQ ID NO: 1657539 - RNA, 14 nt, Human
cuuuuauaaacuuu

SEQ ID NO: 1657540 - RNA, 13 nt, Human
cuuuuauaaacuu

SEQ ID NO: 1657541 - RNA, 14 nt, Human
cuuuuaugugaaac

SEQ ID NO: 1657542 - RNA, 18 nt, Human
cuuuuaugugaaacaugu

SEQ ID NO: 1657543 - RNA, 15 nt, Human
gacuaggguccuggg

SEQ ID NO: 1657544 - RNA, 16 nt, Human
gacuaggguccugggg

SEQ ID NO: 1657545 - RNA, 18 nt, Human
gacuaggguccuggggaa

SEQ ID NO: 1657546 - RNA, 22 nt, Human
gacuaucuaaauguugaaagau

SEQ ID NO: 1657547 - RNA, 12 nt, Human
gacucugucuca

SEQ ID NO: 1657548 - RNA, 17 nt, Human
gacucuuaagaagacug

SEQ ID NO: 1657549 - RNA, 18 nt, Human
gacucuuaagaagacugc

SEQ ID NO: 1657550 - RNA, 16 nt, Human
gacucuuaagaagacu

SEQ ID NO: 1657551 - RNA, 15 nt, Human
gagaaucacuugaac

SEQ ID NO: 1657552 - RNA, 14 nt, Human
gagaaucacuugaa

SEQ ID NO: 1657553 - RNA, 21 nt, Human
gagacccugucucaaaaaaag

SEQ ID NO: 1657554 - RNA, 11 nt, Human
gagaccugccc

SEQ ID NO: 1657555 - RNA, 12 nt, Human
gagaccugcccc

SEQ ID NO: 1657556 - RNA, 13 nt, Human
gagaccugccccu

SEQ ID NO: 1657557 - RNA, 22 nt, Human
gagaaggacccggaggggccug

SEQ ID NO: 1657558 - RNA, 23 nt, Human
gagaaggacccggaggggccugg

SEQ ID NO: 1657559 - RNA, 20 nt, Human
gagaaggacccggaggggcc

SEQ ID NO: 1657560 - RNA, 12 nt, Human
gagaaggaagcc

SEQ ID NO: 1657561 - RNA, 16 nt, Human
gagaagcggcuggcag

SEQ ID NO: 1657562 - RNA, 13 nt, Human
gagaagcggcugg

SEQ ID NO: 1657563 - RNA, 15 nt, Human
gagaagcggcuggca

SEQ ID NO: 1657564 - RNA, 11 nt, Human
gacuuuccucu

SEQ ID NO: 1657565 - RNA, 15 nt, Human
gacuggugacugauu

SEQ ID NO: 1657566 - RNA, 18 nt, Human
gacuggugacugauucuu

SEQ ID NO: 1657567 - RNA, 12 nt, Human
gacuggugacug

SEQ ID NO: 1657568 - RNA, 23 nt, Human
gacuuuucuuucagccaagaauu

SEQ ID NO: 1657569 - RNA, 21 nt, Human
gacuuuucuuuguggcuuccu

SEQ ID NO: 1657570 - RNA, 13 nt, Human
gagcaucaggcca

SEQ ID NO: 1657571 - RNA, 22 nt, Human
gagcaugccuggauggggcugc

SEQ ID NO: 1657572 - RNA, 12 nt, Human
gagcaucaggcc

SEQ ID NO: 1657573 - RNA, 21 nt, Human
gagcagggcucagcggggaca

SEQ ID NO: 1657574 - RNA, 14 nt, Human
gagcagggcucagc

SEQ ID NO: 1657575 - RNA, 18 nt, Human
gagcugggugucaagagg

SEQ ID NO: 1657576 - RNA, 22 nt, Human
gagccuugaacuuugaccucug

SEQ ID NO: 1657577 - RNA, 13 nt, Human
gagccccgaggcc

SEQ ID NO: 1657578 - RNA, 14 nt, Human
gagccuuccagggg

SEQ ID NO: 1657579 - RNA, 15 nt, Human
gagccuuccaggggu

SEQ ID NO: 1657580 - RNA, 16 nt, Human
gagccuuccaggggug

SEQ ID NO: 1657581 - RNA, 17 nt, Human
gagccuuccaggggugg

SEQ ID NO: 1657582 - RNA, 21 nt, Human
gagcugccuguucagcuccag

SEQ ID NO: 1657583 - RNA, 22 nt, Human
gagcugccuguucagcuccagc

SEQ ID NO: 1657584 - RNA, 18 nt, Human
gagcggagaaaggaaggg

SEQ ID NO: 1657585 - RNA, 21 nt, Human
gagcggagaaaggaagggcug

SEQ ID NO: 1657586 - RNA, 21 nt, Human
gagaugaugccaugggcccuc

SEQ ID NO: 1657587 - RNA, 22 nt, Human
gagaggcauccaguaucuugaa

SEQ ID NO: 1657588 - RNA, 14 nt, Human
gagaggcauccagu

SEQ ID NO: 1657589 - RNA, 17 nt, Human
gagacuccugcaggcag

SEQ ID NO: 1657590 - RNA, 18 nt, Human
gagacuccugcaggcagc

SEQ ID NO: 1657591 - RNA, 15 nt, Human
gagacuccugcaggc

SEQ ID NO: 1657592 - RNA, 16 nt, Human
gagacuccugcaggca

SEQ ID NO: 1657593 - RNA, 14 nt, Human
gagauguagccccu

SEQ ID NO: 1657594 - RNA, 21 nt, Human
gagauugcaccacugcacucc

SEQ ID NO: 1657595 - RNA, 18 nt, Human
gagauugcaccacugcac

SEQ ID NO: 1657596 - RNA, 13 nt, Human
gagauuuacaacu

SEQ ID NO: 1657597 - RNA, 13 nt, Human
gacacugaugggc

SEQ ID NO: 1657598 - RNA, 15 nt, Human
gacacugaugggcaa

SEQ ID NO: 1657599 - RNA, 16 nt, Human
gacacuuaaaaauggu

SEQ ID NO: 1657600 - RNA, 12 nt, Human
gacagacacagg

SEQ ID NO: 1657601 - RNA, 21 nt, Human
gacagcccgggcucugccucc

SEQ ID NO: 1657602 - RNA, 22 nt, Human
gacagcccgggcucugccuccc

SEQ ID NO: 1657603 - RNA, 23 nt, Human
gacagcccgggcucugccuccca

SEQ ID NO: 1657604 - RNA, 20 nt, Human
gacaggguuuugccauguug

SEQ ID NO: 1657605 - RNA, 22 nt, Human
gacaggguuuugccauguuggc

SEQ ID NO: 1657606 - RNA, 13 nt, Human
gacagcccuccau

SEQ ID NO: 1657607 - RNA, 13 nt, Human
gacagccuggcac

SEQ ID NO: 1657608 - RNA, 19 nt, Human
gacagccuggcacagggca

SEQ ID NO: 1657609 - RNA, 11 nt, Human
gacagcuccuu

SEQ ID NO: 1657610 - RNA, 14 nt, Human
gacagugaaagaaa

SEQ ID NO: 1657611 - RNA, 17 nt, Human
gacagucaccucaugga

SEQ ID NO: 1657612 - RNA, 15 nt, Human
gacaaaauggaauac

SEQ ID NO: 1657613 - RNA, 14 nt, Human
gacacacagcucug

SEQ ID NO: 1657614 - RNA, 15 nt, Human
gacacacagcucugu

SEQ ID NO: 1657615 - RNA, 17 nt, Human
gacacacagcucugucc

SEQ ID NO: 1657616 - RNA, 18 nt, Human
gacacacagcucuguccu

SEQ ID NO: 1657617 - RNA, 19 nt, Human
gacacacagcucuguccug

SEQ ID NO: 1657618 - RNA, 16 nt, Human
gaauuuuguguuagag

SEQ ID NO: 1657619 - RNA, 22 nt, Human
gaauuuuguguuagagauuuuu

SEQ ID NO: 1657620 - RNA, 13 nt, Human
gaauuuuguguua

SEQ ID NO: 1657621 - RNA, 21 nt, Human
gaauuuugugcccccauguaa

SEQ ID NO: 1657622 - RNA, 23 nt, Human
gaauuuuggcugugucucccuuc

SEQ ID NO: 1657623 - RNA, 20 nt, Human
gaauuuugugcccccaugua

SEQ ID NO: 1657624 - RNA, 21 nt, Human
gaauuuuauuuuuugggaaaa

SEQ ID NO: 1657625 - RNA, 19 nt, Human
gaauuuuggcugugucucc

SEQ ID NO: 1657626 - RNA, 12 nt, Human
gaauuaugaaac

SEQ ID NO: 1657627 - RNA, 11 nt, Human
gaauuaguuuu

SEQ ID NO: 1657628 - RNA, 13 nt, Human
gacacacugaaga

SEQ ID NO: 1657629 - RNA, 21 nt, Human
gacacacagcucuguccuggg

SEQ ID NO: 1657630 - RNA, 12 nt, Human
gacacacaugaa

SEQ ID NO: 1657631 - RNA, 14 nt, Human
gacacacugaagaa

SEQ ID NO: 1657632 - RNA, 11 nt, Human
gaaugaauguc

SEQ ID NO: 1657633 - RNA, 14 nt, Human
gaaugaaugucagu

SEQ ID NO: 1657634 - RNA, 18 nt, Human
gaaugaaugucaguguga

SEQ ID NO: 1657635 - RNA, 22 nt, Human
gaaugaaugucagugugacuga

SEQ ID NO: 1657636 - RNA, 22 nt, Human
gaaugagagacacacugaagaa

SEQ ID NO: 1657637 - RNA, 23 nt, Human
gaaugagagacacacugaagaag

SEQ ID NO: 1657638 - RNA, 20 nt, Human
gaaugagagacacacugaag

SEQ ID NO: 1657639 - RNA, 15 nt, Human
gaaguggggacagag

SEQ ID NO: 1657640 - RNA, 12 nt, Human
gaaguggaaugg

SEQ ID NO: 1657641 - RNA, 19 nt, Human
gaagucuuuguacagacaa

SEQ ID NO: 1657642 - RNA, 20 nt, Human
gaagucuuuguacagacaac

SEQ ID NO: 1657643 - RNA, 18 nt, Human
gaagucuuuguacagaca

SEQ ID NO: 1657644 - RNA, 14 nt, Human
gaagugaaacugcu

SEQ ID NO: 1657645 - RNA, 19 nt, Human
gaaggcucgagcaugccug

SEQ ID NO: 1657646 - RNA, 16 nt, Human
gaaggcucgagcaugc

SEQ ID NO: 1657647 - RNA, 17 nt, Human
gaaggcucgagcaugcc

SEQ ID NO: 1657648 - RNA, 13 nt, Human
gaaauccagggug

SEQ ID NO: 1657649 - RNA, 18 nt, Human
gaaauccagggugguggu

SEQ ID NO: 1657650 - RNA, 23 nt, Human
gaagcucagggccuggcucaggu

SEQ ID NO: 1657651 - RNA, 20 nt, Human
gaagcucagggccuggcuca

SEQ ID NO: 1657652 - RNA, 21 nt, Human
gaagcucagggccuggcucag

SEQ ID NO: 1657653 - RNA, 16 nt, Human
gaagcucagggccugg

SEQ ID NO: 1657654 - RNA, 17 nt, Human
gaagcucagggccuggc

SEQ ID NO: 1657655 - RNA, 18 nt, Human
gaagcucagggccuggcu

SEQ ID NO: 1657656 - RNA, 19 nt, Human
gaagcucagggccuggcuc

SEQ ID NO: 1657657 - RNA, 14 nt, Human
gaagcucagggccu

SEQ ID NO: 1657658 - RNA, 15 nt, Human
gaagcucagggccug

SEQ ID NO: 1657659 - RNA, 19 nt, Human
gcagagcagagaccauccc

SEQ ID NO: 1657660 - RNA, 20 nt, Human
gcagagcagagaccaucccu

SEQ ID NO: 1657661 - RNA, 24 nt, Human
gcagagcaccuuagacagucccug

SEQ ID NO: 1657662 - RNA, 12 nt, Human
gcagagcagaga

SEQ ID NO: 1657663 - RNA, 14 nt, Human
gcagagcagagacc

SEQ ID NO: 1657664 - RNA, 15 nt, Human
gcagagcagagacca

SEQ ID NO: 1657665 - RNA, 19 nt, Human
gcagagcaccuuagacagu

SEQ ID NO: 1657666 - RNA, 22 nt, Human
gcagagcaccuuagacaguccc

SEQ ID NO: 1657667 - RNA, 23 nt, Human
gcagagcaccuuagacagucccu

SEQ ID NO: 1657668 - RNA, 12 nt, Human
gcacugacauug

SEQ ID NO: 1657669 - RNA, 21 nt, Human
gcaccggcuggccuggccccu

SEQ ID NO: 1657670 - RNA, 23 nt, Human
gcaccggcuggccuggccccuca

SEQ ID NO: 1657671 - RNA, 19 nt, Human
gcaccggcuggccuggccc

SEQ ID NO: 1657672 - RNA, 14 nt, Human
gcacaugccucucu

SEQ ID NO: 1657673 - RNA, 17 nt, Human
gcacaugccucucucag

SEQ ID NO: 1657674 - RNA, 18 nt, Human
gcacaugccucucucagg

SEQ ID NO: 1657675 - RNA, 19 nt, Human
gcacaugccucucucaggc

SEQ ID NO: 1657676 - RNA, 20 nt, Human
gcacaugccucucucaggcc

SEQ ID NO: 1657677 - RNA, 21 nt, Human
gcacaugccucucucaggcca

SEQ ID NO: 1657678 - RNA, 22 nt, Human
gcacaugccucucucaggccaa

SEQ ID NO: 1657679 - RNA, 21 nt, Human
gcacaucagcacgauuucugu

SEQ ID NO: 1657680 - RNA, 20 nt, Human
gcacaucagcacgauuucug

SEQ ID NO: 1657681 - RNA, 19 nt, Human
gcacaucagcacgauuucu

SEQ ID NO: 1657682 - RNA, 13 nt, Human
gcacaugccucuc

SEQ ID NO: 1657683 - RNA, 22 nt, Human
gcacaaucucggcucacugcau

SEQ ID NO: 1657684 - RNA, 21 nt, Human
gcacaaucucggcucacugca

SEQ ID NO: 1657685 - RNA, 18 nt, Human
gcacaguuuucugagaaa

SEQ ID NO: 1657686 - RNA, 14 nt, Human
gcacaguuuucuga

SEQ ID NO: 1657687 - RNA, 17 nt, Human
gcacaguuuucugagaa

SEQ ID NO: 1657688 - RNA, 15 nt, Human
gcaagugagagcugg

SEQ ID NO: 1657689 - RNA, 23 nt, Human
gcaauaaggggagaguaacccug

SEQ ID NO: 1657690 - RNA, 22 nt, Human
gcacaagcuccaagcucccagg

SEQ ID NO: 1657691 - RNA, 23 nt, Human
gcacaagcuccaagcucccaggc

SEQ ID NO: 1657692 - RNA, 14 nt, Human
gcacaagcugcacc

SEQ ID NO: 1657693 - RNA, 13 nt, Human
gcaagugagagcu

SEQ ID NO: 1657694 - RNA, 10 nt, Human
gcagggaggg

SEQ ID NO: 1657695 - RNA, 13 nt, Human
gcagggagggccu

SEQ ID NO: 1657696 - RNA, 13 nt, Human
gcagggaaacagc

SEQ ID NO: 1657697 - RNA, 19 nt, Human
gcagggacuugaacccaua

SEQ ID NO: 1657698 - RNA, 19 nt, Human
gcaggcuggcccugcccug

SEQ ID NO: 1657699 - RNA, 20 nt, Human
gcaggcuggcccugcccugg

SEQ ID NO: 1657700 - RNA, 21 nt, Human
gcaggcuggcccugcccuggu

SEQ ID NO: 1657701 - RNA, 15 nt, Human
gcaggcuggcccugc

SEQ ID NO: 1657702 - RNA, 16 nt, Human
gcaggcuggcccugcc

SEQ ID NO: 1657703 - RNA, 17 nt, Human
gcaggcuggcccugccc

SEQ ID NO: 1657704 - RNA, 18 nt, Human
gcaggcuggcccugcccu

SEQ ID NO: 1657705 - RNA, 14 nt, Human
gcaggcuggcccug

SEQ ID NO: 1657706 - RNA, 23 nt, Human
gcaggcucucaggccagcugcuu

SEQ ID NO: 1657707 - RNA, 17 nt, Human
gcagcugcgguccaccc

SEQ ID NO: 1657708 - RNA, 19 nt, Human
gcagcugcgguccacccag

SEQ ID NO: 1657709 - RNA, 20 nt, Human
gcaggcucucaggccagcug

SEQ ID NO: 1657710 - RNA, 22 nt, Human
gcaggcucucaggccagcugcu

SEQ ID NO: 1657711 - RNA, 22 nt, Human
gcagcugccuccccuccucugc

SEQ ID NO: 1657712 - RNA, 18 nt, Human
gcagcugccuccccuccu

SEQ ID NO: 1657713 - RNA, 17 nt, Human
gcagcugccuccccucc

SEQ ID NO: 1657714 - RNA, 16 nt, Human
gcagcugccuccccuc

SEQ ID NO: 1657715 - RNA, 15 nt, Human
gcagcugccuccccu

SEQ ID NO: 1657716 - RNA, 13 nt, Human
gcagcugccuccc

SEQ ID NO: 1657717 - RNA, 12 nt, Human
gcagcugccucc

SEQ ID NO: 1657718 - RNA, 11 nt, Human
gcagcugccuc

SEQ ID NO: 1657719 - RNA, 21 nt, Human
gcauaacauaaaucugugaac

SEQ ID NO: 1657720 - RNA, 23 nt, Human
gcauaacauaaaucugugaacuu

SEQ ID NO: 1657721 - RNA, 22 nt, Human
gcauaacguauaaaagccuguu

SEQ ID NO: 1657722 - RNA, 20 nt, Human
gcauaccacuuuuguucuug

SEQ ID NO: 1657723 - RNA, 17 nt, Human
gcauaccacuuuuguuc

SEQ ID NO: 1657724 - RNA, 14 nt, Human
gcauacguacacau

SEQ ID NO: 1657725 - RNA, 16 nt, Human
gcagccacauuccuga

SEQ ID NO: 1657726 - RNA, 14 nt, Human
gcagccacuauugu

SEQ ID NO: 1657727 - RNA, 12 nt, Human
gcagccaggcca

SEQ ID NO: 1657728 - RNA, 16 nt, Human
gcagccaggccacaag

SEQ ID NO: 1657729 - RNA, 13 nt, Human
gcagccaggccac

SEQ ID NO: 1657730 - RNA, 14 nt, Human
gcagccaggccaca

SEQ ID NO: 1657731 - RNA, 11 nt, Human
gauacuacagu

SEQ ID NO: 1657732 - RNA, 16 nt, Human
gauacuacaguuuguu

SEQ ID NO: 1657733 - RNA, 13 nt, Human
gauacccauccca

SEQ ID NO: 1657734 - RNA, 14 nt, Human
gauacccaucccau

SEQ ID NO: 1657735 - RNA, 16 nt, Human
gauacuugaaaauuaa

SEQ ID NO: 1657736 - RNA, 17 nt, Human
gauacuugaaaauuaac

SEQ ID NO: 1657737 - RNA, 13 nt, Human
gauaugugaacag

SEQ ID NO: 1657738 - RNA, 14 nt, Human
gauaugugaacagu

SEQ ID NO: 1657739 - RNA, 20 nt, Human
gauauguaccuaacgaagua

SEQ ID NO: 1657740 - RNA, 16 nt, Human
gagucccaccuuggcu

SEQ ID NO: 1657741 - RNA, 20 nt, Human
gagucccaccuuggcugcag

SEQ ID NO: 1657742 - RNA, 15 nt, Human
gagucaccaagccca

SEQ ID NO: 1657743 - RNA, 13 nt, Human
gagucaccaagcc

SEQ ID NO: 1657744 - RNA, 14 nt, Human
gagucaccaagccc

SEQ ID NO: 1657745 - RNA, 11 nt, Human
gagugcaguga

SEQ ID NO: 1657746 - RNA, 12 nt, Human
gagugcagugag

SEQ ID NO: 1657747 - RNA, 21 nt, Human
gagucccaccuuggcugcagg

SEQ ID NO: 1657748 - RNA, 12 nt, Human
gagugagcuggu

SEQ ID NO: 1657749 - RNA, 12 nt, Human
gaggugggaucc

SEQ ID NO: 1657750 - RNA, 11 nt, Human
gaggugggagg

SEQ ID NO: 1657751 - RNA, 14 nt, Human
gaggucuguucuuu

SEQ ID NO: 1657752 - RNA, 13 nt, Human
gaggucuguucuu

SEQ ID NO: 1657753 - RNA, 20 nt, Human
gaguuugggguaugggagag

SEQ ID NO: 1657754 - RNA, 13 nt, Human
gagugcagugagc

SEQ ID NO: 1657755 - RNA, 20 nt, Human
gaguuguuacauuuuuaagu

SEQ ID NO: 1657756 - RNA, 16 nt, Human
gaguuguuacauuuuu

SEQ ID NO: 1657757 - RNA, 16 nt, Human
gaguuuagcuggaaaa

SEQ ID NO: 1657758 - RNA, 20 nt, Human
gauuacaggugugaaccacc

SEQ ID NO: 1657759 - RNA, 20 nt, Human
gauuacaggugugagccacc

SEQ ID NO: 1657760 - RNA, 14 nt, Human
gaugugaacacauc

SEQ ID NO: 1657761 - RNA, 16 nt, Human
gaugugaacacaucag

SEQ ID NO: 1657762 - RNA, 14 nt, Human
gauuagaauucugu

SEQ ID NO: 1657763 - RNA, 15 nt, Human
gauuagaauucugua

SEQ ID NO: 1657764 - RNA, 23 nt, Human
gauuagaauucuguauagauuag

SEQ ID NO: 1657765 - RNA, 18 nt, Human
gauuacugccuauuuuaa

SEQ ID NO: 1657766 - RNA, 14 nt, Human
gauuaccagggacu

SEQ ID NO: 1657767 - RNA, 13 nt, Human
gauuauucacuga

SEQ ID NO: 1657768 - RNA, 15 nt, Human
gauuauucacugauu

SEQ ID NO: 1657769 - RNA, 16 nt, Human
gauuauucacugauuu

SEQ ID NO: 1657770 - RNA, 21 nt, Human
gauuauucacugauuugacau

SEQ ID NO: 1657771 - RNA, 14 nt, Human
gauuagagaguguu

SEQ ID NO: 1657772 - RNA, 18 nt, Human
gauuagagaguguugaaa

SEQ ID NO: 1657773 - RNA, 17 nt, Human
gauuagggagagaagau

SEQ ID NO: 1657774 - RNA, 17 nt, Human
gauauuuuuuucuuuuc

SEQ ID NO: 1657775 - RNA, 15 nt, Human
gauauuuuuuucuuu

SEQ ID NO: 1657776 - RNA, 16 nt, Human
gauauuuugcuuugug

SEQ ID NO: 1657777 - RNA, 11 nt, Human
gauccaguuuu

SEQ ID NO: 1657778 - RNA, 17 nt, Human
gauccaguuuuguuugg

SEQ ID NO: 1657779 - RNA, 22 nt, Human
gauccaguuuuguuuggaccaa

SEQ ID NO: 1657780 - RNA, 15 nt, Human
gaucucuaacuucac

SEQ ID NO: 1657781 - RNA, 18 nt, Human
gaucucuugagccuggga

SEQ ID NO: 1657782 - RNA, 17 nt, Human
gaucucuugagccuggg

SEQ ID NO: 1657783 - RNA, 12 nt, Human
gaucucuugagc

SEQ ID NO: 1657784 - RNA, 16 nt, Human
gaucucuugagccugg

SEQ ID NO: 1657785 - RNA, 21 nt, Human
gaugaugaaaugaggucagag

SEQ ID NO: 1657786 - RNA, 20 nt, Human
gaugaucuuugcagacaggc

SEQ ID NO: 1657787 - RNA, 21 nt, Human
gaugaucuuugcagacaggca

SEQ ID NO: 1657788 - RNA, 14 nt, Human
gguagcuuuucccu

SEQ ID NO: 1657789 - RNA, 16 nt, Human
gguccacaacacacag

SEQ ID NO: 1657790 - RNA, 22 nt, Human
gguaugaucacggcucacugca

SEQ ID NO: 1657791 - RNA, 14 nt, Human
gguaugcaaucaaa

SEQ ID NO: 1657792 - RNA, 19 nt, Human
gguccacccaggagccccg

SEQ ID NO: 1657793 - RNA, 17 nt, Human
gguccacccaggagccc

SEQ ID NO: 1657794 - RNA, 12 nt, Human
gguccacccagg

SEQ ID NO: 1657795 - RNA, 13 nt, Human
gguccacccagga

SEQ ID NO: 1657796 - RNA, 15 nt, Human
gguccacccaggagc

SEQ ID NO: 1657797 - RNA, 16 nt, Human
gguccacccaggagcc

SEQ ID NO: 1657798 - RNA, 18 nt, Human
aaagaaguggggacagag

SEQ ID NO: 1657799 - RNA, 12 nt, Human
aaacuuuacuau

SEQ ID NO: 1657800 - RNA, 18 nt, Human
aaacuuuacuauggcccu

SEQ ID NO: 1657801 - RNA, 22 nt, Human
aaacuuuaccuuuuuuauacau

SEQ ID NO: 1657802 - RNA, 17 nt, Human
aaacuuuaccuuuuuua

SEQ ID NO: 1657803 - RNA, 15 nt, Human
gguccauagagagca

SEQ ID NO: 1657804 - RNA, 13 nt, Human
aaagacaccuacu

SEQ ID NO: 1657805 - RNA, 19 nt, Human
aaagacaccuacugagugg

SEQ ID NO: 1657806 - RNA, 17 nt, Human
aaagacuaucuaaaugu

SEQ ID NO: 1657807 - RNA, 14 nt, Human
aaagacuauucaaa

SEQ ID NO: 1657808 - RNA, 18 nt, Human
ggguggggggggugcugg

SEQ ID NO: 1657809 - RNA, 12 nt, Human
ggguggugaccu

SEQ ID NO: 1657810 - RNA, 17 nt, Human
ggguguggcgcagcaua

SEQ ID NO: 1657811 - RNA, 19 nt, Human
ggguggcaccagcagccug

SEQ ID NO: 1657812 - RNA, 20 nt, Human
ggguggggaccucaggccug

SEQ ID NO: 1657813 - RNA, 11 nt, Human
ggggccuggca

SEQ ID NO: 1657814 - RNA, 12 nt, Human
ggggccuggcag

SEQ ID NO: 1657815 - RNA, 13 nt, Human
ggguggaugccug

SEQ ID NO: 1657816 - RNA, 17 nt, Human
ggguggaugccuggugg

SEQ ID NO: 1657817 - RNA, 15 nt, Human
ggguggcaccagcag

SEQ ID NO: 1657818 - RNA, 14 nt, Human
gguaaucgaccugc

SEQ ID NO: 1657819 - RNA, 17 nt, Human
gguaaucgaccugccuc

SEQ ID NO: 1657820 - RNA, 18 nt, Human
gguaaucgaccugccucg

SEQ ID NO: 1657821 - RNA, 24 nt, Human
gguacaaccuguucugcuuuccuc

SEQ ID NO: 1657822 - RNA, 23 nt, Human
gguacaaccuguucugcuuuccu

SEQ ID NO: 1657823 - RNA, 18 nt, Human
gguaacuagggaagauaa

SEQ ID NO: 1657824 - RNA, 14 nt, Human
gguaacaggcagau

SEQ ID NO: 1657825 - RNA, 20 nt, Human
gguaacaggcagauacagga

SEQ ID NO: 1657826 - RNA, 17 nt, Human
ggguuucuaaagcugcc

SEQ ID NO: 1657827 - RNA, 20 nt, Human
ggguuuuauuguuuaaaauc

SEQ ID NO: 1657828 - RNA, 18 nt, Human
ggugcaaugaccuuucaa

SEQ ID NO: 1657829 - RNA, 19 nt, Human
ggugcaaugaccuuucaau

SEQ ID NO: 1657830 - RNA, 20 nt, Human
ggugcaaugaccuuucaaua

SEQ ID NO: 1657831 - RNA, 20 nt, Human
ggugcugggccccugccucu

SEQ ID NO: 1657832 - RNA, 15 nt, Human
ggugccaguuauggc

SEQ ID NO: 1657833 - RNA, 14 nt, Human
gguggaugccuggu

SEQ ID NO: 1657834 - RNA, 21 nt, Human
gguggaugccugguggcagcu

SEQ ID NO: 1657835 - RNA, 22 nt, Human
aaagcagcguuucuaugacaca

SEQ ID NO: 1657836 - RNA, 18 nt, Human
aaagcagcguuucuauga

SEQ ID NO: 1657837 - RNA, 16 nt, Human
aaagcagcguuucuau

SEQ ID NO: 1657838 - RNA, 17 nt, Human
aaagcaggcagaacuca

SEQ ID NO: 1657839 - RNA, 19 nt, Human
aaagcaggcagaacucauc

SEQ ID NO: 1657840 - RNA, 17 nt, Human
aaagcagggacuugaac

SEQ ID NO: 1657841 - RNA, 14 nt, Human
ggucggaaaacaug

SEQ ID NO: 1657842 - RNA, 17 nt, Human
ggucuacacugugcuga

SEQ ID NO: 1657843 - RNA, 13 nt, Human
ggucggaaaacau

SEQ ID NO: 1657844 - RNA, 13 nt, Human
aaagcaaaugucu

SEQ ID NO: 1657845 - RNA, 21 nt, Human
gguccugcugcaguugccagu

SEQ ID NO: 1657846 - RNA, 23 nt, Human
gguccugcugcaguugccaguca

SEQ ID NO: 1657847 - RNA, 15 nt, Human
aaagacuauucaaac

SEQ ID NO: 1657848 - RNA, 13 nt, Human
aaagcaaaggaga

SEQ ID NO: 1657849 - RNA, 12 nt, Human
gguguggaagag

SEQ ID NO: 1657850 - RNA, 21 nt, Human
ggugugcggccuuuggcuuca

SEQ ID NO: 1657851 - RNA, 13 nt, Human
ggugugcucugau

SEQ ID NO: 1657852 - RNA, 22 nt, Human
gguucaggguuggccccugccc

SEQ ID NO: 1657853 - RNA, 18 nt, Human
gguucaggguuggccccu

SEQ ID NO: 1657854 - RNA, 21 nt, Human
gguucaggguuggccccugcc

SEQ ID NO: 1657855 - RNA, 23 nt, Human
gguuccagcaauucuccugccuc

SEQ ID NO: 1657856 - RNA, 15 nt, Human
gguuccccuguucac

SEQ ID NO: 1657857 - RNA, 24 nt, Human
gguuccagcaauucuccugccuca

SEQ ID NO: 1657858 - RNA, 16 nt, Human
gguuccuccccuccuc

SEQ ID NO: 1657859 - RNA, 22 nt, Human
gguucccuuugacgccauccca

SEQ ID NO: 1657860 - RNA, 21 nt, Human
gguucccuuugacgccauccc

SEQ ID NO: 1657861 - RNA, 13 nt, Human
gguuucagaaaug

SEQ ID NO: 1657862 - RNA, 12 nt, Human
gguuucagaaau

SEQ ID NO: 1657863 - RNA, 15 nt, Human
gguuucagaaaugug

SEQ ID NO: 1657864 - RNA, 14 nt, Human
gguuucagaaaugu

SEQ ID NO: 1657865 - RNA, 19 nt, Human
gguuccuuccucugagccu

SEQ ID NO: 1657866 - RNA, 20 nt, Human
gguuccuuccucugagccuu

SEQ ID NO: 1657867 - RNA, 16 nt, Human
gguuuagaaagcuugc

SEQ ID NO: 1657868 - RNA, 18 nt, Human
gguucuggugugaacuaa

SEQ ID NO: 1657869 - RNA, 16 nt, Human
aaagccuguuuaagag

SEQ ID NO: 1657870 - RNA, 18 nt, Human
aaagccuguuuaagagac

SEQ ID NO: 1657871 - RNA, 20 nt, Human
ggugggaggauugcuugagc

SEQ ID NO: 1657872 - RNA, 14 nt, Human
ggugggauccucca

SEQ ID NO: 1657873 - RNA, 15 nt, Human
ggugggauccuccag

SEQ ID NO: 1657874 - RNA, 19 nt, Human
ggugggauccuccaggugc

SEQ ID NO: 1657875 - RNA, 13 nt, Human
gguggggcagcuu

SEQ ID NO: 1657876 - RNA, 17 nt, Human
gguggggcagcuugagg

SEQ ID NO: 1657877 - RNA, 17 nt, Human
gguggggggggugcugg

SEQ ID NO: 1657878 - RNA, 15 nt, Human
gguggggucacucug

SEQ ID NO: 1657879 - RNA, 23 nt, Human
gguggggucacucuggcagcuca

SEQ ID NO: 1657880 - RNA, 13 nt, Human
ggugucgggcaug

SEQ ID NO: 1657881 - RNA, 16 nt, Human
ggugucgggcaugaca

SEQ ID NO: 1657882 - RNA, 18 nt, Human
ggugugagucaccaagcc

SEQ ID NO: 1657883 - RNA, 16 nt, Human
ggugugacugaauuuc

SEQ ID NO: 1657884 - RNA, 16 nt, Human
ggugugaccacugcag

SEQ ID NO: 1657885 - RNA, 20 nt, Human
aaaguuuaauauuaaagcca

SEQ ID NO: 1657886 - RNA, 21 nt, Human
aaaguuuaauauuaaagccau

SEQ ID NO: 1657887 - RNA, 22 nt, Human
aaaguuuaauauuaaagccaug

SEQ ID NO: 1657888 - RNA, 16 nt, Human
aaaguuuaauauuaaa

SEQ ID NO: 1657889 - RNA, 19 nt, Human
aaaguuuaauauuaaagcc

SEQ ID NO: 1657890 - RNA, 13 nt, Human
aaaguugaauuua

SEQ ID NO: 1657891 - RNA, 23 nt, Human
aaaguucccuacuuccugugacu

SEQ ID NO: 1657892 - RNA, 16 nt, Human
aaaguugaauuuauug

SEQ ID NO: 1657893 - RNA, 22 nt, Human
aaaguugaauuuauuggcuuuu

SEQ ID NO: 1657894 - RNA, 16 nt, Human
aaaguugaauuuuaca

SEQ ID NO: 1657895 - RNA, 16 nt, Human
aaaguuuguugaaaca

SEQ ID NO: 1657896 - RNA, 21 nt, Human
aaaguuucucuuuucaaaaca

SEQ ID NO: 1657897 - RNA, 23 nt, Human
aaaguuucucuuuucaaaacauu

SEQ ID NO: 1657898 - RNA, 20 nt, Human
gguuuggacaaaauggaaua

SEQ ID NO: 1657899 - RNA, 21 nt, Human
aaaguucccuacuuccuguga

SEQ ID NO: 1657900 - RNA, 12 nt, Human
aaauaaugugaa

SEQ ID NO: 1657901 - RNA, 13 nt, Human
aaauaaugugaaa

SEQ ID NO: 1657902 - RNA, 15 nt, Human
aaauaauuuuuauau

SEQ ID NO: 1657903 - RNA, 18 nt, Human
aaauaauuuuuauauuug

SEQ ID NO: 1657904 - RNA, 20 nt, Human
aaauaauuuuuauauuugaa

SEQ ID NO: 1657905 - RNA, 14 nt, Human
aaauaaugugaaac

SEQ ID NO: 1657906 - RNA, 23 nt, Human
gggcuacaccuuagccugcccuc

SEQ ID NO: 1657907 - RNA, 15 nt, Human
gggcgggaggauguu

SEQ ID NO: 1657908 - RNA, 22 nt, Human
gggccucggacuuagcugggag

SEQ ID NO: 1657909 - RNA, 15 nt, Human
gggccuccugugugu

SEQ ID NO: 1657910 - RNA, 13 nt, Human
gggccuccugugu

SEQ ID NO: 1657911 - RNA, 20 nt, Human
gggccucuuaugggcugggu

SEQ ID NO: 1657912 - RNA, 14 nt, Human
gggccaguuggucc

SEQ ID NO: 1657913 - RNA, 18 nt, Human
gggccaguuggucccccu

SEQ ID NO: 1657914 - RNA, 22 nt, Human
gggccaguuggucccccuucca

SEQ ID NO: 1657915 - RNA, 23 nt, Human
gggccaguuggucccccuuccau

SEQ ID NO: 1657916 - RNA, 18 nt, Human
gggccagugcuccagcca

SEQ ID NO: 1657917 - RNA, 14 nt, Human
gggccagugcucca

SEQ ID NO: 1657918 - RNA, 14 nt, Human
gggccaggcugggu

SEQ ID NO: 1657919 - RNA, 15 nt, Human
gggccaggcuggguc

SEQ ID NO: 1657920 - RNA, 21 nt, Human
gggccaggcugggucgcccug

SEQ ID NO: 1657921 - RNA, 12 nt, Human
gggccaggagcc

SEQ ID NO: 1657922 - RNA, 21 nt, Human
aaaaugcuguauuagucacag

SEQ ID NO: 1657923 - RNA, 13 nt, Human
gggccaggcuggg

SEQ ID NO: 1657924 - RNA, 11 nt, Human
gggccaggagc

SEQ ID NO: 1657925 - RNA, 14 nt, Human
aaaaugagccuggc

SEQ ID NO: 1657926 - RNA, 21 nt, Human
aaaaugagccuggcaagaaug

SEQ ID NO: 1657927 - RNA, 19 nt, Human
aaaaguauguuagugcaaa

SEQ ID NO: 1657928 - RNA, 22 nt, Human
aaacauccuacaagacacagug

SEQ ID NO: 1657929 - RNA, 18 nt, Human
aaacauccuacaagacac

SEQ ID NO: 1657930 - RNA, 12 nt, Human
ggggacagcucc

SEQ ID NO: 1657931 - RNA, 14 nt, Human
ggggacagcuccuu

SEQ ID NO: 1657932 - RNA, 20 nt, Human
ggggacagcuccuucugucc

SEQ ID NO: 1657933 - RNA, 20 nt, Human
aaacaagaccacguuucuaa

SEQ ID NO: 1657934 - RNA, 16 nt, Human
aaacacauuuuucuua

SEQ ID NO: 1657935 - RNA, 20 nt, Human
aaacaagcacuaaacaaaga

SEQ ID NO: 1657936 - RNA, 20 nt, Human
aaacagucucaggaaaucaa

SEQ ID NO: 1657937 - RNA, 13 nt, Human
gggcugcccuggu

SEQ ID NO: 1657938 - RNA, 14 nt, Human
gggcugcccuggug

SEQ ID NO: 1657939 - RNA, 15 nt, Human
gggcugcccuggugc

SEQ ID NO: 1657940 - RNA, 21 nt, Human
gggcugcccuggugcugccac

SEQ ID NO: 1657941 - RNA, 16 nt, Human
gggcugggagcucugc

SEQ ID NO: 1657942 - RNA, 18 nt, Human
gggcugggagcucugcag

SEQ ID NO: 1657943 - RNA, 12 nt, Human
gggcugggcaga

SEQ ID NO: 1657944 - RNA, 20 nt, Human
gggcuggguucuacccaggu

SEQ ID NO: 1657945 - RNA, 10 nt, Human
gggcucagca

SEQ ID NO: 1657946 - RNA, 22 nt, Human
gggcugcaccggcuggccuggc

SEQ ID NO: 1657947 - RNA, 18 nt, Human
gggcucagcaaaagaugc

SEQ ID NO: 1657948 - RNA, 21 nt, Human
gggcugcaugcgggcuuccuc

SEQ ID NO: 1657949 - RNA, 18 nt, Human
gggcugcaugcgggcuuc

SEQ ID NO: 1657950 - RNA, 12 nt, Human
aaaaugugugug

SEQ ID NO: 1657951 - RNA, 22 nt, Human
aaaauuuuuucucuaggaaaua

SEQ ID NO: 1657952 - RNA, 22 nt, Human
gggcuggguucuacccaggugc

SEQ ID NO: 1657953 - RNA, 15 nt, Human
aaaaugugauaugua

SEQ ID NO: 1657954 - RNA, 22 nt, Human
gggaggcucuggagcccacugu

SEQ ID NO: 1657955 - RNA, 14 nt, Human
gggagggcuccaga

SEQ ID NO: 1657956 - RNA, 15 nt, Human
gggagggcuccagac

SEQ ID NO: 1657957 - RNA, 17 nt, Human
gggagggcuccagacac

SEQ ID NO: 1657958 - RNA, 18 nt, Human
gggagggcuccagacaca

SEQ ID NO: 1657959 - RNA, 17 nt, Human
gggaggucgaggcagga

SEQ ID NO: 1657960 - RNA, 18 nt, Human
gggaggucgaggcaggag

SEQ ID NO: 1657961 - RNA, 19 nt, Human
gggaggucgaggcaggagg

SEQ ID NO: 1657962 - RNA, 19 nt, Human
aaaagguaugcaaucaaau

SEQ ID NO: 1657963 - RNA, 12 nt, Human
gggcagcugccu

SEQ ID NO: 1657964 - RNA, 23 nt, Human
gggcagagcagagaccaucccug

SEQ ID NO: 1657965 - RNA, 17 nt, Human
gggcagagcagagacca

SEQ ID NO: 1657966 - RNA, 22 nt, Human
gggcagagcagagaccaucccu

SEQ ID NO: 1657967 - RNA, 16 nt, Human
gggcaacccccagccu

SEQ ID NO: 1657968 - RNA, 18 nt, Human
gggcaacccccagccugc

SEQ ID NO: 1657969 - RNA, 20 nt, Human
gggcaacccccagccugcua

SEQ ID NO: 1657970 - RNA, 16 nt, Human
gggcagagcagagacc

SEQ ID NO: 1657971 - RNA, 14 nt, Human
gggauuacaggcgu

SEQ ID NO: 1657972 - RNA, 13 nt, Human
gggauuacaggcu

SEQ ID NO: 1657973 - RNA, 16 nt, Human
gggauuacaggcuccu

SEQ ID NO: 1657974 - RNA, 21 nt, Human
gggauuacaggcuccugccac

SEQ ID NO: 1657975 - RNA, 12 nt, Human
gggauuacaggu

SEQ ID NO: 1657976 - RNA, 15 nt, Human
gggauuacaggugug

SEQ ID NO: 1657977 - RNA, 16 nt, Human
gggauuguaaaauggu

SEQ ID NO: 1657978 - RNA, 17 nt, Human
gggauuguaaaauggug

SEQ ID NO: 1657979 - RNA, 15 nt, Human
aaaacccagauaaag

SEQ ID NO: 1657980 - RNA, 14 nt, Human
aaaaccacagcagu

SEQ ID NO: 1657981 - RNA, 13 nt, Human
aaaaccacagcag

SEQ ID NO: 1657982 - RNA, 22 nt, Human
aaaacugcugacuguuuucucu

SEQ ID NO: 1657983 - RNA, 13 nt, Human
aaaacucauuuuu

SEQ ID NO: 1657984 - RNA, 23 nt, Human
aaaacugcugacuguuuucucuu

SEQ ID NO: 1657985 - RNA, 13 nt, Human
aaaagaugcuucu

SEQ ID NO: 1657986 - RNA, 17 nt, Human
aaaagaugaaaauauuu

SEQ ID NO: 1657987 - RNA, 15 nt, Human
aaaacaugcuacaca

SEQ ID NO: 1657988 - RNA, 12 nt, Human
aaaaccacagca

SEQ ID NO: 1657989 - RNA, 21 nt, Human
aaaaccaauguucucucuucu

SEQ ID NO: 1657990 - RNA, 17 nt, Human
aaaaaucucaaauuucu

SEQ ID NO: 1657991 - RNA, 14 nt, Human
aaaaaucucaaauu

SEQ ID NO: 1657992 - RNA, 22 nt, Human
aaaaauggaacauaaaauacaa

SEQ ID NO: 1657993 - RNA, 21 nt, Human
gggacagcuccuucuguccua

SEQ ID NO: 1657994 - RNA, 20 nt, Human
gggacauuugcucauggaau

SEQ ID NO: 1657995 - RNA, 21 nt, Human
gggacauuugcucauggaauu

SEQ ID NO: 1657996 - RNA, 14 nt, Human
aaaaauauuuuaug

SEQ ID NO: 1657997 - RNA, 21 nt, Human
aaaaauaugaccacacuccag

SEQ ID NO: 1657998 - RNA, 23 nt, Human
aaaaauaugaccacacuccagcu

SEQ ID NO: 1657999 - RNA, 16 nt, Human
gggaaggauacaaaag

SEQ ID NO: 1658000 - RNA, 13 nt, Human
gggaaggauacaa

SEQ ID NO: 1658001 - RNA, 13 nt, Human
gggacagaggggg

SEQ ID NO: 1658002 - RNA, 22 nt, Human
gggacagaggggguggccuccc

SEQ ID NO: 1658003 - RNA, 23 nt, Human
gggacagaggggguggccuccca

SEQ ID NO: 1658004 - RNA, 15 nt, Human
ggccuucucugaagg

SEQ ID NO: 1658005 - RNA, 16 nt, Human
ggccuucucugaagga

SEQ ID NO: 1658006 - RNA, 13 nt, Human
ggccuuuggcuuc

SEQ ID NO: 1658007 - RNA, 14 nt, Human
ggccuuuggcuuca

SEQ ID NO: 1658008 - RNA, 21 nt, Human
ggccuggccagaugcaccagc

SEQ ID NO: 1658009 - RNA, 20 nt, Human
ggccuguggaucaaauccag

SEQ ID NO: 1658010 - RNA, 21 nt, Human
ggccugugucuaguuguuuga

SEQ ID NO: 1658011 - RNA, 12 nt, Human
ggccuucucuga

SEQ ID NO: 1658012 - RNA, 23 nt, Human
ggccuucggccuccauccugagg

SEQ ID NO: 1658013 - RNA, 15 nt, Human
ggccugagcugggau

SEQ ID NO: 1658014 - RNA, 13 nt, Human
ggccuccauccug

SEQ ID NO: 1658015 - RNA, 16 nt, Human
ggcucacugcauccuc

SEQ ID NO: 1658016 - RNA, 19 nt, Human
ggcucacugcauccuccgc

SEQ ID NO: 1658017 - RNA, 17 nt, Human
ggcucacugcagccuca

SEQ ID NO: 1658018 - RNA, 16 nt, Human
ggcucacugcagccuc

SEQ ID NO: 1658019 - RNA, 19 nt, Human
ggcgugcaguggugcgauc

SEQ ID NO: 1658020 - RNA, 23 nt, Human
ggcucagcaaaagaugcuucuca

SEQ ID NO: 1658021 - RNA, 21 nt, Human
ggcucagcggggacagcuccu

SEQ ID NO: 1658022 - RNA, 22 nt, Human
ggcucagcggggacagcuccuu

SEQ ID NO: 1658023 - RNA, 23 nt, Human
ggcucagcggggacagcuccuuc

SEQ ID NO: 1658024 - RNA, 16 nt, Human
ggccaggcuggucuca

SEQ ID NO: 1658025 - RNA, 18 nt, Human
ggccaggcuggucucaaa

SEQ ID NO: 1658026 - RNA, 14 nt, Human
ggccaggcuggucu

SEQ ID NO: 1658027 - RNA, 21 nt, Human
ggccaaacucaccugccccuc

SEQ ID NO: 1658028 - RNA, 17 nt, Human
ggccaaacucaccugcc

SEQ ID NO: 1658029 - RNA, 16 nt, Human
ggccagugugacaagg

SEQ ID NO: 1658030 - RNA, 13 nt, Human
ggccagugcucca

SEQ ID NO: 1658031 - RNA, 15 nt, Human
ggccagugcuccagc

SEQ ID NO: 1658032 - RNA, 15 nt, Human
ggcaccagcagccug

SEQ ID NO: 1658033 - RNA, 16 nt, Human
ggcaccagcagccugg

SEQ ID NO: 1658034 - RNA, 24 nt, Human
ggcacugcuuccagugaggcucug

SEQ ID NO: 1658035 - RNA, 17 nt, Human
ggcagugggagcugccu

SEQ ID NO: 1658036 - RNA, 18 nt, Human
ggcauccaguaucuugaa

SEQ ID NO: 1658037 - RNA, 18 nt, Human
ggcagugggagcugccug

SEQ ID NO: 1658038 - RNA, 19 nt, Human
ggcagugggagcugccugu

SEQ ID NO: 1658039 - RNA, 18 nt, Human
ggcauuuuacuguacaga

SEQ ID NO: 1658040 - RNA, 15 nt, Human
ggcccgacagccugg

SEQ ID NO: 1658041 - RNA, 13 nt, Human
ggcccuuccucuc

SEQ ID NO: 1658042 - RNA, 15 nt, Human
ggcccuuccucucca

SEQ ID NO: 1658043 - RNA, 18 nt, Human
ggcccuuccucuccacug

SEQ ID NO: 1658044 - RNA, 16 nt, Human
ggcccuucucuccagc

SEQ ID NO: 1658045 - RNA, 17 nt, Human
ggcccuucucuccagcc

SEQ ID NO: 1658046 - RNA, 17 nt, Human
ggcccuuccucuccacu

SEQ ID NO: 1658047 - RNA, 19 nt, Human
ggcccuucucuccagcccc

SEQ ID NO: 1658048 - RNA, 18 nt, Human
ggcccuucucuccagccc

SEQ ID NO: 1658049 - RNA, 12 nt, Human
ggauaaaugcca

SEQ ID NO: 1658050 - RNA, 22 nt, Human
ggauaauaaggaaaaguuuaau

SEQ ID NO: 1658051 - RNA, 21 nt, Human
ggaguuggaagugugugaucu

SEQ ID NO: 1658052 - RNA, 15 nt, Human
ggaguucugguuccu

SEQ ID NO: 1658053 - RNA, 14 nt, Human
ggaguggccacaga

SEQ ID NO: 1658054 - RNA, 21 nt, Human
ggauguacaaggacagccccu

SEQ ID NO: 1658055 - RNA, 16 nt, Human
ggauggggcugcaccg

SEQ ID NO: 1658056 - RNA, 18 nt, Human
ggauggauuuccagccaa

SEQ ID NO: 1658057 - RNA, 12 nt, Human
ggauggcaagau

SEQ ID NO: 1658058 - RNA, 15 nt, Human
ggauccuccaggugc

SEQ ID NO: 1658059 - RNA, 14 nt, Human
ggauccuccaggug

SEQ ID NO: 1658060 - RNA, 13 nt, Human
ggauccugagcca

SEQ ID NO: 1658061 - RNA, 14 nt, Human
ggauccugagccag

SEQ ID NO: 1658062 - RNA, 16 nt, Human
ggcacagggcaguggg

SEQ ID NO: 1658063 - RNA, 22 nt, Human
ggcacaaucucggcucacugca

SEQ ID NO: 1658064 - RNA, 24 nt, Human
ggcacagaaaauggaagacagcuc

SEQ ID NO: 1658065 - RNA, 15 nt, Human
ggauguucugggaca

SEQ ID NO: 1658066 - RNA, 16 nt, Human
ggauguucugggacac

SEQ ID NO: 1658067 - RNA, 22 nt, Human
ggauguugaaaaaguucugcag

SEQ ID NO: 1658068 - RNA, 12 nt, Human
ggaggccagccu

SEQ ID NO: 1658069 - RNA, 20 nt, Human
ggaggccagcacggugguga

SEQ ID NO: 1658070 - RNA, 11 nt, Human
ggaggccagcc

SEQ ID NO: 1658071 - RNA, 20 nt, Human
ggaggaaggaaacccagcuc

SEQ ID NO: 1658072 - RNA, 23 nt, Human
ggaggaaggaaacccagcucugg

SEQ ID NO: 1658073 - RNA, 19 nt, Human
ggaggaaggaaacccagcu

SEQ ID NO: 1658074 - RNA, 16 nt, Human
ggagccaauggagacu

SEQ ID NO: 1658075 - RNA, 16 nt, Human
ggagccccgaggccuu

SEQ ID NO: 1658076 - RNA, 22 nt, Human
ggagccccgaggccuucucuga

SEQ ID NO: 1658077 - RNA, 12 nt, Human
ggagcugccugu

SEQ ID NO: 1658078 - RNA, 21 nt, Human
ggagcugccuguucagcucca

SEQ ID NO: 1658079 - RNA, 16 nt, Human
ggaggggggagguggg

SEQ ID NO: 1658080 - RNA, 14 nt, Human
ggaggucgaggcag

SEQ ID NO: 1658081 - RNA, 14 nt, Human
ggaggugaccccag

SEQ ID NO: 1658082 - RNA, 20 nt, Human
ggaggucaaggcugcaguga

SEQ ID NO: 1658083 - RNA, 16 nt, Human
ggagcaucagugcccu

SEQ ID NO: 1658084 - RNA, 18 nt, Human
gcucucaaguuaucaggg

SEQ ID NO: 1658085 - RNA, 19 nt, Human
gcucuacugaggugcuaug

SEQ ID NO: 1658086 - RNA, 16 nt, Human
gcuccucuccccagca

SEQ ID NO: 1658087 - RNA, 19 nt, Human
gcuccucuccccagcaagu

SEQ ID NO: 1658088 - RNA, 17 nt, Human
gcucucaggccagcugc

SEQ ID NO: 1658089 - RNA, 18 nt, Human
gcucucaggccagcugcu

SEQ ID NO: 1658090 - RNA, 19 nt, Human
gcucucaggccagcugcuu

SEQ ID NO: 1658091 - RNA, 20 nt, Human
gcucucaggccagcugcuug

SEQ ID NO: 1658092 - RNA, 19 nt, Human
gcuccucccggugcccaag

SEQ ID NO: 1658093 - RNA, 15 nt, Human
gcuccucuccccagc

SEQ ID NO: 1658094 - RNA, 17 nt, Human
gcuccagcucaccagcc

SEQ ID NO: 1658095 - RNA, 13 nt, Human
gcuccagcucacc

SEQ ID NO: 1658096 - RNA, 14 nt, Human
gcuccagcucacca

SEQ ID NO: 1658097 - RNA, 18 nt, Human
gcuccagacacaugucca

SEQ ID NO: 1658098 - RNA, 21 nt, Human
gcuccagacacauguccaaga

SEQ ID NO: 1658099 - RNA, 23 nt, Human
gcuccagacacauguccaagaag

SEQ ID NO: 1658100 - RNA, 9 nt, Human
gcuccagac

SEQ ID NO: 1658101 - RNA, 20 nt, Human
gcuccacuuggucugugaga

SEQ ID NO: 1658102 - RNA, 20 nt, Human
gcucugaucauccacugugc

SEQ ID NO: 1658103 - RNA, 15 nt, Human
gcucuggagcccacu

SEQ ID NO: 1658104 - RNA, 16 nt, Human
gcucuggagcccacug

SEQ ID NO: 1658105 - RNA, 21 nt, Human
gcucugcccauccugccccug

SEQ ID NO: 1658106 - RNA, 21 nt, Human
gcucugaucauccacugugcc

SEQ ID NO: 1658107 - RNA, 22 nt, Human
gcucugaucauccacugugcca

SEQ ID NO: 1658108 - RNA, 23 nt, Human
gcucugaucauccacugugccau

SEQ ID NO: 1658109 - RNA, 15 nt, Human
gcucugcccauccug

SEQ ID NO: 1658110 - RNA, 20 nt, Human
gcugaacuuguuuucuggga

SEQ ID NO: 1658111 - RNA, 23 nt, Human
gcugaaggcucgagcaugccugg

SEQ ID NO: 1658112 - RNA, 17 nt, Human
gcugaauacagaggcaa

SEQ ID NO: 1658113 - RNA, 22 nt, Human
gcugaauacagaggcaacugca

SEQ ID NO: 1658114 - RNA, 12 nt, Human
gcugagccucag

SEQ ID NO: 1658115 - RNA, 16 nt, Human
gcugagccucagucuc

SEQ ID NO: 1658116 - RNA, 13 nt, Human
gcugacagacaca

SEQ ID NO: 1658117 - RNA, 17 nt, Human
gcucuggagcccacugu

SEQ ID NO: 1658118 - RNA, 14 nt, Human
gcucuguccuggga

SEQ ID NO: 1658119 - RNA, 16 nt, Human
gcugaaacaacaaaua

SEQ ID NO: 1658120 - RNA, 17 nt, Human
gcugccccuggcagccc

SEQ ID NO: 1658121 - RNA, 17 nt, Human
gcugccauccagguuca

SEQ ID NO: 1658122 - RNA, 13 nt, Human
gcugccccuggca

SEQ ID NO: 1658123 - RNA, 15 nt, Human
gcugccccuggcagc

SEQ ID NO: 1658124 - RNA, 16 nt, Human
gcugccccuggcagcc

SEQ ID NO: 1658125 - RNA, 12 nt, Human
gcugcugacagu

SEQ ID NO: 1658126 - RNA, 12 nt, Human
gcugccauccag

SEQ ID NO: 1658127 - RNA, 13 nt, Human
gcugccauccagg

SEQ ID NO: 1658128 - RNA, 16 nt, Human
gcugcacccucaggca

SEQ ID NO: 1658129 - RNA, 13 nt, Human
gcugcacccucag

SEQ ID NO: 1658130 - RNA, 15 nt, Human
gcugcacccucaggc

SEQ ID NO: 1658131 - RNA, 13 nt, Human
gcuguuggcuggg

SEQ ID NO: 1658132 - RNA, 14 nt, Human
gcuguuggcugggg

SEQ ID NO: 1658133 - RNA, 12 nt, Human
gcugugccucug

SEQ ID NO: 1658134 - RNA, 16 nt, Human
gcuucaaauuguaagc

SEQ ID NO: 1658135 - RNA, 18 nt, Human
gcuucaaggauccugagc

SEQ ID NO: 1658136 - RNA, 14 nt, Human
gcuucaaggauccu

SEQ ID NO: 1658137 - RNA, 14 nt, Human
gcuucaguggcagc

SEQ ID NO: 1658138 - RNA, 15 nt, Human
gcuucaguggcagcu

SEQ ID NO: 1658139 - RNA, 23 nt, Human
gcugguucaggguuggccccugc

SEQ ID NO: 1658140 - RNA, 19 nt, Human
gcuguauuagucacagaga

SEQ ID NO: 1658141 - RNA, 12 nt, Human
gcuguauuuuaa

SEQ ID NO: 1658142 - RNA, 13 nt, Human
gcuguauuuuaaa

SEQ ID NO: 1658143 - RNA, 16 nt, Human
gcuuuccucuuccuga

SEQ ID NO: 1658144 - RNA, 22 nt, Human
gcuuuccccaugucucgacuca

SEQ ID NO: 1658145 - RNA, 21 nt, Human
gcuuuccccaugucucgacuc

SEQ ID NO: 1658146 - RNA, 18 nt, Human
gcuuguaaauagcucagg

SEQ ID NO: 1658147 - RNA, 19 nt, Human
gcuuguaaauagcucaggu

SEQ ID NO: 1658148 - RNA, 23 nt, Human
gcuugaccgugaggccagagaca

SEQ ID NO: 1658149 - RNA, 18 nt, Human
gcuugaccuuuaagagaa

SEQ ID NO: 1658150 - RNA, 16 nt, Human
gcuugaccgugaggcc

SEQ ID NO: 1658151 - RNA, 22 nt, Human
gcuugaccuuuaagagaaauga

SEQ ID NO: 1658152 - RNA, 17 nt, Human
gcuuguaaauagcucag

SEQ ID NO: 1658153 - RNA, 15 nt, Human
gcuucuucagagacu

SEQ ID NO: 1658154 - RNA, 12 nt, Human
gcuucuucagag

SEQ ID NO: 1658155 - RNA, 23 nt, Human
gcuuccagugaggcucugcccuu

SEQ ID NO: 1658156 - RNA, 19 nt, Human
gcuuccuggcaauagucaa

SEQ ID NO: 1658157 - RNA, 22 nt, Human
gcuuccagugaggcucugcccu

SEQ ID NO: 1658158 - RNA, 14 nt, Human
gcuuugaucccuuc

SEQ ID NO: 1658159 - RNA, 17 nt, Human
gcuuugaucccuucuua

SEQ ID NO: 1658160 - RNA, 22 nt, Human
gcuuuuuucucugauacagaaa

SEQ ID NO: 1658161 - RNA, 18 nt, Human
ggaaaauuuuaaaaauac

SEQ ID NO: 1658162 - RNA, 16 nt, Human
ggaaacccagcucugg

SEQ ID NO: 1658163 - RNA, 15 nt, Human
gcuuuuuuaucaugu

SEQ ID NO: 1658164 - RNA, 18 nt, Human
gcuuuuuuaucaugugaa

SEQ ID NO: 1658165 - RNA, 20 nt, Human
gcuuuuuuaucaugugaaau

SEQ ID NO: 1658166 - RNA, 12 nt, Human
gcuuuugugcau

SEQ ID NO: 1658167 - RNA, 12 nt, Human
gcuuuucugauc

SEQ ID NO: 1658168 - RNA, 15 nt, Human
gcuuuucugauccag

SEQ ID NO: 1658169 - RNA, 16 nt, Human
gcuuuucugauccagu

SEQ ID NO: 1658170 - RNA, 15 nt, Human
gcuuuuggucugugu

SEQ ID NO: 1658171 - RNA, 18 nt, Human
gcuuuugucuaugggacu

SEQ ID NO: 1658172 - RNA, 11 nt, Human
gcuuuucugau

SEQ ID NO: 1658173 - RNA, 14 nt, Human
ggaagacaauguga

SEQ ID NO: 1658174 - RNA, 16 nt, Human
ggaagacaaugugaaa

SEQ ID NO: 1658175 - RNA, 17 nt, Human
ggaacaccauaggucac

SEQ ID NO: 1658176 - RNA, 13 nt, Human
ggaacaccuccuc

SEQ ID NO: 1658177 - RNA, 23 nt, Human
ggaacaaggcaaggcugucaauu

SEQ ID NO: 1658178 - RNA, 15 nt, Human
ggaacacuccuucac

SEQ ID NO: 1658179 - RNA, 19 nt, Human
ggaacacuccuucacagau

SEQ ID NO: 1658180 - RNA, 21 nt, Human
ggaaacuaggugcauauuuau

SEQ ID NO: 1658181 - RNA, 14 nt, Human
ggaaaugggcagag

SEQ ID NO: 1658182 - RNA, 16 nt, Human
ggaaaugggcagagca

SEQ ID NO: 1658183 - RNA, 17 nt, Human
ggaaaugggcagagcag

SEQ ID NO: 1658184 - RNA, 18 nt, Human
ggaaaugggcagagcaga

SEQ ID NO: 1658185 - RNA, 22 nt, Human
ggaaaugggcagagcagagacc

SEQ ID NO: 1658186 - RNA, 17 nt, Human
ggaaaugucaacaagua

SEQ ID NO: 1658187 - RNA, 15 nt, Human
ggaacaaggcaaggc

SEQ ID NO: 1658188 - RNA, 17 nt, Human
ggaacaaggcaaggcug

SEQ ID NO: 1658189 - RNA, 21 nt, Human
ggaacaaggcaaggcugucaa

SEQ ID NO: 1658190 - RNA, 22 nt, Human
ggaagacaaugugaaaagaaaa

SEQ ID NO: 1658191 - RNA, 17 nt, Human
ggaagacuucaucccuc

SEQ ID NO: 1658192 - RNA, 20 nt, Human
ggaagacuucaucccucugg

SEQ ID NO: 1658193 - RNA, 12 nt, Human
ggaagacuuugg

SEQ ID NO: 1658194 - RNA, 17 nt, Human
gccuccaagcuccaucu

SEQ ID NO: 1658195 - RNA, 11 nt, Human
gccuccaugcu

SEQ ID NO: 1658196 - RNA, 19 nt, Human
gccuccuuugugaggaagc

SEQ ID NO: 1658197 - RNA, 20 nt, Human
gccuccuuugugaggaagcc

SEQ ID NO: 1658198 - RNA, 21 nt, Human
gccuccuuugugaggaagccg

SEQ ID NO: 1658199 - RNA, 16 nt, Human
gccuccauccugaggc

SEQ ID NO: 1658200 - RNA, 20 nt, Human
gccuccauccugaggcucca

SEQ ID NO: 1658201 - RNA, 13 nt, Human
gccucggacuuag

SEQ ID NO: 1658202 - RNA, 17 nt, Human
gccugcuaauuccccag

SEQ ID NO: 1658203 - RNA, 23 nt, Human
gccugcuaauuccccagauugca

SEQ ID NO: 1658204 - RNA, 13 nt, Human
gccugcuccagcu

SEQ ID NO: 1658205 - RNA, 18 nt, Human
gcuaauuuugaaaaacug

SEQ ID NO: 1658206 - RNA, 16 nt, Human
gcuaauuuuucauuuu

SEQ ID NO: 1658207 - RNA, 23 nt, Human
gcguugaaauuguaauuauaucu

SEQ ID NO: 1658208 - RNA, 24 nt, Human
gcguugaaauuguaauuauaucug

SEQ ID NO: 1658209 - RNA, 17 nt, Human
gcguuucuaugacacau

SEQ ID NO: 1658210 - RNA, 17 nt, Human
gcuacaaaaacacagca

SEQ ID NO: 1658211 - RNA, 18 nt, Human
gcuacaaaaacacagcaa

SEQ ID NO: 1658212 - RNA, 19 nt, Human
gcuacaaaaacacagcaag

SEQ ID NO: 1658213 - RNA, 19 nt, Human
gcuacuguccuacccaccc

SEQ ID NO: 1658214 - RNA, 20 nt, Human
gcuacuguccuacccacccu

SEQ ID NO: 1658215 - RNA, 18 nt, Human
gcuacuguaaggcaauca

SEQ ID NO: 1658216 - RNA, 19 nt, Human
gcuacuguaaggcaaucau

SEQ ID NO: 1658217 - RNA, 15 nt, Human
gcuacugucagcucc

SEQ ID NO: 1658218 - RNA, 17 nt, Human
gcuacuugggaggcuga

SEQ ID NO: 1658219 - RNA, 19 nt, Human
gcgugcacacaccagagcc

SEQ ID NO: 1658220 - RNA, 18 nt, Human
gcgugcacacaccagagc

SEQ ID NO: 1658221 - RNA, 14 nt, Human
gcgugcacacacca

SEQ ID NO: 1658222 - RNA, 20 nt, Human
gcgugguggacaugcacagc

SEQ ID NO: 1658223 - RNA, 16 nt, Human
gcggccuuuggcuuca

SEQ ID NO: 1658224 - RNA, 13 nt, Human
gcgauucuucugc

SEQ ID NO: 1658225 - RNA, 17 nt, Human
gcgauucuucugcuuca

SEQ ID NO: 1658226 - RNA, 14 nt, Human
gcgauucuucugcu

SEQ ID NO: 1658227 - RNA, 15 nt, Human
gccccugccucucug

SEQ ID NO: 1658228 - RNA, 16 nt, Human
gccccugccucucugc

SEQ ID NO: 1658229 - RNA, 17 nt, Human
gccccugccucucugca

SEQ ID NO: 1658230 - RNA, 18 nt, Human
gccccugccucucugcag

SEQ ID NO: 1658231 - RNA, 22 nt, Human
gccccugcugguucaggguugg

SEQ ID NO: 1658232 - RNA, 17 nt, Human
gcccucacccuggggcu

SEQ ID NO: 1658233 - RNA, 16 nt, Human
gcccucacccuggggc

SEQ ID NO: 1658234 - RNA, 15 nt, Human
gccccuggaugcagc

SEQ ID NO: 1658235 - RNA, 17 nt, Human
gcccaggccccugccac

SEQ ID NO: 1658236 - RNA, 18 nt, Human
gcccaggccccugccacc

SEQ ID NO: 1658237 - RNA, 13 nt, Human
gcccaggcagguc

SEQ ID NO: 1658238 - RNA, 14 nt, Human
gcccaggcaggucu

SEQ ID NO: 1658239 - RNA, 16 nt, Human
gcccaggcaggucuug

SEQ ID NO: 1658240 - RNA, 15 nt, Human
gcccaggccccugcc

SEQ ID NO: 1658241 - RNA, 13 nt, Human
gcccaggccccug

SEQ ID NO: 1658242 - RNA, 24 nt, Human
gccaucaauaaaaaauuaugacau

SEQ ID NO: 1658243 - RNA, 14 nt, Human
gccaugugccaggu

SEQ ID NO: 1658244 - RNA, 22 nt, Human
gccaugugcuaguaauuggaaa

SEQ ID NO: 1658245 - RNA, 13 nt, Human
gccaggccacaag

SEQ ID NO: 1658246 - RNA, 18 nt, Human
gccaggccacaagacccu

SEQ ID NO: 1658247 - RNA, 21 nt, Human
gccaggccacaagacccuugu

SEQ ID NO: 1658248 - RNA, 15 nt, Human
gccaggccagaggga

SEQ ID NO: 1658249 - RNA, 22 nt, Human
gccaggccagagggagugacag

SEQ ID NO: 1658250 - RNA, 13 nt, Human
gccaggcccucug

SEQ ID NO: 1658251 - RNA, 14 nt, Human
gccaggcccucugc

SEQ ID NO: 1658252 - RNA, 15 nt, Human
gccaggcccucugcc

SEQ ID NO: 1658253 - RNA, 21 nt, Human
gccagcaguucagagcugccc

SEQ ID NO: 1658254 - RNA, 20 nt, Human
gccagcaguucagagcugcc

SEQ ID NO: 1658255 - RNA, 19 nt, Human
gccagcaguucagagcugc

SEQ ID NO: 1658256 - RNA, 14 nt, Human
gccagcaguucaga

SEQ ID NO: 1658257 - RNA, 13 nt, Human
gccagcaguucag

SEQ ID NO: 1658258 - RNA, 22 nt, Human
gccaguuggucccccuuccaug

SEQ ID NO: 1658259 - RNA, 23 nt, Human
gccaguuggucccccuuccaugg

SEQ ID NO: 1658260 - RNA, 16 nt, Human
gccaguuggucccccu

SEQ ID NO: 1658261 - RNA, 18 nt, Human
gccaguuggucccccuuc

SEQ ID NO: 1658262 - RNA, 20 nt, Human
gccaguuggucccccuucca

SEQ ID NO: 1658263 - RNA, 21 nt, Human
gccaguuggucccccuuccau

SEQ ID NO: 1658264 - RNA, 16 nt, Human
gccauaugaaaaggcu

SEQ ID NO: 1658265 - RNA, 15 nt, Human
gccagugcuccagcc

SEQ ID NO: 1658266 - RNA, 13 nt, Human
gccagugugacaa

SEQ ID NO: 1658267 - RNA, 13 nt, Human
gccaguugguccc

SEQ ID NO: 1658268 - RNA, 22 nt, Human
gccaguuauggcuauaggugcu

SEQ ID NO: 1658269 - RNA, 14 nt, Human
cugacagaaggacu

SEQ ID NO: 1658270 - RNA, 12 nt, Human
cugacagacaca

SEQ ID NO: 1658271 - RNA, 14 nt, Human
cugacagacacagg

SEQ ID NO: 1658272 - RNA, 15 nt, Human
cugacagacacaggc

SEQ ID NO: 1658273 - RNA, 18 nt, Human
cugacccaugcugcccug

SEQ ID NO: 1658274 - RNA, 17 nt, Human
cugacccaugcugcccu

SEQ ID NO: 1658275 - RNA, 19 nt, Human
cugacccaugcugcccugu

SEQ ID NO: 1658276 - RNA, 20 nt, Human
cugacccaugcugcccugug

SEQ ID NO: 1658277 - RNA, 22 nt, Human
cugaaggaauaaauugcuccuu

SEQ ID NO: 1658278 - RNA, 16 nt, Human
cugaaaauguaugugu

SEQ ID NO: 1658279 - RNA, 19 nt, Human
cugaaggacauugcggaca

SEQ ID NO: 1658280 - RNA, 20 nt, Human
cugaaggacauugcggacag

SEQ ID NO: 1658281 - RNA, 21 nt, Human
cugaaggacauugcggacagc

SEQ ID NO: 1658282 - RNA, 13 nt, Human
cugaaggccccgc

SEQ ID NO: 1658283 - RNA, 14 nt, Human
cugaaggccccgcc

SEQ ID NO: 1658284 - RNA, 17 nt, Human
cugaaggccccgcccag

SEQ ID NO: 1658285 - RNA, 18 nt, Human
cugaaggccccgcccagg

SEQ ID NO: 1658286 - RNA, 17 nt, Human
cucuugccacugccucu

SEQ ID NO: 1658287 - RNA, 18 nt, Human
cucuugccacugccucuu

SEQ ID NO: 1658288 - RNA, 19 nt, Human
cucuugccacugccucuuc

SEQ ID NO: 1658289 - RNA, 20 nt, Human
cucuugccacugccucuucc

SEQ ID NO: 1658290 - RNA, 16 nt, Human
cucuugccacugccuc

SEQ ID NO: 1658291 - RNA, 20 nt, Human
cucuuagaugcaguucugaa

SEQ ID NO: 1658292 - RNA, 21 nt, Human
cucuuagaugcaguucugaag

SEQ ID NO: 1658293 - RNA, 14 nt, Human
cucugcacuccccu

SEQ ID NO: 1658294 - RNA, 19 nt, Human
cucugcagcaauaaagcag

SEQ ID NO: 1658295 - RNA, 18 nt, Human
cucugcagcaauaaagca

SEQ ID NO: 1658296 - RNA, 23 nt, Human
cucugcagcaauaaagcagcguu

SEQ ID NO: 1658297 - RNA, 14 nt, Human
cucugguuccuccc

SEQ ID NO: 1658298 - RNA, 19 nt, Human
cucugguccauagagagca

SEQ ID NO: 1658299 - RNA, 16 nt, Human
cucugguccauagaga

SEQ ID NO: 1658300 - RNA, 18 nt, Human
cucugguccauagagagc

SEQ ID NO: 1658301 - RNA, 17 nt, Human
cucugcugacagacaca

SEQ ID NO: 1658302 - RNA, 18 nt, Human
cucugcugacagacacag

SEQ ID NO: 1658303 - RNA, 19 nt, Human
cucugcugacagacacagg

SEQ ID NO: 1658304 - RNA, 20 nt, Human
cucugcugacagacacaggc

SEQ ID NO: 1658305 - RNA, 17 nt, Human
cucuguacagagcccac

SEQ ID NO: 1658306 - RNA, 21 nt, Human
cucuguacagagcccacgccc

SEQ ID NO: 1658307 - RNA, 15 nt, Human
cucuuagaugcaguu

SEQ ID NO: 1658308 - RNA, 20 nt, Human
cucgggauuaguacacacuu

SEQ ID NO: 1658309 - RNA, 21 nt, Human
cucucacuuguuuuauuuaac

SEQ ID NO: 1658310 - RNA, 15 nt, Human
cucucacuccuugaa

SEQ ID NO: 1658311 - RNA, 19 nt, Human
cucucagauuguaccauug

SEQ ID NO: 1658312 - RNA, 12 nt, Human
cucucacuccuu

SEQ ID NO: 1658313 - RNA, 14 nt, Human
cucucacuccuuga

SEQ ID NO: 1658314 - RNA, 20 nt, Human
cucucaaccaccuuucagau

SEQ ID NO: 1658315 - RNA, 15 nt, Human
cucugaaggacauug

SEQ ID NO: 1658316 - RNA, 12 nt, Human
cucucuggccuu

SEQ ID NO: 1658317 - RNA, 12 nt, Human
cucuccuccaga

SEQ ID NO: 1658318 - RNA, 11 nt, Human
cucucuggccu

SEQ ID NO: 1658319 - RNA, 16 nt, Human
cuccaaagucucugga

SEQ ID NO: 1658320 - RNA, 18 nt, Human
cucaugccucagccuccu

SEQ ID NO: 1658321 - RNA, 20 nt, Human
cucaugccucagccuccuga

SEQ ID NO: 1658322 - RNA, 19 nt, Human
cucauguucuuaauucuua

SEQ ID NO: 1658323 - RNA, 18 nt, Human
cucauguucuuaauucuu

SEQ ID NO: 1658324 - RNA, 14 nt, Human
cucauguucuuaau

SEQ ID NO: 1658325 - RNA, 12 nt, Human
cucauguucuua

SEQ ID NO: 1658326 - RNA, 20 nt, Human
cucagucuggcccuuccuuu

SEQ ID NO: 1658327 - RNA, 13 nt, Human
cucagugccacua

SEQ ID NO: 1658328 - RNA, 17 nt, Human
cucagucuggcccuucc

SEQ ID NO: 1658329 - RNA, 18 nt, Human
cucagucuggcccuuccu

SEQ ID NO: 1658330 - RNA, 22 nt, Human
cucagccucccaaagugcuggg

SEQ ID NO: 1658331 - RNA, 13 nt, Human
cucagccucccga

SEQ ID NO: 1658332 - RNA, 23 nt, Human
cucagccucccgaauagcuggga

SEQ ID NO: 1658333 - RNA, 17 nt, Human
cuaucccggcugcccuu

SEQ ID NO: 1658334 - RNA, 21 nt, Human
cucagccucccaaagugcugg

SEQ ID NO: 1658335 - RNA, 14 nt, Human
cucagccucccaaa

SEQ ID NO: 1658336 - RNA, 16 nt, Human
cucagccucccaaagu

SEQ ID NO: 1658337 - RNA, 15 nt, Human
cuaucccggcugccc

SEQ ID NO: 1658338 - RNA, 16 nt, Human
cuaucccggcugcccu

SEQ ID NO: 1658339 - RNA, 13 nt, Human
cucagccucccaa

SEQ ID NO: 1658340 - RNA, 12 nt, Human
cucagccuccug

SEQ ID NO: 1658341 - RNA, 13 nt, Human
cucagccuccuga

SEQ ID NO: 1658342 - RNA, 13 nt, Human
cucaggccagcug

SEQ ID NO: 1658343 - RNA, 14 nt, Human
cucagcgaaugaau

SEQ ID NO: 1658344 - RNA, 13 nt, Human
cucagcggggaca

SEQ ID NO: 1658345 - RNA, 14 nt, Human
cucaggccagcugc

SEQ ID NO: 1658346 - RNA, 15 nt, Human
cucaggccagcugcu

SEQ ID NO: 1658347 - RNA, 21 nt, Human
cucaggccagcugcuugggcu

SEQ ID NO: 1658348 - RNA, 22 nt, Human
cucaggccagcugcuugggcuu

SEQ ID NO: 1658349 - RNA, 14 nt, Human
cucaggccuggggg

SEQ ID NO: 1658350 - RNA, 20 nt, Human
cucaggccugggggcugggc

SEQ ID NO: 1658351 - RNA, 21 nt, Human
cucaggccugggggcugggca

SEQ ID NO: 1658352 - RNA, 11 nt, Human
cuccaggugca

SEQ ID NO: 1658353 - RNA, 14 nt, Human
cuccagaccccugg

SEQ ID NO: 1658354 - RNA, 16 nt, Human
cuccaagaccuucucc

SEQ ID NO: 1658355 - RNA, 17 nt, Human
cuccaagaccuucuccu

SEQ ID NO: 1658356 - RNA, 18 nt, Human
cuccaagaccuucuccuu

SEQ ID NO: 1658357 - RNA, 21 nt, Human
cuccaagaccuucuccuucac

SEQ ID NO: 1658358 - RNA, 22 nt, Human
cuccacuuucuagccagaggag

SEQ ID NO: 1658359 - RNA, 15 nt, Human
cuccagaauuuccca

SEQ ID NO: 1658360 - RNA, 18 nt, Human
cuccagaauuucccaaag

SEQ ID NO: 1658361 - RNA, 21 nt, Human
cuccagaauuucccaaagcag

SEQ ID NO: 1658362 - RNA, 17 nt, Human
cuccagacacaugucca

SEQ ID NO: 1658363 - RNA, 19 nt, Human
cuccagacacauguccaag

SEQ ID NO: 1658364 - RNA, 19 nt, Human
cuccgcuuucuacccagcg

SEQ ID NO: 1658365 - RNA, 14 nt, Human
cucccugcaauaaa

SEQ ID NO: 1658366 - RNA, 16 nt, Human
cucccugcaauaaaau

SEQ ID NO: 1658367 - RNA, 12 nt, Human
cucccaccucag

SEQ ID NO: 1658368 - RNA, 13 nt, Human
cucccaccucagc

SEQ ID NO: 1658369 - RNA, 21 nt, Human
cuccagugagacagcucugca

SEQ ID NO: 1658370 - RNA, 16 nt, Human
cgaccugccucggccu

SEQ ID NO: 1658371 - RNA, 14 nt, Human
cgccuacaggagug

SEQ ID NO: 1658372 - RNA, 21 nt, Human
cgcaggcuggcccugcccugg

SEQ ID NO: 1658373 - RNA, 23 nt, Human
cgccaaggcugggggaagaagcu

SEQ ID NO: 1658374 - RNA, 13 nt, Human
cgccaaggcuggg

SEQ ID NO: 1658375 - RNA, 16 nt, Human
cgccaaggcuggggga

SEQ ID NO: 1658376 - RNA, 14 nt, Human
cgcaggcuggcccu

SEQ ID NO: 1658377 - RNA, 15 nt, Human
cgcaggcuggcccug

SEQ ID NO: 1658378 - RNA, 17 nt, Human
cgcaggcuggcccugcc

SEQ ID NO: 1658379 - RNA, 18 nt, Human
cgcaggcuggcccugccc

SEQ ID NO: 1658380 - RNA, 19 nt, Human
cgcaggcuggcccugcccu

SEQ ID NO: 1658381 - RNA, 20 nt, Human
cgcaggcuggcccugcccug

SEQ ID NO: 1658382 - RNA, 12 nt, Human
cgccaaggcugg

SEQ ID NO: 1658383 - RNA, 17 nt, Human
cgaguuacagacaaagc

SEQ ID NO: 1658384 - RNA, 18 nt, Human
cgaguuacagacaaagcg

SEQ ID NO: 1658385 - RNA, 14 nt, Human
cgaguagcugggac

SEQ ID NO: 1658386 - RNA, 15 nt, Human
cgaguagcugggacu

SEQ ID NO: 1658387 - RNA, 16 nt, Human
cgaguagcugggacua

SEQ ID NO: 1658388 - RNA, 16 nt, Human
cggaggggccuggcag

SEQ ID NO: 1658389 - RNA, 18 nt, Human
cggaggggccuggcagcc

SEQ ID NO: 1658390 - RNA, 14 nt, Human
cggagucccaccuu

SEQ ID NO: 1658391 - RNA, 21 nt, Human
cggcucacugcauccuccgcc

SEQ ID NO: 1658392 - RNA, 19 nt, Human
cggcucacugcagccucaa

SEQ ID NO: 1658393 - RNA, 17 nt, Human
cggcucacugcauccuc

SEQ ID NO: 1658394 - RNA, 18 nt, Human
cggcucacugcagccuca

SEQ ID NO: 1658395 - RNA, 22 nt, Human
ccuucuggaauaaggagaauga

SEQ ID NO: 1658396 - RNA, 23 nt, Human
ccuucugacccaugcugcccugu

SEQ ID NO: 1658397 - RNA, 21 nt, Human
ccuucugacccaugcugcccu

SEQ ID NO: 1658398 - RNA, 22 nt, Human
ccuucugacccaugcugcccug

SEQ ID NO: 1658399 - RNA, 20 nt, Human
ccuggccugagcugggauga

SEQ ID NO: 1658400 - RNA, 14 nt, Human
ccuggccugagcug

SEQ ID NO: 1658401 - RNA, 15 nt, Human
ccuggccugagcugg

SEQ ID NO: 1658402 - RNA, 12 nt, Human
ccuucugaccca

SEQ ID NO: 1658403 - RNA, 16 nt, Human
ccuucugacccaugcu

SEQ ID NO: 1658404 - RNA, 17 nt, Human
ccuucugacccaugcug

SEQ ID NO: 1658405 - RNA, 20 nt, Human
ccuucugacccaugcugccc

SEQ ID NO: 1658406 - RNA, 20 nt, Human
ccuugccgucuaccugaggg

SEQ ID NO: 1658407 - RNA, 14 nt, Human
ccuuuagcgcccag

SEQ ID NO: 1658408 - RNA, 20 nt, Human
ccuuuagcgcccaguugggu

SEQ ID NO: 1658409 - RNA, 17 nt, Human
ccuuuuucauuauuuua

SEQ ID NO: 1658410 - RNA, 12 nt, Human
ccuuuuuuauac

SEQ ID NO: 1658411 - RNA, 19 nt, Human
ccuuuuuuauacauaaaca

SEQ ID NO: 1658412 - RNA, 12 nt, Human
cgaccaccugcc

SEQ ID NO: 1658413 - RNA, 14 nt, Human
cgaccaccugccca

SEQ ID NO: 1658414 - RNA, 23 nt, Human
cgaccagacaccuugacagggca

SEQ ID NO: 1658415 - RNA, 18 nt, Human
ccuuuuuuauacauaaac

SEQ ID NO: 1658416 - RNA, 17 nt, Human
ccuuuuuuauacauaaa

SEQ ID NO: 1658417 - RNA, 15 nt, Human
cgacagugagacucu

SEQ ID NO: 1658418 - RNA, 16 nt, Human
cgacagugagacucug

SEQ ID NO: 1658419 - RNA, 19 nt, Human
cuagggaaaaaccagcgug

SEQ ID NO: 1658420 - RNA, 21 nt, Human
cuagggaaaaaccagcgugug

SEQ ID NO: 1658421 - RNA, 18 nt, Human
cuaguuccaccaucaagc

SEQ ID NO: 1658422 - RNA, 20 nt, Human
cuaguuccaccaucaagcca

SEQ ID NO: 1658423 - RNA, 22 nt, Human
cuaguuccaccaucaagccacc

SEQ ID NO: 1658424 - RNA, 23 nt, Human
cuaguugaucagcuuauugucua

SEQ ID NO: 1658425 - RNA, 15 nt, Human
cuaccugaggggccu

SEQ ID NO: 1658426 - RNA, 11 nt, Human
cuaccugaggg

SEQ ID NO: 1658427 - RNA, 14 nt, Human
cuaccugaggggcc

SEQ ID NO: 1658428 - RNA, 19 nt, Human
cuagaaauuccccacccug

SEQ ID NO: 1658429 - RNA, 23 nt, Human
cuagcagcagggagggcuucugc

SEQ ID NO: 1658430 - RNA, 17 nt, Human
cuagcauggcugccaau

SEQ ID NO: 1658431 - RNA, 22 nt, Human
cuagcagcagggagggcuucug

SEQ ID NO: 1658432 - RNA, 16 nt, Human
cuagaacucccuuuca

SEQ ID NO: 1658433 - RNA, 17 nt, Human
cuagaacucccuuucaa

SEQ ID NO: 1658434 - RNA, 18 nt, Human
cuagaacucccuuucaac

SEQ ID NO: 1658435 - RNA, 19 nt, Human
cuagaacucccuuucaaca

SEQ ID NO: 1658436 - RNA, 23 nt, Human
cuaaacugcccccucugcccugc

SEQ ID NO: 1658437 - RNA, 15 nt, Human
cuaaacuuuucugau

SEQ ID NO: 1658438 - RNA, 14 nt, Human
cuaaacuuucacac

SEQ ID NO: 1658439 - RNA, 13 nt, Human
cuaaacuuuucug

SEQ ID NO: 1658440 - RNA, 13 nt, Human
cuaaacuuucaca

SEQ ID NO: 1658441 - RNA, 22 nt, Human
cuaaacugcccccucugcccug

SEQ ID NO: 1658442 - RNA, 13 nt, Human
cgugagaccugcc

SEQ ID NO: 1658443 - RNA, 14 nt, Human
cgugagaccugccc

SEQ ID NO: 1658444 - RNA, 16 nt, Human
cgugagaccugccccu

SEQ ID NO: 1658445 - RNA, 23 nt, Human
cgugagccaccgugccuggccac

SEQ ID NO: 1658446 - RNA, 16 nt, Human
cuaacuucaccauauu

SEQ ID NO: 1658447 - RNA, 15 nt, Human
cuaacuucaccauau

SEQ ID NO: 1658448 - RNA, 20 nt, Human
cuaacgaaguauccuucagc

SEQ ID NO: 1658449 - RNA, 20 nt, Human
cuaagugaaauaagccagac

SEQ ID NO: 1658450 - RNA, 23 nt, Human
cuaagugaaauaagccagacauc

SEQ ID NO: 1658451 - RNA, 18 nt, Human
cuaagugaggaugaaaaa

SEQ ID NO: 1658452 - RNA, 20 nt, Human
cuaagugauccucccaccuc

SEQ ID NO: 1658453 - RNA, 22 nt, Human
cuaagugauccucccaccucag

SEQ ID NO: 1658454 - RNA, 15 nt, Human
cuacaagacacagug

SEQ ID NO: 1658455 - RNA, 15 nt, Human
cuacaguccucccau

SEQ ID NO: 1658456 - RNA, 16 nt, Human
cuacaguccucccauc

SEQ ID NO: 1658457 - RNA, 17 nt, Human
cuacaguccucccaucu

SEQ ID NO: 1658458 - RNA, 18 nt, Human
cuacaguccucccaucuc

SEQ ID NO: 1658459 - RNA, 13 nt, Human
cuacaguugaaaa

SEQ ID NO: 1658460 - RNA, 19 nt, Human
cuacaguugaaaaacagcu

SEQ ID NO: 1658461 - RNA, 18 nt, Human
cuacaugagguacugaga

SEQ ID NO: 1658462 - RNA, 15 nt, Human
cuacaugagguacug

SEQ ID NO: 1658463 - RNA, 18 nt, Human
cuacauacaauuccaaac

SEQ ID NO: 1658464 - RNA, 15 nt, Human
cccucacccuggggc

SEQ ID NO: 1658465 - RNA, 12 nt, Human
cccugcccugug

SEQ ID NO: 1658466 - RNA, 13 nt, Human
cccugcccugugg

SEQ ID NO: 1658467 - RNA, 20 nt, Human
cccuauuuuuuuucuguuau

SEQ ID NO: 1658468 - RNA, 21 nt, Human
cccuauuuuuuuucuguuaua

SEQ ID NO: 1658469 - RNA, 21 nt, Human
cccugcccugugggcccccaa

SEQ ID NO: 1658470 - RNA, 12 nt, Human
cccuggcagccc

SEQ ID NO: 1658471 - RNA, 13 nt, Human
cccuggcagcccc

SEQ ID NO: 1658472 - RNA, 14 nt, Human
cccugcccuguggg

SEQ ID NO: 1658473 - RNA, 15 nt, Human
cccugcccugugggc

SEQ ID NO: 1658474 - RNA, 16 nt, Human
cccugcccugugggcc

SEQ ID NO: 1658475 - RNA, 20 nt, Human
cccugcccugugggccccca

SEQ ID NO: 1658476 - RNA, 13 nt, Human
cccuggcuuuuca

SEQ ID NO: 1658477 - RNA, 17 nt, Human
cccuggcuuuucacugc

SEQ ID NO: 1658478 - RNA, 17 nt, Human
cccuggcucccacaggc

SEQ ID NO: 1658479 - RNA, 19 nt, Human
cccuggcucccacaggccc

SEQ ID NO: 1658480 - RNA, 14 nt, Human
cccuggcagccccu

SEQ ID NO: 1658481 - RNA, 16 nt, Human
cccuggcagccccugu

SEQ ID NO: 1658482 - RNA, 17 nt, Human
cccuggccuuucauauu

SEQ ID NO: 1658483 - RNA, 21 nt, Human
cccuucugacccaugcugccc

SEQ ID NO: 1658484 - RNA, 22 nt, Human
cccuucugacccaugcugcccu

SEQ ID NO: 1658485 - RNA, 23 nt, Human
cccuucugacccaugcugcccug

SEQ ID NO: 1658486 - RNA, 16 nt, Human
cccuucuaccuuccug

SEQ ID NO: 1658487 - RNA, 16 nt, Human
cccuucgcuccugugu

SEQ ID NO: 1658488 - RNA, 18 nt, Human
cccuucgcuccugugucu

SEQ ID NO: 1658489 - RNA, 16 nt, Human
ccgccaugcuccuggc

SEQ ID NO: 1658490 - RNA, 20 nt, Human
ccgcccaggcuuagucacug

SEQ ID NO: 1658491 - RNA, 16 nt, Human
ccgacccuugccgucu

SEQ ID NO: 1658492 - RNA, 17 nt, Human
ccgccaaggcuggggga

SEQ ID NO: 1658493 - RNA, 20 nt, Human
ccgaauagcugggacuacag

SEQ ID NO: 1658494 - RNA, 17 nt, Human
cccuucuuuccacagaa

SEQ ID NO: 1658495 - RNA, 23 nt, Human
ccuaggcauuugcugaauacaga

SEQ ID NO: 1658496 - RNA, 17 nt, Human
ccuagcacuuugggagg

SEQ ID NO: 1658497 - RNA, 17 nt, Human
ccuagcacacacuuuug

SEQ ID NO: 1658498 - RNA, 18 nt, Human
ccgucucugguuccuccc

SEQ ID NO: 1658499 - RNA, 14 nt, Human
ccuaauaaagcugu

SEQ ID NO: 1658500 - RNA, 23 nt, Human
ccuaauaaagcuguguggcaguc

SEQ ID NO: 1658501 - RNA, 12 nt, Human
ccggcuccaggc

SEQ ID NO: 1658502 - RNA, 22 nt, Human
ccggcuaugggggcacugagga

SEQ ID NO: 1658503 - RNA, 23 nt, Human
ccggcuaugggggcacugaggac

SEQ ID NO: 1658504 - RNA, 17 nt, Human
ccggcuaugggggcacu

SEQ ID NO: 1658505 - RNA, 19 nt, Human
ccggcuaauuuuuguauuu

SEQ ID NO: 1658506 - RNA, 16 nt, Human
ccguagguuauuuuca

SEQ ID NO: 1658507 - RNA, 15 nt, Human
ccuauuuuaauaaac

SEQ ID NO: 1658508 - RNA, 15 nt, Human
ccucaacucuccucc

SEQ ID NO: 1658509 - RNA, 15 nt, Human
ccucaagagaaggca

SEQ ID NO: 1658510 - RNA, 11 nt, Human
ccucagccucc

SEQ ID NO: 1658511 - RNA, 22 nt, Human
ccucagccucccaaagugcugg

SEQ ID NO: 1658512 - RNA, 14 nt, Human
ccucccaggcgccc

SEQ ID NO: 1658513 - RNA, 20 nt, Human
ccucccaggcgccccuuccc

SEQ ID NO: 1658514 - RNA, 22 nt, Human
ccuccaaucccaccaacccuca

SEQ ID NO: 1658515 - RNA, 22 nt, Human
ccucccaaggggcccaaauucu

SEQ ID NO: 1658516 - RNA, 19 nt, Human
ccucauguucuuaauucuu

SEQ ID NO: 1658517 - RNA, 21 nt, Human
ccuccaagcuccaucuccacu

SEQ ID NO: 1658518 - RNA, 22 nt, Human
ccuccaagcuccaucuccacuc

SEQ ID NO: 1658519 - RNA, 18 nt, Human
ccucauuagcauuuugcu

SEQ ID NO: 1658520 - RNA, 23 nt, Human
ccucagccucccaaagugcuggg

SEQ ID NO: 1658521 - RNA, 22 nt, Human
ccucagccucccgaauagcugg

SEQ ID NO: 1658522 - RNA, 13 nt, Human
ccucagccuccug

SEQ ID NO: 1658523 - RNA, 15 nt, Human
ccucauguccacugg

SEQ ID NO: 1658524 - RNA, 13 nt, Human
ccucauguucuua

SEQ ID NO: 1658525 - RNA, 20 nt, Human
ccucauguccacugguucuu

SEQ ID NO: 1658526 - RNA, 12 nt, Human
ccugcugggugu

SEQ ID NO: 1658527 - RNA, 21 nt, Human
ccugcuggguguggcgcagca

SEQ ID NO: 1658528 - RNA, 14 nt, Human
ccugcugggugugg

SEQ ID NO: 1658529 - RNA, 20 nt, Human
ccugcuggguguggcgcagc

SEQ ID NO: 1658530 - RNA, 14 nt, Human
ccugcccaggcccc

SEQ ID NO: 1658531 - RNA, 15 nt, Human
ccugcccaggccccu

SEQ ID NO: 1658532 - RNA, 16 nt, Human
ccugcccaggccccug

SEQ ID NO: 1658533 - RNA, 18 nt, Human
ccugcccaggccccugcc

SEQ ID NO: 1658534 - RNA, 15 nt, Human
ccuggaguucugguu

SEQ ID NO: 1658535 - RNA, 16 nt, Human
ccuggaguucugguuc

SEQ ID NO: 1658536 - RNA, 17 nt, Human
ccuggaguucugguucc

SEQ ID NO: 1658537 - RNA, 19 nt, Human
ccuggaugcagccucacag

SEQ ID NO: 1658538 - RNA, 14 nt, Human
ccuggaugcagccu

SEQ ID NO: 1658539 - RNA, 17 nt, Human
ccuggaugcagccucac

SEQ ID NO: 1658540 - RNA, 21 nt, Human
ccuggauccaucaggccacuu

SEQ ID NO: 1658541 - RNA, 13 nt, Human
ccuggaugcagcc

SEQ ID NO: 1658542 - RNA, 16 nt, Human
ccuggcacagggcagu

SEQ ID NO: 1658543 - RNA, 17 nt, Human
ccuggcacagggcagug

SEQ ID NO: 1658544 - RNA, 18 nt, Human
ccuggcacagggcagugg

SEQ ID NO: 1658545 - RNA, 18 nt, Human
ccuggcacccggccccug

SEQ ID NO: 1658546 - RNA, 12 nt, Human
ccuggccucugc

SEQ ID NO: 1658547 - RNA, 16 nt, Human
ccuggccucugcacuc

SEQ ID NO: 1658548 - RNA, 13 nt, Human
ccuggccugagcu

SEQ ID NO: 1658549 - RNA, 14 nt, Human
ccuggccucugcac

SEQ ID NO: 1658550 - RNA, 15 nt, Human
ccuggccucugcacu

SEQ ID NO: 1658551 - RNA, 14 nt, Human
ccucuugccacugc

SEQ ID NO: 1658552 - RNA, 13 nt, Human
ccucuuggguuca

SEQ ID NO: 1658553 - RNA, 19 nt, Human
ccucuugagccuugaacuu

SEQ ID NO: 1658554 - RNA, 13 nt, Human
ccucuugagccuu

SEQ ID NO: 1658555 - RNA, 22 nt, Human
ccugcacuugcagacucuacag

SEQ ID NO: 1658556 - RNA, 13 nt, Human
ccucucugcaggu

SEQ ID NO: 1658557 - RNA, 15 nt, Human
ccucucugcaggucc

SEQ ID NO: 1658558 - RNA, 14 nt, Human
ccucucucaggcca

SEQ ID NO: 1658559 - RNA, 13 nt, Human
ccucucucacucc

SEQ ID NO: 1658560 - RNA, 14 nt, Human
ccucucucacuccu

SEQ ID NO: 1658561 - RNA, 15 nt, Human
ccucucucacuccuu

SEQ ID NO: 1658562 - RNA, 17 nt, Human
ccucucucacuccuuga

SEQ ID NO: 1658563 - RNA, 12 nt, Human
ccucucucaggc

SEQ ID NO: 1658564 - RNA, 12 nt, Human
ccucucugcccu

SEQ ID NO: 1658565 - RNA, 23 nt, Human
ccucucugcaggucccuaauaaa

SEQ ID NO: 1658566 - RNA, 21 nt, Human
ccucucugcaggucccuaaua

SEQ ID NO: 1658567 - RNA, 22 nt, Human
ccucucugcaggucccuaauaa

SEQ ID NO: 1658568 - RNA, 12 nt, Human
ccucugccuguc

SEQ ID NO: 1658569 - RNA, 22 nt, Human
ccucugccugaagucacacagu

SEQ ID NO: 1658570 - RNA, 15 nt, Human
ccucugcugauccuc

SEQ ID NO: 1658571 - RNA, 18 nt, Human
ccucugcugauccuccca

SEQ ID NO: 1658572 - RNA, 13 nt, Human
ccucugcugcugg

SEQ ID NO: 1658573 - RNA, 14 nt, Human
ccucugcugcuggc

SEQ ID NO: 1658574 - RNA, 15 nt, Human
ccucugcugcuggcu

SEQ ID NO: 1658575 - RNA, 16 nt, Human
ccucugcugcuggcug

SEQ ID NO: 1658576 - RNA, 17 nt, Human
ccucugcugcuggcugg

SEQ ID NO: 1658577 - RNA, 18 nt, Human
ccucugcugcuggcuggu

SEQ ID NO: 1658578 - RNA, 13 nt, Human
ccucugcuugcca

SEQ ID NO: 1658579 - RNA, 17 nt, Human
ccucugcuugccauccc

SEQ ID NO: 1658580 - RNA, 18 nt, Human
cccacccugaaagcccug

SEQ ID NO: 1658581 - RNA, 17 nt, Human
cccacccccacccaagg

SEQ ID NO: 1658582 - RNA, 15 nt, Human
cccacccccacccaa

SEQ ID NO: 1658583 - RNA, 20 nt, Human
cccacccaagggccuggccu

SEQ ID NO: 1658584 - RNA, 21 nt, Human
cccacccaagggccuggccug

SEQ ID NO: 1658585 - RNA, 22 nt, Human
cccacccaagggccuggccuga

SEQ ID NO: 1658586 - RNA, 22 nt, Human
cccacugcuuuuggucugugug

SEQ ID NO: 1658587 - RNA, 19 nt, Human
cccacugcuuuuggucugu

SEQ ID NO: 1658588 - RNA, 12 nt, Human
cccacugcucug

SEQ ID NO: 1658589 - RNA, 13 nt, Human
cccacugcucugg

SEQ ID NO: 1658590 - RNA, 18 nt, Human
cccacuagacccacugga

SEQ ID NO: 1658591 - RNA, 12 nt, Human
cccacucccugc

SEQ ID NO: 1658592 - RNA, 13 nt, Human
cccauccucugua

SEQ ID NO: 1658593 - RNA, 15 nt, Human
cccagcuugaaaccu

SEQ ID NO: 1658594 - RNA, 15 nt, Human
cccaggaaaggcucc

SEQ ID NO: 1658595 - RNA, 13 nt, Human
cccaggcuggcgu

SEQ ID NO: 1658596 - RNA, 17 nt, Human
cccaggcuggcgugcag

SEQ ID NO: 1658597 - RNA, 20 nt, Human
cccauauuuguacaccaaua

SEQ ID NO: 1658598 - RNA, 24 nt, Human
cccagccagcaguucagagcugcc

SEQ ID NO: 1658599 - RNA, 16 nt, Human
cccagccagcaguuca

SEQ ID NO: 1658600 - RNA, 23 nt, Human
cccagcucugguccauagagagc

SEQ ID NO: 1658601 - RNA, 20 nt, Human
cccagccagcaguucagagc

SEQ ID NO: 1658602 - RNA, 17 nt, Human
cccagccagcaguucag

SEQ ID NO: 1658603 - RNA, 23 nt, Human
ccccgaggccuucucugaaggac

SEQ ID NO: 1658604 - RNA, 23 nt, Human
ccccgacccuugccgucuaccug

SEQ ID NO: 1658605 - RNA, 22 nt, Human
cccccaaauggaaaugggcaga

SEQ ID NO: 1658606 - RNA, 13 nt, Human
ccccagaggcugg

SEQ ID NO: 1658607 - RNA, 22 nt, Human
ccccagcaagugagagcugggu

SEQ ID NO: 1658608 - RNA, 23 nt, Human
ccccaaaacucuccucugcugcu

SEQ ID NO: 1658609 - RNA, 22 nt, Human
cccauuguggucacaggaagua

SEQ ID NO: 1658610 - RNA, 22 nt, Human
ccccaaaacucuccucugcugc

SEQ ID NO: 1658611 - RNA, 23 nt, Human
cccauuguggucacaggaaguag

SEQ ID NO: 1658612 - RNA, 19 nt, Human
ccccucuggcuccagcugg

SEQ ID NO: 1658613 - RNA, 14 nt, Human
cccgaauagcuggg

SEQ ID NO: 1658614 - RNA, 13 nt, Human
cccggccaccugc

SEQ ID NO: 1658615 - RNA, 14 nt, Human
cccggccaccugcg

SEQ ID NO: 1658616 - RNA, 12 nt, Human
cccggcuccagg

SEQ ID NO: 1658617 - RNA, 13 nt, Human
cccggcuccaggc

SEQ ID NO: 1658618 - RNA, 14 nt, Human
cccggcuccaggcu

SEQ ID NO: 1658619 - RNA, 15 nt, Human
cccggcuccaggcuc

SEQ ID NO: 1658620 - RNA, 16 nt, Human
cccggcuccaggcucc

SEQ ID NO: 1658621 - RNA, 17 nt, Human
cccggccaccugcggug

SEQ ID NO: 1658622 - RNA, 17 nt, Human
cccuauugguaaagaau

SEQ ID NO: 1658623 - RNA, 18 nt, Human
cccuauuagagaagagau

SEQ ID NO: 1658624 - RNA, 23 nt, Human
cccgggaggcagagguugcagug

SEQ ID NO: 1658625 - RNA, 16 nt, Human
ccaggcacugcugccc

SEQ ID NO: 1658626 - RNA, 18 nt, Human
ccaggcacugcugcccag

SEQ ID NO: 1658627 - RNA, 20 nt, Human
ccaggcuccuuuagcgccca

SEQ ID NO: 1658628 - RNA, 21 nt, Human
ccaggcuccuuuagcgcccag

SEQ ID NO: 1658629 - RNA, 19 nt, Human
ccaggcuggcgugcagugg

SEQ ID NO: 1658630 - RNA, 17 nt, Human
ccaggcuggcgugcagu

SEQ ID NO: 1658631 - RNA, 18 nt, Human
ccaggcuggcgugcagug

SEQ ID NO: 1658632 - RNA, 19 nt, Human
ccaggggaaaaucagccug

SEQ ID NO: 1658633 - RNA, 20 nt, Human
ccaggggaaaaucagccugc

SEQ ID NO: 1658634 - RNA, 13 nt, Human
ccaggggugggac

SEQ ID NO: 1658635 - RNA, 19 nt, Human
ccaggggugggacacccug

SEQ ID NO: 1658636 - RNA, 14 nt, Human
ccaggggugggaca

SEQ ID NO: 1658637 - RNA, 17 nt, Human
ccaggggugggacaccc

SEQ ID NO: 1658638 - RNA, 17 nt, Human
ccaguuggguggaugcc

SEQ ID NO: 1658639 - RNA, 19 nt, Human
ccaguuggguggaugccug

SEQ ID NO: 1658640 - RNA, 20 nt, Human
ccaguuggguggaugccugg

SEQ ID NO: 1658641 - RNA, 23 nt, Human
ccaguuggguggaugccuggugg

SEQ ID NO: 1658642 - RNA, 23 nt, Human
ccaguuggucccccuuccaugga

SEQ ID NO: 1658643 - RNA, 14 nt, Human
ccaucccagcccca

SEQ ID NO: 1658644 - RNA, 15 nt, Human
ccaucccagccccaa

SEQ ID NO: 1658645 - RNA, 14 nt, Human
ccaucccugaaggc

SEQ ID NO: 1658646 - RNA, 15 nt, Human
ccaucccugaaggcc

SEQ ID NO: 1658647 - RNA, 17 nt, Human
ccaucccugaaggcccc

SEQ ID NO: 1658648 - RNA, 20 nt, Human
ccaucccugaaggccccgcc

SEQ ID NO: 1658649 - RNA, 21 nt, Human
ccaugagccucagcauccugg

SEQ ID NO: 1658650 - RNA, 23 nt, Human
ccaugagccucagcauccuggca

SEQ ID NO: 1658651 - RNA, 20 nt, Human
ccauggucggaaaacaugcu

SEQ ID NO: 1658652 - RNA, 16 nt, Human
ccaggaaaggcuccag

SEQ ID NO: 1658653 - RNA, 14 nt, Human
ccaggaaaggcucc

SEQ ID NO: 1658654 - RNA, 15 nt, Human
ccaggaaaggcucca

SEQ ID NO: 1658655 - RNA, 12 nt, Human
ccaggaagccag

SEQ ID NO: 1658656 - RNA, 14 nt, Human
ccaggaagccagca

SEQ ID NO: 1658657 - RNA, 13 nt, Human
ccaggaagccagc

SEQ ID NO: 1658658 - RNA, 11 nt, Human
ccagccccugg

SEQ ID NO: 1658659 - RNA, 12 nt, Human
ccagccccugga

SEQ ID NO: 1658660 - RNA, 17 nt, Human
ccagcuguucagcuggu

SEQ ID NO: 1658661 - RNA, 16 nt, Human
ccagcuuaucucaggg

SEQ ID NO: 1658662 - RNA, 19 nt, Human
ccagcuuaaaggggcuaga

SEQ ID NO: 1658663 - RNA, 15 nt, Human
ccagcucaccagccc

SEQ ID NO: 1658664 - RNA, 16 nt, Human
ccagcucaccagcccc

SEQ ID NO: 1658665 - RNA, 22 nt, Human
ccagcucaccagccccagugcc

SEQ ID NO: 1658666 - RNA, 16 nt, Human
ccagcuguucagcugg

SEQ ID NO: 1658667 - RNA, 21 nt, Human
ccagcagauuauucacugauu

SEQ ID NO: 1658668 - RNA, 22 nt, Human
ccagcagauuauucacugauuu

SEQ ID NO: 1658669 - RNA, 13 nt, Human
ccagcaggcucuc

SEQ ID NO: 1658670 - RNA, 15 nt, Human
ccagcaggcucucag

SEQ ID NO: 1658671 - RNA, 23 nt, Human
ccagaugcaccagcccuuagcag

SEQ ID NO: 1658672 - RNA, 18 nt, Human
ccagaugcaccagcccuu

SEQ ID NO: 1658673 - RNA, 17 nt, Human
ccagaugcaccagcccu

SEQ ID NO: 1658674 - RNA, 15 nt, Human
ccagaugcaccagcc

SEQ ID NO: 1658675 - RNA, 20 nt, Human
ccagagggccugcaagggag

SEQ ID NO: 1658676 - RNA, 16 nt, Human
ccaccuuggcucaagu

SEQ ID NO: 1658677 - RNA, 17 nt, Human
ccagagggccugcaagg

SEQ ID NO: 1658678 - RNA, 18 nt, Human
ccagagggccugcaaggg

SEQ ID NO: 1658679 - RNA, 19 nt, Human
ccagagggccugcaaggga

SEQ ID NO: 1658680 - RNA, 15 nt, Human
ccagauccuggaaau

SEQ ID NO: 1658681 - RNA, 15 nt, Human
caggguuggccccug

SEQ ID NO: 1658682 - RNA, 16 nt, Human
caggguuggccccugc

SEQ ID NO: 1658683 - RNA, 21 nt, Human
cagggucucuaccauccccug

SEQ ID NO: 1658684 - RNA, 23 nt, Human
cagggucucacucugucgcccag

SEQ ID NO: 1658685 - RNA, 23 nt, Human
cagguuuuuggucugacccacug

SEQ ID NO: 1658686 - RNA, 13 nt, Human
caggugcugccau

SEQ ID NO: 1658687 - RNA, 14 nt, Human
caggugcugccauc

SEQ ID NO: 1658688 - RNA, 17 nt, Human
caggguuggccccugcc

SEQ ID NO: 1658689 - RNA, 21 nt, Human
caggguuggccccugcccggc

SEQ ID NO: 1658690 - RNA, 18 nt, Human
caguaaaugggggugcau

SEQ ID NO: 1658691 - RNA, 20 nt, Human
caguaaaugggggugcauuu

SEQ ID NO: 1658692 - RNA, 19 nt, Human
caguaaaugggggugcauu

SEQ ID NO: 1658693 - RNA, 12 nt, Human
caguauugaagc

SEQ ID NO: 1658694 - RNA, 14 nt, Human
caguauugaagcau

SEQ ID NO: 1658695 - RNA, 15 nt, Human
caguauugaagcauu

SEQ ID NO: 1658696 - RNA, 22 nt, Human
caguauuguacaaaguauuaag

SEQ ID NO: 1658697 - RNA, 16 nt, Human
caguauugaagcauuu

SEQ ID NO: 1658698 - RNA, 17 nt, Human
caguauugaagcauuuu

SEQ ID NO: 1658699 - RNA, 20 nt, Human
caguauugaagcauuuuaua

SEQ ID NO: 1658700 - RNA, 21 nt, Human
caguauugaagcauuuuauaa

SEQ ID NO: 1658701 - RNA, 16 nt, Human
cagucaccccggccac

SEQ ID NO: 1658702 - RNA, 17 nt, Human
cagucaccccggccacc

SEQ ID NO: 1658703 - RNA, 20 nt, Human
caggccugggggcugggcag

SEQ ID NO: 1658704 - RNA, 22 nt, Human
caggccugggggcugggcagag

SEQ ID NO: 1658705 - RNA, 23 nt, Human
caggccugggggcugggcagagg

SEQ ID NO: 1658706 - RNA, 17 nt, Human
caggcuggcgugcagug

SEQ ID NO: 1658707 - RNA, 18 nt, Human
caggcuggcgugcagugg

SEQ ID NO: 1658708 - RNA, 19 nt, Human
caggcuggcgugcaguggu

SEQ ID NO: 1658709 - RNA, 16 nt, Human
caggcugggagagccu

SEQ ID NO: 1658710 - RNA, 18 nt, Human
caggcugggagagccuuc

SEQ ID NO: 1658711 - RNA, 19 nt, Human
caggcugggagagccuucc

SEQ ID NO: 1658712 - RNA, 20 nt, Human
caggcugggagagccuucca

SEQ ID NO: 1658713 - RNA, 18 nt, Human
cagggagggccugggccc

SEQ ID NO: 1658714 - RNA, 16 nt, Human
cagggagggcuucugc

SEQ ID NO: 1658715 - RNA, 20 nt, Human
cagggcucagcggggacagc

SEQ ID NO: 1658716 - RNA, 12 nt, Human
cagggcucagcg

SEQ ID NO: 1658717 - RNA, 15 nt, Human
cagggcucagcgggg

SEQ ID NO: 1658718 - RNA, 14 nt, Human
caggcugggcuuca

SEQ ID NO: 1658719 - RNA, 15 nt, Human
caggcugggcuucag

SEQ ID NO: 1658720 - RNA, 22 nt, Human
cagggaggacgcucucuggccu

SEQ ID NO: 1658721 - RNA, 16 nt, Human
caggcacugcugccca

SEQ ID NO: 1658722 - RNA, 17 nt, Human
caggcacugcugcccag

SEQ ID NO: 1658723 - RNA, 21 nt, Human
caggcaaugcuggcuguuggc

SEQ ID NO: 1658724 - RNA, 14 nt, Human
caggaggccagccu

SEQ ID NO: 1658725 - RNA, 12 nt, Human
caggaggccagc

SEQ ID NO: 1658726 - RNA, 13 nt, Human
caggaggccagcc

SEQ ID NO: 1658727 - RNA, 19 nt, Human
caggcaaugcuggcuguug

SEQ ID NO: 1658728 - RNA, 20 nt, Human
caggcaaugcuggcuguugg

SEQ ID NO: 1658729 - RNA, 23 nt, Human
caggcacugcugcccagccucca

SEQ ID NO: 1658730 - RNA, 13 nt, Human
caggccagcugcu

SEQ ID NO: 1658731 - RNA, 15 nt, Human
caggccagcugcuug

SEQ ID NO: 1658732 - RNA, 13 nt, Human
caggccaggcccu

SEQ ID NO: 1658733 - RNA, 14 nt, Human
caggccaggcccuc

SEQ ID NO: 1658734 - RNA, 15 nt, Human
caggccaggcccucu

SEQ ID NO: 1658735 - RNA, 16 nt, Human
caggccaggcccucug

SEQ ID NO: 1658736 - RNA, 13 nt, Human
caggaccagggau

SEQ ID NO: 1658737 - RNA, 21 nt, Human
caggaccagggauuuccauga

SEQ ID NO: 1658738 - RNA, 13 nt, Human
caggaccucaggu

SEQ ID NO: 1658739 - RNA, 23 nt, Human
caggacagcccuucuuuccacag

SEQ ID NO: 1658740 - RNA, 24 nt, Human
caggacagcccuucuuuccacaga

SEQ ID NO: 1658741 - RNA, 23 nt, Human
caggaaaggcuccaggagcagcc

SEQ ID NO: 1658742 - RNA, 21 nt, Human
caggaaaggcuccaggagcag

SEQ ID NO: 1658743 - RNA, 22 nt, Human
caggaaaggcuccaggagcagc

SEQ ID NO: 1658744 - RNA, 19 nt, Human
caggaaaagcugcugacag

SEQ ID NO: 1658745 - RNA, 20 nt, Human
caggaaaagcugcugacagu

SEQ ID NO: 1658746 - RNA, 15 nt, Human
cagcuguucagcugg

SEQ ID NO: 1658747 - RNA, 16 nt, Human
cagcuguucagcuggu

SEQ ID NO: 1658748 - RNA, 19 nt, Human
cagcuguucagcugguuga

SEQ ID NO: 1658749 - RNA, 16 nt, Human
cagcuuauucacaaga

SEQ ID NO: 1658750 - RNA, 17 nt, Human
cagcuuauucacaagac

SEQ ID NO: 1658751 - RNA, 22 nt, Human
caggaaaucaaauaugcaaagc

SEQ ID NO: 1658752 - RNA, 21 nt, Human
caggaaaucaaauaugcaaag

SEQ ID NO: 1658753 - RNA, 19 nt, Human
caggaaaucaaauaugcaa

SEQ ID NO: 1658754 - RNA, 17 nt, Human
cagagcuacacagggga

SEQ ID NO: 1658755 - RNA, 22 nt, Human
cagagcuacacaggggaaaaga

SEQ ID NO: 1658756 - RNA, 16 nt, Human
cagagagggugggagu

SEQ ID NO: 1658757 - RNA, 23 nt, Human
cagagagggugggagugggccca

SEQ ID NO: 1658758 - RNA, 14 nt, Human
cagagccugcaguu

SEQ ID NO: 1658759 - RNA, 20 nt, Human
cagagagggugggagugggc

SEQ ID NO: 1658760 - RNA, 22 nt, Human
cagagagggugggagugggccc

SEQ ID NO: 1658761 - RNA, 23 nt, Human
cagagacuccugcaggcagccag

SEQ ID NO: 1658762 - RNA, 21 nt, Human
cagagacuccugcaggcagcc

SEQ ID NO: 1658763 - RNA, 22 nt, Human
cagagacuccugcaggcagcca

SEQ ID NO: 1658764 - RNA, 20 nt, Human
cagagacuccugcaggcagc

SEQ ID NO: 1658765 - RNA, 22 nt, Human
cagaucauugugaaauuauuca

SEQ ID NO: 1658766 - RNA, 13 nt, Human
cagauacuggauu

SEQ ID NO: 1658767 - RNA, 16 nt, Human
cagaucauugugaaau

SEQ ID NO: 1658768 - RNA, 23 nt, Human
cagauacaggaaaagcugcugac

SEQ ID NO: 1658769 - RNA, 16 nt, Human
cagagguugcagugag

SEQ ID NO: 1658770 - RNA, 16 nt, Human
cagauuugagcucagc

SEQ ID NO: 1658771 - RNA, 13 nt, Human
cagauuugagcuc

SEQ ID NO: 1658772 - RNA, 14 nt, Human
cagauuugagcuca

SEQ ID NO: 1658773 - RNA, 15 nt, Human
cagauuucacucucc

SEQ ID NO: 1658774 - RNA, 16 nt, Human
cagauuucacucuccu

SEQ ID NO: 1658775 - RNA, 18 nt, Human
cagauuucacucuccuug

SEQ ID NO: 1658776 - RNA, 19 nt, Human
cagauuucacucuccuugg

SEQ ID NO: 1658777 - RNA, 21 nt, Human
cagauugcaacaggcugggcu

SEQ ID NO: 1658778 - RNA, 16 nt, Human
cagcauauucaggaag

SEQ ID NO: 1658779 - RNA, 17 nt, Human
cagcauauucaggaagc

SEQ ID NO: 1658780 - RNA, 18 nt, Human
cagcauauucaggaagcu

SEQ ID NO: 1658781 - RNA, 22 nt, Human
cagcaguucagagcugcccucu

SEQ ID NO: 1658782 - RNA, 21 nt, Human
cagcaguucagagcugcccuc

SEQ ID NO: 1658783 - RNA, 18 nt, Human
cagcaguucagagcugcc

SEQ ID NO: 1658784 - RNA, 20 nt, Human
cagcaguucagagcugcccu

SEQ ID NO: 1658785 - RNA, 19 nt, Human
cagcaguucagagcugccc

SEQ ID NO: 1658786 - RNA, 23 nt, Human
cagccccauucugccugcccagg

SEQ ID NO: 1658787 - RNA, 24 nt, Human
cagccccauucugccugcccaggc

SEQ ID NO: 1658788 - RNA, 19 nt, Human
cagccccauucugccugcc

SEQ ID NO: 1658789 - RNA, 20 nt, Human
cagccccauucugccugccc

SEQ ID NO: 1658790 - RNA, 22 nt, Human
cagccccauucugccugcccag

SEQ ID NO: 1658791 - RNA, 13 nt, Human
cagccccugcaca

SEQ ID NO: 1658792 - RNA, 19 nt, Human
cagccccgugggguuccuc

SEQ ID NO: 1658793 - RNA, 14 nt, Human
cagcguuucuauga

SEQ ID NO: 1658794 - RNA, 16 nt, Human
cagcguuucuaugaca

SEQ ID NO: 1658795 - RNA, 19 nt, Human
cagcguuucuaugacacau

SEQ ID NO: 1658796 - RNA, 14 nt, Human
cagcggggacagcu

SEQ ID NO: 1658797 - RNA, 13 nt, Human
cagcccuuagcag

SEQ ID NO: 1658798 - RNA, 15 nt, Human
cagcccuuagcaggg

SEQ ID NO: 1658799 - RNA, 23 nt, Human
cagccgccaugcuccuggcccac

SEQ ID NO: 1658800 - RNA, 17 nt, Human
cagccucugaaaaccaa

SEQ ID NO: 1658801 - RNA, 23 nt, Human
cagccugagcgacagugagacuc

SEQ ID NO: 1658802 - RNA, 12 nt, Human
caucgcaaugua

SEQ ID NO: 1658803 - RNA, 18 nt, Human
caucugugaaaggaaaga

SEQ ID NO: 1658804 - RNA, 19 nt, Human
caucugugaaaggaaagag

SEQ ID NO: 1658805 - RNA, 21 nt, Human
caucuuagguuggcaaaaagg

SEQ ID NO: 1658806 - RNA, 22 nt, Human
caucuuagguuggcaaaaaggc

SEQ ID NO: 1658807 - RNA, 17 nt, Human
caucccagccccaauga

SEQ ID NO: 1658808 - RNA, 16 nt, Human
caucccagccccaaug

SEQ ID NO: 1658809 - RNA, 13 nt, Human
caucccagcccca

SEQ ID NO: 1658810 - RNA, 14 nt, Human
caucccagccccaa

SEQ ID NO: 1658811 - RNA, 14 nt, Human
caucaggccaggcc

SEQ ID NO: 1658812 - RNA, 21 nt, Human
caucaggccaggcccucugcc

SEQ ID NO: 1658813 - RNA, 22 nt, Human
caucaggccaggcccucugccc

SEQ ID NO: 1658814 - RNA, 23 nt, Human
caucaggccaggcccucugccca

SEQ ID NO: 1658815 - RNA, 18 nt, Human
caucagcacgauuucugu

SEQ ID NO: 1658816 - RNA, 17 nt, Human
caucagcacgauuucug

SEQ ID NO: 1658817 - RNA, 13 nt, Human
caucaggccaggc

SEQ ID NO: 1658818 - RNA, 20 nt, Human
caucagcuugcccuguuaaa

SEQ ID NO: 1658819 - RNA, 19 nt, Human
caucagcacgauuucuguu

SEQ ID NO: 1658820 - RNA, 15 nt, Human
caucagcugcugaaa

SEQ ID NO: 1658821 - RNA, 17 nt, Human
caucagcugcugaaaca

SEQ ID NO: 1658822 - RNA, 18 nt, Human
caucagcugcugaaacaa

SEQ ID NO: 1658823 - RNA, 22 nt, Human
caugcaaggucauuuuuuuuaa

SEQ ID NO: 1658824 - RNA, 18 nt, Human
caugcaaggucauuuuuu

SEQ ID NO: 1658825 - RNA, 17 nt, Human
caugcaaggucauuuuu

SEQ ID NO: 1658826 - RNA, 12 nt, Human
caugcugccucc

SEQ ID NO: 1658827 - RNA, 14 nt, Human
caugcugccuccag

SEQ ID NO: 1658828 - RNA, 22 nt, Human
cauggccuuugcuugaaagaaa

SEQ ID NO: 1658829 - RNA, 19 nt, Human
cauggccuuugcuugaaag

SEQ ID NO: 1658830 - RNA, 16 nt, Human
caugcugcccugugag

SEQ ID NO: 1658831 - RNA, 18 nt, Human
caugcugcccugugagua

SEQ ID NO: 1658832 - RNA, 17 nt, Human
caugacacgaauauugc

SEQ ID NO: 1658833 - RNA, 18 nt, Human
caugacacgaauauugcu

SEQ ID NO: 1658834 - RNA, 14 nt, Human
caugaauuugugaa

SEQ ID NO: 1658835 - RNA, 14 nt, Human
caugacacgaauau

SEQ ID NO: 1658836 - RNA, 16 nt, Human
caugaauuaguuuuau

SEQ ID NO: 1658837 - RNA, 18 nt, Human
cagucaccccggccaccu

SEQ ID NO: 1658838 - RNA, 14 nt, Human
caguuugcuuugua

SEQ ID NO: 1658839 - RNA, 21 nt, Human
caguuugcuuuguaugcacuu

SEQ ID NO: 1658840 - RNA, 12 nt, Human
caguuugcuuug

SEQ ID NO: 1658841 - RNA, 23 nt, Human
cauaaucuggacuccucugucca

SEQ ID NO: 1658842 - RNA, 17 nt, Human
cauaaugcgugcauacc

SEQ ID NO: 1658843 - RNA, 14 nt, Human
cauaaugcgugcau

SEQ ID NO: 1658844 - RNA, 21 nt, Human
cauaaucuggacuccucuguc

SEQ ID NO: 1658845 - RNA, 22 nt, Human
cauaaucuggacuccucugucc

SEQ ID NO: 1658846 - RNA, 20 nt, Human
cauaaucuggacuccucugu

SEQ ID NO: 1658847 - RNA, 21 nt, Human
caguuuguuaguaugaggcau

SEQ ID NO: 1658848 - RNA, 22 nt, Human
cauauuaccacagacauacuaa

SEQ ID NO: 1658849 - RNA, 21 nt, Human
cauauuaccacagacauacua

SEQ ID NO: 1658850 - RNA, 20 nt, Human
cauauuaccacagacauacu

SEQ ID NO: 1658851 - RNA, 17 nt, Human
cauauuaccacagacau

SEQ ID NO: 1658852 - RNA, 15 nt, Human
cauagcccucacccu

SEQ ID NO: 1658853 - RNA, 19 nt, Human
cauagcccucacccugggg

SEQ ID NO: 1658854 - RNA, 12 nt, Human
cauagcccucac

SEQ ID NO: 1658855 - RNA, 21 nt, Human
cauaaugcgugcauaccacuu

SEQ ID NO: 1658856 - RNA, 15 nt, Human
cauacaauuccaaac

SEQ ID NO: 1658857 - RNA, 17 nt, Human
cauagauucccugagca

SEQ ID NO: 1658858 - RNA, 18 nt, Human
cauagauucccugagcag

SEQ ID NO: 1658859 - RNA, 23 nt, Human
ccaccgggcugggagcucugcag

SEQ ID NO: 1658860 - RNA, 19 nt, Human
ccaccgcagacaggaccag

SEQ ID NO: 1658861 - RNA, 18 nt, Human
ccaccgcagacaggacca

SEQ ID NO: 1658862 - RNA, 14 nt, Human
ccaccuuggcucaa

SEQ ID NO: 1658863 - RNA, 15 nt, Human
ccaccuuggcucaag

SEQ ID NO: 1658864 - RNA, 13 nt, Human
ccacccugcucuc

SEQ ID NO: 1658865 - RNA, 18 nt, Human
ccaccaucaccagacagg

SEQ ID NO: 1658866 - RNA, 20 nt, Human
ccaccaucaagccaccaaca

SEQ ID NO: 1658867 - RNA, 14 nt, Human
ccaccgcagacagg

SEQ ID NO: 1658868 - RNA, 17 nt, Human
ccaccgcagacaggacc

SEQ ID NO: 1658869 - RNA, 22 nt, Human
ccacacuucaggcucuucuccu

SEQ ID NO: 1658870 - RNA, 23 nt, Human
ccacagaaaagaaaguucaugcu

SEQ ID NO: 1658871 - RNA, 16 nt, Human
ccaccaucaagccacc

SEQ ID NO: 1658872 - RNA, 17 nt, Human
ccaccaucaagccacca

SEQ ID NO: 1658873 - RNA, 11 nt, Human
ccaacuuguaa

SEQ ID NO: 1658874 - RNA, 22 nt, Human
ccaaagugcugggauuacaggu

SEQ ID NO: 1658875 - RNA, 12 nt, Human
ccaaaugcagcu

SEQ ID NO: 1658876 - RNA, 15 nt, Human
ccaaaugcaauguga

SEQ ID NO: 1658877 - RNA, 12 nt, Human
ccaaauuaagag

SEQ ID NO: 1658878 - RNA, 19 nt, Human
ccaaagugcugggauuaca

SEQ ID NO: 1658879 - RNA, 22 nt, Human
ccaaagugcugggauuacaggc

SEQ ID NO: 1658880 - RNA, 23 nt, Human
ccaaugcacuuuguucuggcucu

SEQ ID NO: 1658881 - RNA, 20 nt, Human
ccaaugcacuuuguucuggc

SEQ ID NO: 1658882 - RNA, 22 nt, Human
ccaaugcacuuuguucuggcuc

SEQ ID NO: 1658883 - RNA, 20 nt, Human
ccaauguucucucuucucca

SEQ ID NO: 1658884 - RNA, 13 nt, Human
ccaauuaaggauu

SEQ ID NO: 1658885 - RNA, 18 nt, Human
ccaauuaaggauuuuaug

SEQ ID NO: 1658886 - RNA, 22 nt, Human
ccaauuaaggauuuuaugcuuu

SEQ ID NO: 1658887 - RNA, 21 nt, Human
cauucuccuaucaccugucuu

SEQ ID NO: 1658888 - RNA, 16 nt, Human
cauucuccuuguguua

SEQ ID NO: 1658889 - RNA, 17 nt, Human
cauucucacuccuaccu

SEQ ID NO: 1658890 - RNA, 16 nt, Human
cauucucacuccuacc

SEQ ID NO: 1658891 - RNA, 13 nt, Human
cauuaugaugugu

SEQ ID NO: 1658892 - RNA, 18 nt, Human
cauuaucuagauacugua

SEQ ID NO: 1658893 - RNA, 22 nt, Human
cauggcuggagcuagaauuuga

SEQ ID NO: 1658894 - RNA, 22 nt, Human
cauggcugccaaugggagcuca

SEQ ID NO: 1658895 - RNA, 15 nt, Human
cauguucucugagga

SEQ ID NO: 1658896 - RNA, 17 nt, Human
cauuaucuagauacugu

SEQ ID NO: 1658897 - RNA, 16 nt, Human
cauuaucuagauacug

SEQ ID NO: 1658898 - RNA, 12 nt, Human
cauuaucuagau

SEQ ID NO: 1658899 - RNA, 15 nt, Human
cauuaggauggcuag

SEQ ID NO: 1658900 - RNA, 18 nt, Human
cauugcugggcuugucug

SEQ ID NO: 1658901 - RNA, 14 nt, Human
cauugcggacagcc

SEQ ID NO: 1658902 - RNA, 15 nt, Human
cauugcggacagcca

SEQ ID NO: 1658903 - RNA, 17 nt, Human
cauugcggacagccacg

SEQ ID NO: 1658904 - RNA, 21 nt, Human
cauugcggacagccacggcca

SEQ ID NO: 1658905 - RNA, 18 nt, Human
cauuucauuugugccaga

SEQ ID NO: 1658906 - RNA, 16 nt, Human
cauuuauucugcucac

SEQ ID NO: 1658907 - RNA, 18 nt, Human
cauuuuugaauacaggca

SEQ ID NO: 1658908 - RNA, 20 nt, Human
cauuuuugaauacaggcaua

SEQ ID NO: 1658909 - RNA, 23 nt, Human
cauuuggugguuucagaaaugug

SEQ ID NO: 1658910 - RNA, 22 nt, Human
cauuuggugguuucagaaaugu

SEQ ID NO: 1658911 - RNA, 12 nt, Human
cauuuccaagca

SEQ ID NO: 1658912 - RNA, 16 nt, Human
ccaaaaaccaguauug

SEQ ID NO: 1658913 - RNA, 19 nt, Human
ccaaaaaccaguauuguac

SEQ ID NO: 1658914 - RNA, 20 nt, Human
ccaaaaaccaguauuguaca

SEQ ID NO: 1658915 - RNA, 17 nt, Human
ccaaaacucuccucugc

SEQ ID NO: 1658916 - RNA, 21 nt, Human
cacagacauacuaaccagcag

SEQ ID NO: 1658917 - RNA, 19 nt, Human
cacagacauacuaaccagc

SEQ ID NO: 1658918 - RNA, 11 nt, Human
cacagccucug

SEQ ID NO: 1658919 - RNA, 13 nt, Human
cacagacccugcc

SEQ ID NO: 1658920 - RNA, 23 nt, Human
cacagaaaauggaagacagcucu

SEQ ID NO: 1658921 - RNA, 19 nt, Human
cacagaaaauucuucucca

SEQ ID NO: 1658922 - RNA, 21 nt, Human
cacacaugagcaucaggccag

SEQ ID NO: 1658923 - RNA, 22 nt, Human
cacacaugagcaucaggccagg

SEQ ID NO: 1658924 - RNA, 18 nt, Human
cacagaaaauggaagaca

SEQ ID NO: 1658925 - RNA, 19 nt, Human
cacagaaaauggaagacag

SEQ ID NO: 1658926 - RNA, 20 nt, Human
cacagaaaauggaagacagc

SEQ ID NO: 1658927 - RNA, 22 nt, Human
cacagaaaauggaagacagcuc

SEQ ID NO: 1658928 - RNA, 18 nt, Human
cacacagugagucgagga

SEQ ID NO: 1658929 - RNA, 20 nt, Human
cacacaguauuacuucugcu

SEQ ID NO: 1658930 - RNA, 23 nt, Human
cacacaguauuacuucugcuaca

SEQ ID NO: 1658931 - RNA, 15 nt, Human
cacacauacacacac

SEQ ID NO: 1658932 - RNA, 21 nt, Human
cacacagugagucgaggacag

SEQ ID NO: 1658933 - RNA, 23 nt, Human
cacacagugagucgaggacaggg

SEQ ID NO: 1658934 - RNA, 17 nt, Human
cacacaugaaguccaag

SEQ ID NO: 1658935 - RNA, 20 nt, Human
cacacaugagcaucaggcca

SEQ ID NO: 1658936 - RNA, 22 nt, Human
cacacaugaaguccaagcauuu

SEQ ID NO: 1658937 - RNA, 20 nt, Human
cacaguauuacuucugcuac

SEQ ID NO: 1658938 - RNA, 21 nt, Human
cacaguauuacuucugcuaca

SEQ ID NO: 1658939 - RNA, 19 nt, Human
cacaggggaaaagaggagu

SEQ ID NO: 1658940 - RNA, 17 nt, Human
cacaggggaaaagagga

SEQ ID NO: 1658941 - RNA, 18 nt, Human
cacaggggaaaagaggag

SEQ ID NO: 1658942 - RNA, 23 nt, Human
cacaggcccuuccucuccacugc

SEQ ID NO: 1658943 - RNA, 17 nt, Human
cacagccucuuagaugc

SEQ ID NO: 1658944 - RNA, 21 nt, Human
cacagccucuuagaugcaguu

SEQ ID NO: 1658945 - RNA, 17 nt, Human
cacacagcucuguccug

SEQ ID NO: 1658946 - RNA, 20 nt, Human
cacacagcucuguccuggga

SEQ ID NO: 1658947 - RNA, 15 nt, Human
caaugcuguauuuua

SEQ ID NO: 1658948 - RNA, 20 nt, Human
caauggagacugucucaaga

SEQ ID NO: 1658949 - RNA, 16 nt, Human
caaugcuguauuuuaa

SEQ ID NO: 1658950 - RNA, 17 nt, Human
caaugcuguauuuuaaa

SEQ ID NO: 1658951 - RNA, 11 nt, Human
caauggcagcc

SEQ ID NO: 1658952 - RNA, 12 nt, Human
caauggcagccu

SEQ ID NO: 1658953 - RNA, 15 nt, Human
caauucuugccaaau

SEQ ID NO: 1658954 - RNA, 17 nt, Human
cacaagagcccaggccu

SEQ ID NO: 1658955 - RNA, 17 nt, Human
cacaagcuccaagcucc

SEQ ID NO: 1658956 - RNA, 23 nt, Human
cacaagcuccaagcucccaggca

SEQ ID NO: 1658957 - RNA, 17 nt, Human
cacaagcugcacccuca

SEQ ID NO: 1658958 - RNA, 23 nt, Human
cacaagcugcacccucaggcagg

SEQ ID NO: 1658959 - RNA, 16 nt, Human
cacaagagcccaggcc

SEQ ID NO: 1658960 - RNA, 13 nt, Human
cacaagcuccaag

SEQ ID NO: 1658961 - RNA, 14 nt, Human
cacaagcuccaagc

SEQ ID NO: 1658962 - RNA, 15 nt, Human
cacaagcuccaagcu

SEQ ID NO: 1658963 - RNA, 13 nt, Human
caauuuauuaugg

SEQ ID NO: 1658964 - RNA, 14 nt, Human
cacaagagcccagg

SEQ ID NO: 1658965 - RNA, 18 nt, Human
cacaagacugcacaucaa

SEQ ID NO: 1658966 - RNA, 19 nt, Human
caauaaagcagcguuucua

SEQ ID NO: 1658967 - RNA, 19 nt, Human
caagcucuaucaccaagga

SEQ ID NO: 1658968 - RNA, 13 nt, Human
caagcucugcucc

SEQ ID NO: 1658969 - RNA, 17 nt, Human
caagcuccaagcuccca

SEQ ID NO: 1658970 - RNA, 12 nt, Human
caagcuccaagc

SEQ ID NO: 1658971 - RNA, 20 nt, Human
caagcugcacccucaggcag

SEQ ID NO: 1658972 - RNA, 14 nt, Human
caagcucugcuccu

SEQ ID NO: 1658973 - RNA, 14 nt, Human
caagcugcacccuc

SEQ ID NO: 1658974 - RNA, 18 nt, Human
caagcugcacccucaggc

SEQ ID NO: 1658975 - RNA, 16 nt, Human
caaguaugaauaaaga

SEQ ID NO: 1658976 - RNA, 17 nt, Human
caaggccaaaggaagca

SEQ ID NO: 1658977 - RNA, 18 nt, Human
caaggccaaaggaagcac

SEQ ID NO: 1658978 - RNA, 15 nt, Human
caaggccaaaggaag

SEQ ID NO: 1658979 - RNA, 16 nt, Human
caaggccaaaggaagc

SEQ ID NO: 1658980 - RNA, 19 nt, Human
caaguaugaauaaagacac

SEQ ID NO: 1658981 - RNA, 21 nt, Human
caaguaugaauaaagacaccu

SEQ ID NO: 1658982 - RNA, 13 nt, Human
caagucaagugaa

SEQ ID NO: 1658983 - RNA, 17 nt, Human
caagucaagugaaaaag

SEQ ID NO: 1658984 - RNA, 14 nt, Human
caaguccaagcaua

SEQ ID NO: 1658985 - RNA, 14 nt, Human
caccugccccucaa

SEQ ID NO: 1658986 - RNA, 15 nt, Human
caccugccccucaac

SEQ ID NO: 1658987 - RNA, 16 nt, Human
caccugccccucaacu

SEQ ID NO: 1658988 - RNA, 17 nt, Human
cacccuggggagaaagu

SEQ ID NO: 1658989 - RNA, 14 nt, Human
caccucagccuccc

SEQ ID NO: 1658990 - RNA, 13 nt, Human
caccucagccucc

SEQ ID NO: 1658991 - RNA, 17 nt, Human
cacccugaaagcccuga

SEQ ID NO: 1658992 - RNA, 15 nt, Human
cacccuggggagaaa

SEQ ID NO: 1658993 - RNA, 16 nt, Human
cacccuggggagaaag

SEQ ID NO: 1658994 - RNA, 14 nt, Human
cacccucaggcagg

SEQ ID NO: 1658995 - RNA, 17 nt, Human
caccugccuguugggcc

SEQ ID NO: 1658996 - RNA, 19 nt, Human
caccugccuguugggccag

SEQ ID NO: 1658997 - RNA, 24 nt, Human
caccugccuguugggccaggagcc

SEQ ID NO: 1658998 - RNA, 14 nt, Human
caccuuggcugcag

SEQ ID NO: 1658999 - RNA, 15 nt, Human
caccuuggcucaagu

SEQ ID NO: 1659000 - RNA, 13 nt, Human
caccuuggcugca

SEQ ID NO: 1659001 - RNA, 12 nt, Human
caccccagcccc

SEQ ID NO: 1659002 - RNA, 11 nt, Human
caccccagccc

SEQ ID NO: 1659003 - RNA, 18 nt, Human
cacugggagaaaugaaaa

SEQ ID NO: 1659004 - RNA, 18 nt, Human
cacugcauccuccgccuc

SEQ ID NO: 1659005 - RNA, 14 nt, Human
cacugcauccuccg

SEQ ID NO: 1659006 - RNA, 16 nt, Human
cacugcauccuccgcc

SEQ ID NO: 1659007 - RNA, 16 nt, Human
cacugcauguuuguga

SEQ ID NO: 1659008 - RNA, 13 nt, Human
cacugcagccuca

SEQ ID NO: 1659009 - RNA, 15 nt, Human
cacugcacuccagcc

SEQ ID NO: 1659010 - RNA, 16 nt, Human
cacugcacuccagccu

SEQ ID NO: 1659011 - RNA, 18 nt, Human
cacugcacuccagccugg

SEQ ID NO: 1659012 - RNA, 19 nt, Human
cacugcacuccagccuggg

SEQ ID NO: 1659013 - RNA, 20 nt, Human
cacugcacuccagccugggu

SEQ ID NO: 1659014 - RNA, 12 nt, Human
cacugcagccuc

SEQ ID NO: 1659015 - RNA, 21 nt, Human
cacugcagaagacaguauggc

SEQ ID NO: 1659016 - RNA, 19 nt, Human
cacugcacuauagccuagg

SEQ ID NO: 1659017 - RNA, 22 nt, Human
cacuuguguuuugcaagccaga

SEQ ID NO: 1659018 - RNA, 23 nt, Human
cacuuaggaacguaaucgugucc

SEQ ID NO: 1659019 - RNA, 24 nt, Human
cacuuagaaauugcauuuccugac

SEQ ID NO: 1659020 - RNA, 16 nt, Human
cacuugucaauaaaau

SEQ ID NO: 1659021 - RNA, 19 nt, Human
cacuuguguuuugcaagcc

SEQ ID NO: 1659022 - RNA, 16 nt, Human
cacuuacacuuuaugc

SEQ ID NO: 1659023 - RNA, 18 nt, Human
cacuuacacuuuaugcac

SEQ ID NO: 1659024 - RNA, 23 nt, Human
cacugguggcccgacagccuggc

SEQ ID NO: 1659025 - RNA, 22 nt, Human
cacugguucuucuuggucucag

SEQ ID NO: 1659026 - RNA, 16 nt, Human
cacuccagccugggug

SEQ ID NO: 1659027 - RNA, 17 nt, Human
cacuccaauuaaggauu

SEQ ID NO: 1659028 - RNA, 18 nt, Human
cacuccaauuaaggauuu

SEQ ID NO: 1659029 - RNA, 21 nt, Human
cacuccaauuaaggauuuuau

SEQ ID NO: 1659030 - RNA, 11 nt, Human
cacuccagcug

SEQ ID NO: 1659031 - RNA, 12 nt, Human
cacuccagcugg

SEQ ID NO: 1659032 - RNA, 15 nt, Human
cacuccagcugggau

SEQ ID NO: 1659033 - RNA, 16 nt, Human
cacuccagugagacag

SEQ ID NO: 1659034 - RNA, 13 nt, Human
cacuccaauuaag

SEQ ID NO: 1659035 - RNA, 15 nt, Human
cacuccaauuaagga

SEQ ID NO: 1659036 - RNA, 14 nt, Human
cacuaggcuucugg

SEQ ID NO: 1659037 - RNA, 20 nt, Human
cacuagggcagggacaggau

SEQ ID NO: 1659038 - RNA, 21 nt, Human
cacuagggcagggacaggaua

SEQ ID NO: 1659039 - RNA, 12 nt, Human
cacuccccugcu

SEQ ID NO: 1659040 - RNA, 13 nt, Human
cacuccccugcug

SEQ ID NO: 1659041 - RNA, 14 nt, Human
cacuccccugcugg

SEQ ID NO: 1659042 - RNA, 15 nt, Human
cacuccccugcuggg

SEQ ID NO: 1659043 - RNA, 16 nt, Human
auuugccaauaauaau

SEQ ID NO: 1659044 - RNA, 15 nt, Human
auuugccaauaauaa

SEQ ID NO: 1659045 - RNA, 23 nt, Human
auuuguuugaacugauaaagaug

SEQ ID NO: 1659046 - RNA, 22 nt, Human
auuuguuugaacugauaaagau

SEQ ID NO: 1659047 - RNA, 14 nt, Human
auuuuaugauccag

SEQ ID NO: 1659048 - RNA, 15 nt, Human
auuuuaugauccagc

SEQ ID NO: 1659049 - RNA, 16 nt, Human
auuuuaugauccagca

SEQ ID NO: 1659050 - RNA, 19 nt, Human
auuuuauagcuacuaauuu

SEQ ID NO: 1659051 - RNA, 12 nt, Human
auuuguuugcau

SEQ ID NO: 1659052 - RNA, 14 nt, Human
auuugugccagaau

SEQ ID NO: 1659053 - RNA, 13 nt, Human
auuuggaaaucuu

SEQ ID NO: 1659054 - RNA, 20 nt, Human
auuugugauacaaugcugug

SEQ ID NO: 1659055 - RNA, 11 nt, Human
auuuggaaauc

SEQ ID NO: 1659056 - RNA, 12 nt, Human
auuuggaaaucu

SEQ ID NO: 1659057 - RNA, 17 nt, Human
auuugugauacaaugcu

SEQ ID NO: 1659058 - RNA, 13 nt, Human
auuuggaaaauaa

SEQ ID NO: 1659059 - RNA, 12 nt, Human
auuuggaaaaua

SEQ ID NO: 1659060 - RNA, 13 nt, Human
auuugcuccuuuc

SEQ ID NO: 1659061 - RNA, 14 nt, Human
auuugcucauggaa

SEQ ID NO: 1659062 - RNA, 17 nt, Human
auuugcucauggaauug

SEQ ID NO: 1659063 - RNA, 12 nt, Human
auuuuaugcuuu

SEQ ID NO: 1659064 - RNA, 17 nt, Human
auuuuaugcuuuaaaca

SEQ ID NO: 1659065 - RNA, 20 nt, Human
caaagauauuuugcuuugug

SEQ ID NO: 1659066 - RNA, 21 nt, Human
caaaccaucauugaaaucuuu

SEQ ID NO: 1659067 - RNA, 19 nt, Human
caaaccaucauugaaaucu

SEQ ID NO: 1659068 - RNA, 15 nt, Human
caaacagucucagga

SEQ ID NO: 1659069 - RNA, 18 nt, Human
caaaagaugcuucucacu

SEQ ID NO: 1659070 - RNA, 15 nt, Human
caaaaggcagaagca

SEQ ID NO: 1659071 - RNA, 16 nt, Human
caaaagaugcuucuca

SEQ ID NO: 1659072 - RNA, 20 nt, Human
caaaaaaaaaaaaaaauuag

SEQ ID NO: 1659073 - RNA, 14 nt, Human
caacacuaacauga

SEQ ID NO: 1659074 - RNA, 22 nt, Human
caacacucacauuuauucugcu

SEQ ID NO: 1659075 - RNA, 20 nt, Human
caacaccucugcacaagcug

SEQ ID NO: 1659076 - RNA, 23 nt, Human
caacacgagcaggcuacugucag

SEQ ID NO: 1659077 - RNA, 21 nt, Human
caaauggaaaugggcagagca

SEQ ID NO: 1659078 - RNA, 22 nt, Human
caaauggaaaugggcagagcag

SEQ ID NO: 1659079 - RNA, 20 nt, Human
caaauggaaaugggcagagc

SEQ ID NO: 1659080 - RNA, 15 nt, Human
caaauccuugaagau

SEQ ID NO: 1659081 - RNA, 21 nt, Human
caaagucucuggaauuugaaa

SEQ ID NO: 1659082 - RNA, 14 nt, Human
caaaguagaagucu

SEQ ID NO: 1659083 - RNA, 21 nt, Human
caaaguagaagucuuagaugu

SEQ ID NO: 1659084 - RNA, 13 nt, Human
caaagugcuggga

SEQ ID NO: 1659085 - RNA, 22 nt, Human
caaaguacacuguuucaaacuu

SEQ ID NO: 1659086 - RNA, 15 nt, Human
caaagcagugcaugc

SEQ ID NO: 1659087 - RNA, 17 nt, Human
caaagcagugcaugcug

SEQ ID NO: 1659088 - RNA, 23 nt, Human
caaagauauuuugcuuugugauu

SEQ ID NO: 1659089 - RNA, 22 nt, Human
caaagauauuuugcuuugugau

SEQ ID NO: 1659090 - RNA, 20 nt, Human
caaagcacugacuucuaagu

SEQ ID NO: 1659091 - RNA, 22 nt, Human
caaagcacugacuucuaaguaa

SEQ ID NO: 1659092 - RNA, 23 nt, Human
auuagauuucucauuugccaaua

SEQ ID NO: 1659093 - RNA, 17 nt, Human
auuagcaguuugcuuug

SEQ ID NO: 1659094 - RNA, 12 nt, Human
auuacaguauaa

SEQ ID NO: 1659095 - RNA, 14 nt, Human
auuacaguauaauu

SEQ ID NO: 1659096 - RNA, 15 nt, Human
auuacaguauaauua

SEQ ID NO: 1659097 - RNA, 16 nt, Human
auuacaguauaauuaa

SEQ ID NO: 1659098 - RNA, 19 nt, Human
auuacaguggggaaugaag

SEQ ID NO: 1659099 - RNA, 17 nt, Human
auuacaggaaguacugg

SEQ ID NO: 1659100 - RNA, 22 nt, Human
auuacaagcgugagccacugca

SEQ ID NO: 1659101 - RNA, 23 nt, Human
auguuugggagacugcugaguca

SEQ ID NO: 1659102 - RNA, 18 nt, Human
auguuugccucugccucu

SEQ ID NO: 1659103 - RNA, 16 nt, Human
auucaaauguauuaca

SEQ ID NO: 1659104 - RNA, 18 nt, Human
auucaaugccccugaauu

SEQ ID NO: 1659105 - RNA, 20 nt, Human
auucaaugccccugaauuua

SEQ ID NO: 1659106 - RNA, 19 nt, Human
auucacaagacccaaaagg

SEQ ID NO: 1659107 - RNA, 18 nt, Human
auucaaaguugccuaaau

SEQ ID NO: 1659108 - RNA, 20 nt, Human
auucaaaguugccuaaaucc

SEQ ID NO: 1659109 - RNA, 21 nt, Human
auucaaaguugccuaaaucca

SEQ ID NO: 1659110 - RNA, 22 nt, Human
auucaaaguugccuaaauccau

SEQ ID NO: 1659111 - RNA, 17 nt, Human
auucaaaguugccuaaa

SEQ ID NO: 1659112 - RNA, 23 nt, Human
auuaugcaugaaguaauaugcac

SEQ ID NO: 1659113 - RNA, 18 nt, Human
auuaugaauuacauuugu

SEQ ID NO: 1659114 - RNA, 14 nt, Human
auuaugaaacuugu

SEQ ID NO: 1659115 - RNA, 15 nt, Human
auuaugaaacuugug

SEQ ID NO: 1659116 - RNA, 21 nt, Human
auuaggugugacugaauuucu

SEQ ID NO: 1659117 - RNA, 18 nt, Human
auuaugaaacuuguguaa

SEQ ID NO: 1659118 - RNA, 20 nt, Human
auuaugaaacuuguguaaau

SEQ ID NO: 1659119 - RNA, 21 nt, Human
auuaugaaacuuguguaaaua

SEQ ID NO: 1659120 - RNA, 18 nt, Human
auuaugaaacuuuuggaa

SEQ ID NO: 1659121 - RNA, 14 nt, Human
auuaugaauuacau

SEQ ID NO: 1659122 - RNA, 17 nt, Human
auuaugaauuacauuug

SEQ ID NO: 1659123 - RNA, 18 nt, Human
auuaggugugacugaauu

SEQ ID NO: 1659124 - RNA, 16 nt, Human
auuaggugugacugaa

SEQ ID NO: 1659125 - RNA, 16 nt, Human
auuagggagagaagau

SEQ ID NO: 1659126 - RNA, 14 nt, Human
auucauaaugacuu

SEQ ID NO: 1659127 - RNA, 15 nt, Human
auucauaaugacuua

SEQ ID NO: 1659128 - RNA, 21 nt, Human
auucauaauuauuauuuggcc

SEQ ID NO: 1659129 - RNA, 19 nt, Human
auucauaaugacuuaagca

SEQ ID NO: 1659130 - RNA, 19 nt, Human
auucauagcagcuuauuca

SEQ ID NO: 1659131 - RNA, 22 nt, Human
auucauagcagcuuauucacaa

SEQ ID NO: 1659132 - RNA, 12 nt, Human
auugcuccuuga

SEQ ID NO: 1659133 - RNA, 15 nt, Human
auugcugauggugca

SEQ ID NO: 1659134 - RNA, 16 nt, Human
auugcugauggugcaa

SEQ ID NO: 1659135 - RNA, 18 nt, Human
auugcugauggugcaaug

SEQ ID NO: 1659136 - RNA, 19 nt, Human
auugcugauggugcaauga

SEQ ID NO: 1659137 - RNA, 23 nt, Human
auugcugauggugcaaugaccuu

SEQ ID NO: 1659138 - RNA, 12 nt, Human
auugcugcuuga

SEQ ID NO: 1659139 - RNA, 14 nt, Human
auugcuugagcuca

SEQ ID NO: 1659140 - RNA, 16 nt, Human
auuguuagucucuuga

SEQ ID NO: 1659141 - RNA, 14 nt, Human
auuguaauuauauc

SEQ ID NO: 1659142 - RNA, 21 nt, Human
auugugucucuugguccugcu

SEQ ID NO: 1659143 - RNA, 23 nt, Human
auugugucucuugguccugcugc

SEQ ID NO: 1659144 - RNA, 18 nt, Human
auugcuugagcucaggag

SEQ ID NO: 1659145 - RNA, 14 nt, Human
auuguaaaauggug

SEQ ID NO: 1659146 - RNA, 13 nt, Human
auuguaauuauau

SEQ ID NO: 1659147 - RNA, 20 nt, Human
auugcuacuguccuacccac

SEQ ID NO: 1659148 - RNA, 22 nt, Human
auugcuacuguccuacccaccc

SEQ ID NO: 1659149 - RNA, 17 nt, Human
auugauaugcuuauaca

SEQ ID NO: 1659150 - RNA, 15 nt, Human
auugcuacuguccua

SEQ ID NO: 1659151 - RNA, 21 nt, Human
auugauaagaaccuuuugagu

SEQ ID NO: 1659152 - RNA, 13 nt, Human
auucuuuccugag

SEQ ID NO: 1659153 - RNA, 11 nt, Human
auucuucugcu

SEQ ID NO: 1659154 - RNA, 12 nt, Human
auucuucugcuu

SEQ ID NO: 1659155 - RNA, 11 nt, Human
auucuuuccug

SEQ ID NO: 1659156 - RNA, 14 nt, Human
auucuucugcuuca

SEQ ID NO: 1659157 - RNA, 13 nt, Human
uuguacaaaguau

SEQ ID NO: 1659158 - RNA, 14 nt, Human
uuguacaaaguauu

SEQ ID NO: 1659159 - RNA, 13 nt, Human
uugguugcuuuaa

SEQ ID NO: 1659160 - RNA, 16 nt, Human
uugguugcuuuaauau

SEQ ID NO: 1659161 - RNA, 15 nt, Human
uuguacaaaguauua

SEQ ID NO: 1659162 - RNA, 17 nt, Human
uuguacaaaguauuaag

SEQ ID NO: 1659163 - RNA, 20 nt, Human
uuguacaaaguauuaagcau

SEQ ID NO: 1659164 - RNA, 21 nt, Human
uuguacaaaguauuaagcaua

SEQ ID NO: 1659165 - RNA, 22 nt, Human
uuguacaaaguauuaagcauau

SEQ ID NO: 1659166 - RNA, 16 nt, Human
uuguauaaaauaauuu

SEQ ID NO: 1659167 - RNA, 15 nt, Human
uuguauaaaauaauu

SEQ ID NO: 1659168 - RNA, 17 nt, Human
uuguauaaaauaauuuu

SEQ ID NO: 1659169 - RNA, 23 nt, Human
uuguaguguuggagaagaacuga

SEQ ID NO: 1659170 - RNA, 22 nt, Human
augacacaugcaaggucauuuu

SEQ ID NO: 1659171 - RNA, 14 nt, Human
augacacaugcaag

SEQ ID NO: 1659172 - RNA, 16 nt, Human
uuguaucacaaaucuu

SEQ ID NO: 1659173 - RNA, 14 nt, Human
augacuuacuguac

SEQ ID NO: 1659174 - RNA, 22 nt, Human
augacuuaagcacacuugacau

SEQ ID NO: 1659175 - RNA, 18 nt, Human
augacacgaauauugcug

SEQ ID NO: 1659176 - RNA, 17 nt, Human
augacuuacuguacaug

SEQ ID NO: 1659177 - RNA, 16 nt, Human
augacuuacuguacau

SEQ ID NO: 1659178 - RNA, 16 nt, Human
augacuucauuaauaa

SEQ ID NO: 1659179 - RNA, 11 nt, Human
augacuuugga

SEQ ID NO: 1659180 - RNA, 12 nt, Human
augacuuuggac

SEQ ID NO: 1659181 - RNA, 23 nt, Human
augagaaaucuaaaaaacgaaaa

SEQ ID NO: 1659182 - RNA, 15 nt, Human
augagaaaucuaaaa

SEQ ID NO: 1659183 - RNA, 18 nt, Human
augagaaaucuaaaaaac

SEQ ID NO: 1659184 - RNA, 21 nt, Human
augagaaagguugaagcacca

SEQ ID NO: 1659185 - RNA, 22 nt, Human
augagaaagguugaagcaccaa

SEQ ID NO: 1659186 - RNA, 13 nt, Human
augagagacacac

SEQ ID NO: 1659187 - RNA, 14 nt, Human
augagagacacacu

SEQ ID NO: 1659188 - RNA, 17 nt, Human
augagagacacacugaa

SEQ ID NO: 1659189 - RNA, 19 nt, Human
augagagacacacugaaga

SEQ ID NO: 1659190 - RNA, 20 nt, Human
augaaugucagugugacuga

SEQ ID NO: 1659191 - RNA, 16 nt, Human
augaagauacugaaau

SEQ ID NO: 1659192 - RNA, 17 nt, Human
augaagauacugaaaua

SEQ ID NO: 1659193 - RNA, 18 nt, Human
augaagauguagaggaga

SEQ ID NO: 1659194 - RNA, 13 nt, Human
augaaugaauggc

SEQ ID NO: 1659195 - RNA, 15 nt, Human
augaagauacugaaa

SEQ ID NO: 1659196 - RNA, 13 nt, Human
augaaauauuaug

SEQ ID NO: 1659197 - RNA, 17 nt, Human
augaaauauuauguuaa

SEQ ID NO: 1659198 - RNA, 15 nt, Human
augaaagggcccaga

SEQ ID NO: 1659199 - RNA, 18 nt, Human
augaaauauuauguuaaa

SEQ ID NO: 1659200 - RNA, 15 nt, Human
uuggggauucuuaaa

SEQ ID NO: 1659201 - RNA, 22 nt, Human
uuggggggcugaggugggagga

SEQ ID NO: 1659202 - RNA, 18 nt, Human
uugggccccagaggcugg

SEQ ID NO: 1659203 - RNA, 13 nt, Human
uuggggauucuua

SEQ ID NO: 1659204 - RNA, 14 nt, Human
uuggggauauuuuu

SEQ ID NO: 1659205 - RNA, 15 nt, Human
augaauuaaguuuuu

SEQ ID NO: 1659206 - RNA, 18 nt, Human
uuggcuagagguucaaag

SEQ ID NO: 1659207 - RNA, 23 nt, Human
uuggcgcugccccuggcagcccc

SEQ ID NO: 1659208 - RNA, 15 nt, Human
uuggauaauaaggaa

SEQ ID NO: 1659209 - RNA, 19 nt, Human
uuggauaauaaggaaaagu

SEQ ID NO: 1659210 - RNA, 21 nt, Human
uuggauaauaaggaaaaguuu

SEQ ID NO: 1659211 - RNA, 16 nt, Human
aucuuuaauuuuacau

SEQ ID NO: 1659212 - RNA, 21 nt, Human
aucuuuaauuuuacauuuccu

SEQ ID NO: 1659213 - RNA, 22 nt, Human
aucuuuaauuuuacauuuccua

SEQ ID NO: 1659214 - RNA, 13 nt, Human
uuggcugcaggga

SEQ ID NO: 1659215 - RNA, 13 nt, Human
aucuuuuuauuca

SEQ ID NO: 1659216 - RNA, 13 nt, Human
aucuuuuucuaac

SEQ ID NO: 1659217 - RNA, 12 nt, Human
augaaagauuca

SEQ ID NO: 1659218 - RNA, 15 nt, Human
augaaagcagggacu

SEQ ID NO: 1659219 - RNA, 18 nt, Human
aucuugaauuguaaggaa

SEQ ID NO: 1659220 - RNA, 19 nt, Human
aucuugcucugcugacaga

SEQ ID NO: 1659221 - RNA, 13 nt, Human
aucugugaacuug

SEQ ID NO: 1659222 - RNA, 17 nt, Human
aucugugaacuugaaau

SEQ ID NO: 1659223 - RNA, 18 nt, Human
aucugugaacuugaaauu

SEQ ID NO: 1659224 - RNA, 19 nt, Human
aucugugaacuugaaauuu

SEQ ID NO: 1659225 - RNA, 14 nt, Human
aucugccuaaggac

SEQ ID NO: 1659226 - RNA, 15 nt, Human
aucugccuaaggacu

SEQ ID NO: 1659227 - RNA, 16 nt, Human
aucugccuaaggacuu

SEQ ID NO: 1659228 - RNA, 17 nt, Human
aucugccuaaggacuuc

SEQ ID NO: 1659229 - RNA, 13 nt, Human
aucugccuaagga

SEQ ID NO: 1659230 - RNA, 18 nt, Human
aucugccuaaggacuucu

SEQ ID NO: 1659231 - RNA, 19 nt, Human
aucugccuaaggacuucuu

SEQ ID NO: 1659232 - RNA, 20 nt, Human
aucugccuaaggacuucuuu

SEQ ID NO: 1659233 - RNA, 19 nt, Human
aucuggguucacugcaacc

SEQ ID NO: 1659234 - RNA, 15 nt, Human
aucugaggaauucug

SEQ ID NO: 1659235 - RNA, 16 nt, Human
aucugaggaauucugu

SEQ ID NO: 1659236 - RNA, 17 nt, Human
aucugaggaauucugua

SEQ ID NO: 1659237 - RNA, 18 nt, Human
aucugaggaauucuguau

SEQ ID NO: 1659238 - RNA, 20 nt, Human
aucugaggaauucuguauag

SEQ ID NO: 1659239 - RNA, 21 nt, Human
aucugaggaauucuguauaga

SEQ ID NO: 1659240 - RNA, 18 nt, Human
aucugaugcaagcaagaa

SEQ ID NO: 1659241 - RNA, 13 nt, Human
uugccuaaaucca

SEQ ID NO: 1659242 - RNA, 14 nt, Human
uugccuaaauccau

SEQ ID NO: 1659243 - RNA, 15 nt, Human
uugccuaaauccauu

SEQ ID NO: 1659244 - RNA, 22 nt, Human
uugccuaaauccauuuggaaau

SEQ ID NO: 1659245 - RNA, 14 nt, Human
uugccguuauuaaa

SEQ ID NO: 1659246 - RNA, 19 nt, Human
uugccgucuaccugagggg

SEQ ID NO: 1659247 - RNA, 15 nt, Human
uugccgucuaccuga

SEQ ID NO: 1659248 - RNA, 18 nt, Human
uugccgucuaccugaggg

SEQ ID NO: 1659249 - RNA, 13 nt, Human
uugccgucuaccu

SEQ ID NO: 1659250 - RNA, 13 nt, Human
uugcccuguuaaa

SEQ ID NO: 1659251 - RNA, 14 nt, Human
uugcaucugaaaau

SEQ ID NO: 1659252 - RNA, 14 nt, Human
uugcaccacugcac

SEQ ID NO: 1659253 - RNA, 12 nt, Human
uugcaugaggcu

SEQ ID NO: 1659254 - RNA, 15 nt, Human
uugauucagacagcu

SEQ ID NO: 1659255 - RNA, 16 nt, Human
uugauucagacagcug

SEQ ID NO: 1659256 - RNA, 19 nt, Human
aucucuucuggguuccuuc

SEQ ID NO: 1659257 - RNA, 12 nt, Human
uugaugccuggc

SEQ ID NO: 1659258 - RNA, 15 nt, Human
uugaugggauuuggu

SEQ ID NO: 1659259 - RNA, 18 nt, Human
uugauggugguauguuuu

SEQ ID NO: 1659260 - RNA, 23 nt, Human
uugauggugaugaaauguaaaua

SEQ ID NO: 1659261 - RNA, 19 nt, Human
uugauggugguauguuuuc

SEQ ID NO: 1659262 - RNA, 14 nt, Human
uugauucagacagc

SEQ ID NO: 1659263 - RNA, 11 nt, Human
aucucagccca

SEQ ID NO: 1659264 - RNA, 20 nt, Human
aucucaccuccugcugggca

SEQ ID NO: 1659265 - RNA, 21 nt, Human
aucucaccuccugcugggcag

SEQ ID NO: 1659266 - RNA, 14 nt, Human
aucucagggccugg

SEQ ID NO: 1659267 - RNA, 15 nt, Human
auccuaguuccacca

SEQ ID NO: 1659268 - RNA, 19 nt, Human
auccuaguuccaccaucaa

SEQ ID NO: 1659269 - RNA, 17 nt, Human
aucucaccuccugcugg

SEQ ID NO: 1659270 - RNA, 16 nt, Human
aucucacacaugagca

SEQ ID NO: 1659271 - RNA, 15 nt, Human
aucucacacaugagc

SEQ ID NO: 1659272 - RNA, 13 nt, Human
aucucaauauuuc

SEQ ID NO: 1659273 - RNA, 16 nt, Human
aucuccccaucauugg

SEQ ID NO: 1659274 - RNA, 14 nt, Human
aucucccccagccc

SEQ ID NO: 1659275 - RNA, 12 nt, Human
aucucccccagc

SEQ ID NO: 1659276 - RNA, 13 nt, Human
aucucccccagcc

SEQ ID NO: 1659277 - RNA, 13 nt, Human
aucuccaaaauaa

SEQ ID NO: 1659278 - RNA, 15 nt, Human
aucuccacuccagau

SEQ ID NO: 1659279 - RNA, 23 nt, Human
aucucauuuccaagcaaguauua

SEQ ID NO: 1659280 - RNA, 21 nt, Human
aucucauuuccaagcaaguau

SEQ ID NO: 1659281 - RNA, 14 nt, Human
uuuagucuugucuc

SEQ ID NO: 1659282 - RNA, 16 nt, Human
uuuaguaucuuuuuau

SEQ ID NO: 1659283 - RNA, 22 nt, Human
uuuagcuggaaaaguauguuag

SEQ ID NO: 1659284 - RNA, 20 nt, Human
uuuagcuggaaaaguauguu

SEQ ID NO: 1659285 - RNA, 22 nt, Human
uuuauuacaguauaauuaacau

SEQ ID NO: 1659286 - RNA, 24 nt, Human
uuuauggcuuuugugcauuaucua

SEQ ID NO: 1659287 - RNA, 13 nt, Human
uuuauauaagcuu

SEQ ID NO: 1659288 - RNA, 20 nt, Human
uuuauggcuuuugugcauua

SEQ ID NO: 1659289 - RNA, 11 nt, Human
auggaacacuc

SEQ ID NO: 1659290 - RNA, 14 nt, Human
auggaacacucuga

SEQ ID NO: 1659291 - RNA, 15 nt, Human
auggaacacucugag

SEQ ID NO: 1659292 - RNA, 16 nt, Human
auggaacacucugaga

SEQ ID NO: 1659293 - RNA, 15 nt, Human
auggaagacagcucu

SEQ ID NO: 1659294 - RNA, 19 nt, Human
augcugucccuuacgugag

SEQ ID NO: 1659295 - RNA, 23 nt, Human
augcugucccuuacgugaguccu

SEQ ID NO: 1659296 - RNA, 22 nt, Human
augcugucuacacuaagagaga

SEQ ID NO: 1659297 - RNA, 15 nt, Human
augcucugcauguua

SEQ ID NO: 1659298 - RNA, 21 nt, Human
augcuggcauagagcagcacu

SEQ ID NO: 1659299 - RNA, 22 nt, Human
augcuguaacuuucugaaauaa

SEQ ID NO: 1659300 - RNA, 16 nt, Human
uuuauuacuguaagaa

SEQ ID NO: 1659301 - RNA, 16 nt, Human
augcuagaacucccuu

SEQ ID NO: 1659302 - RNA, 19 nt, Human
augcuagaacucccuuuca

SEQ ID NO: 1659303 - RNA, 23 nt, Human
uuuauuacaguauaauuaacaug

SEQ ID NO: 1659304 - RNA, 15 nt, Human
augcuagaacucccu

SEQ ID NO: 1659305 - RNA, 19 nt, Human
auggcaaggacugcaggga

SEQ ID NO: 1659306 - RNA, 22 nt, Human
auggcacaaucucggcucacug

SEQ ID NO: 1659307 - RNA, 23 nt, Human
auggcacaucagcacgauuucug

SEQ ID NO: 1659308 - RNA, 17 nt, Human
auggcacaucagcacga

SEQ ID NO: 1659309 - RNA, 19 nt, Human
auggacuaacuugucuuug

SEQ ID NO: 1659310 - RNA, 19 nt, Human
auggacguguuaugacucc

SEQ ID NO: 1659311 - RNA, 20 nt, Human
auggacguguuaugacucca

SEQ ID NO: 1659312 - RNA, 18 nt, Human
auggauuuccagccaaag

SEQ ID NO: 1659313 - RNA, 23 nt, Human
auggacguguuaugacuccagaa

SEQ ID NO: 1659314 - RNA, 22 nt, Human
auggccagguggccacuccaga

SEQ ID NO: 1659315 - RNA, 16 nt, Human
auggccagguggccac

SEQ ID NO: 1659316 - RNA, 21 nt, Human
auggccgggcgcgguggcuca

SEQ ID NO: 1659317 - RNA, 20 nt, Human
auggccuuugcuugaaagaa

SEQ ID NO: 1659318 - RNA, 20 nt, Human
auggcuaguaucaaaagaaa

SEQ ID NO: 1659319 - RNA, 19 nt, Human
auggacaugaucuucuuua

SEQ ID NO: 1659320 - RNA, 14 nt, Human
auggacaugaucuu

SEQ ID NO: 1659321 - RNA, 20 nt, Human
uuucacugcuggcugccuua

SEQ ID NO: 1659322 - RNA, 22 nt, Human
uuucacugcuggcugccuuaga

SEQ ID NO: 1659323 - RNA, 17 nt, Human
uuucacugcuggcugcc

SEQ ID NO: 1659324 - RNA, 18 nt, Human
uuucacugcuggcugccu

SEQ ID NO: 1659325 - RNA, 14 nt, Human
uuucacugcuggcu

SEQ ID NO: 1659326 - RNA, 16 nt, Human
auggaauacucuuaua

SEQ ID NO: 1659327 - RNA, 16 nt, Human
auggaagacagcucuu

SEQ ID NO: 1659328 - RNA, 17 nt, Human
auggaauacucuuauau

SEQ ID NO: 1659329 - RNA, 13 nt, Human
uuucauauuuuag

SEQ ID NO: 1659330 - RNA, 21 nt, Human
uuucauauuuuagcuacuaua

SEQ ID NO: 1659331 - RNA, 18 nt, Human
augcaguucugaagaaga

SEQ ID NO: 1659332 - RNA, 19 nt, Human
augcaguucugaagaagau

SEQ ID NO: 1659333 - RNA, 14 nt, Human
augccaaguuguuu

SEQ ID NO: 1659334 - RNA, 16 nt, Human
augccaaguuguuuga

SEQ ID NO: 1659335 - RNA, 11 nt, Human
augcccagccc

SEQ ID NO: 1659336 - RNA, 15 nt, Human
augccacuaaauuga

SEQ ID NO: 1659337 - RNA, 17 nt, Human
augccacuaaauugaca

SEQ ID NO: 1659338 - RNA, 23 nt, Human
augccaaguuguuugagaaauua

SEQ ID NO: 1659339 - RNA, 17 nt, Human
augcagccucacagucc

SEQ ID NO: 1659340 - RNA, 14 nt, Human
augcagccucacag

SEQ ID NO: 1659341 - RNA, 15 nt, Human
augcagccucacagu

SEQ ID NO: 1659342 - RNA, 14 nt, Human
uuuaauuuuggaau

SEQ ID NO: 1659343 - RNA, 15 nt, Human
uuuaauuuuggaauu

SEQ ID NO: 1659344 - RNA, 17 nt, Human
uuuaauuuuggaauuuu

SEQ ID NO: 1659345 - RNA, 19 nt, Human
uuuaauuuuuuugagacag

SEQ ID NO: 1659346 - RNA, 13 nt, Human
augcagccucaca

SEQ ID NO: 1659347 - RNA, 15 nt, Human
augcaguucugaaga

SEQ ID NO: 1659348 - RNA, 17 nt, Human
augcaguucugaagaag

SEQ ID NO: 1659349 - RNA, 12 nt, Human
uuuaauuuuaca

SEQ ID NO: 1659350 - RNA, 16 nt, Human
uuuaagugcugcauuu

SEQ ID NO: 1659351 - RNA, 15 nt, Human
uuuaagugcugcauu

SEQ ID NO: 1659352 - RNA, 19 nt, Human
uuuaagugcugcauuuaaa

SEQ ID NO: 1659353 - RNA, 17 nt, Human
uuuaagugcugcauuua

SEQ ID NO: 1659354 - RNA, 16 nt, Human
augcacuuuguucugg

SEQ ID NO: 1659355 - RNA, 15 nt, Human
augcacuuuguucug

SEQ ID NO: 1659356 - RNA, 13 nt, Human
uuguuuucagugu

SEQ ID NO: 1659357 - RNA, 16 nt, Human
uuguuuucaguguaca

SEQ ID NO: 1659358 - RNA, 14 nt, Human
uuuaaauguuuuuu

SEQ ID NO: 1659359 - RNA, 15 nt, Human
uuguuuuacugucuu

SEQ ID NO: 1659360 - RNA, 14 nt, Human
uuguuuucauuauc

SEQ ID NO: 1659361 - RNA, 15 nt, Human
augcaaagcacugac

SEQ ID NO: 1659362 - RNA, 12 nt, Human
augauuucuaug

SEQ ID NO: 1659363 - RNA, 13 nt, Human
augauuucuaugc

SEQ ID NO: 1659364 - RNA, 16 nt, Human
augauuucuaugcuga

SEQ ID NO: 1659365 - RNA, 19 nt, Human
augauuucagcucacugca

SEQ ID NO: 1659366 - RNA, 13 nt, Human
augcaccagcccu

SEQ ID NO: 1659367 - RNA, 14 nt, Human
augcaccagcccuu

SEQ ID NO: 1659368 - RNA, 12 nt, Human
augcacuuuguu

SEQ ID NO: 1659369 - RNA, 21 nt, Human
augauucaaaugucuauaaac

SEQ ID NO: 1659370 - RNA, 21 nt, Human
augauucaacagguuuuccug

SEQ ID NO: 1659371 - RNA, 17 nt, Human
augauuucagcucacug

SEQ ID NO: 1659372 - RNA, 12 nt, Human
augauucccagc

SEQ ID NO: 1659373 - RNA, 15 nt, Human
uuguugucugcaacu

SEQ ID NO: 1659374 - RNA, 19 nt, Human
augauuaaccacuucagcu

SEQ ID NO: 1659375 - RNA, 20 nt, Human
augauuaaccacuucagcug

SEQ ID NO: 1659376 - RNA, 21 nt, Human
augauuaaccacuucagcuga

SEQ ID NO: 1659377 - RNA, 22 nt, Human
augauuaugaauuacauuugua

SEQ ID NO: 1659378 - RNA, 18 nt, Human
uugugauacaaugcugug

SEQ ID NO: 1659379 - RNA, 19 nt, Human
uugugauacaaugcugugc

SEQ ID NO: 1659380 - RNA, 21 nt, Human
uugugaggaagccgcuggggc

SEQ ID NO: 1659381 - RNA, 20 nt, Human
augagagacacacugaagaa

SEQ ID NO: 1659382 - RNA, 21 nt, Human
augagagacacacugaagaag

SEQ ID NO: 1659383 - RNA, 23 nt, Human
augagagacacacugaagaagca

SEQ ID NO: 1659384 - RNA, 13 nt, Human
uugugguuaaucu

SEQ ID NO: 1659385 - RNA, 19 nt, Human
uuguguaaauacaauuuug

SEQ ID NO: 1659386 - RNA, 23 nt, Human
uugugugaaagguacuucaaauc

SEQ ID NO: 1659387 - RNA, 20 nt, Human
uuguucuggcucuuccaggc

SEQ ID NO: 1659388 - RNA, 22 nt, Human
uuguucuggcucuuccaggcug

SEQ ID NO: 1659389 - RNA, 17 nt, Human
uuguguguuuauuguca

SEQ ID NO: 1659390 - RNA, 19 nt, Human
uuguucuggcucuuccagg

SEQ ID NO: 1659391 - RNA, 15 nt, Human
auauuuuacauaaau

SEQ ID NO: 1659392 - RNA, 16 nt, Human
auauuuuacauaaauu

SEQ ID NO: 1659393 - RNA, 20 nt, Human
auauuuuacauaaauuuagu

SEQ ID NO: 1659394 - RNA, 14 nt, Human
uuccccuguucacu

SEQ ID NO: 1659395 - RNA, 17 nt, Human
uuccccuguucacucua

SEQ ID NO: 1659396 - RNA, 22 nt, Human
uuccccuuccuaauuccacagc

SEQ ID NO: 1659397 - RNA, 14 nt, Human
uucccuacuuccug

SEQ ID NO: 1659398 - RNA, 16 nt, Human
uucccuacuuccugug

SEQ ID NO: 1659399 - RNA, 17 nt, Human
uucccuacuuccuguga

SEQ ID NO: 1659400 - RNA, 15 nt, Human
uucccuauuagagaa

SEQ ID NO: 1659401 - RNA, 18 nt, Human
uucccuuuuuuggcugcu

SEQ ID NO: 1659402 - RNA, 19 nt, Human
uucccuuuuuuggcugcug

SEQ ID NO: 1659403 - RNA, 20 nt, Human
uucccuuuuuuggcugcuga

SEQ ID NO: 1659404 - RNA, 13 nt, Human
uuccucuccacug

SEQ ID NO: 1659405 - RNA, 14 nt, Human
uuccucuccacugc

SEQ ID NO: 1659406 - RNA, 15 nt, Human
uuccucuccacugcc

SEQ ID NO: 1659407 - RNA, 16 nt, Human
uuccucuccacugccu

SEQ ID NO: 1659408 - RNA, 12 nt, Human
uuccucuccacu

SEQ ID NO: 1659409 - RNA, 20 nt, Human
uuccuucaaagcaaaugucu

SEQ ID NO: 1659410 - RNA, 17 nt, Human
auauuuucauucuccua

SEQ ID NO: 1659411 - RNA, 22 nt, Human
aucaaguuggcuucuaaucaaa

SEQ ID NO: 1659412 - RNA, 23 nt, Human
aucaaguuggcuucuaaucaaag

SEQ ID NO: 1659413 - RNA, 14 nt, Human
aucaaguuauuuuu

SEQ ID NO: 1659414 - RNA, 22 nt, Human
aucaaccccuucgcuccugugu

SEQ ID NO: 1659415 - RNA, 19 nt, Human
aucaaccccuucgcuccug

SEQ ID NO: 1659416 - RNA, 20 nt, Human
aucaaccccuucgcuccugu

SEQ ID NO: 1659417 - RNA, 16 nt, Human
auauuuuuauauuuac

SEQ ID NO: 1659418 - RNA, 20 nt, Human
aucaaauaugcaaagcacug

SEQ ID NO: 1659419 - RNA, 19 nt, Human
aucagacuaugaaguuuuu

SEQ ID NO: 1659420 - RNA, 13 nt, Human
aucagacagaucu

SEQ ID NO: 1659421 - RNA, 13 nt, Human
aucaggccaggcc

SEQ ID NO: 1659422 - RNA, 14 nt, Human
aucaggccaggccc

SEQ ID NO: 1659423 - RNA, 13 nt, Human
uucucagcuccca

SEQ ID NO: 1659424 - RNA, 13 nt, Human
uucucagaaucuc

SEQ ID NO: 1659425 - RNA, 14 nt, Human
aucacuuuuuucca

SEQ ID NO: 1659426 - RNA, 21 nt, Human
uucuaaguaaaaccacagcag

SEQ ID NO: 1659427 - RNA, 21 nt, Human
uucucacugccaugccagcuu

SEQ ID NO: 1659428 - RNA, 18 nt, Human
uucucagaaggcaaauga

SEQ ID NO: 1659429 - RNA, 19 nt, Human
uucucagaaggcaaaugac

SEQ ID NO: 1659430 - RNA, 21 nt, Human
uucucagaaggcaaaugacuu

SEQ ID NO: 1659431 - RNA, 22 nt, Human
uucucagaaggcaaaugacuuu

SEQ ID NO: 1659432 - RNA, 14 nt, Human
uucuauaauuuaaa

SEQ ID NO: 1659433 - RNA, 13 nt, Human
uucuauaauuuaa

SEQ ID NO: 1659434 - RNA, 21 nt, Human
uucgcaggauucuuccucccu

SEQ ID NO: 1659435 - RNA, 20 nt, Human
uucgauacaccgggccugga

SEQ ID NO: 1659436 - RNA, 15 nt, Human
aucaauaaaaaauua

SEQ ID NO: 1659437 - RNA, 17 nt, Human
aucaauaaaaaauuaug

SEQ ID NO: 1659438 - RNA, 18 nt, Human
aucaauaaaaaauuauga

SEQ ID NO: 1659439 - RNA, 13 nt, Human
uucuaagaaguga

SEQ ID NO: 1659440 - RNA, 17 nt, Human
uucuaaguaaaaccaca

SEQ ID NO: 1659441 - RNA, 19 nt, Human
uucuaaguaaaaccacagc

SEQ ID NO: 1659442 - RNA, 20 nt, Human
uucuaaguaaaaccacagca

SEQ ID NO: 1659443 - RNA, 15 nt, Human
uucuaaaguaaaaac

SEQ ID NO: 1659444 - RNA, 13 nt, Human
uucgcuccugugu

SEQ ID NO: 1659445 - RNA, 19 nt, Human
uucuaaaucuccaaaauaa

SEQ ID NO: 1659446 - RNA, 13 nt, Human
uucuguacuuuuu

SEQ ID NO: 1659447 - RNA, 22 nt, Human
uucugguugaugccugugaacu

SEQ ID NO: 1659448 - RNA, 18 nt, Human
uucuguacuuuuuggcau

SEQ ID NO: 1659449 - RNA, 19 nt, Human
uucuguacuuuuuggcaua

SEQ ID NO: 1659450 - RNA, 20 nt, Human
uucuggcuaugcauuugaaa

SEQ ID NO: 1659451 - RNA, 18 nt, Human
uucuggcuaugcauuuga

SEQ ID NO: 1659452 - RNA, 14 nt, Human
uucugccgcagccc

SEQ ID NO: 1659453 - RNA, 15 nt, Human
uucugccgcagcccu

SEQ ID NO: 1659454 - RNA, 16 nt, Human
uucugccgcagcccug

SEQ ID NO: 1659455 - RNA, 15 nt, Human
uucuggcucuuccag

SEQ ID NO: 1659456 - RNA, 20 nt, Human
uucuggugugaacuaaacuu

SEQ ID NO: 1659457 - RNA, 21 nt, Human
uucuggugugaacuaaacuuu

SEQ ID NO: 1659458 - RNA, 20 nt, Human
auccaguuuuguuuggacca

SEQ ID NO: 1659459 - RNA, 21 nt, Human
auccaguuuuguuuggaccaa

SEQ ID NO: 1659460 - RNA, 18 nt, Human
auccaguuuuguuuggac

SEQ ID NO: 1659461 - RNA, 17 nt, Human
auccauuuggaaaucuu

SEQ ID NO: 1659462 - RNA, 19 nt, Human
auccauuuggaaaucuuua

SEQ ID NO: 1659463 - RNA, 13 nt, Human
auccauuuggaaa

SEQ ID NO: 1659464 - RNA, 15 nt, Human
aucccaccaacccuc

SEQ ID NO: 1659465 - RNA, 20 nt, Human
auccauuuggaaaucuuuaa

SEQ ID NO: 1659466 - RNA, 14 nt, Human
auccauacauuugu

SEQ ID NO: 1659467 - RNA, 16 nt, Human
uucucuuuucaaaaca

SEQ ID NO: 1659468 - RNA, 17 nt, Human
uucucuacucuagggaa

SEQ ID NO: 1659469 - RNA, 19 nt, Human
uucugcagccacuauuguu

SEQ ID NO: 1659470 - RNA, 13 nt, Human
uucugccgcagcc

SEQ ID NO: 1659471 - RNA, 15 nt, Human
uucugcacacagcac

SEQ ID NO: 1659472 - RNA, 16 nt, Human
uucugacccaugcugc

SEQ ID NO: 1659473 - RNA, 14 nt, Human
uucugacccaugcu

SEQ ID NO: 1659474 - RNA, 21 nt, Human
aucauugaaaucuuuuugcuu

SEQ ID NO: 1659475 - RNA, 21 nt, Human
aucaggccaggcccucugccc

SEQ ID NO: 1659476 - RNA, 22 nt, Human
aucaggccaggcccucugccca

SEQ ID NO: 1659477 - RNA, 23 nt, Human
aucaggccaggcccucugcccac

SEQ ID NO: 1659478 - RNA, 12 nt, Human
uucuccugccuc

SEQ ID NO: 1659479 - RNA, 13 nt, Human
uucuccugccuca

SEQ ID NO: 1659480 - RNA, 14 nt, Human
uucuccugccucag

SEQ ID NO: 1659481 - RNA, 20 nt, Human
aucauuucugcaucagcugc

SEQ ID NO: 1659482 - RNA, 13 nt, Human
uucuugcaaagua

SEQ ID NO: 1659483 - RNA, 12 nt, Human
uucuugcaaagu

SEQ ID NO: 1659484 - RNA, 13 nt, Human
uucuuucuuccuc

SEQ ID NO: 1659485 - RNA, 15 nt, Human
uucuuucuuccucug

SEQ ID NO: 1659486 - RNA, 22 nt, Human
uucuuucuggcuaugcauuuga

SEQ ID NO: 1659487 - RNA, 11 nt, Human
uucuuccucug

SEQ ID NO: 1659488 - RNA, 12 nt, Human
uucuuccucugc

SEQ ID NO: 1659489 - RNA, 13 nt, Human
uucuuccucugcu

SEQ ID NO: 1659490 - RNA, 23 nt, Human
uucuuccucccucccucuuuccc

SEQ ID NO: 1659491 - RNA, 13 nt, Human
uucuuaauucuua

SEQ ID NO: 1659492 - RNA, 15 nt, Human
uucuguugcugccuc

SEQ ID NO: 1659493 - RNA, 16 nt, Human
uucuguugcugccuca

SEQ ID NO: 1659494 - RNA, 18 nt, Human
uucuguucuuucuggcua

SEQ ID NO: 1659495 - RNA, 17 nt, Human
uucuguugcugccucau

SEQ ID NO: 1659496 - RNA, 21 nt, Human
uucuguuggccagugugacaa

SEQ ID NO: 1659497 - RNA, 20 nt, Human
uucuguuuuucuaggccugg

SEQ ID NO: 1659498 - RNA, 16 nt, Human
uugaaaguuuacagga

SEQ ID NO: 1659499 - RNA, 21 nt, Human
uugaaauuuuuauuaaauuau

SEQ ID NO: 1659500 - RNA, 11 nt, Human
uugaaaucuuu

SEQ ID NO: 1659501 - RNA, 20 nt, Human
uugaaauauaggaacuuaaa

SEQ ID NO: 1659502 - RNA, 19 nt, Human
uugaaauauugacuuuuua

SEQ ID NO: 1659503 - RNA, 18 nt, Human
uugaacccgggaggcaga

SEQ ID NO: 1659504 - RNA, 12 nt, Human
auccuaaugaau

SEQ ID NO: 1659505 - RNA, 13 nt, Human
auccuaaugaaug

SEQ ID NO: 1659506 - RNA, 14 nt, Human
auccuacaagacac

SEQ ID NO: 1659507 - RNA, 19 nt, Human
auccuaaugaaugcauaaa

SEQ ID NO: 1659508 - RNA, 21 nt, Human
auccuaggcauuugcugaaua

SEQ ID NO: 1659509 - RNA, 13 nt, Human
auccuaguuccac

SEQ ID NO: 1659510 - RNA, 22 nt, Human
auagcuuuucccuuuuuuuaag

SEQ ID NO: 1659511 - RNA, 15 nt, Human
auagcuuuuuucucu

SEQ ID NO: 1659512 - RNA, 12 nt, Human
auaggaaaaacu

SEQ ID NO: 1659513 - RNA, 14 nt, Human
auaggaaaaacuga

SEQ ID NO: 1659514 - RNA, 16 nt, Human
auaggaaaaacugauu

SEQ ID NO: 1659515 - RNA, 17 nt, Human
auaggaaaaacugauuu

SEQ ID NO: 1659516 - RNA, 17 nt, Human
auaggcguaacuaauuu

SEQ ID NO: 1659517 - RNA, 20 nt, Human
uucacagaugggugcuugga

SEQ ID NO: 1659518 - RNA, 15 nt, Human
uucacaguucucucc

SEQ ID NO: 1659519 - RNA, 20 nt, Human
uucacaguucucuccuucuu

SEQ ID NO: 1659520 - RNA, 17 nt, Human
uucaagugauucucaug

SEQ ID NO: 1659521 - RNA, 23 nt, Human
uucacaagacccaaaaggcagaa

SEQ ID NO: 1659522 - RNA, 21 nt, Human
uucaagcgauucuucugcuuc

SEQ ID NO: 1659523 - RNA, 21 nt, Human
uucaaaauuguuacaaauugu

SEQ ID NO: 1659524 - RNA, 17 nt, Human
uucaaaauaaaaaugag

SEQ ID NO: 1659525 - RNA, 14 nt, Human
uucaaacauauaua

SEQ ID NO: 1659526 - RNA, 18 nt, Human
uucaaacagucucaggaa

SEQ ID NO: 1659527 - RNA, 13 nt, Human
uuauuuuuuucug

SEQ ID NO: 1659528 - RNA, 17 nt, Human
uuauuuuuuucugaauu

SEQ ID NO: 1659529 - RNA, 18 nt, Human
uuauuuuuagacagaguc

SEQ ID NO: 1659530 - RNA, 17 nt, Human
uuauuuuuagacagagu

SEQ ID NO: 1659531 - RNA, 15 nt, Human
uucacuuacagcacc

SEQ ID NO: 1659532 - RNA, 21 nt, Human
auauauauuuuuuucugaaau

SEQ ID NO: 1659533 - RNA, 12 nt, Human
auauauaaccag

SEQ ID NO: 1659534 - RNA, 13 nt, Human
auauauaaccagu

SEQ ID NO: 1659535 - RNA, 14 nt, Human
auauauaacaaugc

SEQ ID NO: 1659536 - RNA, 22 nt, Human
auaguuaagcgugcauaaguua

SEQ ID NO: 1659537 - RNA, 22 nt, Human
auaguuggcuaggaccccucca

SEQ ID NO: 1659538 - RNA, 20 nt, Human
auaguuguaccgcaauguga

SEQ ID NO: 1659539 - RNA, 15 nt, Human
auaguggugugauuu

SEQ ID NO: 1659540 - RNA, 17 nt, Human
auaguggcuuaaaacaa

SEQ ID NO: 1659541 - RNA, 21 nt, Human
auagugaggcaucgcaaugua

SEQ ID NO: 1659542 - RNA, 13 nt, Human
auagucuggcugu

SEQ ID NO: 1659543 - RNA, 15 nt, Human
auauguggaguucau

SEQ ID NO: 1659544 - RNA, 16 nt, Human
auauguggaguucauc

SEQ ID NO: 1659545 - RNA, 18 nt, Human
uucauuuaggugaggaag

SEQ ID NO: 1659546 - RNA, 15 nt, Human
uuccaaggguacuaa

SEQ ID NO: 1659547 - RNA, 17 nt, Human
uuccaaggguacuaagg

SEQ ID NO: 1659548 - RNA, 17 nt, Human
uuccaggggugggacac

SEQ ID NO: 1659549 - RNA, 22 nt, Human
uuccacaagagcccaggccucc

SEQ ID NO: 1659550 - RNA, 19 nt, Human
uuccaccaucaagccacca

SEQ ID NO: 1659551 - RNA, 23 nt, Human
uucccaaagcagugcaugcuguc

SEQ ID NO: 1659552 - RNA, 19 nt, Human
uuccauaaucuggacuccu

SEQ ID NO: 1659553 - RNA, 22 nt, Human
uuccauaaucuggacuccucug

SEQ ID NO: 1659554 - RNA, 23 nt, Human
uuccauaaucuggacuccucugu

SEQ ID NO: 1659555 - RNA, 13 nt, Human
uuccaggcuggga

SEQ ID NO: 1659556 - RNA, 21 nt, Human
uuccaggggugggacacccug

SEQ ID NO: 1659557 - RNA, 17 nt, Human
uuccagugaggcucugc

SEQ ID NO: 1659558 - RNA, 19 nt, Human
uuccagugaggcucugccc

SEQ ID NO: 1659559 - RNA, 20 nt, Human
uuccagugaggcucugcccu

SEQ ID NO: 1659560 - RNA, 21 nt, Human
uuccagugaggcucugcccuu

SEQ ID NO: 1659561 - RNA, 22 nt, Human
uuccagugaggcucugcccuug

SEQ ID NO: 1659562 - RNA, 12 nt, Human
uucccaccucuc

SEQ ID NO: 1659563 - RNA, 22 nt, Human
uucccaccucucucacuccuug

SEQ ID NO: 1659564 - RNA, 18 nt, Human
uucccaagcucugcuccu

SEQ ID NO: 1659565 - RNA, 13 nt, Human
uucccaagcucug

SEQ ID NO: 1659566 - RNA, 14 nt, Human
uucccaagcucugc

SEQ ID NO: 1659567 - RNA, 15 nt, Human
uucccaagcucugcu

SEQ ID NO: 1659568 - RNA, 16 nt, Human
uucccaagcucugcuc

SEQ ID NO: 1659569 - RNA, 18 nt, Human
uucccaacuccagaaagu

SEQ ID NO: 1659570 - RNA, 12 nt, Human
uucccaaauuuc

SEQ ID NO: 1659571 - RNA, 21 nt, Human
uucaucccucuggggcuguuc

SEQ ID NO: 1659572 - RNA, 17 nt, Human
uucaucccucuggggcu

SEQ ID NO: 1659573 - RNA, 12 nt, Human
auauauuuuaag

SEQ ID NO: 1659574 - RNA, 13 nt, Human
auauauuuuaaga

SEQ ID NO: 1659575 - RNA, 14 nt, Human
auauaugugaugau

SEQ ID NO: 1659576 - RNA, 13 nt, Human
uucagaaaugugu

SEQ ID NO: 1659577 - RNA, 11 nt, Human
uucagaaaugu

SEQ ID NO: 1659578 - RNA, 12 nt, Human
uucagugccuua

SEQ ID NO: 1659579 - RNA, 13 nt, Human
uucagugccuuau

SEQ ID NO: 1659580 - RNA, 19 nt, Human
uucauaauuauuauuuggc

SEQ ID NO: 1659581 - RNA, 18 nt, Human
uucagugccuuauggaac

SEQ ID NO: 1659582 - RNA, 17 nt, Human
auauguaacaagccacc

SEQ ID NO: 1659583 - RNA, 16 nt, Human
auauguaacaagccac

SEQ ID NO: 1659584 - RNA, 22 nt, Human
auaugcacacauuuuuuaaaug

SEQ ID NO: 1659585 - RNA, 16 nt, Human
auaugcacacauuuuu

SEQ ID NO: 1659586 - RNA, 15 nt, Human
auaugcacacauuuu

SEQ ID NO: 1659587 - RNA, 14 nt, Human
auaugcacacauuu

SEQ ID NO: 1659588 - RNA, 16 nt, Human
auaucugaaaauguau

SEQ ID NO: 1659589 - RNA, 17 nt, Human
auaucugaaaauguaug

SEQ ID NO: 1659590 - RNA, 20 nt, Human
auaucugaaaauguaugugu

SEQ ID NO: 1659591 - RNA, 19 nt, Human
auaucuccgucaacucaua

SEQ ID NO: 1659592 - RNA, 20 nt, Human
auaucuccgucaacucauau

SEQ ID NO: 1659593 - RNA, 21 nt, Human
auaucuccgucaacucauauu

SEQ ID NO: 1659594 - RNA, 14 nt, Human
auauauuuuaagac

SEQ ID NO: 1659595 - RNA, 15 nt, Human
auauauuuuaagacg

SEQ ID NO: 1659596 - RNA, 23 nt, Human
auuucuuuugccguuauuaaaaa

SEQ ID NO: 1659597 - RNA, 21 nt, Human
auuuuauguugcauagaauaa

SEQ ID NO: 1659598 - RNA, 14 nt, Human
auuuuauguugcau

SEQ ID NO: 1659599 - RNA, 18 nt, Human
auuuuauguugcauagaa

SEQ ID NO: 1659600 - RNA, 21 nt, Human
auuuuacuuuaaaaggagcca

SEQ ID NO: 1659601 - RNA, 13 nt, Human
auuuuauuaugaa

SEQ ID NO: 1659602 - RNA, 14 nt, Human
auuuuauuaugaaa

SEQ ID NO: 1659603 - RNA, 11 nt, Human
auuuuauuaug

SEQ ID NO: 1659604 - RNA, 12 nt, Human
auuuuauuauga

SEQ ID NO: 1659605 - RNA, 18 nt, Human
auuuuauuaugaaacuug

SEQ ID NO: 1659606 - RNA, 21 nt, Human
auuuuauuaugaaacuugugu

SEQ ID NO: 1659607 - RNA, 13 nt, Human
auuuuauuaugca

SEQ ID NO: 1659608 - RNA, 14 nt, Human
auuuuauuauguaa

SEQ ID NO: 1659609 - RNA, 15 nt, Human
auuuuauuauguaaa

SEQ ID NO: 1659610 - RNA, 15 nt, Human
auuuuauuaugcaug

SEQ ID NO: 1659611 - RNA, 14 nt, Human
auuuuauuaugcau

SEQ ID NO: 1659612 - RNA, 13 nt, Human
auuuuauuaugua

SEQ ID NO: 1659613 - RNA, 17 nt, Human
auuuuauuaugcaugaa

SEQ ID NO: 1659614 - RNA, 22 nt, Human
auuuuacuguacagacagaaaa

SEQ ID NO: 1659615 - RNA, 20 nt, Human
auuuuacuguacagacagaa

SEQ ID NO: 1659616 - RNA, 13 nt, Human
auuuuacauaaau

SEQ ID NO: 1659617 - RNA, 19 nt, Human
auuuguaguguuggagaag

SEQ ID NO: 1659618 - RNA, 15 nt, Human
auuuguaucacaaau

SEQ ID NO: 1659619 - RNA, 14 nt, Human
auuuuaauaauguu

SEQ ID NO: 1659620 - RNA, 15 nt, Human
auuuuaauaauguuu

SEQ ID NO: 1659621 - RNA, 16 nt, Human
auuuuaauaauguuuc

SEQ ID NO: 1659622 - RNA, 23 nt, Human
auuuccugggagcuuuuguagaa

SEQ ID NO: 1659623 - RNA, 22 nt, Human
auuuccugggagcuuuuguaga

SEQ ID NO: 1659624 - RNA, 16 nt, Human
auuuauuauggcacau

SEQ ID NO: 1659625 - RNA, 14 nt, Human
auuuccugugucuu

SEQ ID NO: 1659626 - RNA, 13 nt, Human
auuucuaaaucuc

SEQ ID NO: 1659627 - RNA, 12 nt, Human
auuucuaaaucu

SEQ ID NO: 1659628 - RNA, 21 nt, Human
auuucuaaaucuccaaaauaa

SEQ ID NO: 1659629 - RNA, 15 nt, Human
auuuacuaaaaugga

SEQ ID NO: 1659630 - RNA, 13 nt, Human
auuuauuauggca

SEQ ID NO: 1659631 - RNA, 22 nt, Human
auuuauuaaaugcccagccccu

SEQ ID NO: 1659632 - RNA, 20 nt, Human
auuuauuaaaugcccagccc

SEQ ID NO: 1659633 - RNA, 22 nt, Human
auuuauuacuguaagaaaauau

SEQ ID NO: 1659634 - RNA, 20 nt, Human
auuuggaaaucuuuaaaaaa

SEQ ID NO: 1659635 - RNA, 17 nt, Human
auuuggaaaucuuuaaa

SEQ ID NO: 1659636 - RNA, 17 nt, Human
auuugagcagggcucag

SEQ ID NO: 1659637 - RNA, 23 nt, Human
auuugaggucuguucuuuccaaa

SEQ ID NO: 1659638 - RNA, 15 nt, Human
auuugaggucuguuc

SEQ ID NO: 1659639 - RNA, 20 nt, Human
auuucuuuugccguuauuaa

SEQ ID NO: 1659640 - RNA, 21 nt, Human
auuugguuuucacauuggaaa

SEQ ID NO: 1659641 - RNA, 22 nt, Human
auuugguuuucacauuggaaac

SEQ ID NO: 1659642 - RNA, 15 nt, Human
auuugguuuucacau

SEQ ID NO: 1659643 - RNA, 17 nt, Human
auuugguuuucacauug

SEQ ID NO: 1659644 - RNA, 20 nt, Human
auuuggugguuucagaaaug

SEQ ID NO: 1659645 - RNA, 18 nt, Human
auuuggugguuucagaaa

SEQ ID NO: 1659646 - RNA, 18 nt, Human
auuuguaguguuggagaa

SEQ ID NO: 1659647 - RNA, 17 nt, Human
auuuggugguuucagaa

SEQ ID NO: 1659648 - RNA, 23 nt, Human
auuugguaaggggaauugaggac

SEQ ID NO: 1659649 - RNA, 14 nt, Human
auugcuacuguccu

SEQ ID NO: 1659650 - RNA, 17 nt, Human
auugaccugaggcccuu

SEQ ID NO: 1659651 - RNA, 13 nt, Human
auugaccugaggc

SEQ ID NO: 1659652 - RNA, 15 nt, Human
auugcaacaggcugg

SEQ ID NO: 1659653 - RNA, 18 nt, Human
auugacaggauuauugga

SEQ ID NO: 1659654 - RNA, 21 nt, Human
auugacccacaagaaaugaaa

SEQ ID NO: 1659655 - RNA, 16 nt, Human
auugcaacaggcuggg

SEQ ID NO: 1659656 - RNA, 21 nt, Human
auugcaacaggcugggcuuca

SEQ ID NO: 1659657 - RNA, 16 nt, Human
auugcggacagccacg

SEQ ID NO: 1659658 - RNA, 18 nt, Human
auugcggacagccacggc

SEQ ID NO: 1659659 - RNA, 19 nt, Human
auugcggacagccacggcc

SEQ ID NO: 1659660 - RNA, 17 nt, Human
auugcccacgcuggagu

SEQ ID NO: 1659661 - RNA, 21 nt, Human
auugcccacgcuggagugcag

SEQ ID NO: 1659662 - RNA, 17 nt, Human
auugcauuuccugacag

SEQ ID NO: 1659663 - RNA, 23 nt, Human
auugccauuucuuccacaagagc

SEQ ID NO: 1659664 - RNA, 18 nt, Human
auucuccaccugccaggg

SEQ ID NO: 1659665 - RNA, 19 nt, Human
auucucacagcuccaagaa

SEQ ID NO: 1659666 - RNA, 21 nt, Human
auucucacagcuccaagaauu

SEQ ID NO: 1659667 - RNA, 22 nt, Human
auucucacagcuccaagaauuu

SEQ ID NO: 1659668 - RNA, 14 nt, Human
auucucagaaucuc

SEQ ID NO: 1659669 - RNA, 13 nt, Human
auucuacuuugag

SEQ ID NO: 1659670 - RNA, 16 nt, Human
auucuacuuugagugc

SEQ ID NO: 1659671 - RNA, 18 nt, Human
auucucagaaucucaaau

SEQ ID NO: 1659672 - RNA, 20 nt, Human
auucucagaaucucaaauaa

SEQ ID NO: 1659673 - RNA, 13 nt, Human
auucuccaccugc

SEQ ID NO: 1659674 - RNA, 16 nt, Human
auucuccaccugccag

SEQ ID NO: 1659675 - RNA, 17 nt, Human
auucuccaccugccagg

SEQ ID NO: 1659676 - RNA, 20 nt, Human
auugacacuuaaaaaugguu

SEQ ID NO: 1659677 - RNA, 16 nt, Human
auuuaaccucuaaauu

SEQ ID NO: 1659678 - RNA, 18 nt, Human
auuuaaccucuaaauucu

SEQ ID NO: 1659679 - RNA, 19 nt, Human
auuuaauuuuuuugagaca

SEQ ID NO: 1659680 - RNA, 23 nt, Human
auuuaauuuuuuugagacagagu

SEQ ID NO: 1659681 - RNA, 22 nt, Human
auuuacaacugggggaggguga

SEQ ID NO: 1659682 - RNA, 16 nt, Human
auuuacaaaugggaaa

SEQ ID NO: 1659683 - RNA, 16 nt, Human
auuuaacagaaaugua

SEQ ID NO: 1659684 - RNA, 15 nt, Human
auuuaacagaaaugu

SEQ ID NO: 1659685 - RNA, 19 nt, Human
auuuaacagaaauguacag

SEQ ID NO: 1659686 - RNA, 17 nt, Human
auuuaacagaaauguac

SEQ ID NO: 1659687 - RNA, 20 nt, Human
auuuaacagaaauguacagc

SEQ ID NO: 1659688 - RNA, 19 nt, Human
auuuaaagcuuauuaaaac

SEQ ID NO: 1659689 - RNA, 13 nt, Human
auuuaaaagauac

SEQ ID NO: 1659690 - RNA, 23 nt, Human
auugugcgcuaaacuuuucugau

SEQ ID NO: 1659691 - RNA, 15 nt, Human
auuguauuacaaauc

SEQ ID NO: 1659692 - RNA, 14 nt, Human
auuguauuacaaau

SEQ ID NO: 1659693 - RNA, 15 nt, Human
auugugaaauuauuc

SEQ ID NO: 1659694 - RNA, 13 nt, Human
auugugccccugc

SEQ ID NO: 1659695 - RNA, 23 nt, Human
auuggcuuuggguugcaggaccu

SEQ ID NO: 1659696 - RNA, 19 nt, Human
auuccccaggaggccagcc

SEQ ID NO: 1659697 - RNA, 20 nt, Human
auuccccagauugcaacagg

SEQ ID NO: 1659698 - RNA, 16 nt, Human
auuccccaggaggcca

SEQ ID NO: 1659699 - RNA, 20 nt, Human
auuccacuuauaggaauuga

SEQ ID NO: 1659700 - RNA, 21 nt, Human
auucaguuguuagugugucuu

SEQ ID NO: 1659701 - RNA, 23 nt, Human
auucaggaagcucagggccuggc

SEQ ID NO: 1659702 - RNA, 16 nt, Human
auucaguuguuagugu

SEQ ID NO: 1659703 - RNA, 14 nt, Human
auucagcucugcaa

SEQ ID NO: 1659704 - RNA, 18 nt, Human
auucagcucugcaagaau

SEQ ID NO: 1659705 - RNA, 21 nt, Human
auucaggaagcucagggccug

SEQ ID NO: 1659706 - RNA, 22 nt, Human
auucaggaagcucagggccugg

SEQ ID NO: 1659707 - RNA, 16 nt, Human
auucaaaaugauguau

SEQ ID NO: 1659708 - RNA, 21 nt, Human
auuauuuuauuaugaaacuug

SEQ ID NO: 1659709 - RNA, 22 nt, Human
auuauuuuauuaugaaacuugu

SEQ ID NO: 1659710 - RNA, 14 nt, Human
auucagcucaugga

SEQ ID NO: 1659711 - RNA, 14 nt, Human
auucaaacagucuc

SEQ ID NO: 1659712 - RNA, 15 nt, Human
auucaaacagucuca

SEQ ID NO: 1659713 - RNA, 15 nt, Human
auuagagaguguuga

SEQ ID NO: 1659714 - RNA, 16 nt, Human
auuagagaguguugaa

SEQ ID NO: 1659715 - RNA, 17 nt, Human
auuagagaguguugaaa

SEQ ID NO: 1659716 - RNA, 18 nt, Human
auuagagaguguugaaac

SEQ ID NO: 1659717 - RNA, 19 nt, Human
auuagagaguguugaaacg

SEQ ID NO: 1659718 - RNA, 16 nt, Human
auuauauuuacaaaug

SEQ ID NO: 1659719 - RNA, 18 nt, Human
auuaucucaaaacugcac

SEQ ID NO: 1659720 - RNA, 23 nt, Human
auuaucucaaaacugcacuguca

SEQ ID NO: 1659721 - RNA, 17 nt, Human
auuauauuuacaaaugg

SEQ ID NO: 1659722 - RNA, 16 nt, Human
auuauuuuauguugca

SEQ ID NO: 1659723 - RNA, 15 nt, Human
auuauuuuauuauga

SEQ ID NO: 1659724 - RNA, 18 nt, Human
auuauuuuauguugcaua

SEQ ID NO: 1659725 - RNA, 23 nt, Human
auuauuuauuaaaugcccagccc

SEQ ID NO: 1659726 - RNA, 20 nt, Human
auuauuaccuuacagaaguu

SEQ ID NO: 1659727 - RNA, 13 nt, Human
auuacauuuguau

SEQ ID NO: 1659728 - RNA, 19 nt, Human
auuaccacagacauacuaa

SEQ ID NO: 1659729 - RNA, 15 nt, Human
auuacauuuguauaa

SEQ ID NO: 1659730 - RNA, 16 nt, Human
auuacauuuguauaaa

SEQ ID NO: 1659731 - RNA, 22 nt, Human
auuaccugaauuuuggcugugu

SEQ ID NO: 1659732 - RNA, 12 nt, Human
auuaccagggac

SEQ ID NO: 1659733 - RNA, 20 nt, Human
auuaagagagucuauuuacg

SEQ ID NO: 1659734 - RNA, 22 nt, Human
uuuuuguuccacaaguuaaaua

SEQ ID NO: 1659735 - RNA, 23 nt, Human
uuuuuuaaaaaagaaacauuugg

SEQ ID NO: 1659736 - RNA, 13 nt, Human
auuaaguaaugau

SEQ ID NO: 1659737 - RNA, 15 nt, Human
auuaaguaaugauaa

SEQ ID NO: 1659738 - RNA, 13 nt, Human
uuuuauuauguaa

SEQ ID NO: 1659739 - RNA, 14 nt, Human
uuuuauuauguaaa

SEQ ID NO: 1659740 - RNA, 21 nt, Human
uuuuauucagcucauggacuu

SEQ ID NO: 1659741 - RNA, 15 nt, Human
uuuucauuauuuuau

SEQ ID NO: 1659742 - RNA, 21 nt, Human
uuuucauuauuuuauuaugaa

SEQ ID NO: 1659743 - RNA, 22 nt, Human
uuuucauucuccuaucaccugu

SEQ ID NO: 1659744 - RNA, 19 nt, Human
uuuuccagguuuaagcugu

SEQ ID NO: 1659745 - RNA, 19 nt, Human
uuuuaugugaaacauguuu

SEQ ID NO: 1659746 - RNA, 12 nt, Human
uuuuauuaugua

SEQ ID NO: 1659747 - RNA, 22 nt, Human
uuuuauguugcauagaauaaaa

SEQ ID NO: 1659748 - RNA, 18 nt, Human
uuuuaugugaaacauguu

SEQ ID NO: 1659749 - RNA, 22 nt, Human
uuuuauggcacuaguauuucua

SEQ ID NO: 1659750 - RNA, 19 nt, Human
uuuuauggcacuaguauuu

SEQ ID NO: 1659751 - RNA, 23 nt, Human
uuuuauggaggcuuugcauagau

SEQ ID NO: 1659752 - RNA, 17 nt, Human
uuuuauaaacuuuaccu

SEQ ID NO: 1659753 - RNA, 14 nt, Human
uuuuauaaacuuua

SEQ ID NO: 1659754 - RNA, 19 nt, Human
uuuuauaaacuuuaccuuu

SEQ ID NO: 1659755 - RNA, 14 nt, Human
uuuuauaauuuugu

SEQ ID NO: 1659756 - RNA, 18 nt, Human
uuuuaugcuuuaaacauu

SEQ ID NO: 1659757 - RNA, 12 nt, Human
uuuuauaaaucg

SEQ ID NO: 1659758 - RNA, 20 nt, Human
uuuuauaaaucgcuuuugau

SEQ ID NO: 1659759 - RNA, 15 nt, Human
auguugcauagaaua

SEQ ID NO: 1659760 - RNA, 14 nt, Human
auguuggccaggcu

SEQ ID NO: 1659761 - RNA, 16 nt, Human
auguuggccaggcugc

SEQ ID NO: 1659762 - RNA, 16 nt, Human
auguuggccaggcugg

SEQ ID NO: 1659763 - RNA, 19 nt, Human
uuuuaguugcaacuuugua

SEQ ID NO: 1659764 - RNA, 13 nt, Human
uuuuauaaacuuu

SEQ ID NO: 1659765 - RNA, 12 nt, Human
uuuuauaaacuu

SEQ ID NO: 1659766 - RNA, 21 nt, Human
uuuuaagugcugcauuuaaaa

SEQ ID NO: 1659767 - RNA, 17 nt, Human
uuuuaagugcugcauuu

SEQ ID NO: 1659768 - RNA, 16 nt, Human
uuuuaagugcugcauu

SEQ ID NO: 1659769 - RNA, 16 nt, Human
auguugaagccuuugu

SEQ ID NO: 1659770 - RNA, 15 nt, Human
auguugaagccuuug

SEQ ID NO: 1659771 - RNA, 15 nt, Human
auguugacaugggac

SEQ ID NO: 1659772 - RNA, 21 nt, Human
auguucaucauccuaagcuau

SEQ ID NO: 1659773 - RNA, 19 nt, Human
auguucaucaaugaaugaa

SEQ ID NO: 1659774 - RNA, 23 nt, Human
auuaacuuuuauaaacuuuaccu

SEQ ID NO: 1659775 - RNA, 13 nt, Human
auuaagaaagacu

SEQ ID NO: 1659776 - RNA, 14 nt, Human
auuaagaaagacua

SEQ ID NO: 1659777 - RNA, 16 nt, Human
auuaagaaugaaauac

SEQ ID NO: 1659778 - RNA, 20 nt, Human
auuaagaaugaaauacuguu

SEQ ID NO: 1659779 - RNA, 21 nt, Human
auuaagaaugaaauacuguuu

SEQ ID NO: 1659780 - RNA, 22 nt, Human
auuaagaaugaaauacuguuug

SEQ ID NO: 1659781 - RNA, 12 nt, Human
auuaacuuuuau

SEQ ID NO: 1659782 - RNA, 20 nt, Human
auuaacuuuuauaaacuuua

SEQ ID NO: 1659783 - RNA, 19 nt, Human
auuaacuuuuauaaacuuu

SEQ ID NO: 1659784 - RNA, 17 nt, Human
auuaacuuuuauaaacu

SEQ ID NO: 1659785 - RNA, 16 nt, Human
auuaacuuuuauaaac

SEQ ID NO: 1659786 - RNA, 12 nt, Human
auuaaagccaug

SEQ ID NO: 1659787 - RNA, 16 nt, Human
auuaaagccauguuua

SEQ ID NO: 1659788 - RNA, 17 nt, Human
auuaaagccauguuuau

SEQ ID NO: 1659789 - RNA, 21 nt, Human
auuaaagccauguuuauuaca

SEQ ID NO: 1659790 - RNA, 21 nt, Human
auuaaacuuaaucuaaaugga

SEQ ID NO: 1659791 - RNA, 19 nt, Human
auuaaacuuaaucuaaaug

SEQ ID NO: 1659792 - RNA, 16 nt, Human
auuaaacuuaaucuaa

SEQ ID NO: 1659793 - RNA, 17 nt, Human
auuaaacuuaaucuaaa

SEQ ID NO: 1659794 - RNA, 18 nt, Human
auuaaccacuucagcuga

SEQ ID NO: 1659795 - RNA, 20 nt, Human
auuaaccacuucagcugacu

SEQ ID NO: 1659796 - RNA, 13 nt, Human
auuaacauguuaa

SEQ ID NO: 1659797 - RNA, 14 nt, Human
auuaacauguuaaa

SEQ ID NO: 1659798 - RNA, 15 nt, Human
auuaacauguuaaac

SEQ ID NO: 1659799 - RNA, 17 nt, Human
auuaacauguuaaacca

SEQ ID NO: 1659800 - RNA, 19 nt, Human
auuaacauguuaaaccaug

SEQ ID NO: 1659801 - RNA, 17 nt, Human
auuaaccacuucagcug

SEQ ID NO: 1659802 - RNA, 16 nt, Human
auuaaaagaauauuuu

SEQ ID NO: 1659803 - RNA, 17 nt, Human
auguuuuucuucucccu

SEQ ID NO: 1659804 - RNA, 18 nt, Human
auguuuuucuucucccuc

SEQ ID NO: 1659805 - RNA, 18 nt, Human
auguuucaaacauauaua

SEQ ID NO: 1659806 - RNA, 14 nt, Human
auguuuuccaugag

SEQ ID NO: 1659807 - RNA, 21 nt, Human
auguuucaaacauauauaaca

SEQ ID NO: 1659808 - RNA, 15 nt, Human
auguaucaaugagua

SEQ ID NO: 1659809 - RNA, 22 nt, Human
uuugggggaaaauuuagaaaua

SEQ ID NO: 1659810 - RNA, 15 nt, Human
auguaucugagcagg

SEQ ID NO: 1659811 - RNA, 12 nt, Human
auguauguguaa

SEQ ID NO: 1659812 - RNA, 15 nt, Human
auguauguguaagua

SEQ ID NO: 1659813 - RNA, 21 nt, Human
augucagugugacugaucucu

SEQ ID NO: 1659814 - RNA, 15 nt, Human
augucagugugacug

SEQ ID NO: 1659815 - RNA, 16 nt, Human
augucagugugacuga

SEQ ID NO: 1659816 - RNA, 19 nt, Human
auguccaagaagcccagga

SEQ ID NO: 1659817 - RNA, 18 nt, Human
auguccaagaagcccagg

SEQ ID NO: 1659818 - RNA, 23 nt, Human
auguccaagaagcccaggaaagg

SEQ ID NO: 1659819 - RNA, 22 nt, Human
augucuauaaaccgaacugaug

SEQ ID NO: 1659820 - RNA, 24 nt, Human
augucccuaccgagucucuucucc

SEQ ID NO: 1659821 - RNA, 20 nt, Human
augucccaacuuguaaaaau

SEQ ID NO: 1659822 - RNA, 16 nt, Human
auguccacugguucuu

SEQ ID NO: 1659823 - RNA, 11 nt, Human
uuugcucaugg

SEQ ID NO: 1659824 - RNA, 12 nt, Human
uuugcucaugga

SEQ ID NO: 1659825 - RNA, 15 nt, Human
auggcuauaggugcu

SEQ ID NO: 1659826 - RNA, 14 nt, Human
uuuggggauauuuu

SEQ ID NO: 1659827 - RNA, 22 nt, Human
uuugggaggccaaggugggagg

SEQ ID NO: 1659828 - RNA, 13 nt, Human
uuugcucauggaa

SEQ ID NO: 1659829 - RNA, 16 nt, Human
uuuuaaaacacuucca

SEQ ID NO: 1659830 - RNA, 22 nt, Human
uuuuaaaacacuuccauaaucu

SEQ ID NO: 1659831 - RNA, 14 nt, Human
uuuuaaaagaauga

SEQ ID NO: 1659832 - RNA, 15 nt, Human
uuuuaaaagaaugau

SEQ ID NO: 1659833 - RNA, 18 nt, Human
uuuguuugaacugauaaa

SEQ ID NO: 1659834 - RNA, 13 nt, Human
uuuuaaaaaagaa

SEQ ID NO: 1659835 - RNA, 20 nt, Human
uuuuaaggguuuguggaaaa

SEQ ID NO: 1659836 - RNA, 23 nt, Human
uuuuaaggguuuguggaaaauga

SEQ ID NO: 1659837 - RNA, 16 nt, Human
uuuuaaguaaggaauu

SEQ ID NO: 1659838 - RNA, 15 nt, Human
uuuuaagugcugcau

SEQ ID NO: 1659839 - RNA, 16 nt, Human
uuuuaagaggcagggu

SEQ ID NO: 1659840 - RNA, 15 nt, Human
uuuuaagaggcaggg

SEQ ID NO: 1659841 - RNA, 13 nt, Human
uuuguaaauuguc

SEQ ID NO: 1659842 - RNA, 13 nt, Human
uuuguagagccag

SEQ ID NO: 1659843 - RNA, 14 nt, Human
uuuguuugaacuga

SEQ ID NO: 1659844 - RNA, 13 nt, Human
uuuguuugaacug

SEQ ID NO: 1659845 - RNA, 18 nt, Human
uuuguuucuguacuuuuu

SEQ ID NO: 1659846 - RNA, 12 nt, Human
uuuguuugaacu

SEQ ID NO: 1659847 - RNA, 12 nt, Human
uuuguuucugua

SEQ ID NO: 1659848 - RNA, 13 nt, Human
uuuguuucuguac

SEQ ID NO: 1659849 - RNA, 15 nt, Human
uuugugauacaaugc

SEQ ID NO: 1659850 - RNA, 18 nt, Human
uuugugaggaagccgcug

SEQ ID NO: 1659851 - RNA, 19 nt, Human
uuugugaggaagccgcugg

SEQ ID NO: 1659852 - RNA, 15 nt, Human
uuugucuacaccauu

SEQ ID NO: 1659853 - RNA, 16 nt, Human
uuugugagcaggcugu

SEQ ID NO: 1659854 - RNA, 17 nt, Human
uuuguagaagucacauu

SEQ ID NO: 1659855 - RNA, 12 nt, Human
auaauacaccac

SEQ ID NO: 1659856 - RNA, 23 nt, Human
auaauaaauucccuggccuuuca

SEQ ID NO: 1659857 - RNA, 20 nt, Human
auaauacaccacuacauucu

SEQ ID NO: 1659858 - RNA, 18 nt, Human
auaauacaccacuacauu

SEQ ID NO: 1659859 - RNA, 19 nt, Human
auaauacuugcuuuggaaa

SEQ ID NO: 1659860 - RNA, 21 nt, Human
auaauacaccacuacauucug

SEQ ID NO: 1659861 - RNA, 14 nt, Human
uuagacagucccug

SEQ ID NO: 1659862 - RNA, 20 nt, Human
auaaugcgugcauaccacuu

SEQ ID NO: 1659863 - RNA, 15 nt, Human
auaaugcgugcauac

SEQ ID NO: 1659864 - RNA, 15 nt, Human
auaaugaaugaaaca

SEQ ID NO: 1659865 - RNA, 22 nt, Human
auaauugacaggauuauuggaa

SEQ ID NO: 1659866 - RNA, 18 nt, Human
auaaucuggacuccucug

SEQ ID NO: 1659867 - RNA, 19 nt, Human
auaaucuggacuccucugu

SEQ ID NO: 1659868 - RNA, 20 nt, Human
auaaucuggacuccucuguc

SEQ ID NO: 1659869 - RNA, 22 nt, Human
auaaucuggacuccucugucca

SEQ ID NO: 1659870 - RNA, 18 nt, Human
auaauccuaaacauauga

SEQ ID NO: 1659871 - RNA, 14 nt, Human
uuagcggagacgga

SEQ ID NO: 1659872 - RNA, 18 nt, Human
uuagccaagugugguaga

SEQ ID NO: 1659873 - RNA, 18 nt, Human
auaauuuaccugaagucu

SEQ ID NO: 1659874 - RNA, 12 nt, Human
uuagcaccaggg

SEQ ID NO: 1659875 - RNA, 18 nt, Human
uuagcaaauucuguuuuu

SEQ ID NO: 1659876 - RNA, 15 nt, Human
uuaguuucuccaagc

SEQ ID NO: 1659877 - RNA, 22 nt, Human
uuaguuugcaguuacacuaaaa

SEQ ID NO: 1659878 - RNA, 16 nt, Human
uuaggugugacugaau

SEQ ID NO: 1659879 - RNA, 16 nt, Human
uuaggugaggaagcaa

SEQ ID NO: 1659880 - RNA, 21 nt, Human
uuaggugugacugaauuucuu

SEQ ID NO: 1659881 - RNA, 20 nt, Human
uuagggaaggauacaaaagc

SEQ ID NO: 1659882 - RNA, 14 nt, Human
uuagggagagaaga

SEQ ID NO: 1659883 - RNA, 23 nt, Human
uuacucuucaguuaagccuuugg

SEQ ID NO: 1659884 - RNA, 17 nt, Human
uuagaaauugcauuucc

SEQ ID NO: 1659885 - RNA, 13 nt, Human
uuagacagagucu

SEQ ID NO: 1659886 - RNA, 20 nt, Human
uuagacagagucucacuguu

SEQ ID NO: 1659887 - RNA, 13 nt, Human
uuagacagucccu

SEQ ID NO: 1659888 - RNA, 13 nt, Human
uuaccuuugacaa

SEQ ID NO: 1659889 - RNA, 20 nt, Human
uuaccuuugacaaagguaaa

SEQ ID NO: 1659890 - RNA, 19 nt, Human
uuacccucauguucuuaau

SEQ ID NO: 1659891 - RNA, 16 nt, Human
uuacaggcuccugcca

SEQ ID NO: 1659892 - RNA, 18 nt, Human
uuacaggcuccugccacc

SEQ ID NO: 1659893 - RNA, 24 nt, Human
uuacaggcgugagccaccgugccu

SEQ ID NO: 1659894 - RNA, 11 nt, Human
auaaauuauuu

SEQ ID NO: 1659895 - RNA, 14 nt, Human
auaaaucgcuuuug

SEQ ID NO: 1659896 - RNA, 21 nt, Human
auaaauucccuggccuuucau

SEQ ID NO: 1659897 - RNA, 22 nt, Human
auaaauucccuggccuuucaua

SEQ ID NO: 1659898 - RNA, 14 nt, Human
auaacguauaaaag

SEQ ID NO: 1659899 - RNA, 22 nt, Human
auaacgauaaaagacagugaaa

SEQ ID NO: 1659900 - RNA, 16 nt, Human
auaacuaaaagguaug

SEQ ID NO: 1659901 - RNA, 18 nt, Human
auaacuguuauuuauaau

SEQ ID NO: 1659902 - RNA, 20 nt, Human
auaacuguuauuuauaauca

SEQ ID NO: 1659903 - RNA, 22 nt, Human
auaacuguuauuuauaaucacu

SEQ ID NO: 1659904 - RNA, 15 nt, Human
auaaagguucaugca

SEQ ID NO: 1659905 - RNA, 17 nt, Human
auaaagguucaugcaaa

SEQ ID NO: 1659906 - RNA, 13 nt, Human
auaaauaaaaaua

SEQ ID NO: 1659907 - RNA, 22 nt, Human
auaaauagcuagacuggugacu

SEQ ID NO: 1659908 - RNA, 14 nt, Human
auaaauaaaaauaa

SEQ ID NO: 1659909 - RNA, 15 nt, Human
auaaauaguuuauga

SEQ ID NO: 1659910 - RNA, 13 nt, Human
auaaaagccuguu

SEQ ID NO: 1659911 - RNA, 18 nt, Human
auaaaagccuguuuaaga

SEQ ID NO: 1659912 - RNA, 12 nt, Human
auaaaauaauuu

SEQ ID NO: 1659913 - RNA, 21 nt, Human
uuaagaaaaaggaugcacaga

SEQ ID NO: 1659914 - RNA, 20 nt, Human
uuaagaaaaaggaugcacag

SEQ ID NO: 1659915 - RNA, 15 nt, Human
auaaaauaauuuuua

SEQ ID NO: 1659916 - RNA, 23 nt, Human
aguuuuuauggcuuuugugcauu

SEQ ID NO: 1659917 - RNA, 15 nt, Human
aguuuugguugcuuu

SEQ ID NO: 1659918 - RNA, 21 nt, Human
aguuuugguugcuuuaauauc

SEQ ID NO: 1659919 - RNA, 22 nt, Human
aguuuugguugcuuuaauauca

SEQ ID NO: 1659920 - RNA, 19 nt, Human
aguuuucugagaaagacua

SEQ ID NO: 1659921 - RNA, 23 nt, Human
aguuuucugagaaagacuauuca

SEQ ID NO: 1659922 - RNA, 22 nt, Human
uuaaucugguuuauuuuuguuc

SEQ ID NO: 1659923 - RNA, 18 nt, Human
uuaaugaaagacuguaca

SEQ ID NO: 1659924 - RNA, 19 nt, Human
uuaaugaaagacuguacaa

SEQ ID NO: 1659925 - RNA, 22 nt, Human
uuaauauuuauaggucacuuug

SEQ ID NO: 1659926 - RNA, 13 nt, Human
uuaaucauuaggu

SEQ ID NO: 1659927 - RNA, 21 nt, Human
uuaaucugggccagaauuuca

SEQ ID NO: 1659928 - RNA, 23 nt, Human
uuaaucauuaggugugacugaau

SEQ ID NO: 1659929 - RNA, 22 nt, Human
uuaaucauuaggugugacugaa

SEQ ID NO: 1659930 - RNA, 9 nt, Human
uuaaggugg

SEQ ID NO: 1659931 - RNA, 22 nt, Human
uuaagaaagacuaucuaaaugu

SEQ ID NO: 1659932 - RNA, 20 nt, Human
uuaagaagacugcauuauau

SEQ ID NO: 1659933 - RNA, 19 nt, Human
uuaagugcugcauuuaaaa

SEQ ID NO: 1659934 - RNA, 16 nt, Human
uuaagugcugcauuua

SEQ ID NO: 1659935 - RNA, 15 nt, Human
uuaagugcugcauuu

SEQ ID NO: 1659936 - RNA, 14 nt, Human
uuaagucuguuuua

SEQ ID NO: 1659937 - RNA, 15 nt, Human
uuaagucuguuuuau

SEQ ID NO: 1659938 - RNA, 17 nt, Human
uuaagucuguuuuauga

SEQ ID NO: 1659939 - RNA, 20 nt, Human
uuaacagaaauguacagcaa

SEQ ID NO: 1659940 - RNA, 19 nt, Human
uuaacagaaauguacagca

SEQ ID NO: 1659941 - RNA, 18 nt, Human
uuaaauaaugugaaacug

SEQ ID NO: 1659942 - RNA, 16 nt, Human
uuaaauaaugugaaac

SEQ ID NO: 1659943 - RNA, 19 nt, Human
uuaaauaaugugaaacugg

SEQ ID NO: 1659944 - RNA, 17 nt, Human
uuaaaaaucucaaauuu

SEQ ID NO: 1659945 - RNA, 16 nt, Human
uuaaaaaucucaaauu

SEQ ID NO: 1659946 - RNA, 15 nt, Human
uuaaaaaucucaaau

SEQ ID NO: 1659947 - RNA, 14 nt, Human
uuaaaaaucucaaa

SEQ ID NO: 1659948 - RNA, 15 nt, Human
uuaaauaaugugaaa

SEQ ID NO: 1659949 - RNA, 18 nt, Human
uuaaacauugguucuugu

SEQ ID NO: 1659950 - RNA, 17 nt, Human
aguuggguggaugccug

SEQ ID NO: 1659951 - RNA, 19 nt, Human
aguugggcuuccucauagu

SEQ ID NO: 1659952 - RNA, 13 nt, Human
aguugggcuuccu

SEQ ID NO: 1659953 - RNA, 11 nt, Human
aguugccuaaa

SEQ ID NO: 1659954 - RNA, 15 nt, Human
aguugccuaaaucca

SEQ ID NO: 1659955 - RNA, 16 nt, Human
aguugccuaaauccau

SEQ ID NO: 1659956 - RNA, 17 nt, Human
aguugccuaaauccauu

SEQ ID NO: 1659957 - RNA, 19 nt, Human
aguugccuaaauccauuug

SEQ ID NO: 1659958 - RNA, 23 nt, Human
aguugccagucaccccggccacc

SEQ ID NO: 1659959 - RNA, 13 nt, Human
uguuucaaacaua

SEQ ID NO: 1659960 - RNA, 13 nt, Human
uuaaaaaaaaucc

SEQ ID NO: 1659961 - RNA, 17 nt, Human
aguuggucccccuucca

SEQ ID NO: 1659962 - RNA, 11 nt, Human
aguuggucccc

SEQ ID NO: 1659963 - RNA, 13 nt, Human
aguuggucccccu

SEQ ID NO: 1659964 - RNA, 14 nt, Human
aguuuaaauuguaa

SEQ ID NO: 1659965 - RNA, 18 nt, Human
uguucuagcauggcugcc

SEQ ID NO: 1659966 - RNA, 18 nt, Human
uguucuuaguuugcaguu

SEQ ID NO: 1659967 - RNA, 18 nt, Human
uguuauuuauaaucacuu

SEQ ID NO: 1659968 - RNA, 21 nt, Human
uguuauuuauaaucacuuuuu

SEQ ID NO: 1659969 - RNA, 21 nt, Human
aguguucauaaauaaaguuug

SEQ ID NO: 1659970 - RNA, 20 nt, Human
uguucuugguuuguaaauua

SEQ ID NO: 1659971 - RNA, 22 nt, Human
uguucuugguuuguaaauuaac

SEQ ID NO: 1659972 - RNA, 19 nt, Human
uguucuuucacccuuuucu

SEQ ID NO: 1659973 - RNA, 13 nt, Human
uguugcccaggcu

SEQ ID NO: 1659974 - RNA, 15 nt, Human
uguugcccaggcugg

SEQ ID NO: 1659975 - RNA, 21 nt, Human
aguuacucuucaguuaagccu

SEQ ID NO: 1659976 - RNA, 23 nt, Human
aguguuggagaagaacugaaauc

SEQ ID NO: 1659977 - RNA, 17 nt, Human
aguguuggagaagaacu

SEQ ID NO: 1659978 - RNA, 18 nt, Human
aguguuggagaagaacug

SEQ ID NO: 1659979 - RNA, 21 nt, Human
aguguugaaacggaugauuuc

SEQ ID NO: 1659980 - RNA, 14 nt, Human
aguguuggagaaga

SEQ ID NO: 1659981 - RNA, 16 nt, Human
aguguuggagaagaac

SEQ ID NO: 1659982 - RNA, 16 nt, Human
aguucaauucucauuu

SEQ ID NO: 1659983 - RNA, 15 nt, Human
aguucccuacuuccu

SEQ ID NO: 1659984 - RNA, 23 nt, Human
aguuccucauuagcauuuugcua

SEQ ID NO: 1659985 - RNA, 22 nt, Human
aguucacucuccauuuaauaau

SEQ ID NO: 1659986 - RNA, 24 nt, Human
aguucacucuccauuuaauaauua

SEQ ID NO: 1659987 - RNA, 12 nt, Human
aguucucuccuu

SEQ ID NO: 1659988 - RNA, 19 nt, Human
aguucggugagcuacaaau

SEQ ID NO: 1659989 - RNA, 20 nt, Human
aguucggugagcuacaaaug

SEQ ID NO: 1659990 - RNA, 13 nt, Human
uguuuagucuugu

SEQ ID NO: 1659991 - RNA, 17 nt, Human
uguuuagucuugucuca

SEQ ID NO: 1659992 - RNA, 18 nt, Human
uguuuagucuugucucag

SEQ ID NO: 1659993 - RNA, 19 nt, Human
uguuuagucuugucucaga

SEQ ID NO: 1659994 - RNA, 20 nt, Human
uguuuagucuugucucagau

SEQ ID NO: 1659995 - RNA, 13 nt, Human
uguuuaguaauca

SEQ ID NO: 1659996 - RNA, 14 nt, Human
uguuuaguaaucau

SEQ ID NO: 1659997 - RNA, 17 nt, Human
uguuuaguaaucauauu

SEQ ID NO: 1659998 - RNA, 14 nt, Human
uguuuauugucaaa

SEQ ID NO: 1659999 - RNA, 17 nt, Human
uguuuauugucaaagug

SEQ ID NO: 1660000 - RNA, 13 nt, Human
uguugucugcaac

SEQ ID NO: 1660001 - RNA, 16 nt, Human
uguugucugcaacucu

SEQ ID NO: 1660002 - RNA, 16 nt, Human
ugugcucuggacaggc

SEQ ID NO: 1660003 - RNA, 18 nt, Human
ugugcucuggacaggcau

SEQ ID NO: 1660004 - RNA, 19 nt, Human
ugugcucuggacaggcaug

SEQ ID NO: 1660005 - RNA, 13 nt, Human
ugugcugcccugc

SEQ ID NO: 1660006 - RNA, 14 nt, Human
ugugcugcccugcc

SEQ ID NO: 1660007 - RNA, 15 nt, Human
ugugcugcccugccc

SEQ ID NO: 1660008 - RNA, 23 nt, Human
uguggcaaaauguuacagaaucu

SEQ ID NO: 1660009 - RNA, 21 nt, Human
agucucacuguugcccaggcu

SEQ ID NO: 1660010 - RNA, 20 nt, Human
agucucacuguugcccaggc

SEQ ID NO: 1660011 - RNA, 18 nt, Human
agucucacuguugcccag

SEQ ID NO: 1660012 - RNA, 19 nt, Human
agucucacuguugcccagg

SEQ ID NO: 1660013 - RNA, 21 nt, Human
ugugcccuaaaguguauuuuu

SEQ ID NO: 1660014 - RNA, 20 nt, Human
ugugcccuaaaguguauuuu

SEQ ID NO: 1660015 - RNA, 12 nt, Human
ugugccucugcc

SEQ ID NO: 1660016 - RNA, 13 nt, Human
ugugccucugccu

SEQ ID NO: 1660017 - RNA, 22 nt, Human
ugugcucugaucauccacugug

SEQ ID NO: 1660018 - RNA, 23 nt, Human
ugugcucugaucauccacugugc

SEQ ID NO: 1660019 - RNA, 15 nt, Human
ugugcucuggacagg

SEQ ID NO: 1660020 - RNA, 16 nt, Human
agugcaucucagccca

SEQ ID NO: 1660021 - RNA, 17 nt, Human
agugcaucucagcccac

SEQ ID NO: 1660022 - RNA, 15 nt, Human
agugcaucucagccc

SEQ ID NO: 1660023 - RNA, 14 nt, Human
agugcaucucagcc

SEQ ID NO: 1660024 - RNA, 14 nt, Human
agugcacuaaugug

SEQ ID NO: 1660025 - RNA, 16 nt, Human
agugccaaaaacaaca

SEQ ID NO: 1660026 - RNA, 14 nt, Human
agugcaugcugucc

SEQ ID NO: 1660027 - RNA, 14 nt, Human
agugcccacaggau

SEQ ID NO: 1660028 - RNA, 16 nt, Human
agugagucgaggacag

SEQ ID NO: 1660029 - RNA, 22 nt, Human
agugauucuccugccucagccu

SEQ ID NO: 1660030 - RNA, 24 nt, Human
agugauucuccugccucagccucc

SEQ ID NO: 1660031 - RNA, 22 nt, Human
agugcaaauugucacaggacag

SEQ ID NO: 1660032 - RNA, 18 nt, Human
agugcaaauugucacagg

SEQ ID NO: 1660033 - RNA, 21 nt, Human
agugcaaauugucacaggaca

SEQ ID NO: 1660034 - RNA, 16 nt, Human
uguggugacuuuggau

SEQ ID NO: 1660035 - RNA, 17 nt, Human
uguggugacuuuggaua

SEQ ID NO: 1660036 - RNA, 12 nt, Human
ugugguuucauu

SEQ ID NO: 1660037 - RNA, 16 nt, Human
agugcuuccaaggaug

SEQ ID NO: 1660038 - RNA, 20 nt, Human
agugcugggauuacaagcgu

SEQ ID NO: 1660039 - RNA, 22 nt, Human
agugcugcauuuaaaagauaca

SEQ ID NO: 1660040 - RNA, 20 nt, Human
agugcugggauuacaggcgu

SEQ ID NO: 1660041 - RNA, 19 nt, Human
agugcugggauuacaggug

SEQ ID NO: 1660042 - RNA, 20 nt, Human
agugcugcauuuaaaagaua

SEQ ID NO: 1660043 - RNA, 17 nt, Human
agugccuuacacaaugg

SEQ ID NO: 1660044 - RNA, 15 nt, Human
agugccuuacacaau

SEQ ID NO: 1660045 - RNA, 21 nt, Human
agugccuguaaucacagcuac

SEQ ID NO: 1660046 - RNA, 14 nt, Human
uguguuaugaagca

SEQ ID NO: 1660047 - RNA, 20 nt, Human
ugugucagguggggcagcuu

SEQ ID NO: 1660048 - RNA, 17 nt, Human
ugugucagguggggcag

SEQ ID NO: 1660049 - RNA, 19 nt, Human
ugugucagguggggcagcu

SEQ ID NO: 1660050 - RNA, 13 nt, Human
ugugucucuuggu

SEQ ID NO: 1660051 - RNA, 16 nt, Human
ugugucucuugguccu

SEQ ID NO: 1660052 - RNA, 11 nt, Human
aguggaaaaau

SEQ ID NO: 1660053 - RNA, 18 nt, Human
aguggaaaaauagccugc

SEQ ID NO: 1660054 - RNA, 19 nt, Human
aguggaaaaauagccugcc

SEQ ID NO: 1660055 - RNA, 19 nt, Human
uguuaaugauagcuacugu

SEQ ID NO: 1660056 - RNA, 21 nt, Human
uguuaacauggacaugaucuu

SEQ ID NO: 1660057 - RNA, 22 nt, Human
aguccaggcuuuuuuaucaugu

SEQ ID NO: 1660058 - RNA, 19 nt, Human
agucagggguucccuuuuu

SEQ ID NO: 1660059 - RNA, 12 nt, Human
agucccugccaa

SEQ ID NO: 1660060 - RNA, 16 nt, Human
agucucacuguugccc

SEQ ID NO: 1660061 - RNA, 17 nt, Human
agucucacuguugccca

SEQ ID NO: 1660062 - RNA, 23 nt, Human
aguccgaaagggacuuggaagcu

SEQ ID NO: 1660063 - RNA, 13 nt, Human
uguccgagcuuug

SEQ ID NO: 1660064 - RNA, 14 nt, Human
uguccgagcuuuga

SEQ ID NO: 1660065 - RNA, 15 nt, Human
ugucgcccaggcugg

SEQ ID NO: 1660066 - RNA, 16 nt, Human
ugucgcccaggcugga

SEQ ID NO: 1660067 - RNA, 16 nt, Human
uguccuacccacccuc

SEQ ID NO: 1660068 - RNA, 13 nt, Human
ugucgccucugca

SEQ ID NO: 1660069 - RNA, 12 nt, Human
ugucgggcauga

SEQ ID NO: 1660070 - RNA, 14 nt, Human
ugucgcccagucug

SEQ ID NO: 1660071 - RNA, 15 nt, Human
ugucgcccagucugg

SEQ ID NO: 1660072 - RNA, 14 nt, Human
ugucgggcaugaca

SEQ ID NO: 1660073 - RNA, 15 nt, Human
ugucgggcaugacac

SEQ ID NO: 1660074 - RNA, 16 nt, Human
agucagacagaugugg

SEQ ID NO: 1660075 - RNA, 16 nt, Human
agucaggaaagagaac

SEQ ID NO: 1660076 - RNA, 15 nt, Human
agucaggaaagagaa

SEQ ID NO: 1660077 - RNA, 17 nt, Human
aguaggaagacuuugga

SEQ ID NO: 1660078 - RNA, 18 nt, Human
aguaggaagacuuuggaa

SEQ ID NO: 1660079 - RNA, 19 nt, Human
aguaggaagacuuuggaaa

SEQ ID NO: 1660080 - RNA, 22 nt, Human
aguaggaagacuuuggaaagac

SEQ ID NO: 1660081 - RNA, 16 nt, Human
aguaggaagacuuugg

SEQ ID NO: 1660082 - RNA, 20 nt, Human
ugucaaucagccuaguugau

SEQ ID NO: 1660083 - RNA, 14 nt, Human
uguauuuuuuuacu

SEQ ID NO: 1660084 - RNA, 16 nt, Human
uguauuuuuuuacuaa

SEQ ID NO: 1660085 - RNA, 19 nt, Human
ugucaagagggucugagga

SEQ ID NO: 1660086 - RNA, 15 nt, Human
ugucaagccauaauu

SEQ ID NO: 1660087 - RNA, 21 nt, Human
ugucaauaaaauccauacauu

SEQ ID NO: 1660088 - RNA, 19 nt, Human
agucacugagacagcccgg

SEQ ID NO: 1660089 - RNA, 13 nt, Human
agucacugcacag

SEQ ID NO: 1660090 - RNA, 16 nt, Human
ugucagcugaaccugg

SEQ ID NO: 1660091 - RNA, 19 nt, Human
ugucagcugaaccugggua

SEQ ID NO: 1660092 - RNA, 16 nt, Human
ugucagguggggcagc

SEQ ID NO: 1660093 - RNA, 23 nt, Human
ugucauuugcuggagcucugccc

SEQ ID NO: 1660094 - RNA, 19 nt, Human
agucacauuccugaacagg

SEQ ID NO: 1660095 - RNA, 18 nt, Human
agucacauuccugaacag

SEQ ID NO: 1660096 - RNA, 20 nt, Human
agucacauuccugaacagga

SEQ ID NO: 1660097 - RNA, 13 nt, Human
agucaccaagccc

SEQ ID NO: 1660098 - RNA, 14 nt, Human
agucaccaagccca

SEQ ID NO: 1660099 - RNA, 22 nt, Human
aguauuucuaugaaauauuaug

SEQ ID NO: 1660100 - RNA, 13 nt, Human
aguauuucuauga

SEQ ID NO: 1660101 - RNA, 15 nt, Human
aguauuucuaugaaa

SEQ ID NO: 1660102 - RNA, 13 nt, Human
uguaaaucccauu

SEQ ID NO: 1660103 - RNA, 16 nt, Human
uguaaaucccauuauu

SEQ ID NO: 1660104 - RNA, 18 nt, Human
uguaaaucccauuauuca

SEQ ID NO: 1660105 - RNA, 10 nt, Human
aggucccuaa

SEQ ID NO: 1660106 - RNA, 23 nt, Human
aggucuugaacuccuggccucaa

SEQ ID NO: 1660107 - RNA, 19 nt, Human
uguaaaucccauuauucaa

SEQ ID NO: 1660108 - RNA, 20 nt, Human
uguaaaucccauuauucaaa

SEQ ID NO: 1660109 - RNA, 22 nt, Human
uguaaaucccauuauucaaagu

SEQ ID NO: 1660110 - RNA, 15 nt, Human
aggugcacaagcucc

SEQ ID NO: 1660111 - RNA, 16 nt, Human
aggugcacaagcucca

SEQ ID NO: 1660112 - RNA, 17 nt, Human
aggugcacaagcuccaa

SEQ ID NO: 1660113 - RNA, 18 nt, Human
aggugcacaagcuccaag

SEQ ID NO: 1660114 - RNA, 20 nt, Human
aggugcacaagcuccaagcu

SEQ ID NO: 1660115 - RNA, 20 nt, Human
aggugggauccuccaggugc

SEQ ID NO: 1660116 - RNA, 17 nt, Human
agguggccacuccagac

SEQ ID NO: 1660117 - RNA, 14 nt, Human
agguggccacucca

SEQ ID NO: 1660118 - RNA, 21 nt, Human
aggugcacaagcuccaagcuc

SEQ ID NO: 1660119 - RNA, 14 nt, Human
uguaauuauaucug

SEQ ID NO: 1660120 - RNA, 15 nt, Human
uguaauuauaucuga

SEQ ID NO: 1660121 - RNA, 13 nt, Human
uguaauuauaucu

SEQ ID NO: 1660122 - RNA, 15 nt, Human
uguaaguaaacgguc

SEQ ID NO: 1660123 - RNA, 17 nt, Human
uguaacuuucugaaaua

SEQ ID NO: 1660124 - RNA, 14 nt, Human
agguuggugggggc

SEQ ID NO: 1660125 - RNA, 17 nt, Human
uguaagaaaauaucacu

SEQ ID NO: 1660126 - RNA, 17 nt, Human
aggugguuauggagagg

SEQ ID NO: 1660127 - RNA, 14 nt, Human
agguugcagugagc

SEQ ID NO: 1660128 - RNA, 23 nt, Human
aguaaggaauuuuauuuuuuucu

SEQ ID NO: 1660129 - RNA, 20 nt, Human
aguaauaugcacacauuuuu

SEQ ID NO: 1660130 - RNA, 19 nt, Human
aguaauaugcacacauuuu

SEQ ID NO: 1660131 - RNA, 18 nt, Human
aguaauaugcacacauuu

SEQ ID NO: 1660132 - RNA, 11 nt, Human
agguuuuccug

SEQ ID NO: 1660133 - RNA, 15 nt, Human
aguaaaaauaaaauu

SEQ ID NO: 1660134 - RNA, 12 nt, Human
aguaaaaauaaa

SEQ ID NO: 1660135 - RNA, 14 nt, Human
agguuuuuaagccu

SEQ ID NO: 1660136 - RNA, 15 nt, Human
aguaaaaccacagca

SEQ ID NO: 1660137 - RNA, 14 nt, Human
uguaauuugugaua

SEQ ID NO: 1660138 - RNA, 12 nt, Human
uguacuuuuugg

SEQ ID NO: 1660139 - RNA, 15 nt, Human
uguacuuuuuggcau

SEQ ID NO: 1660140 - RNA, 16 nt, Human
uguacuuuuuggcaua

SEQ ID NO: 1660141 - RNA, 13 nt, Human
uguagagugggag

SEQ ID NO: 1660142 - RNA, 14 nt, Human
uguagagugggagc

SEQ ID NO: 1660143 - RNA, 17 nt, Human
uguacuuuuuggcauaa

SEQ ID NO: 1660144 - RNA, 18 nt, Human
uguagaggagaaacugga

SEQ ID NO: 1660145 - RNA, 15 nt, Human
aguaauccaagcaaa

SEQ ID NO: 1660146 - RNA, 21 nt, Human
aguaauccaagcaaaugugaa

SEQ ID NO: 1660147 - RNA, 19 nt, Human
aguacuuuuggcauuuuac

SEQ ID NO: 1660148 - RNA, 14 nt, Human
aguacacuguuuca

SEQ ID NO: 1660149 - RNA, 20 nt, Human
aguacacuguuucaaacuuu

SEQ ID NO: 1660150 - RNA, 16 nt, Human
aguacacuguuucaaa

SEQ ID NO: 1660151 - RNA, 20 nt, Human
uguaggaagguuaauguuca

SEQ ID NO: 1660152 - RNA, 19 nt, Human
aguagauaggccaugggca

SEQ ID NO: 1660153 - RNA, 17 nt, Human
aguagaagucuuagaug

SEQ ID NO: 1660154 - RNA, 12 nt, Human
aguagagacagg

SEQ ID NO: 1660155 - RNA, 14 nt, Human
uggggaaugaagau

SEQ ID NO: 1660156 - RNA, 15 nt, Human
uggggaaugaagaua

SEQ ID NO: 1660157 - RNA, 23 nt, Human
ugggcuggguucuacccaggugc

SEQ ID NO: 1660158 - RNA, 18 nt, Human
ugggcuggguucuaccca

SEQ ID NO: 1660159 - RNA, 19 nt, Human
ugggcuggguucuacccag

SEQ ID NO: 1660160 - RNA, 13 nt, Human
uggggaccucagg

SEQ ID NO: 1660161 - RNA, 17 nt, Human
uggggaccagagcugcc

SEQ ID NO: 1660162 - RNA, 18 nt, Human
uggggaccagagcugcca

SEQ ID NO: 1660163 - RNA, 17 nt, Human
uggggacagagcagaac

SEQ ID NO: 1660164 - RNA, 14 nt, Human
uggggaccagagcu

SEQ ID NO: 1660165 - RNA, 15 nt, Human
uggggaccagagcug

SEQ ID NO: 1660166 - RNA, 17 nt, Human
ugggcugcccuggugcu

SEQ ID NO: 1660167 - RNA, 19 nt, Human
ugggcugcccuggugcugc

SEQ ID NO: 1660168 - RNA, 20 nt, Human
ugggcugcccuggugcugcc

SEQ ID NO: 1660169 - RNA, 21 nt, Human
ugggcugcccuggugcugcca

SEQ ID NO: 1660170 - RNA, 20 nt, Human
ugggcucccuucccaccucu

SEQ ID NO: 1660171 - RNA, 21 nt, Human
ugggcucccuucccaccucuc

SEQ ID NO: 1660172 - RNA, 17 nt, Human
ugggcugaacacuccaa

SEQ ID NO: 1660173 - RNA, 19 nt, Human
ugggcugaacacuccaauu

SEQ ID NO: 1660174 - RNA, 23 nt, Human
agggcuucugccauuucugagau

SEQ ID NO: 1660175 - RNA, 18 nt, Human
ugggcucccuucccaccu

SEQ ID NO: 1660176 - RNA, 19 nt, Human
ugggcucccuucccaccuc

SEQ ID NO: 1660177 - RNA, 14 nt, Human
uggggcccugccuc

SEQ ID NO: 1660178 - RNA, 12 nt, Human
uggggagaaagu

SEQ ID NO: 1660179 - RNA, 23 nt, Human
uggggaccucaggccugggggcu

SEQ ID NO: 1660180 - RNA, 15 nt, Human
uggggcccugccucc

SEQ ID NO: 1660181 - RNA, 16 nt, Human
uggggcccugccuccu

SEQ ID NO: 1660182 - RNA, 23 nt, Human
uggggcuaggaaauccagggugg

SEQ ID NO: 1660183 - RNA, 18 nt, Human
uggggcggugagagggga

SEQ ID NO: 1660184 - RNA, 15 nt, Human
ugggguacccacugc

SEQ ID NO: 1660185 - RNA, 16 nt, Human
ugggguacccacugcu

SEQ ID NO: 1660186 - RNA, 17 nt, Human
uggggucacucuggcag

SEQ ID NO: 1660187 - RNA, 18 nt, Human
uggggucacucuggcagc

SEQ ID NO: 1660188 - RNA, 15 nt, Human
ugggguaugggagag

SEQ ID NO: 1660189 - RNA, 14 nt, Human
ugggguacccacug

SEQ ID NO: 1660190 - RNA, 22 nt, Human
uggggcugcaccggcuggccug

SEQ ID NO: 1660191 - RNA, 20 nt, Human
uggggcugcaccggcuggcc

SEQ ID NO: 1660192 - RNA, 17 nt, Human
ugggccagaauuucaaa

SEQ ID NO: 1660193 - RNA, 17 nt, Human
ugggcaacccccagccu

SEQ ID NO: 1660194 - RNA, 20 nt, Human
ugggcaacccccagccugcu

SEQ ID NO: 1660195 - RNA, 21 nt, Human
ugggcaacccccagccugcua

SEQ ID NO: 1660196 - RNA, 18 nt, Human
ugggccagaauuucaaac

SEQ ID NO: 1660197 - RNA, 13 nt, Human
ugggccaggagcc

SEQ ID NO: 1660198 - RNA, 20 nt, Human
ugggcccaaugcacuuuguu

SEQ ID NO: 1660199 - RNA, 14 nt, Human
ugggccaggagccu

SEQ ID NO: 1660200 - RNA, 16 nt, Human
ugggccaggagccucc

SEQ ID NO: 1660201 - RNA, 18 nt, Human
ugggaggucaaggcugca

SEQ ID NO: 1660202 - RNA, 19 nt, Human
ugggaggucaaggcugcag

SEQ ID NO: 1660203 - RNA, 20 nt, Human
ugggaggucaaggcugcagu

SEQ ID NO: 1660204 - RNA, 23 nt, Human
ugggaggucaaggcugcagugag

SEQ ID NO: 1660205 - RNA, 16 nt, Human
ugggcaacccccagcc

SEQ ID NO: 1660206 - RNA, 14 nt, Human
ugggaguacaaaag

SEQ ID NO: 1660207 - RNA, 17 nt, Human
agggaggugaccccagg

SEQ ID NO: 1660208 - RNA, 17 nt, Human
agggagugacagaggca

SEQ ID NO: 1660209 - RNA, 18 nt, Human
agggagugacagaggcag

SEQ ID NO: 1660210 - RNA, 19 nt, Human
agggagugacagaggcagc

SEQ ID NO: 1660211 - RNA, 15 nt, Human
agggagggcuucugc

SEQ ID NO: 1660212 - RNA, 23 nt, Human
agggcccagagaggguggugacc

SEQ ID NO: 1660213 - RNA, 17 nt, Human
agggcagggacaggaua

SEQ ID NO: 1660214 - RNA, 20 nt, Human
uggggucacucuggcagcuc

SEQ ID NO: 1660215 - RNA, 19 nt, Human
uggggucacucuggcagcu

SEQ ID NO: 1660216 - RNA, 18 nt, Human
aggggccuggcagccgug

SEQ ID NO: 1660217 - RNA, 23 nt, Human
aggggccuggcagccgugccuuc

SEQ ID NO: 1660218 - RNA, 23 nt, Human
aggggagcaaaaucgaugcagug

SEQ ID NO: 1660219 - RNA, 20 nt, Human
aggggugggacacccuguga

SEQ ID NO: 1660220 - RNA, 22 nt, Human
aggggugggacacccugugaug

SEQ ID NO: 1660221 - RNA, 15 nt, Human
aggggguggccuccc

SEQ ID NO: 1660222 - RNA, 17 nt, Human
aggggguggccucccaa

SEQ ID NO: 1660223 - RNA, 18 nt, Human
aggggguggccucccaac

SEQ ID NO: 1660224 - RNA, 24 nt, Human
agggguucccuuuuuuggcugcug

SEQ ID NO: 1660225 - RNA, 21 nt, Human
agggucucacuauguugccca

SEQ ID NO: 1660226 - RNA, 22 nt, Human
agggucucacuauguugcccag

SEQ ID NO: 1660227 - RNA, 23 nt, Human
agggucucacuauguugcccagg

SEQ ID NO: 1660228 - RNA, 22 nt, Human
agggucucacucugucgcccag

SEQ ID NO: 1660229 - RNA, 21 nt, Human
ugggucgcccuggacugugug

SEQ ID NO: 1660230 - RNA, 15 nt, Human
agggugggagugggc

SEQ ID NO: 1660231 - RNA, 22 nt, Human
ugggugcuuggaggaaggaaac

SEQ ID NO: 1660232 - RNA, 15 nt, Human
ugggugcuuggagga

SEQ ID NO: 1660233 - RNA, 19 nt, Human
ugggugcuuggaggaagga

SEQ ID NO: 1660234 - RNA, 22 nt, Human
uggucacaggacucugccuccu

SEQ ID NO: 1660235 - RNA, 23 nt, Human
uggucacaggacucugccuccuc

SEQ ID NO: 1660236 - RNA, 21 nt, Human
ugguagcuuuucccuucuuuu

SEQ ID NO: 1660237 - RNA, 20 nt, Human
ugguagcuuuucccuucuuu

SEQ ID NO: 1660238 - RNA, 16 nt, Human
ugguacuaacuuuccu

SEQ ID NO: 1660239 - RNA, 20 nt, Human
ugguaaggggaauugaggac

SEQ ID NO: 1660240 - RNA, 17 nt, Human
uggucucaaacucuuga

SEQ ID NO: 1660241 - RNA, 23 nt, Human
uggucucaaacucuugaccucag

SEQ ID NO: 1660242 - RNA, 19 nt, Human
uggucuaucuuugagcgcc

SEQ ID NO: 1660243 - RNA, 16 nt, Human
uggucucaaacucuug

SEQ ID NO: 1660244 - RNA, 16 nt, Human
uggucccaccccacac

SEQ ID NO: 1660245 - RNA, 13 nt, Human
uggucccacucag

SEQ ID NO: 1660246 - RNA, 14 nt, Human
uggucccaccccac

SEQ ID NO: 1660247 - RNA, 15 nt, Human
uggucccaccccaca

SEQ ID NO: 1660248 - RNA, 18 nt, Human
uggucaccaaaucagcug

SEQ ID NO: 1660249 - RNA, 22 nt, Human
uggucagauuugaacucuucaa

SEQ ID NO: 1660250 - RNA, 20 nt, Human
uggucaccaaaucagcugcu

SEQ ID NO: 1660251 - RNA, 15 nt, Human
uggucucgaacuccu

SEQ ID NO: 1660252 - RNA, 16 nt, Human
uggucugacccacugc

SEQ ID NO: 1660253 - RNA, 17 nt, Human
uggucugacccacugcu

SEQ ID NO: 1660254 - RNA, 18 nt, Human
uggucugacccacugcuu

SEQ ID NO: 1660255 - RNA, 22 nt, Human
aggguguccggucccuguccca

SEQ ID NO: 1660256 - RNA, 13 nt, Human
aggguuauaauaa

SEQ ID NO: 1660257 - RNA, 17 nt, Human
aggguuaugauuaagua

SEQ ID NO: 1660258 - RNA, 19 nt, Human
agguauaaguggugugugu

SEQ ID NO: 1660259 - RNA, 20 nt, Human
agguauaaguggugugugua

SEQ ID NO: 1660260 - RNA, 23 nt, Human
agguauaauucacauuguauuca

SEQ ID NO: 1660261 - RNA, 21 nt, Human
agguaugcaaucaaaucugcu

SEQ ID NO: 1660262 - RNA, 23 nt, Human
agguagaaauaucugaaaaugua

SEQ ID NO: 1660263 - RNA, 13 nt, Human
aggguugggcugg

SEQ ID NO: 1660264 - RNA, 18 nt, Human
aggguuggccccugcccg

SEQ ID NO: 1660265 - RNA, 23 nt, Human
aggguuggccccugcccggcugc

SEQ ID NO: 1660266 - RNA, 17 nt, Human
agguagaaauaucugaa

SEQ ID NO: 1660267 - RNA, 19 nt, Human
agguagaaauaucugaaaa

SEQ ID NO: 1660268 - RNA, 23 nt, Human
agguacuucaaauccuugaagau

SEQ ID NO: 1660269 - RNA, 19 nt, Human
aggucaccuuuauucuggc

SEQ ID NO: 1660270 - RNA, 18 nt, Human
aggucaccuuuauucugg

SEQ ID NO: 1660271 - RNA, 20 nt, Human
aggucauuuuuuuuaagaaa

SEQ ID NO: 1660272 - RNA, 17 nt, Human
aggucauuuuuuuuaag

SEQ ID NO: 1660273 - RNA, 12 nt, Human
aggucagagccu

SEQ ID NO: 1660274 - RNA, 23 nt, Human
uggaaggggacacgugacagccg

SEQ ID NO: 1660275 - RNA, 13 nt, Human
uggaagguauuua

SEQ ID NO: 1660276 - RNA, 17 nt, Human
uggaagguauuuaauag

SEQ ID NO: 1660277 - RNA, 18 nt, Human
uggaaguacuauaauuua

SEQ ID NO: 1660278 - RNA, 14 nt, Human
uggaaaucuuuaaa

SEQ ID NO: 1660279 - RNA, 15 nt, Human
uggaaaucuuuaaaa

SEQ ID NO: 1660280 - RNA, 17 nt, Human
uggaaaugggcagagca

SEQ ID NO: 1660281 - RNA, 18 nt, Human
uggaaaugggcagagcag

SEQ ID NO: 1660282 - RNA, 16 nt, Human
uggaagcacagcuuca

SEQ ID NO: 1660283 - RNA, 13 nt, Human
aggauccugagcc

SEQ ID NO: 1660284 - RNA, 14 nt, Human
aggauccugagcca

SEQ ID NO: 1660285 - RNA, 16 nt, Human
ugcuuugugauuuuug

SEQ ID NO: 1660286 - RNA, 14 nt, Human
ugcuuugugauuuu

SEQ ID NO: 1660287 - RNA, 12 nt, Human
ugcuuugugauu

SEQ ID NO: 1660288 - RNA, 22 nt, Human
ugcuuguacauaaugcgugcau

SEQ ID NO: 1660289 - RNA, 16 nt, Human
ugcuuguacauaaugc

SEQ ID NO: 1660290 - RNA, 14 nt, Human
ugcuuguacauaau

SEQ ID NO: 1660291 - RNA, 17 nt, Human
ugcuuugugauuuuugu

SEQ ID NO: 1660292 - RNA, 14 nt, Human
ugcuuuuggucugu

SEQ ID NO: 1660293 - RNA, 17 nt, Human
ugcuuuuggucugugug

SEQ ID NO: 1660294 - RNA, 13 nt, Human
ugcuuguacauaa

SEQ ID NO: 1660295 - RNA, 12 nt, Human
ugcuuguacaua

SEQ ID NO: 1660296 - RNA, 14 nt, Human
ugcuuggaggaagg

SEQ ID NO: 1660297 - RNA, 15 nt, Human
ugcuuggaggaagga

SEQ ID NO: 1660298 - RNA, 16 nt, Human
ugcuuggaggaaggaa

SEQ ID NO: 1660299 - RNA, 21 nt, Human
ugcuugaggcaacucaucuua

SEQ ID NO: 1660300 - RNA, 23 nt, Human
aggacagcccuucuuuccacaga

SEQ ID NO: 1660301 - RNA, 17 nt, Human
uggacuguggugacuuu

SEQ ID NO: 1660302 - RNA, 19 nt, Human
uggacuguggugacuuugg

SEQ ID NO: 1660303 - RNA, 21 nt, Human
uggacuguggugacuuuggau

SEQ ID NO: 1660304 - RNA, 22 nt, Human
uggacuguggugacuuuggaua

SEQ ID NO: 1660305 - RNA, 15 nt, Human
uggacuguggugacu

SEQ ID NO: 1660306 - RNA, 16 nt, Human
uggacuguggugacuu

SEQ ID NO: 1660307 - RNA, 20 nt, Human
uggaccuugaacuggguacu

SEQ ID NO: 1660308 - RNA, 23 nt, Human
uggacacagcucuucuccaggcu

SEQ ID NO: 1660309 - RNA, 16 nt, Human
uggacccugaggccca

SEQ ID NO: 1660310 - RNA, 18 nt, Human
uggacccugaggcccaga

SEQ ID NO: 1660311 - RNA, 19 nt, Human
uggacccugaggcccagag

SEQ ID NO: 1660312 - RNA, 20 nt, Human
uggacccugaggcccagagg

SEQ ID NO: 1660313 - RNA, 21 nt, Human
uggacccugaggcccagaggg

SEQ ID NO: 1660314 - RNA, 23 nt, Human
uggacccuguggaugauaaaaca

SEQ ID NO: 1660315 - RNA, 22 nt, Human
uggacacagcucuucuccaggc

SEQ ID NO: 1660316 - RNA, 13 nt, Human
uggacacagcucu

SEQ ID NO: 1660317 - RNA, 14 nt, Human
uggacacagcucuu

SEQ ID NO: 1660318 - RNA, 19 nt, Human
aggaucucuugagccuggg

SEQ ID NO: 1660319 - RNA, 17 nt, Human
aggaucucuugagccug

SEQ ID NO: 1660320 - RNA, 18 nt, Human
aggaucucuugagccugg

SEQ ID NO: 1660321 - RNA, 14 nt, Human
aggcaaaugacuuu

SEQ ID NO: 1660322 - RNA, 15 nt, Human
aggcaaaugacuuug

SEQ ID NO: 1660323 - RNA, 18 nt, Human
aggcaaaugacuuuggac

SEQ ID NO: 1660324 - RNA, 20 nt, Human
aggcaccuaccaccacgccc

SEQ ID NO: 1660325 - RNA, 14 nt, Human
aggcaaugcuggcu

SEQ ID NO: 1660326 - RNA, 20 nt, Human
aggcacccaccaucaugucu

SEQ ID NO: 1660327 - RNA, 21 nt, Human
aggcacccaccaucaugucug

SEQ ID NO: 1660328 - RNA, 22 nt, Human
aggcacccaccaucaugucugg

SEQ ID NO: 1660329 - RNA, 13 nt, Human
aggcaaucauggu

SEQ ID NO: 1660330 - RNA, 14 nt, Human
uggagcucguggaa

SEQ ID NO: 1660331 - RNA, 13 nt, Human
uggagaagcggcu

SEQ ID NO: 1660332 - RNA, 22 nt, Human
uggagaagcggcuggcagccca

SEQ ID NO: 1660333 - RNA, 14 nt, Human
uggagaagaacuga

SEQ ID NO: 1660334 - RNA, 15 nt, Human
uggacugugugcuca

SEQ ID NO: 1660335 - RNA, 14 nt, Human
uggagaacuagaga

SEQ ID NO: 1660336 - RNA, 13 nt, Human
uggagaagaacug

SEQ ID NO: 1660337 - RNA, 17 nt, Human
uggauuauauuaugaag

SEQ ID NO: 1660338 - RNA, 21 nt, Human
uggauuguccccgacccuugc

SEQ ID NO: 1660339 - RNA, 13 nt, Human
uggauuguccccg

SEQ ID NO: 1660340 - RNA, 15 nt, Human
uggauggaaggggcu

SEQ ID NO: 1660341 - RNA, 14 nt, Human
uggaguauauguca

SEQ ID NO: 1660342 - RNA, 16 nt, Human
aggcagccccauucug

SEQ ID NO: 1660343 - RNA, 17 nt, Human
aggcagccccauucugc

SEQ ID NO: 1660344 - RNA, 16 nt, Human
aggccaaaggaagcac

SEQ ID NO: 1660345 - RNA, 18 nt, Human
aggccaaaggaagcacau

SEQ ID NO: 1660346 - RNA, 19 nt, Human
aggccaaaggaagcacaug

SEQ ID NO: 1660347 - RNA, 20 nt, Human
aggccaaaggaagcacaugc

SEQ ID NO: 1660348 - RNA, 16 nt, Human
aggccaaggugggagg

SEQ ID NO: 1660349 - RNA, 20 nt, Human
uggagguacgaaaagagggg

SEQ ID NO: 1660350 - RNA, 16 nt, Human
aggccccgcccaggcu

SEQ ID NO: 1660351 - RNA, 20 nt, Human
aggccagagggagugacaga

SEQ ID NO: 1660352 - RNA, 21 nt, Human
aggcccagagggccugcaagg

SEQ ID NO: 1660353 - RNA, 17 nt, Human
uggcagccuuggcaaac

SEQ ID NO: 1660354 - RNA, 15 nt, Human
uggcagcucaccucu

SEQ ID NO: 1660355 - RNA, 19 nt, Human
uggcagcucaccucucccu

SEQ ID NO: 1660356 - RNA, 17 nt, Human
aggccacaagacccuug

SEQ ID NO: 1660357 - RNA, 18 nt, Human
aggccacaagacccuugu

SEQ ID NO: 1660358 - RNA, 19 nt, Human
aggccacaagacccuugug

SEQ ID NO: 1660359 - RNA, 14 nt, Human
aggccagagggagu

SEQ ID NO: 1660360 - RNA, 18 nt, Human
uggcacagggcaguggga

SEQ ID NO: 1660361 - RNA, 18 nt, Human
uggcacaguuuucugaga

SEQ ID NO: 1660362 - RNA, 19 nt, Human
uggcacaguuuucugagaa

SEQ ID NO: 1660363 - RNA, 20 nt, Human
uggcacaguuuucugagaaa

SEQ ID NO: 1660364 - RNA, 13 nt, Human
uggccucuucaga

SEQ ID NO: 1660365 - RNA, 14 nt, Human
uggcccugcccugg

SEQ ID NO: 1660366 - RNA, 13 nt, Human
uggcccacgcacu

SEQ ID NO: 1660367 - RNA, 18 nt, Human
uggccugagcugggauga

SEQ ID NO: 1660368 - RNA, 18 nt, Human
uggccuggccccucaggg

SEQ ID NO: 1660369 - RNA, 21 nt, Human
uggccuggccccucagggucc

SEQ ID NO: 1660370 - RNA, 20 nt, Human
aggccugggggcugggcaga

SEQ ID NO: 1660371 - RNA, 12 nt, Human
aggccuggggac

SEQ ID NO: 1660372 - RNA, 18 nt, Human
aggccugggggcugggca

SEQ ID NO: 1660373 - RNA, 14 nt, Human
uggccuucggccuc

SEQ ID NO: 1660374 - RNA, 11 nt, Human
uggccaggugg

SEQ ID NO: 1660375 - RNA, 15 nt, Human
uggccagguggccac

SEQ ID NO: 1660376 - RNA, 21 nt, Human
uggccaaagccaaagcuaggc

SEQ ID NO: 1660377 - RNA, 23 nt, Human
uggccaaagccaaagcuaggccu

SEQ ID NO: 1660378 - RNA, 16 nt, Human
uggccagguggccacu

SEQ ID NO: 1660379 - RNA, 17 nt, Human
uggccagguggccacuc

SEQ ID NO: 1660380 - RNA, 19 nt, Human
uggccagguggccacucca

SEQ ID NO: 1660381 - RNA, 23 nt, Human
uggccagugugacaaggauugcu

SEQ ID NO: 1660382 - RNA, 12 nt, Human
aggccccugcca

SEQ ID NO: 1660383 - RNA, 17 nt, Human
aggccccgcccaggcuu

SEQ ID NO: 1660384 - RNA, 21 nt, Human
uggcauaacauaaaucuguga

SEQ ID NO: 1660385 - RNA, 22 nt, Human
uggcauaacauaaaucugugaa

SEQ ID NO: 1660386 - RNA, 15 nt, Human
uggcauagagcagca

SEQ ID NO: 1660387 - RNA, 21 nt, Human
uggcauagagcagcacuaaau

SEQ ID NO: 1660388 - RNA, 14 nt, Human
agcuguguggcagu

SEQ ID NO: 1660389 - RNA, 16 nt, Human
agcuguguggcagucu

SEQ ID NO: 1660390 - RNA, 21 nt, Human
agcugugcucuggacaggcau

SEQ ID NO: 1660391 - RNA, 23 nt, Human
agcugugcucuggacaggcaugu

SEQ ID NO: 1660392 - RNA, 20 nt, Human
agcugugcucuggacaggca

SEQ ID NO: 1660393 - RNA, 15 nt, Human
agcugggacuacagg

SEQ ID NO: 1660394 - RNA, 20 nt, Human
ugccuguugggccaggagcc

SEQ ID NO: 1660395 - RNA, 21 nt, Human
ugccuguucagcuccagcuca

SEQ ID NO: 1660396 - RNA, 19 nt, Human
ugccuguugggccaggagc

SEQ ID NO: 1660397 - RNA, 15 nt, Human
ugccuuauggaacac

SEQ ID NO: 1660398 - RNA, 16 nt, Human
ugccuuauggaacacu

SEQ ID NO: 1660399 - RNA, 13 nt, Human
agcuguucagcug

SEQ ID NO: 1660400 - RNA, 14 nt, Human
agcuguucagcugg

SEQ ID NO: 1660401 - RNA, 18 nt, Human
ugccuguucagcuccagc

SEQ ID NO: 1660402 - RNA, 20 nt, Human
ugccuguucagcuccagcuc

SEQ ID NO: 1660403 - RNA, 14 nt, Human
agcuguuacugucu

SEQ ID NO: 1660404 - RNA, 16 nt, Human
agcuguucacagccag

SEQ ID NO: 1660405 - RNA, 19 nt, Human
agcuguucacagccagacu

SEQ ID NO: 1660406 - RNA, 15 nt, Human
ugccugcccuauucu

SEQ ID NO: 1660407 - RNA, 14 nt, Human
ugccugcccaggcc

SEQ ID NO: 1660408 - RNA, 15 nt, Human
ugccugcccaggccc

SEQ ID NO: 1660409 - RNA, 16 nt, Human
ugccugcccaggcccc

SEQ ID NO: 1660410 - RNA, 12 nt, Human
ugcccaggcagg

SEQ ID NO: 1660411 - RNA, 13 nt, Human
ugcccaggcaggu

SEQ ID NO: 1660412 - RNA, 14 nt, Human
ugcccaggcagguc

SEQ ID NO: 1660413 - RNA, 13 nt, Human
ugccucugccucu

SEQ ID NO: 1660414 - RNA, 14 nt, Human
ugccucugccucug

SEQ ID NO: 1660415 - RNA, 15 nt, Human
ugccucugccucuga

SEQ ID NO: 1660416 - RNA, 22 nt, Human
agcuggaucuccauucucucag

SEQ ID NO: 1660417 - RNA, 21 nt, Human
agcugcuuuugucuaugggac

SEQ ID NO: 1660418 - RNA, 22 nt, Human
agcugcuuuugucuaugggacu

SEQ ID NO: 1660419 - RNA, 21 nt, Human
agcugcuugggcuucauccuc

SEQ ID NO: 1660420 - RNA, 21 nt, Human
agcugccuguucagcuccagc

SEQ ID NO: 1660421 - RNA, 22 nt, Human
agcugccuguucagcuccagcu

SEQ ID NO: 1660422 - RNA, 14 nt, Human
ugccuggauggggc

SEQ ID NO: 1660423 - RNA, 15 nt, Human
ugccuggauggggcu

SEQ ID NO: 1660424 - RNA, 22 nt, Human
agcugcccucuccugggcagcu

SEQ ID NO: 1660425 - RNA, 15 nt, Human
agcugccuccccucc

SEQ ID NO: 1660426 - RNA, 20 nt, Human
agcugccuguucagcuccag

SEQ ID NO: 1660427 - RNA, 17 nt, Human
agcugccuccccuccuc

SEQ ID NO: 1660428 - RNA, 16 nt, Human
agcugccuccccuccu

SEQ ID NO: 1660429 - RNA, 22 nt, Human
ugcggacagccacggccaggcc

SEQ ID NO: 1660430 - RNA, 23 nt, Human
ugcggacagccacggccaggcca

SEQ ID NO: 1660431 - RNA, 17 nt, Human
ugcgggucacaggaggg

SEQ ID NO: 1660432 - RNA, 14 nt, Human
ugcgggucacagga

SEQ ID NO: 1660433 - RNA, 16 nt, Human
ugcgggucacaggagg

SEQ ID NO: 1660434 - RNA, 18 nt, Human
ugcgguccacccaggagc

SEQ ID NO: 1660435 - RNA, 12 nt, Human
ugcuaaggacuu

SEQ ID NO: 1660436 - RNA, 21 nt, Human
ugcggugcuaucucccccagc

SEQ ID NO: 1660437 - RNA, 17 nt, Human
ugcggugcuaucucccc

SEQ ID NO: 1660438 - RNA, 20 nt, Human
ugcgggcuuccuccuggugu

SEQ ID NO: 1660439 - RNA, 17 nt, Human
ugcggccuuuggcuuca

SEQ ID NO: 1660440 - RNA, 19 nt, Human
ugcggccuuuggcuucacg

SEQ ID NO: 1660441 - RNA, 11 nt, Human
ugcuacacacu

SEQ ID NO: 1660442 - RNA, 20 nt, Human
ugcuacaaaaacacagcaag

SEQ ID NO: 1660443 - RNA, 13 nt, Human
ugcuaaggacuug

SEQ ID NO: 1660444 - RNA, 18 nt, Human
ugcuaaggacuuguuaga

SEQ ID NO: 1660445 - RNA, 22 nt, Human
ugcuaaggacuuguuagaucua

SEQ ID NO: 1660446 - RNA, 16 nt, Human
ugcuacaaaaacacag

SEQ ID NO: 1660447 - RNA, 17 nt, Human
ugcuacaaaaacacagc

SEQ ID NO: 1660448 - RNA, 18 nt, Human
ugcuacaaaaacacagca

SEQ ID NO: 1660449 - RNA, 19 nt, Human
ugcuacaaaaacacagcaa

SEQ ID NO: 1660450 - RNA, 14 nt, Human
agcuugaggguugg

SEQ ID NO: 1660451 - RNA, 18 nt, Human
agcuugaggguugggcug

SEQ ID NO: 1660452 - RNA, 22 nt, Human
agcuugaggguugggcuggugu

SEQ ID NO: 1660453 - RNA, 18 nt, Human
agcuuguaaauagcucag

SEQ ID NO: 1660454 - RNA, 19 nt, Human
agcuugaccgugaggccag

SEQ ID NO: 1660455 - RNA, 17 nt, Human
agcuugaaacugagaug

SEQ ID NO: 1660456 - RNA, 23 nt, Human
aggaauggagccugcacggugaa

SEQ ID NO: 1660457 - RNA, 13 nt, Human
ugcugcccugccc

SEQ ID NO: 1660458 - RNA, 16 nt, Human
ugcugcccugcccacc

SEQ ID NO: 1660459 - RNA, 17 nt, Human
ugcugcccugcccaccu

SEQ ID NO: 1660460 - RNA, 18 nt, Human
ugcugcccugcccaccug

SEQ ID NO: 1660461 - RNA, 12 nt, Human
ugcugcccugug

SEQ ID NO: 1660462 - RNA, 11 nt, Human
ugcugcccugu

SEQ ID NO: 1660463 - RNA, 19 nt, Human
ugcugcccugcccaccugg

SEQ ID NO: 1660464 - RNA, 21 nt, Human
ugcugcccugcccaccuggcc

SEQ ID NO: 1660465 - RNA, 13 nt, Human
ugcuggcugccuu

SEQ ID NO: 1660466 - RNA, 19 nt, Human
ugcugggauuacaagcgug

SEQ ID NO: 1660467 - RNA, 19 nt, Human
ugcuggcuguuggcugggg

SEQ ID NO: 1660468 - RNA, 21 nt, Human
ugcuggcuguuggcugggggc

SEQ ID NO: 1660469 - RNA, 21 nt, Human
ugcugggauuacaagcgugag

SEQ ID NO: 1660470 - RNA, 17 nt, Human
ugcugggauuacaggug

SEQ ID NO: 1660471 - RNA, 21 nt, Human
ugcuguauuuuaaaagaauga

SEQ ID NO: 1660472 - RNA, 22 nt, Human
ugcuguauuuuaaaagaaugau

SEQ ID NO: 1660473 - RNA, 13 nt, Human
ugcuguauuuuaa

SEQ ID NO: 1660474 - RNA, 16 nt, Human
ugcuuccagugaggcu

SEQ ID NO: 1660475 - RNA, 18 nt, Human
aggacacuaaccacgcug

SEQ ID NO: 1660476 - RNA, 17 nt, Human
aggacagccccuccucc

SEQ ID NO: 1660477 - RNA, 19 nt, Human
aggacacuaaccacgcugg

SEQ ID NO: 1660478 - RNA, 17 nt, Human
aggacacugauaugggu

SEQ ID NO: 1660479 - RNA, 12 nt, Human
ugcuucaaggau

SEQ ID NO: 1660480 - RNA, 20 nt, Human
ugcuucaaggauccugagcc

SEQ ID NO: 1660481 - RNA, 21 nt, Human
ugcuucaaggauccugagcca

SEQ ID NO: 1660482 - RNA, 23 nt, Human
ugcuucaaggauccugagccaga

SEQ ID NO: 1660483 - RNA, 13 nt, Human
ugcugugcaaaug

SEQ ID NO: 1660484 - RNA, 17 nt, Human
ugcugucccuuuuccuu

SEQ ID NO: 1660485 - RNA, 19 nt, Human
ugcugucccuuacgugagu

SEQ ID NO: 1660486 - RNA, 15 nt, Human
ugcugucccuuuucc

SEQ ID NO: 1660487 - RNA, 17 nt, Human
ugcugucccuuacguga

SEQ ID NO: 1660488 - RNA, 23 nt, Human
ugcuguauuuuaaaagaaugauu

SEQ ID NO: 1660489 - RNA, 18 nt, Human
aggaagccgcuggggcca

SEQ ID NO: 1660490 - RNA, 19 nt, Human
aggaagccgcuggggccag

SEQ ID NO: 1660491 - RNA, 20 nt, Human
aggaagccgcuggggccagu

SEQ ID NO: 1660492 - RNA, 15 nt, Human
aggaaauccagggug

SEQ ID NO: 1660493 - RNA, 22 nt, Human
aggaagcacaugccucucucag

SEQ ID NO: 1660494 - RNA, 21 nt, Human
aggaagccagcaggcucucag

SEQ ID NO: 1660495 - RNA, 22 nt, Human
aggaagccagcaggcucucagg

SEQ ID NO: 1660496 - RNA, 23 nt, Human
aggaagccagcaggcucucaggc

SEQ ID NO: 1660497 - RNA, 17 nt, Human
aggaagccugauuaaag

SEQ ID NO: 1660498 - RNA, 18 nt, Human
aggaagccugauuaaaga

SEQ ID NO: 1660499 - RNA, 21 nt, Human
aggaagccugauuaaagaaug

SEQ ID NO: 1660500 - RNA, 12 nt, Human
aggaagcucagg

SEQ ID NO: 1660501 - RNA, 23 nt, Human
aggaaggaaacccagcucugguc

SEQ ID NO: 1660502 - RNA, 20 nt, Human
aggaaggaaacccagcucug

SEQ ID NO: 1660503 - RNA, 22 nt, Human
aggaaggaaacccagcucuggu

SEQ ID NO: 1660504 - RNA, 14 nt, Human
aggaaauccagggu

SEQ ID NO: 1660505 - RNA, 11 nt, Human
aggaagcacau

SEQ ID NO: 1660506 - RNA, 16 nt, Human
aggaagcacaugccuc

SEQ ID NO: 1660507 - RNA, 17 nt, Human
aggaagcacaugccucu

SEQ ID NO: 1660508 - RNA, 15 nt, Human
aggaaaucaccgaaa

SEQ ID NO: 1660509 - RNA, 19 nt, Human
aggaaaucaccgaaaacgu

SEQ ID NO: 1660510 - RNA, 13 nt, Human
aggaaauauuuau

SEQ ID NO: 1660511 - RNA, 21 nt, Human
ugcugacuguacuccucccag

SEQ ID NO: 1660512 - RNA, 22 nt, Human
ugcugacuguacuccucccagg

SEQ ID NO: 1660513 - RNA, 16 nt, Human
ugcugacuguuuucuc

SEQ ID NO: 1660514 - RNA, 13 nt, Human
aggaaaggcucca

SEQ ID NO: 1660515 - RNA, 14 nt, Human
aggaaaggcuccag

SEQ ID NO: 1660516 - RNA, 15 nt, Human
aggaaaggcuccagg

SEQ ID NO: 1660517 - RNA, 16 nt, Human
aggaaaggcuccagga

SEQ ID NO: 1660518 - RNA, 12 nt, Human
aggaaauauuua

SEQ ID NO: 1660519 - RNA, 16 nt, Human
ugcugacuguacuccu

SEQ ID NO: 1660520 - RNA, 19 nt, Human
ugcugacuguacuccuccc

SEQ ID NO: 1660521 - RNA, 17 nt, Human
ugcucuggacaggcaug

SEQ ID NO: 1660522 - RNA, 15 nt, Human
ugcucuggacaggca

SEQ ID NO: 1660523 - RNA, 16 nt, Human
ugcucuggacaggcau

SEQ ID NO: 1660524 - RNA, 14 nt, Human
ugcucuggacaggc

SEQ ID NO: 1660525 - RNA, 14 nt, Human
ugcucauggaauug

SEQ ID NO: 1660526 - RNA, 20 nt, Human
ugcuaucucccccagcccca

SEQ ID NO: 1660527 - RNA, 19 nt, Human
ugcuaucucccccagcccc

SEQ ID NO: 1660528 - RNA, 20 nt, Human
ugcacacauuuuuuaaaugc

SEQ ID NO: 1660529 - RNA, 10 nt, Human
ugcacacauu

SEQ ID NO: 1660530 - RNA, 14 nt, Human
ugcacgugugugca

SEQ ID NO: 1660531 - RNA, 15 nt, Human
ugcacgugugugcac

SEQ ID NO: 1660532 - RNA, 16 nt, Human
ugcacccucaggcagg

SEQ ID NO: 1660533 - RNA, 17 nt, Human
ugcacccucaggcaggu

SEQ ID NO: 1660534 - RNA, 22 nt, Human
agcccugcuuugggcugcccug

SEQ ID NO: 1660535 - RNA, 23 nt, Human
agcccugcuuugggcugcccugg

SEQ ID NO: 1660536 - RNA, 21 nt, Human
agcccugcuuugggcugcccu

SEQ ID NO: 1660537 - RNA, 20 nt, Human
agccccuucugacccaugcu

SEQ ID NO: 1660538 - RNA, 24 nt, Human
agccccuucugacccaugcugccc

SEQ ID NO: 1660539 - RNA, 15 nt, Human
ugcacaagcugcacc

SEQ ID NO: 1660540 - RNA, 22 nt, Human
agcccugguggcagugggagcu

SEQ ID NO: 1660541 - RNA, 23 nt, Human
agcccugguggcagugggagcug

SEQ ID NO: 1660542 - RNA, 12 nt, Human
ugcacacagcac

SEQ ID NO: 1660543 - RNA, 24 nt, Human
ugcacacagcacgggggccaagga

SEQ ID NO: 1660544 - RNA, 18 nt, Human
ugcacaagcugcacccuc

SEQ ID NO: 1660545 - RNA, 21 nt, Human
ugcacaagcugcacccucagg

SEQ ID NO: 1660546 - RNA, 22 nt, Human
agccccuggaugcagccucaca

SEQ ID NO: 1660547 - RNA, 19 nt, Human
agccccuggaugcagccuc

SEQ ID NO: 1660548 - RNA, 17 nt, Human
agccccuggaugcagcc

SEQ ID NO: 1660549 - RNA, 18 nt, Human
agccccuggaugcagccu

SEQ ID NO: 1660550 - RNA, 24 nt, Human
agccccaaaacucuccucugcugc

SEQ ID NO: 1660551 - RNA, 17 nt, Human
agccccgaggccuucuc

SEQ ID NO: 1660552 - RNA, 22 nt, Human
agccccgaggccuucucugaag

SEQ ID NO: 1660553 - RNA, 16 nt, Human
agccccgaggccuucu

SEQ ID NO: 1660554 - RNA, 15 nt, Human
ugauucuccugccuc

SEQ ID NO: 1660555 - RNA, 19 nt, Human
ugauucuccugccucagcc

SEQ ID NO: 1660556 - RNA, 20 nt, Human
ugauucuccugccucagccu

SEQ ID NO: 1660557 - RNA, 21 nt, Human
agccccaaaacucuccucugc

SEQ ID NO: 1660558 - RNA, 22 nt, Human
agccccaaaacucuccucugcu

SEQ ID NO: 1660559 - RNA, 20 nt, Human
agccccaaaacucuccucug

SEQ ID NO: 1660560 - RNA, 18 nt, Human
agcccauggcacucuaug

SEQ ID NO: 1660561 - RNA, 23 nt, Human
agcccuucuaccuuccugcaaca

SEQ ID NO: 1660562 - RNA, 23 nt, Human
ugcacuauagccuaggugacaga

SEQ ID NO: 1660563 - RNA, 22 nt, Human
agccguggcuucccgcucagcc

SEQ ID NO: 1660564 - RNA, 23 nt, Human
agccguggcuucccgcucagccc

SEQ ID NO: 1660565 - RNA, 19 nt, Human
agccguuuguuccccaaga

SEQ ID NO: 1660566 - RNA, 14 nt, Human
agccguggcuuccc

SEQ ID NO: 1660567 - RNA, 21 nt, Human
agccguggcuucccgcucagc

SEQ ID NO: 1660568 - RNA, 20 nt, Human
agccgagauagccaaggcca

SEQ ID NO: 1660569 - RNA, 13 nt, Human
agccguggcuucc

SEQ ID NO: 1660570 - RNA, 17 nt, Human
agcccuucuuuccacag

SEQ ID NO: 1660571 - RNA, 17 nt, Human
agccucagcauccuggc

SEQ ID NO: 1660572 - RNA, 19 nt, Human
agccucagcauccuggcac

SEQ ID NO: 1660573 - RNA, 20 nt, Human
agccucagcauccuggcacc

SEQ ID NO: 1660574 - RNA, 21 nt, Human
agccucagcauccuggcaccc

SEQ ID NO: 1660575 - RNA, 16 nt, Human
agccucccaaagugcu

SEQ ID NO: 1660576 - RNA, 18 nt, Human
agccuccaugcugccucc

SEQ ID NO: 1660577 - RNA, 20 nt, Human
agccuccaugcugccuccag

SEQ ID NO: 1660578 - RNA, 20 nt, Human
agccucauguccacugguuc

SEQ ID NO: 1660579 - RNA, 22 nt, Human
agccucagcauccuggcacccg

SEQ ID NO: 1660580 - RNA, 23 nt, Human
agccucagcauccuggcacccgg

SEQ ID NO: 1660581 - RNA, 15 nt, Human
agccucauguccacu

SEQ ID NO: 1660582 - RNA, 18 nt, Human
ugcaguacuuuaccuccu

SEQ ID NO: 1660583 - RNA, 12 nt, Human
ugcaggucccua

SEQ ID NO: 1660584 - RNA, 14 nt, Human
ugcaggucccuaau

SEQ ID NO: 1660585 - RNA, 15 nt, Human
ugcaggucccuaaua

SEQ ID NO: 1660586 - RNA, 16 nt, Human
ugcaggucccuaauaa

SEQ ID NO: 1660587 - RNA, 23 nt, Human
ugcauaacguauaaaagccuguu

SEQ ID NO: 1660588 - RNA, 22 nt, Human
ugcauaacguauaaaagccugu

SEQ ID NO: 1660589 - RNA, 14 nt, Human
ugcauaaguuaacu

SEQ ID NO: 1660590 - RNA, 17 nt, Human
ugcauaaguuaacuucc

SEQ ID NO: 1660591 - RNA, 17 nt, Human
ugcagccucacaguccu

SEQ ID NO: 1660592 - RNA, 16 nt, Human
ugcagccucacagucc

SEQ ID NO: 1660593 - RNA, 13 nt, Human
ugcagccucacag

SEQ ID NO: 1660594 - RNA, 15 nt, Human
ugcagccucacaguc

SEQ ID NO: 1660595 - RNA, 17 nt, Human
agccucccaaagugcug

SEQ ID NO: 1660596 - RNA, 22 nt, Human
agccugaaagaggaaugaagua

SEQ ID NO: 1660597 - RNA, 18 nt, Human
agcuaggaauuguguuua

SEQ ID NO: 1660598 - RNA, 12 nt, Human
agcuaggccugg

SEQ ID NO: 1660599 - RNA, 16 nt, Human
agcuaggccuggccag

SEQ ID NO: 1660600 - RNA, 14 nt, Human
agcuaggccuggcc

SEQ ID NO: 1660601 - RNA, 15 nt, Human
agcuaggccuggcca

SEQ ID NO: 1660602 - RNA, 18 nt, Human
agcucaggugucccugca

SEQ ID NO: 1660603 - RNA, 22 nt, Human
agcucaggugucccugcacuug

SEQ ID NO: 1660604 - RNA, 20 nt, Human
agcucaggugucccugcacu

SEQ ID NO: 1660605 - RNA, 21 nt, Human
agcucaggugucccugcacuu

SEQ ID NO: 1660606 - RNA, 21 nt, Human
ugcccagccccuucugaccca

SEQ ID NO: 1660607 - RNA, 20 nt, Human
ugcccagccccuucugaccc

SEQ ID NO: 1660608 - RNA, 20 nt, Human
ugcccacaggaucagucuga

SEQ ID NO: 1660609 - RNA, 19 nt, Human
ugcccacaggaucagucug

SEQ ID NO: 1660610 - RNA, 22 nt, Human
ugcccaagaauagaugcugacu

SEQ ID NO: 1660611 - RNA, 23 nt, Human
ugcccaagaauagaugcugacug

SEQ ID NO: 1660612 - RNA, 21 nt, Human
ugcccaagaauagaugcugac

SEQ ID NO: 1660613 - RNA, 21 nt, Human
agcucauucuccuuguguuac

SEQ ID NO: 1660614 - RNA, 20 nt, Human
agcucauucuccuuguguua

SEQ ID NO: 1660615 - RNA, 22 nt, Human
ugccacacuucaggcucuucuc

SEQ ID NO: 1660616 - RNA, 23 nt, Human
ugccacacuucaggcucuucucc

SEQ ID NO: 1660617 - RNA, 19 nt, Human
agcgugagccacugcaccg

SEQ ID NO: 1660618 - RNA, 22 nt, Human
agcgugagccacugcaccgggc

SEQ ID NO: 1660619 - RNA, 15 nt, Human
agcgugcauaaguua

SEQ ID NO: 1660620 - RNA, 19 nt, Human
agcuacuaauuuuaaaaug

SEQ ID NO: 1660621 - RNA, 14 nt, Human
agcuagacugguga

SEQ ID NO: 1660622 - RNA, 16 nt, Human
agcuagacuggugacu

SEQ ID NO: 1660623 - RNA, 17 nt, Human
agcuagacuggugacug

SEQ ID NO: 1660624 - RNA, 21 nt, Human
agcuagacuggugacugauuc

SEQ ID NO: 1660625 - RNA, 13 nt, Human
agcuagacuggug

SEQ ID NO: 1660626 - RNA, 18 nt, Human
agcuagacgagcaggcuu

SEQ ID NO: 1660627 - RNA, 13 nt, Human
agcuagaauuuga

SEQ ID NO: 1660628 - RNA, 16 nt, Human
agcuagaauuugauau

SEQ ID NO: 1660629 - RNA, 17 nt, Human
agcuacuugggaggcug

SEQ ID NO: 1660630 - RNA, 18 nt, Human
agcuacuugggaggcuga

SEQ ID NO: 1660631 - RNA, 22 nt, Human
agccugggugacagagcaagug

SEQ ID NO: 1660632 - RNA, 19 nt, Human
agccugcuccagcuguuca

SEQ ID NO: 1660633 - RNA, 22 nt, Human
agccugcuccagcuguucagcu

SEQ ID NO: 1660634 - RNA, 14 nt, Human
ugcauaccacuuuu

SEQ ID NO: 1660635 - RNA, 15 nt, Human
agccugcuccagcug

SEQ ID NO: 1660636 - RNA, 16 nt, Human
agccugcuccagcugu

SEQ ID NO: 1660637 - RNA, 17 nt, Human
agccugcuccagcuguu

SEQ ID NO: 1660638 - RNA, 12 nt, Human
ugcauaccacuu

SEQ ID NO: 1660639 - RNA, 16 nt, Human
agccugugucuuuaaa

SEQ ID NO: 1660640 - RNA, 23 nt, Human
agccugugucuuuaaaugcugcu

SEQ ID NO: 1660641 - RNA, 13 nt, Human
agccuguuuaaga

SEQ ID NO: 1660642 - RNA, 21 nt, Human
agccugugccucugggacugg

SEQ ID NO: 1660643 - RNA, 13 nt, Human
ugccacacuucag

SEQ ID NO: 1660644 - RNA, 14 nt, Human
ugccacacuucagg

SEQ ID NO: 1660645 - RNA, 15 nt, Human
ugccacacuucaggc

SEQ ID NO: 1660646 - RNA, 16 nt, Human
ugccacacuucaggcu

SEQ ID NO: 1660647 - RNA, 21 nt, Human
ugccaauaauaauaccucccu

SEQ ID NO: 1660648 - RNA, 22 nt, Human
ugccaauaauaauaccucccuu

SEQ ID NO: 1660649 - RNA, 15 nt, Human
ugccaaguuguuuga

SEQ ID NO: 1660650 - RNA, 19 nt, Human
ugccaaguuguuugagaaa

SEQ ID NO: 1660651 - RNA, 20 nt, Human
ugccaaguuguuugagaaau

SEQ ID NO: 1660652 - RNA, 22 nt, Human
ugcauuaucuagauacuguauc

SEQ ID NO: 1660653 - RNA, 21 nt, Human
ugcauuaucuagauacuguau

SEQ ID NO: 1660654 - RNA, 16 nt, Human
agcggagaaaggaagg

SEQ ID NO: 1660655 - RNA, 20 nt, Human
ugcauuaucuagauacugua

SEQ ID NO: 1660656 - RNA, 20 nt, Human
agcggagaaaggaagggcug

SEQ ID NO: 1660657 - RNA, 18 nt, Human
agcggagacggaguccca

SEQ ID NO: 1660658 - RNA, 11 nt, Human
agccuuccagg

SEQ ID NO: 1660659 - RNA, 14 nt, Human
agccuuccaggggu

SEQ ID NO: 1660660 - RNA, 16 nt, Human
agccuuccaggggugg

SEQ ID NO: 1660661 - RNA, 17 nt, Human
agccuuccagggguggg

SEQ ID NO: 1660662 - RNA, 20 nt, Human
agccuuggggcugaugcagu

SEQ ID NO: 1660663 - RNA, 19 nt, Human
ugauucccaagcucugcuc

SEQ ID NO: 1660664 - RNA, 21 nt, Human
ugauucccaagcucugcuccu

SEQ ID NO: 1660665 - RNA, 15 nt, Human
ugauucccaagcucu

SEQ ID NO: 1660666 - RNA, 16 nt, Human
ugauucccaagcucug

SEQ ID NO: 1660667 - RNA, 18 nt, Human
ugauucccaagcucugcu

SEQ ID NO: 1660668 - RNA, 15 nt, Human
ugauucauaaugacu

SEQ ID NO: 1660669 - RNA, 13 nt, Human
ugauucagcucug

SEQ ID NO: 1660670 - RNA, 14 nt, Human
ugauucagcucugc

SEQ ID NO: 1660671 - RNA, 24 nt, Human
agcccaggaaaggcuccaggagca

SEQ ID NO: 1660672 - RNA, 22 nt, Human
agcccaggaaaggcuccaggag

SEQ ID NO: 1660673 - RNA, 23 nt, Human
agcccaggaaaggcuccaggagc

SEQ ID NO: 1660674 - RNA, 17 nt, Human
agccauguuuauuacag

SEQ ID NO: 1660675 - RNA, 16 nt, Human
agccauguuuauuaca

SEQ ID NO: 1660676 - RNA, 13 nt, Human
agccauguuuauu

SEQ ID NO: 1660677 - RNA, 14 nt, Human
agccauguuuauua

SEQ ID NO: 1660678 - RNA, 19 nt, Human
agcccaggaaaggcuccag

SEQ ID NO: 1660679 - RNA, 20 nt, Human
agcccaggaaaggcuccagg

SEQ ID NO: 1660680 - RNA, 21 nt, Human
agcccaggaaaggcuccagga

SEQ ID NO: 1660681 - RNA, 23 nt, Human
agccaguaaaugggggugcauuu

SEQ ID NO: 1660682 - RNA, 12 nt, Human
agccagggucuc

SEQ ID NO: 1660683 - RNA, 21 nt, Human
agccaggccacaagacccuug

SEQ ID NO: 1660684 - RNA, 22 nt, Human
agccaggccacaagacccuugu

SEQ ID NO: 1660685 - RNA, 12 nt, Human
agccaggccaca

SEQ ID NO: 1660686 - RNA, 14 nt, Human
agccaggccacaag

SEQ ID NO: 1660687 - RNA, 19 nt, Human
agccagacuggcacaguuu

SEQ ID NO: 1660688 - RNA, 14 nt, Human
agccagacuggcac

SEQ ID NO: 1660689 - RNA, 18 nt, Human
ugauguuuuaaggaugcu

SEQ ID NO: 1660690 - RNA, 17 nt, Human
ugauguuuuaaggaugc

SEQ ID NO: 1660691 - RNA, 15 nt, Human
ugauggugguauguu

SEQ ID NO: 1660692 - RNA, 14 nt, Human
ugaugauccuaggc

SEQ ID NO: 1660693 - RNA, 20 nt, Human
ugaugauccuaggcauuugc

SEQ ID NO: 1660694 - RNA, 14 nt, Human
ugaugaucuuuaaa

SEQ ID NO: 1660695 - RNA, 17 nt, Human
ugauggugcaaugaccu

SEQ ID NO: 1660696 - RNA, 23 nt, Human
ugauggugcaaugaccuuucaau

SEQ ID NO: 1660697 - RNA, 16 nt, Human
ugauggugcaaugacc

SEQ ID NO: 1660698 - RNA, 17 nt, Human
ugaugaucuuuaaaaua

SEQ ID NO: 1660699 - RNA, 13 nt, Human
agccacugcaccg

SEQ ID NO: 1660700 - RNA, 16 nt, Human
agccacugcaccgggc

SEQ ID NO: 1660701 - RNA, 21 nt, Human
agccacugcaccgggccacag

SEQ ID NO: 1660702 - RNA, 22 nt, Human
agccacugcaccgggccacaga

SEQ ID NO: 1660703 - RNA, 12 nt, Human
ugauuaaaccaa

SEQ ID NO: 1660704 - RNA, 15 nt, Human
ugauuaauuaaaaca

SEQ ID NO: 1660705 - RNA, 16 nt, Human
ugauuaccagggacug

SEQ ID NO: 1660706 - RNA, 14 nt, Human
ugauuaccagggac

SEQ ID NO: 1660707 - RNA, 18 nt, Human
agccaccgugccuggcca

SEQ ID NO: 1660708 - RNA, 14 nt, Human
agccacggccaggc

SEQ ID NO: 1660709 - RNA, 19 nt, Human
agccaccaacauacuccca

SEQ ID NO: 1660710 - RNA, 20 nt, Human
agccaccaacauacucccau

SEQ ID NO: 1660711 - RNA, 23 nt, Human
agccaccaacauacucccaucug

SEQ ID NO: 1660712 - RNA, 14 nt, Human
agccacauuccuga

SEQ ID NO: 1660713 - RNA, 18 nt, Human
agccacauuccugaugcu

SEQ ID NO: 1660714 - RNA, 22 nt, Human
ugauccaguuuuguuuggacca

SEQ ID NO: 1660715 - RNA, 18 nt, Human
ugauccuuuuggagucag

SEQ ID NO: 1660716 - RNA, 22 nt, Human
ugauccagcagauuauucacug

SEQ ID NO: 1660717 - RNA, 21 nt, Human
ugauccagcagauuauucacu

SEQ ID NO: 1660718 - RNA, 15 nt, Human
agccacggccaggcc

SEQ ID NO: 1660719 - RNA, 13 nt, Human
ugaugaagaggag

SEQ ID NO: 1660720 - RNA, 14 nt, Human
ugaugaagaggagu

SEQ ID NO: 1660721 - RNA, 17 nt, Human
ugaugaagaaguugaua

SEQ ID NO: 1660722 - RNA, 21 nt, Human
agcauacguacacauuuuauu

SEQ ID NO: 1660723 - RNA, 20 nt, Human
agcauacguacacauuuuau

SEQ ID NO: 1660724 - RNA, 19 nt, Human
agcauacguacacauuuua

SEQ ID NO: 1660725 - RNA, 18 nt, Human
agcauacguacacauuuu

SEQ ID NO: 1660726 - RNA, 17 nt, Human
agcauacguacacauuu

SEQ ID NO: 1660727 - RNA, 16 nt, Human
agcauacguacacauu

SEQ ID NO: 1660728 - RNA, 12 nt, Human
ugagaauuaccc

SEQ ID NO: 1660729 - RNA, 21 nt, Human
agcauaauacuugcuuuggaa

SEQ ID NO: 1660730 - RNA, 15 nt, Human
agcauacguacacau

SEQ ID NO: 1660731 - RNA, 23 nt, Human
agcauaaauguugacaugggaca

SEQ ID NO: 1660732 - RNA, 17 nt, Human
ugaguacuacaguccuc

SEQ ID NO: 1660733 - RNA, 21 nt, Human
ugaguacuacaguccucccau

SEQ ID NO: 1660734 - RNA, 22 nt, Human
ugaguacuacaguccucccauc

SEQ ID NO: 1660735 - RNA, 23 nt, Human
ugaguacuacaguccucccaucu

SEQ ID NO: 1660736 - RNA, 13 nt, Human
ugaguagcuggga

SEQ ID NO: 1660737 - RNA, 16 nt, Human
agcauauucaggaagc

SEQ ID NO: 1660738 - RNA, 15 nt, Human
ugagguuuuuaagcc

SEQ ID NO: 1660739 - RNA, 14 nt, Human
agcauauucaggaa

SEQ ID NO: 1660740 - RNA, 15 nt, Human
ugaguacuacagucc

SEQ ID NO: 1660741 - RNA, 22 nt, Human
ugaguaacugauuuguaacaag

SEQ ID NO: 1660742 - RNA, 14 nt, Human
ugagucaccaagcc

SEQ ID NO: 1660743 - RNA, 16 nt, Human
ugagucaccaagccca

SEQ ID NO: 1660744 - RNA, 17 nt, Human
ugagucaccaagcccag

SEQ ID NO: 1660745 - RNA, 17 nt, Human
ugagugccuuacacaau

SEQ ID NO: 1660746 - RNA, 20 nt, Human
ugagugccuuacacaauggu

SEQ ID NO: 1660747 - RNA, 21 nt, Human
ugagugggugaauaauacagu

SEQ ID NO: 1660748 - RNA, 18 nt, Human
ugagugucuuaauuaaaa

SEQ ID NO: 1660749 - RNA, 18 nt, Human
ugaguucauacccuguua

SEQ ID NO: 1660750 - RNA, 17 nt, Human
ugaguucauacccuguu

SEQ ID NO: 1660751 - RNA, 20 nt, Human
ugauaagaaccuuuugagug

SEQ ID NO: 1660752 - RNA, 14 nt, Human
ugauaaucaacugg

SEQ ID NO: 1660753 - RNA, 18 nt, Human
ugauaaucaacugggcug

SEQ ID NO: 1660754 - RNA, 24 nt, Human
ugauaaucaacugggcugaacacu

SEQ ID NO: 1660755 - RNA, 12 nt, Human
ugauacagaaaa

SEQ ID NO: 1660756 - RNA, 21 nt, Human
ugauacaaugcugugcccuaa

SEQ ID NO: 1660757 - RNA, 20 nt, Human
ugauacaaugcugugcccua

SEQ ID NO: 1660758 - RNA, 17 nt, Human
ugauacuacaguuuguu

SEQ ID NO: 1660759 - RNA, 14 nt, Human
ugauacuacaguuu

SEQ ID NO: 1660760 - RNA, 19 nt, Human
ugauauuuucaacgcagcc

SEQ ID NO: 1660761 - RNA, 21 nt, Human
ugauauuuucaacgcagcccu

SEQ ID NO: 1660762 - RNA, 22 nt, Human
ugauauuuucaacgcagcccug

SEQ ID NO: 1660763 - RNA, 23 nt, Human
ugauauuuucaacgcagcccugc

SEQ ID NO: 1660764 - RNA, 15 nt, Human
ugauaugugaacagu

SEQ ID NO: 1660765 - RNA, 16 nt, Human
ugauaugugaacaguu

SEQ ID NO: 1660766 - RNA, 12 nt, Human
ugauaugggucu

SEQ ID NO: 1660767 - RNA, 19 nt, Human
ugaucacggcucacugcag

SEQ ID NO: 1660768 - RNA, 22 nt, Human
agcauauucaggaagcucaggg

SEQ ID NO: 1660769 - RNA, 20 nt, Human
ugaucacggcucacugcagc

SEQ ID NO: 1660770 - RNA, 21 nt, Human
ugaucacggcucacugcagcc

SEQ ID NO: 1660771 - RNA, 13 nt, Human
agcaucaggccag

SEQ ID NO: 1660772 - RNA, 17 nt, Human
agcaucacaguuuuggu

SEQ ID NO: 1660773 - RNA, 15 nt, Human
agcaucacaguuuug

SEQ ID NO: 1660774 - RNA, 20 nt, Human
agcaucacaugaacuuguaa

SEQ ID NO: 1660775 - RNA, 17 nt, Human
agcauuguaaaugugcu

SEQ ID NO: 1660776 - RNA, 18 nt, Human
agcauuguaaaugugcuu

SEQ ID NO: 1660777 - RNA, 12 nt, Human
agcauggcugcc

SEQ ID NO: 1660778 - RNA, 20 nt, Human
agcaugucgucaaagcugaa

SEQ ID NO: 1660779 - RNA, 17 nt, Human
agcaugucgucaaagcu

SEQ ID NO: 1660780 - RNA, 14 nt, Human
agcaucaggccagg

SEQ ID NO: 1660781 - RNA, 16 nt, Human
agcaucaggccaggcc

SEQ ID NO: 1660782 - RNA, 17 nt, Human
agcaucaggccaggccc

SEQ ID NO: 1660783 - RNA, 18 nt, Human
agcaucaggccaggcccu

SEQ ID NO: 1660784 - RNA, 19 nt, Human
agcaucaggccaggcccuc

SEQ ID NO: 1660785 - RNA, 20 nt, Human
agcaucaggccaggcccucu

SEQ ID NO: 1660786 - RNA, 23 nt, Human
agcaagacgcugugcugcccugc

SEQ ID NO: 1660787 - RNA, 17 nt, Human
agcaagacgcugugcug

SEQ ID NO: 1660788 - RNA, 20 nt, Human
agcaagacgcugugcugccc

SEQ ID NO: 1660789 - RNA, 21 nt, Human
agcaagacgcugugcugcccu

SEQ ID NO: 1660790 - RNA, 22 nt, Human
agcaagacgcugugcugcccug

SEQ ID NO: 1660791 - RNA, 20 nt, Human
ugagaagcagaggaaggaga

SEQ ID NO: 1660792 - RNA, 16 nt, Human
ugagaaggguguugua

SEQ ID NO: 1660793 - RNA, 13 nt, Human
agcaagacgcugu

SEQ ID NO: 1660794 - RNA, 16 nt, Human
agcaagacgcugugcu

SEQ ID NO: 1660795 - RNA, 18 nt, Human
agauuuuuuuguuguuug

SEQ ID NO: 1660796 - RNA, 19 nt, Human
agauuuuuuuguuguuugu

SEQ ID NO: 1660797 - RNA, 23 nt, Human
agauuuuuuuguuguuuguuuag

SEQ ID NO: 1660798 - RNA, 15 nt, Human
agauuuuuuuguugu

SEQ ID NO: 1660799 - RNA, 16 nt, Human
agauuuuuuuguuguu

SEQ ID NO: 1660800 - RNA, 23 nt, Human
agcaacgcaggcccccaggugcc

SEQ ID NO: 1660801 - RNA, 14 nt, Human
agauuuuauuaugu

SEQ ID NO: 1660802 - RNA, 15 nt, Human
agauuuuauuaugua

SEQ ID NO: 1660803 - RNA, 16 nt, Human
agauuuuauuauguaa

SEQ ID NO: 1660804 - RNA, 17 nt, Human
agauuuuauuauguaaa

SEQ ID NO: 1660805 - RNA, 18 nt, Human
agauuuuauuauguaaau

SEQ ID NO: 1660806 - RNA, 17 nt, Human
agauuugaacucuucaa

SEQ ID NO: 1660807 - RNA, 20 nt, Human
agauuucucauuugccaaua

SEQ ID NO: 1660808 - RNA, 19 nt, Human
agauuuuauuauguaaauc

SEQ ID NO: 1660809 - RNA, 20 nt, Human
agauuuuauuauguaaaucc

SEQ ID NO: 1660810 - RNA, 21 nt, Human
agauuuugaaauuuuuauuaa

SEQ ID NO: 1660811 - RNA, 12 nt, Human
agauuuugaaug

SEQ ID NO: 1660812 - RNA, 13 nt, Human
agauuggaaggaa

SEQ ID NO: 1660813 - RNA, 19 nt, Human
agauuccagagaguggcuc

SEQ ID NO: 1660814 - RNA, 15 nt, Human
agauucccugagcag

SEQ ID NO: 1660815 - RNA, 19 nt, Human
ugacuuacuguacaugaaa

SEQ ID NO: 1660816 - RNA, 15 nt, Human
ugacuucuaaguaaa

SEQ ID NO: 1660817 - RNA, 22 nt, Human
ugacuucuaaguaaaaccacag

SEQ ID NO: 1660818 - RNA, 23 nt, Human
ugacuucuaaguaaaaccacagc

SEQ ID NO: 1660819 - RNA, 18 nt, Human
agauuccagagaguggcu

SEQ ID NO: 1660820 - RNA, 22 nt, Human
agauucauauuuacuucuuaua

SEQ ID NO: 1660821 - RNA, 24 nt, Human
ugacuucuaaguaaaaccacagca

SEQ ID NO: 1660822 - RNA, 16 nt, Human
ugacuuacuguacaug

SEQ ID NO: 1660823 - RNA, 15 nt, Human
ugacuuacuguacau

SEQ ID NO: 1660824 - RNA, 13 nt, Human
ugacuuacuguac

SEQ ID NO: 1660825 - RNA, 18 nt, Human
ugaccugaggcccuucuc

SEQ ID NO: 1660826 - RNA, 19 nt, Human
ugaccugaggcccuucucu

SEQ ID NO: 1660827 - RNA, 20 nt, Human
agaugcugacuguacuccuc

SEQ ID NO: 1660828 - RNA, 23 nt, Human
agaugcugacuguacuccuccca

SEQ ID NO: 1660829 - RNA, 16 nt, Human
agaugccgcauuugga

SEQ ID NO: 1660830 - RNA, 16 nt, Human
agaugcaguucugaag

SEQ ID NO: 1660831 - RNA, 17 nt, Human
agaugcaguucugaaga

SEQ ID NO: 1660832 - RNA, 17 nt, Human
ugacacuuaaaaauggu

SEQ ID NO: 1660833 - RNA, 16 nt, Human
ugacacuuaaaaaugg

SEQ ID NO: 1660834 - RNA, 17 nt, Human
ugacccaugcugcccug

SEQ ID NO: 1660835 - RNA, 16 nt, Human
ugacccaugcugcccu

SEQ ID NO: 1660836 - RNA, 21 nt, Human
ugacccaugcugcccugugag

SEQ ID NO: 1660837 - RNA, 14 nt, Human
ugacccaugcugcc

SEQ ID NO: 1660838 - RNA, 15 nt, Human
ugacccaugcugccc

SEQ ID NO: 1660839 - RNA, 19 nt, Human
ugacacacagcucuguccu

SEQ ID NO: 1660840 - RNA, 20 nt, Human
ugacacacagcucuguccug

SEQ ID NO: 1660841 - RNA, 19 nt, Human
ugacaaagacugaguacgu

SEQ ID NO: 1660842 - RNA, 16 nt, Human
ugacacacagcucugu

SEQ ID NO: 1660843 - RNA, 18 nt, Human
ugacacacagcucugucc

SEQ ID NO: 1660844 - RNA, 20 nt, Human
ugacacaugcaaggucauuu

SEQ ID NO: 1660845 - RNA, 12 nt, Human
ugacacaugcaa

SEQ ID NO: 1660846 - RNA, 17 nt, Human
ugaauuuuguguuagag

SEQ ID NO: 1660847 - RNA, 21 nt, Human
ugaauuuuguguuagagauuu

SEQ ID NO: 1660848 - RNA, 23 nt, Human
ugaauuugugaagguggaaauaa

SEQ ID NO: 1660849 - RNA, 13 nt, Human
ugaauuugugaag

SEQ ID NO: 1660850 - RNA, 21 nt, Human
ugaauuugugaagguggaaau

SEQ ID NO: 1660851 - RNA, 23 nt, Human
ugaauuucuuuugccguuauuaa

SEQ ID NO: 1660852 - RNA, 16 nt, Human
agauacuguaucauga

SEQ ID NO: 1660853 - RNA, 15 nt, Human
agauacuguaucaug

SEQ ID NO: 1660854 - RNA, 18 nt, Human
agaucaaaagguuaauaa

SEQ ID NO: 1660855 - RNA, 21 nt, Human
agauauuuugcuuugugauuu

SEQ ID NO: 1660856 - RNA, 20 nt, Human
agauauuuugcuuugugauu

SEQ ID NO: 1660857 - RNA, 22 nt, Human
agauacaguuacucagaauucu

SEQ ID NO: 1660858 - RNA, 17 nt, Human
agauacuggauuguacu

SEQ ID NO: 1660859 - RNA, 14 nt, Human
agauacuggauugu

SEQ ID NO: 1660860 - RNA, 11 nt, Human
agauacuguau

SEQ ID NO: 1660861 - RNA, 13 nt, Human
agauacaguuacu

SEQ ID NO: 1660862 - RNA, 20 nt, Human
agauacaggaaaagcugcug

SEQ ID NO: 1660863 - RNA, 18 nt, Human
agauaauauuaaggaaga

SEQ ID NO: 1660864 - RNA, 22 nt, Human
agauaauauuaaggaagacaau

SEQ ID NO: 1660865 - RNA, 17 nt, Human
agauaaggguaucuggu

SEQ ID NO: 1660866 - RNA, 16 nt, Human
agauaacuguuauuua

SEQ ID NO: 1660867 - RNA, 19 nt, Human
agauaacuguuauuuauaa

SEQ ID NO: 1660868 - RNA, 20 nt, Human
agauaacuguuauuuauaau

SEQ ID NO: 1660869 - RNA, 20 nt, Human
agaguuguuacauuuuuaag

SEQ ID NO: 1660870 - RNA, 19 nt, Human
agaguuguuacauuuuuaa

SEQ ID NO: 1660871 - RNA, 21 nt, Human
agaguuguuacauuuuuaagu

SEQ ID NO: 1660872 - RNA, 17 nt, Human
agaguuguuacauuuuu

SEQ ID NO: 1660873 - RNA, 22 nt, Human
agagucagaaguuucugccgca

SEQ ID NO: 1660874 - RNA, 15 nt, Human
agagucacuggaaca

SEQ ID NO: 1660875 - RNA, 15 nt, Human
ugaagucacugcaca

SEQ ID NO: 1660876 - RNA, 16 nt, Human
ugaagucacugcacag

SEQ ID NO: 1660877 - RNA, 21 nt, Human
ugaagucacugcacagugcau

SEQ ID NO: 1660878 - RNA, 16 nt, Human
ugaauaaagacaccua

SEQ ID NO: 1660879 - RNA, 22 nt, Human
ugaaggguaauuauauaguuac

SEQ ID NO: 1660880 - RNA, 14 nt, Human
ugaagucacugcac

SEQ ID NO: 1660881 - RNA, 14 nt, Human
ugaagucacacagu

SEQ ID NO: 1660882 - RNA, 15 nt, Human
ugaauacuuuauaaa

SEQ ID NO: 1660883 - RNA, 12 nt, Human
ugaauggcuuug

SEQ ID NO: 1660884 - RNA, 15 nt, Human
ugaauggcuuuguau

SEQ ID NO: 1660885 - RNA, 18 nt, Human
ugaauauuuaguguucau

SEQ ID NO: 1660886 - RNA, 11 nt, Human
ugaauggcuuu

SEQ ID NO: 1660887 - RNA, 17 nt, Human
ugaauggcuuuguauag

SEQ ID NO: 1660888 - RNA, 18 nt, Human
ugaauggcuuuguauaga

SEQ ID NO: 1660889 - RNA, 19 nt, Human
ugaauggcuuuguauagaa

SEQ ID NO: 1660890 - RNA, 22 nt, Human
ugaauggcuuuguauagaaccu

SEQ ID NO: 1660891 - RNA, 20 nt, Human
agagggagggagggcuccag

SEQ ID NO: 1660892 - RNA, 16 nt, Human
agagggagggagggcu

SEQ ID NO: 1660893 - RNA, 12 nt, Human
ugaagccuuugu

SEQ ID NO: 1660894 - RNA, 15 nt, Human
ugaagcauuuuauaa

SEQ ID NO: 1660895 - RNA, 16 nt, Human
ugaagcauuuuauaaa

SEQ ID NO: 1660896 - RNA, 17 nt, Human
ugaagcauuuuauaaau

SEQ ID NO: 1660897 - RNA, 18 nt, Human
ugaagcauuuuauaaauc

SEQ ID NO: 1660898 - RNA, 22 nt, Human
ugaagcauuuuauaaaucgcuu

SEQ ID NO: 1660899 - RNA, 20 nt, Human
ugaagcuaucguaaaauuaa

SEQ ID NO: 1660900 - RNA, 15 nt, Human
agagguuaagguggg

SEQ ID NO: 1660901 - RNA, 16 nt, Human
agagguggggagcaga

SEQ ID NO: 1660902 - RNA, 17 nt, Human
ugaaacggaugauuucu

SEQ ID NO: 1660903 - RNA, 18 nt, Human
ugaaacggaugauuucua

SEQ ID NO: 1660904 - RNA, 19 nt, Human
ugaaacggaugauuucuau

SEQ ID NO: 1660905 - RNA, 20 nt, Human
ugaaacggaugauuucuaug

SEQ ID NO: 1660906 - RNA, 17 nt, Human
ugaaacuuguguaaaua

SEQ ID NO: 1660907 - RNA, 23 nt, Human
ugaaacuuguguaaauacaauuu

SEQ ID NO: 1660908 - RNA, 19 nt, Human
ugaaacucguuaauuugua

SEQ ID NO: 1660909 - RNA, 22 nt, Human
ugaaacugagaugugaacacau

SEQ ID NO: 1660910 - RNA, 15 nt, Human
ugaaacggaugauuu

SEQ ID NO: 1660911 - RNA, 16 nt, Human
ugaaacgcaaccacca

SEQ ID NO: 1660912 - RNA, 17 nt, Human
ugaaaauguauguguaa

SEQ ID NO: 1660913 - RNA, 19 nt, Human
ugaaaaucgugacaacacu

SEQ ID NO: 1660914 - RNA, 20 nt, Human
ugaaaaucuuauaauuuaaa

SEQ ID NO: 1660915 - RNA, 20 nt, Human
ugaaaaaggaggaagagaaa

SEQ ID NO: 1660916 - RNA, 22 nt, Human
ugaaaaaggaggaagagaaaaa

SEQ ID NO: 1660917 - RNA, 22 nt, Human
ugaaaaaguucugcagauaaac

SEQ ID NO: 1660918 - RNA, 16 nt, Human
ugaaaaucgugacaac

SEQ ID NO: 1660919 - RNA, 22 nt, Human
ucuuuggucuacacugugcuga

SEQ ID NO: 1660920 - RNA, 20 nt, Human
ucuuucuggcuaugcauuug

SEQ ID NO: 1660921 - RNA, 21 nt, Human
ucuuucuggcuaugcauuuga

SEQ ID NO: 1660922 - RNA, 23 nt, Human
ugaaaaaauauauaucaaauaua

SEQ ID NO: 1660923 - RNA, 16 nt, Human
ugaaaaaggaggaaga

SEQ ID NO: 1660924 - RNA, 14 nt, Human
agagcugccaccug

SEQ ID NO: 1660925 - RNA, 20 nt, Human
agagcuagcagcagggaggg

SEQ ID NO: 1660926 - RNA, 13 nt, Human
agagccuuccagg

SEQ ID NO: 1660927 - RNA, 15 nt, Human
agagccuuccagggg

SEQ ID NO: 1660928 - RNA, 17 nt, Human
agagccuuccaggggug

SEQ ID NO: 1660929 - RNA, 22 nt, Human
agagccuuccaggggugggaca

SEQ ID NO: 1660930 - RNA, 22 nt, Human
agagcaccuuagacagucccug

SEQ ID NO: 1660931 - RNA, 23 nt, Human
agagcaccuuagacagucccugc

SEQ ID NO: 1660932 - RNA, 12 nt, Human
ugaaacuuuugg

SEQ ID NO: 1660933 - RNA, 13 nt, Human
ugaaagacuguac

SEQ ID NO: 1660934 - RNA, 15 nt, Human
ugaaagacuguacaa

SEQ ID NO: 1660935 - RNA, 16 nt, Human
agagacuccagcuggg

SEQ ID NO: 1660936 - RNA, 11 nt, Human
agagacuccug

SEQ ID NO: 1660937 - RNA, 17 nt, Human
agagacuccugcaggca

SEQ ID NO: 1660938 - RNA, 18 nt, Human
agagacuccugcaggcag

SEQ ID NO: 1660939 - RNA, 19 nt, Human
agagacuccugcaggcagc

SEQ ID NO: 1660940 - RNA, 20 nt, Human
agagacuccugcaggcagcc

SEQ ID NO: 1660941 - RNA, 21 nt, Human
agagacuccugcaggcagcca

SEQ ID NO: 1660942 - RNA, 22 nt, Human
agagacuccugcaggcagccag

SEQ ID NO: 1660943 - RNA, 19 nt, Human
agagcaagacgcugugcug

SEQ ID NO: 1660944 - RNA, 23 nt, Human
agagcaagacgcugugcugcccu

SEQ ID NO: 1660945 - RNA, 22 nt, Human
agagaucaaccccuucgcuccu

SEQ ID NO: 1660946 - RNA, 23 nt, Human
agagacuccugcaggcagccagg

SEQ ID NO: 1660947 - RNA, 11 nt, Human
ucuuccucugc

SEQ ID NO: 1660948 - RNA, 12 nt, Human
ucuuccucugcu

SEQ ID NO: 1660949 - RNA, 14 nt, Human
ucuuccucugcuga

SEQ ID NO: 1660950 - RNA, 15 nt, Human
ucuuccucccucccu

SEQ ID NO: 1660951 - RNA, 14 nt, Human
ucuuccucccuccc

SEQ ID NO: 1660952 - RNA, 19 nt, Human
ucuucccuacaguugaaaa

SEQ ID NO: 1660953 - RNA, 22 nt, Human
ucuucccuacaguugaaaaaca

SEQ ID NO: 1660954 - RNA, 21 nt, Human
ucuuccaggcugggagagccu

SEQ ID NO: 1660955 - RNA, 20 nt, Human
ucuucagagacuccugcagg

SEQ ID NO: 1660956 - RNA, 15 nt, Human
ucuuccaggcuggga

SEQ ID NO: 1660957 - RNA, 17 nt, Human
ucuuccaggcugggaga

SEQ ID NO: 1660958 - RNA, 20 nt, Human
ucuuccaggcugggagagcc

SEQ ID NO: 1660959 - RNA, 16 nt, Human
ucuucaacugaccagc

SEQ ID NO: 1660960 - RNA, 19 nt, Human
ucuucaacugaccagccuc

SEQ ID NO: 1660961 - RNA, 15 nt, Human
ucuucaacucccugc

SEQ ID NO: 1660962 - RNA, 14 nt, Human
agaaucacuugaac

SEQ ID NO: 1660963 - RNA, 17 nt, Human
ucuucagagacuccugc

SEQ ID NO: 1660964 - RNA, 18 nt, Human
ucuucagagacuccugca

SEQ ID NO: 1660965 - RNA, 12 nt, Human
ucuucagagacu

SEQ ID NO: 1660966 - RNA, 15 nt, Human
ucuucacaacagauu

SEQ ID NO: 1660967 - RNA, 21 nt, Human
ucuucugaacuuggcgcugcc

SEQ ID NO: 1660968 - RNA, 12 nt, Human
ucuucugcuuca

SEQ ID NO: 1660969 - RNA, 19 nt, Human
ucuucugcuucagccuccc

SEQ ID NO: 1660970 - RNA, 20 nt, Human
ucuucuguggguuucuaaag

SEQ ID NO: 1660971 - RNA, 18 nt, Human
ucuucuggguuccuuccu

SEQ ID NO: 1660972 - RNA, 15 nt, Human
ucuucuguacgucug

SEQ ID NO: 1660973 - RNA, 20 nt, Human
ucuucuguacgucugacagg

SEQ ID NO: 1660974 - RNA, 19 nt, Human
agacauacuaaccagcaga

SEQ ID NO: 1660975 - RNA, 21 nt, Human
agacauagaauuaacacauga

SEQ ID NO: 1660976 - RNA, 17 nt, Human
agacaucaacagauaaa

SEQ ID NO: 1660977 - RNA, 18 nt, Human
agacaucaacagauaaau

SEQ ID NO: 1660978 - RNA, 21 nt, Human
ucuugaugccuggcggggugg

SEQ ID NO: 1660979 - RNA, 13 nt, Human
ucuugauucauaa

SEQ ID NO: 1660980 - RNA, 15 nt, Human
ucuugauuaaaaguu

SEQ ID NO: 1660981 - RNA, 16 nt, Human
ucuugagccuugaacu

SEQ ID NO: 1660982 - RNA, 13 nt, Human
ucuugagccuggg

SEQ ID NO: 1660983 - RNA, 16 nt, Human
ucuugagccugggagg

SEQ ID NO: 1660984 - RNA, 14 nt, Human
agaccccuggcuuu

SEQ ID NO: 1660985 - RNA, 11 nt, Human
agaccuucucc

SEQ ID NO: 1660986 - RNA, 15 nt, Human
agaccuucuccuuca

SEQ ID NO: 1660987 - RNA, 18 nt, Human
agaccuucuccuucaccu

SEQ ID NO: 1660988 - RNA, 21 nt, Human
agaccuucuccuucaccuuug

SEQ ID NO: 1660989 - RNA, 23 nt, Human
agaccuucuccuucaccuuuguc

SEQ ID NO: 1660990 - RNA, 16 nt, Human
agacuauucaaacagu

SEQ ID NO: 1660991 - RNA, 15 nt, Human
agacuauucaaacag

SEQ ID NO: 1660992 - RNA, 12 nt, Human
agacuauucaaa

SEQ ID NO: 1660993 - RNA, 14 nt, Human
agacuauucaaaca

SEQ ID NO: 1660994 - RNA, 17 nt, Human
ucuuggucagauuugaa

SEQ ID NO: 1660995 - RNA, 14 nt, Human
ucuugguccugcug

SEQ ID NO: 1660996 - RNA, 19 nt, Human
ucuugcaauggcagccuug

SEQ ID NO: 1660997 - RNA, 18 nt, Human
ucuugcaauggcagccuu

SEQ ID NO: 1660998 - RNA, 22 nt, Human
ucuugcaauggcagccuuggca

SEQ ID NO: 1660999 - RNA, 23 nt, Human
ucuugcaauggcagccuuggcaa

SEQ ID NO: 1661000 - RNA, 18 nt, Human
ucuuucuaaugugugaau

SEQ ID NO: 1661001 - RNA, 19 nt, Human
ucuuucuaaugugugaauc

SEQ ID NO: 1661002 - RNA, 17 nt, Human
ucuuuccugaggcuggg

SEQ ID NO: 1661003 - RNA, 15 nt, Human
ucuugguccugcugc

SEQ ID NO: 1661004 - RNA, 17 nt, Human
ucuugguccugcugcag

SEQ ID NO: 1661005 - RNA, 16 nt, Human
ucuuuaaaugcugcuu

SEQ ID NO: 1661006 - RNA, 19 nt, Human
ucuugguccugcugcaguu

SEQ ID NO: 1661007 - RNA, 16 nt, Human
agaagcagaggaagga

SEQ ID NO: 1661008 - RNA, 19 nt, Human
agaagcaccaaucaugaau

SEQ ID NO: 1661009 - RNA, 22 nt, Human
ucugcccugcgggucacaggag

SEQ ID NO: 1661010 - RNA, 12 nt, Human
ucugcccuuggu

SEQ ID NO: 1661011 - RNA, 23 nt, Human
ucugcccuugguuaggcauugug

SEQ ID NO: 1661012 - RNA, 21 nt, Human
agaagccccacccugccucac

SEQ ID NO: 1661013 - RNA, 23 nt, Human
agaagcccaggaaaggcuccagg

SEQ ID NO: 1661014 - RNA, 20 nt, Human
ucugcccauccugccccuga

SEQ ID NO: 1661015 - RNA, 23 nt, Human
ucugcccacucccugcaaccuga

SEQ ID NO: 1661016 - RNA, 21 nt, Human
ucugcaggucccuaauaaagc

SEQ ID NO: 1661017 - RNA, 19 nt, Human
ucugcaggucccuaauaaa

SEQ ID NO: 1661018 - RNA, 22 nt, Human
ucugcaggucccuaauaaagcu

SEQ ID NO: 1661019 - RNA, 23 nt, Human
ucugcaggucccuaauaaagcug

SEQ ID NO: 1661020 - RNA, 18 nt, Human
ucugaagugaaacugcuu

SEQ ID NO: 1661021 - RNA, 22 nt, Human
ucugaagugaaacugcuuguuu

SEQ ID NO: 1661022 - RNA, 12 nt, Human
agaaauuaugug

SEQ ID NO: 1661023 - RNA, 13 nt, Human
agaaauuaaguau

SEQ ID NO: 1661024 - RNA, 17 nt, Human
agaaauuaaguaucuga

SEQ ID NO: 1661025 - RNA, 19 nt, Human
agaaccuuuugagugccuu

SEQ ID NO: 1661026 - RNA, 23 nt, Human
agaaccuuuugagugccuuacac

SEQ ID NO: 1661027 - RNA, 17 nt, Human
agaacucccuuucaaca

SEQ ID NO: 1661028 - RNA, 16 nt, Human
agaacucccuuucaac

SEQ ID NO: 1661029 - RNA, 12 nt, Human
ucugccugucuc

SEQ ID NO: 1661030 - RNA, 14 nt, Human
ucugccugucuccc

SEQ ID NO: 1661031 - RNA, 22 nt, Human
ucugcuuugggguuuaucagaa

SEQ ID NO: 1661032 - RNA, 23 nt, Human
ucugcuuuuuaaagaaugcucuu

SEQ ID NO: 1661033 - RNA, 17 nt, Human
ucuggcagcucagagag

SEQ ID NO: 1661034 - RNA, 20 nt, Human
ucuggcagaguugaagacag

SEQ ID NO: 1661035 - RNA, 23 nt, Human
ucuggcagaguugaagacagagc

SEQ ID NO: 1661036 - RNA, 18 nt, Human
ucuggcagcucagagagg

SEQ ID NO: 1661037 - RNA, 21 nt, Human
ucuggcagcucagagagggug

SEQ ID NO: 1661038 - RNA, 10 nt, Human
ucuggccuuc

SEQ ID NO: 1661039 - RNA, 22 nt, Human
agaaguuugagaucagccuggg

SEQ ID NO: 1661040 - RNA, 13 nt, Human
agaaguugauaug

SEQ ID NO: 1661041 - RNA, 23 nt, Human
agaagcucccugaaguaagcaaa

SEQ ID NO: 1661042 - RNA, 20 nt, Human
ucucgcuauugucaccaggg

SEQ ID NO: 1661043 - RNA, 17 nt, Human
ucucgaacuccugaccu

SEQ ID NO: 1661044 - RNA, 15 nt, Human
ucucggcucacugca

SEQ ID NO: 1661045 - RNA, 22 nt, Human
ucucucacuuguuuuauuuaac

SEQ ID NO: 1661046 - RNA, 12 nt, Human
ucucucaggcca

SEQ ID NO: 1661047 - RNA, 21 nt, Human
ucucucaggccaaacucaccu

SEQ ID NO: 1661048 - RNA, 22 nt, Human
acuuugugcugggguuaucuga

SEQ ID NO: 1661049 - RNA, 16 nt, Human
acuuuguguucaccuu

SEQ ID NO: 1661050 - RNA, 18 nt, Human
acuuuguguucaccuugu

SEQ ID NO: 1661051 - RNA, 20 nt, Human
ucuccuuaaagaguguggca

SEQ ID NO: 1661052 - RNA, 21 nt, Human
ucuccuuggugucgggcauga

SEQ ID NO: 1661053 - RNA, 23 nt, Human
ucuccuuggugucgggcaugaca

SEQ ID NO: 1661054 - RNA, 13 nt, Human
acuuuagggaagu

SEQ ID NO: 1661055 - RNA, 16 nt, Human
acuuguuuucugggaa

SEQ ID NO: 1661056 - RNA, 22 nt, Human
acuuguuuuauuuaaccucuaa

SEQ ID NO: 1661057 - RNA, 15 nt, Human
acuuguggacacagc

SEQ ID NO: 1661058 - RNA, 16 nt, Human
acuuuaaaaggagcca

SEQ ID NO: 1661059 - RNA, 18 nt, Human
acuugucuuuggacccug

SEQ ID NO: 1661060 - RNA, 14 nt, Human
acuuguggacacag

SEQ ID NO: 1661061 - RNA, 12 nt, Human
acuuuggaaaga

SEQ ID NO: 1661062 - RNA, 13 nt, Human
acuuuggaaagag

SEQ ID NO: 1661063 - RNA, 14 nt, Human
acuuuggaaagagu

SEQ ID NO: 1661064 - RNA, 19 nt, Human
acuuuguauaaaagggacu

SEQ ID NO: 1661065 - RNA, 23 nt, Human
acuuuggaaagaguaggaagacu

SEQ ID NO: 1661066 - RNA, 16 nt, Human
agaaaugaaaaaauau

SEQ ID NO: 1661067 - RNA, 13 nt, Human
agaaaugaaaaaa

SEQ ID NO: 1661068 - RNA, 12 nt, Human
agaaaugaaaaa

SEQ ID NO: 1661069 - RNA, 20 nt, Human
ucugaaggguaauuauauag

SEQ ID NO: 1661070 - RNA, 18 nt, Human
ucugaaggcuggguucug

SEQ ID NO: 1661071 - RNA, 15 nt, Human
agaaaugccuuaccc

SEQ ID NO: 1661072 - RNA, 20 nt, Human
agaaagcagaacagugauua

SEQ ID NO: 1661073 - RNA, 17 nt, Human
agaaagcagaacaguga

SEQ ID NO: 1661074 - RNA, 18 nt, Human
agaaagcagaacagugau

SEQ ID NO: 1661075 - RNA, 20 nt, Human
agaaagacuaucuaaauguu

SEQ ID NO: 1661076 - RNA, 22 nt, Human
agaaagacuaucuaaauguuga

SEQ ID NO: 1661077 - RNA, 16 nt, Human
agaaagacuauucaaa

SEQ ID NO: 1661078 - RNA, 19 nt, Human
ucucugcaggucccuaaua

SEQ ID NO: 1661079 - RNA, 20 nt, Human
ucucugcaggucccuaauaa

SEQ ID NO: 1661080 - RNA, 21 nt, Human
ucucugcaggucccuaauaaa

SEQ ID NO: 1661081 - RNA, 22 nt, Human
ucucugcaggucccuaauaaag

SEQ ID NO: 1661082 - RNA, 16 nt, Human
ucucuugguccugcug

SEQ ID NO: 1661083 - RNA, 17 nt, Human
ucucuugguccugcugc

SEQ ID NO: 1661084 - RNA, 18 nt, Human
ucucuugguccugcugca

SEQ ID NO: 1661085 - RNA, 18 nt, Human
agaaaaaugagccuggca

SEQ ID NO: 1661086 - RNA, 19 nt, Human
agaaaaaauauuuucccua

SEQ ID NO: 1661087 - RNA, 17 nt, Human
agaaaaaauauuuuccu

SEQ ID NO: 1661088 - RNA, 23 nt, Human
agaaaaaauauuuuccugccagg

SEQ ID NO: 1661089 - RNA, 16 nt, Human
agaaaacaaggaugaa

SEQ ID NO: 1661090 - RNA, 16 nt, Human
agaaacacaacuauau

SEQ ID NO: 1661091 - RNA, 23 nt, Human
agaaacuuaagguuaccuuuguu

SEQ ID NO: 1661092 - RNA, 15 nt, Human
agaaacauuugguaa

SEQ ID NO: 1661093 - RNA, 18 nt, Human
acuguacagacagaaaaa

SEQ ID NO: 1661094 - RNA, 16 nt, Human
acuguacaugaaaaca

SEQ ID NO: 1661095 - RNA, 19 nt, Human
acuguacaugaaaacacau

SEQ ID NO: 1661096 - RNA, 17 nt, Human
acuggguacuuguggac

SEQ ID NO: 1661097 - RNA, 18 nt, Human
acuggguacuuguggaca

SEQ ID NO: 1661098 - RNA, 16 nt, Human
acuguacaaaguagaa

SEQ ID NO: 1661099 - RNA, 22 nt, Human
acuguacaaaguagaagucuua

SEQ ID NO: 1661100 - RNA, 23 nt, Human
acuguacuugcucuugaugccug

SEQ ID NO: 1661101 - RNA, 14 nt, Human
acuguaucaugaca

SEQ ID NO: 1661102 - RNA, 20 nt, Human
acuguacuccucccaggcgc

SEQ ID NO: 1661103 - RNA, 15 nt, Human
acuguacuugcucuu

SEQ ID NO: 1661104 - RNA, 21 nt, Human
acuguacaugaaaacacauuu

SEQ ID NO: 1661105 - RNA, 20 nt, Human
acuguacaugaaaacacauu

SEQ ID NO: 1661106 - RNA, 20 nt, Human
acuguaucaugacaaagacu

SEQ ID NO: 1661107 - RNA, 16 nt, Human
acuguaucaugacaaa

SEQ ID NO: 1661108 - RNA, 23 nt, Human
acugucagcuccccucggagaag

SEQ ID NO: 1661109 - RNA, 22 nt, Human
acugggcuuggggaccagagcu

SEQ ID NO: 1661110 - RNA, 21 nt, Human
acugggcuuggggaccagagc

SEQ ID NO: 1661111 - RNA, 21 nt, Human
acugggcugaacacuccaauu

SEQ ID NO: 1661112 - RNA, 15 nt, Human
acuggguacuugugg

SEQ ID NO: 1661113 - RNA, 23 nt, Human
ucgcugugucagcauagaaguaa

SEQ ID NO: 1661114 - RNA, 16 nt, Human
acugggcugaacacuc

SEQ ID NO: 1661115 - RNA, 18 nt, Human
ucgcccuggacugugugc

SEQ ID NO: 1661116 - RNA, 22 nt, Human
acugaagaagcaccaaucauga

SEQ ID NO: 1661117 - RNA, 19 nt, Human
ucggggagaggcugaggac

SEQ ID NO: 1661118 - RNA, 23 nt, Human
ucgucacugcuuaacuucacaua

SEQ ID NO: 1661119 - RNA, 17 nt, Human
acuguuaauaguucagg

SEQ ID NO: 1661120 - RNA, 21 nt, Human
acuguuaauaguucagguaac

SEQ ID NO: 1661121 - RNA, 13 nt, Human
acuguggguagac

SEQ ID NO: 1661122 - RNA, 21 nt, Human
ucuacccucuuagaaaaacca

SEQ ID NO: 1661123 - RNA, 17 nt, Human
ucuaccaaaaaucucaa

SEQ ID NO: 1661124 - RNA, 13 nt, Human
ucuaaacugcccc

SEQ ID NO: 1661125 - RNA, 16 nt, Human
ucuaaacugcccccuc

SEQ ID NO: 1661126 - RNA, 22 nt, Human
ucuaaacugcccccucugcccu

SEQ ID NO: 1661127 - RNA, 23 nt, Human
ucuaaacugcccccucugcccug

SEQ ID NO: 1661128 - RNA, 17 nt, Human
ucuaaagcugccagccg

SEQ ID NO: 1661129 - RNA, 16 nt, Human
ucuaaaggcuaccuuu

SEQ ID NO: 1661130 - RNA, 13 nt, Human
ucuaaaggcuacc

SEQ ID NO: 1661131 - RNA, 13 nt, Human
acuuguauuaugu

SEQ ID NO: 1661132 - RNA, 14 nt, Human
acuuguauuaugug

SEQ ID NO: 1661133 - RNA, 14 nt, Human
acuuguaugaaaga

SEQ ID NO: 1661134 - RNA, 15 nt, Human
acuuguauuaugugu

SEQ ID NO: 1661135 - RNA, 14 nt, Human
acuugucuuuggac

SEQ ID NO: 1661136 - RNA, 14 nt, Human
acuuggaagcuccg

SEQ ID NO: 1661137 - RNA, 19 nt, Human
acuugagaauuacccuuuu

SEQ ID NO: 1661138 - RNA, 17 nt, Human
acuugaaaauuaacaug

SEQ ID NO: 1661139 - RNA, 18 nt, Human
acuugaaaauuaacauga

SEQ ID NO: 1661140 - RNA, 16 nt, Human
acuugaaauuugaauu

SEQ ID NO: 1661141 - RNA, 23 nt, Human
acuugaacccgggaggcagaggu

SEQ ID NO: 1661142 - RNA, 16 nt, Human
ucuauuguuucuuuca

SEQ ID NO: 1661143 - RNA, 16 nt, Human
ucucaaaaaaagaaaa

SEQ ID NO: 1661144 - RNA, 13 nt, Human
ucucacuccuacc

SEQ ID NO: 1661145 - RNA, 17 nt, Human
ucucaaaacugcacugu

SEQ ID NO: 1661146 - RNA, 22 nt, Human
acuucgggaggucgaggcagga

SEQ ID NO: 1661147 - RNA, 13 nt, Human
acuucuaaguaaa

SEQ ID NO: 1661148 - RNA, 18 nt, Human
acuucuaaguaaaaccac

SEQ ID NO: 1661149 - RNA, 19 nt, Human
acuucuaaguaaaaccaca

SEQ ID NO: 1661150 - RNA, 21 nt, Human
acuucuaaguaaaaccacagc

SEQ ID NO: 1661151 - RNA, 17 nt, Human
acuucgggaggucgagg

SEQ ID NO: 1661152 - RNA, 20 nt, Human
acuucgggaggucgaggcag

SEQ ID NO: 1661153 - RNA, 16 nt, Human
ucucacuccuaccugg

SEQ ID NO: 1661154 - RNA, 17 nt, Human
ucucacuccuaccuggu

SEQ ID NO: 1661155 - RNA, 18 nt, Human
ucucacuccuaccuggua

SEQ ID NO: 1661156 - RNA, 12 nt, Human
ucuaccugaggg

SEQ ID NO: 1661157 - RNA, 19 nt, Human
ucuaccugaggggccucuu

SEQ ID NO: 1661158 - RNA, 15 nt, Human
acuuacuguacauga

SEQ ID NO: 1661159 - RNA, 20 nt, Human
acuuagagguggggagcaga

SEQ ID NO: 1661160 - RNA, 14 nt, Human
acuuacuguacaug

SEQ ID NO: 1661161 - RNA, 13 nt, Human
acuuacuguacau

SEQ ID NO: 1661162 - RNA, 16 nt, Human
acuuacuguacaugaa

SEQ ID NO: 1661163 - RNA, 17 nt, Human
acuucaggcucuucucc

SEQ ID NO: 1661164 - RNA, 18 nt, Human
acuucaggcucuucuccu

SEQ ID NO: 1661165 - RNA, 20 nt, Human
acuucaggcucuucuccuuu

SEQ ID NO: 1661166 - RNA, 17 nt, Human
acuucauuaauaauaaa

SEQ ID NO: 1661167 - RNA, 18 nt, Human
acuuccaauuuacauacu

SEQ ID NO: 1661168 - RNA, 17 nt, Human
acuuccacugccauccu

SEQ ID NO: 1661169 - RNA, 17 nt, Human
acuuccauaaucuggac

SEQ ID NO: 1661170 - RNA, 20 nt, Human
acuuccagauccuggaaauc

SEQ ID NO: 1661171 - RNA, 12 nt, Human
ucuaguucacuc

SEQ ID NO: 1661172 - RNA, 16 nt, Human
ucuaguucacucucca

SEQ ID NO: 1661173 - RNA, 19 nt, Human
ucuaguucacucuccauuu

SEQ ID NO: 1661174 - RNA, 23 nt, Human
ucuaguuugauuaaauucuugca

SEQ ID NO: 1661175 - RNA, 13 nt, Human
ucuauaauuuaaa

SEQ ID NO: 1661176 - RNA, 24 nt, Human
ucuagauacuguaucaugacaaag

SEQ ID NO: 1661177 - RNA, 21 nt, Human
accgaacugauguaaguaaac

SEQ ID NO: 1661178 - RNA, 22 nt, Human
ucagguggggucacucuggcag

SEQ ID NO: 1661179 - RNA, 21 nt, Human
accgaaaacguggcugcuuca

SEQ ID NO: 1661180 - RNA, 22 nt, Human
accgaaaacguggcugcuucaa

SEQ ID NO: 1661181 - RNA, 23 nt, Human
ucagguggggucacucuggcagc

SEQ ID NO: 1661182 - RNA, 15 nt, Human
ucaggugucccugca

SEQ ID NO: 1661183 - RNA, 17 nt, Human
ucaggugucccugcacu

SEQ ID NO: 1661184 - RNA, 18 nt, Human
ucaggugucccugcacuu

SEQ ID NO: 1661185 - RNA, 20 nt, Human
acccuugccgucuaccugag

SEQ ID NO: 1661186 - RNA, 20 nt, Human
accgaaaacguggcugcuuc

SEQ ID NO: 1661187 - RNA, 15 nt, Human
acccuugugguccca

SEQ ID NO: 1661188 - RNA, 13 nt, Human
ucaguaauaacuc

SEQ ID NO: 1661189 - RNA, 13 nt, Human
ucaguaagccgug

SEQ ID NO: 1661190 - RNA, 22 nt, Human
ucagguugucugaagucacugc

SEQ ID NO: 1661191 - RNA, 22 nt, Human
ucaggugucccugcacuugcag

SEQ ID NO: 1661192 - RNA, 24 nt, Human
ucauaaagcaggcagaacucaucu

SEQ ID NO: 1661193 - RNA, 18 nt, Human
ucauaaauaaaguuuguu

SEQ ID NO: 1661194 - RNA, 19 nt, Human
ucaguuguuagugugucuu

SEQ ID NO: 1661195 - RNA, 15 nt, Human
ucagugcuucgcaga

SEQ ID NO: 1661196 - RNA, 19 nt, Human
ucaguauugaagcauuuua

SEQ ID NO: 1661197 - RNA, 22 nt, Human
ucaguauugaagcauuuuauaa

SEQ ID NO: 1661198 - RNA, 14 nt, Human
ucaguggcagcugc

SEQ ID NO: 1661199 - RNA, 15 nt, Human
ucaguggcagcugcu

SEQ ID NO: 1661200 - RNA, 16 nt, Human
ucaguggcagcugcuu

SEQ ID NO: 1661201 - RNA, 19 nt, Human
ucagugccuuauggaacac

SEQ ID NO: 1661202 - RNA, 20 nt, Human
ucagugccuuauggaacacu

SEQ ID NO: 1661203 - RNA, 22 nt, Human
ucagugccuuauggaacacucu

SEQ ID NO: 1661204 - RNA, 23 nt, Human
ucagugccuuauggaacacucug

SEQ ID NO: 1661205 - RNA, 14 nt, Human
ucaguauugaagca

SEQ ID NO: 1661206 - RNA, 15 nt, Human
ucaguauugaagcau

SEQ ID NO: 1661207 - RNA, 16 nt, Human
ucaguauugaagcauu

SEQ ID NO: 1661208 - RNA, 17 nt, Human
ucaguauugaagcauuu

SEQ ID NO: 1661209 - RNA, 18 nt, Human
ucaguauugaagcauuuu

SEQ ID NO: 1661210 - RNA, 21 nt, Human
ucagguaaucgaccugccucg

SEQ ID NO: 1661211 - RNA, 19 nt, Human
acccgcuaagagggaggga

SEQ ID NO: 1661212 - RNA, 19 nt, Human
ucagguaaucgaccugccu

SEQ ID NO: 1661213 - RNA, 20 nt, Human
ucagguaaucgaccugccuc

SEQ ID NO: 1661214 - RNA, 18 nt, Human
ucagguaaucgaccugcc

SEQ ID NO: 1661215 - RNA, 23 nt, Human
ucaggguuggccccugcccggcu

SEQ ID NO: 1661216 - RNA, 18 nt, Human
ucaggguuggccccugcc

SEQ ID NO: 1661217 - RNA, 19 nt, Human
ucaggguuggccccugccc

SEQ ID NO: 1661218 - RNA, 20 nt, Human
ucaggccaggcccucugccc

SEQ ID NO: 1661219 - RNA, 19 nt, Human
ucaggccaggcccucugcc

SEQ ID NO: 1661220 - RNA, 17 nt, Human
ucaggccaggcccucug

SEQ ID NO: 1661221 - RNA, 18 nt, Human
ucaggccaggcccucugc

SEQ ID NO: 1661222 - RNA, 12 nt, Human
ucaggggugugc

SEQ ID NO: 1661223 - RNA, 19 nt, Human
ucaggggugugcggccuuu

SEQ ID NO: 1661224 - RNA, 23 nt, Human
ucaggggugugcggccuuuggcu

SEQ ID NO: 1661225 - RNA, 13 nt, Human
ucaggccacuuga

SEQ ID NO: 1661226 - RNA, 13 nt, Human
ucaggccagcugc

SEQ ID NO: 1661227 - RNA, 14 nt, Human
ucaggccagcugcu

SEQ ID NO: 1661228 - RNA, 13 nt, Human
ucaggccaggccc

SEQ ID NO: 1661229 - RNA, 14 nt, Human
ucaggccaggcccu

SEQ ID NO: 1661230 - RNA, 15 nt, Human
ucaggccaggcccuc

SEQ ID NO: 1661231 - RNA, 16 nt, Human
ucaggccaggcccucu

SEQ ID NO: 1661232 - RNA, 12 nt, Human
acccccagccug

SEQ ID NO: 1661233 - RNA, 14 nt, Human
acccccagccugcu

SEQ ID NO: 1661234 - RNA, 13 nt, Human
acccccagccugc

SEQ ID NO: 1661235 - RNA, 17 nt, Human
ucaggcaggugggaugg

SEQ ID NO: 1661236 - RNA, 18 nt, Human
ucaggcaggugggaugga

SEQ ID NO: 1661237 - RNA, 23 nt, Human
acccugaggcccagagggccugc

SEQ ID NO: 1661238 - RNA, 11 nt, Human
acccugaggcc

SEQ ID NO: 1661239 - RNA, 13 nt, Human
acccugaggccca

SEQ ID NO: 1661240 - RNA, 19 nt, Human
acccugaggcccagagggc

SEQ ID NO: 1661241 - RNA, 21 nt, Human
acccugaggcccagagggccu

SEQ ID NO: 1661242 - RNA, 17 nt, Human
acccucauguucuuaau

SEQ ID NO: 1661243 - RNA, 15 nt, Human
acccucauguucuua

SEQ ID NO: 1661244 - RNA, 14 nt, Human
acccucauguucuu

SEQ ID NO: 1661245 - RNA, 22 nt, Human
acccgggaagggggcugggaca

SEQ ID NO: 1661246 - RNA, 15 nt, Human
acccggaggggccug

SEQ ID NO: 1661247 - RNA, 19 nt, Human
acccgggaagggggcuggg

SEQ ID NO: 1661248 - RNA, 20 nt, Human
acccgggaagggggcuggga

SEQ ID NO: 1661249 - RNA, 21 nt, Human
acccuccuuucaccacaugug

SEQ ID NO: 1661250 - RNA, 15 nt, Human
acccgggaggcagag

SEQ ID NO: 1661251 - RNA, 23 nt, Human
ucacugagacagcccgggcucug

SEQ ID NO: 1661252 - RNA, 19 nt, Human
ucacauuccugaacaggau

SEQ ID NO: 1661253 - RNA, 22 nt, Human
ucaccagccccagugcccacag

SEQ ID NO: 1661254 - RNA, 21 nt, Human
ucacuauguugcccaggcagg

SEQ ID NO: 1661255 - RNA, 21 nt, Human
ucacugcaaccuucgccaccu

SEQ ID NO: 1661256 - RNA, 18 nt, Human
ucacugcaaccuccgccu

SEQ ID NO: 1661257 - RNA, 15 nt, Human
ucacugcacagugca

SEQ ID NO: 1661258 - RNA, 14 nt, Human
ucacuguugcccag

SEQ ID NO: 1661259 - RNA, 15 nt, Human
ucacuguugcccagg

SEQ ID NO: 1661260 - RNA, 16 nt, Human
ucacuguugcccaggc

SEQ ID NO: 1661261 - RNA, 17 nt, Human
accaugggauaaaugcc

SEQ ID NO: 1661262 - RNA, 18 nt, Human
accaugggauaaaugcca

SEQ ID NO: 1661263 - RNA, 18 nt, Human
accauguuggccaggcug

SEQ ID NO: 1661264 - RNA, 19 nt, Human
accauucuccaccugccag

SEQ ID NO: 1661265 - RNA, 20 nt, Human
accauucuccaccugccagg

SEQ ID NO: 1661266 - RNA, 21 nt, Human
accauucuccaccugccaggg

SEQ ID NO: 1661267 - RNA, 22 nt, Human
accauuuugcugucccuuuucc

SEQ ID NO: 1661268 - RNA, 23 nt, Human
accauuuugcugucccuuuuccu

SEQ ID NO: 1661269 - RNA, 21 nt, Human
accauuuugggguacccacug

SEQ ID NO: 1661270 - RNA, 21 nt, Human
acccacuggacucaccucccc

SEQ ID NO: 1661271 - RNA, 14 nt, Human
acccacuggacuca

SEQ ID NO: 1661272 - RNA, 17 nt, Human
acccacuggacucaccu

SEQ ID NO: 1661273 - RNA, 20 nt, Human
acccacugcuuuuggucugu

SEQ ID NO: 1661274 - RNA, 22 nt, Human
accauuuugggguacccacugc

SEQ ID NO: 1661275 - RNA, 16 nt, Human
acccaaauguucauca

SEQ ID NO: 1661276 - RNA, 20 nt, Human
acccaaauguucaucaauga

SEQ ID NO: 1661277 - RNA, 13 nt, Human
acccaggagcccc

SEQ ID NO: 1661278 - RNA, 15 nt, Human
acccaggagccccga

SEQ ID NO: 1661279 - RNA, 13 nt, Human
acccagcgagccc

SEQ ID NO: 1661280 - RNA, 16 nt, Human
acccagcgagcccugg

SEQ ID NO: 1661281 - RNA, 17 nt, Human
acccagcgagcccuggu

SEQ ID NO: 1661282 - RNA, 13 nt, Human
accccagguuucu

SEQ ID NO: 1661283 - RNA, 11 nt, Human
acccaggugcu

SEQ ID NO: 1661284 - RNA, 23 nt, Human
acccaggugcuaggaacacuccu

SEQ ID NO: 1661285 - RNA, 19 nt, Human
accccagcuggggccaggc

SEQ ID NO: 1661286 - RNA, 22 nt, Human
accccagcuggggccaggcugg

SEQ ID NO: 1661287 - RNA, 16 nt, Human
ucagaauagaaauuag

SEQ ID NO: 1661288 - RNA, 15 nt, Human
acccagcccacuucu

SEQ ID NO: 1661289 - RNA, 16 nt, Human
ucagaauucucuaguu

SEQ ID NO: 1661290 - RNA, 20 nt, Human
ucagaauucucagaaucuca

SEQ ID NO: 1661291 - RNA, 10 nt, Human
ucagaauucu

SEQ ID NO: 1661292 - RNA, 12 nt, Human
ucagaauucuca

SEQ ID NO: 1661293 - RNA, 16 nt, Human
ucagagacuccugcag

SEQ ID NO: 1661294 - RNA, 23 nt, Human
ucagagacuccugcaggcagcca

SEQ ID NO: 1661295 - RNA, 21 nt, Human
ucagagccaccccuaaagaga

SEQ ID NO: 1661296 - RNA, 14 nt, Human
ucagagcugcccuc

SEQ ID NO: 1661297 - RNA, 13 nt, Human
ucagagcugcccu

SEQ ID NO: 1661298 - RNA, 15 nt, Human
ucagaucugccuaag

SEQ ID NO: 1661299 - RNA, 18 nt, Human
ucagaucugccuaaggac

SEQ ID NO: 1661300 - RNA, 20 nt, Human
ucagaucugccuaaggacuu

SEQ ID NO: 1661301 - RNA, 21 nt, Human
ucagaucugccuaaggacuuc

SEQ ID NO: 1661302 - RNA, 21 nt, Human
ucagaugcugugcaaauguua

SEQ ID NO: 1661303 - RNA, 13 nt, Human
ucagaucugccua

SEQ ID NO: 1661304 - RNA, 16 nt, Human
ucagaucucuaacuuc

SEQ ID NO: 1661305 - RNA, 16 nt, Human
ucagagcugcccucuc

SEQ ID NO: 1661306 - RNA, 15 nt, Human
ucagagcugcccucu

SEQ ID NO: 1661307 - RNA, 17 nt, Human
ucagagcugcccucucc

SEQ ID NO: 1661308 - RNA, 18 nt, Human
ucagagcugcccucuccu

SEQ ID NO: 1661309 - RNA, 16 nt, Human
ucacagaccuuugaac

SEQ ID NO: 1661310 - RNA, 12 nt, Human
ucaauuuaaaaa

SEQ ID NO: 1661311 - RNA, 21 nt, Human
ucacagaacccuuggagccaa

SEQ ID NO: 1661312 - RNA, 13 nt, Human
ucaauuuaaaaaa

SEQ ID NO: 1661313 - RNA, 15 nt, Human
ucacagaugggugcu

SEQ ID NO: 1661314 - RNA, 14 nt, Human
ucacagaugggugc

SEQ ID NO: 1661315 - RNA, 19 nt, Human
ucacagcuccaagaauuuc

SEQ ID NO: 1661316 - RNA, 17 nt, Human
ucacagccagacuggca

SEQ ID NO: 1661317 - RNA, 23 nt, Human
ucacagccagacuggcacaguuu

SEQ ID NO: 1661318 - RNA, 13 nt, Human
ucacauuccugaa

SEQ ID NO: 1661319 - RNA, 17 nt, Human
ucacauuccugaacagg

SEQ ID NO: 1661320 - RNA, 20 nt, Human
ucacauuccugaacaggaua

SEQ ID NO: 1661321 - RNA, 17 nt, Human
ucaccagccccagugcc

SEQ ID NO: 1661322 - RNA, 20 nt, Human
ucacauauugauuuccguua

SEQ ID NO: 1661323 - RNA, 18 nt, Human
ucacauauugauuuccgu

SEQ ID NO: 1661324 - RNA, 16 nt, Human
ucacauauugauuucc

SEQ ID NO: 1661325 - RNA, 14 nt, Human
ucacaggaaguaga

SEQ ID NO: 1661326 - RNA, 17 nt, Human
accacacagaggcugcc

SEQ ID NO: 1661327 - RNA, 15 nt, Human
accacacccagccca

SEQ ID NO: 1661328 - RNA, 16 nt, Human
accacacccagcccac

SEQ ID NO: 1661329 - RNA, 20 nt, Human
accacacccagcccacuucu

SEQ ID NO: 1661330 - RNA, 21 nt, Human
accacacccagcccacuucug

SEQ ID NO: 1661331 - RNA, 23 nt, Human
accacacccagcccacuucugcc

SEQ ID NO: 1661332 - RNA, 15 nt, Human
accaacccucagagc

SEQ ID NO: 1661333 - RNA, 16 nt, Human
accacaagacugcaca

SEQ ID NO: 1661334 - RNA, 20 nt, Human
accaaccacugcgaccacaa

SEQ ID NO: 1661335 - RNA, 17 nt, Human
accaacauacucccauc

SEQ ID NO: 1661336 - RNA, 16 nt, Human
accaacauacucccau

SEQ ID NO: 1661337 - RNA, 14 nt, Human
accaacacgagcag

SEQ ID NO: 1661338 - RNA, 19 nt, Human
accaacacgagcaggcuac

SEQ ID NO: 1661339 - RNA, 16 nt, Human
accaaaucagcugcua

SEQ ID NO: 1661340 - RNA, 19 nt, Human
accaaaucagcugcuacua

SEQ ID NO: 1661341 - RNA, 12 nt, Human
accaaaaaccag

SEQ ID NO: 1661342 - RNA, 13 nt, Human
accaaaaaccagu

SEQ ID NO: 1661343 - RNA, 23 nt, Human
accaaaaaucucaauauuucaga

SEQ ID NO: 1661344 - RNA, 20 nt, Human
ucaagagggcacugguggcc

SEQ ID NO: 1661345 - RNA, 21 nt, Human
ucaagagggcacugguggccc

SEQ ID NO: 1661346 - RNA, 17 nt, Human
ucaagagggucugagga

SEQ ID NO: 1661347 - RNA, 21 nt, Human
ucaagugauucucaugccuca

SEQ ID NO: 1661348 - RNA, 22 nt, Human
ucaagugauucucaugccucag

SEQ ID NO: 1661349 - RNA, 16 nt, Human
ucaagugauucuccug

SEQ ID NO: 1661350 - RNA, 17 nt, Human
ucaagugauucuccugc

SEQ ID NO: 1661351 - RNA, 18 nt, Human
ucaauaggaaaaacugau

SEQ ID NO: 1661352 - RNA, 19 nt, Human
ucaauaggaaaaacugauu

SEQ ID NO: 1661353 - RNA, 22 nt, Human
ucaauaggaaaaacugauuuuu

SEQ ID NO: 1661354 - RNA, 23 nt, Human
ucaauauuucagauaaucacaau

SEQ ID NO: 1661355 - RNA, 19 nt, Human
acauuuuuaagugcugcau

SEQ ID NO: 1661356 - RNA, 18 nt, Human
acauuuuuaagugcugca

SEQ ID NO: 1661357 - RNA, 15 nt, Human
acauuuuuaagugcu

SEQ ID NO: 1661358 - RNA, 23 nt, Human
acauuuuucuuagggaaggauac

SEQ ID NO: 1661359 - RNA, 13 nt, Human
acauuuuucuuag

SEQ ID NO: 1661360 - RNA, 16 nt, Human
acauuggaaacaaguc

SEQ ID NO: 1661361 - RNA, 21 nt, Human
acauugcggacagccacggcc

SEQ ID NO: 1661362 - RNA, 22 nt, Human
acauugcggacagccacggcca

SEQ ID NO: 1661363 - RNA, 14 nt, Human
acauugguguugua

SEQ ID NO: 1661364 - RNA, 16 nt, Human
acauugguguuguacu

SEQ ID NO: 1661365 - RNA, 22 nt, Human
acauugguguuguacucaauuu

SEQ ID NO: 1661366 - RNA, 23 nt, Human
acauugguguuguacucaauuuu

SEQ ID NO: 1661367 - RNA, 14 nt, Human
acauugguucuugu

SEQ ID NO: 1661368 - RNA, 16 nt, Human
acauugguucuuguau

SEQ ID NO: 1661369 - RNA, 18 nt, Human
acauugguucuuguauua

SEQ ID NO: 1661370 - RNA, 21 nt, Human
acauugguucuuguauuaaga

SEQ ID NO: 1661371 - RNA, 22 nt, Human
acauugguucuuguauuaagaa

SEQ ID NO: 1661372 - RNA, 23 nt, Human
acauugguucuuguauuaagaau

SEQ ID NO: 1661373 - RNA, 21 nt, Human
acaugucuuuucuugcaugag

SEQ ID NO: 1661374 - RNA, 16 nt, Human
acauguauuuguuugc

SEQ ID NO: 1661375 - RNA, 12 nt, Human
acauguauuugu

SEQ ID NO: 1661376 - RNA, 22 nt, Human
acauggcuggagcuagaauuug

SEQ ID NO: 1661377 - RNA, 14 nt, Human
acauggccuuugcu

SEQ ID NO: 1661378 - RNA, 15 nt, Human
acauggaguauaugu

SEQ ID NO: 1661379 - RNA, 19 nt, Human
acauggaguauaugucaag

SEQ ID NO: 1661380 - RNA, 23 nt, Human
acaugagcaucaggccaggcccu

SEQ ID NO: 1661381 - RNA, 20 nt, Human
acauggaauaacauguaauu

SEQ ID NO: 1661382 - RNA, 18 nt, Human
acauggaauaacauguaa

SEQ ID NO: 1661383 - RNA, 16 nt, Human
acaugagguacugaga

SEQ ID NO: 1661384 - RNA, 15 nt, Human
ucaaaguugccuaaa

SEQ ID NO: 1661385 - RNA, 18 nt, Human
ucaaaguugccuaaaucc

SEQ ID NO: 1661386 - RNA, 21 nt, Human
ucaaauacgugggcauucaaa

SEQ ID NO: 1661387 - RNA, 22 nt, Human
ucaaauacgugggcauucaaau

SEQ ID NO: 1661388 - RNA, 13 nt, Human
ucaaauauauuca

SEQ ID NO: 1661389 - RNA, 23 nt, Human
ucaaauacgugggcauucaaaug

SEQ ID NO: 1661390 - RNA, 23 nt, Human
acaugaaaacacauuuuucuuag

SEQ ID NO: 1661391 - RNA, 13 nt, Human
acaugagcaucag

SEQ ID NO: 1661392 - RNA, 15 nt, Human
ucaaagcaaaugucu

SEQ ID NO: 1661393 - RNA, 23 nt, Human
ucaaagcaaaugucuuccuggau

SEQ ID NO: 1661394 - RNA, 22 nt, Human
ucaaagauauuuugcuuuguga

SEQ ID NO: 1661395 - RNA, 20 nt, Human
ucaaagauauuuugcuuugu

SEQ ID NO: 1661396 - RNA, 13 nt, Human
ucaaagauauuuu

SEQ ID NO: 1661397 - RNA, 13 nt, Human
ucaaacagucuca

SEQ ID NO: 1661398 - RNA, 20 nt, Human
ucaaacagucucaggaaauc

SEQ ID NO: 1661399 - RNA, 21 nt, Human
ucaaacagucucaggaaauca

SEQ ID NO: 1661400 - RNA, 16 nt, Human
ucaaaagcugggcagg

SEQ ID NO: 1661401 - RNA, 15 nt, Human
uauuuugcuuuguga

SEQ ID NO: 1661402 - RNA, 13 nt, Human
uauuuugcuuugu

SEQ ID NO: 1661403 - RNA, 20 nt, Human
uauuuugcuuugugauuuuu

SEQ ID NO: 1661404 - RNA, 14 nt, Human
uauuuuaauaaaca

SEQ ID NO: 1661405 - RNA, 17 nt, Human
uauuuuaauaaacacuc

SEQ ID NO: 1661406 - RNA, 19 nt, Human
uauuuuaauaauguuucaa

SEQ ID NO: 1661407 - RNA, 13 nt, Human
uauuuuacauaaa

SEQ ID NO: 1661408 - RNA, 22 nt, Human
uauuuuaauaauguuucaaaca

SEQ ID NO: 1661409 - RNA, 17 nt, Human
uauuuuuguagagccag

SEQ ID NO: 1661410 - RNA, 17 nt, Human
uauuuuguguuuaggaa

SEQ ID NO: 1661411 - RNA, 20 nt, Human
uauuuuguguuuaggaacua

SEQ ID NO: 1661412 - RNA, 16 nt, Human
acaugaaaacacauuu

SEQ ID NO: 1661413 - RNA, 15 nt, Human
acaugaaaacacauu

SEQ ID NO: 1661414 - RNA, 14 nt, Human
uauuuuaagacgaa

SEQ ID NO: 1661415 - RNA, 22 nt, Human
uauuuuaagacgaaacauuugu

SEQ ID NO: 1661416 - RNA, 14 nt, Human
uauuuuaaaagaau

SEQ ID NO: 1661417 - RNA, 15 nt, Human
uauuuguuugcauag

SEQ ID NO: 1661418 - RNA, 18 nt, Human
uauuuuaaaagaaugauu

SEQ ID NO: 1661419 - RNA, 19 nt, Human
acaucuuggucagauuuga

SEQ ID NO: 1661420 - RNA, 17 nt, Human
acaucuugcucugcuga

SEQ ID NO: 1661421 - RNA, 14 nt, Human
uaugugccagauuu

SEQ ID NO: 1661422 - RNA, 19 nt, Human
uaugugccagauuuaugca

SEQ ID NO: 1661423 - RNA, 15 nt, Human
acaucuugcucugcu

SEQ ID NO: 1661424 - RNA, 16 nt, Human
acaucuugcucugcug

SEQ ID NO: 1661425 - RNA, 22 nt, Human
uccccacuugagaauuacccuu

SEQ ID NO: 1661426 - RNA, 14 nt, Human
acguacacauuuua

SEQ ID NO: 1661427 - RNA, 13 nt, Human
acguacacauuuu

SEQ ID NO: 1661428 - RNA, 12 nt, Human
acguacacauuu

SEQ ID NO: 1661429 - RNA, 13 nt, Human
acguacacacaca

SEQ ID NO: 1661430 - RNA, 14 nt, Human
acuacuagggaaau

SEQ ID NO: 1661431 - RNA, 18 nt, Human
acuacggaauaguuggcu

SEQ ID NO: 1661432 - RNA, 20 nt, Human
acuagaguuuagcuggaaaa

SEQ ID NO: 1661433 - RNA, 13 nt, Human
acuauguugauaa

SEQ ID NO: 1661434 - RNA, 12 nt, Human
acuauguaucaa

SEQ ID NO: 1661435 - RNA, 13 nt, Human
acuauucaaacag

SEQ ID NO: 1661436 - RNA, 14 nt, Human
acuauucaaacagu

SEQ ID NO: 1661437 - RNA, 16 nt, Human
acuauucaaacagucu

SEQ ID NO: 1661438 - RNA, 18 nt, Human
acuauucaaacagucuca

SEQ ID NO: 1661439 - RNA, 12 nt, Human
acuauaauguaa

SEQ ID NO: 1661440 - RNA, 13 nt, Human
acuauaauguaag

SEQ ID NO: 1661441 - RNA, 14 nt, Human
acuauaauguaagc

SEQ ID NO: 1661442 - RNA, 16 nt, Human
acuaugauuuggaaaa

SEQ ID NO: 1661443 - RNA, 15 nt, Human
acuaugauuuggaaa

SEQ ID NO: 1661444 - RNA, 21 nt, Human
acuauaauguaagcucuacug

SEQ ID NO: 1661445 - RNA, 21 nt, Human
acucacauuuauucugcucac

SEQ ID NO: 1661446 - RNA, 19 nt, Human
acucacauuuauucugcuc

SEQ ID NO: 1661447 - RNA, 20 nt, Human
acucacauuuauucugcuca

SEQ ID NO: 1661448 - RNA, 14 nt, Human
acucaaugcacuga

SEQ ID NO: 1661449 - RNA, 24 nt, Human
uccccuccucugcuugccaucccu

SEQ ID NO: 1661450 - RNA, 14 nt, Human
uccccuccucugcu

SEQ ID NO: 1661451 - RNA, 18 nt, Human
uccccuccucugcuugcc

SEQ ID NO: 1661452 - RNA, 15 nt, Human
uccccuccucugcuu

SEQ ID NO: 1661453 - RNA, 19 nt, Human
acucaccucccccaucucu

SEQ ID NO: 1661454 - RNA, 20 nt, Human
acucaccucccccaucucuu

SEQ ID NO: 1661455 - RNA, 17 nt, Human
acucaccccagccccaa

SEQ ID NO: 1661456 - RNA, 23 nt, Human
ucccugaaggccccgcccaggcu

SEQ ID NO: 1661457 - RNA, 18 nt, Human
ucccugaaggccccgccc

SEQ ID NO: 1661458 - RNA, 21 nt, Human
ucccugaaggccccgcccagg

SEQ ID NO: 1661459 - RNA, 22 nt, Human
ucccugaaggccccgcccaggc

SEQ ID NO: 1661460 - RNA, 11 nt, Human
ucccucuuucc

SEQ ID NO: 1661461 - RNA, 13 nt, Human
ucccucuuucccu

SEQ ID NO: 1661462 - RNA, 19 nt, Human
ucccuccaccucccugcaa

SEQ ID NO: 1661463 - RNA, 18 nt, Human
ucccucagucuggcccuu

SEQ ID NO: 1661464 - RNA, 20 nt, Human
ucccucagucuggcccuucc

SEQ ID NO: 1661465 - RNA, 17 nt, Human
ucccuccaccucccugc

SEQ ID NO: 1661466 - RNA, 15 nt, Human
ucccuccaccucccu

SEQ ID NO: 1661467 - RNA, 14 nt, Human
ucccuccaccuccc

SEQ ID NO: 1661468 - RNA, 23 nt, Human
acucaucuagguaaauuacaguu

SEQ ID NO: 1661469 - RNA, 12 nt, Human
acucaucuuagg

SEQ ID NO: 1661470 - RNA, 16 nt, Human
acucauugaccugagg

SEQ ID NO: 1661471 - RNA, 17 nt, Human
acucauugaccugaggc

SEQ ID NO: 1661472 - RNA, 18 nt, Human
acucauugaccugaggcc

SEQ ID NO: 1661473 - RNA, 22 nt, Human
acucauugaccugaggcccuuc

SEQ ID NO: 1661474 - RNA, 21 nt, Human
acuccaaacugacucuuaaga

SEQ ID NO: 1661475 - RNA, 21 nt, Human
acucaccugccccucaacucu

SEQ ID NO: 1661476 - RNA, 14 nt, Human
acucaccugccccu

SEQ ID NO: 1661477 - RNA, 19 nt, Human
acucaccugccccucaacu

SEQ ID NO: 1661478 - RNA, 14 nt, Human
acucagaagacacu

SEQ ID NO: 1661479 - RNA, 15 nt, Human
acucagaagacacug

SEQ ID NO: 1661480 - RNA, 16 nt, Human
acucagaagacacuga

SEQ ID NO: 1661481 - RNA, 17 nt, Human
acucagaagacacugau

SEQ ID NO: 1661482 - RNA, 18 nt, Human
acucagaagacacugaug

SEQ ID NO: 1661483 - RNA, 22 nt, Human
acucagaauucucuaguuugau

SEQ ID NO: 1661484 - RNA, 21 nt, Human
acucagaauucucuaguuuga

SEQ ID NO: 1661485 - RNA, 14 nt, Human
acucagaauucucu

SEQ ID NO: 1661486 - RNA, 17 nt, Human
acucugacaacagacuu

SEQ ID NO: 1661487 - RNA, 18 nt, Human
acucugacaacagacuuc

SEQ ID NO: 1661488 - RNA, 20 nt, Human
acucugacaacagacuucug

SEQ ID NO: 1661489 - RNA, 22 nt, Human
acucugacaacagacuucugaa

SEQ ID NO: 1661490 - RNA, 23 nt, Human
acucugacaacagacuucugaaa

SEQ ID NO: 1661491 - RNA, 14 nt, Human
acucguauaugucu

SEQ ID NO: 1661492 - RNA, 17 nt, Human
acucgcgacaaugcaaa

SEQ ID NO: 1661493 - RNA, 15 nt, Human
acucgcgacaaugca

SEQ ID NO: 1661494 - RNA, 16 nt, Human
acucgcgacaaugcaa

SEQ ID NO: 1661495 - RNA, 20 nt, Human
acucuucaguuaagccuuug

SEQ ID NO: 1661496 - RNA, 21 nt, Human
acucuucaguuaagccuuugg

SEQ ID NO: 1661497 - RNA, 13 nt, Human
acucuugaaaaau

SEQ ID NO: 1661498 - RNA, 21 nt, Human
acucuuauugcccacgcugga

SEQ ID NO: 1661499 - RNA, 19 nt, Human
acucuggcagcucagagag

SEQ ID NO: 1661500 - RNA, 20 nt, Human
acucuggcagcucagagagg

SEQ ID NO: 1661501 - RNA, 16 nt, Human
acucuggcagcucaga

SEQ ID NO: 1661502 - RNA, 17 nt, Human
acucuggcagcucagag

SEQ ID NO: 1661503 - RNA, 16 nt, Human
acucgaguuacagaca

SEQ ID NO: 1661504 - RNA, 12 nt, Human
uccuacucugug

SEQ ID NO: 1661505 - RNA, 21 nt, Human
uccuagccugugccucuggga

SEQ ID NO: 1661506 - RNA, 23 nt, Human
uccgugcuaaggacuuguuagau

SEQ ID NO: 1661507 - RNA, 13 nt, Human
uccguuaaaauac

SEQ ID NO: 1661508 - RNA, 15 nt, Human
uccguuaaaauacca

SEQ ID NO: 1661509 - RNA, 17 nt, Human
uccgugcuaaggacuug

SEQ ID NO: 1661510 - RNA, 18 nt, Human
uccgugcuaaggacuugu

SEQ ID NO: 1661511 - RNA, 14 nt, Human
acuccagaaaguga

SEQ ID NO: 1661512 - RNA, 18 nt, Human
acuccagaaagugacaag

SEQ ID NO: 1661513 - RNA, 14 nt, Human
acucuugaaaaaug

SEQ ID NO: 1661514 - RNA, 19 nt, Human
acucuugaaaaaugcaugu

SEQ ID NO: 1661515 - RNA, 21 nt, Human
acucuugaaaaaugcauguug

SEQ ID NO: 1661516 - RNA, 14 nt, Human
uccucccaccucag

SEQ ID NO: 1661517 - RNA, 15 nt, Human
uccucccaccucagc

SEQ ID NO: 1661518 - RNA, 16 nt, Human
uccucccaccucagcc

SEQ ID NO: 1661519 - RNA, 18 nt, Human
uccucccaccucagccuc

SEQ ID NO: 1661520 - RNA, 20 nt, Human
uccucccaccucagccuccc

SEQ ID NO: 1661521 - RNA, 21 nt, Human
uccucccaccucagccucccg

SEQ ID NO: 1661522 - RNA, 19 nt, Human
acucuucuugauuaaaagu

SEQ ID NO: 1661523 - RNA, 20 nt, Human
acucuucuugauuaaaaguu

SEQ ID NO: 1661524 - RNA, 13 nt, Human
uccucugagccuu

SEQ ID NO: 1661525 - RNA, 17 nt, Human
uccucugagccuuggga

SEQ ID NO: 1661526 - RNA, 12 nt, Human
uccucugagccu

SEQ ID NO: 1661527 - RNA, 12 nt, Human
uccucucugccc

SEQ ID NO: 1661528 - RNA, 13 nt, Human
uccucucugcccu

SEQ ID NO: 1661529 - RNA, 14 nt, Human
uccucucugcccua

SEQ ID NO: 1661530 - RNA, 15 nt, Human
uccucucugcccuaa

SEQ ID NO: 1661531 - RNA, 17 nt, Human
uccucuccacugccuuc

SEQ ID NO: 1661532 - RNA, 18 nt, Human
uccucuccacugccuucg

SEQ ID NO: 1661533 - RNA, 17 nt, Human
uccucuccccaugaugu

SEQ ID NO: 1661534 - RNA, 14 nt, Human
uccucugaggcuga

SEQ ID NO: 1661535 - RNA, 19 nt, Human
uccucuugccacugccucu

SEQ ID NO: 1661536 - RNA, 12 nt, Human
uccucugcugcu

SEQ ID NO: 1661537 - RNA, 21 nt, Human
uccugaaaacccuugccaugu

SEQ ID NO: 1661538 - RNA, 22 nt, Human
uccugaaaacccuugccaugug

SEQ ID NO: 1661539 - RNA, 15 nt, Human
uccugaagaauugaa

SEQ ID NO: 1661540 - RNA, 15 nt, Human
ucccacaggcccuuc

SEQ ID NO: 1661541 - RNA, 17 nt, Human
ucccacaggcccuuccu

SEQ ID NO: 1661542 - RNA, 21 nt, Human
ucccacaggcccuuccucucc

SEQ ID NO: 1661543 - RNA, 22 nt, Human
ucccacaggcccuuccucucca

SEQ ID NO: 1661544 - RNA, 14 nt, Human
ucccacaaaggaga

SEQ ID NO: 1661545 - RNA, 21 nt, Human
ucccaaagugcugggauuaca

SEQ ID NO: 1661546 - RNA, 17 nt, Human
uccauuuaauaauuaua

SEQ ID NO: 1661547 - RNA, 12 nt, Human
uccauuuggaaa

SEQ ID NO: 1661548 - RNA, 19 nt, Human
uccauuuggaaaucuuuaa

SEQ ID NO: 1661549 - RNA, 20 nt, Human
uccauuuggaaaucuuuaaa

SEQ ID NO: 1661550 - RNA, 20 nt, Human
ucccaaagugcugggauuac

SEQ ID NO: 1661551 - RNA, 16 nt, Human
ucccaaagugcuggga

SEQ ID NO: 1661552 - RNA, 15 nt, Human
ucccaaagugcuggg

SEQ ID NO: 1661553 - RNA, 19 nt, Human
ucccaccaacccucagagc

SEQ ID NO: 1661554 - RNA, 11 nt, Human
ucccaccccac

SEQ ID NO: 1661555 - RNA, 14 nt, Human
ucccaccccacaca

SEQ ID NO: 1661556 - RNA, 15 nt, Human
acggcucacugcagc

SEQ ID NO: 1661557 - RNA, 14 nt, Human
acggcucacugcag

SEQ ID NO: 1661558 - RNA, 20 nt, Human
uccagugaggcucugcccuu

SEQ ID NO: 1661559 - RNA, 18 nt, Human
uccagugaggcucugccc

SEQ ID NO: 1661560 - RNA, 19 nt, Human
uccagugaggcucugcccu

SEQ ID NO: 1661561 - RNA, 14 nt, Human
uccagugagacagc

SEQ ID NO: 1661562 - RNA, 12 nt, Human
uccauuuaauaa

SEQ ID NO: 1661563 - RNA, 15 nt, Human
uccaugaguccccug

SEQ ID NO: 1661564 - RNA, 16 nt, Human
uccaugaguccccugu

SEQ ID NO: 1661565 - RNA, 17 nt, Human
uccaugaguccccuguu

SEQ ID NO: 1661566 - RNA, 20 nt, Human
uccaucucuuguuuaaauuc

SEQ ID NO: 1661567 - RNA, 11 nt, Human
uccauccugag

SEQ ID NO: 1661568 - RNA, 22 nt, Human
uccaugaagauguagaggagaa

SEQ ID NO: 1661569 - RNA, 16 nt, Human
acggccaggccagagg

SEQ ID NO: 1661570 - RNA, 15 nt, Human
acggaugauuucuau

SEQ ID NO: 1661571 - RNA, 21 nt, Human
acggagucccaccuuggcugc

SEQ ID NO: 1661572 - RNA, 19 nt, Human
acggagucccaccuuggcu

SEQ ID NO: 1661573 - RNA, 17 nt, Human
acgcucucuggccuucg

SEQ ID NO: 1661574 - RNA, 14 nt, Human
acgcccccacuggu

SEQ ID NO: 1661575 - RNA, 23 nt, Human
acgcgugcacacaccagagccca

SEQ ID NO: 1661576 - RNA, 13 nt, Human
acgcguugaaauu

SEQ ID NO: 1661577 - RNA, 14 nt, Human
acgcguugaaauug

SEQ ID NO: 1661578 - RNA, 18 nt, Human
acgcguugaaauuguaau

SEQ ID NO: 1661579 - RNA, 20 nt, Human
acgcguugaaauuguaauua

SEQ ID NO: 1661580 - RNA, 13 nt, Human
acgcuacccggga

SEQ ID NO: 1661581 - RNA, 17 nt, Human
acgcuacccgggaaggg

SEQ ID NO: 1661582 - RNA, 18 nt, Human
acgcuacccgggaagggg

SEQ ID NO: 1661583 - RNA, 15 nt, Human
acgcucucuggccuu

SEQ ID NO: 1661584 - RNA, 16 nt, Human
acgcucucuggccuuc

SEQ ID NO: 1661585 - RNA, 23 nt, Human
acgccaggggaaaaucagccugc

SEQ ID NO: 1661586 - RNA, 11 nt, Human
acgccauccca

SEQ ID NO: 1661587 - RNA, 14 nt, Human
acgccaucccagcc

SEQ ID NO: 1661588 - RNA, 15 nt, Human
acgccaucccagccc

SEQ ID NO: 1661589 - RNA, 16 nt, Human
acgccaucccagcccc

SEQ ID NO: 1661590 - RNA, 17 nt, Human
acgccaucccagcccca

SEQ ID NO: 1661591 - RNA, 18 nt, Human
acgccaucccagccccaa

SEQ ID NO: 1661592 - RNA, 15 nt, Human
acgacugcccggcag

SEQ ID NO: 1661593 - RNA, 18 nt, Human
acgccaggggaaaaucag

SEQ ID NO: 1661594 - RNA, 18 nt, Human
uccaggcugggagagccu

SEQ ID NO: 1661595 - RNA, 14 nt, Human
uccaggcugggaga

SEQ ID NO: 1661596 - RNA, 17 nt, Human
uccaggcugggagagcc

SEQ ID NO: 1661597 - RNA, 14 nt, Human
acgaauauugcuga

SEQ ID NO: 1661598 - RNA, 17 nt, Human
accugccucggccuccc

SEQ ID NO: 1661599 - RNA, 18 nt, Human
accugccaggaagccagc

SEQ ID NO: 1661600 - RNA, 19 nt, Human
accugccaggaagccagca

SEQ ID NO: 1661601 - RNA, 16 nt, Human
accugccaggaagcca

SEQ ID NO: 1661602 - RNA, 17 nt, Human
accugccaggaagccag

SEQ ID NO: 1661603 - RNA, 14 nt, Human
accugauugugucu

SEQ ID NO: 1661604 - RNA, 16 nt, Human
accugaggggccucuu

SEQ ID NO: 1661605 - RNA, 14 nt, Human
accugaggggccuc

SEQ ID NO: 1661606 - RNA, 19 nt, Human
accugaauuuuggcugugu

SEQ ID NO: 1661607 - RNA, 18 nt, Human
accugaagacucauucuu

SEQ ID NO: 1661608 - RNA, 13 nt, Human
ucauaaugacuua

SEQ ID NO: 1661609 - RNA, 12 nt, Human
ucauaaugacuu

SEQ ID NO: 1661610 - RNA, 16 nt, Human
ucauaauaaguugcau

SEQ ID NO: 1661611 - RNA, 17 nt, Human
accugaccccugacccc

SEQ ID NO: 1661612 - RNA, 22 nt, Human
accugaagcuaucguaaaauua

SEQ ID NO: 1661613 - RNA, 23 nt, Human
accugaggcccuucucuccagcc

SEQ ID NO: 1661614 - RNA, 12 nt, Human
accugagcccca

SEQ ID NO: 1661615 - RNA, 17 nt, Human
accugagccccaaaagg

SEQ ID NO: 1661616 - RNA, 18 nt, Human
accugcggugcuaucucc

SEQ ID NO: 1661617 - RNA, 16 nt, Human
accugcggugcuaucu

SEQ ID NO: 1661618 - RNA, 21 nt, Human
accugcgucucauacucaccu

SEQ ID NO: 1661619 - RNA, 23 nt, Human
accugccuguugggccaggagcc

SEQ ID NO: 1661620 - RNA, 12 nt, Human
accugcucuccu

SEQ ID NO: 1661621 - RNA, 20 nt, Human
accuggaauauauaaccagu

SEQ ID NO: 1661622 - RNA, 16 nt, Human
ucauuugucacacacu

SEQ ID NO: 1661623 - RNA, 14 nt, Human
ucauuugucacaca

SEQ ID NO: 1661624 - RNA, 19 nt, Human
ucauuuuuaguagagacag

SEQ ID NO: 1661625 - RNA, 14 nt, Human
ucauuuuugaauac

SEQ ID NO: 1661626 - RNA, 18 nt, Human
ucauuuuuuuuaagaaaa

SEQ ID NO: 1661627 - RNA, 15 nt, Human
accuucgccaccugg

SEQ ID NO: 1661628 - RNA, 17 nt, Human
accuucgccaccugggu

SEQ ID NO: 1661629 - RNA, 17 nt, Human
accuucccaugcccugg

SEQ ID NO: 1661630 - RNA, 21 nt, Human
accuggguaacuagggaagau

SEQ ID NO: 1661631 - RNA, 22 nt, Human
accuucuccuucaccuuugucc

SEQ ID NO: 1661632 - RNA, 13 nt, Human
accuuugucccca

SEQ ID NO: 1661633 - RNA, 17 nt, Human
accuuuuuuauacauaa

SEQ ID NO: 1661634 - RNA, 16 nt, Human
accuuuuuuauacaua

SEQ ID NO: 1661635 - RNA, 18 nt, Human
accuuuuuuauacauaaa

SEQ ID NO: 1661636 - RNA, 14 nt, Human
accuuuguccccac

SEQ ID NO: 1661637 - RNA, 15 nt, Human
accuuuguccccacc

SEQ ID NO: 1661638 - RNA, 16 nt, Human
accuuuguccccaccg

SEQ ID NO: 1661639 - RNA, 14 nt, Human
accuuuuuuauaca

SEQ ID NO: 1661640 - RNA, 12 nt, Human
uccacccaccuc

SEQ ID NO: 1661641 - RNA, 13 nt, Human
uccacccaccuca

SEQ ID NO: 1661642 - RNA, 17 nt, Human
uccacccaccucagccu

SEQ ID NO: 1661643 - RNA, 20 nt, Human
uccacccaggagccccgagg

SEQ ID NO: 1661644 - RNA, 12 nt, Human
accuggccucug

SEQ ID NO: 1661645 - RNA, 13 nt, Human
accuggccucugc

SEQ ID NO: 1661646 - RNA, 18 nt, Human
uccaaggguacuaaggaa

SEQ ID NO: 1661647 - RNA, 16 nt, Human
uccaauuaaggauuuu

SEQ ID NO: 1661648 - RNA, 17 nt, Human
uccaauuaaggauuuua

SEQ ID NO: 1661649 - RNA, 15 nt, Human
uccaauuaaggauuu

SEQ ID NO: 1661650 - RNA, 19 nt, Human
uccaaaugcagcuuuaaaa

SEQ ID NO: 1661651 - RNA, 15 nt, Human
uagaaacacaacuau

SEQ ID NO: 1661652 - RNA, 17 nt, Human
uagaacucccuuucaac

SEQ ID NO: 1661653 - RNA, 18 nt, Human
uagaacucccuuucaaca

SEQ ID NO: 1661654 - RNA, 16 nt, Human
uagaacucccuuucaa

SEQ ID NO: 1661655 - RNA, 12 nt, Human
aauuccacagcu

SEQ ID NO: 1661656 - RNA, 13 nt, Human
aauuccacagcug

SEQ ID NO: 1661657 - RNA, 14 nt, Human
aauuccacagcugc

SEQ ID NO: 1661658 - RNA, 22 nt, Human
uagaauuugauaugugaacagu

SEQ ID NO: 1661659 - RNA, 20 nt, Human
uagaauuugauaugugaaca

SEQ ID NO: 1661660 - RNA, 19 nt, Human
uagaauuugauaugugaac

SEQ ID NO: 1661661 - RNA, 16 nt, Human
uagacagucccugcca

SEQ ID NO: 1661662 - RNA, 10 nt, Human
uagacagagu

SEQ ID NO: 1661663 - RNA, 18 nt, Human
uagacaauuuauuauggc

SEQ ID NO: 1661664 - RNA, 13 nt, Human
uagacacacauga

SEQ ID NO: 1661665 - RNA, 21 nt, Human
uagacagagucucacuguugc

SEQ ID NO: 1661666 - RNA, 17 nt, Human
uagacagucccugccaa

SEQ ID NO: 1661667 - RNA, 21 nt, Human
uagacagucccugccaaugga

SEQ ID NO: 1661668 - RNA, 18 nt, Human
aauuugugauacaaugcu

SEQ ID NO: 1661669 - RNA, 17 nt, Human
aauuugugauacaaugc

SEQ ID NO: 1661670 - RNA, 20 nt, Human
aauuugugauacaaugcugu

SEQ ID NO: 1661671 - RNA, 14 nt, Human
aauuugugauacaa

SEQ ID NO: 1661672 - RNA, 18 nt, Human
aauuugggggaaaauuua

SEQ ID NO: 1661673 - RNA, 15 nt, Human
acaaaguauuaagca

SEQ ID NO: 1661674 - RNA, 16 nt, Human
acaaaguauuaagcau

SEQ ID NO: 1661675 - RNA, 13 nt, Human
acaaaguauuaag

SEQ ID NO: 1661676 - RNA, 18 nt, Human
acaaaguauuaagcauau

SEQ ID NO: 1661677 - RNA, 22 nt, Human
uagagcggagaaaggaagggcu

SEQ ID NO: 1661678 - RNA, 14 nt, Human
uagagccagggucu

SEQ ID NO: 1661679 - RNA, 12 nt, Human
aauuuuacauuu

SEQ ID NO: 1661680 - RNA, 20 nt, Human
aauuuuacauggcuggagcu

SEQ ID NO: 1661681 - RNA, 13 nt, Human
acaaaaacacagc

SEQ ID NO: 1661682 - RNA, 16 nt, Human
acaaaaagcuacuuau

SEQ ID NO: 1661683 - RNA, 16 nt, Human
acaaaaacacagcaag

SEQ ID NO: 1661684 - RNA, 14 nt, Human
acaaaaacacagca

SEQ ID NO: 1661685 - RNA, 15 nt, Human
acaaaaacacagcaa

SEQ ID NO: 1661686 - RNA, 15 nt, Human
uagcacagacccugc

SEQ ID NO: 1661687 - RNA, 18 nt, Human
uagcacacacuuuugguu

SEQ ID NO: 1661688 - RNA, 20 nt, Human
uagcacagacccugcccugu

SEQ ID NO: 1661689 - RNA, 21 nt, Human
uagcacagacccugcccugug

SEQ ID NO: 1661690 - RNA, 14 nt, Human
uagcacagacccug

SEQ ID NO: 1661691 - RNA, 14 nt, Human
uagaggguguguaa

SEQ ID NO: 1661692 - RNA, 14 nt, Human
uagccaaggccaaa

SEQ ID NO: 1661693 - RNA, 13 nt, Human
uagccaaggccaa

SEQ ID NO: 1661694 - RNA, 12 nt, Human
uagccaaggcca

SEQ ID NO: 1661695 - RNA, 22 nt, Human
uagcacagacccugcccugugg

SEQ ID NO: 1661696 - RNA, 24 nt, Human
uagcacagacccugcccugugggc

SEQ ID NO: 1661697 - RNA, 12 nt, Human
uaguaaucauau

SEQ ID NO: 1661698 - RNA, 13 nt, Human
uaguagagacggg

SEQ ID NO: 1661699 - RNA, 14 nt, Human
uagucacugagaca

SEQ ID NO: 1661700 - RNA, 15 nt, Human
uaguagagacagggu

SEQ ID NO: 1661701 - RNA, 22 nt, Human
uaguagagacaggguuuugcca

SEQ ID NO: 1661702 - RNA, 13 nt, Human
uaguaaaaauaaa

SEQ ID NO: 1661703 - RNA, 16 nt, Human
uaguaaaaauaaaauu

SEQ ID NO: 1661704 - RNA, 16 nt, Human
acacaguauuacuucu

SEQ ID NO: 1661705 - RNA, 23 nt, Human
acacacagauuugagcucagccc

SEQ ID NO: 1661706 - RNA, 16 nt, Human
acacaggcccggcucc

SEQ ID NO: 1661707 - RNA, 17 nt, Human
acacaggcccggcucca

SEQ ID NO: 1661708 - RNA, 18 nt, Human
acacaggcccggcuccag

SEQ ID NO: 1661709 - RNA, 23 nt, Human
acacaggcccggcuccaggcucc

SEQ ID NO: 1661710 - RNA, 24 nt, Human
acacaggcccggcuccaggcuccu

SEQ ID NO: 1661711 - RNA, 19 nt, Human
acacaggcccggcuccagg

SEQ ID NO: 1661712 - RNA, 20 nt, Human
acacaggcccggcuccaggc

SEQ ID NO: 1661713 - RNA, 21 nt, Human
acacaggcccggcuccaggcu

SEQ ID NO: 1661714 - RNA, 22 nt, Human
acacaggcccggcuccaggcuc

SEQ ID NO: 1661715 - RNA, 22 nt, Human
acaaugacuuacuguacaugaa

SEQ ID NO: 1661716 - RNA, 20 nt, Human
acaaugacuuacuguacaug

SEQ ID NO: 1661717 - RNA, 11 nt, Human
acaaugcaaac

SEQ ID NO: 1661718 - RNA, 16 nt, Human
acaaugcaaaccauca

SEQ ID NO: 1661719 - RNA, 17 nt, Human
acaaugcaaaccaucau

SEQ ID NO: 1661720 - RNA, 18 nt, Human
acaaugcaaaccaucauu

SEQ ID NO: 1661721 - RNA, 13 nt, Human
uaggguccugggg

SEQ ID NO: 1661722 - RNA, 19 nt, Human
uaggguaagugagagaggg

SEQ ID NO: 1661723 - RNA, 17 nt, Human
uaggguuauaauaaugu

SEQ ID NO: 1661724 - RNA, 15 nt, Human
uagggugggccuuca

SEQ ID NO: 1661725 - RNA, 15 nt, Human
uaggguuauaauaau

SEQ ID NO: 1661726 - RNA, 23 nt, Human
acaaugcaaaccaucauugaaau

SEQ ID NO: 1661727 - RNA, 19 nt, Human
acaaugcaaaccaucauug

SEQ ID NO: 1661728 - RNA, 21 nt, Human
acaaugcaaaccaucauugaa

SEQ ID NO: 1661729 - RNA, 13 nt, Human
acacaacuauauu

SEQ ID NO: 1661730 - RNA, 13 nt, Human
uagcuuuucccuu

SEQ ID NO: 1661731 - RNA, 13 nt, Human
uagcuuuuuucuc

SEQ ID NO: 1661732 - RNA, 23 nt, Human
uagcuuuuuucucugauacagaa

SEQ ID NO: 1661733 - RNA, 13 nt, Human
uaggaaaaacuga

SEQ ID NO: 1661734 - RNA, 14 nt, Human
uaggaaaaacugau

SEQ ID NO: 1661735 - RNA, 17 nt, Human
uagcgcccaguugggug

SEQ ID NO: 1661736 - RNA, 21 nt, Human
uagccuuagaagucacacagu

SEQ ID NO: 1661737 - RNA, 14 nt, Human
uagcgcccaguugg

SEQ ID NO: 1661738 - RNA, 20 nt, Human
uagccuuagaagucacacag

SEQ ID NO: 1661739 - RNA, 19 nt, Human
uagggauggggcugugggg

SEQ ID NO: 1661740 - RNA, 21 nt, Human
uagggaaggauacaaaagcau

SEQ ID NO: 1661741 - RNA, 13 nt, Human
uagggaagauaau

SEQ ID NO: 1661742 - RNA, 16 nt, Human
uaggaaaaacugauuu

SEQ ID NO: 1661743 - RNA, 17 nt, Human
uaggaaaaacugauuuu

SEQ ID NO: 1661744 - RNA, 13 nt, Human
uaggauguugaaa

SEQ ID NO: 1661745 - RNA, 22 nt, Human
uauggcccuggccuagcauacg

SEQ ID NO: 1661746 - RNA, 21 nt, Human
uauggcccuggccuagcauac

SEQ ID NO: 1661747 - RNA, 20 nt, Human
uauggcccuggccuagcaua

SEQ ID NO: 1661748 - RNA, 16 nt, Human
uaugggacucaaugca

SEQ ID NO: 1661749 - RNA, 23 nt, Human
uaugggacucaaugcacugacau

SEQ ID NO: 1661750 - RNA, 10 nt, Human
uaugggagag

SEQ ID NO: 1661751 - RNA, 17 nt, Human
uaugauacuugaaaauu

SEQ ID NO: 1661752 - RNA, 14 nt, Human
uaugaucacggcuc

SEQ ID NO: 1661753 - RNA, 22 nt, Human
uaugcaugaaguaauaugcaca

SEQ ID NO: 1661754 - RNA, 14 nt, Human
uaugcuauuucuau

SEQ ID NO: 1661755 - RNA, 15 nt, Human
uaugcuauuucuaua

SEQ ID NO: 1661756 - RNA, 16 nt, Human
uaugcuauuucuauau

SEQ ID NO: 1661757 - RNA, 18 nt, Human
uaugcuauuucuauauuu

SEQ ID NO: 1661758 - RNA, 22 nt, Human
uaugcuauuucuauauuuucau

SEQ ID NO: 1661759 - RNA, 23 nt, Human
uaugcuauuucuauauuuucauu

SEQ ID NO: 1661760 - RNA, 14 nt, Human
uaugcucugcaugu

SEQ ID NO: 1661761 - RNA, 15 nt, Human
uaugccccauucaac

SEQ ID NO: 1661762 - RNA, 22 nt, Human
acagauuugagcucagcccugg

SEQ ID NO: 1661763 - RNA, 15 nt, Human
uaucuauauuuuaca

SEQ ID NO: 1661764 - RNA, 19 nt, Human
acagcacgggggccaagga

SEQ ID NO: 1661765 - RNA, 17 nt, Human
acagcagccccugcaca

SEQ ID NO: 1661766 - RNA, 14 nt, Human
acagccccuccucc

SEQ ID NO: 1661767 - RNA, 16 nt, Human
acagccccuccuccau

SEQ ID NO: 1661768 - RNA, 15 nt, Human
acagcccgggcucug

SEQ ID NO: 1661769 - RNA, 23 nt, Human
acagcccuccaucuaaacugccc

SEQ ID NO: 1661770 - RNA, 16 nt, Human
acagcccgggcucugc

SEQ ID NO: 1661771 - RNA, 20 nt, Human
uaugaagcuuuuaugugaaa

SEQ ID NO: 1661772 - RNA, 22 nt, Human
uaugaagcuuuuaugugaaaca

SEQ ID NO: 1661773 - RNA, 23 nt, Human
uaugaagcuuuuaugugaaacau

SEQ ID NO: 1661774 - RNA, 23 nt, Human
uaugaggcauuuguuugaacuga

SEQ ID NO: 1661775 - RNA, 21 nt, Human
uaugaggcauuuguuugaacu

SEQ ID NO: 1661776 - RNA, 15 nt, Human
uaugaggcauuuguu

SEQ ID NO: 1661777 - RNA, 14 nt, Human
uaugaggcauuugu

SEQ ID NO: 1661778 - RNA, 14 nt, Human
uaugaaacuugugu

SEQ ID NO: 1661779 - RNA, 19 nt, Human
uaugaaacuuguguaaaua

SEQ ID NO: 1661780 - RNA, 21 nt, Human
uaugaaacuuguguaaauaca

SEQ ID NO: 1661781 - RNA, 19 nt, Human
acagcccuucuuuccacag

SEQ ID NO: 1661782 - RNA, 22 nt, Human
acagcuugaccgugaggccaga

SEQ ID NO: 1661783 - RNA, 23 nt, Human
acagcuugaccgugaggccagag

SEQ ID NO: 1661784 - RNA, 19 nt, Human
acaggaaaagcugcugaca

SEQ ID NO: 1661785 - RNA, 20 nt, Human
acaggaaaagcugcugacag

SEQ ID NO: 1661786 - RNA, 21 nt, Human
acaggaaaagcugcugacagu

SEQ ID NO: 1661787 - RNA, 17 nt, Human
acagcuugaccgugagg

SEQ ID NO: 1661788 - RNA, 20 nt, Human
acagcuugaccgugaggcca

SEQ ID NO: 1661789 - RNA, 21 nt, Human
acagcuugaccgugaggccag

SEQ ID NO: 1661790 - RNA, 17 nt, Human
acagcuucauuuccugu

SEQ ID NO: 1661791 - RNA, 19 nt, Human
acagcuucauuuccugugu

SEQ ID NO: 1661792 - RNA, 21 nt, Human
acagcuucauuuccugugucu

SEQ ID NO: 1661793 - RNA, 15 nt, Human
acagcuaaugggaca

SEQ ID NO: 1661794 - RNA, 16 nt, Human
acagcuaaugggacac

SEQ ID NO: 1661795 - RNA, 17 nt, Human
acagcuaaugggacacu

SEQ ID NO: 1661796 - RNA, 19 nt, Human
acagcuaaugggacacuaa

SEQ ID NO: 1661797 - RNA, 14 nt, Human
acagcuguaugauu

SEQ ID NO: 1661798 - RNA, 19 nt, Human
acagcuguaugauucccag

SEQ ID NO: 1661799 - RNA, 20 nt, Human
acagcuguaugauucccagc

SEQ ID NO: 1661800 - RNA, 23 nt, Human
acagcuguaugauucccagccag

SEQ ID NO: 1661801 - RNA, 13 nt, Human
acaggcccuuccu

SEQ ID NO: 1661802 - RNA, 15 nt, Human
acaggcccuuccucu

SEQ ID NO: 1661803 - RNA, 22 nt, Human
acaggcccuuccucuccacugc

SEQ ID NO: 1661804 - RNA, 18 nt, Human
acaggcccggcuccaggc

SEQ ID NO: 1661805 - RNA, 20 nt, Human
acaggcccggcuccaggcuc

SEQ ID NO: 1661806 - RNA, 21 nt, Human
acaggcccggcuccaggcucc

SEQ ID NO: 1661807 - RNA, 22 nt, Human
acaggcccggcuccaggcuccu

SEQ ID NO: 1661808 - RNA, 13 nt, Human
acaggcaggucca

SEQ ID NO: 1661809 - RNA, 16 nt, Human
acaggcccggcuccag

SEQ ID NO: 1661810 - RNA, 17 nt, Human
acaggcccggcuccagg

SEQ ID NO: 1661811 - RNA, 16 nt, Human
acaggacucugccucc

SEQ ID NO: 1661812 - RNA, 15 nt, Human
acaggacucugccuc

SEQ ID NO: 1661813 - RNA, 15 nt, Human
acaggcagauacagg

SEQ ID NO: 1661814 - RNA, 20 nt, Human
acaggaaaauuuuaaaaaua

SEQ ID NO: 1661815 - RNA, 22 nt, Human
acaggaaccacaagacugcaca

SEQ ID NO: 1661816 - RNA, 17 nt, Human
uagucacugagacagcc

SEQ ID NO: 1661817 - RNA, 20 nt, Human
uagucacugagacagcccgg

SEQ ID NO: 1661818 - RNA, 15 nt, Human
acacuaaugaggaaa

SEQ ID NO: 1661819 - RNA, 22 nt, Human
acacuaaugaggaaacugcacu

SEQ ID NO: 1661820 - RNA, 21 nt, Human
acacucaaaagcugggcaggu

SEQ ID NO: 1661821 - RNA, 13 nt, Human
acacucaaaucaa

SEQ ID NO: 1661822 - RNA, 19 nt, Human
uauaagugauugcugguuu

SEQ ID NO: 1661823 - RNA, 18 nt, Human
acacucaaaucaagaaac

SEQ ID NO: 1661824 - RNA, 17 nt, Human
acacucaaaucaagaaa

SEQ ID NO: 1661825 - RNA, 18 nt, Human
uauaauuuaccugaaguc

SEQ ID NO: 1661826 - RNA, 21 nt, Human
uauaauuuaccugaagucuuu

SEQ ID NO: 1661827 - RNA, 22 nt, Human
uauacacuuacacuuuaugcac

SEQ ID NO: 1661828 - RNA, 18 nt, Human
uauagauuagaauucugu

SEQ ID NO: 1661829 - RNA, 19 nt, Human
uauagauuagaauucugua

SEQ ID NO: 1661830 - RNA, 18 nt, Human
uauagccuaggugacaga

SEQ ID NO: 1661831 - RNA, 15 nt, Human
uauaggcaccuacca

SEQ ID NO: 1661832 - RNA, 16 nt, Human
uauaggugcuacaaaa

SEQ ID NO: 1661833 - RNA, 23 nt, Human
uauaggaacuuaaauaaugugaa

SEQ ID NO: 1661834 - RNA, 12 nt, Human
uauaggaauuga

SEQ ID NO: 1661835 - RNA, 21 nt, Human
uauaucuauauuuuacauaaa

SEQ ID NO: 1661836 - RNA, 16 nt, Human
acacucauugaccuga

SEQ ID NO: 1661837 - RNA, 19 nt, Human
uauauauuuuuuucugaaa

SEQ ID NO: 1661838 - RNA, 13 nt, Human
acagaaauguaca

SEQ ID NO: 1661839 - RNA, 19 nt, Human
acagacauacuaaccagca

SEQ ID NO: 1661840 - RNA, 18 nt, Human
acagacauacuaaccagc

SEQ ID NO: 1661841 - RNA, 13 nt, Human
acacuuuugguua

SEQ ID NO: 1661842 - RNA, 22 nt, Human
acacuuuugguuaagucuguuu

SEQ ID NO: 1661843 - RNA, 15 nt, Human
acacuucaggcucuu

SEQ ID NO: 1661844 - RNA, 19 nt, Human
acacuucaggcucuucucc

SEQ ID NO: 1661845 - RNA, 22 nt, Human
acacuucaggcucuucuccuuu

SEQ ID NO: 1661846 - RNA, 14 nt, Human
acacuuccauaauc

SEQ ID NO: 1661847 - RNA, 18 nt, Human
acacuuacacuuuaugca

SEQ ID NO: 1661848 - RNA, 21 nt, Human
acacuuacacuuuaugcacaa

SEQ ID NO: 1661849 - RNA, 18 nt, Human
acacuguuucaaacuuua

SEQ ID NO: 1661850 - RNA, 17 nt, Human
acacuguuucaaacuuu

SEQ ID NO: 1661851 - RNA, 17 nt, Human
acacucauugaccugag

SEQ ID NO: 1661852 - RNA, 19 nt, Human
acacucauugaccugaggc

SEQ ID NO: 1661853 - RNA, 23 nt, Human
acacuguuucaaacuuuacuaug

SEQ ID NO: 1661854 - RNA, 20 nt, Human
acacuguuucaaacuuuacu

SEQ ID NO: 1661855 - RNA, 16 nt, Human
acacuuacacuuuaug

SEQ ID NO: 1661856 - RNA, 15 nt, Human
uaucccggcugcccu

SEQ ID NO: 1661857 - RNA, 19 nt, Human
uauccaacaucaacaucuu

SEQ ID NO: 1661858 - RNA, 17 nt, Human
uaucagaauucucagaa

SEQ ID NO: 1661859 - RNA, 22 nt, Human
uaucacccagaagaaaauagug

SEQ ID NO: 1661860 - RNA, 19 nt, Human
uaucacccagaagaaaaua

SEQ ID NO: 1661861 - RNA, 14 nt, Human
uaucacaaaucuua

SEQ ID NO: 1661862 - RNA, 16 nt, Human
uaucacaaaucuuaac

SEQ ID NO: 1661863 - RNA, 20 nt, Human
uaucacaaaucuuaacuuga

SEQ ID NO: 1661864 - RNA, 14 nt, Human
acagaccuuugaac

SEQ ID NO: 1661865 - RNA, 21 nt, Human
aaugugcugaaugguuuucaa

SEQ ID NO: 1661866 - RNA, 23 nt, Human
uacagagcccacgcccccacugg

SEQ ID NO: 1661867 - RNA, 13 nt, Human
aauguucaucaau

SEQ ID NO: 1661868 - RNA, 15 nt, Human
aauguuacagaaucu

SEQ ID NO: 1661869 - RNA, 16 nt, Human
aauuaacuuuuauaaa

SEQ ID NO: 1661870 - RNA, 15 nt, Human
aauuaacuuuuauaa

SEQ ID NO: 1661871 - RNA, 16 nt, Human
aauuaaguacuaugua

SEQ ID NO: 1661872 - RNA, 17 nt, Human
aauuaaguacuauguau

SEQ ID NO: 1661873 - RNA, 13 nt, Human
aauuaacuuuuau

SEQ ID NO: 1661874 - RNA, 12 nt, Human
aauuaacuuuua

SEQ ID NO: 1661875 - RNA, 21 nt, Human
aauguucucucuucuccaccu

SEQ ID NO: 1661876 - RNA, 16 nt, Human
aauguucaucaaugaa

SEQ ID NO: 1661877 - RNA, 20 nt, Human
aauguucaucaaugaaugaa

SEQ ID NO: 1661878 - RNA, 13 nt, Human
uacauuuccuaaa

SEQ ID NO: 1661879 - RNA, 12 nt, Human
uacauucuguua

SEQ ID NO: 1661880 - RNA, 13 nt, Human
aauuaaguaucug

SEQ ID NO: 1661881 - RNA, 14 nt, Human
aauuaaguaucuga

SEQ ID NO: 1661882 - RNA, 18 nt, Human
uaccagccaguaaauggg

SEQ ID NO: 1661883 - RNA, 22 nt, Human
uaccagcagagcaccuuagaca

SEQ ID NO: 1661884 - RNA, 13 nt, Human
uaccagcagagca

SEQ ID NO: 1661885 - RNA, 14 nt, Human
uaccagcagagcac

SEQ ID NO: 1661886 - RNA, 12 nt, Human
uaccagcagagc

SEQ ID NO: 1661887 - RNA, 15 nt, Human
uacccccugcaaagc

SEQ ID NO: 1661888 - RNA, 19 nt, Human
uacccccugcaaagcccag

SEQ ID NO: 1661889 - RNA, 23 nt, Human
uacccccugcaaagcccagcuug

SEQ ID NO: 1661890 - RNA, 16 nt, Human
uaccaugccauuuaaa

SEQ ID NO: 1661891 - RNA, 19 nt, Human
uaccagggacugaggggag

SEQ ID NO: 1661892 - RNA, 23 nt, Human
uacccgggaagggggcugggaca

SEQ ID NO: 1661893 - RNA, 23 nt, Human
uaccucuugagccuugaacuuug

SEQ ID NO: 1661894 - RNA, 22 nt, Human
uaccucuugagccuugaacuuu

SEQ ID NO: 1661895 - RNA, 15 nt, Human
uacccucauguucuu

SEQ ID NO: 1661896 - RNA, 23 nt, Human
uaccugaagcuaucguaaaauua

SEQ ID NO: 1661897 - RNA, 13 nt, Human
uaccugaagucuu

SEQ ID NO: 1661898 - RNA, 14 nt, Human
uaccugaagucuuu

SEQ ID NO: 1661899 - RNA, 16 nt, Human
uaccugaagucuuugu

SEQ ID NO: 1661900 - RNA, 13 nt, Human
uaccugaggggcc

SEQ ID NO: 1661901 - RNA, 15 nt, Human
uaccugaggggccuc

SEQ ID NO: 1661902 - RNA, 16 nt, Human
uaccugccaggaagcc

SEQ ID NO: 1661903 - RNA, 16 nt, Human
uaccugaggggccucu

SEQ ID NO: 1661904 - RNA, 17 nt, Human
aauuacaggaaguacug

SEQ ID NO: 1661905 - RNA, 19 nt, Human
aauuacaggaaguacugga

SEQ ID NO: 1661906 - RNA, 20 nt, Human
aauuacaggaaguacuggag

SEQ ID NO: 1661907 - RNA, 13 nt, Human
aauuacauuugua

SEQ ID NO: 1661908 - RNA, 14 nt, Human
aauuacauuuguau

SEQ ID NO: 1661909 - RNA, 21 nt, Human
aauuauuuauuaaaugcccag

SEQ ID NO: 1661910 - RNA, 12 nt, Human
aauuauugguaa

SEQ ID NO: 1661911 - RNA, 22 nt, Human
aauuaugugccagauuuaugca

SEQ ID NO: 1661912 - RNA, 17 nt, Human
aauucaguuguuagugu

SEQ ID NO: 1661913 - RNA, 22 nt, Human
aauucaguuguuagugugucuu

SEQ ID NO: 1661914 - RNA, 11 nt, Human
aauucaguugu

SEQ ID NO: 1661915 - RNA, 22 nt, Human
aauuauuuauuaaaugcccagc

SEQ ID NO: 1661916 - RNA, 15 nt, Human
uacaccgggccugga

SEQ ID NO: 1661917 - RNA, 17 nt, Human
uacaccgggccuggaga

SEQ ID NO: 1661918 - RNA, 13 nt, Human
uacagacaaagcg

SEQ ID NO: 1661919 - RNA, 14 nt, Human
uacagacaaagcgu

SEQ ID NO: 1661920 - RNA, 15 nt, Human
uacagacaaagcgug

SEQ ID NO: 1661921 - RNA, 23 nt, Human
uacagagcagacaguuaagagaa

SEQ ID NO: 1661922 - RNA, 19 nt, Human
uacagagcccacgccccca

SEQ ID NO: 1661923 - RNA, 22 nt, Human
uacagagcccacgcccccacug

SEQ ID NO: 1661924 - RNA, 19 nt, Human
uacagacaaagcguggugg

SEQ ID NO: 1661925 - RNA, 17 nt, Human
uacagagacagaaagca

SEQ ID NO: 1661926 - RNA, 18 nt, Human
aauggaagacagcucuua

SEQ ID NO: 1661927 - RNA, 16 nt, Human
aauggaagacagcucu

SEQ ID NO: 1661928 - RNA, 14 nt, Human
aaugguuuucaaaa

SEQ ID NO: 1661929 - RNA, 16 nt, Human
aaugguuuucaaaaua

SEQ ID NO: 1661930 - RNA, 16 nt, Human
aaugguuuucuugugu

SEQ ID NO: 1661931 - RNA, 12 nt, Human
aauguaaauaaa

SEQ ID NO: 1661932 - RNA, 20 nt, Human
aauguaagggaaacugccag

SEQ ID NO: 1661933 - RNA, 13 nt, Human
aauggaagacagc

SEQ ID NO: 1661934 - RNA, 22 nt, Human
aaugcuguauuuuaaaagaaug

SEQ ID NO: 1661935 - RNA, 21 nt, Human
aaugcuggcuguuggcugggg

SEQ ID NO: 1661936 - RNA, 22 nt, Human
aaugcuggcuguuggcuggggg

SEQ ID NO: 1661937 - RNA, 20 nt, Human
aaugcuguauuuuaaaagaa

SEQ ID NO: 1661938 - RNA, 21 nt, Human
aaugcuguauuuuaaaagaau

SEQ ID NO: 1661939 - RNA, 16 nt, Human
uacaaugcugugcccu

SEQ ID NO: 1661940 - RNA, 14 nt, Human
uacaaugcugugcc

SEQ ID NO: 1661941 - RNA, 13 nt, Human
uacaaugcugugc

SEQ ID NO: 1661942 - RNA, 15 nt, Human
uaauuuuuguauuuu

SEQ ID NO: 1661943 - RNA, 18 nt, Human
uaauuuuuuugagacaga

SEQ ID NO: 1661944 - RNA, 22 nt, Human
uaauuuuuuuuuuccuuuuaaa

SEQ ID NO: 1661945 - RNA, 21 nt, Human
uacaaaaaaaaaaaaaaauua

SEQ ID NO: 1661946 - RNA, 24 nt, Human
aaugauuucagcucacugcaaccu

SEQ ID NO: 1661947 - RNA, 16 nt, Human
aaugaggucagagccu

SEQ ID NO: 1661948 - RNA, 18 nt, Human
aaugaggucagagccugc

SEQ ID NO: 1661949 - RNA, 14 nt, Human
aaugagccuggcaa

SEQ ID NO: 1661950 - RNA, 12 nt, Human
aaugagccuggc

SEQ ID NO: 1661951 - RNA, 13 nt, Human
aaugagccuggca

SEQ ID NO: 1661952 - RNA, 11 nt, Human
aaugagccugg

SEQ ID NO: 1661953 - RNA, 12 nt, Human
aaugagaaaucu

SEQ ID NO: 1661954 - RNA, 22 nt, Human
aaugagaaaucuaaaaaacgaa

SEQ ID NO: 1661955 - RNA, 22 nt, Human
aaugagagacacacugaagaag

SEQ ID NO: 1661956 - RNA, 21 nt, Human
aaugaccuuucaauaggaaaa

SEQ ID NO: 1661957 - RNA, 14 nt, Human
uaauuauaugcuau

SEQ ID NO: 1661958 - RNA, 18 nt, Human
uaauuauaugcuauuucu

SEQ ID NO: 1661959 - RNA, 19 nt, Human
uaauuauaugcuauuucua

SEQ ID NO: 1661960 - RNA, 20 nt, Human
uaauuauaugcuauuucuau

SEQ ID NO: 1661961 - RNA, 19 nt, Human
uaauuauaucugaggaauu

SEQ ID NO: 1661962 - RNA, 21 nt, Human
uaauuauaucugaggaauucu

SEQ ID NO: 1661963 - RNA, 22 nt, Human
uaauuauaucugaggaauucug

SEQ ID NO: 1661964 - RNA, 23 nt, Human
uaauuauaucugaggaauucugu

SEQ ID NO: 1661965 - RNA, 13 nt, Human
aaugcaccuggaa

SEQ ID NO: 1661966 - RNA, 14 nt, Human
aaugcaaaccauca

SEQ ID NO: 1661967 - RNA, 12 nt, Human
aaugcaaaccau

SEQ ID NO: 1661968 - RNA, 11 nt, Human
aaugcaaacca

SEQ ID NO: 1661969 - RNA, 13 nt, Human
aaugauuuuuaaa

SEQ ID NO: 1661970 - RNA, 16 nt, Human
aaugauuucauucaau

SEQ ID NO: 1661971 - RNA, 22 nt, Human
uaauuccguagguuauuuucag

SEQ ID NO: 1661972 - RNA, 19 nt, Human
uaauuuuuauauuugaaau

SEQ ID NO: 1661973 - RNA, 21 nt, Human
uaauuuuuauauuugaaauau

SEQ ID NO: 1661974 - RNA, 18 nt, Human
uaauuuuuauauuugaaa

SEQ ID NO: 1661975 - RNA, 15 nt, Human
aauauuuauagguca

SEQ ID NO: 1661976 - RNA, 15 nt, Human
aauauuuauuuuaau

SEQ ID NO: 1661977 - RNA, 19 nt, Human
aaucagccugcuccagcug

SEQ ID NO: 1661978 - RNA, 13 nt, Human
aaucagccugcuc

SEQ ID NO: 1661979 - RNA, 18 nt, Human
aaucagccugcuccagcu

SEQ ID NO: 1661980 - RNA, 18 nt, Human
aaucagcauucucacucc

SEQ ID NO: 1661981 - RNA, 19 nt, Human
aaucagcauucucacuccu

SEQ ID NO: 1661982 - RNA, 11 nt, Human
aaucagccugc

SEQ ID NO: 1661983 - RNA, 16 nt, Human
aaucagccuaguugau

SEQ ID NO: 1661984 - RNA, 14 nt, Human
uaaggacuucuuua

SEQ ID NO: 1661985 - RNA, 15 nt, Human
uaaggacuucuuuaa

SEQ ID NO: 1661986 - RNA, 16 nt, Human
uaaggacuucuuuaau

SEQ ID NO: 1661987 - RNA, 22 nt, Human
uaaggacuucuuuaauuuugga

SEQ ID NO: 1661988 - RNA, 22 nt, Human
uaaggaauuuuauuuuuuucug

SEQ ID NO: 1661989 - RNA, 17 nt, Human
uaaggaauaccuguccc

SEQ ID NO: 1661990 - RNA, 18 nt, Human
uaaggaauaccugucccc

SEQ ID NO: 1661991 - RNA, 17 nt, Human
uaaggaaaaguuuaaua

SEQ ID NO: 1661992 - RNA, 19 nt, Human
uaaggaaaaguuuaauauu

SEQ ID NO: 1661993 - RNA, 21 nt, Human
uaaggaaaaguuuaauauuaa

SEQ ID NO: 1661994 - RNA, 12 nt, Human
uaaggaaacugg

SEQ ID NO: 1661995 - RNA, 14 nt, Human
uaaggaaacugggu

SEQ ID NO: 1661996 - RNA, 13 nt, Human
uaaggaagacaau

SEQ ID NO: 1661997 - RNA, 9 nt, Human
uaaggaaua

SEQ ID NO: 1661998 - RNA, 19 nt, Human
uaaggaaacuggguuccug

SEQ ID NO: 1661999 - RNA, 13 nt, Human
uaagcauauauuu

SEQ ID NO: 1662000 - RNA, 16 nt, Human
uaagcauauauuuuua

SEQ ID NO: 1662001 - RNA, 21 nt, Human
uaagcuauucaguaauaacuc

SEQ ID NO: 1662002 - RNA, 15 nt, Human
uaagcaaaaugugau

SEQ ID NO: 1662003 - RNA, 21 nt, Human
uaagcaaaaugugauauguac

SEQ ID NO: 1662004 - RNA, 14 nt, Human
uaagauucauauuu

SEQ ID NO: 1662005 - RNA, 14 nt, Human
uaagcaaaauguga

SEQ ID NO: 1662006 - RNA, 17 nt, Human
uaaguguguguuuuuca

SEQ ID NO: 1662007 - RNA, 13 nt, Human
uaaggacuuguua

SEQ ID NO: 1662008 - RNA, 15 nt, Human
uaaggacuuguuaga

SEQ ID NO: 1662009 - RNA, 16 nt, Human
uaaggacuuguuagau

SEQ ID NO: 1662010 - RNA, 19 nt, Human
uaaggacuuguuagaucua

SEQ ID NO: 1662011 - RNA, 18 nt, Human
uaagguuaccuuuguucc

SEQ ID NO: 1662012 - RNA, 18 nt, Human
uaaggaugcuuguacaua

SEQ ID NO: 1662013 - RNA, 13 nt, Human
uaaguaaaaccac

SEQ ID NO: 1662014 - RNA, 15 nt, Human
uaaguaaaaccacag

SEQ ID NO: 1662015 - RNA, 16 nt, Human
uaaguaaaaccacagc

SEQ ID NO: 1662016 - RNA, 17 nt, Human
uaaguaaaaccacagca

SEQ ID NO: 1662017 - RNA, 18 nt, Human
uaaguaaaaccacagcag

SEQ ID NO: 1662018 - RNA, 19 nt, Human
uaaguaaaaccacagcagu

SEQ ID NO: 1662019 - RNA, 20 nt, Human
uaaguaaugauaacuggaaa

SEQ ID NO: 1662020 - RNA, 13 nt, Human
aaucucaaauaac

SEQ ID NO: 1662021 - RNA, 18 nt, Human
aaucugggccagaauuuc

SEQ ID NO: 1662022 - RNA, 12 nt, Human
aaucuaaaugga

SEQ ID NO: 1662023 - RNA, 21 nt, Human
aauccucucaaccaccuuuca

SEQ ID NO: 1662024 - RNA, 21 nt, Human
aaucccauuauucaaaguugc

SEQ ID NO: 1662025 - RNA, 12 nt, Human
aaucccaggaug

SEQ ID NO: 1662026 - RNA, 14 nt, Human
aaucccauuauuca

SEQ ID NO: 1662027 - RNA, 16 nt, Human
aaucccauuauucaaa

SEQ ID NO: 1662028 - RNA, 17 nt, Human
aaucccauuuaaaaaaa

SEQ ID NO: 1662029 - RNA, 13 nt, Human
uaaaugugguaaa

SEQ ID NO: 1662030 - RNA, 20 nt, Human
uaaauuaacuuuuauaaacu

SEQ ID NO: 1662031 - RNA, 19 nt, Human
uaaauuaacuuuuauaaac

SEQ ID NO: 1662032 - RNA, 18 nt, Human
uaaaugaaaaucgugaca

SEQ ID NO: 1662033 - RNA, 21 nt, Human
aaguguauuuuuuuacuaaua

SEQ ID NO: 1662034 - RNA, 18 nt, Human
aaguguauuuuuuuacua

SEQ ID NO: 1662035 - RNA, 22 nt, Human
uaaauuaacuuuuauaaacuuu

SEQ ID NO: 1662036 - RNA, 21 nt, Human
uaaauuaacuuuuauaaacuu

SEQ ID NO: 1662037 - RNA, 13 nt, Human
aauacagaggcaa

SEQ ID NO: 1662038 - RNA, 13 nt, Human
uaacaaugcugua

SEQ ID NO: 1662039 - RNA, 12 nt, Human
aauaccaaggaa

SEQ ID NO: 1662040 - RNA, 23 nt, Human
aauaccacaggaaccacaagacu

SEQ ID NO: 1662041 - RNA, 17 nt, Human
aauaccagccaguaaau

SEQ ID NO: 1662042 - RNA, 19 nt, Human
aauaccagccaguaaaugg

SEQ ID NO: 1662043 - RNA, 18 nt, Human
aauaccaugccauuuaaa

SEQ ID NO: 1662044 - RNA, 23 nt, Human
aauacaucccuuaccugggaaag

SEQ ID NO: 1662045 - RNA, 21 nt, Human
aauaccugucccccugacaac

SEQ ID NO: 1662046 - RNA, 19 nt, Human
aauaccugucccccugaca

SEQ ID NO: 1662047 - RNA, 15 nt, Human
aauaccugucccccu

SEQ ID NO: 1662048 - RNA, 18 nt, Human
aauaccugucccccugac

SEQ ID NO: 1662049 - RNA, 13 nt, Human
uaacguauaaaag

SEQ ID NO: 1662050 - RNA, 17 nt, Human
uaacguauaaaagccug

SEQ ID NO: 1662051 - RNA, 14 nt, Human
uaacuaaaagguau

SEQ ID NO: 1662052 - RNA, 13 nt, Human
uaacuucacauau

SEQ ID NO: 1662053 - RNA, 13 nt, Human
uaagacaaauaug

SEQ ID NO: 1662054 - RNA, 23 nt, Human
uaagacaaaaagcuacuuauugu

SEQ ID NO: 1662055 - RNA, 13 nt, Human
uaagaagugaaaa

SEQ ID NO: 1662056 - RNA, 16 nt, Human
uaacuugucuuuggac

SEQ ID NO: 1662057 - RNA, 20 nt, Human
uaacuugucuuuggacccug

SEQ ID NO: 1662058 - RNA, 21 nt, Human
uaacuuccuuggacucauuuu

SEQ ID NO: 1662059 - RNA, 19 nt, Human
uaacaugaauauuuagugu

SEQ ID NO: 1662060 - RNA, 12 nt, Human
uaacauguuaaa

SEQ ID NO: 1662061 - RNA, 15 nt, Human
uaacauguuaaacca

SEQ ID NO: 1662062 - RNA, 16 nt, Human
uaacauguuaaaccau

SEQ ID NO: 1662063 - RNA, 20 nt, Human
uaacaugaauauuuaguguu

SEQ ID NO: 1662064 - RNA, 21 nt, Human
uaacaugaauauuuaguguuc

SEQ ID NO: 1662065 - RNA, 14 nt, Human
uaacaugaauauuu

SEQ ID NO: 1662066 - RNA, 19 nt, Human
uaacauguaauuaaguacu

SEQ ID NO: 1662067 - RNA, 21 nt, Human
aauauauucagccuggcuuca

SEQ ID NO: 1662068 - RNA, 21 nt, Human
aauaguucagguaacaggcag

SEQ ID NO: 1662069 - RNA, 21 nt, Human
aauauauuuuaagacgaaaca

SEQ ID NO: 1662070 - RNA, 14 nt, Human
aauagcuagacugg

SEQ ID NO: 1662071 - RNA, 20 nt, Human
aauagcuagacuggugacug

SEQ ID NO: 1662072 - RNA, 21 nt, Human
aauagcuagacuggugacuga

SEQ ID NO: 1662073 - RNA, 19 nt, Human
aauagucaaauugugugaa

SEQ ID NO: 1662074 - RNA, 19 nt, Human
aagcccugagcuuucugcu

SEQ ID NO: 1662075 - RNA, 21 nt, Human
aagcccugugcuccauggcug

SEQ ID NO: 1662076 - RNA, 15 nt, Human
aagcccuuccauguc

SEQ ID NO: 1662077 - RNA, 20 nt, Human
aagcccuuccaugucgccuc

SEQ ID NO: 1662078 - RNA, 23 nt, Human
aagcccuuccaugucgccucugc

SEQ ID NO: 1662079 - RNA, 20 nt, Human
aagccgcuggggccaguugg

SEQ ID NO: 1662080 - RNA, 22 nt, Human
aagccaaagcuaggccuggcca

SEQ ID NO: 1662081 - RNA, 17 nt, Human
aagccaaaccucuguga

SEQ ID NO: 1662082 - RNA, 14 nt, Human
aagcccaggaaagg

SEQ ID NO: 1662083 - RNA, 17 nt, Human
aagcccaggaaaggcuc

SEQ ID NO: 1662084 - RNA, 19 nt, Human
aagcccaggaaaggcucca

SEQ ID NO: 1662085 - RNA, 22 nt, Human
aagcccaggaaaggcuccagga

SEQ ID NO: 1662086 - RNA, 14 nt, Human
aagcagugcaugcu

SEQ ID NO: 1662087 - RNA, 15 nt, Human
aagcagugcaugcug

SEQ ID NO: 1662088 - RNA, 20 nt, Human
aagcagugcaugcugucccu

SEQ ID NO: 1662089 - RNA, 12 nt, Human
aagcagugcaug

SEQ ID NO: 1662090 - RNA, 21 nt, Human
gugugugcgccuacaggagug

SEQ ID NO: 1662091 - RNA, 16 nt, Human
aagcauuuagauguau

SEQ ID NO: 1662092 - RNA, 18 nt, Human
aagcauuguaaaugugcu

SEQ ID NO: 1662093 - RNA, 16 nt, Human
aagcauuuacuuugug

SEQ ID NO: 1662094 - RNA, 13 nt, Human
aagcauuguaaau

SEQ ID NO: 1662095 - RNA, 14 nt, Human
aagcauuuaggaau

SEQ ID NO: 1662096 - RNA, 20 nt, Human
aagcucagggccuggcucag

SEQ ID NO: 1662097 - RNA, 18 nt, Human
aagcucagggccuggcuc

SEQ ID NO: 1662098 - RNA, 19 nt, Human
aagcucagggccuggcuca

SEQ ID NO: 1662099 - RNA, 17 nt, Human
aagcuccaagcucccag

SEQ ID NO: 1662100 - RNA, 18 nt, Human
aagcuccaagcucccagg

SEQ ID NO: 1662101 - RNA, 13 nt, Human
aagcuccagguag

SEQ ID NO: 1662102 - RNA, 14 nt, Human
aagcuccagguaga

SEQ ID NO: 1662103 - RNA, 12 nt, Human
aagcucagggcc

SEQ ID NO: 1662104 - RNA, 13 nt, Human
aagcucagggccu

SEQ ID NO: 1662105 - RNA, 16 nt, Human
aagcucagggccuggc

SEQ ID NO: 1662106 - RNA, 17 nt, Human
aagcucagggccuggcu

SEQ ID NO: 1662107 - RNA, 20 nt, Human
aagcucacagaccuuugaac

SEQ ID NO: 1662108 - RNA, 13 nt, Human
guucagccugccu

SEQ ID NO: 1662109 - RNA, 15 nt, Human
guucagcuccagcuc

SEQ ID NO: 1662110 - RNA, 13 nt, Human
guucagcuccagc

SEQ ID NO: 1662111 - RNA, 12 nt, Human
aagcuaggccug

SEQ ID NO: 1662112 - RNA, 16 nt, Human
aagcuaggccuggcca

SEQ ID NO: 1662113 - RNA, 20 nt, Human
aagccugaguuugcuuucaa

SEQ ID NO: 1662114 - RNA, 19 nt, Human
guuaggcauugugggaagg

SEQ ID NO: 1662115 - RNA, 20 nt, Human
guuaggcauugugggaaggg

SEQ ID NO: 1662116 - RNA, 18 nt, Human
guuaagagaaaugagcuu

SEQ ID NO: 1662117 - RNA, 11 nt, Human
guuaagagaaa

SEQ ID NO: 1662118 - RNA, 12 nt, Human
guuaagagaaau

SEQ ID NO: 1662119 - RNA, 18 nt, Human
guucaagcgauucuucug

SEQ ID NO: 1662120 - RNA, 22 nt, Human
guucaaagauauuuugcuuugu

SEQ ID NO: 1662121 - RNA, 21 nt, Human
guucaaagauauuuugcuuug

SEQ ID NO: 1662122 - RNA, 20 nt, Human
guucaaagauauuuugcuuu

SEQ ID NO: 1662123 - RNA, 23 nt, Human
guuauuuuuauuuauuuaaauuu

SEQ ID NO: 1662124 - RNA, 12 nt, Human
aagaguaggaag

SEQ ID NO: 1662125 - RNA, 22 nt, Human
aagagggucugaggaauccaga

SEQ ID NO: 1662126 - RNA, 23 nt, Human
aagagggagggagggcuccagac

SEQ ID NO: 1662127 - RNA, 17 nt, Human
guggggucacucuggca

SEQ ID NO: 1662128 - RNA, 20 nt, Human
guggggucacucuggcagcu

SEQ ID NO: 1662129 - RNA, 21 nt, Human
guggggucacucuggcagcuc

SEQ ID NO: 1662130 - RNA, 22 nt, Human
guggggucacucuggcagcuca

SEQ ID NO: 1662131 - RNA, 20 nt, Human
aagauggcugugccucugcc

SEQ ID NO: 1662132 - RNA, 21 nt, Human
aagauggcugugccucugccu

SEQ ID NO: 1662133 - RNA, 23 nt, Human
aagauggcugugccucugccugu

SEQ ID NO: 1662134 - RNA, 19 nt, Human
aagaugcuucucacugcca

SEQ ID NO: 1662135 - RNA, 18 nt, Human
aagauggcugugccucug

SEQ ID NO: 1662136 - RNA, 17 nt, Human
aagaugcuucucacugc

SEQ ID NO: 1662137 - RNA, 16 nt, Human
aagaugcuucucacug

SEQ ID NO: 1662138 - RNA, 13 nt, Human
aagaguaggaaga

SEQ ID NO: 1662139 - RNA, 14 nt, Human
aagaguaggaagac

SEQ ID NO: 1662140 - RNA, 13 nt, Human
aagaugaaaauau

SEQ ID NO: 1662141 - RNA, 14 nt, Human
aagaugaaaauauu

SEQ ID NO: 1662142 - RNA, 20 nt, Human
gugugugaaaaugugugugu

SEQ ID NO: 1662143 - RNA, 16 nt, Human
gugugguagagugugc

SEQ ID NO: 1662144 - RNA, 22 nt, Human
gugugacaaggauugcuacugu

SEQ ID NO: 1662145 - RNA, 21 nt, Human
gugugaccacugcagaagaca

SEQ ID NO: 1662146 - RNA, 16 nt, Human
gugucagcauagaagu

SEQ ID NO: 1662147 - RNA, 23 nt, Human
guguauuuuuuuacuaauagaca

SEQ ID NO: 1662148 - RNA, 17 nt, Human
guguauuuuuuuacuaa

SEQ ID NO: 1662149 - RNA, 20 nt, Human
gugucaagagggucugagga

SEQ ID NO: 1662150 - RNA, 13 nt, Human
aagauguagagga

SEQ ID NO: 1662151 - RNA, 19 nt, Human
aagauguagaggagaaacu

SEQ ID NO: 1662152 - RNA, 13 nt, Human
gugggacacccug

SEQ ID NO: 1662153 - RNA, 14 nt, Human
gugggagcugccug

SEQ ID NO: 1662154 - RNA, 15 nt, Human
gugggacacccugug

SEQ ID NO: 1662155 - RNA, 22 nt, Human
guggcgcagcauauucaggaag

SEQ ID NO: 1662156 - RNA, 15 nt, Human
guggggucacucugg

SEQ ID NO: 1662157 - RNA, 15 nt, Human
gugggagcugccugu

SEQ ID NO: 1662158 - RNA, 18 nt, Human
gugggagcugccuguuca

SEQ ID NO: 1662159 - RNA, 17 nt, Human
gugggaagggcuacacc

SEQ ID NO: 1662160 - RNA, 23 nt, Human
gugggaggaucucuugagccugg

SEQ ID NO: 1662161 - RNA, 21 nt, Human
guggccucccaacucacccca

SEQ ID NO: 1662162 - RNA, 22 nt, Human
guggccucccaacucaccccag

SEQ ID NO: 1662163 - RNA, 23 nt, Human
aagaggaaugaaguacucauaca

SEQ ID NO: 1662164 - RNA, 16 nt, Human
aagacuuuggaaagac

SEQ ID NO: 1662165 - RNA, 20 nt, Human
aagacgcugugcugcccugc

SEQ ID NO: 1662166 - RNA, 23 nt, Human
aagacugaguacguugugcauuu

SEQ ID NO: 1662167 - RNA, 16 nt, Human
aagacugcacaucaaa

SEQ ID NO: 1662168 - RNA, 17 nt, Human
aagacugcauuauauuu

SEQ ID NO: 1662169 - RNA, 15 nt, Human
aagaccuucuccuuc

SEQ ID NO: 1662170 - RNA, 18 nt, Human
aagaccuucuccuucacc

SEQ ID NO: 1662171 - RNA, 19 nt, Human
aagaccuucuccuucaccu

SEQ ID NO: 1662172 - RNA, 11 nt, Human
gugccuuaugg

SEQ ID NO: 1662173 - RNA, 15 nt, Human
aagacgcugugcugc

SEQ ID NO: 1662174 - RNA, 17 nt, Human
aagacgcugugcugccc

SEQ ID NO: 1662175 - RNA, 18 nt, Human
aagacgcugugcugcccu

SEQ ID NO: 1662176 - RNA, 19 nt, Human
aagacgcugugcugcccug

SEQ ID NO: 1662177 - RNA, 13 nt, Human
aagacgcugugcu

SEQ ID NO: 1662178 - RNA, 21 nt, Human
uaaaaauaaaaaacacuggga

SEQ ID NO: 1662179 - RNA, 17 nt, Human
uaaaaaucucaaauuuc

SEQ ID NO: 1662180 - RNA, 16 nt, Human
uaaaaaucucaaauuu

SEQ ID NO: 1662181 - RNA, 15 nt, Human
uaaaaaucucaaauu

SEQ ID NO: 1662182 - RNA, 18 nt, Human
uaaaaauaaaaaacacug

SEQ ID NO: 1662183 - RNA, 19 nt, Human
uaaaaauaaaaaacacugg

SEQ ID NO: 1662184 - RNA, 15 nt, Human
uaaaaaguggaaaaa

SEQ ID NO: 1662185 - RNA, 15 nt, Human
guuuuucuucucccu

SEQ ID NO: 1662186 - RNA, 21 nt, Human
guuuuucuuaaauaauaaaga

SEQ ID NO: 1662187 - RNA, 21 nt, Human
uaaaaaucucaaauuucuaaa

SEQ ID NO: 1662188 - RNA, 20 nt, Human
uaaaaaucucaaauuucuaa

SEQ ID NO: 1662189 - RNA, 19 nt, Human
uaaaaaucucaaauuucua

SEQ ID NO: 1662190 - RNA, 20 nt, Human
uaaaacuugauguguuaucu

SEQ ID NO: 1662191 - RNA, 22 nt, Human
uaaaacuugauguguuaucucu

SEQ ID NO: 1662192 - RNA, 12 nt, Human
uaaaagaaugau

SEQ ID NO: 1662193 - RNA, 23 nt, Human
uaaaagaauauuuuaacuuccuu

SEQ ID NO: 1662194 - RNA, 13 nt, Human
uaaaauauuccug

SEQ ID NO: 1662195 - RNA, 22 nt, Human
uaaaauauuccugcauuuguga

SEQ ID NO: 1662196 - RNA, 20 nt, Human
aagugauucucaugccucag

SEQ ID NO: 1662197 - RNA, 16 nt, Human
aagugaggaugaaaaa

SEQ ID NO: 1662198 - RNA, 21 nt, Human
aagugauucucaugccucagc

SEQ ID NO: 1662199 - RNA, 20 nt, Human
aagugauucuccugccucag

SEQ ID NO: 1662200 - RNA, 19 nt, Human
aagugauucuccugccuca

SEQ ID NO: 1662201 - RNA, 15 nt, Human
aagugauucuccugc

SEQ ID NO: 1662202 - RNA, 16 nt, Human
aagugauucuccugcc

SEQ ID NO: 1662203 - RNA, 17 nt, Human
aagugauucuccugccu

SEQ ID NO: 1662204 - RNA, 18 nt, Human
aagugauucuccugccuc

SEQ ID NO: 1662205 - RNA, 20 nt, Human
uaaaagacagugaaagaaaa

SEQ ID NO: 1662206 - RNA, 22 nt, Human
uaaaagacugucuuaauuugca

SEQ ID NO: 1662207 - RNA, 22 nt, Human
uaaaauaccagccaguaaaugg

SEQ ID NO: 1662208 - RNA, 20 nt, Human
uaaaauaauuuuuauauuug

SEQ ID NO: 1662209 - RNA, 15 nt, Human
aaguauuaagcauau

SEQ ID NO: 1662210 - RNA, 20 nt, Human
aaguacacuguuucaaacuu

SEQ ID NO: 1662211 - RNA, 19 nt, Human
aaguacacuguuucaaacu

SEQ ID NO: 1662212 - RNA, 23 nt, Human
aaguacacuguuucaaacuuuac

SEQ ID NO: 1662213 - RNA, 18 nt, Human
aaguauuaagcauauauu

SEQ ID NO: 1662214 - RNA, 16 nt, Human
aaguauuaagcauaua

SEQ ID NO: 1662215 - RNA, 17 nt, Human
aaguauuaagcauauau

SEQ ID NO: 1662216 - RNA, 13 nt, Human
aaguauuagaaua

SEQ ID NO: 1662217 - RNA, 14 nt, Human
guuucugccgcagc

SEQ ID NO: 1662218 - RNA, 18 nt, Human
guuucugccgcagcccug

SEQ ID NO: 1662219 - RNA, 15 nt, Human
guuucugccgcagcc

SEQ ID NO: 1662220 - RNA, 16 nt, Human
guuuugccauguuggc

SEQ ID NO: 1662221 - RNA, 20 nt, Human
guuuugccauguuggccagg

SEQ ID NO: 1662222 - RNA, 21 nt, Human
guuuugccauguuggccaggc

SEQ ID NO: 1662223 - RNA, 22 nt, Human
guuuugccauguuggccaggcu

SEQ ID NO: 1662224 - RNA, 18 nt, Human
aaguacacuguuucaaac

SEQ ID NO: 1662225 - RNA, 13 nt, Human
aaguacacuguuu

SEQ ID NO: 1662226 - RNA, 14 nt, Human
aaguaaugauaacu

SEQ ID NO: 1662227 - RNA, 19 nt, Human
aaguaaugauaacuggaaa

SEQ ID NO: 1662228 - RNA, 15 nt, Human
guuuuucauaaagca

SEQ ID NO: 1662229 - RNA, 15 nt, Human
aagugagagcugggu

SEQ ID NO: 1662230 - RNA, 12 nt, Human
aagugagagagg

SEQ ID NO: 1662231 - RNA, 14 nt, Human
aagugagagcuggg

SEQ ID NO: 1662232 - RNA, 20 nt, Human
guuuuucuuaaauaauaaag

SEQ ID NO: 1662233 - RNA, 19 nt, Human
aagugaagacaaugacuua

SEQ ID NO: 1662234 - RNA, 17 nt, Human
aagugaagacaaugacu

SEQ ID NO: 1662235 - RNA, 21 nt, Human
aagugaaaaaggaggaagaga

SEQ ID NO: 1662236 - RNA, 21 nt, Human
aagucaugcguuuaaucacau

SEQ ID NO: 1662237 - RNA, 16 nt, Human
aagucuuucacauuua

SEQ ID NO: 1662238 - RNA, 14 nt, Human
aagcuccaucucca

SEQ ID NO: 1662239 - RNA, 20 nt, Human
aagcuccaucuccacuccag

SEQ ID NO: 1662240 - RNA, 15 nt, Human
aaggaaagagggagg

SEQ ID NO: 1662241 - RNA, 21 nt, Human
aaggaauaaauugcuccuuga

SEQ ID NO: 1662242 - RNA, 17 nt, Human
aaggaauaccugucccc

SEQ ID NO: 1662243 - RNA, 16 nt, Human
aaggaagcacaugccu

SEQ ID NO: 1662244 - RNA, 14 nt, Human
aaggaagacuucau

SEQ ID NO: 1662245 - RNA, 15 nt, Human
aaggaagacuucauc

SEQ ID NO: 1662246 - RNA, 13 nt, Human
aaggaagcacaug

SEQ ID NO: 1662247 - RNA, 20 nt, Human
aaggaggggauagagagaga

SEQ ID NO: 1662248 - RNA, 18 nt, Human
aaggaggaagagaaaaaa

SEQ ID NO: 1662249 - RNA, 11 nt, Human
aaggagagcua

SEQ ID NO: 1662250 - RNA, 18 nt, Human
aaggaauaccuguccccc

SEQ ID NO: 1662251 - RNA, 14 nt, Human
aaggagauuuacaa

SEQ ID NO: 1662252 - RNA, 17 nt, Human
aaggagauuuacaacug

SEQ ID NO: 1662253 - RNA, 11 nt, Human
aaggauaaagu

SEQ ID NO: 1662254 - RNA, 21 nt, Human
aaggauacaaaagcaugugag

SEQ ID NO: 1662255 - RNA, 13 nt, Human
aaggauacaaaag

SEQ ID NO: 1662256 - RNA, 16 nt, Human
aaggccaaaggaagca

SEQ ID NO: 1662257 - RNA, 22 nt, Human
guugccuaaauccauuuggaaa

SEQ ID NO: 1662258 - RNA, 23 nt, Human
guugcccaggcaggucuugaacu

SEQ ID NO: 1662259 - RNA, 12 nt, Human
guugcccaggcu

SEQ ID NO: 1662260 - RNA, 13 nt, Human
guugcccaggcug

SEQ ID NO: 1662261 - RNA, 13 nt, Human
guuuauugucaaa

SEQ ID NO: 1662262 - RNA, 20 nt, Human
guuuaauauuaaagccaugu

SEQ ID NO: 1662263 - RNA, 15 nt, Human
guugggcugguguca

SEQ ID NO: 1662264 - RNA, 13 nt, Human
guugggcuggugu

SEQ ID NO: 1662265 - RNA, 15 nt, Human
guugggccaggagcc

SEQ ID NO: 1662266 - RNA, 17 nt, Human
guugggccaggagccuc

SEQ ID NO: 1662267 - RNA, 22 nt, Human
aaggcucgagcaugccuggaug

SEQ ID NO: 1662268 - RNA, 19 nt, Human
aaggcucgagcaugccugg

SEQ ID NO: 1662269 - RNA, 20 nt, Human
aaggcucgagcaugccugga

SEQ ID NO: 1662270 - RNA, 19 nt, Human
aaggcuccaggagcagcca

SEQ ID NO: 1662271 - RNA, 22 nt, Human
aaggcuccaggagcagccacau

SEQ ID NO: 1662272 - RNA, 16 nt, Human
aaggcucgagcaugcc

SEQ ID NO: 1662273 - RNA, 18 nt, Human
aaggcucgagcaugccug

SEQ ID NO: 1662274 - RNA, 13 nt, Human
guuucaaacuuua

SEQ ID NO: 1662275 - RNA, 16 nt, Human
guuucaaacuuuacua

SEQ ID NO: 1662276 - RNA, 14 nt, Human
guuucaaacuuuac

SEQ ID NO: 1662277 - RNA, 16 nt, Human
aaggcuccaggagcag

SEQ ID NO: 1662278 - RNA, 18 nt, Human
aaggcuccaggagcagcc

SEQ ID NO: 1662279 - RNA, 15 nt, Human
aaggcuccaggagca

SEQ ID NO: 1662280 - RNA, 17 nt, Human
guuucaaacuuuacuau

SEQ ID NO: 1662281 - RNA, 13 nt, Human
aaguaagcaaaga

SEQ ID NO: 1662282 - RNA, 16 nt, Human
aaguaaggaauuuuau

SEQ ID NO: 1662283 - RNA, 18 nt, Human
aagguauuuaauagguuu

SEQ ID NO: 1662284 - RNA, 12 nt, Human
aaggucauuuuu

SEQ ID NO: 1662285 - RNA, 19 nt, Human
guuucuauguguagggcgg

SEQ ID NO: 1662286 - RNA, 18 nt, Human
guuucugaaagggacgcu

SEQ ID NO: 1662287 - RNA, 23 nt, Human
aaggcucugagcaaauguggcuc

SEQ ID NO: 1662288 - RNA, 22 nt, Human
aaggggcccaaauucuuucagu

SEQ ID NO: 1662289 - RNA, 20 nt, Human
aagguagaaauaucugaaaa

SEQ ID NO: 1662290 - RNA, 14 nt, Human
aagguacuucaaau

SEQ ID NO: 1662291 - RNA, 19 nt, Human
aagggugaugggaaagcau

SEQ ID NO: 1662292 - RNA, 19 nt, Human
guaucccaugagccucagc

SEQ ID NO: 1662293 - RNA, 22 nt, Human
guaucaggugcugccauccagg

SEQ ID NO: 1662294 - RNA, 15 nt, Human
guaugcgugugugug

SEQ ID NO: 1662295 - RNA, 21 nt, Human
guaucccaugagccucagcau

SEQ ID NO: 1662296 - RNA, 15 nt, Human
guaugguggcugggu

SEQ ID NO: 1662297 - RNA, 16 nt, Human
guaugguggcuggguu

SEQ ID NO: 1662298 - RNA, 14 nt, Human
guaugguggcuggg

SEQ ID NO: 1662299 - RNA, 10 nt, Human
guauaauuaa

SEQ ID NO: 1662300 - RNA, 15 nt, Human
guauaaguggugugu

SEQ ID NO: 1662301 - RNA, 15 nt, Human
guauaaaauaauuuu

SEQ ID NO: 1662302 - RNA, 21 nt, Human
guauaaaauaauuuuuauauu

SEQ ID NO: 1662303 - RNA, 16 nt, Human
guaucaggugcugcca

SEQ ID NO: 1662304 - RNA, 18 nt, Human
guaucaggugcugccauc

SEQ ID NO: 1662305 - RNA, 16 nt, Human
guauauuuuauaucaa

SEQ ID NO: 1662306 - RNA, 19 nt, Human
guauaaaagggacugagaa

SEQ ID NO: 1662307 - RNA, 20 nt, Human
guaguguuggagaagaacug

SEQ ID NO: 1662308 - RNA, 16 nt, Human
aaauguaagggaaacu

SEQ ID NO: 1662309 - RNA, 17 nt, Human
guaguguuggagaagaa

SEQ ID NO: 1662310 - RNA, 22 nt, Human
guaacaggaaaauuuuaaaaau

SEQ ID NO: 1662311 - RNA, 12 nt, Human
guaacaggcaga

SEQ ID NO: 1662312 - RNA, 14 nt, Human
aaauggguuuuacu

SEQ ID NO: 1662313 - RNA, 15 nt, Human
aaauggguuuuacug

SEQ ID NO: 1662314 - RNA, 13 nt, Human
aaaugguuaaaag

SEQ ID NO: 1662315 - RNA, 19 nt, Human
aaaugguuaaaagagguuu

SEQ ID NO: 1662316 - RNA, 11 nt, Human
aaaugguuaaa

SEQ ID NO: 1662317 - RNA, 12 nt, Human
aaaugugugugu

SEQ ID NO: 1662318 - RNA, 14 nt, Human
aaauuaagaaagga

SEQ ID NO: 1662319 - RNA, 19 nt, Human
aaaugucuaguuguaacac

SEQ ID NO: 1662320 - RNA, 24 nt, Human
aaaugucuaguuguaacaccauga

SEQ ID NO: 1662321 - RNA, 15 nt, Human
aaauguauuacagug

SEQ ID NO: 1662322 - RNA, 13 nt, Human
aaauguaugugag

SEQ ID NO: 1662323 - RNA, 18 nt, Human
guauguacuucaugcugu

SEQ ID NO: 1662324 - RNA, 16 nt, Human
aaauucugucucugga

SEQ ID NO: 1662325 - RNA, 19 nt, Human
aaauuguaagcaugcacaa

SEQ ID NO: 1662326 - RNA, 18 nt, Human
aaauucugucucuggauu

SEQ ID NO: 1662327 - RNA, 14 nt, Human
aaauuguaauuaua

SEQ ID NO: 1662328 - RNA, 20 nt, Human
aaauuguaagcaugcacaaa

SEQ ID NO: 1662329 - RNA, 15 nt, Human
aaauuguaauuauau

SEQ ID NO: 1662330 - RNA, 15 nt, Human
gucaaacgugaaaau

SEQ ID NO: 1662331 - RNA, 17 nt, Human
gucaaacgugaaaaugc

SEQ ID NO: 1662332 - RNA, 14 nt, Human
gucaaacgugaaaa

SEQ ID NO: 1662333 - RNA, 21 nt, Human
gucaacaaguaugaauaaaga

SEQ ID NO: 1662334 - RNA, 17 nt, Human
gucaacacuaacaugau

SEQ ID NO: 1662335 - RNA, 22 nt, Human
guauuuuguuuuugucuuaaaa

SEQ ID NO: 1662336 - RNA, 13 nt, Human
guccauagagagc

SEQ ID NO: 1662337 - RNA, 14 nt, Human
guccauagagagca

SEQ ID NO: 1662338 - RNA, 21 nt, Human
gucccaccccacacacgccag

SEQ ID NO: 1662339 - RNA, 14 nt, Human
gucccaccuuggcu

SEQ ID NO: 1662340 - RNA, 15 nt, Human
gucccaccuuggcug

SEQ ID NO: 1662341 - RNA, 16 nt, Human
gucccaccuuggcugc

SEQ ID NO: 1662342 - RNA, 13 nt, Human
guccaagaagccc

SEQ ID NO: 1662343 - RNA, 15 nt, Human
guccaagaagcccag

SEQ ID NO: 1662344 - RNA, 16 nt, Human
guccaagaagcccagg

SEQ ID NO: 1662345 - RNA, 20 nt, Human
guccaagaagcccaggaaag

SEQ ID NO: 1662346 - RNA, 17 nt, Human
guccaagaagcccagga

SEQ ID NO: 1662347 - RNA, 18 nt, Human
guccaagaagcccaggaa

SEQ ID NO: 1662348 - RNA, 17 nt, Human
aacacaacuauauuguu

SEQ ID NO: 1662349 - RNA, 15 nt, Human
aacacagcaagggug

SEQ ID NO: 1662350 - RNA, 21 nt, Human
gucauuuuuuuuaagaaaaag

SEQ ID NO: 1662351 - RNA, 19 nt, Human
gucauuuuuuuuaagaaaa

SEQ ID NO: 1662352 - RNA, 15 nt, Human
aacagaaauguacag

SEQ ID NO: 1662353 - RNA, 14 nt, Human
aacagaaauguaca

SEQ ID NO: 1662354 - RNA, 13 nt, Human
aacagaaauguac

SEQ ID NO: 1662355 - RNA, 12 nt, Human
aacagaaaugua

SEQ ID NO: 1662356 - RNA, 16 nt, Human
guccuacccacccucc

SEQ ID NO: 1662357 - RNA, 12 nt, Human
guccuacucugu

SEQ ID NO: 1662358 - RNA, 14 nt, Human
gucccccuuccaug

SEQ ID NO: 1662359 - RNA, 16 nt, Human
gucccccuuccaugga

SEQ ID NO: 1662360 - RNA, 18 nt, Human
gucccccuuccauggacu

SEQ ID NO: 1662361 - RNA, 15 nt, Human
aacagugauuaccag

SEQ ID NO: 1662362 - RNA, 22 nt, Human
aacagugauuaccagggacuga

SEQ ID NO: 1662363 - RNA, 13 nt, Human
guccuacucugug

SEQ ID NO: 1662364 - RNA, 16 nt, Human
aacagauaaauaguuu

SEQ ID NO: 1662365 - RNA, 18 nt, Human
aaauuuguuauaaugaau

SEQ ID NO: 1662366 - RNA, 13 nt, Human
gucagaauagaaa

SEQ ID NO: 1662367 - RNA, 17 nt, Human
gucagaauagaaauuag

SEQ ID NO: 1662368 - RNA, 22 nt, Human
gucacacaguauuacuucugcu

SEQ ID NO: 1662369 - RNA, 17 nt, Human
aacaaugcuguauuuua

SEQ ID NO: 1662370 - RNA, 22 nt, Human
aacaaugcuguauuuuaaaaga

SEQ ID NO: 1662371 - RNA, 15 nt, Human
aacacaacuauauug

SEQ ID NO: 1662372 - RNA, 16 nt, Human
aacacaacuauauugu

SEQ ID NO: 1662373 - RNA, 18 nt, Human
aacaaggcaaggcuguca

SEQ ID NO: 1662374 - RNA, 21 nt, Human
aacaaggcaaggcugucaauu

SEQ ID NO: 1662375 - RNA, 12 nt, Human
aacaauaaaaga

SEQ ID NO: 1662376 - RNA, 14 nt, Human
aacaaugcuguauu

SEQ ID NO: 1662377 - RNA, 15 nt, Human
aacaaugcuguauuu

SEQ ID NO: 1662378 - RNA, 23 nt, Human
aaauuuugauguuuuaaggaugc

SEQ ID NO: 1662379 - RNA, 18 nt, Human
aaauuuugauguuuuaag

SEQ ID NO: 1662380 - RNA, 20 nt, Human
aaauuuuuucucuaggaaau

SEQ ID NO: 1662381 - RNA, 16 nt, Human
aacaaggcaaggcugu

SEQ ID NO: 1662382 - RNA, 14 nt, Human
gucuggcccuuccu

SEQ ID NO: 1662383 - RNA, 20 nt, Human
aaccugagccccaaaaggua

SEQ ID NO: 1662384 - RNA, 16 nt, Human
gucuuuuuucacuaca

SEQ ID NO: 1662385 - RNA, 15 nt, Human
gucuuuaaaugcugc

SEQ ID NO: 1662386 - RNA, 17 nt, Human
gucuuuaaaugcugcuu

SEQ ID NO: 1662387 - RNA, 16 nt, Human
gucuuucacauuuaaa

SEQ ID NO: 1662388 - RNA, 17 nt, Human
aacucuccucugcugcu

SEQ ID NO: 1662389 - RNA, 16 nt, Human
aacucuccucugcugc

SEQ ID NO: 1662390 - RNA, 15 nt, Human
aacucuccuccagag

SEQ ID NO: 1662391 - RNA, 18 nt, Human
aacucuccuccagaguca

SEQ ID NO: 1662392 - RNA, 22 nt, Human
gugaaccaccacacccagccca

SEQ ID NO: 1662393 - RNA, 23 nt, Human
gugaaccaccacacccagcccac

SEQ ID NO: 1662394 - RNA, 22 nt, Human
aacucaucuagguaaauuacag

SEQ ID NO: 1662395 - RNA, 16 nt, Human
aacuaugauuuggaaa

SEQ ID NO: 1662396 - RNA, 21 nt, Human
aacuaugauuuggaaaauaaa

SEQ ID NO: 1662397 - RNA, 23 nt, Human
aacuagacucccaagcuggacua

SEQ ID NO: 1662398 - RNA, 20 nt, Human
aacuagacucccaagcugga

SEQ ID NO: 1662399 - RNA, 21 nt, Human
aacuagaguuuagcuggaaaa

SEQ ID NO: 1662400 - RNA, 12 nt, Human
aaccugugucuc

SEQ ID NO: 1662401 - RNA, 18 nt, Human
aaccuugaaaacuuuaug

SEQ ID NO: 1662402 - RNA, 13 nt, Human
gucucgaacuccu

SEQ ID NO: 1662403 - RNA, 18 nt, Human
gucucgaacuccugaccu

SEQ ID NO: 1662404 - RNA, 19 nt, Human
gucucgaacuccugaccuu

SEQ ID NO: 1662405 - RNA, 16 nt, Human
aaccaagccguggcuu

SEQ ID NO: 1662406 - RNA, 18 nt, Human
aaccaagccguggcuucc

SEQ ID NO: 1662407 - RNA, 19 nt, Human
aaccaccacacccagccca

SEQ ID NO: 1662408 - RNA, 20 nt, Human
aaccacauuggagauguuua

SEQ ID NO: 1662409 - RNA, 15 nt, Human
aaccaagucaaguga

SEQ ID NO: 1662410 - RNA, 17 nt, Human
aaccaucauugaaaucu

SEQ ID NO: 1662411 - RNA, 18 nt, Human
aaccaucauugaaaucuu

SEQ ID NO: 1662412 - RNA, 12 nt, Human
aaccaucauuga

SEQ ID NO: 1662413 - RNA, 21 nt, Human
aaccaccacacccagcccacu

SEQ ID NO: 1662414 - RNA, 13 nt, Human
aacccaauaguug

SEQ ID NO: 1662415 - RNA, 18 nt, Human
aacccaaguccaagcaua

SEQ ID NO: 1662416 - RNA, 23 nt, Human
aaccauuuugcugucccuuuucc

SEQ ID NO: 1662417 - RNA, 23 nt, Human
aacccaaauguucaucaaugaau

SEQ ID NO: 1662418 - RNA, 14 nt, Human
aacccagauaaagg

SEQ ID NO: 1662419 - RNA, 10 nt, Human
aacccagcuc

SEQ ID NO: 1662420 - RNA, 16 nt, Human
aacccgggaggcagag

SEQ ID NO: 1662421 - RNA, 16 nt, Human
aaccucuuugucuaca

SEQ ID NO: 1662422 - RNA, 12 nt, Human
aaccucuaaauu

SEQ ID NO: 1662423 - RNA, 24 nt, Human
aaccucuaaauucuuucauuuuag

SEQ ID NO: 1662424 - RNA, 11 nt, Human
aaccugacccc

SEQ ID NO: 1662425 - RNA, 18 nt, Human
aaccugagccccaaaagg

SEQ ID NO: 1662426 - RNA, 22 nt, Human
aacugggggagggugaagugaa

SEQ ID NO: 1662427 - RNA, 21 nt, Human
aacugggggagggugaaguga

SEQ ID NO: 1662428 - RNA, 16 nt, Human
aacuggguacuugugg

SEQ ID NO: 1662429 - RNA, 21 nt, Human
aacuggguacuuguggacaca

SEQ ID NO: 1662430 - RNA, 17 nt, Human
aacugggacaggggaga

SEQ ID NO: 1662431 - RNA, 14 nt, Human
aacugggcugaaca

SEQ ID NO: 1662432 - RNA, 16 nt, Human
aacugggcugaacacu

SEQ ID NO: 1662433 - RNA, 11 nt, Human
aacuggcugca

SEQ ID NO: 1662434 - RNA, 16 nt, Human
aacuggauuaaacuua

SEQ ID NO: 1662435 - RNA, 15 nt, Human
aacuggauuaaacuu

SEQ ID NO: 1662436 - RNA, 19 nt, Human
aacuggacugguucaaaug

SEQ ID NO: 1662437 - RNA, 23 nt, Human
aacugcugacuguuuucucuuga

SEQ ID NO: 1662438 - RNA, 20 nt, Human
aacugcugacuguuuucucu

SEQ ID NO: 1662439 - RNA, 21 nt, Human
aacugcugacuguuuucucuu

SEQ ID NO: 1662440 - RNA, 17 nt, Human
aacugcuuguuuccuag

SEQ ID NO: 1662441 - RNA, 15 nt, Human
aacugcugacuguuu

SEQ ID NO: 1662442 - RNA, 19 nt, Human
aacugcacugucaagauga

SEQ ID NO: 1662443 - RNA, 15 nt, Human
gugagcaauccugca

SEQ ID NO: 1662444 - RNA, 17 nt, Human
gugaggccagagacaca

SEQ ID NO: 1662445 - RNA, 22 nt, Human
gugaggccagagacacaagccu

SEQ ID NO: 1662446 - RNA, 14 nt, Human
gugaacuugaaauu

SEQ ID NO: 1662447 - RNA, 15 nt, Human
gugaacuugaaauuu

SEQ ID NO: 1662448 - RNA, 17 nt, Human
gugaacuugggccacug

SEQ ID NO: 1662449 - RNA, 19 nt, Human
gugaacuugggccacugug

SEQ ID NO: 1662450 - RNA, 21 nt, Human
gugagaugcuagaacucccuu

SEQ ID NO: 1662451 - RNA, 22 nt, Human
aacucugacaacagacuucuga

SEQ ID NO: 1662452 - RNA, 23 nt, Human
aacucugacaacagacuucugaa

SEQ ID NO: 1662453 - RNA, 20 nt, Human
aacucugacaacagacuucu

SEQ ID NO: 1662454 - RNA, 22 nt, Human
gugagucgaggacagggaggug

SEQ ID NO: 1662455 - RNA, 21 nt, Human
aacucuucaaucucuugcacu

SEQ ID NO: 1662456 - RNA, 12 nt, Human
aacugaaaucau

SEQ ID NO: 1662457 - RNA, 13 nt, Human
aacugaaaucaua

SEQ ID NO: 1662458 - RNA, 22 nt, Human
gugaugguuccccuguucacuc

SEQ ID NO: 1662459 - RNA, 14 nt, Human
gugaugguuccccu

SEQ ID NO: 1662460 - RNA, 16 nt, Human
gugaugguuccccugu

SEQ ID NO: 1662461 - RNA, 19 nt, Human
gugauggggcccugccucc

SEQ ID NO: 1662462 - RNA, 21 nt, Human
gugcacacaccagagcccacc

SEQ ID NO: 1662463 - RNA, 22 nt, Human
gugcaugcugucccuuacguga

SEQ ID NO: 1662464 - RNA, 12 nt, Human
gugccucugccu

SEQ ID NO: 1662465 - RNA, 19 nt, Human
gugcauuaucuagauacug

SEQ ID NO: 1662466 - RNA, 15 nt, Human
gugcauuaucuagau

SEQ ID NO: 1662467 - RNA, 19 nt, Human
gugcauguguguucaugca

SEQ ID NO: 1662468 - RNA, 23 nt, Human
gugcauuaucuagauacuguauc

SEQ ID NO: 1662469 - RNA, 14 nt, Human
gugaugagaggaaa

SEQ ID NO: 1662470 - RNA, 16 nt, Human
gugaugagaggaaauc

SEQ ID NO: 1662471 - RNA, 14 nt, Human
gugauggggcccug

SEQ ID NO: 1662472 - RNA, 16 nt, Human
gugauggggcccugcc

SEQ ID NO: 1662473 - RNA, 17 nt, Human
gugauggggcccugccu

SEQ ID NO: 1662474 - RNA, 18 nt, Human
gugauggggcccugccuc

SEQ ID NO: 1662475 - RNA, 22 nt, Human
gugaugcgcaugucacggaggg

SEQ ID NO: 1662476 - RNA, 17 nt, Human
gugaugggaaagcauug

SEQ ID NO: 1662477 - RNA, 13 nt, Human
aacuuccaauuua

SEQ ID NO: 1662478 - RNA, 18 nt, Human
aacuuccagauccuggaa

SEQ ID NO: 1662479 - RNA, 22 nt, Human
aacugguggacauggcuguuca

SEQ ID NO: 1662480 - RNA, 15 nt, Human
aacuggguuccugca

SEQ ID NO: 1662481 - RNA, 14 nt, Human
aacuggguuccugc

SEQ ID NO: 1662482 - RNA, 17 nt, Human
acuagggaagauaauau

SEQ ID NO: 1662483 - RNA, 16 nt, Human
acuauuguuagucucu

SEQ ID NO: 1662484 - RNA, 19 nt, Human
acuaguauuucuaugaaau

SEQ ID NO: 1662485 - RNA, 18 nt, Human
acuaguauuucuaugaaa

SEQ ID NO: 1662486 - RNA, 11 nt, Human
accugugucuc

SEQ ID NO: 1662487 - RNA, 23 nt, Human
acgucugacaggcaaugcuggcu

SEQ ID NO: 1662488 - RNA, 12 nt, Human
acgucugugcca

SEQ ID NO: 1662489 - RNA, 15 nt, Human
acuaauagacaauuu

SEQ ID NO: 1662490 - RNA, 11 nt, Human
acguggcugcu

SEQ ID NO: 1662491 - RNA, 19 nt, Human
acgcuggagugcagugagc

SEQ ID NO: 1662492 - RNA, 15 nt, Human
acggaagagccuugc

SEQ ID NO: 1662493 - RNA, 16 nt, Human
acggaagagccuugcg

SEQ ID NO: 1662494 - RNA, 15 nt, Human
acggaauaguuggcu

SEQ ID NO: 1662495 - RNA, 19 nt, Human
acggacgaaccuugaaaac

SEQ ID NO: 1662496 - RNA, 14 nt, Human
accggcuggccugg

SEQ ID NO: 1662497 - RNA, 15 nt, Human
accggcuggccuggc

SEQ ID NO: 1662498 - RNA, 17 nt, Human
accggcuggccuggccc

SEQ ID NO: 1662499 - RNA, 18 nt, Human
accggcuggccuggcccc

SEQ ID NO: 1662500 - RNA, 20 nt, Human
accgggcacucagaagacac

SEQ ID NO: 1662501 - RNA, 19 nt, Human
accggcuggccuggccccu

SEQ ID NO: 1662502 - RNA, 20 nt, Human
accgggccacagagaaagua

SEQ ID NO: 1662503 - RNA, 15 nt, Human
accgggccacagaga

SEQ ID NO: 1662504 - RNA, 19 nt, Human
accgggccacagagaaagu

SEQ ID NO: 1662505 - RNA, 14 nt, Human
accgugaggccaga

SEQ ID NO: 1662506 - RNA, 17 nt, Human
acccuguuaccauuuug

SEQ ID NO: 1662507 - RNA, 16 nt, Human
acccaugcugcccugu

SEQ ID NO: 1662508 - RNA, 14 nt, Human
acccaugcugcccu

SEQ ID NO: 1662509 - RNA, 15 nt, Human
acccaugcugcccug

SEQ ID NO: 1662510 - RNA, 22 nt, Human
acccugugauggggcccugccu

SEQ ID NO: 1662511 - RNA, 16 nt, Human
accccacacacgccag

SEQ ID NO: 1662512 - RNA, 23 nt, Human
accucagguaaucgaccugccuc

SEQ ID NO: 1662513 - RNA, 18 nt, Human
accucaggugagaagcag

SEQ ID NO: 1662514 - RNA, 22 nt, Human
accucagguaaucgaccugccu

SEQ ID NO: 1662515 - RNA, 14 nt, Human
accucaggccuggg

SEQ ID NO: 1662516 - RNA, 22 nt, Human
accucaggccugggggcugggc

SEQ ID NO: 1662517 - RNA, 16 nt, Human
accgugaggccagaga

SEQ ID NO: 1662518 - RNA, 17 nt, Human
accgugaggccagagac

SEQ ID NO: 1662519 - RNA, 12 nt, Human
accucaggccug

SEQ ID NO: 1662520 - RNA, 13 nt, Human
accucaggccugg

SEQ ID NO: 1662521 - RNA, 21 nt, Human
accucuugagccuugaacuuu

SEQ ID NO: 1662522 - RNA, 20 nt, Human
accucuugagccuugaacuu

SEQ ID NO: 1662523 - RNA, 19 nt, Human
accucuugagccuugaacu

SEQ ID NO: 1662524 - RNA, 17 nt, Human
accucuugagccuugaa

SEQ ID NO: 1662525 - RNA, 17 nt, Human
accucugccucagaaaa

SEQ ID NO: 1662526 - RNA, 18 nt, Human
accucugccucagaaaac

SEQ ID NO: 1662527 - RNA, 13 nt, Human
accugcccaaccu

SEQ ID NO: 1662528 - RNA, 23 nt, Human
accugccccuccucucugcccua

SEQ ID NO: 1662529 - RNA, 19 nt, Human
accugucuugccuuuuuca

SEQ ID NO: 1662530 - RNA, 21 nt, Human
accugucuugccuuuuucauu

SEQ ID NO: 1662531 - RNA, 22 nt, Human
accugucuugccuuuuucauua

SEQ ID NO: 1662532 - RNA, 15 nt, Human
accugccagggacag

SEQ ID NO: 1662533 - RNA, 16 nt, Human
accugccagggacaga

SEQ ID NO: 1662534 - RNA, 18 nt, Human
accugccagggacagagg

SEQ ID NO: 1662535 - RNA, 12 nt, Human
accugccaggga

SEQ ID NO: 1662536 - RNA, 13 nt, Human
accugccagggac

SEQ ID NO: 1662537 - RNA, 11 nt, Human
accugccaggg

SEQ ID NO: 1662538 - RNA, 20 nt, Human
accucugccucagaaaacaa

SEQ ID NO: 1662539 - RNA, 17 nt, Human
acuucuuauacauuuga

SEQ ID NO: 1662540 - RNA, 18 nt, Human
acuucuuauacauuugau

SEQ ID NO: 1662541 - RNA, 20 nt, Human
acuucaaauccuugaagauu

SEQ ID NO: 1662542 - RNA, 18 nt, Human
acuucagcgguuuauaua

SEQ ID NO: 1662543 - RNA, 13 nt, Human
acuucagcucugu

SEQ ID NO: 1662544 - RNA, 20 nt, Human
acuucugccauauucuguug

SEQ ID NO: 1662545 - RNA, 19 nt, Human
acuucagcgguuuauauaa

SEQ ID NO: 1662546 - RNA, 22 nt, Human
acuuaaaauauuccugcauuug

SEQ ID NO: 1662547 - RNA, 15 nt, Human
acuuaaauaauguga

SEQ ID NO: 1662548 - RNA, 19 nt, Human
acuucaaauccuugaagau

SEQ ID NO: 1662549 - RNA, 14 nt, Human
acuuaaauaaugug

SEQ ID NO: 1662550 - RNA, 21 nt, Human
acuuaaaaaugguuuaaaugg

SEQ ID NO: 1662551 - RNA, 13 nt, Human
acuuaaaaauggu

SEQ ID NO: 1662552 - RNA, 14 nt, Human
acuuaaaaaugguu

SEQ ID NO: 1662553 - RNA, 22 nt, Human
acuuucaggccacauggcuaaa

SEQ ID NO: 1662554 - RNA, 15 nt, Human
acuuuauuuuguguu

SEQ ID NO: 1662555 - RNA, 12 nt, Human
acuuuaugcuaa

SEQ ID NO: 1662556 - RNA, 17 nt, Human
acuuuaugcuaagugaa

SEQ ID NO: 1662557 - RNA, 22 nt, Human
acuugggaggcugagaugggag

SEQ ID NO: 1662558 - RNA, 19 nt, Human
acugccagucccccugccc

SEQ ID NO: 1662559 - RNA, 18 nt, Human
acugccagucccccugcc

SEQ ID NO: 1662560 - RNA, 15 nt, Human
acugcccggcagggu

SEQ ID NO: 1662561 - RNA, 16 nt, Human
acugcuuuuggucugu

SEQ ID NO: 1662562 - RNA, 20 nt, Human
acugcuuuuggucuguguga

SEQ ID NO: 1662563 - RNA, 22 nt, Human
acugcccggcaggguccuagaa

SEQ ID NO: 1662564 - RNA, 15 nt, Human
acugcuuuuggucug

SEQ ID NO: 1662565 - RNA, 15 nt, Human
acugauucuucagca

SEQ ID NO: 1662566 - RNA, 22 nt, Human
acugauucuucagcaaaaauau

SEQ ID NO: 1662567 - RNA, 12 nt, Human
acugauucuuca

SEQ ID NO: 1662568 - RNA, 13 nt, Human
acugauucuucag

SEQ ID NO: 1662569 - RNA, 23 nt, Human
acugaugggcaacccccagccug

SEQ ID NO: 1662570 - RNA, 23 nt, Human
acugauuuuuuuuuccuucagug

SEQ ID NO: 1662571 - RNA, 21 nt, Human
acugauuuuuuuuuccuucag

SEQ ID NO: 1662572 - RNA, 22 nt, Human
acugauuuuuuuuuccuucagu

SEQ ID NO: 1662573 - RNA, 15 nt, Human
acugaccagccucca

SEQ ID NO: 1662574 - RNA, 20 nt, Human
acugaccagccuccaugcug

SEQ ID NO: 1662575 - RNA, 13 nt, Human
acugaccagccuc

SEQ ID NO: 1662576 - RNA, 23 nt, Human
acugacauuguuggccaaagcca

SEQ ID NO: 1662577 - RNA, 23 nt, Human
acugaccagccuccaugcugccu

SEQ ID NO: 1662578 - RNA, 13 nt, Human
acugaucucucgu

SEQ ID NO: 1662579 - RNA, 22 nt, Human
acugauggcuaauguacugcau

SEQ ID NO: 1662580 - RNA, 12 nt, Human
acugaugggcaa

SEQ ID NO: 1662581 - RNA, 22 nt, Human
acugaugggcaacccccagccu

SEQ ID NO: 1662582 - RNA, 14 nt, Human
acucuuaagaagac

SEQ ID NO: 1662583 - RNA, 15 nt, Human
acucuuaagaagacu

SEQ ID NO: 1662584 - RNA, 20 nt, Human
acucuuaagaagacugcauu

SEQ ID NO: 1662585 - RNA, 21 nt, Human
acucuacuuagcaugucccua

SEQ ID NO: 1662586 - RNA, 20 nt, Human
acucuacuuagcaugucccu

SEQ ID NO: 1662587 - RNA, 19 nt, Human
acucugucucaaaaaaaca

SEQ ID NO: 1662588 - RNA, 21 nt, Human
acucugugucagguggggcag

SEQ ID NO: 1662589 - RNA, 19 nt, Human
acucugugucagguggggc

SEQ ID NO: 1662590 - RNA, 15 nt, Human
acucugucucagucc

SEQ ID NO: 1662591 - RNA, 17 nt, Human
acucugucucaguccau

SEQ ID NO: 1662592 - RNA, 12 nt, Human
aauuguaaggaa

SEQ ID NO: 1662593 - RNA, 16 nt, Human
aauuguaaggaaugau

SEQ ID NO: 1662594 - RNA, 17 nt, Human
aauuggggauucuuaaa

SEQ ID NO: 1662595 - RNA, 20 nt, Human
aauuggggauucuuaaaguu

SEQ ID NO: 1662596 - RNA, 21 nt, Human
aaugguccgugcuaaggacuu

SEQ ID NO: 1662597 - RNA, 16 nt, Human
aauuggggauucuuaa

SEQ ID NO: 1662598 - RNA, 16 nt, Human
aaugucacaggcaggu

SEQ ID NO: 1662599 - RNA, 19 nt, Human
aaugucacaggcaggucca

SEQ ID NO: 1662600 - RNA, 17 nt, Human
aauuuauuggcuuuucu

SEQ ID NO: 1662601 - RNA, 19 nt, Human
aauuuauuggcuuuucuga

SEQ ID NO: 1662602 - RNA, 20 nt, Human
aauuuauuggcuuuucugau

SEQ ID NO: 1662603 - RNA, 21 nt, Human
aauuuauuggcuuuucugauc

SEQ ID NO: 1662604 - RNA, 23 nt, Human
aauuuauuggcuuuucugaucca

SEQ ID NO: 1662605 - RNA, 20 nt, Human
aauuuauuuaugggauccug

SEQ ID NO: 1662606 - RNA, 18 nt, Human
aauuuccugggagcuuuu

SEQ ID NO: 1662607 - RNA, 21 nt, Human
aauuuccugggagcuuuugua

SEQ ID NO: 1662608 - RNA, 22 nt, Human
aauuucauaccuaucaucuuaa

SEQ ID NO: 1662609 - RNA, 17 nt, Human
aauuuccugggagcuuu

SEQ ID NO: 1662610 - RNA, 12 nt, Human
acaaagaaauua

SEQ ID NO: 1662611 - RNA, 14 nt, Human
acaaagaaauuaug

SEQ ID NO: 1662612 - RNA, 16 nt, Human
acaaagaaauuaugug

SEQ ID NO: 1662613 - RNA, 13 nt, Human
acaaaauggaaua

SEQ ID NO: 1662614 - RNA, 14 nt, Human
acaaaauggaauac

SEQ ID NO: 1662615 - RNA, 13 nt, Human
acaaaaugaaacg

SEQ ID NO: 1662616 - RNA, 22 nt, Human
acaaaaugaaacgcaaccacca

SEQ ID NO: 1662617 - RNA, 18 nt, Human
acaaccuucuguggcuca

SEQ ID NO: 1662618 - RNA, 21 nt, Human
acaaggaugaauuaaguuuuu

SEQ ID NO: 1662619 - RNA, 22 nt, Human
acaagaaaugaaagcagggacu

SEQ ID NO: 1662620 - RNA, 15 nt, Human
acaagaaaugaaagc

SEQ ID NO: 1662621 - RNA, 16 nt, Human
acaagaaaugaaagca

SEQ ID NO: 1662622 - RNA, 18 nt, Human
aauuuucaucuaggauuu

SEQ ID NO: 1662623 - RNA, 12 nt, Human
aauuuuggaauu

SEQ ID NO: 1662624 - RNA, 11 nt, Human
aauuuuggaau

SEQ ID NO: 1662625 - RNA, 14 nt, Human
aauuuugauguuuu

SEQ ID NO: 1662626 - RNA, 17 nt, Human
aauuuugugaagcaaaa

SEQ ID NO: 1662627 - RNA, 16 nt, Human
aauuuugugcccccau

SEQ ID NO: 1662628 - RNA, 18 nt, Human
aauuuugugaagcaaaau

SEQ ID NO: 1662629 - RNA, 19 nt, Human
acacaaaaguuucucuuuu

SEQ ID NO: 1662630 - RNA, 14 nt, Human
acacauuuuuuaaa

SEQ ID NO: 1662631 - RNA, 22 nt, Human
acacagcucuucuccaggcugu

SEQ ID NO: 1662632 - RNA, 20 nt, Human
acacagcucuucuccaggcu

SEQ ID NO: 1662633 - RNA, 21 nt, Human
acacagcucuucuccaggcug

SEQ ID NO: 1662634 - RNA, 20 nt, Human
acaccacuacauucuguuaa

SEQ ID NO: 1662635 - RNA, 17 nt, Human
acaccacuacauucugu

SEQ ID NO: 1662636 - RNA, 14 nt, Human
acacgaauauugcu

SEQ ID NO: 1662637 - RNA, 15 nt, Human
acaccacuacauucu

SEQ ID NO: 1662638 - RNA, 19 nt, Human
acacauuuuuuaaaugcac

SEQ ID NO: 1662639 - RNA, 18 nt, Human
acacauuuuuuaaaugca

SEQ ID NO: 1662640 - RNA, 16 nt, Human
acacauuuuuuaaaug

SEQ ID NO: 1662641 - RNA, 21 nt, Human
acaccacuacauucuguuaau

SEQ ID NO: 1662642 - RNA, 15 nt, Human
acacgaauauugcug

SEQ ID NO: 1662643 - RNA, 21 nt, Human
acacgaauauugcugauggug

SEQ ID NO: 1662644 - RNA, 13 nt, Human
acaauuuauuaug

SEQ ID NO: 1662645 - RNA, 20 nt, Human
acaauuuuguuucuguacuu

SEQ ID NO: 1662646 - RNA, 14 nt, Human
acaauuuauuaugg

SEQ ID NO: 1662647 - RNA, 20 nt, Human
acaaggaugaucuaggaaga

SEQ ID NO: 1662648 - RNA, 16 nt, Human
acaaggauugcuacug

SEQ ID NO: 1662649 - RNA, 20 nt, Human
acacugggagaaaugaaaaa

SEQ ID NO: 1662650 - RNA, 22 nt, Human
acacugugcugagucugaaggc

SEQ ID NO: 1662651 - RNA, 17 nt, Human
acacugugcugagucug

SEQ ID NO: 1662652 - RNA, 13 nt, Human
acagaggcagccc

SEQ ID NO: 1662653 - RNA, 14 nt, Human
acagaggcagcccc

SEQ ID NO: 1662654 - RNA, 17 nt, Human
acagaggccaugggccu

SEQ ID NO: 1662655 - RNA, 21 nt, Human
acagaggccaugggccuccug

SEQ ID NO: 1662656 - RNA, 23 nt, Human
acagaggccaugggccuccugug

SEQ ID NO: 1662657 - RNA, 14 nt, Human
acagacaaagcgug

SEQ ID NO: 1662658 - RNA, 16 nt, Human
acagaagcuccaggua

SEQ ID NO: 1662659 - RNA, 17 nt, Human
acccacccccacccaag

SEQ ID NO: 1662660 - RNA, 15 nt, Human
acccacccccaccca

SEQ ID NO: 1662661 - RNA, 13 nt, Human
acccaugcugccc

SEQ ID NO: 1662662 - RNA, 15 nt, Human
acccacccuccuuuc

SEQ ID NO: 1662663 - RNA, 13 nt, Human
accauacuaauua

SEQ ID NO: 1662664 - RNA, 16 nt, Human
accauacuaauuauac

SEQ ID NO: 1662665 - RNA, 21 nt, Human
accauacuaauuauacccccu

SEQ ID NO: 1662666 - RNA, 17 nt, Human
accauaggucaccuuua

SEQ ID NO: 1662667 - RNA, 14 nt, Human
accaucaagccacc

SEQ ID NO: 1662668 - RNA, 15 nt, Human
accaucauugaaauc

SEQ ID NO: 1662669 - RNA, 15 nt, Human
accaucaagccacca

SEQ ID NO: 1662670 - RNA, 16 nt, Human
accaucccugaaggcc

SEQ ID NO: 1662671 - RNA, 23 nt, Human
accaucauugaaaucuuuuugcu

SEQ ID NO: 1662672 - RNA, 16 nt, Human
acauuuccuaaauaua

SEQ ID NO: 1662673 - RNA, 17 nt, Human
acauuuccuaaauauau

SEQ ID NO: 1662674 - RNA, 14 nt, Human
acauuuauucugcu

SEQ ID NO: 1662675 - RNA, 23 nt, Human
acaugucuuuucuugcaugaggc

SEQ ID NO: 1662676 - RNA, 19 nt, Human
acaugccucucucaggcca

SEQ ID NO: 1662677 - RNA, 20 nt, Human
acaugccucucucaggccaa

SEQ ID NO: 1662678 - RNA, 14 nt, Human
accagcagaaaugc

SEQ ID NO: 1662679 - RNA, 12 nt, Human
accagcagagca

SEQ ID NO: 1662680 - RNA, 13 nt, Human
accagcagagcac

SEQ ID NO: 1662681 - RNA, 13 nt, Human
accagcagccugg

SEQ ID NO: 1662682 - RNA, 16 nt, Human
accagccccagugccc

SEQ ID NO: 1662683 - RNA, 17 nt, Human
accagccccagugccca

SEQ ID NO: 1662684 - RNA, 18 nt, Human
accagccccagugcccac

SEQ ID NO: 1662685 - RNA, 19 nt, Human
accagccccagugcccaca

SEQ ID NO: 1662686 - RNA, 20 nt, Human
accagccccagugcccacag

SEQ ID NO: 1662687 - RNA, 19 nt, Human
accaaggcugauuaaacca

SEQ ID NO: 1662688 - RNA, 12 nt, Human
accaccugccca

SEQ ID NO: 1662689 - RNA, 14 nt, Human
accaccuuucagau

SEQ ID NO: 1662690 - RNA, 20 nt, Human
accaaggcugauuaaaccaa

SEQ ID NO: 1662691 - RNA, 12 nt, Human
acagcugccugc

SEQ ID NO: 1662692 - RNA, 16 nt, Human
acagcugccugcagua

SEQ ID NO: 1662693 - RNA, 13 nt, Human
acagcugccuggg

SEQ ID NO: 1662694 - RNA, 20 nt, Human
acaggcaagcaccuccugcc

SEQ ID NO: 1662695 - RNA, 23 nt, Human
acaggcaagcaccuccugccucg

SEQ ID NO: 1662696 - RNA, 16 nt, Human
acagcucuguccuggg

SEQ ID NO: 1662697 - RNA, 17 nt, Human
acagcucuguccuggga

SEQ ID NO: 1662698 - RNA, 17 nt, Human
acagaggggguggccuc

SEQ ID NO: 1662699 - RNA, 18 nt, Human
acagaggggguggccucc

SEQ ID NO: 1662700 - RNA, 19 nt, Human
acagaggggguggccuccc

SEQ ID NO: 1662701 - RNA, 21 nt, Human
acagaggggguggccucccaa

SEQ ID NO: 1662702 - RNA, 16 nt, Human
acagcuccuucugucc

SEQ ID NO: 1662703 - RNA, 18 nt, Human
acagcuccuucuguccua

SEQ ID NO: 1662704 - RNA, 23 nt, Human
acagcuccuucuguccuacucug

SEQ ID NO: 1662705 - RNA, 14 nt, Human
acagcucuguccug

SEQ ID NO: 1662706 - RNA, 22 nt, Human
acagugagucgaggacagggag

SEQ ID NO: 1662707 - RNA, 19 nt, Human
acaggugugaaccaccaca

SEQ ID NO: 1662708 - RNA, 22 nt, Human
acaggugugagucaccaagccc

SEQ ID NO: 1662709 - RNA, 23 nt, Human
acaggugugagucaccaagccca

SEQ ID NO: 1662710 - RNA, 14 nt, Human
acaggcaaugcugg

SEQ ID NO: 1662711 - RNA, 13 nt, Human
acagugcaucuca

SEQ ID NO: 1662712 - RNA, 15 nt, Human
acaguggggaaugaa

SEQ ID NO: 1662713 - RNA, 19 nt, Human
acaguggggaaugaagaua

SEQ ID NO: 1662714 - RNA, 23 nt, Human
acagugagucgaggacagggagg

SEQ ID NO: 1662715 - RNA, 21 nt, Human
acagugauuaccagggacuga

SEQ ID NO: 1662716 - RNA, 15 nt, Human
acauccuacaagaca

SEQ ID NO: 1662717 - RNA, 16 nt, Human
acaugcaaggucauuu

SEQ ID NO: 1662718 - RNA, 20 nt, Human
acaucccuuaccugggaaag

SEQ ID NO: 1662719 - RNA, 17 nt, Human
acaugcaaggucauuuu

SEQ ID NO: 1662720 - RNA, 18 nt, Human
acaugcaaggucauuuuu

SEQ ID NO: 1662721 - RNA, 15 nt, Human
acaugccucucucag

SEQ ID NO: 1662722 - RNA, 16 nt, Human
acaugccucucucagg

SEQ ID NO: 1662723 - RNA, 17 nt, Human
acaugccucucucaggc

SEQ ID NO: 1662724 - RNA, 18 nt, Human
acaugccucucucaggcc

SEQ ID NO: 1662725 - RNA, 16 nt, Human
acauaagauaaaugug

SEQ ID NO: 1662726 - RNA, 20 nt, Human
acauaauucaggaagcagcu

SEQ ID NO: 1662727 - RNA, 12 nt, Human
aaguagaggagg

SEQ ID NO: 1662728 - RNA, 18 nt, Human
aagguucuggugugaacu

SEQ ID NO: 1662729 - RNA, 15 nt, Human
aagggacugagaaau

SEQ ID NO: 1662730 - RNA, 17 nt, Human
aagggacugagaaauuu

SEQ ID NO: 1662731 - RNA, 20 nt, Human
aagggacuuggaagcuccgc

SEQ ID NO: 1662732 - RNA, 14 nt, Human
aagggauggcaaga

SEQ ID NO: 1662733 - RNA, 17 nt, Human
aagggauggcaagaugu

SEQ ID NO: 1662734 - RNA, 16 nt, Human
aagcugcugacagugu

SEQ ID NO: 1662735 - RNA, 23 nt, Human
aaggaaugauuaauuaaaacaca

SEQ ID NO: 1662736 - RNA, 21 nt, Human
aagcgugagccacugcaccgg

SEQ ID NO: 1662737 - RNA, 17 nt, Human
aagcgugagccacugca

SEQ ID NO: 1662738 - RNA, 20 nt, Human
aagcgugagccacugcaccg

SEQ ID NO: 1662739 - RNA, 11 nt, Human
aagcugccagc

SEQ ID NO: 1662740 - RNA, 12 nt, Human
aagcugccagcc

SEQ ID NO: 1662741 - RNA, 14 nt, Human
aagcugcugacagu

SEQ ID NO: 1662742 - RNA, 22 nt, Human
aagcugccagccgagauagcca

SEQ ID NO: 1662743 - RNA, 22 nt, Human
aaggacccggaggggccuggca

SEQ ID NO: 1662744 - RNA, 12 nt, Human
aaggaauuuuau

SEQ ID NO: 1662745 - RNA, 15 nt, Human
aaggacuaggguccu

SEQ ID NO: 1662746 - RNA, 13 nt, Human
aaggacuaggguc

SEQ ID NO: 1662747 - RNA, 13 nt, Human
aaggacacuagaa

SEQ ID NO: 1662748 - RNA, 14 nt, Human
aaggcaaaugacuu

SEQ ID NO: 1662749 - RNA, 15 nt, Human
aaggcaaaugacuuu

SEQ ID NO: 1662750 - RNA, 16 nt, Human
aaggcaaaugacuuug

SEQ ID NO: 1662751 - RNA, 15 nt, Human
aagcgauucuucugc

SEQ ID NO: 1662752 - RNA, 14 nt, Human
aagcgauucuucug

SEQ ID NO: 1662753 - RNA, 16 nt, Human
aagcgauucuucugcu

SEQ ID NO: 1662754 - RNA, 17 nt, Human
aagcgauucuucugcuu

SEQ ID NO: 1662755 - RNA, 15 nt, Human
aagccagcaggcucu

SEQ ID NO: 1662756 - RNA, 19 nt, Human
aagccagcaggcucucagg

SEQ ID NO: 1662757 - RNA, 18 nt, Human
aagccagcaggcucucag

SEQ ID NO: 1662758 - RNA, 21 nt, Human
aagccaccaacauacucccau

SEQ ID NO: 1662759 - RNA, 19 nt, Human
aagccagauuuuccugaaa

SEQ ID NO: 1662760 - RNA, 15 nt, Human
aagacuuuuaugaua

SEQ ID NO: 1662761 - RNA, 17 nt, Human
aagacuuuuccaacccu

SEQ ID NO: 1662762 - RNA, 15 nt, Human
aagagaacuuccaga

SEQ ID NO: 1662763 - RNA, 23 nt, Human
aagacagugaaagaaaauaacaa

SEQ ID NO: 1662764 - RNA, 16 nt, Human
aagacuuuggaaagag

SEQ ID NO: 1662765 - RNA, 20 nt, Human
aagauucaaugccccugaau

SEQ ID NO: 1662766 - RNA, 21 nt, Human
aagauucaaugccccugaauu

SEQ ID NO: 1662767 - RNA, 20 nt, Human
aagauucauauuuacuucuu

SEQ ID NO: 1662768 - RNA, 14 nt, Human
aagauacugaaaua

SEQ ID NO: 1662769 - RNA, 16 nt, Human
aagauacugaaauaaa

SEQ ID NO: 1662770 - RNA, 20 nt, Human
aagauacugaaauaaacguc

SEQ ID NO: 1662771 - RNA, 17 nt, Human
aagauucaaucccagga

SEQ ID NO: 1662772 - RNA, 14 nt, Human
aagauagcagggca

SEQ ID NO: 1662773 - RNA, 19 nt, Human
aagccaccaacauacuccc

SEQ ID NO: 1662774 - RNA, 15 nt, Human
aagcagggacuugaa

SEQ ID NO: 1662775 - RNA, 19 nt, Human
aagauuuugaaauuuuuau

SEQ ID NO: 1662776 - RNA, 20 nt, Human
aaugguccgugcuaaggacu

SEQ ID NO: 1662777 - RNA, 17 nt, Human
aaugggggugcauuuga

SEQ ID NO: 1662778 - RNA, 15 nt, Human
aaugggggugcauuu

SEQ ID NO: 1662779 - RNA, 23 nt, Human
aaugcucuuuacuucauggacuu

SEQ ID NO: 1662780 - RNA, 13 nt, Human
aaugggacacuaa

SEQ ID NO: 1662781 - RNA, 14 nt, Human
aaugggagcucaug

SEQ ID NO: 1662782 - RNA, 17 nt, Human
aaugcgcaggcuggccc

SEQ ID NO: 1662783 - RNA, 18 nt, Human
aaugcgcaggcuggcccu

SEQ ID NO: 1662784 - RNA, 19 nt, Human
aaugcgcaggcuggcccug

SEQ ID NO: 1662785 - RNA, 20 nt, Human
aaugcgcaggcuggcccugc

SEQ ID NO: 1662786 - RNA, 15 nt, Human
aaugcgcaggcuggc

SEQ ID NO: 1662787 - RNA, 14 nt, Human
aaugcgcaggcugg

SEQ ID NO: 1662788 - RNA, 21 nt, Human
aaugcgcaggcuggcccugcc

SEQ ID NO: 1662789 - RNA, 23 nt, Human
aaugcgugcauaccacuuuuguu

SEQ ID NO: 1662790 - RNA, 21 nt, Human
aaugcgugcauaccacuuuug

SEQ ID NO: 1662791 - RNA, 15 nt, Human
aaucuggacuccucu

SEQ ID NO: 1662792 - RNA, 16 nt, Human
aaucuggacuccucug

SEQ ID NO: 1662793 - RNA, 17 nt, Human
aaucuggacuccucugu

SEQ ID NO: 1662794 - RNA, 18 nt, Human
aaucuggacuccucuguc

SEQ ID NO: 1662795 - RNA, 20 nt, Human
aaucuggacuccucugucca

SEQ ID NO: 1662796 - RNA, 18 nt, Human
aaucucggcucacugcau

SEQ ID NO: 1662797 - RNA, 23 nt, Human
aaucucgcucugucgcccaggcu

SEQ ID NO: 1662798 - RNA, 16 nt, Human
aauccauacauuugug

SEQ ID NO: 1662799 - RNA, 17 nt, Human
aauccagacccggcugc

SEQ ID NO: 1662800 - RNA, 17 nt, Human
aauccauacauuugugu

SEQ ID NO: 1662801 - RNA, 23 nt, Human
aaugauguauguugaagccuuug

SEQ ID NO: 1662802 - RNA, 15 nt, Human
aaugauagcuacugu

SEQ ID NO: 1662803 - RNA, 16 nt, Human
aaugauuaauuaaaac

SEQ ID NO: 1662804 - RNA, 12 nt, Human
aaugauuaauua

SEQ ID NO: 1662805 - RNA, 13 nt, Human
aaugauuaauuaa

SEQ ID NO: 1662806 - RNA, 14 nt, Human
aaugauaacuggaa

SEQ ID NO: 1662807 - RNA, 15 nt, Human
aaugauaacuggaaa

SEQ ID NO: 1662808 - RNA, 16 nt, Human
aaugauaacuggaaac

SEQ ID NO: 1662809 - RNA, 22 nt, Human
aaucauuucugcaucagcugcu

SEQ ID NO: 1662810 - RNA, 22 nt, Human
aauauuaaagccauguuuauua

SEQ ID NO: 1662811 - RNA, 22 nt, Human
aaucaaauaugcaaagcacuga

SEQ ID NO: 1662812 - RNA, 15 nt, Human
aaucaaauaugcaaa

SEQ ID NO: 1662813 - RNA, 16 nt, Human
aaucaaauaugcaaag

SEQ ID NO: 1662814 - RNA, 19 nt, Human
aauacgugggcauucaaau

SEQ ID NO: 1662815 - RNA, 20 nt, Human
aauacgugggcauucaaaug

SEQ ID NO: 1662816 - RNA, 12 nt, Human
aauacuguuuga

SEQ ID NO: 1662817 - RNA, 13 nt, Human
aauauuaaagcca

SEQ ID NO: 1662818 - RNA, 14 nt, Human
aauauuaaagccau

SEQ ID NO: 1662819 - RNA, 15 nt, Human
aauauuaaagccaug

SEQ ID NO: 1662820 - RNA, 16 nt, Human
aauauuaaagccaugu

SEQ ID NO: 1662821 - RNA, 18 nt, Human
aauauuaaagccauguuu

SEQ ID NO: 1662822 - RNA, 19 nt, Human
aauauuaaagccauguuua

SEQ ID NO: 1662823 - RNA, 20 nt, Human
aauauuaaagccauguuuau

SEQ ID NO: 1662824 - RNA, 16 nt, Human
aauauaggaacuuaaa

SEQ ID NO: 1662825 - RNA, 14 nt, Human
aauaauguuucaaa

SEQ ID NO: 1662826 - RNA, 19 nt, Human
aauaauguuucaaacauau

SEQ ID NO: 1662827 - RNA, 12 nt, Human
aauaauguuuca

SEQ ID NO: 1662828 - RNA, 13 nt, Human
aagugcugcauuu

SEQ ID NO: 1662829 - RNA, 14 nt, Human
aagugcugcauuua

SEQ ID NO: 1662830 - RNA, 15 nt, Human
aaguggggacagagc

SEQ ID NO: 1662831 - RNA, 22 nt, Human
aaguugauaugccuuuucccaa

SEQ ID NO: 1662832 - RNA, 11 nt, Human
aauaaagcugu

SEQ ID NO: 1662833 - RNA, 19 nt, Human
aauaaagcuguguggcagu

SEQ ID NO: 1662834 - RNA, 15 nt, Human
aauaaacgucuuaaa

SEQ ID NO: 1662835 - RNA, 21 nt, Human
aauaauaaagaucauguaaaa

SEQ ID NO: 1662836 - RNA, 13 nt, Human
aauaauaaagauc

SEQ ID NO: 1662837 - RNA, 18 nt, Human
aaguugauggugaugaaa

SEQ ID NO: 1662838 - RNA, 12 nt, Human
aauaaaauuuuu

SEQ ID NO: 1662839 - RNA, 10 nt, Human
aauaaaccau

SEQ ID NO: 1662840 - RNA, 14 nt, Human
aaauggacguguua

SEQ ID NO: 1662841 - RNA, 17 nt, Human
aaauggaauacucuuau

SEQ ID NO: 1662842 - RNA, 15 nt, Human
aaauggacguguuau

SEQ ID NO: 1662843 - RNA, 17 nt, Human
aaauggacguguuauga

SEQ ID NO: 1662844 - RNA, 22 nt, Human
aaaucuccaaaauaaaacuuuu

SEQ ID NO: 1662845 - RNA, 20 nt, Human
aaaucugugaacuugaaauu

SEQ ID NO: 1662846 - RNA, 19 nt, Human
aaaucugugaacuugaaau

SEQ ID NO: 1662847 - RNA, 21 nt, Human
aaaucugugaacuugaaauuu

SEQ ID NO: 1662848 - RNA, 18 nt, Human
aaaucugcuuuuuaaaga

SEQ ID NO: 1662849 - RNA, 14 nt, Human
aaaucuuaacuuga

SEQ ID NO: 1662850 - RNA, 18 nt, Human
aaauguuuuuuuuuaaag

SEQ ID NO: 1662851 - RNA, 21 nt, Human
aaauguuuuuuuuuaaagacu

SEQ ID NO: 1662852 - RNA, 20 nt, Human
aaauguucaucaaugaauga

SEQ ID NO: 1662853 - RNA, 22 nt, Human
aacaaaccuguuucugcagcca

SEQ ID NO: 1662854 - RNA, 21 nt, Human
aacacauacaggaagguagaa

SEQ ID NO: 1662855 - RNA, 17 nt, Human
aacacuaacaugauuug

SEQ ID NO: 1662856 - RNA, 19 nt, Human
aacaccucugcacaagcug

SEQ ID NO: 1662857 - RNA, 12 nt, Human
aacacaucagcu

SEQ ID NO: 1662858 - RNA, 22 nt, Human
aaauguuuuuuuuuaaagacuu

SEQ ID NO: 1662859 - RNA, 12 nt, Human
aaauuaacuuuu

SEQ ID NO: 1662860 - RNA, 19 nt, Human
aaauuaacuuuuauaaacu

SEQ ID NO: 1662861 - RNA, 14 nt, Human
aaauuaacuuuuau

SEQ ID NO: 1662862 - RNA, 13 nt, Human
aaauuaacuuuua

SEQ ID NO: 1662863 - RNA, 23 nt, Human
aaauuggggauucuuaaaguuga

SEQ ID NO: 1662864 - RNA, 18 nt, Human
aaauuggggauucuuaaa

SEQ ID NO: 1662865 - RNA, 19 nt, Human
aaauuggggauucuuaaag

SEQ ID NO: 1662866 - RNA, 20 nt, Human
aaauuggggauucuuaaagu

SEQ ID NO: 1662867 - RNA, 22 nt, Human
aaauuggggauucuuaaaguug

SEQ ID NO: 1662868 - RNA, 18 nt, Human
aaauugaugggauuuggu

SEQ ID NO: 1662869 - RNA, 15 nt, Human
aacauccuacaagac

SEQ ID NO: 1662870 - RNA, 22 nt, Human
aacauccuacaagacacaguga

SEQ ID NO: 1662871 - RNA, 16 nt, Human
aacagcuaaugggaca

SEQ ID NO: 1662872 - RNA, 15 nt, Human
aacauggaaguacua

SEQ ID NO: 1662873 - RNA, 22 nt, Human
aacaugcuacacacugcauguu

SEQ ID NO: 1662874 - RNA, 13 nt, Human
aacccuucagugc

SEQ ID NO: 1662875 - RNA, 11 nt, Human
aaccaguauug

SEQ ID NO: 1662876 - RNA, 13 nt, Human
aaccaguauugua

SEQ ID NO: 1662877 - RNA, 14 nt, Human
aaccaguauuguac

SEQ ID NO: 1662878 - RNA, 19 nt, Human
aaccaguguuguggauuua

SEQ ID NO: 1662879 - RNA, 13 nt, Human
aacgcguugaaau

SEQ ID NO: 1662880 - RNA, 14 nt, Human
aacgcguugaaauu

SEQ ID NO: 1662881 - RNA, 15 nt, Human
aacgcguugaaauug

SEQ ID NO: 1662882 - RNA, 17 nt, Human
aacgcguugaaauugua

SEQ ID NO: 1662883 - RNA, 15 nt, Human
aacguauaaaagccu

SEQ ID NO: 1662884 - RNA, 13 nt, Human
aacgucugugcca

SEQ ID NO: 1662885 - RNA, 17 nt, Human
aacucaaacucuuaaaa

SEQ ID NO: 1662886 - RNA, 16 nt, Human
aacucaccccagcccc

SEQ ID NO: 1662887 - RNA, 17 nt, Human
aacucaccccagcccca

SEQ ID NO: 1662888 - RNA, 18 nt, Human
aacucaccccagccccaa

SEQ ID NO: 1662889 - RNA, 15 nt, Human
aacucauauuuucau

SEQ ID NO: 1662890 - RNA, 16 nt, Human
aacucauauuuucaug

SEQ ID NO: 1662891 - RNA, 18 nt, Human
aacucauauuuucaugcu

SEQ ID NO: 1662892 - RNA, 23 nt, Human
aacugagaugugaacacaucagc

SEQ ID NO: 1662893 - RNA, 15 nt, Human
aacuguuauuuauaa

SEQ ID NO: 1662894 - RNA, 16 nt, Human
aacuguuauuuauaau

SEQ ID NO: 1662895 - RNA, 17 nt, Human
aacuguuauuuauaauc

SEQ ID NO: 1662896 - RNA, 20 nt, Human
aacuguuauuuauaaucacu

SEQ ID NO: 1662897 - RNA, 22 nt, Human
aacuguuauuuauaaucacuuu

SEQ ID NO: 1662898 - RNA, 21 nt, Human
aaaauccacuuuaucuugaau

SEQ ID NO: 1662899 - RNA, 23 nt, Human
aaaaguuuaauauuaaagccaug

SEQ ID NO: 1662900 - RNA, 21 nt, Human
aaaaguuuaauauuaaagcca

SEQ ID NO: 1662901 - RNA, 22 nt, Human
aaaaguuuaauauuaaagccau

SEQ ID NO: 1662902 - RNA, 15 nt, Human
aaaauaaaaaacacu

SEQ ID NO: 1662903 - RNA, 19 nt, Human
aaaauuaggauuucaugau

SEQ ID NO: 1662904 - RNA, 15 nt, Human
aaaauuagccaagug

SEQ ID NO: 1662905 - RNA, 13 nt, Human
aaaauuaagaaag

SEQ ID NO: 1662906 - RNA, 20 nt, Human
aaaauuaagaaaggauaaag

SEQ ID NO: 1662907 - RNA, 23 nt, Human
aaaauuaaucugggccagaauuu

SEQ ID NO: 1662908 - RNA, 22 nt, Human
aaaaucccuuaccucggugccu

SEQ ID NO: 1662909 - RNA, 22 nt, Human
aaaauuaacaugaauauuuagu

SEQ ID NO: 1662910 - RNA, 12 nt, Human
aaaauuaagaaa

SEQ ID NO: 1662911 - RNA, 19 nt, Human
aaaauccauacauuugugu

SEQ ID NO: 1662912 - RNA, 17 nt, Human
aaacagcuaaugggaca

SEQ ID NO: 1662913 - RNA, 15 nt, Human
aaacagccugugucu

SEQ ID NO: 1662914 - RNA, 15 nt, Human
aaagauacaguuacu

SEQ ID NO: 1662915 - RNA, 11 nt, Human
aaagagguuuu

SEQ ID NO: 1662916 - RNA, 22 nt, Human
aaacugauuuuuuuuuccuuca

SEQ ID NO: 1662917 - RNA, 20 nt, Human
aaacugauuuuuuuuuccuu

SEQ ID NO: 1662918 - RNA, 13 nt, Human
aaacugauuuuuu

SEQ ID NO: 1662919 - RNA, 19 nt, Human
aaacugauuuuuuuuuccu

SEQ ID NO: 1662920 - RNA, 13 nt, Human
aaagaaacauuug

SEQ ID NO: 1662921 - RNA, 17 nt, Human
aaaccccaucucuacaa

SEQ ID NO: 1662922 - RNA, 21 nt, Human
aaacccugucucuacuaaaaa

SEQ ID NO: 1662923 - RNA, 14 nt, Human
aaacccuucagugc

SEQ ID NO: 1662924 - RNA, 19 nt, Human
aaacccuugccaugugcua

SEQ ID NO: 1662925 - RNA, 17 nt, Human
aaacucuugaccucagg

SEQ ID NO: 1662926 - RNA, 19 nt, Human
aaaggcagaagcaacccaa

SEQ ID NO: 1662927 - RNA, 21 nt, Human
aaaggcuccaggagcagccac

SEQ ID NO: 1662928 - RNA, 22 nt, Human
aaaggcuccaggagcagccaca

SEQ ID NO: 1662929 - RNA, 14 nt, Human
aaaggcuccaggag

SEQ ID NO: 1662930 - RNA, 14 nt, Human
aaaggcuaccuuug

SEQ ID NO: 1662931 - RNA, 17 nt, Human
aaaggcuaccuuuguau

SEQ ID NO: 1662932 - RNA, 15 nt, Human
aaagccaaagcuagg

SEQ ID NO: 1662933 - RNA, 19 nt, Human
aaagcauuguaaaugugcu

SEQ ID NO: 1662934 - RNA, 20 nt, Human
aaagcauuguaaaugugcuu

SEQ ID NO: 1662935 - RNA, 17 nt, Human
aaauaaacgucuuaaau

SEQ ID NO: 1662936 - RNA, 11 nt, Human
aaauaaauuau

SEQ ID NO: 1662937 - RNA, 15 nt, Human
aaauaaacgucuuaa

SEQ ID NO: 1662938 - RNA, 16 nt, Human
aaauaaacgucuuaaa

SEQ ID NO: 1662939 - RNA, 22 nt, Human
aggguuuugccauguuggccag

SEQ ID NO: 1662940 - RNA, 23 nt, Human
aggguuuugccauguuggccagg

SEQ ID NO: 1662941 - RNA, 13 nt, Human
agguacucuccug

SEQ ID NO: 1662942 - RNA, 14 nt, Human
agguacucuccugg

SEQ ID NO: 1662943 - RNA, 23 nt, Human
aggucccuaauaaagcugugugg

SEQ ID NO: 1662944 - RNA, 16 nt, Human
agguaacaggcagaua

SEQ ID NO: 1662945 - RNA, 13 nt, Human
agguaacaggcag

SEQ ID NO: 1662946 - RNA, 14 nt, Human
agguaacaggcaga

SEQ ID NO: 1662947 - RNA, 20 nt, Human
agggucucacuauguugccc

SEQ ID NO: 1662948 - RNA, 14 nt, Human
agggccuggccuga

SEQ ID NO: 1662949 - RNA, 22 nt, Human
aggggcccaaauucuuucagug

SEQ ID NO: 1662950 - RNA, 12 nt, Human
agggucccuggu

SEQ ID NO: 1662951 - RNA, 14 nt, Human
agggucccuggugg

SEQ ID NO: 1662952 - RNA, 13 nt, Human
aggggccuggcag

SEQ ID NO: 1662953 - RNA, 15 nt, Human
aggggccuggcagcc

SEQ ID NO: 1662954 - RNA, 12 nt, Human
aggggccuggca

SEQ ID NO: 1662955 - RNA, 21 nt, Human
aggguaucuggugacuuuccu

SEQ ID NO: 1662956 - RNA, 13 nt, Human
aggguauuccaga

SEQ ID NO: 1662957 - RNA, 16 nt, Human
agggucccugguggca

SEQ ID NO: 1662958 - RNA, 17 nt, Human
agggucccugguggcag

SEQ ID NO: 1662959 - RNA, 20 nt, Human
agggucccugguggcagcuc

SEQ ID NO: 1662960 - RNA, 22 nt, Human
agggucccugguggcagcucac

SEQ ID NO: 1662961 - RNA, 15 nt, Human
agggccugcaaggga

SEQ ID NO: 1662962 - RNA, 12 nt, Human
agggccuggccu

SEQ ID NO: 1662963 - RNA, 13 nt, Human
agggccuggccug

SEQ ID NO: 1662964 - RNA, 14 nt, Human
agggccugcaaggg

SEQ ID NO: 1662965 - RNA, 20 nt, Human
agggauuagggagagaagau

SEQ ID NO: 1662966 - RNA, 15 nt, Human
agggauuagggagag

SEQ ID NO: 1662967 - RNA, 14 nt, Human
aggagaggggcaca

SEQ ID NO: 1662968 - RNA, 17 nt, Human
aggcaugugaugagagg

SEQ ID NO: 1662969 - RNA, 15 nt, Human
aggcaugguggccca

SEQ ID NO: 1662970 - RNA, 19 nt, Human
aggcaugugaugagaggaa

SEQ ID NO: 1662971 - RNA, 20 nt, Human
aggcaugugaugagaggaaa

SEQ ID NO: 1662972 - RNA, 21 nt, Human
aggcaugugaugagaggaaau

SEQ ID NO: 1662973 - RNA, 17 nt, Human
aggcauguucucugagg

SEQ ID NO: 1662974 - RNA, 18 nt, Human
aggcauguucucugagga

SEQ ID NO: 1662975 - RNA, 19 nt, Human
aggcauguucucugaggac

SEQ ID NO: 1662976 - RNA, 18 nt, Human
aggcauuccccaggaggc

SEQ ID NO: 1662977 - RNA, 19 nt, Human
aggcauuccccaggaggcc

SEQ ID NO: 1662978 - RNA, 20 nt, Human
aggcauuccccaggaggcca

SEQ ID NO: 1662979 - RNA, 13 nt, Human
aggccaggcccuc

SEQ ID NO: 1662980 - RNA, 14 nt, Human
aggccaggcccucu

SEQ ID NO: 1662981 - RNA, 15 nt, Human
aggccaggcccucug

SEQ ID NO: 1662982 - RNA, 22 nt, Human
aggcccuuccucuccacugccu

SEQ ID NO: 1662983 - RNA, 12 nt, Human
aggcccuucucu

SEQ ID NO: 1662984 - RNA, 15 nt, Human
aggcccuucucucca

SEQ ID NO: 1662985 - RNA, 19 nt, Human
aggcccuucucuccagccc

SEQ ID NO: 1662986 - RNA, 22 nt, Human
aggcccucugcccacucccugc

SEQ ID NO: 1662987 - RNA, 23 nt, Human
aggcccucugcccacucccugca

SEQ ID NO: 1662988 - RNA, 21 nt, Human
aggccaugggcacugugggua

SEQ ID NO: 1662989 - RNA, 23 nt, Human
aggccaugggcacuguggguaga

SEQ ID NO: 1662990 - RNA, 14 nt, Human
aggcuaccuuugua

SEQ ID NO: 1662991 - RNA, 13 nt, Human
aggcuaccuuugu

SEQ ID NO: 1662992 - RNA, 15 nt, Human
aggcuaccuuuguau

SEQ ID NO: 1662993 - RNA, 18 nt, Human
aggcuggguucugauccu

SEQ ID NO: 1662994 - RNA, 23 nt, Human
aggcuggucucgaacuccugacc

SEQ ID NO: 1662995 - RNA, 20 nt, Human
aggcuguaucccaugagccu

SEQ ID NO: 1662996 - RNA, 21 nt, Human
aggcuguaucccaugagccuc

SEQ ID NO: 1662997 - RNA, 22 nt, Human
aggcuguaucccaugagccuca

SEQ ID NO: 1662998 - RNA, 17 nt, Human
aggcuuagucacugaga

SEQ ID NO: 1662999 - RNA, 18 nt, Human
aggcuuagucacugagac

SEQ ID NO: 1663000 - RNA, 21 nt, Human
aggcuuagucacugagacagc

SEQ ID NO: 1663001 - RNA, 15 nt, Human
agggacccuccacca

SEQ ID NO: 1663002 - RNA, 23 nt, Human
agggacugccagucccccugccc

SEQ ID NO: 1663003 - RNA, 15 nt, Human
agggacugaggggag

SEQ ID NO: 1663004 - RNA, 18 nt, Human
aggacccggaggggccug

SEQ ID NO: 1663005 - RNA, 20 nt, Human
aggacccggaggggccuggc

SEQ ID NO: 1663006 - RNA, 21 nt, Human
aggacccggaggggccuggca

SEQ ID NO: 1663007 - RNA, 22 nt, Human
aggacccggaggggccuggcag

SEQ ID NO: 1663008 - RNA, 15 nt, Human
agcuuuuaugugaaa

SEQ ID NO: 1663009 - RNA, 21 nt, Human
agcuuuuaugugaaacauguu

SEQ ID NO: 1663010 - RNA, 12 nt, Human
aggaacaaggca

SEQ ID NO: 1663011 - RNA, 13 nt, Human
aggaacaaggcaa

SEQ ID NO: 1663012 - RNA, 16 nt, Human
aggaacaaggcaaggc

SEQ ID NO: 1663013 - RNA, 17 nt, Human
aggaacaaggcaaggcu

SEQ ID NO: 1663014 - RNA, 19 nt, Human
aggaacaaggcaaggcugu

SEQ ID NO: 1663015 - RNA, 21 nt, Human
aggaacuuaaauaaugugaaa

SEQ ID NO: 1663016 - RNA, 20 nt, Human
aggaacaaggcaaggcuguc

SEQ ID NO: 1663017 - RNA, 23 nt, Human
aggaacaaggcaaggcugucaau

SEQ ID NO: 1663018 - RNA, 19 nt, Human
aggaauaaauugcuccuug

SEQ ID NO: 1663019 - RNA, 20 nt, Human
aggaauaaauugcuccuuga

SEQ ID NO: 1663020 - RNA, 13 nt, Human
aggaaguggaaug

SEQ ID NO: 1663021 - RNA, 22 nt, Human
aggaauaccugucccccugaca

SEQ ID NO: 1663022 - RNA, 15 nt, Human
aggaauaccuguccc

SEQ ID NO: 1663023 - RNA, 18 nt, Human
aggaauaccugucccccu

SEQ ID NO: 1663024 - RNA, 22 nt, Human
aggaaggcugagaggagagaga

SEQ ID NO: 1663025 - RNA, 23 nt, Human
aggaacuuaaauaaugugaaacu

SEQ ID NO: 1663026 - RNA, 16 nt, Human
agcuuuuaaacccuau

SEQ ID NO: 1663027 - RNA, 23 nt, Human
agcuuuguuuguugucagcugaa

SEQ ID NO: 1663028 - RNA, 19 nt, Human
agcuucauuuccugugucu

SEQ ID NO: 1663029 - RNA, 18 nt, Human
agcuucauuuccuguguc

SEQ ID NO: 1663030 - RNA, 18 nt, Human
agcuucacuguaaaauaa

SEQ ID NO: 1663031 - RNA, 22 nt, Human
agcugguuuuuagcggagacgg

SEQ ID NO: 1663032 - RNA, 18 nt, Human
agcuggucccacucaguc

SEQ ID NO: 1663033 - RNA, 19 nt, Human
agcuggucccacucagucc

SEQ ID NO: 1663034 - RNA, 13 nt, Human
agcugcugacagu

SEQ ID NO: 1663035 - RNA, 14 nt, Human
agcugcugacagug

SEQ ID NO: 1663036 - RNA, 17 nt, Human
agcuggucccacucagu

SEQ ID NO: 1663037 - RNA, 21 nt, Human
agcugcgguccacccaggagc

SEQ ID NO: 1663038 - RNA, 12 nt, Human
agcugcugacag

SEQ ID NO: 1663039 - RNA, 19 nt, Human
agcugcgguccacccagga

SEQ ID NO: 1663040 - RNA, 20 nt, Human
agcugcgguccacccaggag

SEQ ID NO: 1663041 - RNA, 13 nt, Human
agcugcgguccac

SEQ ID NO: 1663042 - RNA, 16 nt, Human
agcugcgguccaccca

SEQ ID NO: 1663043 - RNA, 17 nt, Human
agcugcgguccacccag

SEQ ID NO: 1663044 - RNA, 18 nt, Human
agcugcgguccacccagg

SEQ ID NO: 1663045 - RNA, 15 nt, Human
agcugaaccugggua

SEQ ID NO: 1663046 - RNA, 20 nt, Human
agcuccccucggagaagagc

SEQ ID NO: 1663047 - RNA, 17 nt, Human
agcuccccucggagaag

SEQ ID NO: 1663048 - RNA, 19 nt, Human
agcuccccucggagaagag

SEQ ID NO: 1663049 - RNA, 15 nt, Human
agcccucccugcccc

SEQ ID NO: 1663050 - RNA, 16 nt, Human
agcccucccugccccu

SEQ ID NO: 1663051 - RNA, 17 nt, Human
agcccucccugccccuc

SEQ ID NO: 1663052 - RNA, 19 nt, Human
agcccucccugccccuccc

SEQ ID NO: 1663053 - RNA, 22 nt, Human
agcccucccugccccucccuuc

SEQ ID NO: 1663054 - RNA, 23 nt, Human
agcccucccugccccucccuuca

SEQ ID NO: 1663055 - RNA, 17 nt, Human
agccuggcuucaaauug

SEQ ID NO: 1663056 - RNA, 18 nt, Human
agccuggcuucaaauugu

SEQ ID NO: 1663057 - RNA, 12 nt, Human
agccugggaggu

SEQ ID NO: 1663058 - RNA, 20 nt, Human
agccugggaggucaaggcug

SEQ ID NO: 1663059 - RNA, 15 nt, Human
agccuuuggaaacag

SEQ ID NO: 1663060 - RNA, 13 nt, Human
agcgagcccuggu

SEQ ID NO: 1663061 - RNA, 19 nt, Human
agcgagcccugguggcagu

SEQ ID NO: 1663062 - RNA, 12 nt, Human
agcucagagagg

SEQ ID NO: 1663063 - RNA, 18 nt, Human
agcucagagaggguggga

SEQ ID NO: 1663064 - RNA, 14 nt, Human
agcucagagagggu

SEQ ID NO: 1663065 - RNA, 12 nt, Human
agcucaccucuc

SEQ ID NO: 1663066 - RNA, 19 nt, Human
agcucaccagccccagugc

SEQ ID NO: 1663067 - RNA, 20 nt, Human
agcucaccagccccagugcc

SEQ ID NO: 1663068 - RNA, 15 nt, Human
agcucaccucucccu

SEQ ID NO: 1663069 - RNA, 18 nt, Human
agcucaccucucccuugg

SEQ ID NO: 1663070 - RNA, 19 nt, Human
agcucaccucucccuugga

SEQ ID NO: 1663071 - RNA, 21 nt, Human
agcuaaucagcauucucacuc

SEQ ID NO: 1663072 - RNA, 16 nt, Human
agcuaaucagcauucu

SEQ ID NO: 1663073 - RNA, 16 nt, Human
agcucaccagccccag

SEQ ID NO: 1663074 - RNA, 12 nt, Human
agcuacaaaugc

SEQ ID NO: 1663075 - RNA, 21 nt, Human
agaggacuuuucuuuguggcu

SEQ ID NO: 1663076 - RNA, 22 nt, Human
agaggacuuuucuuuguggcuu

SEQ ID NO: 1663077 - RNA, 23 nt, Human
agaggagggagcaucagugcccu

SEQ ID NO: 1663078 - RNA, 23 nt, Human
agaggacuuuucuuuguggcuuc

SEQ ID NO: 1663079 - RNA, 13 nt, Human
agagggccugcaa

SEQ ID NO: 1663080 - RNA, 16 nt, Human
agagggccugcaaggg

SEQ ID NO: 1663081 - RNA, 17 nt, Human
agaggggguggccuccc

SEQ ID NO: 1663082 - RNA, 19 nt, Human
agaggggguggccucccaa

SEQ ID NO: 1663083 - RNA, 13 nt, Human
agaggaaugaagu

SEQ ID NO: 1663084 - RNA, 13 nt, Human
agagcccaccuug

SEQ ID NO: 1663085 - RNA, 13 nt, Human
agagccagggucu

SEQ ID NO: 1663086 - RNA, 16 nt, Human
agacuggaagcacagc

SEQ ID NO: 1663087 - RNA, 16 nt, Human
agagagaccacuuuuc

SEQ ID NO: 1663088 - RNA, 16 nt, Human
agacgcugugcugccc

SEQ ID NO: 1663089 - RNA, 18 nt, Human
agacucugucucaaaaaa

SEQ ID NO: 1663090 - RNA, 23 nt, Human
agacugaguacguugugcauuug

SEQ ID NO: 1663091 - RNA, 22 nt, Human
agacugaguacguugugcauuu

SEQ ID NO: 1663092 - RNA, 20 nt, Human
agacugaguacguugugcau

SEQ ID NO: 1663093 - RNA, 18 nt, Human
agacucugucucagucca

SEQ ID NO: 1663094 - RNA, 18 nt, Human
agaagucacauuccugaa

SEQ ID NO: 1663095 - RNA, 20 nt, Human
agaagucacauuccugaaca

SEQ ID NO: 1663096 - RNA, 21 nt, Human
agaagucacauuccugaacag

SEQ ID NO: 1663097 - RNA, 18 nt, Human
agaagguuucagaaagaa

SEQ ID NO: 1663098 - RNA, 14 nt, Human
agaaguaacuuacu

SEQ ID NO: 1663099 - RNA, 13 nt, Human
agaagauagcagg

SEQ ID NO: 1663100 - RNA, 13 nt, Human
agaagacacugau

SEQ ID NO: 1663101 - RNA, 21 nt, Human
agaagacacugaugggcaacc

SEQ ID NO: 1663102 - RNA, 21 nt, Human
acuuuccucuuagucgagcca

SEQ ID NO: 1663103 - RNA, 21 nt, Human
acuuuccucuuuggucuacac

SEQ ID NO: 1663104 - RNA, 18 nt, Human
agaagacugcauuauauu

SEQ ID NO: 1663105 - RNA, 21 nt, Human
agaagagauugugguuucauu

SEQ ID NO: 1663106 - RNA, 22 nt, Human
agaagagcuguucacagccaga

SEQ ID NO: 1663107 - RNA, 21 nt, Human
agaagagcuguucacagccag

SEQ ID NO: 1663108 - RNA, 18 nt, Human
agaaugaaagggcccaga

SEQ ID NO: 1663109 - RNA, 16 nt, Human
agaaugaaauacuguu

SEQ ID NO: 1663110 - RNA, 19 nt, Human
agaaugaaauacuguuuga

SEQ ID NO: 1663111 - RNA, 20 nt, Human
agaaugaaauacuguuugag

SEQ ID NO: 1663112 - RNA, 22 nt, Human
agaagucacauuccugaacagg

SEQ ID NO: 1663113 - RNA, 21 nt, Human
agaagugaaaaucuacacucc

SEQ ID NO: 1663114 - RNA, 17 nt, Human
agaaugagagacacacu

SEQ ID NO: 1663115 - RNA, 22 nt, Human
agaaugagagacacacugaaga

SEQ ID NO: 1663116 - RNA, 19 nt, Human
agaaugcacaaacagaggc

SEQ ID NO: 1663117 - RNA, 22 nt, Human
agaaugcacaaacagaggccgc

SEQ ID NO: 1663118 - RNA, 17 nt, Human
agaaugauuaugaauua

SEQ ID NO: 1663119 - RNA, 20 nt, Human
agacaaugacuuacuguaca

SEQ ID NO: 1663120 - RNA, 23 nt, Human
agacaaugacuuacuguacauga

SEQ ID NO: 1663121 - RNA, 15 nt, Human
agacagagcuacaca

SEQ ID NO: 1663122 - RNA, 22 nt, Human
agacaaugacuuacuguacaug

SEQ ID NO: 1663123 - RNA, 21 nt, Human
agacaaugacuuacuguacau

SEQ ID NO: 1663124 - RNA, 11 nt, Human
agacagagucu

SEQ ID NO: 1663125 - RNA, 19 nt, Human
agacagagucucacuguug

SEQ ID NO: 1663126 - RNA, 20 nt, Human
agacagagucucacuguugc

SEQ ID NO: 1663127 - RNA, 22 nt, Human
agacagccaacuauggccugug

SEQ ID NO: 1663128 - RNA, 20 nt, Human
agacagaucuggaaugugaa

SEQ ID NO: 1663129 - RNA, 23 nt, Human
agacagagucucacuguugccca

SEQ ID NO: 1663130 - RNA, 21 nt, Human
agacagagucucacuguugcc

SEQ ID NO: 1663131 - RNA, 19 nt, Human
agacccaaaaggcagaagc

SEQ ID NO: 1663132 - RNA, 17 nt, Human
agacgaugucuucauac

SEQ ID NO: 1663133 - RNA, 19 nt, Human
agacgaugucuucauaccu

SEQ ID NO: 1663134 - RNA, 14 nt, Human
agccagcaggcucu

SEQ ID NO: 1663135 - RNA, 17 nt, Human
agccagaggagagagga

SEQ ID NO: 1663136 - RNA, 18 nt, Human
agccagaggagagaggac

SEQ ID NO: 1663137 - RNA, 20 nt, Human
agccaaggccaaaggaagca

SEQ ID NO: 1663138 - RNA, 13 nt, Human
agccagaggagag

SEQ ID NO: 1663139 - RNA, 15 nt, Human
agccagaggagagag

SEQ ID NO: 1663140 - RNA, 18 nt, Human
agcauccuggcacccggc

SEQ ID NO: 1663141 - RNA, 16 nt, Human
agccaaaccucuguga

SEQ ID NO: 1663142 - RNA, 14 nt, Human
agcauccuggcacc

SEQ ID NO: 1663143 - RNA, 17 nt, Human
agcauccuggcacccgg

SEQ ID NO: 1663144 - RNA, 16 nt, Human
agccaaagcuaggccu

SEQ ID NO: 1663145 - RNA, 18 nt, Human
agccaaagcuaggccugg

SEQ ID NO: 1663146 - RNA, 15 nt, Human
agcccaccccucaac

SEQ ID NO: 1663147 - RNA, 16 nt, Human
agcccaccuuggcuca

SEQ ID NO: 1663148 - RNA, 14 nt, Human
agcccaccuuggcu

SEQ ID NO: 1663149 - RNA, 16 nt, Human
agccagcaggcucuca

SEQ ID NO: 1663150 - RNA, 17 nt, Human
agccagcaggcucucag

SEQ ID NO: 1663151 - RNA, 23 nt, Human
agcccacgcccccacuggugaca

SEQ ID NO: 1663152 - RNA, 14 nt, Human
agcccacgccccca

SEQ ID NO: 1663153 - RNA, 15 nt, Human
agcccacgcccccac

SEQ ID NO: 1663154 - RNA, 13 nt, Human
agcauccuggcac

SEQ ID NO: 1663155 - RNA, 17 nt, Human
agccccauucugccugc

SEQ ID NO: 1663156 - RNA, 18 nt, Human
agccccauucugccugcc

SEQ ID NO: 1663157 - RNA, 19 nt, Human
agccccauucugccugccc

SEQ ID NO: 1663158 - RNA, 15 nt, Human
agccccauccucugu

SEQ ID NO: 1663159 - RNA, 17 nt, Human
agccccauccucuguac

SEQ ID NO: 1663160 - RNA, 23 nt, Human
agccccauccucuguacagagcc

SEQ ID NO: 1663161 - RNA, 12 nt, Human
agcccucccugc

SEQ ID NO: 1663162 - RNA, 13 nt, Human
agcccucccugcc

SEQ ID NO: 1663163 - RNA, 23 nt, Human
agcccuccaucuaaacugccccc

SEQ ID NO: 1663164 - RNA, 21 nt, Human
agcccuccaucuaaacugccc

SEQ ID NO: 1663165 - RNA, 20 nt, Human
agccccauucugccugccca

SEQ ID NO: 1663166 - RNA, 17 nt, Human
agcccgggcucugccuc

SEQ ID NO: 1663167 - RNA, 18 nt, Human
agcccgggcucugccucc

SEQ ID NO: 1663168 - RNA, 20 nt, Human
agcccgggcucugccuccca

SEQ ID NO: 1663169 - RNA, 21 nt, Human
agcccgggcucugccucccau

SEQ ID NO: 1663170 - RNA, 14 nt, Human
agcacagacccugc

SEQ ID NO: 1663171 - RNA, 15 nt, Human
agcacagacccugcc

SEQ ID NO: 1663172 - RNA, 14 nt, Human
agcacacacuuuug

SEQ ID NO: 1663173 - RNA, 20 nt, Human
agcacacacuuuugguuaag

SEQ ID NO: 1663174 - RNA, 12 nt, Human
agcacagacccu

SEQ ID NO: 1663175 - RNA, 21 nt, Human
agcacgauuucuguuuagaua

SEQ ID NO: 1663176 - RNA, 19 nt, Human
agcacgauuucuguuuaga

SEQ ID NO: 1663177 - RNA, 17 nt, Human
agcacgauuucuguuua

SEQ ID NO: 1663178 - RNA, 16 nt, Human
agcacagacccugccc

SEQ ID NO: 1663179 - RNA, 18 nt, Human
agcacgguggugaggcag

SEQ ID NO: 1663180 - RNA, 19 nt, Human
agauucuuuccugaggcug

SEQ ID NO: 1663181 - RNA, 21 nt, Human
agauucuuuccugaggcuggg

SEQ ID NO: 1663182 - RNA, 23 nt, Human
agauugcaacaggcugggcuuca

SEQ ID NO: 1663183 - RNA, 20 nt, Human
agauugcaacaggcugggcu

SEQ ID NO: 1663184 - RNA, 21 nt, Human
agauugcaacaggcugggcuu

SEQ ID NO: 1663185 - RNA, 18 nt, Human
agcaaaagaugcuucuca

SEQ ID NO: 1663186 - RNA, 24 nt, Human
agcaaaauuuuuucucuaggaaau

SEQ ID NO: 1663187 - RNA, 17 nt, Human
agcaaaugucuuccugg

SEQ ID NO: 1663188 - RNA, 20 nt, Human
agcaaaugucuuccuggauu

SEQ ID NO: 1663189 - RNA, 16 nt, Human
agcaaauguggcuccu

SEQ ID NO: 1663190 - RNA, 20 nt, Human
agcaaaggagauuggaagga

SEQ ID NO: 1663191 - RNA, 19 nt, Human
agaucugccuaaggacuuc

SEQ ID NO: 1663192 - RNA, 16 nt, Human
agaucuggaaugugaa

SEQ ID NO: 1663193 - RNA, 23 nt, Human
agaggggguggccucccaacuca

SEQ ID NO: 1663194 - RNA, 21 nt, Human
agauguagccccucuccugga

SEQ ID NO: 1663195 - RNA, 16 nt, Human
agauguagaggagaaa

SEQ ID NO: 1663196 - RNA, 19 nt, Human
agauguagaggagaaacug

SEQ ID NO: 1663197 - RNA, 14 nt, Human
agaugagugagcau

SEQ ID NO: 1663198 - RNA, 19 nt, Human
agaugaugaugaucuuuaa

SEQ ID NO: 1663199 - RNA, 18 nt, Human
aguucagguaacaggcag

SEQ ID NO: 1663200 - RNA, 13 nt, Human
aguucaucuugaa

SEQ ID NO: 1663201 - RNA, 15 nt, Human
aguucaucuugaauu

SEQ ID NO: 1663202 - RNA, 19 nt, Human
aguucaucuugaauuguaa

SEQ ID NO: 1663203 - RNA, 20 nt, Human
aguucagagcugcccucucc

SEQ ID NO: 1663204 - RNA, 22 nt, Human
aguucagagcugcccucuccug

SEQ ID NO: 1663205 - RNA, 21 nt, Human
aguucagagcugcccucuccu

SEQ ID NO: 1663206 - RNA, 23 nt, Human
aguucagagcugcccucuccugg

SEQ ID NO: 1663207 - RNA, 14 nt, Human
aguugauagcacag

SEQ ID NO: 1663208 - RNA, 16 nt, Human
aguugauacuacaguu

SEQ ID NO: 1663209 - RNA, 21 nt, Human
aguugaaaagacuccaaagaa

SEQ ID NO: 1663210 - RNA, 22 nt, Human
aguucaucuugaauuguaagga

SEQ ID NO: 1663211 - RNA, 18 nt, Human
aguugaaaagacuccaaa

SEQ ID NO: 1663212 - RNA, 19 nt, Human
aguugaaaagacuccaaag

SEQ ID NO: 1663213 - RNA, 20 nt, Human
aguugaaaagacuccaaaga

SEQ ID NO: 1663214 - RNA, 18 nt, Human
agugcuaauuuugaaaaa

SEQ ID NO: 1663215 - RNA, 20 nt, Human
agugcuaauuuugaaaaacu

SEQ ID NO: 1663216 - RNA, 15 nt, Human
agugcuaauuuugaa

SEQ ID NO: 1663217 - RNA, 16 nt, Human
agugccuuauggaaca

SEQ ID NO: 1663218 - RNA, 18 nt, Human
agugccuuauggaacacu

SEQ ID NO: 1663219 - RNA, 10 nt, Human
agugccuuau

SEQ ID NO: 1663220 - RNA, 13 nt, Human
agugccuuaugga

SEQ ID NO: 1663221 - RNA, 14 nt, Human
agugccuuauggaa

SEQ ID NO: 1663222 - RNA, 15 nt, Human
agugccuuauggaac

SEQ ID NO: 1663223 - RNA, 20 nt, Human
agugauggguuaguggaugg

SEQ ID NO: 1663224 - RNA, 21 nt, Human
agugauucucaugccucagcc

SEQ ID NO: 1663225 - RNA, 14 nt, Human
agugauucuccugc

SEQ ID NO: 1663226 - RNA, 15 nt, Human
agugauucuccugcc

SEQ ID NO: 1663227 - RNA, 17 nt, Human
agugauucuccugccuc

SEQ ID NO: 1663228 - RNA, 18 nt, Human
agugccuuacacaauggu

SEQ ID NO: 1663229 - RNA, 14 nt, Human
agugauccucccac

SEQ ID NO: 1663230 - RNA, 15 nt, Human
agugauccucccacc

SEQ ID NO: 1663231 - RNA, 18 nt, Human
agugauccucccaccuca

SEQ ID NO: 1663232 - RNA, 19 nt, Human
agugauccucccaccucag

SEQ ID NO: 1663233 - RNA, 24 nt, Human
agugauccucccaccucagccucc

SEQ ID NO: 1663234 - RNA, 19 nt, Human
agugggacagggcauggcc

SEQ ID NO: 1663235 - RNA, 21 nt, Human
agugggacagggcauggccag

SEQ ID NO: 1663236 - RNA, 22 nt, Human
agugggcccaaugcacuuuguu

SEQ ID NO: 1663237 - RNA, 19 nt, Human
agugucaaugcagccccca

SEQ ID NO: 1663238 - RNA, 20 nt, Human
aguaagccgugauuuucauu

SEQ ID NO: 1663239 - RNA, 14 nt, Human
aguacuauaauuua

SEQ ID NO: 1663240 - RNA, 19 nt, Human
aguacuacaguccucccau

SEQ ID NO: 1663241 - RNA, 22 nt, Human
aguacuacaguccucccaucuc

SEQ ID NO: 1663242 - RNA, 18 nt, Human
aguacguugugcauuugg

SEQ ID NO: 1663243 - RNA, 17 nt, Human
aguacguugugcauuug

SEQ ID NO: 1663244 - RNA, 16 nt, Human
aguacguugugcauuu

SEQ ID NO: 1663245 - RNA, 17 nt, Human
aguacuucuccacccug

SEQ ID NO: 1663246 - RNA, 19 nt, Human
aguacuucuccacccugcu

SEQ ID NO: 1663247 - RNA, 12 nt, Human
aguacuucuuuu

SEQ ID NO: 1663248 - RNA, 12 nt, Human
aguacuauguau

SEQ ID NO: 1663249 - RNA, 14 nt, Human
aguacuauguauca

SEQ ID NO: 1663250 - RNA, 13 nt, Human
aguacucauacau

SEQ ID NO: 1663251 - RNA, 14 nt, Human
aguacguugugcau

SEQ ID NO: 1663252 - RNA, 15 nt, Human
aguacguugugcauu

SEQ ID NO: 1663253 - RNA, 16 nt, Human
aggucuguucuuucca

SEQ ID NO: 1663254 - RNA, 15 nt, Human
aggucuguucuuucc

SEQ ID NO: 1663255 - RNA, 13 nt, Human
aggucuguucuuu

SEQ ID NO: 1663256 - RNA, 18 nt, Human
aguaaaugggggugcauu

SEQ ID NO: 1663257 - RNA, 23 nt, Human
agucacacaguauuacuucugcu

SEQ ID NO: 1663258 - RNA, 22 nt, Human
agucacacaguauuacuucugc

SEQ ID NO: 1663259 - RNA, 21 nt, Human
aguaugaggcauuuguuugaa

SEQ ID NO: 1663260 - RNA, 20 nt, Human
aguaugaggcauuuguuuga

SEQ ID NO: 1663261 - RNA, 15 nt, Human
aguaucucagggccu

SEQ ID NO: 1663262 - RNA, 14 nt, Human
aguauuuuguuuca

SEQ ID NO: 1663263 - RNA, 23 nt, Human
aguaugaggcauuuguuugaacu

SEQ ID NO: 1663264 - RNA, 17 nt, Human
aguauuuuguuucagug

SEQ ID NO: 1663265 - RNA, 19 nt, Human
agucaugcguuuaaucaca

SEQ ID NO: 1663266 - RNA, 22 nt, Human
aguccucuuuucugagaggacu

SEQ ID NO: 1663267 - RNA, 20 nt, Human
aguccuuaccagcagagcac

SEQ ID NO: 1663268 - RNA, 19 nt, Human
aguccucuuuucugagagg

SEQ ID NO: 1663269 - RNA, 11 nt, Human
aguccaagcau

SEQ ID NO: 1663270 - RNA, 18 nt, Human
agugaccucagcuuugau

SEQ ID NO: 1663271 - RNA, 17 nt, Human
agugaccucagcuuuga

SEQ ID NO: 1663272 - RNA, 13 nt, Human
agucuguuuuaug

SEQ ID NO: 1663273 - RNA, 12 nt, Human
agucuguuuuau

SEQ ID NO: 1663274 - RNA, 12 nt, Human
auaacauguaau

SEQ ID NO: 1663275 - RNA, 13 nt, Human
auaacauguaauu

SEQ ID NO: 1663276 - RNA, 18 nt, Human
auaacauguaauuaagua

SEQ ID NO: 1663277 - RNA, 20 nt, Human
auaacauguaauuaaguacu

SEQ ID NO: 1663278 - RNA, 14 nt, Human
auaacaaugaaagu

SEQ ID NO: 1663279 - RNA, 15 nt, Human
auaacaaugcuguau

SEQ ID NO: 1663280 - RNA, 17 nt, Human
auaacaaugcuguauuu

SEQ ID NO: 1663281 - RNA, 19 nt, Human
auaacaaugcuguauuuua

SEQ ID NO: 1663282 - RNA, 20 nt, Human
auaacaaugcuguauuuuaa

SEQ ID NO: 1663283 - RNA, 21 nt, Human
auaacaaugcuguauuuuaaa

SEQ ID NO: 1663284 - RNA, 22 nt, Human
aguuguuacauuuuuaagugcu

SEQ ID NO: 1663285 - RNA, 20 nt, Human
aguuguuacauuuuuaagug

SEQ ID NO: 1663286 - RNA, 19 nt, Human
aguuguuacauuuuuaagu

SEQ ID NO: 1663287 - RNA, 22 nt, Human
aguuugauuaaauucuugcaaa

SEQ ID NO: 1663288 - RNA, 20 nt, Human
aguuugauuaaauucuugca

SEQ ID NO: 1663289 - RNA, 18 nt, Human
aguuugauuaaauucuug

SEQ ID NO: 1663290 - RNA, 17 nt, Human
aguuugauuaaauucuu

SEQ ID NO: 1663291 - RNA, 20 nt, Human
aguuugagaucagccugggc

SEQ ID NO: 1663292 - RNA, 18 nt, Human
aguuugagaucagccugg

SEQ ID NO: 1663293 - RNA, 19 nt, Human
aguuugagaucagccuggg

SEQ ID NO: 1663294 - RNA, 23 nt, Human
aguuugauuaaauucuugcaaag

SEQ ID NO: 1663295 - RNA, 13 nt, Human
auaauggucagag

SEQ ID NO: 1663296 - RNA, 18 nt, Human
auaaggguaucuggugac

SEQ ID NO: 1663297 - RNA, 15 nt, Human
auaauguaaauaaag

SEQ ID NO: 1663298 - RNA, 14 nt, Human
auaauguaagcucu

SEQ ID NO: 1663299 - RNA, 13 nt, Human
auaauguuucaaa

SEQ ID NO: 1663300 - RNA, 21 nt, Human
auaagccagacaucaacagau

SEQ ID NO: 1663301 - RNA, 22 nt, Human
auaagccagacaucaacagaua

SEQ ID NO: 1663302 - RNA, 21 nt, Human
auacccccugcaaagcccagc

SEQ ID NO: 1663303 - RNA, 14 nt, Human
auaccugucccccu

SEQ ID NO: 1663304 - RNA, 15 nt, Human
auaccugucccccug

SEQ ID NO: 1663305 - RNA, 16 nt, Human
auaccugucccccuga

SEQ ID NO: 1663306 - RNA, 20 nt, Human
auacccccugcaaagcccag

SEQ ID NO: 1663307 - RNA, 17 nt, Human
auaccugucccccugac

SEQ ID NO: 1663308 - RNA, 17 nt, Human
auacaaugcugugcccu

SEQ ID NO: 1663309 - RNA, 14 nt, Human
auacaaugcugugc

SEQ ID NO: 1663310 - RNA, 13 nt, Human
auacacuuacacu

SEQ ID NO: 1663311 - RNA, 22 nt, Human
auacacuuacacuuuaugcaca

SEQ ID NO: 1663312 - RNA, 18 nt, Human
auaauguuucaaacauau

SEQ ID NO: 1663313 - RNA, 13 nt, Human
auacccaccccca

SEQ ID NO: 1663314 - RNA, 14 nt, Human
auacccacccccac

SEQ ID NO: 1663315 - RNA, 16 nt, Human
auacccacccccaccc

SEQ ID NO: 1663316 - RNA, 17 nt, Human
auacccccugcaaagcc

SEQ ID NO: 1663317 - RNA, 19 nt, Human
auacccccugcaaagccca

SEQ ID NO: 1663318 - RNA, 17 nt, Human
auacccacccccaccca

SEQ ID NO: 1663319 - RNA, 13 nt, Human
auacagaaaaguu

SEQ ID NO: 1663320 - RNA, 13 nt, Human
auaguaaaaauaa

SEQ ID NO: 1663321 - RNA, 14 nt, Human
auaguaaaaauaaa

SEQ ID NO: 1663322 - RNA, 24 nt, Human
auagguuuggacaaaauggaauac

SEQ ID NO: 1663323 - RNA, 15 nt, Human
auagccuaggugaca

SEQ ID NO: 1663324 - RNA, 17 nt, Human
auagccuaggugacaga

SEQ ID NO: 1663325 - RNA, 17 nt, Human
auagcacagacccugcc

SEQ ID NO: 1663326 - RNA, 18 nt, Human
auagcacagacccugccc

SEQ ID NO: 1663327 - RNA, 18 nt, Human
auagcagcuuauucacaa

SEQ ID NO: 1663328 - RNA, 15 nt, Human
auagcagcuuauuca

SEQ ID NO: 1663329 - RNA, 20 nt, Human
auauauuuuuauauuuacua

SEQ ID NO: 1663330 - RNA, 18 nt, Human
auauauuuuuauauuuac

SEQ ID NO: 1663331 - RNA, 19 nt, Human
auauauuuuuauauuuacu

SEQ ID NO: 1663332 - RNA, 18 nt, Human
auauauuuuuuucugaaa

SEQ ID NO: 1663333 - RNA, 19 nt, Human
auauucaggaagcucaggg

SEQ ID NO: 1663334 - RNA, 15 nt, Human
auauuauuuuauguu

SEQ ID NO: 1663335 - RNA, 22 nt, Human
auauuauuuuauguugcauaga

SEQ ID NO: 1663336 - RNA, 14 nt, Human
auauuauguuaaaa

SEQ ID NO: 1663337 - RNA, 16 nt, Human
auauuauguuaaaacu

SEQ ID NO: 1663338 - RNA, 16 nt, Human
auaugcucugcauguu

SEQ ID NO: 1663339 - RNA, 17 nt, Human
auaugcucugcauguua

SEQ ID NO: 1663340 - RNA, 13 nt, Human
auaucaucaguau

SEQ ID NO: 1663341 - RNA, 17 nt, Human
auaucaucaguauugaa

SEQ ID NO: 1663342 - RNA, 20 nt, Human
auaugcucugcauguuacau

SEQ ID NO: 1663343 - RNA, 13 nt, Human
auauuauguuaaa

SEQ ID NO: 1663344 - RNA, 17 nt, Human
auccucauacccacccc

SEQ ID NO: 1663345 - RNA, 13 nt, Human
auccacucgccuu

SEQ ID NO: 1663346 - RNA, 19 nt, Human
auccagacccggcugcgug

SEQ ID NO: 1663347 - RNA, 14 nt, Human
aucccauuauucaa

SEQ ID NO: 1663348 - RNA, 15 nt, Human
aucccauuauucaaa

SEQ ID NO: 1663349 - RNA, 20 nt, Human
aucccauuauucaaaguugc

SEQ ID NO: 1663350 - RNA, 18 nt, Human
auccccaagccuggcaag

SEQ ID NO: 1663351 - RNA, 19 nt, Human
aucccaugagccucagcau

SEQ ID NO: 1663352 - RNA, 15 nt, Human
aucccggcugcccuu

SEQ ID NO: 1663353 - RNA, 19 nt, Human
auccucaguuuuugugaaa

SEQ ID NO: 1663354 - RNA, 14 nt, Human
aucaaauauauuca

SEQ ID NO: 1663355 - RNA, 20 nt, Human
aucaaagagguuuuaaaaaa

SEQ ID NO: 1663356 - RNA, 23 nt, Human
aucaaagagguuuuaaaaaaauc

SEQ ID NO: 1663357 - RNA, 23 nt, Human
aucacccgcuaagagggagggag

SEQ ID NO: 1663358 - RNA, 13 nt, Human
aucaccagacagg

SEQ ID NO: 1663359 - RNA, 15 nt, Human
aucacaguuuugguu

SEQ ID NO: 1663360 - RNA, 22 nt, Human
aucacaguuuugguugcuuuaa

SEQ ID NO: 1663361 - RNA, 21 nt, Human
aucacaguuuugguugcuuua

SEQ ID NO: 1663362 - RNA, 13 nt, Human
aucacagccucug

SEQ ID NO: 1663363 - RNA, 22 nt, Human
aucaaauauauucagccuggcu

SEQ ID NO: 1663364 - RNA, 14 nt, Human
aucaaauaugcaaa

SEQ ID NO: 1663365 - RNA, 13 nt, Human
aucagcuuauugu

SEQ ID NO: 1663366 - RNA, 22 nt, Human
aucagcuugcccuguuaaaaga

SEQ ID NO: 1663367 - RNA, 14 nt, Human
aucaugugaaauca

SEQ ID NO: 1663368 - RNA, 12 nt, Human
aucaugugaaau

SEQ ID NO: 1663369 - RNA, 14 nt, Human
aucaugucuggcua

SEQ ID NO: 1663370 - RNA, 17 nt, Human
aucaugaauuaguuuua

SEQ ID NO: 1663371 - RNA, 15 nt, Human
augaaaacacauuuu

SEQ ID NO: 1663372 - RNA, 14 nt, Human
augaaaacacauuu

SEQ ID NO: 1663373 - RNA, 16 nt, Human
augaaaacacauuuuu

SEQ ID NO: 1663374 - RNA, 22 nt, Human
augaggcauuuguuugaacuga

SEQ ID NO: 1663375 - RNA, 21 nt, Human
augaggcauuuguuugaacug

SEQ ID NO: 1663376 - RNA, 14 nt, Human
augaggcauuuguu

SEQ ID NO: 1663377 - RNA, 13 nt, Human
augaggcauuugu

SEQ ID NO: 1663378 - RNA, 18 nt, Human
augaccacacuccagcug

SEQ ID NO: 1663379 - RNA, 15 nt, Human
augaccacacuccag

SEQ ID NO: 1663380 - RNA, 20 nt, Human
augaaguccaagcauuuaga

SEQ ID NO: 1663381 - RNA, 23 nt, Human
augaaguccaagcauuuagaugu

SEQ ID NO: 1663382 - RNA, 14 nt, Human
augaagucucugaa

SEQ ID NO: 1663383 - RNA, 21 nt, Human
augaaguacucauacauguua

SEQ ID NO: 1663384 - RNA, 16 nt, Human
aucucugcuuuggaaa

SEQ ID NO: 1663385 - RNA, 18 nt, Human
aucucugcaaucuucuca

SEQ ID NO: 1663386 - RNA, 21 nt, Human
aucucugcaaucuucucagaa

SEQ ID NO: 1663387 - RNA, 18 nt, Human
aucugggggccucuucug

SEQ ID NO: 1663388 - RNA, 17 nt, Human
aucuggguucacugcaa

SEQ ID NO: 1663389 - RNA, 20 nt, Human
aucuccgucaacucauauuu

SEQ ID NO: 1663390 - RNA, 15 nt, Human
auggcugugccucug

SEQ ID NO: 1663391 - RNA, 16 nt, Human
auggcugugccucugc

SEQ ID NO: 1663392 - RNA, 17 nt, Human
auggcugugccucugcc

SEQ ID NO: 1663393 - RNA, 18 nt, Human
auggcugugccucugccu

SEQ ID NO: 1663394 - RNA, 18 nt, Human
auggcuggagcuagaauu

SEQ ID NO: 1663395 - RNA, 18 nt, Human
auggauaggcacaggaaa

SEQ ID NO: 1663396 - RNA, 17 nt, Human
auggauaggcacaggaa

SEQ ID NO: 1663397 - RNA, 21 nt, Human
augcuuuaggauguacaguua

SEQ ID NO: 1663398 - RNA, 18 nt, Human
augcuuuaggauguacag

SEQ ID NO: 1663399 - RNA, 13 nt, Human
augcuuuaaacau

SEQ ID NO: 1663400 - RNA, 15 nt, Human
augcuuguacauaau

SEQ ID NO: 1663401 - RNA, 16 nt, Human
augcuuguacauaaug

SEQ ID NO: 1663402 - RNA, 19 nt, Human
auggcuuuguauagaaccu

SEQ ID NO: 1663403 - RNA, 18 nt, Human
auggcuuuugugcauuau

SEQ ID NO: 1663404 - RNA, 17 nt, Human
auggcuuuugugcauua

SEQ ID NO: 1663405 - RNA, 16 nt, Human
auggcuuuugugcauu

SEQ ID NO: 1663406 - RNA, 20 nt, Human
augcugacuguacuccuccc

SEQ ID NO: 1663407 - RNA, 21 nt, Human
augcugacuguacuccuccca

SEQ ID NO: 1663408 - RNA, 19 nt, Human
augcugacuguacuccucc

SEQ ID NO: 1663409 - RNA, 20 nt, Human
augcugaguuugugcuggug

SEQ ID NO: 1663410 - RNA, 12 nt, Human
augcugccucca

SEQ ID NO: 1663411 - RNA, 15 nt, Human
augcugccuccagaa

SEQ ID NO: 1663412 - RNA, 16 nt, Human
augcugcccugugagu

SEQ ID NO: 1663413 - RNA, 13 nt, Human
augcugcccugug

SEQ ID NO: 1663414 - RNA, 14 nt, Human
augcugcccuguga

SEQ ID NO: 1663415 - RNA, 15 nt, Human
augcugcccugugag

SEQ ID NO: 1663416 - RNA, 19 nt, Human
augccuggauggggcugca

SEQ ID NO: 1663417 - RNA, 20 nt, Human
augccuggauggggcugcac

SEQ ID NO: 1663418 - RNA, 23 nt, Human
augcacagaguuguuacauuuuu

SEQ ID NO: 1663419 - RNA, 22 nt, Human
augcacagaguuguuacauuuu

SEQ ID NO: 1663420 - RNA, 21 nt, Human
augcacagaguuguuacauuu

SEQ ID NO: 1663421 - RNA, 19 nt, Human
augcacagaguuguuacau

SEQ ID NO: 1663422 - RNA, 15 nt, Human
augcacacauuuuuu

SEQ ID NO: 1663423 - RNA, 14 nt, Human
augcacacauuuuu

SEQ ID NO: 1663424 - RNA, 13 nt, Human
augcacacauuuu

SEQ ID NO: 1663425 - RNA, 23 nt, Human
augcacaaauucugucucuggau

SEQ ID NO: 1663426 - RNA, 15 nt, Human
augcacaaauucugu

SEQ ID NO: 1663427 - RNA, 22 nt, Human
augcacaaauucugucucugga

SEQ ID NO: 1663428 - RNA, 18 nt, Human
augcacaaacagaggccg

SEQ ID NO: 1663429 - RNA, 23 nt, Human
augaugaaaugaggucagagccu

SEQ ID NO: 1663430 - RNA, 18 nt, Human
augaugaaaugaggucag

SEQ ID NO: 1663431 - RNA, 15 nt, Human
augaugauccuaggc

SEQ ID NO: 1663432 - RNA, 18 nt, Human
augaugaucuuuaaaaua

SEQ ID NO: 1663433 - RNA, 21 nt, Human
augaugaucuuuaaaauacac

SEQ ID NO: 1663434 - RNA, 18 nt, Human
augaucuuugcagacagg

SEQ ID NO: 1663435 - RNA, 19 nt, Human
augaucuuugcagacaggc

SEQ ID NO: 1663436 - RNA, 21 nt, Human
augaucuuugcagacaggcaa

SEQ ID NO: 1663437 - RNA, 17 nt, Human
augaucuuugcagacag

SEQ ID NO: 1663438 - RNA, 16 nt, Human
augaucuuuaaaauac

SEQ ID NO: 1663439 - RNA, 21 nt, Human
augggugcuuggaggaaggaa

SEQ ID NO: 1663440 - RNA, 23 nt, Human
augggugcuuggaggaaggaaac

SEQ ID NO: 1663441 - RNA, 14 nt, Human
augugaaacauguu

SEQ ID NO: 1663442 - RNA, 14 nt, Human
augucacaggcagg

SEQ ID NO: 1663443 - RNA, 19 nt, Human
augucacaggcagguccag

SEQ ID NO: 1663444 - RNA, 17 nt, Human
augugaaaucauucauu

SEQ ID NO: 1663445 - RNA, 18 nt, Human
augugaaaucauucauuu

SEQ ID NO: 1663446 - RNA, 15 nt, Human
augugaacacaucag

SEQ ID NO: 1663447 - RNA, 15 nt, Human
augguccgugcuaag

SEQ ID NO: 1663448 - RNA, 18 nt, Human
augguccgugcuaaggac

SEQ ID NO: 1663449 - RNA, 19 nt, Human
augguccgugcuaaggacu

SEQ ID NO: 1663450 - RNA, 13 nt, Human
augucacaggcag

SEQ ID NO: 1663451 - RNA, 21 nt, Human
augucaaucagccuaguugau

SEQ ID NO: 1663452 - RNA, 14 nt, Human
auguucuuaauucu

SEQ ID NO: 1663453 - RNA, 15 nt, Human
auguuugccucugcc

SEQ ID NO: 1663454 - RNA, 17 nt, Human
auguuugccucugccuc

SEQ ID NO: 1663455 - RNA, 14 nt, Human
auguuugccucugc

SEQ ID NO: 1663456 - RNA, 15 nt, Human
auguucugggacaca

SEQ ID NO: 1663457 - RNA, 17 nt, Human
auguucucugaggacac

SEQ ID NO: 1663458 - RNA, 14 nt, Human
auguucugggacac

SEQ ID NO: 1663459 - RNA, 17 nt, Human
auguucucucuucucca

SEQ ID NO: 1663460 - RNA, 13 nt, Human
auguucucugagg

SEQ ID NO: 1663461 - RNA, 17 nt, Human
auguuccuagugaaaga

SEQ ID NO: 1663462 - RNA, 13 nt, Human
auguguaaguauu

SEQ ID NO: 1663463 - RNA, 15 nt, Human
auguuccuagugaaa

SEQ ID NO: 1663464 - RNA, 16 nt, Human
auguuccuagugaaag

SEQ ID NO: 1663465 - RNA, 19 nt, Human
auguguaagacaaaaagcu

SEQ ID NO: 1663466 - RNA, 17 nt, Human
auguguaagacaaaaag

SEQ ID NO: 1663467 - RNA, 16 nt, Human
cacaggcccuuccucu

SEQ ID NO: 1663468 - RNA, 17 nt, Human
cacaggcccuuccucuc

SEQ ID NO: 1663469 - RNA, 18 nt, Human
cacaggcccuuccucucc

SEQ ID NO: 1663470 - RNA, 19 nt, Human
cacaggcccuuccucucca

SEQ ID NO: 1663471 - RNA, 13 nt, Human
cacaggaaaccag

SEQ ID NO: 1663472 - RNA, 22 nt, Human
cacagcugcucaauaaaguaca

SEQ ID NO: 1663473 - RNA, 12 nt, Human
cacagcugcuca

SEQ ID NO: 1663474 - RNA, 21 nt, Human
cacaggcccuuccucuccacu

SEQ ID NO: 1663475 - RNA, 22 nt, Human
cacaggcccuuccucuccacug

SEQ ID NO: 1663476 - RNA, 18 nt, Human
cacagugcaucucagccc

SEQ ID NO: 1663477 - RNA, 19 nt, Human
cacagugcaucucagccca

SEQ ID NO: 1663478 - RNA, 17 nt, Human
cacaguucaauucucau

SEQ ID NO: 1663479 - RNA, 17 nt, Human
cacacacgcgugcacac

SEQ ID NO: 1663480 - RNA, 20 nt, Human
cacaagaaaugaaagcaggg

SEQ ID NO: 1663481 - RNA, 21 nt, Human
cacaagaaaugaaagcaggga

SEQ ID NO: 1663482 - RNA, 13 nt, Human
cacaaaggagagc

SEQ ID NO: 1663483 - RNA, 18 nt, Human
cacaagaaaugaaagcag

SEQ ID NO: 1663484 - RNA, 22 nt, Human
caaugugaaaagaaaaaugagc

SEQ ID NO: 1663485 - RNA, 22 nt, Human
caaugugacuuaaugccacuaa

SEQ ID NO: 1663486 - RNA, 21 nt, Human
caauaucuuuuuuuuaauaaa

SEQ ID NO: 1663487 - RNA, 18 nt, Human
caauuacaggaaguacug

SEQ ID NO: 1663488 - RNA, 13 nt, Human
cacaaacagaggc

SEQ ID NO: 1663489 - RNA, 18 nt, Human
cacaaagcccuuccaugu

SEQ ID NO: 1663490 - RNA, 15 nt, Human
cacaaacagaggccg

SEQ ID NO: 1663491 - RNA, 14 nt, Human
cacaaacagaggcc

SEQ ID NO: 1663492 - RNA, 22 nt, Human
caauuuuucuuauuucauuucu

SEQ ID NO: 1663493 - RNA, 17 nt, Human
cacagccagacuggcac

SEQ ID NO: 1663494 - RNA, 18 nt, Human
cacagccagacuggcaca

SEQ ID NO: 1663495 - RNA, 21 nt, Human
cacagcaguugaaaagacucc

SEQ ID NO: 1663496 - RNA, 16 nt, Human
cacagauuugagcuca

SEQ ID NO: 1663497 - RNA, 17 nt, Human
cacagauuugagcucag

SEQ ID NO: 1663498 - RNA, 18 nt, Human
cacagauuugagcucagc

SEQ ID NO: 1663499 - RNA, 22 nt, Human
cacagauuugagcucagcccug

SEQ ID NO: 1663500 - RNA, 19 nt, Human
cacagcaguugaaaagacu

SEQ ID NO: 1663501 - RNA, 22 nt, Human
cacagaguuguuacauuuuuaa

SEQ ID NO: 1663502 - RNA, 13 nt, Human
cacagaggcugcc

SEQ ID NO: 1663503 - RNA, 19 nt, Human
cacagagaaaguacuucuc

SEQ ID NO: 1663504 - RNA, 20 nt, Human
cacagagaaaguacuucucc

SEQ ID NO: 1663505 - RNA, 21 nt, Human
cacagagaaaguacuucucca

SEQ ID NO: 1663506 - RNA, 14 nt, Human
cacacuccagcugg

SEQ ID NO: 1663507 - RNA, 13 nt, Human
cacacugaagaag

SEQ ID NO: 1663508 - RNA, 14 nt, Human
cacacugaagaagc

SEQ ID NO: 1663509 - RNA, 18 nt, Human
caauaggaaaaacugauu

SEQ ID NO: 1663510 - RNA, 22 nt, Human
caagcugcacccucaggcaggu

SEQ ID NO: 1663511 - RNA, 21 nt, Human
caagcuggucccacucagucc

SEQ ID NO: 1663512 - RNA, 15 nt, Human
caagcgauucuucug

SEQ ID NO: 1663513 - RNA, 17 nt, Human
caagcgauucuucugcu

SEQ ID NO: 1663514 - RNA, 18 nt, Human
caagcgauucuucugcuu

SEQ ID NO: 1663515 - RNA, 21 nt, Human
caagcugcacccucaggcagg

SEQ ID NO: 1663516 - RNA, 16 nt, Human
caaggagauuuacaac

SEQ ID NO: 1663517 - RNA, 18 nt, Human
caaggauccugagccaga

SEQ ID NO: 1663518 - RNA, 19 nt, Human
caaggauccugagccagau

SEQ ID NO: 1663519 - RNA, 14 nt, Human
caaggagccaaaca

SEQ ID NO: 1663520 - RNA, 22 nt, Human
caaggauccugagccagauuuc

SEQ ID NO: 1663521 - RNA, 20 nt, Human
caaggauccugagccagauu

SEQ ID NO: 1663522 - RNA, 17 nt, Human
caaggcugcagugagcc

SEQ ID NO: 1663523 - RNA, 22 nt, Human
caaggcugcagugagccgagau

SEQ ID NO: 1663524 - RNA, 20 nt, Human
caaggaaaaaauaacaauga

SEQ ID NO: 1663525 - RNA, 22 nt, Human
caagcuggucccacucagucca

SEQ ID NO: 1663526 - RNA, 23 nt, Human
caagcuggucccacucaguccau

SEQ ID NO: 1663527 - RNA, 18 nt, Human
caaggaaaaaauaacaau

SEQ ID NO: 1663528 - RNA, 23 nt, Human
caagggugaugggaaagcauugu

SEQ ID NO: 1663529 - RNA, 18 nt, Human
caaggcugggggaagaag

SEQ ID NO: 1663530 - RNA, 21 nt, Human
caagggugaugggaaagcauu

SEQ ID NO: 1663531 - RNA, 15 nt, Human
caauaggaaaaacug

SEQ ID NO: 1663532 - RNA, 16 nt, Human
caauaggaaaaacuga

SEQ ID NO: 1663533 - RNA, 17 nt, Human
caauaggaaaaacugau

SEQ ID NO: 1663534 - RNA, 17 nt, Human
caauagucaaauugugu

SEQ ID NO: 1663535 - RNA, 19 nt, Human
caauagucaaauuguguga

SEQ ID NO: 1663536 - RNA, 18 nt, Human
caauaauaauaccucccu

SEQ ID NO: 1663537 - RNA, 13 nt, Human
caacaggcugggc

SEQ ID NO: 1663538 - RNA, 13 nt, Human
caaacagaggccg

SEQ ID NO: 1663539 - RNA, 15 nt, Human
caaacagaggccgcc

SEQ ID NO: 1663540 - RNA, 21 nt, Human
caaaaugagcccuguccugcc

SEQ ID NO: 1663541 - RNA, 11 nt, Human
caaaaugaaac

SEQ ID NO: 1663542 - RNA, 22 nt, Human
caaaaugaaacgcaaccaccac

SEQ ID NO: 1663543 - RNA, 17 nt, Human
caaacucuugaccucag

SEQ ID NO: 1663544 - RNA, 19 nt, Human
caaacucuugaccucaggu

SEQ ID NO: 1663545 - RNA, 20 nt, Human
caaacucuugaccucaggug

SEQ ID NO: 1663546 - RNA, 17 nt, Human
caaacugacucuuaaga

SEQ ID NO: 1663547 - RNA, 21 nt, Human
caaacugacucuuaagaagac

SEQ ID NO: 1663548 - RNA, 21 nt, Human
caaacucuugaccucagguga

SEQ ID NO: 1663549 - RNA, 16 nt, Human
caaacugacucuuaag

SEQ ID NO: 1663550 - RNA, 18 nt, Human
auuuuauuuuauuaugca

SEQ ID NO: 1663551 - RNA, 15 nt, Human
caaaacgguuuuacu

SEQ ID NO: 1663552 - RNA, 21 nt, Human
caaaacgguuuuacugcagcu

SEQ ID NO: 1663553 - RNA, 15 nt, Human
caaaacucuccucug

SEQ ID NO: 1663554 - RNA, 16 nt, Human
caaaacucuccucugc

SEQ ID NO: 1663555 - RNA, 14 nt, Human
caaaaguuucucuu

SEQ ID NO: 1663556 - RNA, 19 nt, Human
caaaacucuccucugcugc

SEQ ID NO: 1663557 - RNA, 14 nt, Human
caaaacugcacugu

SEQ ID NO: 1663558 - RNA, 17 nt, Human
caaaacugcacugucaa

SEQ ID NO: 1663559 - RNA, 18 nt, Human
caaaacugcacugucaag

SEQ ID NO: 1663560 - RNA, 21 nt, Human
caaaaucgaugcagugcuucc

SEQ ID NO: 1663561 - RNA, 20 nt, Human
caaaauaaaacuuuuuaaaa

SEQ ID NO: 1663562 - RNA, 16 nt, Human
caaaauaaaacuuuuu

SEQ ID NO: 1663563 - RNA, 23 nt, Human
caagggaauuucuucaacucccu

SEQ ID NO: 1663564 - RNA, 21 nt, Human
caagaccuucuccuucaccuu

SEQ ID NO: 1663565 - RNA, 23 nt, Human
caagaccuucuccuucaccuuug

SEQ ID NO: 1663566 - RNA, 13 nt, Human
caagacgcugugc

SEQ ID NO: 1663567 - RNA, 15 nt, Human
caagacgcugugcug

SEQ ID NO: 1663568 - RNA, 17 nt, Human
caagagcuuaacagugu

SEQ ID NO: 1663569 - RNA, 13 nt, Human
caagagcccaggc

SEQ ID NO: 1663570 - RNA, 12 nt, Human
caacuugggaac

SEQ ID NO: 1663571 - RNA, 16 nt, Human
caacuuguaaaugugg

SEQ ID NO: 1663572 - RNA, 14 nt, Human
caagaagcccagga

SEQ ID NO: 1663573 - RNA, 13 nt, Human
caagaagcccagg

SEQ ID NO: 1663574 - RNA, 17 nt, Human
caagaaaugaaagcagg

SEQ ID NO: 1663575 - RNA, 19 nt, Human
caagaaaugaaagcaggga

SEQ ID NO: 1663576 - RNA, 21 nt, Human
caaccugcucuccucuugcca

SEQ ID NO: 1663577 - RNA, 23 nt, Human
caaccugcucuccucuugccacu

SEQ ID NO: 1663578 - RNA, 18 nt, Human
caaccugcucuccucuug

SEQ ID NO: 1663579 - RNA, 20 nt, Human
caacauacucccaucuguga

SEQ ID NO: 1663580 - RNA, 17 nt, Human
caaccuucuguggcuca

SEQ ID NO: 1663581 - RNA, 19 nt, Human
caaccuucuguggcucaca

SEQ ID NO: 1663582 - RNA, 20 nt, Human
caaccuucuguggcucacag

SEQ ID NO: 1663583 - RNA, 16 nt, Human
caaccuggucacagga

SEQ ID NO: 1663584 - RNA, 16 nt, Human
caaccuucuguggcuc

SEQ ID NO: 1663585 - RNA, 23 nt, Human
caacagcuggugcccugcuuuca

SEQ ID NO: 1663586 - RNA, 12 nt, Human
caacaggcuggg

SEQ ID NO: 1663587 - RNA, 17 nt, Human
caacauacucccaucug

SEQ ID NO: 1663588 - RNA, 19 nt, Human
caacauacucccaucugug

SEQ ID NO: 1663589 - RNA, 22 nt, Human
caaauuucuaaaucuccaaaau

SEQ ID NO: 1663590 - RNA, 15 nt, Human
caaauuucuaaaucu

SEQ ID NO: 1663591 - RNA, 14 nt, Human
caaauaugcaaagc

SEQ ID NO: 1663592 - RNA, 13 nt, Human
caaauaugcaaag

SEQ ID NO: 1663593 - RNA, 23 nt, Human
caaauauauucagccuggcuuca

SEQ ID NO: 1663594 - RNA, 12 nt, Human
caaauaugcaaa

SEQ ID NO: 1663595 - RNA, 23 nt, Human
caaauggaaaugggcagagcaga

SEQ ID NO: 1663596 - RNA, 20 nt, Human
caaauguucaucaaugaaug

SEQ ID NO: 1663597 - RNA, 18 nt, Human
caaauguucaucaaugaa

SEQ ID NO: 1663598 - RNA, 14 nt, Human
caaauguucaucaa

SEQ ID NO: 1663599 - RNA, 18 nt, Human
caaagugcugggauuaca

SEQ ID NO: 1663600 - RNA, 23 nt, Human
caaagugcugggauuacaagcgu

SEQ ID NO: 1663601 - RNA, 20 nt, Human
caaaguucccuacuuccugu

SEQ ID NO: 1663602 - RNA, 21 nt, Human
caaaguucccuacuuccugug

SEQ ID NO: 1663603 - RNA, 19 nt, Human
caaagugcugggauuacaa

SEQ ID NO: 1663604 - RNA, 13 nt, Human
uuaacuuuuauaa

SEQ ID NO: 1663605 - RNA, 12 nt, Human
uuaacuuuuaua

SEQ ID NO: 1663606 - RNA, 17 nt, Human
uuaaaugcccagccccu

SEQ ID NO: 1663607 - RNA, 12 nt, Human
uuaagaguaaaa

SEQ ID NO: 1663608 - RNA, 14 nt, Human
uuaacuuuuauaaa

SEQ ID NO: 1663609 - RNA, 13 nt, Human
uuaauauuaaagc

SEQ ID NO: 1663610 - RNA, 14 nt, Human
uuaauauuaaagcc

SEQ ID NO: 1663611 - RNA, 16 nt, Human
uuaauauuaaagccau

SEQ ID NO: 1663612 - RNA, 17 nt, Human
uuaauauuaaagccaug

SEQ ID NO: 1663613 - RNA, 11 nt, Human
uuaauauuaaa

SEQ ID NO: 1663614 - RNA, 14 nt, Human
uuaauaauaaauuc

SEQ ID NO: 1663615 - RNA, 23 nt, Human
uuaauaauaaauucccuggccuu

SEQ ID NO: 1663616 - RNA, 12 nt, Human
uuacagaagccc

SEQ ID NO: 1663617 - RNA, 13 nt, Human
uuacacuuuaugc

SEQ ID NO: 1663618 - RNA, 20 nt, Human
uuacacuuuaugcacaaaau

SEQ ID NO: 1663619 - RNA, 17 nt, Human
uuacauuuuuaagugcu

SEQ ID NO: 1663620 - RNA, 12 nt, Human
uuacauuuuuaa

SEQ ID NO: 1663621 - RNA, 20 nt, Human
uuacauuuguauaaaauaau

SEQ ID NO: 1663622 - RNA, 19 nt, Human
uuacagaaucuaacuggug

SEQ ID NO: 1663623 - RNA, 18 nt, Human
uuaauauuaaagccaugu

SEQ ID NO: 1663624 - RNA, 19 nt, Human
uuaauauuaaagccauguu

SEQ ID NO: 1663625 - RNA, 20 nt, Human
uuaauauuaaagccauguuu

SEQ ID NO: 1663626 - RNA, 22 nt, Human
uuaauuaaaacacaacaucuuu

SEQ ID NO: 1663627 - RNA, 11 nt, Human
uuaaaugcacc

SEQ ID NO: 1663628 - RNA, 14 nt, Human
uuaaaugcccagcc

SEQ ID NO: 1663629 - RNA, 15 nt, Human
uuaaaugcccagccc

SEQ ID NO: 1663630 - RNA, 16 nt, Human
uuaaaugcccagcccc

SEQ ID NO: 1663631 - RNA, 12 nt, Human
uuaaagccaugu

SEQ ID NO: 1663632 - RNA, 14 nt, Human
uuaaagccauguuu

SEQ ID NO: 1663633 - RNA, 18 nt, Human
uuaaagccauguuuauua

SEQ ID NO: 1663634 - RNA, 20 nt, Human
uuaaagccauguuuauuaca

SEQ ID NO: 1663635 - RNA, 14 nt, Human
uuaaaacccaagug

SEQ ID NO: 1663636 - RNA, 18 nt, Human
uuaaaauacacacucaaa

SEQ ID NO: 1663637 - RNA, 23 nt, Human
uguuuuaaggaugcuuguacaua

SEQ ID NO: 1663638 - RNA, 22 nt, Human
uguuuuaaggaugcuuguacau

SEQ ID NO: 1663639 - RNA, 17 nt, Human
uguuuuaagaggcaggg

SEQ ID NO: 1663640 - RNA, 15 nt, Human
uuaaaaaaaaaauug

SEQ ID NO: 1663641 - RNA, 22 nt, Human
uuaaaaaaaaaccugagcccca

SEQ ID NO: 1663642 - RNA, 11 nt, Human
uguuucuguac

SEQ ID NO: 1663643 - RNA, 22 nt, Human
uguuucuguacuuuuuggcaua

SEQ ID NO: 1663644 - RNA, 23 nt, Human
uguuucuguacuuuuuggcauaa

SEQ ID NO: 1663645 - RNA, 16 nt, Human
uguuuguugucagcug

SEQ ID NO: 1663646 - RNA, 16 nt, Human
uguuuuaagaggcagg

SEQ ID NO: 1663647 - RNA, 15 nt, Human
uguuuccuggcacug

SEQ ID NO: 1663648 - RNA, 23 nt, Human
uguuuccuagcacacacuuuugg

SEQ ID NO: 1663649 - RNA, 13 nt, Human
uguucaugaaaga

SEQ ID NO: 1663650 - RNA, 14 nt, Human
uguucaugaaagau

SEQ ID NO: 1663651 - RNA, 19 nt, Human
uguucaucauccuaagcua

SEQ ID NO: 1663652 - RNA, 15 nt, Human
uguucucucuucucc

SEQ ID NO: 1663653 - RNA, 16 nt, Human
uguucucucuucucca

SEQ ID NO: 1663654 - RNA, 13 nt, Human
uguucucugcccu

SEQ ID NO: 1663655 - RNA, 14 nt, Human
uguucucugcccuc

SEQ ID NO: 1663656 - RNA, 15 nt, Human
uguucucugcccucc

SEQ ID NO: 1663657 - RNA, 16 nt, Human
uguucucugcccucca

SEQ ID NO: 1663658 - RNA, 13 nt, Human
uguucucugagga

SEQ ID NO: 1663659 - RNA, 12 nt, Human
uguucuggcucu

SEQ ID NO: 1663660 - RNA, 13 nt, Human
uguucuggcucuu

SEQ ID NO: 1663661 - RNA, 16 nt, Human
uguucuggcucuucca

SEQ ID NO: 1663662 - RNA, 23 nt, Human
uguucuuucuggcuaugcauuug

SEQ ID NO: 1663663 - RNA, 15 nt, Human
uguucugcuuuccuc

SEQ ID NO: 1663664 - RNA, 12 nt, Human
uguucugggaca

SEQ ID NO: 1663665 - RNA, 21 nt, Human
uguucuggcucuuccaggcug

SEQ ID NO: 1663666 - RNA, 17 nt, Human
uguucuggcucuuccag

SEQ ID NO: 1663667 - RNA, 20 nt, Human
uguucuggcucuuccaggcu

SEQ ID NO: 1663668 - RNA, 15 nt, Human
uguugaagccuuugu

SEQ ID NO: 1663669 - RNA, 20 nt, Human
uguugacaugggacauuugc

SEQ ID NO: 1663670 - RNA, 12 nt, Human
uguuuaagagac

SEQ ID NO: 1663671 - RNA, 17 nt, Human
uguuggcugggggccuc

SEQ ID NO: 1663672 - RNA, 19 nt, Human
uguuggcugggggccucag

SEQ ID NO: 1663673 - RNA, 17 nt, Human
uguuuaaaaucauuucu

SEQ ID NO: 1663674 - RNA, 18 nt, Human
uguuuaaaaucauuucug

SEQ ID NO: 1663675 - RNA, 14 nt, Human
uguuggagaagaac

SEQ ID NO: 1663676 - RNA, 16 nt, Human
uguuggagaagaacug

SEQ ID NO: 1663677 - RNA, 17 nt, Human
uguuggagaagaacuga

SEQ ID NO: 1663678 - RNA, 14 nt, Human
uguuggcagccucu

SEQ ID NO: 1663679 - RNA, 15 nt, Human
uguuggccaaagcca

SEQ ID NO: 1663680 - RNA, 15 nt, Human
uguuggccaggcugg

SEQ ID NO: 1663681 - RNA, 16 nt, Human
uguuggccaggcuggu

SEQ ID NO: 1663682 - RNA, 19 nt, Human
uguuggagaagaacugaaa

SEQ ID NO: 1663683 - RNA, 20 nt, Human
uguuggagaagaacugaaau

SEQ ID NO: 1663684 - RNA, 15 nt, Human
ugugugcuuauguau

SEQ ID NO: 1663685 - RNA, 19 nt, Human
ugugugcacguacacacac

SEQ ID NO: 1663686 - RNA, 18 nt, Human
uguguaugcgugugugug

SEQ ID NO: 1663687 - RNA, 21 nt, Human
ugugugaaagguacuucaaau

SEQ ID NO: 1663688 - RNA, 22 nt, Human
ugugugaaagguacuucaaauc

SEQ ID NO: 1663689 - RNA, 17 nt, Human
ugugugugaaaaugugu

SEQ ID NO: 1663690 - RNA, 20 nt, Human
ugugugugcuuauguaugag

SEQ ID NO: 1663691 - RNA, 19 nt, Human
ugugugugcuuauguauga

SEQ ID NO: 1663692 - RNA, 16 nt, Human
uguguuuauugucaaa

SEQ ID NO: 1663693 - RNA, 15 nt, Human
uguguuuuucauaaa

SEQ ID NO: 1663694 - RNA, 18 nt, Human
uguguuuuucauaaagca

SEQ ID NO: 1663695 - RNA, 13 nt, Human
uguguuugaagca

SEQ ID NO: 1663696 - RNA, 13 nt, Human
uguguuuugcaag

SEQ ID NO: 1663697 - RNA, 19 nt, Human
uguguuuugcaagccagau

SEQ ID NO: 1663698 - RNA, 17 nt, Human
uguuagccccauaauuu

SEQ ID NO: 1663699 - RNA, 14 nt, Human
uguuacuaaguuuu

SEQ ID NO: 1663700 - RNA, 16 nt, Human
uguuaaaccaugggau

SEQ ID NO: 1663701 - RNA, 21 nt, Human
uguuaaaagaugaaaauauuu

SEQ ID NO: 1663702 - RNA, 20 nt, Human
uguuaguaugaggcauuugu

SEQ ID NO: 1663703 - RNA, 19 nt, Human
uguuaguaugaggcauuug

SEQ ID NO: 1663704 - RNA, 17 nt, Human
uguuaguaugaggcauu

SEQ ID NO: 1663705 - RNA, 14 nt, Human
uguuagugcaaauu

SEQ ID NO: 1663706 - RNA, 20 nt, Human
uguucagcuccagcucacca

SEQ ID NO: 1663707 - RNA, 21 nt, Human
uguucagcuccagcucaccag

SEQ ID NO: 1663708 - RNA, 22 nt, Human
uguucagcuccagcucaccagc

SEQ ID NO: 1663709 - RNA, 17 nt, Human
uguucauaaauaaaguu

SEQ ID NO: 1663710 - RNA, 18 nt, Human
uguggacacagcucuucu

SEQ ID NO: 1663711 - RNA, 13 nt, Human
uguggacacagcu

SEQ ID NO: 1663712 - RNA, 19 nt, Human
uguggacacagcucuucuc

SEQ ID NO: 1663713 - RNA, 10 nt, Human
uguggcucac

SEQ ID NO: 1663714 - RNA, 23 nt, Human
uguggcgcagcauauucaggaag

SEQ ID NO: 1663715 - RNA, 20 nt, Human
ugugggcgugagaccugccc

SEQ ID NO: 1663716 - RNA, 21 nt, Human
ugugggcgugagaccugcccc

SEQ ID NO: 1663717 - RNA, 22 nt, Human
ugugggcgugagaccugccccu

SEQ ID NO: 1663718 - RNA, 22 nt, Human
ugugggcuaguugggcuuccuc

SEQ ID NO: 1663719 - RNA, 16 nt, Human
uguguagggcgggagg

SEQ ID NO: 1663720 - RNA, 12 nt, Human
uguguagggcgg

SEQ ID NO: 1663721 - RNA, 23 nt, Human
ugugcauuuggugguuucagaaa

SEQ ID NO: 1663722 - RNA, 23 nt, Human
ugugcauuaucuagauacuguau

SEQ ID NO: 1663723 - RNA, 21 nt, Human
ugugcauuaucuagauacugu

SEQ ID NO: 1663724 - RNA, 20 nt, Human
ugugcauuaucuagauacug

SEQ ID NO: 1663725 - RNA, 16 nt, Human
ugugcacaugcacgug

SEQ ID NO: 1663726 - RNA, 14 nt, Human
ugugcacguacaca

SEQ ID NO: 1663727 - RNA, 19 nt, Human
ugugcauuaucuagauacu

SEQ ID NO: 1663728 - RNA, 16 nt, Human
ugugcauuaucuagau

SEQ ID NO: 1663729 - RNA, 14 nt, Human
ugugcauuaucuag

SEQ ID NO: 1663730 - RNA, 14 nt, Human
ugugcuuguuaacu

SEQ ID NO: 1663731 - RNA, 20 nt, Human
ugugcucaggagcccuggga

SEQ ID NO: 1663732 - RNA, 17 nt, Human
ugugcucaggagcccug

SEQ ID NO: 1663733 - RNA, 15 nt, Human
ugugcucaggagccc

SEQ ID NO: 1663734 - RNA, 16 nt, Human
ugugcucaggagcccu

SEQ ID NO: 1663735 - RNA, 14 nt, Human
ugugcgccuacagg

SEQ ID NO: 1663736 - RNA, 19 nt, Human
ugugcgccuacaggaguga

SEQ ID NO: 1663737 - RNA, 19 nt, Human
ugugcuaguaauuggaaag

SEQ ID NO: 1663738 - RNA, 17 nt, Human
ugugaaaaugugugugu

SEQ ID NO: 1663739 - RNA, 16 nt, Human
ugugaaaaugugugug

SEQ ID NO: 1663740 - RNA, 16 nt, Human
ugucuuuuuucacuac

SEQ ID NO: 1663741 - RNA, 23 nt, Human
ugugaaaagaaaaaugagccugg

SEQ ID NO: 1663742 - RNA, 23 nt, Human
ugucuuuucuugcaugaggcuag

SEQ ID NO: 1663743 - RNA, 17 nt, Human
ugucuuuggacccugag

SEQ ID NO: 1663744 - RNA, 14 nt, Human
ugucuuuggacccu

SEQ ID NO: 1663745 - RNA, 16 nt, Human
ugucuuuggacccuga

SEQ ID NO: 1663746 - RNA, 21 nt, Human
ugucuuuucuugcaugaggcu

SEQ ID NO: 1663747 - RNA, 19 nt, Human
ugucugaagucacugcaca

SEQ ID NO: 1663748 - RNA, 20 nt, Human
ugucugaagucacugcacag

SEQ ID NO: 1663749 - RNA, 17 nt, Human
ugucugaagucacugca

SEQ ID NO: 1663750 - RNA, 18 nt, Human
ugucugaagucacugcac

SEQ ID NO: 1663751 - RNA, 16 nt, Human
ugucugaagucacugc

SEQ ID NO: 1663752 - RNA, 16 nt, Human
ugugauauaagugugu

SEQ ID NO: 1663753 - RNA, 17 nt, Human
ugugagucaccaagccc

SEQ ID NO: 1663754 - RNA, 19 nt, Human
ugugagucaccaagcccag

SEQ ID NO: 1663755 - RNA, 21 nt, Human
ugugagucaccaagcccaguu

SEQ ID NO: 1663756 - RNA, 13 nt, Human
ugugaggaagccg

SEQ ID NO: 1663757 - RNA, 18 nt, Human
ugugaggaagccgcuggg

SEQ ID NO: 1663758 - RNA, 20 nt, Human
ugugaggaagccgcuggggc

SEQ ID NO: 1663759 - RNA, 13 nt, Human
ugucaccugaaga

SEQ ID NO: 1663760 - RNA, 16 nt, Human
ugucccaacuuguaaa

SEQ ID NO: 1663761 - RNA, 19 nt, Human
ugucauuugagcagggcuc

SEQ ID NO: 1663762 - RNA, 16 nt, Human
ugucauuugagcaggg

SEQ ID NO: 1663763 - RNA, 12 nt, Human
uguccuacucug

SEQ ID NO: 1663764 - RNA, 17 nt, Human
uguccuacucuguguca

SEQ ID NO: 1663765 - RNA, 16 nt, Human
uguccccgacccuugc

SEQ ID NO: 1663766 - RNA, 17 nt, Human
uguccccgacccuugcc

SEQ ID NO: 1663767 - RNA, 20 nt, Human
uguccuacccacccuccuuu

SEQ ID NO: 1663768 - RNA, 18 nt, Human
uguccccaccgcagacag

SEQ ID NO: 1663769 - RNA, 19 nt, Human
uguccccaccgcagacagg

SEQ ID NO: 1663770 - RNA, 22 nt, Human
uguccccaccgcagacaggacc

SEQ ID NO: 1663771 - RNA, 20 nt, Human
uguauuuauuuaguauuuau

SEQ ID NO: 1663772 - RNA, 13 nt, Human
ugucacaggcagg

SEQ ID NO: 1663773 - RNA, 12 nt, Human
ugucacaggcag

SEQ ID NO: 1663774 - RNA, 17 nt, Human
ugucacacacuuuggcu

SEQ ID NO: 1663775 - RNA, 22 nt, Human
uguauaaaagggacugagaaau

SEQ ID NO: 1663776 - RNA, 15 nt, Human
uguaugauucccagc

SEQ ID NO: 1663777 - RNA, 21 nt, Human
uguauugugcgcuaaacuuuu

SEQ ID NO: 1663778 - RNA, 22 nt, Human
uguauucucuccuguaccucuu

SEQ ID NO: 1663779 - RNA, 14 nt, Human
uguaaucacagcua

SEQ ID NO: 1663780 - RNA, 17 nt, Human
uggucacaggaaguaga

SEQ ID NO: 1663781 - RNA, 16 nt, Human
uguacaaggacagccc

SEQ ID NO: 1663782 - RNA, 20 nt, Human
uguacaaggacagccccucc

SEQ ID NO: 1663783 - RNA, 23 nt, Human
uguacaaggacagccccuccucc

SEQ ID NO: 1663784 - RNA, 17 nt, Human
uguaauuaaguacuaug

SEQ ID NO: 1663785 - RNA, 16 nt, Human
uguacagagcccacgc

SEQ ID NO: 1663786 - RNA, 17 nt, Human
uguacagagcccacgcc

SEQ ID NO: 1663787 - RNA, 18 nt, Human
uguacagagcccacgccc

SEQ ID NO: 1663788 - RNA, 21 nt, Human
uguacagagcccacgccccca

SEQ ID NO: 1663789 - RNA, 16 nt, Human
uguaccgcaaugugac

SEQ ID NO: 1663790 - RNA, 18 nt, Human
uguagccccucuccugga

SEQ ID NO: 1663791 - RNA, 22 nt, Human
uguaguguuggagaagaacuga

SEQ ID NO: 1663792 - RNA, 14 nt, Human
uguagcauccugga

SEQ ID NO: 1663793 - RNA, 16 nt, Human
uguagcauccuggaau

SEQ ID NO: 1663794 - RNA, 17 nt, Human
uguagcauccuggaaua

SEQ ID NO: 1663795 - RNA, 18 nt, Human
uguagcauccuggaauau

SEQ ID NO: 1663796 - RNA, 15 nt, Human
uguacgucugacagg

SEQ ID NO: 1663797 - RNA, 10 nt, Human
ugccaggcau

SEQ ID NO: 1663798 - RNA, 18 nt, Human
ugccagguuuuuggucug

SEQ ID NO: 1663799 - RNA, 19 nt, Human
ugccagguuuuuggucuga

SEQ ID NO: 1663800 - RNA, 22 nt, Human
ugccagguuuuuggucugaccc

SEQ ID NO: 1663801 - RNA, 20 nt, Human
ugccacccuggggagaaagu

SEQ ID NO: 1663802 - RNA, 22 nt, Human
ugccacuacggaauaguuggcu

SEQ ID NO: 1663803 - RNA, 19 nt, Human
ugccacccuggggagaaag

SEQ ID NO: 1663804 - RNA, 20 nt, Human
ugccacuaaauugacacuua

SEQ ID NO: 1663805 - RNA, 20 nt, Human
ugcauauuuauaaaaauaaa

SEQ ID NO: 1663806 - RNA, 21 nt, Human
ugcauauuuauaaaaauaaaa

SEQ ID NO: 1663807 - RNA, 18 nt, Human
ugccaaauauaaauaaaa

SEQ ID NO: 1663808 - RNA, 17 nt, Human
ugccaaauauaaauaaa

SEQ ID NO: 1663809 - RNA, 19 nt, Human
ugcaucaagaugugacaug

SEQ ID NO: 1663810 - RNA, 14 nt, Human
ugcaucaagaugug

SEQ ID NO: 1663811 - RNA, 22 nt, Human
ugccaaauauaaauaaaaauaa

SEQ ID NO: 1663812 - RNA, 19 nt, Human
ugccaaauauaaauaaaaa

SEQ ID NO: 1663813 - RNA, 13 nt, Human
ugccccucccuuc

SEQ ID NO: 1663814 - RNA, 17 nt, Human
ugccccuggcagccccu

SEQ ID NO: 1663815 - RNA, 15 nt, Human
ugccccagggcuccc

SEQ ID NO: 1663816 - RNA, 23 nt, Human
ugccccucaacucuccuccagag

SEQ ID NO: 1663817 - RNA, 14 nt, Human
ugcccacucccugc

SEQ ID NO: 1663818 - RNA, 15 nt, Human
ugcccacucccugca

SEQ ID NO: 1663819 - RNA, 16 nt, Human
ugcccacucccugcaa

SEQ ID NO: 1663820 - RNA, 11 nt, Human
ugcccaggcug

SEQ ID NO: 1663821 - RNA, 21 nt, Human
ugcccacucccugcaaccuga

SEQ ID NO: 1663822 - RNA, 13 nt, Human
ugcccaggcuggc

SEQ ID NO: 1663823 - RNA, 13 nt, Human
ugcccaccuggcc

SEQ ID NO: 1663824 - RNA, 14 nt, Human
ugcccaccuggccu

SEQ ID NO: 1663825 - RNA, 24 nt, Human
ugccagguuuuuggucugacccac

SEQ ID NO: 1663826 - RNA, 21 nt, Human
ugccauccagguucagcuugu

SEQ ID NO: 1663827 - RNA, 12 nt, Human
ugccaucccucc

SEQ ID NO: 1663828 - RNA, 11 nt, Human
ugccaucccuc

SEQ ID NO: 1663829 - RNA, 14 nt, Human
ugccaucccucccu

SEQ ID NO: 1663830 - RNA, 14 nt, Human
ugcacggugaaugg

SEQ ID NO: 1663831 - RNA, 18 nt, Human
ugcacggugaauggcuuu

SEQ ID NO: 1663832 - RNA, 19 nt, Human
ugcacggugaauggcuuug

SEQ ID NO: 1663833 - RNA, 20 nt, Human
ugaguccccuguuuguuucu

SEQ ID NO: 1663834 - RNA, 17 nt, Human
ugcaccgggccacagag

SEQ ID NO: 1663835 - RNA, 22 nt, Human
ugcaccgggccacagagaaagu

SEQ ID NO: 1663836 - RNA, 19 nt, Human
ugaguccccuguuuguuuc

SEQ ID NO: 1663837 - RNA, 23 nt, Human
ugcaccggcuggccuggccccuc

SEQ ID NO: 1663838 - RNA, 14 nt, Human
ugcaccgggccaca

SEQ ID NO: 1663839 - RNA, 15 nt, Human
ugcaccgggccacag

SEQ ID NO: 1663840 - RNA, 21 nt, Human
ugcagagcaggaaacaugacu

SEQ ID NO: 1663841 - RNA, 23 nt, Human
ugcagcaauaaagcagcguuucu

SEQ ID NO: 1663842 - RNA, 20 nt, Human
ugcagcaauaaagcagcguu

SEQ ID NO: 1663843 - RNA, 12 nt, Human
ugcacuuuguuc

SEQ ID NO: 1663844 - RNA, 14 nt, Human
ugcacuuuguucug

SEQ ID NO: 1663845 - RNA, 15 nt, Human
ugcaggcagccaggc

SEQ ID NO: 1663846 - RNA, 13 nt, Human
ugcaggcagccag

SEQ ID NO: 1663847 - RNA, 14 nt, Human
ugcaggcagccagg

SEQ ID NO: 1663848 - RNA, 16 nt, Human
ugcagugcuuccaagg

SEQ ID NO: 1663849 - RNA, 22 nt, Human
ugcagugguaugaucacggcuc

SEQ ID NO: 1663850 - RNA, 20 nt, Human
ugcaguggugcgaucugggu

SEQ ID NO: 1663851 - RNA, 15 nt, Human
ugcaguucugaagaa

SEQ ID NO: 1663852 - RNA, 16 nt, Human
ugcaguucugaagaag

SEQ ID NO: 1663853 - RNA, 17 nt, Human
ugcaguucugaagaaga

SEQ ID NO: 1663854 - RNA, 18 nt, Human
ugcaguucugaagaagau

SEQ ID NO: 1663855 - RNA, 15 nt, Human
ugcaguugccaguca

SEQ ID NO: 1663856 - RNA, 13 nt, Human
ugcaguugccagu

SEQ ID NO: 1663857 - RNA, 14 nt, Human
ugcaguugccaguc

SEQ ID NO: 1663858 - RNA, 19 nt, Human
ugcaguucugaagaagaug

SEQ ID NO: 1663859 - RNA, 22 nt, Human
ugcaguucugaagaagauggua

SEQ ID NO: 1663860 - RNA, 13 nt, Human
ugcugcuggcugg

SEQ ID NO: 1663861 - RNA, 23 nt, Human
ugcugcaguugccagucaccccg

SEQ ID NO: 1663862 - RNA, 18 nt, Human
ugcugcaguugccaguca

SEQ ID NO: 1663863 - RNA, 14 nt, Human
ugcugcauuuaaaa

SEQ ID NO: 1663864 - RNA, 18 nt, Human
ugcugauggugcaaugac

SEQ ID NO: 1663865 - RNA, 13 nt, Human
ugcugauggugca

SEQ ID NO: 1663866 - RNA, 15 nt, Human
ugcugauggugcaau

SEQ ID NO: 1663867 - RNA, 17 nt, Human
ugcugauggugcaauga

SEQ ID NO: 1663868 - RNA, 23 nt, Human
ugcugaaggaauaaauugcuccu

SEQ ID NO: 1663869 - RNA, 12 nt, Human
ugcugaaggcuc

SEQ ID NO: 1663870 - RNA, 13 nt, Human
ugcugaaggcucg

SEQ ID NO: 1663871 - RNA, 21 nt, Human
ugcugaaggcucgagcaugcc

SEQ ID NO: 1663872 - RNA, 22 nt, Human
ugcugacagacacaggcccggc

SEQ ID NO: 1663873 - RNA, 23 nt, Human
ugcugacagacacaggcccggcu

SEQ ID NO: 1663874 - RNA, 16 nt, Human
ugcucuccucuugcca

SEQ ID NO: 1663875 - RNA, 18 nt, Human
ugcucuccucuugccacu

SEQ ID NO: 1663876 - RNA, 21 nt, Human
ugcucuccucuugccacugcc

SEQ ID NO: 1663877 - RNA, 22 nt, Human
ugcucuccucuugccacugccu

SEQ ID NO: 1663878 - RNA, 18 nt, Human
ugcuccuuucuuguuuua

SEQ ID NO: 1663879 - RNA, 17 nt, Human
ugcuccucuccccagca

SEQ ID NO: 1663880 - RNA, 18 nt, Human
ugcuccucuccccagcaa

SEQ ID NO: 1663881 - RNA, 14 nt, Human
ugcuccucucccca

SEQ ID NO: 1663882 - RNA, 17 nt, Human
ugcucagagcaguguuu

SEQ ID NO: 1663883 - RNA, 15 nt, Human
ugcucacauaucugu

SEQ ID NO: 1663884 - RNA, 16 nt, Human
ugcucacauaucuguc

SEQ ID NO: 1663885 - RNA, 15 nt, Human
ugcuaagcauuccaa

SEQ ID NO: 1663886 - RNA, 19 nt, Human
ugcuaagcauuccaacuau

SEQ ID NO: 1663887 - RNA, 9 nt, Human
ugccucucu

SEQ ID NO: 1663888 - RNA, 17 nt, Human
ugccugaagucacacag

SEQ ID NO: 1663889 - RNA, 18 nt, Human
ugccccuggcagccccug

SEQ ID NO: 1663890 - RNA, 20 nt, Human
ugccucgaacuggcugcaaa

SEQ ID NO: 1663891 - RNA, 18 nt, Human
ugccucgaacuggcugca

SEQ ID NO: 1663892 - RNA, 19 nt, Human
ugccucgaacuggcugcaa

SEQ ID NO: 1663893 - RNA, 21 nt, Human
ugccugggaucccucauccuc

SEQ ID NO: 1663894 - RNA, 18 nt, Human
ugccugggcagaaggaag

SEQ ID NO: 1663895 - RNA, 14 nt, Human
ugccugugaacuga

SEQ ID NO: 1663896 - RNA, 14 nt, Human
ugccugguggcagc

SEQ ID NO: 1663897 - RNA, 15 nt, Human
ugccugguggcagcu

SEQ ID NO: 1663898 - RNA, 16 nt, Human
ugccugguggcagcug

SEQ ID NO: 1663899 - RNA, 18 nt, Human
ugccuguaaucacagcua

SEQ ID NO: 1663900 - RNA, 14 nt, Human
ugcgccuacaggag

SEQ ID NO: 1663901 - RNA, 16 nt, Human
ugcgccuacaggagug

SEQ ID NO: 1663902 - RNA, 22 nt, Human
ugcgccuacaggagugagcacu

SEQ ID NO: 1663903 - RNA, 15 nt, Human
ugcuaaaugugaaug

SEQ ID NO: 1663904 - RNA, 14 nt, Human
ugcgaucuggguuc

SEQ ID NO: 1663905 - RNA, 15 nt, Human
ugcgaucuggguuca

SEQ ID NO: 1663906 - RNA, 19 nt, Human
ugcgaucuggguucacugc

SEQ ID NO: 1663907 - RNA, 20 nt, Human
ugcgaucuggguucacugca

SEQ ID NO: 1663908 - RNA, 21 nt, Human
ugcgaucuggguucacugcaa

SEQ ID NO: 1663909 - RNA, 17 nt, Human
ugccugugaacugaacu

SEQ ID NO: 1663910 - RNA, 18 nt, Human
ugccugugaacugaacuc

SEQ ID NO: 1663911 - RNA, 21 nt, Human
ugccugugaacugaacucuga

SEQ ID NO: 1663912 - RNA, 15 nt, Human
ugccuucucaacucc

SEQ ID NO: 1663913 - RNA, 14 nt, Human
uggguuaguggaug

SEQ ID NO: 1663914 - RNA, 22 nt, Human
uggguucuacccaggugcuagg

SEQ ID NO: 1663915 - RNA, 15 nt, Human
uggguucuacccagg

SEQ ID NO: 1663916 - RNA, 16 nt, Human
uggguucuacccaggu

SEQ ID NO: 1663917 - RNA, 19 nt, Human
ugggguuuaucagaauucu

SEQ ID NO: 1663918 - RNA, 16 nt, Human
uggguaacuagggaag

SEQ ID NO: 1663919 - RNA, 23 nt, Human
ugguauuggcuagagguucaaag

SEQ ID NO: 1663920 - RNA, 18 nt, Human
ugguaugaucacggcuca

SEQ ID NO: 1663921 - RNA, 21 nt, Human
uggguuucuaaagcugccagc

SEQ ID NO: 1663922 - RNA, 17 nt, Human
uggguuucuaaagcugc

SEQ ID NO: 1663923 - RNA, 18 nt, Human
uggguuucuaaagcugcc

SEQ ID NO: 1663924 - RNA, 16 nt, Human
ugggcagaggaaagca

SEQ ID NO: 1663925 - RNA, 20 nt, Human
ugggcgugagaccugccccu

SEQ ID NO: 1663926 - RNA, 22 nt, Human
ugggcuaagugauccucccacc

SEQ ID NO: 1663927 - RNA, 16 nt, Human
ugggcuaguugggcuu

SEQ ID NO: 1663928 - RNA, 17 nt, Human
ugggcuggugucaccug

SEQ ID NO: 1663929 - RNA, 15 nt, Human
ugggcuucaguggca

SEQ ID NO: 1663930 - RNA, 17 nt, Human
ugggcuucaguggcagc

SEQ ID NO: 1663931 - RNA, 12 nt, Human
uggggauucuua

SEQ ID NO: 1663932 - RNA, 13 nt, Human
uggggauucuuaa

SEQ ID NO: 1663933 - RNA, 16 nt, Human
uggggauucuuaaagu

SEQ ID NO: 1663934 - RNA, 18 nt, Human
uggggauucuuaaaguug

SEQ ID NO: 1663935 - RNA, 20 nt, Human
uggggauucuuaaaguugaa

SEQ ID NO: 1663936 - RNA, 20 nt, Human
ugggggaucacagccucuga

SEQ ID NO: 1663937 - RNA, 21 nt, Human
ugggggaucacagccucugaa

SEQ ID NO: 1663938 - RNA, 15 nt, Human
ugggggugcauuuga

SEQ ID NO: 1663939 - RNA, 12 nt, Human
ugggggugcauu

SEQ ID NO: 1663940 - RNA, 19 nt, Human
ugggggcugggcagaggaa

SEQ ID NO: 1663941 - RNA, 17 nt, Human
ugggggcugggcagagg

SEQ ID NO: 1663942 - RNA, 18 nt, Human
ugggggcugggcagagga

SEQ ID NO: 1663943 - RNA, 15 nt, Human
ugggagugagcuggu

SEQ ID NO: 1663944 - RNA, 15 nt, Human
ugggauccuccaggu

SEQ ID NO: 1663945 - RNA, 17 nt, Human
ugggagcugccuguuca

SEQ ID NO: 1663946 - RNA, 21 nt, Human
ugggagcugccuguucagcuc

SEQ ID NO: 1663947 - RNA, 22 nt, Human
ugggagcugccuguucagcucc

SEQ ID NO: 1663948 - RNA, 17 nt, Human
ugggauuacagguguga

SEQ ID NO: 1663949 - RNA, 15 nt, Human
ugggcagaggaaagc

SEQ ID NO: 1663950 - RNA, 18 nt, Human
ugggauccuccaggugca

SEQ ID NO: 1663951 - RNA, 13 nt, Human
ugggauccuggag

SEQ ID NO: 1663952 - RNA, 18 nt, Human
ugggauuacaggcuccug

SEQ ID NO: 1663953 - RNA, 16 nt, Human
ugggauuacaggugug

SEQ ID NO: 1663954 - RNA, 12 nt, Human
ugggacacccug

SEQ ID NO: 1663955 - RNA, 15 nt, Human
uggcuuuugugcauu

SEQ ID NO: 1663956 - RNA, 13 nt, Human
ugggacacccugu

SEQ ID NO: 1663957 - RNA, 13 nt, Human
ugggagcaaaaga

SEQ ID NO: 1663958 - RNA, 12 nt, Human
ugggagcugccu

SEQ ID NO: 1663959 - RNA, 13 nt, Human
ugggagcugccug

SEQ ID NO: 1663960 - RNA, 14 nt, Human
ugggagcugccugu

SEQ ID NO: 1663961 - RNA, 21 nt, Human
uggcugggggccucagugcca

SEQ ID NO: 1663962 - RNA, 21 nt, Human
uggcugcuucaaggauccuga

SEQ ID NO: 1663963 - RNA, 16 nt, Human
uggcuuccuggcaaua

SEQ ID NO: 1663964 - RNA, 14 nt, Human
uggcuuuucugauc

SEQ ID NO: 1663965 - RNA, 17 nt, Human
uggcuuuucugauccag

SEQ ID NO: 1663966 - RNA, 18 nt, Human
uggcuuuucugauccagu

SEQ ID NO: 1663967 - RNA, 19 nt, Human
uggcuuuucugauccaguu

SEQ ID NO: 1663968 - RNA, 14 nt, Human
uggcuuuugugcau

SEQ ID NO: 1663969 - RNA, 21 nt, Human
uggcuugaguuuaaauuguaa

SEQ ID NO: 1663970 - RNA, 13 nt, Human
uggcagugggagc

SEQ ID NO: 1663971 - RNA, 19 nt, Human
uggcaggaguuggaagugu

SEQ ID NO: 1663972 - RNA, 13 nt, Human
uggcagcugcuuu

SEQ ID NO: 1663973 - RNA, 21 nt, Human
uggcacccggccccugcuggu

SEQ ID NO: 1663974 - RNA, 17 nt, Human
uggccacuccagacccc

SEQ ID NO: 1663975 - RNA, 20 nt, Human
uggccacuccagaccccugg

SEQ ID NO: 1663976 - RNA, 21 nt, Human
uggccagaugcaccagcccuu

SEQ ID NO: 1663977 - RNA, 24 nt, Human
uggauuuaacagaaauguacagca

SEQ ID NO: 1663978 - RNA, 20 nt, Human
uggauuuaacagaaauguac

SEQ ID NO: 1663979 - RNA, 15 nt, Human
uggacuccucugucc

SEQ ID NO: 1663980 - RNA, 15 nt, Human
uggacuccugcacac

SEQ ID NO: 1663981 - RNA, 20 nt, Human
uggaggaaggaaacccagcu

SEQ ID NO: 1663982 - RNA, 12 nt, Human
uggaggaaggaa

SEQ ID NO: 1663983 - RNA, 18 nt, Human
uggaggaaggaaacccag

SEQ ID NO: 1663984 - RNA, 11 nt, Human
uggagggaagc

SEQ ID NO: 1663985 - RNA, 20 nt, Human
uggaaaaauagccugccucu

SEQ ID NO: 1663986 - RNA, 13 nt, Human
ugcuuuaauauca

SEQ ID NO: 1663987 - RNA, 15 nt, Human
ugcuuuaauaucauc

SEQ ID NO: 1663988 - RNA, 18 nt, Human
ugcuuuaauaucaucagu

SEQ ID NO: 1663989 - RNA, 20 nt, Human
ugcuuuaauaucaucaguau

SEQ ID NO: 1663990 - RNA, 17 nt, Human
uggaaacagcucgacuu

SEQ ID NO: 1663991 - RNA, 17 nt, Human
uggaaacaagucaguca

SEQ ID NO: 1663992 - RNA, 21 nt, Human
uggaaagacuuuuccaacccu

SEQ ID NO: 1663993 - RNA, 22 nt, Human
uggaaacagcucgacuuuaaaa

SEQ ID NO: 1663994 - RNA, 23 nt, Human
uggaaacuucagcgguuuauaua

SEQ ID NO: 1663995 - RNA, 14 nt, Human
uggaaagaguacuc

SEQ ID NO: 1663996 - RNA, 20 nt, Human
uggaaagaguaggaagacuu

SEQ ID NO: 1663997 - RNA, 20 nt, Human
uggaacauaaaauacaaugu

SEQ ID NO: 1663998 - RNA, 21 nt, Human
uggaacauaaaauacaauguu

SEQ ID NO: 1663999 - RNA, 19 nt, Human
uggaacgcguugaaauugu

SEQ ID NO: 1664000 - RNA, 18 nt, Human
uggaacgcguugaaauug

SEQ ID NO: 1664001 - RNA, 14 nt, Human
uggaauaacaugua

SEQ ID NO: 1664002 - RNA, 15 nt, Human
uggaauaacauguaa

SEQ ID NO: 1664003 - RNA, 19 nt, Human
uggaauaacauguaauuaa

SEQ ID NO: 1664004 - RNA, 16 nt, Human
uggaauaucuccguca

SEQ ID NO: 1664005 - RNA, 16 nt, Human
uggaauauauaaccag

SEQ ID NO: 1664006 - RNA, 15 nt, Human
uggaauauauaacca

SEQ ID NO: 1664007 - RNA, 17 nt, Human
uggaauaaggagaauga

SEQ ID NO: 1664008 - RNA, 22 nt, Human
uggaauaauccuaaacauauga

SEQ ID NO: 1664009 - RNA, 18 nt, Human
uggacucaccucccccau

SEQ ID NO: 1664010 - RNA, 20 nt, Human
uggacucaccucccccaucu

SEQ ID NO: 1664011 - RNA, 13 nt, Human
uggacaugcacag

SEQ ID NO: 1664012 - RNA, 19 nt, Human
uggacaugcacagcuaaca

SEQ ID NO: 1664013 - RNA, 19 nt, Human
ucccuaccgagucucuucu

SEQ ID NO: 1664014 - RNA, 21 nt, Human
ucccuaccgagucucuucucc

SEQ ID NO: 1664015 - RNA, 22 nt, Human
ucccuaccgagucucuucucca

SEQ ID NO: 1664016 - RNA, 23 nt, Human
ucccuaccgagucucuucuccac

SEQ ID NO: 1664017 - RNA, 12 nt, Human
ucccaugcccug

SEQ ID NO: 1664018 - RNA, 17 nt, Human
ucccaugagccucagca

SEQ ID NO: 1664019 - RNA, 22 nt, Human
ucccaugagccucagcauccug

SEQ ID NO: 1664020 - RNA, 13 nt, Human
ucccucccuuggg

SEQ ID NO: 1664021 - RNA, 14 nt, Human
ucccucccuugggg

SEQ ID NO: 1664022 - RNA, 17 nt, Human
ucccuacuuccugugac

SEQ ID NO: 1664023 - RNA, 18 nt, Human
ucccucccuuccucuuuc

SEQ ID NO: 1664024 - RNA, 14 nt, Human
ucccugccaaugga

SEQ ID NO: 1664025 - RNA, 16 nt, Human
ucccugccaauggacu

SEQ ID NO: 1664026 - RNA, 20 nt, Human
ucccugcacuugcagacucu

SEQ ID NO: 1664027 - RNA, 17 nt, Human
ucccucuggggcuguuc

SEQ ID NO: 1664028 - RNA, 13 nt, Human
ucccucuggggcu

SEQ ID NO: 1664029 - RNA, 22 nt, Human
uccgaaagggacuuggaagcuc

SEQ ID NO: 1664030 - RNA, 17 nt, Human
ucccuucuuuuucuucu

SEQ ID NO: 1664031 - RNA, 21 nt, Human
uccgaaagggacuuggaagcu

SEQ ID NO: 1664032 - RNA, 21 nt, Human
uccgcuuucuacccagcgagc

SEQ ID NO: 1664033 - RNA, 18 nt, Human
ucccugccccucccuuca

SEQ ID NO: 1664034 - RNA, 19 nt, Human
ucccugccccucccuucaa

SEQ ID NO: 1664035 - RNA, 24 nt, Human
ucccuggccuuucauauuuuagcu

SEQ ID NO: 1664036 - RNA, 16 nt, Human
ucccuggccuuucaua

SEQ ID NO: 1664037 - RNA, 16 nt, Human
ucccugccccccagcc

SEQ ID NO: 1664038 - RNA, 14 nt, Human
ucccugccccuccc

SEQ ID NO: 1664039 - RNA, 16 nt, Human
ucccuucccaccucuc

SEQ ID NO: 1664040 - RNA, 17 nt, Human
ucccuucccaccucucu

SEQ ID NO: 1664041 - RNA, 21 nt, Human
ucccuucccacuggaggcaug

SEQ ID NO: 1664042 - RNA, 21 nt, Human
uccucuaggaggucucuaaga

SEQ ID NO: 1664043 - RNA, 13 nt, Human
uccuccuggacuc

SEQ ID NO: 1664044 - RNA, 21 nt, Human
uccuccuuuucacaguucucu

SEQ ID NO: 1664045 - RNA, 17 nt, Human
uccucugcuugccaucc

SEQ ID NO: 1664046 - RNA, 16 nt, Human
uccucugcuugccauc

SEQ ID NO: 1664047 - RNA, 15 nt, Human
uccucugcuugccau

SEQ ID NO: 1664048 - RNA, 14 nt, Human
uccucugcuugcca

SEQ ID NO: 1664049 - RNA, 18 nt, Human
uccucucaaccaccuuuc

SEQ ID NO: 1664050 - RNA, 20 nt, Human
uccucucaaccaccuuucag

SEQ ID NO: 1664051 - RNA, 21 nt, Human
uccucucaaccaccuuucaga

SEQ ID NO: 1664052 - RNA, 15 nt, Human
uccucuguacagagc

SEQ ID NO: 1664053 - RNA, 13 nt, Human
uccucuguacaga

SEQ ID NO: 1664054 - RNA, 15 nt, Human
uccucuggccugugu

SEQ ID NO: 1664055 - RNA, 19 nt, Human
uccucugcuugccaucccu

SEQ ID NO: 1664056 - RNA, 17 nt, Human
uccucuguccaggcacu

SEQ ID NO: 1664057 - RNA, 17 nt, Human
uccugagccagauuuca

SEQ ID NO: 1664058 - RNA, 23 nt, Human
uccucuguacagagcccacgccc

SEQ ID NO: 1664059 - RNA, 18 nt, Human
uccugagccagauuucac

SEQ ID NO: 1664060 - RNA, 19 nt, Human
uccugagccagauuucacu

SEQ ID NO: 1664061 - RNA, 22 nt, Human
uccucuguccaggcacugcugc

SEQ ID NO: 1664062 - RNA, 21 nt, Human
uccugagccagauuucacucu

SEQ ID NO: 1664063 - RNA, 15 nt, Human
uccugaggcuccacu

SEQ ID NO: 1664064 - RNA, 15 nt, Human
uccugaggcugggcu

SEQ ID NO: 1664065 - RNA, 16 nt, Human
uccugaggcugggcuc

SEQ ID NO: 1664066 - RNA, 17 nt, Human
uccugaggcugggcucc

SEQ ID NO: 1664067 - RNA, 19 nt, Human
uccugaggcugggcucccu

SEQ ID NO: 1664068 - RNA, 12 nt, Human
uccugaggcugg

SEQ ID NO: 1664069 - RNA, 16 nt, Human
uccugaggcuccacuu

SEQ ID NO: 1664070 - RNA, 17 nt, Human
uccugaggcuccacuug

SEQ ID NO: 1664071 - RNA, 22 nt, Human
uccuaguuccaccaucaagcca

SEQ ID NO: 1664072 - RNA, 21 nt, Human
uccuaguuccaccaucaagcc

SEQ ID NO: 1664073 - RNA, 16 nt, Human
uccuaagcuauucagu

SEQ ID NO: 1664074 - RNA, 18 nt, Human
uccuaagcuauucaguaa

SEQ ID NO: 1664075 - RNA, 14 nt, Human
uccuaguuccacca

SEQ ID NO: 1664076 - RNA, 17 nt, Human
uccuaguuccaccauca

SEQ ID NO: 1664077 - RNA, 12 nt, Human
uccuccucagau

SEQ ID NO: 1664078 - RNA, 14 nt, Human
uccuccaggugcac

SEQ ID NO: 1664079 - RNA, 18 nt, Human
uccuccaggugcacaagc

SEQ ID NO: 1664080 - RNA, 20 nt, Human
uccuccaggugcacaagcuc

SEQ ID NO: 1664081 - RNA, 22 nt, Human
uccuccaggugcacaagcucca

SEQ ID NO: 1664082 - RNA, 12 nt, Human
uccuccaggugc

SEQ ID NO: 1664083 - RNA, 13 nt, Human
uccuccaggugca

SEQ ID NO: 1664084 - RNA, 20 nt, Human
uccucaaaacuucagacaua

SEQ ID NO: 1664085 - RNA, 17 nt, Human
ucgcaggauucuuccuc

SEQ ID NO: 1664086 - RNA, 21 nt, Human
ucgcaggauucuuccucccuc

SEQ ID NO: 1664087 - RNA, 23 nt, Human
ucgcaggauucuuccucccuccc

SEQ ID NO: 1664088 - RNA, 22 nt, Human
uccuuuucgcaggauucuuccu

SEQ ID NO: 1664089 - RNA, 14 nt, Human
ucgcccagucugga

SEQ ID NO: 1664090 - RNA, 19 nt, Human
ucgcccagucuggaaugca

SEQ ID NO: 1664091 - RNA, 23 nt, Human
ucgcccagucuggaaugcagugg

SEQ ID NO: 1664092 - RNA, 18 nt, Human
ucggaaaacaugcuacac

SEQ ID NO: 1664093 - RNA, 15 nt, Human
ucggaaaacaugcua

SEQ ID NO: 1664094 - RNA, 15 nt, Human
ucggccuccauccug

SEQ ID NO: 1664095 - RNA, 16 nt, Human
ucggccuccauccuga

SEQ ID NO: 1664096 - RNA, 17 nt, Human
ucggccuccauccugag

SEQ ID NO: 1664097 - RNA, 15 nt, Human
ucgcuuuugauaauc

SEQ ID NO: 1664098 - RNA, 14 nt, Human
uccuuaucaaagga

SEQ ID NO: 1664099 - RNA, 15 nt, Human
uccuuaucaaaggac

SEQ ID NO: 1664100 - RNA, 17 nt, Human
uccuuaucaaaggacac

SEQ ID NO: 1664101 - RNA, 22 nt, Human
uccuugaaaacacuguucucug

SEQ ID NO: 1664102 - RNA, 23 nt, Human
uccuugaaaacacuguucucugc

SEQ ID NO: 1664103 - RNA, 21 nt, Human
uccuuaccagcagagcaccuu

SEQ ID NO: 1664104 - RNA, 22 nt, Human
uccuuggugucgggcaugacac

SEQ ID NO: 1664105 - RNA, 17 nt, Human
uccuuugugaggaagcc

SEQ ID NO: 1664106 - RNA, 18 nt, Human
uccuuugugaggaagccg

SEQ ID NO: 1664107 - RNA, 22 nt, Human
uccuuugugaggaagccgcugg

SEQ ID NO: 1664108 - RNA, 18 nt, Human
uccuuggugucgggcaug

SEQ ID NO: 1664109 - RNA, 21 nt, Human
uccuuggugucgggcaugaca

SEQ ID NO: 1664110 - RNA, 17 nt, Human
uccuugcaucaauuuuu

SEQ ID NO: 1664111 - RNA, 13 nt, Human
ucuauauuuucau

SEQ ID NO: 1664112 - RNA, 14 nt, Human
ucuauauuuucauu

SEQ ID NO: 1664113 - RNA, 13 nt, Human
ucuauauuuuaca

SEQ ID NO: 1664114 - RNA, 15 nt, Human
ucuagguaaauuaca

SEQ ID NO: 1664115 - RNA, 12 nt, Human
ucuagggaaaaa

SEQ ID NO: 1664116 - RNA, 19 nt, Human
ucuagggaaaaaccagcgu

SEQ ID NO: 1664117 - RNA, 18 nt, Human
ucuacucuagggaaaaac

SEQ ID NO: 1664118 - RNA, 20 nt, Human
ucuacucgaguuacagacaa

SEQ ID NO: 1664119 - RNA, 21 nt, Human
ucuacucgaguuacagacaaa

SEQ ID NO: 1664120 - RNA, 12 nt, Human
ucuacuaaaaau

SEQ ID NO: 1664121 - RNA, 14 nt, Human
ucuacuauuuaugu

SEQ ID NO: 1664122 - RNA, 15 nt, Human
ucuacuaaaaauaca

SEQ ID NO: 1664123 - RNA, 19 nt, Human
ucuacuaaaaauacaaaaa

SEQ ID NO: 1664124 - RNA, 18 nt, Human
ucucaaauuucuaaaucu

SEQ ID NO: 1664125 - RNA, 16 nt, Human
ucucacacaugagcau

SEQ ID NO: 1664126 - RNA, 23 nt, Human
ucucacacaugagcaucaggcca

SEQ ID NO: 1664127 - RNA, 20 nt, Human
ucucacugccaugccagcuu

SEQ ID NO: 1664128 - RNA, 21 nt, Human
ucucacacaugagcaucaggc

SEQ ID NO: 1664129 - RNA, 23 nt, Human
ucucacucugucgcccagucugg

SEQ ID NO: 1664130 - RNA, 15 nt, Human
ucuauauuuucauuc

SEQ ID NO: 1664131 - RNA, 16 nt, Human
ucuauauuuucauucu

SEQ ID NO: 1664132 - RNA, 19 nt, Human
ucuauauuuucauucuccu

SEQ ID NO: 1664133 - RNA, 18 nt, Human
ucuauauguuuaaaagua

SEQ ID NO: 1664134 - RNA, 16 nt, Human
ucucaaauuucuaaau

SEQ ID NO: 1664135 - RNA, 14 nt, Human
ucucaaauuucuaa

SEQ ID NO: 1664136 - RNA, 22 nt, Human
ucuaucuuugagcgcccacuag

SEQ ID NO: 1664137 - RNA, 13 nt, Human
ucucaaauuucua

SEQ ID NO: 1664138 - RNA, 17 nt, Human
ucucacuguugcccagg

SEQ ID NO: 1664139 - RNA, 14 nt, Human
ucucacuguugccc

SEQ ID NO: 1664140 - RNA, 15 nt, Human
ucucacuguugccca

SEQ ID NO: 1664141 - RNA, 16 nt, Human
ucucagauuuuauuau

SEQ ID NO: 1664142 - RNA, 17 nt, Human
ucucagauuuuauuaug

SEQ ID NO: 1664143 - RNA, 18 nt, Human
ucucagauuuuauuaugu

SEQ ID NO: 1664144 - RNA, 19 nt, Human
ucucagauuuuauuaugua

SEQ ID NO: 1664145 - RNA, 14 nt, Human
ucucagauuuuauu

SEQ ID NO: 1664146 - RNA, 15 nt, Human
ucucagauuuuauua

SEQ ID NO: 1664147 - RNA, 13 nt, Human
ucucagauuuuau

SEQ ID NO: 1664148 - RNA, 15 nt, Human
uccaagcaaauguga

SEQ ID NO: 1664149 - RNA, 17 nt, Human
uccaagcaaaugugaau

SEQ ID NO: 1664150 - RNA, 14 nt, Human
uccaagcaggacau

SEQ ID NO: 1664151 - RNA, 22 nt, Human
uccaagcaggacauggacaagg

SEQ ID NO: 1664152 - RNA, 19 nt, Human
uccaagaagcccaggaaag

SEQ ID NO: 1664153 - RNA, 20 nt, Human
uccaagaccuucuccuucac

SEQ ID NO: 1664154 - RNA, 14 nt, Human
uccaagaagcccag

SEQ ID NO: 1664155 - RNA, 15 nt, Human
uccaagaagcccagg

SEQ ID NO: 1664156 - RNA, 16 nt, Human
uccaagaagcccagga

SEQ ID NO: 1664157 - RNA, 21 nt, Human
uccacaagagcccaggccucc

SEQ ID NO: 1664158 - RNA, 20 nt, Human
uccacaagagcccaggccuc

SEQ ID NO: 1664159 - RNA, 22 nt, Human
uccagagaguggcuccucccgg

SEQ ID NO: 1664160 - RNA, 19 nt, Human
uccagagaguggcuccucc

SEQ ID NO: 1664161 - RNA, 19 nt, Human
uccacuuucuagccagagg

SEQ ID NO: 1664162 - RNA, 17 nt, Human
uccacuuuaucuugaau

SEQ ID NO: 1664163 - RNA, 14 nt, Human
uccacuuucuagcc

SEQ ID NO: 1664164 - RNA, 21 nt, Human
uccacuuagaaauugcauuuc

SEQ ID NO: 1664165 - RNA, 23 nt, Human
uccacuuagaaauugcauuuccu

SEQ ID NO: 1664166 - RNA, 15 nt, Human
uccacuuuaucuuga

SEQ ID NO: 1664167 - RNA, 22 nt, Human
uccacugugccaugugccaggu

SEQ ID NO: 1664168 - RNA, 21 nt, Human
uccacccugcucuccgaccag

SEQ ID NO: 1664169 - RNA, 14 nt, Human
uccacccugcucuc

SEQ ID NO: 1664170 - RNA, 15 nt, Human
uccagcuggccggga

SEQ ID NO: 1664171 - RNA, 21 nt, Human
uccagcuggccgggagccuga

SEQ ID NO: 1664172 - RNA, 22 nt, Human
uccagcuggccgggagccugau

SEQ ID NO: 1664173 - RNA, 19 nt, Human
uccagcuggguuggaaaac

SEQ ID NO: 1664174 - RNA, 22 nt, Human
uccagauuuuuuacagcugccu

SEQ ID NO: 1664175 - RNA, 19 nt, Human
uccagcaauucuccugccu

SEQ ID NO: 1664176 - RNA, 20 nt, Human
uccagcaauucuccugccuc

SEQ ID NO: 1664177 - RNA, 21 nt, Human
uccagcaauucuccugccuca

SEQ ID NO: 1664178 - RNA, 18 nt, Human
uccagcaauucuccugcc

SEQ ID NO: 1664179 - RNA, 17 nt, Human
ucccaggcauuccccag

SEQ ID NO: 1664180 - RNA, 18 nt, Human
ucccaggcauuccccagg

SEQ ID NO: 1664181 - RNA, 16 nt, Human
ucccaggauguacaag

SEQ ID NO: 1664182 - RNA, 19 nt, Human
ucccaggcugagccucagu

SEQ ID NO: 1664183 - RNA, 19 nt, Human
ucccaggcauuccccagga

SEQ ID NO: 1664184 - RNA, 15 nt, Human
ucccaugagccucag

SEQ ID NO: 1664185 - RNA, 16 nt, Human
ucccaugagccucagc

SEQ ID NO: 1664186 - RNA, 14 nt, Human
ucccaccucucuca

SEQ ID NO: 1664187 - RNA, 17 nt, Human
ucccaccucucucacuc

SEQ ID NO: 1664188 - RNA, 18 nt, Human
ucccaccucucucacucc

SEQ ID NO: 1664189 - RNA, 16 nt, Human
ucccaccucagccucc

SEQ ID NO: 1664190 - RNA, 18 nt, Human
ucccaccucagccucccg

SEQ ID NO: 1664191 - RNA, 20 nt, Human
ucccaccucucucacuccuu

SEQ ID NO: 1664192 - RNA, 19 nt, Human
ucccaccuuggcugcaggg

SEQ ID NO: 1664193 - RNA, 21 nt, Human
ucccaccuuggcugcagggag

SEQ ID NO: 1664194 - RNA, 14 nt, Human
ucccacucagucca

SEQ ID NO: 1664195 - RNA, 17 nt, Human
uccaugucgccucugca

SEQ ID NO: 1664196 - RNA, 18 nt, Human
uccaugucgccucugcau

SEQ ID NO: 1664197 - RNA, 19 nt, Human
uccaugucgccucugcauu

SEQ ID NO: 1664198 - RNA, 16 nt, Human
uccaugucgccucugc

SEQ ID NO: 1664199 - RNA, 17 nt, Human
ucccaacucaccccagc

SEQ ID NO: 1664200 - RNA, 18 nt, Human
ucccaacucaccccagcc

SEQ ID NO: 1664201 - RNA, 14 nt, Human
ucccaacuuguaaa

SEQ ID NO: 1664202 - RNA, 19 nt, Human
ucccaacucaccccagccc

SEQ ID NO: 1664203 - RNA, 21 nt, Human
ucccaacucaccccagcccca

SEQ ID NO: 1664204 - RNA, 20 nt, Human
uccauagagagcaagacgcu

SEQ ID NO: 1664205 - RNA, 23 nt, Human
uccauaaucuggacuccucuguc

SEQ ID NO: 1664206 - RNA, 17 nt, Human
uccauagagagcaagac

SEQ ID NO: 1664207 - RNA, 12 nt, Human
uccauacauuug

SEQ ID NO: 1664208 - RNA, 14 nt, Human
ucaucauccuaagc

SEQ ID NO: 1664209 - RNA, 20 nt, Human
ucaucaguauugaagcauuu

SEQ ID NO: 1664210 - RNA, 21 nt, Human
ucaucaguauugaagcauuuu

SEQ ID NO: 1664211 - RNA, 23 nt, Human
ucaucaguauugaagcauuuuau

SEQ ID NO: 1664212 - RNA, 24 nt, Human
ucauggacuucugccagcauaaua

SEQ ID NO: 1664213 - RNA, 15 nt, Human
ucaugaaagauucaa

SEQ ID NO: 1664214 - RNA, 21 nt, Human
ucauggaauuggagcucgugg

SEQ ID NO: 1664215 - RNA, 13 nt, Human
ucaugaaagauuc

SEQ ID NO: 1664216 - RNA, 19 nt, Human
ucauggaauuggagcucgu

SEQ ID NO: 1664217 - RNA, 14 nt, Human
ucagguggggcagc

SEQ ID NO: 1664218 - RNA, 18 nt, Human
ucaggugcugccauccag

SEQ ID NO: 1664219 - RNA, 20 nt, Human
ucaggugcugccauccaggu

SEQ ID NO: 1664220 - RNA, 15 nt, Human
ucagguggggcagcu

SEQ ID NO: 1664221 - RNA, 16 nt, Human
ucagguggggcagcuu

SEQ ID NO: 1664222 - RNA, 21 nt, Human
ucagguggggcagcuugaggg

SEQ ID NO: 1664223 - RNA, 17 nt, Human
ucagguggggcagcuug

SEQ ID NO: 1664224 - RNA, 21 nt, Human
ucagguggggucacucuggca

SEQ ID NO: 1664225 - RNA, 17 nt, Human
ucagguggggucacucu

SEQ ID NO: 1664226 - RNA, 20 nt, Human
ucagguggggucacucuggc

SEQ ID NO: 1664227 - RNA, 18 nt, Human
ucaguccccgugaaggag

SEQ ID NO: 1664228 - RNA, 15 nt, Human
ucaguccauagcaga

SEQ ID NO: 1664229 - RNA, 18 nt, Human
ucaguccaugaagaugua

SEQ ID NO: 1664230 - RNA, 16 nt, Human
ucaguuaagccuuugg

SEQ ID NO: 1664231 - RNA, 17 nt, Human
ucaguuaagccuuugga

SEQ ID NO: 1664232 - RNA, 17 nt, Human
ucagucugauucccaag

SEQ ID NO: 1664233 - RNA, 19 nt, Human
ucagucugauucccaagcu

SEQ ID NO: 1664234 - RNA, 18 nt, Human
ucagugugacugaucucu

SEQ ID NO: 1664235 - RNA, 14 nt, Human
ucagauacuggauu

SEQ ID NO: 1664236 - RNA, 15 nt, Human
ucagauacuggauug

SEQ ID NO: 1664237 - RNA, 16 nt, Human
ucagauacuggauugu

SEQ ID NO: 1664238 - RNA, 19 nt, Human
ucagauacuggauuguacu

SEQ ID NO: 1664239 - RNA, 20 nt, Human
ucagauacuggauuguacuu

SEQ ID NO: 1664240 - RNA, 17 nt, Human
ucagauaugauucaaau

SEQ ID NO: 1664241 - RNA, 16 nt, Human
ucagauaugauucaaa

SEQ ID NO: 1664242 - RNA, 18 nt, Human
ucagauaugauucaaaug

SEQ ID NO: 1664243 - RNA, 15 nt, Human
ucagaucucuaacuu

SEQ ID NO: 1664244 - RNA, 18 nt, Human
ucagcacgauuucuguuu

SEQ ID NO: 1664245 - RNA, 17 nt, Human
ucagcacgauuucuguu

SEQ ID NO: 1664246 - RNA, 16 nt, Human
ucagcacgauuucugu

SEQ ID NO: 1664247 - RNA, 15 nt, Human
ucagcacgauuucug

SEQ ID NO: 1664248 - RNA, 12 nt, Human
ucagccucccaa

SEQ ID NO: 1664249 - RNA, 13 nt, Human
ucagccucccaaa

SEQ ID NO: 1664250 - RNA, 15 nt, Human
ucagcauccuggcac

SEQ ID NO: 1664251 - RNA, 16 nt, Human
ucagcauccuggcacc

SEQ ID NO: 1664252 - RNA, 17 nt, Human
ucagcauccuggcaccc

SEQ ID NO: 1664253 - RNA, 18 nt, Human
ucagcauccuggcacccg

SEQ ID NO: 1664254 - RNA, 22 nt, Human
ucagccucccaaagugcuggga

SEQ ID NO: 1664255 - RNA, 12 nt, Human
ucagccucccga

SEQ ID NO: 1664256 - RNA, 20 nt, Human
ucagccucccgaauagcugg

SEQ ID NO: 1664257 - RNA, 16 nt, Human
ucagccugcuccagcu

SEQ ID NO: 1664258 - RNA, 18 nt, Human
ucagcuccagcucaccag

SEQ ID NO: 1664259 - RNA, 21 nt, Human
ucagcuccagcucaccagccc

SEQ ID NO: 1664260 - RNA, 22 nt, Human
ucagcuccagcucaccagcccc

SEQ ID NO: 1664261 - RNA, 22 nt, Human
ucagcuccccucggagaagagc

SEQ ID NO: 1664262 - RNA, 21 nt, Human
ucagcuccccucggagaagag

SEQ ID NO: 1664263 - RNA, 15 nt, Human
ucagcugcuacuacu

SEQ ID NO: 1664264 - RNA, 16 nt, Human
ucagcugcugaaacaa

SEQ ID NO: 1664265 - RNA, 22 nt, Human
ucuggacuccucuguccaggca

SEQ ID NO: 1664266 - RNA, 15 nt, Human
ucuggacuccucugu

SEQ ID NO: 1664267 - RNA, 16 nt, Human
ucuggacuccucuguc

SEQ ID NO: 1664268 - RNA, 18 nt, Human
ucuggacuccucugucca

SEQ ID NO: 1664269 - RNA, 14 nt, Human
ucuggaauuugaaa

SEQ ID NO: 1664270 - RNA, 14 nt, Human
ucuggaaugugaag

SEQ ID NO: 1664271 - RNA, 17 nt, Human
ucugcugcuggcugguu

SEQ ID NO: 1664272 - RNA, 14 nt, Human
ucugcugcuggcug

SEQ ID NO: 1664273 - RNA, 15 nt, Human
ucugcugcuggcugg

SEQ ID NO: 1664274 - RNA, 13 nt, Human
ucugcugaaggaa

SEQ ID NO: 1664275 - RNA, 17 nt, Human
ucugcugacagacacag

SEQ ID NO: 1664276 - RNA, 11 nt, Human
ucugcugcugg

SEQ ID NO: 1664277 - RNA, 13 nt, Human
ucugcugcuggcu

SEQ ID NO: 1664278 - RNA, 13 nt, Human
ucugccugcccag

SEQ ID NO: 1664279 - RNA, 17 nt, Human
ucugccugcccaggccc

SEQ ID NO: 1664280 - RNA, 18 nt, Human
ucugccugcccaggcccc

SEQ ID NO: 1664281 - RNA, 20 nt, Human
ucugccugcccaggccccug

SEQ ID NO: 1664282 - RNA, 12 nt, Human
ucuggagcccac

SEQ ID NO: 1664283 - RNA, 16 nt, Human
ucuggagcccacugua

SEQ ID NO: 1664284 - RNA, 22 nt, Human
ucuggagcccacuguacuugcu

SEQ ID NO: 1664285 - RNA, 16 nt, Human
ucuggugacuuuccuc

SEQ ID NO: 1664286 - RNA, 14 nt, Human
ucuguacagagccc

SEQ ID NO: 1664287 - RNA, 15 nt, Human
ucuguacagagccca

SEQ ID NO: 1664288 - RNA, 12 nt, Human
ucuguccuggga

SEQ ID NO: 1664289 - RNA, 17 nt, Human
ucugucgcccagucugg

SEQ ID NO: 1664290 - RNA, 13 nt, Human
ucugucuaggaau

SEQ ID NO: 1664291 - RNA, 21 nt, Human
ucuguccugggagugagcugg

SEQ ID NO: 1664292 - RNA, 14 nt, Human
ucugucucagucca

SEQ ID NO: 1664293 - RNA, 12 nt, Human
ucugcccacucc

SEQ ID NO: 1664294 - RNA, 22 nt, Human
ucugccauauucuguuggccag

SEQ ID NO: 1664295 - RNA, 23 nt, Human
ucugccauauucuguuggccagu

SEQ ID NO: 1664296 - RNA, 23 nt, Human
ucugccuaaggacuucuuuaauu

SEQ ID NO: 1664297 - RNA, 12 nt, Human
ucugccucccau

SEQ ID NO: 1664298 - RNA, 13 nt, Human
ucugccucccauc

SEQ ID NO: 1664299 - RNA, 15 nt, Human
ucugccucccaucac

SEQ ID NO: 1664300 - RNA, 20 nt, Human
ucugccuaaggacuucuuua

SEQ ID NO: 1664301 - RNA, 21 nt, Human
ucugccuaaggacuucuuuaa

SEQ ID NO: 1664302 - RNA, 16 nt, Human
ucugcccacucccugc

SEQ ID NO: 1664303 - RNA, 13 nt, Human
ucugcccacuccc

SEQ ID NO: 1664304 - RNA, 14 nt, Human
ucugcccacucccu

SEQ ID NO: 1664305 - RNA, 15 nt, Human
ucugccuccucuuca

SEQ ID NO: 1664306 - RNA, 15 nt, Human
ucugccucugacaca

SEQ ID NO: 1664307 - RNA, 18 nt, Human
ucugccucugacacacag

SEQ ID NO: 1664308 - RNA, 16 nt, Human
ucugccucccaucacc

SEQ ID NO: 1664309 - RNA, 17 nt, Human
ucugccucccaucaccc

SEQ ID NO: 1664310 - RNA, 20 nt, Human
ucugccucccaucacccgcu

SEQ ID NO: 1664311 - RNA, 21 nt, Human
ucugccucccaucacccgcua

SEQ ID NO: 1664312 - RNA, 23 nt, Human
ucugccucugacacacagcucug

SEQ ID NO: 1664313 - RNA, 21 nt, Human
ucugccucugacacacagcuc

SEQ ID NO: 1664314 - RNA, 22 nt, Human
ucugccucugacacacagcucu

SEQ ID NO: 1664315 - RNA, 19 nt, Human
ucugccugaagucacacag

SEQ ID NO: 1664316 - RNA, 20 nt, Human
ucugccugaagucacacagu

SEQ ID NO: 1664317 - RNA, 13 nt, Human
ucugcacuccccu

SEQ ID NO: 1664318 - RNA, 14 nt, Human
ucugcaaucuucuc

SEQ ID NO: 1664319 - RNA, 17 nt, Human
ucugcaaucuucucaga

SEQ ID NO: 1664320 - RNA, 23 nt, Human
ucugaggaauccagacccggcug

SEQ ID NO: 1664321 - RNA, 22 nt, Human
ucugaggaauccagacccggcu

SEQ ID NO: 1664322 - RNA, 18 nt, Human
ucugaggaauccagaccc

SEQ ID NO: 1664323 - RNA, 21 nt, Human
ucugaggaauccagacccggc

SEQ ID NO: 1664324 - RNA, 18 nt, Human
ucugagaggacuuuucuu

SEQ ID NO: 1664325 - RNA, 24 nt, Human
ucugagaucaaaacgguuuuacug

SEQ ID NO: 1664326 - RNA, 20 nt, Human
ucugacccaugcugcccugu

SEQ ID NO: 1664327 - RNA, 22 nt, Human
ucugacccaugcugcccuguga

SEQ ID NO: 1664328 - RNA, 23 nt, Human
ucugacccaugcugcccugugag

SEQ ID NO: 1664329 - RNA, 14 nt, Human
ucuuugcagacagg

SEQ ID NO: 1664330 - RNA, 17 nt, Human
ucuuugcagacaggcaa

SEQ ID NO: 1664331 - RNA, 23 nt, Human
ucuuugagugaagcugggagaac

SEQ ID NO: 1664332 - RNA, 13 nt, Human
ucuuugcagacag

SEQ ID NO: 1664333 - RNA, 16 nt, Human
ucuuuggacccugagg

SEQ ID NO: 1664334 - RNA, 14 nt, Human
ucuuuggacccuga

SEQ ID NO: 1664335 - RNA, 15 nt, Human
ucuuuggacccugag

SEQ ID NO: 1664336 - RNA, 13 nt, Human
ucuuuggacccug

SEQ ID NO: 1664337 - RNA, 17 nt, Human
ucuugucucagauuuua

SEQ ID NO: 1664338 - RNA, 14 nt, Human
ucuugucucagauu

SEQ ID NO: 1664339 - RNA, 15 nt, Human
ucuugucucagauuu

SEQ ID NO: 1664340 - RNA, 12 nt, Human
ucuugucucaga

SEQ ID NO: 1664341 - RNA, 23 nt, Human
ucuuuccaaaguacacuguuuca

SEQ ID NO: 1664342 - RNA, 13 nt, Human
ucuuguguguuua

SEQ ID NO: 1664343 - RNA, 13 nt, Human
ucuuucccucccu

SEQ ID NO: 1664344 - RNA, 23 nt, Human
ucuuucccucccuuccucuuucc

SEQ ID NO: 1664345 - RNA, 12 nt, Human
ucuuucccuccc

SEQ ID NO: 1664346 - RNA, 17 nt, Human
ucuuuccacagaagcuc

SEQ ID NO: 1664347 - RNA, 21 nt, Human
ugaaaacacauuuuucuuagg

SEQ ID NO: 1664348 - RNA, 17 nt, Human
ugaaaacacuguucucu

SEQ ID NO: 1664349 - RNA, 20 nt, Human
ugaaaacacuguucucugcc

SEQ ID NO: 1664350 - RNA, 21 nt, Human
ugaaaacacuguucucugccc

SEQ ID NO: 1664351 - RNA, 22 nt, Human
ugaaaacacuguucucugcccu

SEQ ID NO: 1664352 - RNA, 23 nt, Human
ugaaaacacuguucucugcccuc

SEQ ID NO: 1664353 - RNA, 18 nt, Human
ugaaaaccacauuggaga

SEQ ID NO: 1664354 - RNA, 19 nt, Human
ugaaaagaaaaaugagccu

SEQ ID NO: 1664355 - RNA, 20 nt, Human
ugaaaagaaaaaugagccug

SEQ ID NO: 1664356 - RNA, 22 nt, Human
ugaaaagaaaaaugagccuggc

SEQ ID NO: 1664357 - RNA, 20 nt, Human
ugaaaauuaggauuucauga

SEQ ID NO: 1664358 - RNA, 14 nt, Human
ugaaaauucagugg

SEQ ID NO: 1664359 - RNA, 12 nt, Human
ugaaaauuuuga

SEQ ID NO: 1664360 - RNA, 15 nt, Human
ugaaacacuuugcau

SEQ ID NO: 1664361 - RNA, 22 nt, Human
ucuucaguuaagccuuuggaaa

SEQ ID NO: 1664362 - RNA, 19 nt, Human
ucuucaguuaagccuuugg

SEQ ID NO: 1664363 - RNA, 20 nt, Human
ucuucaguuaagccuuugga

SEQ ID NO: 1664364 - RNA, 15 nt, Human
ucuucagaucucuaa

SEQ ID NO: 1664365 - RNA, 14 nt, Human
ucuucagaucucua

SEQ ID NO: 1664366 - RNA, 21 nt, Human
ucuucagagacuccugcaggc

SEQ ID NO: 1664367 - RNA, 14 nt, Human
ucuuauacauuuga

SEQ ID NO: 1664368 - RNA, 22 nt, Human
ucuuauccaacaucaacaucuu

SEQ ID NO: 1664369 - RNA, 22 nt, Human
ucugugucagguggggcagcuu

SEQ ID NO: 1664370 - RNA, 17 nt, Human
ucugugucagguggggc

SEQ ID NO: 1664371 - RNA, 20 nt, Human
ucugugucagguggggcagc

SEQ ID NO: 1664372 - RNA, 15 nt, Human
ucuuagauguauaua

SEQ ID NO: 1664373 - RNA, 22 nt, Human
ucuuaggguuaugauuaaguaa

SEQ ID NO: 1664374 - RNA, 20 nt, Human
ucuuagguuggcaaaaaggc

SEQ ID NO: 1664375 - RNA, 23 nt, Human
ucuuagguuggcaaaaaggcagg

SEQ ID NO: 1664376 - RNA, 14 nt, Human
ucuuauaauuuaaa

SEQ ID NO: 1664377 - RNA, 13 nt, Human
ucuuauaauuuaa

SEQ ID NO: 1664378 - RNA, 13 nt, Human
ucuugaagacuuu

SEQ ID NO: 1664379 - RNA, 22 nt, Human
ucuugaagacuuuucuuucagc

SEQ ID NO: 1664380 - RNA, 21 nt, Human
ucuugaaauauaggaacuuaa

SEQ ID NO: 1664381 - RNA, 20 nt, Human
ucuugaaauauaggaacuua

SEQ ID NO: 1664382 - RNA, 16 nt, Human
ucuucuuggucucagu

SEQ ID NO: 1664383 - RNA, 15 nt, Human
ucuugcucugcugac

SEQ ID NO: 1664384 - RNA, 23 nt, Human
ucuugcucugcugacagacacag

SEQ ID NO: 1664385 - RNA, 14 nt, Human
ucuuguauuaagaa

SEQ ID NO: 1664386 - RNA, 15 nt, Human
ucuuguauuaagaau

SEQ ID NO: 1664387 - RNA, 16 nt, Human
ucuugccacugccucu

SEQ ID NO: 1664388 - RNA, 17 nt, Human
ucuugccacugccucuu

SEQ ID NO: 1664389 - RNA, 14 nt, Human
ucuugcucugcuga

SEQ ID NO: 1664390 - RNA, 19 nt, Human
ucuugccaaauauaaauaa

SEQ ID NO: 1664391 - RNA, 23 nt, Human
ucuugcauggcaaggacugcagg

SEQ ID NO: 1664392 - RNA, 16 nt, Human
ugaggcucugcccuug

SEQ ID NO: 1664393 - RNA, 18 nt, Human
ugaggcucugcccuuggu

SEQ ID NO: 1664394 - RNA, 20 nt, Human
ugaggcguauguggcaaaau

SEQ ID NO: 1664395 - RNA, 15 nt, Human
ugaggcugggcuccc

SEQ ID NO: 1664396 - RNA, 16 nt, Human
ugaggcugggcucccu

SEQ ID NO: 1664397 - RNA, 20 nt, Human
ugagucccaggcugagccuc

SEQ ID NO: 1664398 - RNA, 21 nt, Human
ugagucccaggcugagccuca

SEQ ID NO: 1664399 - RNA, 21 nt, Human
ugaggcugggcucccuuccca

SEQ ID NO: 1664400 - RNA, 18 nt, Human
ugaggucagagccugcag

SEQ ID NO: 1664401 - RNA, 19 nt, Human
ugaggucagagccugcagu

SEQ ID NO: 1664402 - RNA, 23 nt, Human
ugagcuuaagaauuuugagcagg

SEQ ID NO: 1664403 - RNA, 13 nt, Human
ugaggaucagagu

SEQ ID NO: 1664404 - RNA, 17 nt, Human
ugaggaucagaguaauc

SEQ ID NO: 1664405 - RNA, 19 nt, Human
ugaggaucagaguaaucca

SEQ ID NO: 1664406 - RNA, 22 nt, Human
ugaggaugaaaaaauaacacug

SEQ ID NO: 1664407 - RNA, 23 nt, Human
ugagccgagaucacgccacugca

SEQ ID NO: 1664408 - RNA, 20 nt, Human
ugagcagggcucagcgggga

SEQ ID NO: 1664409 - RNA, 22 nt, Human
ugagcagggcucagcggggaca

SEQ ID NO: 1664410 - RNA, 23 nt, Human
ugagcagggcucagcggggacag

SEQ ID NO: 1664411 - RNA, 22 nt, Human
ugagccgagaucacgccacugc

SEQ ID NO: 1664412 - RNA, 20 nt, Human
ugagcucagcccuggugggc

SEQ ID NO: 1664413 - RNA, 11 nt, Human
ugagcucagcc

SEQ ID NO: 1664414 - RNA, 12 nt, Human
ugagcucagccc

SEQ ID NO: 1664415 - RNA, 11 nt, Human
ugagcucagga

SEQ ID NO: 1664416 - RNA, 19 nt, Human
ugagcucaggaguuugaga

SEQ ID NO: 1664417 - RNA, 12 nt, Human
ugacuuuggaua

SEQ ID NO: 1664418 - RNA, 13 nt, Human
ugacuuuggauaa

SEQ ID NO: 1664419 - RNA, 14 nt, Human
ugacuuuggauaau

SEQ ID NO: 1664420 - RNA, 15 nt, Human
ugacuuuggauaaua

SEQ ID NO: 1664421 - RNA, 16 nt, Human
ugacuuuggauaauaa

SEQ ID NO: 1664422 - RNA, 20 nt, Human
ugacuuuggauaauaaggaa

SEQ ID NO: 1664423 - RNA, 22 nt, Human
ugacuuuggauaauaaggaaaa

SEQ ID NO: 1664424 - RNA, 16 nt, Human
ugacuuuccucuuugg

SEQ ID NO: 1664425 - RNA, 21 nt, Human
ugacucuuucuauuguuucuu

SEQ ID NO: 1664426 - RNA, 14 nt, Human
ugaccauucuccac

SEQ ID NO: 1664427 - RNA, 13 nt, Human
ugaccauucucca

SEQ ID NO: 1664428 - RNA, 14 nt, Human
ugacucuuaagaag

SEQ ID NO: 1664429 - RNA, 15 nt, Human
ugacucuuaagaaga

SEQ ID NO: 1664430 - RNA, 16 nt, Human
ugacucuuaagaagac

SEQ ID NO: 1664431 - RNA, 13 nt, Human
ugacucuuaagaa

SEQ ID NO: 1664432 - RNA, 22 nt, Human
ugacuuuucuguccgagcuuug

SEQ ID NO: 1664433 - RNA, 15 nt, Human
ugagaaauaaaguuu

SEQ ID NO: 1664434 - RNA, 15 nt, Human
ugagaaagacuauuc

SEQ ID NO: 1664435 - RNA, 13 nt, Human
ugagaccugcccc

SEQ ID NO: 1664436 - RNA, 14 nt, Human
ugagaccugccccu

SEQ ID NO: 1664437 - RNA, 15 nt, Human
ugagaccugccccuc

SEQ ID NO: 1664438 - RNA, 22 nt, Human
ugagaccugccccuccucucug

SEQ ID NO: 1664439 - RNA, 12 nt, Human
ugagaccugccc

SEQ ID NO: 1664440 - RNA, 14 nt, Human
ugagaccaaccugg

SEQ ID NO: 1664441 - RNA, 19 nt, Human
ugagaggggaacagacugg

SEQ ID NO: 1664442 - RNA, 18 nt, Human
ugagaggggaacagacug

SEQ ID NO: 1664443 - RNA, 14 nt, Human
ugagaggggaacag

SEQ ID NO: 1664444 - RNA, 20 nt, Human
ugagcaggauuuuaaucuuu

SEQ ID NO: 1664445 - RNA, 15 nt, Human
ugagcaggauuuuaa

SEQ ID NO: 1664446 - RNA, 19 nt, Human
ugacauguguuggcagccu

SEQ ID NO: 1664447 - RNA, 21 nt, Human
ugaccagccuccaugcugccu

SEQ ID NO: 1664448 - RNA, 22 nt, Human
ugaccagccuccaugcugccuc

SEQ ID NO: 1664449 - RNA, 23 nt, Human
ugaccagccuccaugcugccucc

SEQ ID NO: 1664450 - RNA, 16 nt, Human
ugaccacugcagaaga

SEQ ID NO: 1664451 - RNA, 17 nt, Human
ugaccacugcagaagac

SEQ ID NO: 1664452 - RNA, 13 nt, Human
ugacauguuuuau

SEQ ID NO: 1664453 - RNA, 18 nt, Human
ugaccacugcagaagaca

SEQ ID NO: 1664454 - RNA, 15 nt, Human
ugacauauuuuugcu

SEQ ID NO: 1664455 - RNA, 13 nt, Human
ugacagaggcagc

SEQ ID NO: 1664456 - RNA, 13 nt, Human
ugacaucucugca

SEQ ID NO: 1664457 - RNA, 14 nt, Human
ugacaucucugcaa

SEQ ID NO: 1664458 - RNA, 23 nt, Human
ugacaucucugcaaucuucucag

SEQ ID NO: 1664459 - RNA, 22 nt, Human
ugacagagcaagugagacccug

SEQ ID NO: 1664460 - RNA, 23 nt, Human
ugacaucaacugcaucaagaugu

SEQ ID NO: 1664461 - RNA, 17 nt, Human
ugacagacacaggcccg

SEQ ID NO: 1664462 - RNA, 18 nt, Human
ugacagacacaggcccgg

SEQ ID NO: 1664463 - RNA, 20 nt, Human
ugacaaagguaaaucagacu

SEQ ID NO: 1664464 - RNA, 16 nt, Human
ugaauuuaaauagcuu

SEQ ID NO: 1664465 - RNA, 13 nt, Human
ugacaacacucau

SEQ ID NO: 1664466 - RNA, 18 nt, Human
ugacaacagacuucugaa

SEQ ID NO: 1664467 - RNA, 19 nt, Human
ugacaacagacuucugaaa

SEQ ID NO: 1664468 - RNA, 15 nt, Human
ugacaacagacuucu

SEQ ID NO: 1664469 - RNA, 23 nt, Human
ugacaacacucauugaccugagg

SEQ ID NO: 1664470 - RNA, 14 nt, Human
ugaauuaaguuuuu

SEQ ID NO: 1664471 - RNA, 13 nt, Human
ugaauuacauuug

SEQ ID NO: 1664472 - RNA, 21 nt, Human
ugaauuguaaggaaugauuaa

SEQ ID NO: 1664473 - RNA, 13 nt, Human
ugaauuguaagga

SEQ ID NO: 1664474 - RNA, 14 nt, Human
ugaauuacauuugu

SEQ ID NO: 1664475 - RNA, 14 nt, Human
ugacacacagcucu

SEQ ID NO: 1664476 - RNA, 15 nt, Human
ugacacacagcucug

SEQ ID NO: 1664477 - RNA, 14 nt, Human
ugacagacacaggc

SEQ ID NO: 1664478 - RNA, 16 nt, Human
ugacagacacaggccc

SEQ ID NO: 1664479 - RNA, 13 nt, Human
ugacagacacagg

SEQ ID NO: 1664480 - RNA, 23 nt, Human
ugacaaggauugcuacuguccua

SEQ ID NO: 1664481 - RNA, 20 nt, Human
ugaaggcuggguucugaucc

SEQ ID NO: 1664482 - RNA, 21 nt, Human
ugaaggcuggguucugauccu

SEQ ID NO: 1664483 - RNA, 14 nt, Human
ugaaugcauaaaau

SEQ ID NO: 1664484 - RNA, 15 nt, Human
ugaaugaauggcuaa

SEQ ID NO: 1664485 - RNA, 20 nt, Human
ugaaugaauggcuaagcaaa

SEQ ID NO: 1664486 - RNA, 16 nt, Human
ugaaucuuggugucua

SEQ ID NO: 1664487 - RNA, 16 nt, Human
ugaaacacuuugcaua

SEQ ID NO: 1664488 - RNA, 13 nt, Human
ugaaacauguuuc

SEQ ID NO: 1664489 - RNA, 13 nt, Human
ugaacuugaaauu

SEQ ID NO: 1664490 - RNA, 14 nt, Human
ugaacuugaaauuu

SEQ ID NO: 1664491 - RNA, 18 nt, Human
ugaacuugaaauuugaau

SEQ ID NO: 1664492 - RNA, 19 nt, Human
ugaagacucauucuucugu

SEQ ID NO: 1664493 - RNA, 20 nt, Human
ugaagacucauucuucugua

SEQ ID NO: 1664494 - RNA, 20 nt, Human
ugaagagguuuuaaagcuuc

SEQ ID NO: 1664495 - RNA, 21 nt, Human
ugaagagguuuuaaagcuucc

SEQ ID NO: 1664496 - RNA, 19 nt, Human
ugaagagguuuuaaagcuu

SEQ ID NO: 1664497 - RNA, 19 nt, Human
ugaaggccccgcccaggcu

SEQ ID NO: 1664498 - RNA, 20 nt, Human
ugaaggccccgcccaggcuu

SEQ ID NO: 1664499 - RNA, 21 nt, Human
ugaagcuuuuaugugaaacau

SEQ ID NO: 1664500 - RNA, 16 nt, Human
ugaagcuuuuauguga

SEQ ID NO: 1664501 - RNA, 18 nt, Human
ugaaggccccgcccaggc

SEQ ID NO: 1664502 - RNA, 12 nt, Human
uacaauuuuguu

SEQ ID NO: 1664503 - RNA, 15 nt, Human
uacaauuuuguuucu

SEQ ID NO: 1664504 - RNA, 16 nt, Human
uacaauuuuguuucug

SEQ ID NO: 1664505 - RNA, 17 nt, Human
uacaauuuuguuucugu

SEQ ID NO: 1664506 - RNA, 11 nt, Human
uacacacacac

SEQ ID NO: 1664507 - RNA, 21 nt, Human
uacacugugcugagucugaag

SEQ ID NO: 1664508 - RNA, 17 nt, Human
uacacacugcauguuug

SEQ ID NO: 1664509 - RNA, 15 nt, Human
uacacacugcauguu

SEQ ID NO: 1664510 - RNA, 17 nt, Human
uacacacucaaaucaag

SEQ ID NO: 1664511 - RNA, 16 nt, Human
uacacacucaaaucaa

SEQ ID NO: 1664512 - RNA, 15 nt, Human
uacaaaguauuaagc

SEQ ID NO: 1664513 - RNA, 16 nt, Human
uacaaaguauuaagca

SEQ ID NO: 1664514 - RNA, 18 nt, Human
uacaaaguauuaagcaua

SEQ ID NO: 1664515 - RNA, 19 nt, Human
uacaaaguauuaagcauau

SEQ ID NO: 1664516 - RNA, 13 nt, Human
uacaaaguauuaa

SEQ ID NO: 1664517 - RNA, 14 nt, Human
uacaaaguauuaag

SEQ ID NO: 1664518 - RNA, 12 nt, Human
uacaaaguauua

SEQ ID NO: 1664519 - RNA, 14 nt, Human
uacaaaguagaagu

SEQ ID NO: 1664520 - RNA, 18 nt, Human
uacaaaguagaagucuua

SEQ ID NO: 1664521 - RNA, 18 nt, Human
uaauuuugugaagcaaaa

SEQ ID NO: 1664522 - RNA, 12 nt, Human
uaauuuuuauau

SEQ ID NO: 1664523 - RNA, 16 nt, Human
uaauuuuuauauuuga

SEQ ID NO: 1664524 - RNA, 17 nt, Human
uaauuuuuauauuugaa

SEQ ID NO: 1664525 - RNA, 13 nt, Human
uaauuuugugaag

SEQ ID NO: 1664526 - RNA, 21 nt, Human
uacauggcuggagcuagaauu

SEQ ID NO: 1664527 - RNA, 14 nt, Human
uacauuuuuaagug

SEQ ID NO: 1664528 - RNA, 22 nt, Human
uacauuuuuaagugcugcauuu

SEQ ID NO: 1664529 - RNA, 19 nt, Human
uacauuuuuaagugcugca

SEQ ID NO: 1664530 - RNA, 14 nt, Human
uacauggaauaaca

SEQ ID NO: 1664531 - RNA, 18 nt, Human
uacauggaauaacaugua

SEQ ID NO: 1664532 - RNA, 19 nt, Human
uacauggaauaacauguaa

SEQ ID NO: 1664533 - RNA, 22 nt, Human
uacauggaauaacauguaauua

SEQ ID NO: 1664534 - RNA, 16 nt, Human
uacauaaacaaguccu

SEQ ID NO: 1664535 - RNA, 21 nt, Human
uacaguuuguuaguaugaggc

SEQ ID NO: 1664536 - RNA, 19 nt, Human
uacaguuuguuaguaugag

SEQ ID NO: 1664537 - RNA, 23 nt, Human
uacaugaaaacacauuuuucuua

SEQ ID NO: 1664538 - RNA, 19 nt, Human
uacaugaaaacacauuuuu

SEQ ID NO: 1664539 - RNA, 18 nt, Human
uacaugaaaacacauuuu

SEQ ID NO: 1664540 - RNA, 17 nt, Human
uacaugaaaacacauuu

SEQ ID NO: 1664541 - RNA, 16 nt, Human
uacaugaaaacacauu

SEQ ID NO: 1664542 - RNA, 16 nt, Human
uacauaagauaaaugu

SEQ ID NO: 1664543 - RNA, 17 nt, Human
uacauaagauaaaugug

SEQ ID NO: 1664544 - RNA, 16 nt, Human
uacagcuaaucagcau

SEQ ID NO: 1664545 - RNA, 18 nt, Human
uacagcuaaucagcauuc

SEQ ID NO: 1664546 - RNA, 22 nt, Human
uacacuguuucaaacuuuacua

SEQ ID NO: 1664547 - RNA, 16 nt, Human
uacacuuacacuuuau

SEQ ID NO: 1664548 - RNA, 20 nt, Human
uacacuguuucaaacuuuac

SEQ ID NO: 1664549 - RNA, 22 nt, Human
uacacugugcugagucugaagg

SEQ ID NO: 1664550 - RNA, 23 nt, Human
uacacugugcugagucugaaggc

SEQ ID NO: 1664551 - RNA, 20 nt, Human
uacagcuugaccgugaggcc

SEQ ID NO: 1664552 - RNA, 18 nt, Human
uacaggaagguagaaaua

SEQ ID NO: 1664553 - RNA, 13 nt, Human
uacaggaaguacu

SEQ ID NO: 1664554 - RNA, 14 nt, Human
uacagcugccugca

SEQ ID NO: 1664555 - RNA, 13 nt, Human
uacagcugccugc

SEQ ID NO: 1664556 - RNA, 18 nt, Human
uacaguuuguuaguauga

SEQ ID NO: 1664557 - RNA, 20 nt, Human
uacaguugaaaaacagcuga

SEQ ID NO: 1664558 - RNA, 21 nt, Human
uacagcuugaccgugaggcca

SEQ ID NO: 1664559 - RNA, 17 nt, Human
uacaguugaaaaacagc

SEQ ID NO: 1664560 - RNA, 19 nt, Human
uacaguugaaaaacagcug

SEQ ID NO: 1664561 - RNA, 14 nt, Human
uacaggaaguacug

SEQ ID NO: 1664562 - RNA, 15 nt, Human
uacaggaaguacugg

SEQ ID NO: 1664563 - RNA, 22 nt, Human
uacaggaaguacuggagaaaau

SEQ ID NO: 1664564 - RNA, 15 nt, Human
uacaggagugagcac

SEQ ID NO: 1664565 - RNA, 23 nt, Human
uacaguucggugagcuacaaaug

SEQ ID NO: 1664566 - RNA, 20 nt, Human
uacaggaugaugacuaugga

SEQ ID NO: 1664567 - RNA, 14 nt, Human
uacaggauuugaaa

SEQ ID NO: 1664568 - RNA, 19 nt, Human
uacugcccaggccugccug

SEQ ID NO: 1664569 - RNA, 20 nt, Human
uacugcccaggccugccugu

SEQ ID NO: 1664570 - RNA, 21 nt, Human
uacugcccaggccugccuguu

SEQ ID NO: 1664571 - RNA, 22 nt, Human
uacugcccaggccugccuguuc

SEQ ID NO: 1664572 - RNA, 14 nt, Human
uacugccuauuuua

SEQ ID NO: 1664573 - RNA, 21 nt, Human
uacugccuauuuuaauaaaca

SEQ ID NO: 1664574 - RNA, 16 nt, Human
uacucuacccucuuag

SEQ ID NO: 1664575 - RNA, 15 nt, Human
uacuccccuccuuga

SEQ ID NO: 1664576 - RNA, 12 nt, Human
uacucccaucug

SEQ ID NO: 1664577 - RNA, 12 nt, Human
uacuccucccag

SEQ ID NO: 1664578 - RNA, 22 nt, Human
uacucgaguuacagacaaagcg

SEQ ID NO: 1664579 - RNA, 18 nt, Human
uacucgaguuacagacaa

SEQ ID NO: 1664580 - RNA, 14 nt, Human
uacuacaguuuguu

SEQ ID NO: 1664581 - RNA, 13 nt, Human
uacuacaguuugu

SEQ ID NO: 1664582 - RNA, 22 nt, Human
uacuacaguccucccaucucac

SEQ ID NO: 1664583 - RNA, 21 nt, Human
uacugucuucaguaagccgug

SEQ ID NO: 1664584 - RNA, 16 nt, Human
uacuguccuacccacc

SEQ ID NO: 1664585 - RNA, 23 nt, Human
uacugucagcuccccucggagaa

SEQ ID NO: 1664586 - RNA, 13 nt, Human
uacuugcucuuga

SEQ ID NO: 1664587 - RNA, 14 nt, Human
uacuugcucuugau

SEQ ID NO: 1664588 - RNA, 18 nt, Human
uacuugcucuugaugccu

SEQ ID NO: 1664589 - RNA, 19 nt, Human
uacuugcucuugaugccug

SEQ ID NO: 1664590 - RNA, 20 nt, Human
uacuugcucuugaugccugg

SEQ ID NO: 1664591 - RNA, 13 nt, Human
uacuuguggacac

SEQ ID NO: 1664592 - RNA, 18 nt, Human
uaccucggugccuuccuc

SEQ ID NO: 1664593 - RNA, 21 nt, Human
uaccucuugagccuugaacuu

SEQ ID NO: 1664594 - RNA, 22 nt, Human
uaccuuuuuuagaguugauacu

SEQ ID NO: 1664595 - RNA, 19 nt, Human
uaccuuuuuuagaguugau

SEQ ID NO: 1664596 - RNA, 13 nt, Human
uaccuuuuuuaga

SEQ ID NO: 1664597 - RNA, 17 nt, Human
uaccuuuuuuauacaua

SEQ ID NO: 1664598 - RNA, 16 nt, Human
uaccuuuuuuauacau

SEQ ID NO: 1664599 - RNA, 13 nt, Human
uaccuuuuuuaua

SEQ ID NO: 1664600 - RNA, 17 nt, Human
uacuaaaauggacugug

SEQ ID NO: 1664601 - RNA, 15 nt, Human
uacuaaaauggacug

SEQ ID NO: 1664602 - RNA, 18 nt, Human
uacgaaaagaggggaaga

SEQ ID NO: 1664603 - RNA, 21 nt, Human
uacgaaaagaggggaagagac

SEQ ID NO: 1664604 - RNA, 14 nt, Human
uacuaaggaaucuu

SEQ ID NO: 1664605 - RNA, 21 nt, Human
uacuaauagacaauuuauuau

SEQ ID NO: 1664606 - RNA, 22 nt, Human
uacuaauaaaauuuaaaagucu

SEQ ID NO: 1664607 - RNA, 20 nt, Human
uacuaauagacaauuuauua

SEQ ID NO: 1664608 - RNA, 23 nt, Human
uacuaaaauggacuguggugacu

SEQ ID NO: 1664609 - RNA, 17 nt, Human
uacuaaccagcagaaau

SEQ ID NO: 1664610 - RNA, 15 nt, Human
uaccuacauacaauu

SEQ ID NO: 1664611 - RNA, 13 nt, Human
uaccuacauguau

SEQ ID NO: 1664612 - RNA, 23 nt, Human
uaccuacauguauuuguuugcau

SEQ ID NO: 1664613 - RNA, 16 nt, Human
uaccuaucaucuuaag

SEQ ID NO: 1664614 - RNA, 18 nt, Human
uaccgagucucuucucca

SEQ ID NO: 1664615 - RNA, 21 nt, Human
uaccgagucucuucuccacug

SEQ ID NO: 1664616 - RNA, 17 nt, Human
uaccgagucucuucucc

SEQ ID NO: 1664617 - RNA, 16 nt, Human
uacccagcgagcccug

SEQ ID NO: 1664618 - RNA, 22 nt, Human
uaccgagucucuucuccacugg

SEQ ID NO: 1664619 - RNA, 22 nt, Human
uaccuaacgaaguauccuucag

SEQ ID NO: 1664620 - RNA, 23 nt, Human
uacauuuuuaagugcugcauuua

SEQ ID NO: 1664621 - RNA, 22 nt, Human
uaccaaaaaucucaauauuuca

SEQ ID NO: 1664622 - RNA, 21 nt, Human
uagacuggugacugauucuuc

SEQ ID NO: 1664623 - RNA, 23 nt, Human
uagacuggugacugauucuucag

SEQ ID NO: 1664624 - RNA, 20 nt, Human
uagacuggugacugauucuu

SEQ ID NO: 1664625 - RNA, 11 nt, Human
uagaauucugu

SEQ ID NO: 1664626 - RNA, 13 nt, Human
uagaauucuguau

SEQ ID NO: 1664627 - RNA, 14 nt, Human
uagaauucuguaua

SEQ ID NO: 1664628 - RNA, 15 nt, Human
uagaauucuguauag

SEQ ID NO: 1664629 - RNA, 16 nt, Human
uagaauucuguauaga

SEQ ID NO: 1664630 - RNA, 21 nt, Human
uagaauucuguauagauuaga

SEQ ID NO: 1664631 - RNA, 20 nt, Human
uagacccacuggacucaccu

SEQ ID NO: 1664632 - RNA, 13 nt, Human
uagagaaggaccc

SEQ ID NO: 1664633 - RNA, 22 nt, Human
uagagaaggacccggaggggcc

SEQ ID NO: 1664634 - RNA, 11 nt, Human
uagagacaggg

SEQ ID NO: 1664635 - RNA, 15 nt, Human
uagagguucaaagau

SEQ ID NO: 1664636 - RNA, 14 nt, Human
uagagguucaaaga

SEQ ID NO: 1664637 - RNA, 12 nt, Human
uagagugggagc

SEQ ID NO: 1664638 - RNA, 17 nt, Human
uagaguugauacuacag

SEQ ID NO: 1664639 - RNA, 14 nt, Human
uagaguugauacua

SEQ ID NO: 1664640 - RNA, 13 nt, Human
uagagugucuuaa

SEQ ID NO: 1664641 - RNA, 14 nt, Human
uacuuguggacaca

SEQ ID NO: 1664642 - RNA, 23 nt, Human
uagaauaccacaggaaccacaag

SEQ ID NO: 1664643 - RNA, 15 nt, Human
uagaauuaacacaug

SEQ ID NO: 1664644 - RNA, 16 nt, Human
uagaauuaacacauga

SEQ ID NO: 1664645 - RNA, 23 nt, Human
uagaauuaguggcacuugcuuuu

SEQ ID NO: 1664646 - RNA, 18 nt, Human
uagaauuaacacaugauc

SEQ ID NO: 1664647 - RNA, 13 nt, Human
uagcauccuggaa

SEQ ID NO: 1664648 - RNA, 15 nt, Human
uagcauccuggaaua

SEQ ID NO: 1664649 - RNA, 16 nt, Human
uagcauccuggaauau

SEQ ID NO: 1664650 - RNA, 18 nt, Human
uagcauccuggaauaucu

SEQ ID NO: 1664651 - RNA, 19 nt, Human
uagcauacguacacauuuu

SEQ ID NO: 1664652 - RNA, 18 nt, Human
uagcauacguacacauuu

SEQ ID NO: 1664653 - RNA, 17 nt, Human
uagcauacguacacauu

SEQ ID NO: 1664654 - RNA, 16 nt, Human
uagcauacguacacau

SEQ ID NO: 1664655 - RNA, 11 nt, Human
uagcagggaaa

SEQ ID NO: 1664656 - RNA, 20 nt, Human
uagauuagagaguguugaaa

SEQ ID NO: 1664657 - RNA, 16 nt, Human
uagauuagaauucugu

SEQ ID NO: 1664658 - RNA, 17 nt, Human
uagauuagaauucugua

SEQ ID NO: 1664659 - RNA, 19 nt, Human
uagauuagaauucuguaua

SEQ ID NO: 1664660 - RNA, 20 nt, Human
uagauuagaauucuguauag

SEQ ID NO: 1664661 - RNA, 14 nt, Human
uagauuagaauucu

SEQ ID NO: 1664662 - RNA, 15 nt, Human
uagauuagaauucug

SEQ ID NO: 1664663 - RNA, 16 nt, Human
uagauacuguaucaug

SEQ ID NO: 1664664 - RNA, 14 nt, Human
uagauaggccaugg

SEQ ID NO: 1664665 - RNA, 18 nt, Human
uagccugugccucuggga

SEQ ID NO: 1664666 - RNA, 20 nt, Human
uagccugugccucugggacu

SEQ ID NO: 1664667 - RNA, 12 nt, Human
uagcucauucuc

SEQ ID NO: 1664668 - RNA, 20 nt, Human
uagcucaggugucccugcac

SEQ ID NO: 1664669 - RNA, 21 nt, Human
uagcucaggugucccugcacu

SEQ ID NO: 1664670 - RNA, 15 nt, Human
uagcugggacuacag

SEQ ID NO: 1664671 - RNA, 17 nt, Human
uagcugggacuacaggc

SEQ ID NO: 1664672 - RNA, 19 nt, Human
uagcugggacuacaggcac

SEQ ID NO: 1664673 - RNA, 16 nt, Human
uagccccucuccugga

SEQ ID NO: 1664674 - RNA, 16 nt, Human
uagccuaggugacaga

SEQ ID NO: 1664675 - RNA, 18 nt, Human
uauaaaccgaacugaugu

SEQ ID NO: 1664676 - RNA, 11 nt, Human
uauaaacuuua

SEQ ID NO: 1664677 - RNA, 14 nt, Human
uauaaacuuuaccu

SEQ ID NO: 1664678 - RNA, 13 nt, Human
uauaaacuuuacc

SEQ ID NO: 1664679 - RNA, 18 nt, Human
uauaaacuuuaccuuuuu

SEQ ID NO: 1664680 - RNA, 17 nt, Human
uauaaacuuuaccuuuu

SEQ ID NO: 1664681 - RNA, 16 nt, Human
uauaaacuuuaccuuu

SEQ ID NO: 1664682 - RNA, 15 nt, Human
uauaaacuuuaccuu

SEQ ID NO: 1664683 - RNA, 15 nt, Human
uaguuugauuaaauu

SEQ ID NO: 1664684 - RNA, 21 nt, Human
uaguuugauuaaauucuugca

SEQ ID NO: 1664685 - RNA, 16 nt, Human
uaguuugauuaaauuc

SEQ ID NO: 1664686 - RNA, 20 nt, Human
uaguuguuugauucagacag

SEQ ID NO: 1664687 - RNA, 21 nt, Human
uaguuguuugauucagacagc

SEQ ID NO: 1664688 - RNA, 22 nt, Human
uaguuguuugauucagacagcu

SEQ ID NO: 1664689 - RNA, 20 nt, Human
uaguggcuuaaaacaacacu

SEQ ID NO: 1664690 - RNA, 16 nt, Human
uaguaugguggcuggg

SEQ ID NO: 1664691 - RNA, 17 nt, Human
uaguauuguccaggucu

SEQ ID NO: 1664692 - RNA, 22 nt, Human
uagcuggucuuauuuguaaagc

SEQ ID NO: 1664693 - RNA, 11 nt, Human
uagggaaaaac

SEQ ID NO: 1664694 - RNA, 11 nt, Human
uaggugacaga

SEQ ID NO: 1664695 - RNA, 16 nt, Human
uaggugacagagugag

SEQ ID NO: 1664696 - RNA, 23 nt, Human
uaggugcuacaaaaacacagcaa

SEQ ID NO: 1664697 - RNA, 20 nt, Human
uaggugcuacaaaaacacag

SEQ ID NO: 1664698 - RNA, 22 nt, Human
uaggugcuacaaaaacacagca

SEQ ID NO: 1664699 - RNA, 18 nt, Human
uaguaugaggcauuuguu

SEQ ID NO: 1664700 - RNA, 17 nt, Human
uaguaugaggcauuugu

SEQ ID NO: 1664701 - RNA, 23 nt, Human
uaggugugacugaauuucuuuug

SEQ ID NO: 1664702 - RNA, 21 nt, Human
uaggugugacugaauuucuuu

SEQ ID NO: 1664703 - RNA, 19 nt, Human
uaggugugacugaauuucu

SEQ ID NO: 1664704 - RNA, 13 nt, Human
uagguguggggga

SEQ ID NO: 1664705 - RNA, 17 nt, Human
uaggugugggggaagca

SEQ ID NO: 1664706 - RNA, 16 nt, Human
uauauuuucauucucc

SEQ ID NO: 1664707 - RNA, 16 nt, Human
uauauuuuuuucugaa

SEQ ID NO: 1664708 - RNA, 19 nt, Human
uauauuuuuuucugaaauu

SEQ ID NO: 1664709 - RNA, 20 nt, Human
uauauuuuuuucugaaauuu

SEQ ID NO: 1664710 - RNA, 21 nt, Human
uauauuuuuuguuaaaugauu

SEQ ID NO: 1664711 - RNA, 20 nt, Human
uauauuugaaauauugacuu

SEQ ID NO: 1664712 - RNA, 14 nt, Human
uauaugcuucuguu

SEQ ID NO: 1664713 - RNA, 16 nt, Human
uauaugcuucuguuuu

SEQ ID NO: 1664714 - RNA, 20 nt, Human
uaucaggugcugccauccag

SEQ ID NO: 1664715 - RNA, 19 nt, Human
uaucaggugcugccaucca

SEQ ID NO: 1664716 - RNA, 14 nt, Human
uaucaaaagaaaga

SEQ ID NO: 1664717 - RNA, 14 nt, Human
uaucaucaguauug

SEQ ID NO: 1664718 - RNA, 15 nt, Human
uaucaucaguauuga

SEQ ID NO: 1664719 - RNA, 16 nt, Human
uaucaucaguauugaa

SEQ ID NO: 1664720 - RNA, 20 nt, Human
uauagaaccucuuugucuac

SEQ ID NO: 1664721 - RNA, 21 nt, Human
uauagaaccucuuugucuaca

SEQ ID NO: 1664722 - RNA, 17 nt, Human
uauauaacaaugcugua

SEQ ID NO: 1664723 - RNA, 19 nt, Human
uauauaacaaugcuguauu

SEQ ID NO: 1664724 - RNA, 23 nt, Human
uauaucugaggaauucuguauag

SEQ ID NO: 1664725 - RNA, 17 nt, Human
uaaucuggacuccucug

SEQ ID NO: 1664726 - RNA, 18 nt, Human
uaaucuggacuccucugu

SEQ ID NO: 1664727 - RNA, 15 nt, Human
uaaucuggacuccuc

SEQ ID NO: 1664728 - RNA, 19 nt, Human
uaaucuggacuccucuguc

SEQ ID NO: 1664729 - RNA, 20 nt, Human
uaaucuggacuccucugucc

SEQ ID NO: 1664730 - RNA, 21 nt, Human
uaaucuggacuccucugucca

SEQ ID NO: 1664731 - RNA, 22 nt, Human
uaaucuggacuccucuguccag

SEQ ID NO: 1664732 - RNA, 18 nt, Human
uaaucugggccagaauuu

SEQ ID NO: 1664733 - RNA, 23 nt, Human
uaaucugggccagaauuucaaac

SEQ ID NO: 1664734 - RNA, 13 nt, Human
uaaucuaaaugga

SEQ ID NO: 1664735 - RNA, 20 nt, Human
uaauccucuaggaggucucu

SEQ ID NO: 1664736 - RNA, 17 nt, Human
uaauauuaaagccaugu

SEQ ID NO: 1664737 - RNA, 20 nt, Human
uaauauuaaagccauguuua

SEQ ID NO: 1664738 - RNA, 21 nt, Human
uaauauuaaagccauguuuau

SEQ ID NO: 1664739 - RNA, 20 nt, Human
uaauauuaaggaagacaaug

SEQ ID NO: 1664740 - RNA, 18 nt, Human
uaauaugcacacauuuuu

SEQ ID NO: 1664741 - RNA, 17 nt, Human
uaauaugcacacauuuu

SEQ ID NO: 1664742 - RNA, 16 nt, Human
uaauaugcacacauuu

SEQ ID NO: 1664743 - RNA, 15 nt, Human
uaauaugcacacauu

SEQ ID NO: 1664744 - RNA, 16 nt, Human
uaauauuaaagccaug

SEQ ID NO: 1664745 - RNA, 19 nt, Human
uaauaugcacacauuuuuu

SEQ ID NO: 1664746 - RNA, 14 nt, Human
uaauaauguuucaa

SEQ ID NO: 1664747 - RNA, 23 nt, Human
uaauaucaucaguauugaagcau

SEQ ID NO: 1664748 - RNA, 15 nt, Human
uaauggggcggugag

SEQ ID NO: 1664749 - RNA, 23 nt, Human
uaaugcgugcauaccacuuuugu

SEQ ID NO: 1664750 - RNA, 22 nt, Human
uaaugcgugcauaccacuuuug

SEQ ID NO: 1664751 - RNA, 19 nt, Human
uaaugcgugcauaccacuu

SEQ ID NO: 1664752 - RNA, 17 nt, Human
uaaugauaacuggaaac

SEQ ID NO: 1664753 - RNA, 22 nt, Human
uaaugauaacuggaaacuucag

SEQ ID NO: 1664754 - RNA, 15 nt, Human
uaaugcgugcauacc

SEQ ID NO: 1664755 - RNA, 23 nt, Human
uaaugauaacuggaaacuucagc

SEQ ID NO: 1664756 - RNA, 21 nt, Human
uaauuaacauguuaaaccaug

SEQ ID NO: 1664757 - RNA, 14 nt, Human
uaauuaaguacuau

SEQ ID NO: 1664758 - RNA, 17 nt, Human
uaauuaaguacuaugua

SEQ ID NO: 1664759 - RNA, 20 nt, Human
uaauuaaguacuauguauca

SEQ ID NO: 1664760 - RNA, 22 nt, Human
uaauguuucaaacauauauaac

SEQ ID NO: 1664761 - RNA, 14 nt, Human
uaaggcaaucaugg

SEQ ID NO: 1664762 - RNA, 20 nt, Human
uaaggauuuuaugcuuuaaa

SEQ ID NO: 1664763 - RNA, 22 nt, Human
uaaggauuuuaugcuuuaaaca

SEQ ID NO: 1664764 - RNA, 14 nt, Human
uaagcuauucagua

SEQ ID NO: 1664765 - RNA, 12 nt, Human
uaaggauuuuau

SEQ ID NO: 1664766 - RNA, 13 nt, Human
uaaggauuuuaug

SEQ ID NO: 1664767 - RNA, 17 nt, Human
uaaggauuuuaugcuuu

SEQ ID NO: 1664768 - RNA, 19 nt, Human
uaaggauuuuaugcuuuaa

SEQ ID NO: 1664769 - RNA, 12 nt, Human
uaagaggcaggg

SEQ ID NO: 1664770 - RNA, 15 nt, Human
uaagaggcagggucu

SEQ ID NO: 1664771 - RNA, 17 nt, Human
uaaggguaucuggugac

SEQ ID NO: 1664772 - RNA, 15 nt, Human
uaaggugugcucuga

SEQ ID NO: 1664773 - RNA, 20 nt, Human
uaagguggguacgggagggu

SEQ ID NO: 1664774 - RNA, 22 nt, Human
uaagugauugcugguuuuaguu

SEQ ID NO: 1664775 - RNA, 12 nt, Human
uaagugagagag

SEQ ID NO: 1664776 - RNA, 23 nt, Human
uaagugaggaugaaaaaauaaca

SEQ ID NO: 1664777 - RNA, 14 nt, Human
uaagugcugcauuu

SEQ ID NO: 1664778 - RNA, 13 nt, Human
uaagugaaauaag

SEQ ID NO: 1664779 - RNA, 13 nt, Human
uaagucuguuuua

SEQ ID NO: 1664780 - RNA, 16 nt, Human
uaagucuguuuuauga

SEQ ID NO: 1664781 - RNA, 19 nt, Human
uaagucuguuuuaugacuu

SEQ ID NO: 1664782 - RNA, 20 nt, Human
uaagucuguuuuaugacuuc

SEQ ID NO: 1664783 - RNA, 21 nt, Human
uaagucuguuuuaugacuuca

SEQ ID NO: 1664784 - RNA, 22 nt, Human
uaagugcugcauuuaaaagaua

SEQ ID NO: 1664785 - RNA, 18 nt, Human
uaagugcugcauuuaaaa

SEQ ID NO: 1664786 - RNA, 16 nt, Human
uaagugcugcauuuaa

SEQ ID NO: 1664787 - RNA, 15 nt, Human
uaagugcugcauuua

SEQ ID NO: 1664788 - RNA, 15 nt, Human
uaaguggugugugua

SEQ ID NO: 1664789 - RNA, 16 nt, Human
uaagugguguguguau

SEQ ID NO: 1664790 - RNA, 12 nt, Human
uaauaaagcugu

SEQ ID NO: 1664791 - RNA, 16 nt, Human
uaauaaggaaaaguuu

SEQ ID NO: 1664792 - RNA, 18 nt, Human
uaauaaggaaaaguuuaa

SEQ ID NO: 1664793 - RNA, 16 nt, Human
uaacuauguugauaaa

SEQ ID NO: 1664794 - RNA, 12 nt, Human
uaacagaaaugu

SEQ ID NO: 1664795 - RNA, 11 nt, Human
uaacagaaaug

SEQ ID NO: 1664796 - RNA, 13 nt, Human
uaaccagaucauu

SEQ ID NO: 1664797 - RNA, 16 nt, Human
uaaccacuucagcuga

SEQ ID NO: 1664798 - RNA, 23 nt, Human
uaaccaguguuguggauuuaaca

SEQ ID NO: 1664799 - RNA, 17 nt, Human
uaaccaggggccaugaa

SEQ ID NO: 1664800 - RNA, 14 nt, Human
uaagagagaaugag

SEQ ID NO: 1664801 - RNA, 23 nt, Human
uaagagagaaugagagacacacu

SEQ ID NO: 1664802 - RNA, 19 nt, Human
uaagaaccuuuugagugcc

SEQ ID NO: 1664803 - RNA, 13 nt, Human
uaagagagaauga

SEQ ID NO: 1664804 - RNA, 24 nt, Human
uaagaaagacuaucuaaauguuga

SEQ ID NO: 1664805 - RNA, 21 nt, Human
uaagaaaauaucacuugucaa

SEQ ID NO: 1664806 - RNA, 18 nt, Human
uaagaaaaaggaugcaca

SEQ ID NO: 1664807 - RNA, 16 nt, Human
uaagaaaaaggaugca

SEQ ID NO: 1664808 - RNA, 23 nt, Human
uaagaaaaaggaugcacagaguu

SEQ ID NO: 1664809 - RNA, 19 nt, Human
uaagaaaaaggaugcacag

SEQ ID NO: 1664810 - RNA, 15 nt, Human
uaacuggaaacuuca

SEQ ID NO: 1664811 - RNA, 21 nt, Human
uaacuguuauuuauaaucacu

SEQ ID NO: 1664812 - RNA, 16 nt, Human
uaacuguuauuuauaa

SEQ ID NO: 1664813 - RNA, 17 nt, Human
uaacuguuauuuauaau

SEQ ID NO: 1664814 - RNA, 16 nt, Human
uaaaguugguaaaccu

SEQ ID NO: 1664815 - RNA, 17 nt, Human
uaaaguugguaaaccuu

SEQ ID NO: 1664816 - RNA, 16 nt, Human
uaaaugccaucaauaa

SEQ ID NO: 1664817 - RNA, 23 nt, Human
uaaaugccaucaauaaaaaauua

SEQ ID NO: 1664818 - RNA, 13 nt, Human
uaaaugcccagcc

SEQ ID NO: 1664819 - RNA, 17 nt, Human
uaaaugcugcuuuuucu

SEQ ID NO: 1664820 - RNA, 11 nt, Human
uaaaugcugcu

SEQ ID NO: 1664821 - RNA, 16 nt, Human
uaaauggaaccacucu

SEQ ID NO: 1664822 - RNA, 14 nt, Human
uaaaugcccagccc

SEQ ID NO: 1664823 - RNA, 15 nt, Human
uaaaugcccagcccc

SEQ ID NO: 1664824 - RNA, 16 nt, Human
uaaaugcccagccccu

SEQ ID NO: 1664825 - RNA, 17 nt, Human
uaaaugcccagccccuu

SEQ ID NO: 1664826 - RNA, 20 nt, Human
uaaaugucuaguuguaacac

SEQ ID NO: 1664827 - RNA, 22 nt, Human
uaaaugucucuuuaaugucaca

SEQ ID NO: 1664828 - RNA, 19 nt, Human
uaaaugggggugcauuuga

SEQ ID NO: 1664829 - RNA, 18 nt, Human
uaaaugggggugcauuug

SEQ ID NO: 1664830 - RNA, 14 nt, Human
uaaaugguuaaaag

SEQ ID NO: 1664831 - RNA, 17 nt, Human
uaaaugggggugcauuu

SEQ ID NO: 1664832 - RNA, 14 nt, Human
uaaaugggggugca

SEQ ID NO: 1664833 - RNA, 20 nt, Human
uaaauggcuuccuggcaaua

SEQ ID NO: 1664834 - RNA, 16 nt, Human
uaaauucuugcaaagu

SEQ ID NO: 1664835 - RNA, 22 nt, Human
uaaauucuugcaaaguaucccu

SEQ ID NO: 1664836 - RNA, 18 nt, Human
uaaauucuugcaaaguau

SEQ ID NO: 1664837 - RNA, 17 nt, Human
uaaauucuugcaaagua

SEQ ID NO: 1664838 - RNA, 16 nt, Human
uaaaugugccuucauu

SEQ ID NO: 1664839 - RNA, 11 nt, Human
uaaauuauuuu

SEQ ID NO: 1664840 - RNA, 16 nt, Human
uaaaugugcuuuuaaa

SEQ ID NO: 1664841 - RNA, 18 nt, Human
uaacaccaugauuaacca

SEQ ID NO: 1664842 - RNA, 13 nt, Human
uaaauucuuucau

SEQ ID NO: 1664843 - RNA, 20 nt, Human
uaaauugacacuuaaaaaug

SEQ ID NO: 1664844 - RNA, 22 nt, Human
uaaauuuaguauuuuguuucag

SEQ ID NO: 1664845 - RNA, 23 nt, Human
uaaauugacacuuaaaaaugguu

SEQ ID NO: 1664846 - RNA, 15 nt, Human
uaaacacucuugaaa

SEQ ID NO: 1664847 - RNA, 17 nt, Human
uaaacacucuugaaaaa

SEQ ID NO: 1664848 - RNA, 18 nt, Human
uaaacacucuugaaaaau

SEQ ID NO: 1664849 - RNA, 16 nt, Human
uaaaaucuugaaaaug

SEQ ID NO: 1664850 - RNA, 20 nt, Human
uaaacaagaccacguuucua

SEQ ID NO: 1664851 - RNA, 22 nt, Human
uaaacaagaccacguuucuaaa

SEQ ID NO: 1664852 - RNA, 21 nt, Human
uaaacaagaccacguuucuaa

SEQ ID NO: 1664853 - RNA, 13 nt, Human
uaaacuuaaucua

SEQ ID NO: 1664854 - RNA, 22 nt, Human
uaaacuugguuuuuaaaaaacu

SEQ ID NO: 1664855 - RNA, 19 nt, Human
uaaacauugguucuuguau

SEQ ID NO: 1664856 - RNA, 21 nt, Human
uaaacauugguucuuguauua

SEQ ID NO: 1664857 - RNA, 11 nt, Human
uaaagccaugu

SEQ ID NO: 1664858 - RNA, 13 nt, Human
uaaagccauguuu

SEQ ID NO: 1664859 - RNA, 15 nt, Human
uaaagccauguuuau

SEQ ID NO: 1664860 - RNA, 20 nt, Human
uaaagccauguuuauuacag

SEQ ID NO: 1664861 - RNA, 18 nt, Human
uaaagcaggcagaacuca

SEQ ID NO: 1664862 - RNA, 19 nt, Human
uaaagcagcguuucuauga

SEQ ID NO: 1664863 - RNA, 17 nt, Human
uaaagcagcguuucuau

SEQ ID NO: 1664864 - RNA, 16 nt, Human
uaaagcagcguuucua

SEQ ID NO: 1664865 - RNA, 12 nt, Human
uaaagaaaacug

SEQ ID NO: 1664866 - RNA, 14 nt, Human
uaaagcugaaaacu

SEQ ID NO: 1664867 - RNA, 20 nt, Human
uaaagccugaguuugcuuuc

SEQ ID NO: 1664868 - RNA, 15 nt, Human
uaaaggcuaccuuug

SEQ ID NO: 1664869 - RNA, 14 nt, Human
uaaaggaauuuaaa

SEQ ID NO: 1664870 - RNA, 17 nt, Human
uaaaggcuaccuuugua

SEQ ID NO: 1664871 - RNA, 14 nt, Human
uaaaguguuugaaa

SEQ ID NO: 1664872 - RNA, 12 nt, Human
uaaaaggagcca

SEQ ID NO: 1664873 - RNA, 21 nt, Human
uaaaagguaugcaaucaaauc

SEQ ID NO: 1664874 - RNA, 15 nt, Human
uaaaauccauacauu

SEQ ID NO: 1664875 - RNA, 17 nt, Human
uaaaauccauacauuug

SEQ ID NO: 1664876 - RNA, 18 nt, Human
uaaaaucauuucugcauc

SEQ ID NO: 1664877 - RNA, 22 nt, Human
uaaaaucauuucugcaucagcu

SEQ ID NO: 1664878 - RNA, 19 nt, Human
uaaaaggugaccaaugaug

SEQ ID NO: 1664879 - RNA, 12 nt, Human
uaaaaggugacc

SEQ ID NO: 1664880 - RNA, 10 nt, Human
uaaaaucauu

SEQ ID NO: 1664881 - RNA, 13 nt, Human
uaaaaucauuucu

SEQ ID NO: 1664882 - RNA, 21 nt, Human
uaaaagauacaguuacucaga

SEQ ID NO: 1664883 - RNA, 14 nt, Human
uaaaagauacaguu

SEQ ID NO: 1664884 - RNA, 19 nt, Human
uaaaagagguuuuucuuaa

SEQ ID NO: 1664885 - RNA, 21 nt, Human
uaaaagagguuuuucuuaaau

SEQ ID NO: 1664886 - RNA, 20 nt, Human
uaaaagauacaguuacucag

SEQ ID NO: 1664887 - RNA, 17 nt, Human
uaaaagauacaguuacu

SEQ ID NO: 1664888 - RNA, 13 nt, Human
uaaaaccacagca

SEQ ID NO: 1664889 - RNA, 18 nt, Human
uaaaagagguuuuucuua

SEQ ID NO: 1664890 - RNA, 19 nt, Human
uaaaacacuuccauaaucu

SEQ ID NO: 1664891 - RNA, 17 nt, Human
uaaaacacaacaucuuu

SEQ ID NO: 1664892 - RNA, 22 nt, Human
uaaaacacaacaucuuuuucua

SEQ ID NO: 1664893 - RNA, 23 nt, Human
uaaaacacaacaucuuuuucuac

SEQ ID NO: 1664894 - RNA, 15 nt, Human
uaaaacaacacucac

SEQ ID NO: 1664895 - RNA, 22 nt, Human
uaaaacaagcacuaaacaaaga

SEQ ID NO: 1664896 - RNA, 19 nt, Human
uaaaaaugguuuaaauggu

SEQ ID NO: 1664897 - RNA, 18 nt, Human
uaaaaaugguuuaaaugg

SEQ ID NO: 1664898 - RNA, 21 nt, Human
guuuuuaaggguuuguggaaa

SEQ ID NO: 1664899 - RNA, 21 nt, Human
uaaaaacaaagaaauuaugug

SEQ ID NO: 1664900 - RNA, 17 nt, Human
uaaaaacaaagaaauua

SEQ ID NO: 1664901 - RNA, 17 nt, Human
guuuuaaaaugagaaau

SEQ ID NO: 1664902 - RNA, 20 nt, Human
guuuucaaaauuguuacaaa

SEQ ID NO: 1664903 - RNA, 17 nt, Human
guuuucaaaauaaaaau

SEQ ID NO: 1664904 - RNA, 11 nt, Human
guuuucacucu

SEQ ID NO: 1664905 - RNA, 12 nt, Human
guuuucacucuu

SEQ ID NO: 1664906 - RNA, 15 nt, Human
guuuuaaaaugagaa

SEQ ID NO: 1664907 - RNA, 16 nt, Human
guuuuaaaaugagaaa

SEQ ID NO: 1664908 - RNA, 20 nt, Human
guuuguuucugaaagggacg

SEQ ID NO: 1664909 - RNA, 13 nt, Human
guuuuccugaaga

SEQ ID NO: 1664910 - RNA, 19 nt, Human
guuuuccaugaguccccug

SEQ ID NO: 1664911 - RNA, 20 nt, Human
guuuuccaugaguccccugu

SEQ ID NO: 1664912 - RNA, 16 nt, Human
guuuugguugcuuuaa

SEQ ID NO: 1664913 - RNA, 18 nt, Human
guuucuuuguaaugaaaa

SEQ ID NO: 1664914 - RNA, 19 nt, Human
guuucuuuguaaugaaaac

SEQ ID NO: 1664915 - RNA, 17 nt, Human
guuugagaucagccugg

SEQ ID NO: 1664916 - RNA, 23 nt, Human
guuugauuaaauucuugcaaagu

SEQ ID NO: 1664917 - RNA, 18 nt, Human
guuugagaucagccuggg

SEQ ID NO: 1664918 - RNA, 16 nt, Human
guuugauucagacagc

SEQ ID NO: 1664919 - RNA, 20 nt, Human
guuugauucagacagcugcc

SEQ ID NO: 1664920 - RNA, 21 nt, Human
guuugauucagacagcugccu

SEQ ID NO: 1664921 - RNA, 18 nt, Human
guuuguuucugaaaggga

SEQ ID NO: 1664922 - RNA, 15 nt, Human
guuuagauaauacac

SEQ ID NO: 1664923 - RNA, 14 nt, Human
guuuagauaauaca

SEQ ID NO: 1664924 - RNA, 18 nt, Human
guuguuugagaaauuaag

SEQ ID NO: 1664925 - RNA, 15 nt, Human
guuguuacauuuuua

SEQ ID NO: 1664926 - RNA, 14 nt, Human
guuguuacauuuuu

SEQ ID NO: 1664927 - RNA, 20 nt, Human
guuguuugauucagacagcu

SEQ ID NO: 1664928 - RNA, 20 nt, Human
guuuagcuggaaaaguaugu

SEQ ID NO: 1664929 - RNA, 21 nt, Human
guuuagcuggaaaaguauguu

SEQ ID NO: 1664930 - RNA, 19 nt, Human
guuuaggaacuacugagga

SEQ ID NO: 1664931 - RNA, 20 nt, Human
guuuaggauguugaaaaagu

SEQ ID NO: 1664932 - RNA, 20 nt, Human
guuuauauaagcuuguauuc

SEQ ID NO: 1664933 - RNA, 12 nt, Human
guugucagcuga

SEQ ID NO: 1664934 - RNA, 23 nt, Human
guuggcugggggccucagugcca

SEQ ID NO: 1664935 - RNA, 19 nt, Human
guuggcugggggccucagu

SEQ ID NO: 1664936 - RNA, 12 nt, Human
guuggcuggggg

SEQ ID NO: 1664937 - RNA, 20 nt, Human
guuggccccugcccggcugc

SEQ ID NO: 1664938 - RNA, 13 nt, Human
guuggccccugcc

SEQ ID NO: 1664939 - RNA, 14 nt, Human
guuggccccugccc

SEQ ID NO: 1664940 - RNA, 22 nt, Human
guuguggauuuaacagaaaugu

SEQ ID NO: 1664941 - RNA, 14 nt, Human
guugugguuaaucu

SEQ ID NO: 1664942 - RNA, 19 nt, Human
guugucugaagucacugca

SEQ ID NO: 1664943 - RNA, 22 nt, Human
guugucugaagucacugcacag

SEQ ID NO: 1664944 - RNA, 19 nt, Human
guugucugcaacucugaag

SEQ ID NO: 1664945 - RNA, 18 nt, Human
guuccuuccucugagccu

SEQ ID NO: 1664946 - RNA, 19 nt, Human
guuccuuccucugagccuu

SEQ ID NO: 1664947 - RNA, 17 nt, Human
guuccuuccucugagcc

SEQ ID NO: 1664948 - RNA, 15 nt, Human
guucugcacacagca

SEQ ID NO: 1664949 - RNA, 16 nt, Human
guucugcacacagcac

SEQ ID NO: 1664950 - RNA, 19 nt, Human
guucugauccuaguuccac

SEQ ID NO: 1664951 - RNA, 12 nt, Human
guucugaagaag

SEQ ID NO: 1664952 - RNA, 13 nt, Human
guucugaagaaga

SEQ ID NO: 1664953 - RNA, 14 nt, Human
guucugaagaagau

SEQ ID NO: 1664954 - RNA, 15 nt, Human
guucugaagaagaug

SEQ ID NO: 1664955 - RNA, 23 nt, Human
guucuggcagaguugaagacaga

SEQ ID NO: 1664956 - RNA, 12 nt, Human
guucuggcucuu

SEQ ID NO: 1664957 - RNA, 16 nt, Human
guucuggcucuuccag

SEQ ID NO: 1664958 - RNA, 20 nt, Human
guucuggcucuuccaggcug

SEQ ID NO: 1664959 - RNA, 11 nt, Human
guucugggaca

SEQ ID NO: 1664960 - RNA, 12 nt, Human
guucugggacac

SEQ ID NO: 1664961 - RNA, 14 nt, Human
guucugggacacag

SEQ ID NO: 1664962 - RNA, 15 nt, Human
guucugggacacagu

SEQ ID NO: 1664963 - RNA, 16 nt, Human
guucugggacacaguu

SEQ ID NO: 1664964 - RNA, 23 nt, Human
guucugggacacaguucaauucu

SEQ ID NO: 1664965 - RNA, 18 nt, Human
guucuuucacccuuuucu

SEQ ID NO: 1664966 - RNA, 16 nt, Human
guucuuucuuccucug

SEQ ID NO: 1664967 - RNA, 17 nt, Human
guucuuucuuccucugc

SEQ ID NO: 1664968 - RNA, 18 nt, Human
guucuuucuuccucugcu

SEQ ID NO: 1664969 - RNA, 19 nt, Human
guucuuucuuccucugcug

SEQ ID NO: 1664970 - RNA, 14 nt, Human
guucuuucuuccuc

SEQ ID NO: 1664971 - RNA, 15 nt, Human
guucuuucuuccucu

SEQ ID NO: 1664972 - RNA, 20 nt, Human
guucuuuccaaaguacacug

SEQ ID NO: 1664973 - RNA, 18 nt, Human
guucuuuccaaaguacac

SEQ ID NO: 1664974 - RNA, 14 nt, Human
guucuuuccaaagu

SEQ ID NO: 1664975 - RNA, 13 nt, Human
guucuuuccaaag

SEQ ID NO: 1664976 - RNA, 17 nt, Human
guugaaaaacagcugag

SEQ ID NO: 1664977 - RNA, 23 nt, Human
guugaaaagacuccaaagaaaug

SEQ ID NO: 1664978 - RNA, 17 nt, Human
guugaaaagacuccaaa

SEQ ID NO: 1664979 - RNA, 22 nt, Human
guugaaaagacuccaaagaaau

SEQ ID NO: 1664980 - RNA, 12 nt, Human
guugcccaggca

SEQ ID NO: 1664981 - RNA, 15 nt, Human
guugcccaggcaggu

SEQ ID NO: 1664982 - RNA, 14 nt, Human
guugcccaggcagg

SEQ ID NO: 1664983 - RNA, 13 nt, Human
guugccagucacc

SEQ ID NO: 1664984 - RNA, 14 nt, Human
guugccagucaccc

SEQ ID NO: 1664985 - RNA, 16 nt, Human
guugccagucaccccg

SEQ ID NO: 1664986 - RNA, 17 nt, Human
guugccagucaccccgg

SEQ ID NO: 1664987 - RNA, 18 nt, Human
guugccagucaccccggc

SEQ ID NO: 1664988 - RNA, 23 nt, Human
guugccagucaccccggccaccu

SEQ ID NO: 1664989 - RNA, 14 nt, Human
guuggccaggcugc

SEQ ID NO: 1664990 - RNA, 13 nt, Human
guuggccaggcug

SEQ ID NO: 1664991 - RNA, 15 nt, Human
guuggccaggcuggu

SEQ ID NO: 1664992 - RNA, 14 nt, Human
guuggccaggcugg

SEQ ID NO: 1664993 - RNA, 19 nt, Human
guuggccaggcugcucuug

SEQ ID NO: 1664994 - RNA, 18 nt, Human
guuggccaggcuggucuc

SEQ ID NO: 1664995 - RNA, 17 nt, Human
guuggccaggcuggucu

SEQ ID NO: 1664996 - RNA, 19 nt, Human
guuggccaggcuggucuca

SEQ ID NO: 1664997 - RNA, 14 nt, Human
guuggccaguguga

SEQ ID NO: 1664998 - RNA, 23 nt, Human
guuggccaaagccaaagcuaggc

SEQ ID NO: 1664999 - RNA, 14 nt, Human
guuggcaaaaaggc

SEQ ID NO: 1665000 - RNA, 18 nt, Human
guuggcaaaaaggcagga

SEQ ID NO: 1665001 - RNA, 16 nt, Human
guugcaacuuuguaua

SEQ ID NO: 1665002 - RNA, 14 nt, Human
guugcaacuuugua

SEQ ID NO: 1665003 - RNA, 15 nt, Human
guugcaggaccucag

SEQ ID NO: 1665004 - RNA, 21 nt, Human
guugaaacggaugauuucuau

SEQ ID NO: 1665005 - RNA, 22 nt, Human
guugaaacggaugauuucuaug

SEQ ID NO: 1665006 - RNA, 16 nt, Human
guugaaauuguaauua

SEQ ID NO: 1665007 - RNA, 20 nt, Human
guugaaauuguaauuauauc

SEQ ID NO: 1665008 - RNA, 15 nt, Human
guugaaauuguaauu

SEQ ID NO: 1665009 - RNA, 18 nt, Human
guugaagagguuuuaaag

SEQ ID NO: 1665010 - RNA, 16 nt, Human
guugaagacagagcua

SEQ ID NO: 1665011 - RNA, 14 nt, Human
guugaauuuauugg

SEQ ID NO: 1665012 - RNA, 13 nt, Human
guugaagccuuug

SEQ ID NO: 1665013 - RNA, 14 nt, Human
guugaagccuuugu

SEQ ID NO: 1665014 - RNA, 21 nt, Human
guugaauuuauuggcuuuucu

SEQ ID NO: 1665015 - RNA, 22 nt, Human
guugaauuuauuggcuuuucug

SEQ ID NO: 1665016 - RNA, 20 nt, Human
guugauggugguauguuuuc

SEQ ID NO: 1665017 - RNA, 21 nt, Human
guugauggugguauguuuuca

SEQ ID NO: 1665018 - RNA, 23 nt, Human
guuccagcaauucuccugccuca

SEQ ID NO: 1665019 - RNA, 20 nt, Human
guuccagcaauucuccugcc

SEQ ID NO: 1665020 - RNA, 21 nt, Human
guuccagcaauucuccugccu

SEQ ID NO: 1665021 - RNA, 17 nt, Human
guuccaccaucaagcca

SEQ ID NO: 1665022 - RNA, 20 nt, Human
guuccaccaucaagccacca

SEQ ID NO: 1665023 - RNA, 23 nt, Human
guuccuccccuccuccuggacuc

SEQ ID NO: 1665024 - RNA, 15 nt, Human
guuccugcaaugaag

SEQ ID NO: 1665025 - RNA, 22 nt, Human
guuccucauuagcauuuugcua

SEQ ID NO: 1665026 - RNA, 14 nt, Human
guuccuaauccucu

SEQ ID NO: 1665027 - RNA, 22 nt, Human
guucauggaacgcguugaaauu

SEQ ID NO: 1665028 - RNA, 23 nt, Human
guucauggaacgcguugaaauug

SEQ ID NO: 1665029 - RNA, 12 nt, Human
guucaugaaaga

SEQ ID NO: 1665030 - RNA, 18 nt, Human
guucaucuugaauuguaa

SEQ ID NO: 1665031 - RNA, 12 nt, Human
guucaucuugaa

SEQ ID NO: 1665032 - RNA, 13 nt, Human
guucaucuugaau

SEQ ID NO: 1665033 - RNA, 17 nt, Human
guucaucauccuaagcu

SEQ ID NO: 1665034 - RNA, 16 nt, Human
guucaucaaugaauga

SEQ ID NO: 1665035 - RNA, 24 nt, Human
guucacucuacuuagcaugucccu

SEQ ID NO: 1665036 - RNA, 19 nt, Human
guucacucuccauuuaaua

SEQ ID NO: 1665037 - RNA, 19 nt, Human
guucacugcaaccuccgcc

SEQ ID NO: 1665038 - RNA, 19 nt, Human
guucagagcugcccucucc

SEQ ID NO: 1665039 - RNA, 17 nt, Human
guucagagcugcccucu

SEQ ID NO: 1665040 - RNA, 16 nt, Human
guucagagcugcccuc

SEQ ID NO: 1665041 - RNA, 15 nt, Human
guucagagcugcccu

SEQ ID NO: 1665042 - RNA, 22 nt, Human
guucagagcugcccucuccugg

SEQ ID NO: 1665043 - RNA, 20 nt, Human
guucagagcugcccucuccu

SEQ ID NO: 1665044 - RNA, 23 nt, Human
guucagagcugcccucuccuggg

SEQ ID NO: 1665045 - RNA, 14 nt, Human
guucagagcugccc

SEQ ID NO: 1665046 - RNA, 13 nt, Human
guucagagcugcc

SEQ ID NO: 1665047 - RNA, 22 nt, Human
guuacuaaguuuuuauggcuuu

SEQ ID NO: 1665048 - RNA, 15 nt, Human
guuacucagaauucu

SEQ ID NO: 1665049 - RNA, 22 nt, Human
guuaguuucuccaagcaggaca

SEQ ID NO: 1665050 - RNA, 16 nt, Human
guuaguuucuccaagc

SEQ ID NO: 1665051 - RNA, 19 nt, Human
guuaguuucuccaagcagg

SEQ ID NO: 1665052 - RNA, 15 nt, Human
guuacagacaaagcg

SEQ ID NO: 1665053 - RNA, 17 nt, Human
guuacagacaaagcgug

SEQ ID NO: 1665054 - RNA, 18 nt, Human
guuacauaagauaaaugu

SEQ ID NO: 1665055 - RNA, 19 nt, Human
guuacauaagauaaaugug

SEQ ID NO: 1665056 - RNA, 16 nt, Human
guuacccaaauuaaga

SEQ ID NO: 1665057 - RNA, 23 nt, Human
guuaccauuuugggguacccacu

SEQ ID NO: 1665058 - RNA, 21 nt, Human
guuacauuuuuaagugcugca

SEQ ID NO: 1665059 - RNA, 23 nt, Human
guuaccucugccucagaaaacaa

SEQ ID NO: 1665060 - RNA, 19 nt, Human
guuaucugaagucagaucu

SEQ ID NO: 1665061 - RNA, 21 nt, Human
guuaugacuccagaauuuccc

SEQ ID NO: 1665062 - RNA, 10 nt, Human
guuauauaaa

SEQ ID NO: 1665063 - RNA, 12 nt, Human
guuauauaaaug

SEQ ID NO: 1665064 - RNA, 13 nt, Human
guuauauaaaugg

SEQ ID NO: 1665065 - RNA, 19 nt, Human
guuauuaaaaaucucaaau

SEQ ID NO: 1665066 - RNA, 19 nt, Human
guuauguaauaaccaaaug

SEQ ID NO: 1665067 - RNA, 19 nt, Human
guucaagcgauucuucugc

SEQ ID NO: 1665068 - RNA, 17 nt, Human
guuauuauauuuacaaa

SEQ ID NO: 1665069 - RNA, 23 nt, Human
guucaauucucauuugucacaca

SEQ ID NO: 1665070 - RNA, 16 nt, Human
guucaauucucauuug

SEQ ID NO: 1665071 - RNA, 20 nt, Human
guucaagcgauucuucugcu

SEQ ID NO: 1665072 - RNA, 23 nt, Human
guucaagugauucucaugccuca

SEQ ID NO: 1665073 - RNA, 16 nt, Human
gugugcucaggagccc

SEQ ID NO: 1665074 - RNA, 17 nt, Human
gugugcucaggagcccu

SEQ ID NO: 1665075 - RNA, 18 nt, Human
gugugcucaggagcccug

SEQ ID NO: 1665076 - RNA, 19 nt, Human
gugugcucaggagcccugg

SEQ ID NO: 1665077 - RNA, 12 nt, Human
gugugcucugau

SEQ ID NO: 1665078 - RNA, 15 nt, Human
gugugcucugaucau

SEQ ID NO: 1665079 - RNA, 22 nt, Human
gugugcucugaucauccacugu

SEQ ID NO: 1665080 - RNA, 15 nt, Human
guguguuucugaucu

SEQ ID NO: 1665081 - RNA, 12 nt, Human
guguguuuuaaa

SEQ ID NO: 1665082 - RNA, 21 nt, Human
guguggagaagcggcuggcag

SEQ ID NO: 1665083 - RNA, 13 nt, Human
guguggagaagcg

SEQ ID NO: 1665084 - RNA, 22 nt, Human
gugucucuugguccugcugcag

SEQ ID NO: 1665085 - RNA, 18 nt, Human
gugucucuugguccugcu

SEQ ID NO: 1665086 - RNA, 19 nt, Human
gugucucuugguccugcug

SEQ ID NO: 1665087 - RNA, 20 nt, Human
gugucucuugguccugcugc

SEQ ID NO: 1665088 - RNA, 21 nt, Human
gugucucuugguccugcugca

SEQ ID NO: 1665089 - RNA, 17 nt, Human
gugucucccuucauccu

SEQ ID NO: 1665090 - RNA, 14 nt, Human
gugucucuuggucc

SEQ ID NO: 1665091 - RNA, 15 nt, Human
gugucgggcaugaca

SEQ ID NO: 1665092 - RNA, 23 nt, Human
gugucccugcacuugcagacucu

SEQ ID NO: 1665093 - RNA, 14 nt, Human
guguccggucccug

SEQ ID NO: 1665094 - RNA, 13 nt, Human
guguucugugaua

SEQ ID NO: 1665095 - RNA, 18 nt, Human
guguuuuucauaaagcag

SEQ ID NO: 1665096 - RNA, 13 nt, Human
guguguuuuaaaa

SEQ ID NO: 1665097 - RNA, 16 nt, Human
guguguuuuaaaauga

SEQ ID NO: 1665098 - RNA, 19 nt, Human
guguguuuuaaaaugagaa

SEQ ID NO: 1665099 - RNA, 14 nt, Human
guguguuuuucaua

SEQ ID NO: 1665100 - RNA, 18 nt, Human
guguuaugacuccagaau

SEQ ID NO: 1665101 - RNA, 12 nt, Human
guguuacuaagu

SEQ ID NO: 1665102 - RNA, 14 nt, Human
guguuacuaaguuu

SEQ ID NO: 1665103 - RNA, 13 nt, Human
guuacagaagccc

SEQ ID NO: 1665104 - RNA, 13 nt, Human
guuacagacaaag

SEQ ID NO: 1665105 - RNA, 18 nt, Human
guuaacugagugccuuuu

SEQ ID NO: 1665106 - RNA, 15 nt, Human
guuacacuaaaaggu

SEQ ID NO: 1665107 - RNA, 16 nt, Human
guuacacuaaaaggug

SEQ ID NO: 1665108 - RNA, 21 nt, Human
guuaaaccaugggauaaaugc

SEQ ID NO: 1665109 - RNA, 18 nt, Human
guuaaaccaugggauaaa

SEQ ID NO: 1665110 - RNA, 20 nt, Human
guuaaaagagguuuuucuua

SEQ ID NO: 1665111 - RNA, 21 nt, Human
guuaaaagagguuuuucuuaa

SEQ ID NO: 1665112 - RNA, 22 nt, Human
guuaaaauaccagccaguaaau

SEQ ID NO: 1665113 - RNA, 20 nt, Human
guuaaaagaugaaaauauuu

SEQ ID NO: 1665114 - RNA, 14 nt, Human
guuaaaagaugaaa

SEQ ID NO: 1665115 - RNA, 16 nt, Human
guuaaaagaugaaaau

SEQ ID NO: 1665116 - RNA, 14 nt, Human
guuaaaagagguuu

SEQ ID NO: 1665117 - RNA, 15 nt, Human
gugggcauucaaaug

SEQ ID NO: 1665118 - RNA, 17 nt, Human
gugggcccaaugcacuu

SEQ ID NO: 1665119 - RNA, 18 nt, Human
gugggcgugagaccugcc

SEQ ID NO: 1665120 - RNA, 21 nt, Human
gugggcgugagaccugccccu

SEQ ID NO: 1665121 - RNA, 22 nt, Human
gugggcgugagaccugccccuc

SEQ ID NO: 1665122 - RNA, 19 nt, Human
gugggccuucagggaguga

SEQ ID NO: 1665123 - RNA, 15 nt, Human
gugggcuaguugggc

SEQ ID NO: 1665124 - RNA, 13 nt, Human
guggggaggggcu

SEQ ID NO: 1665125 - RNA, 15 nt, Human
guggggaccucaggc

SEQ ID NO: 1665126 - RNA, 18 nt, Human
guggggaccucaggccug

SEQ ID NO: 1665127 - RNA, 23 nt, Human
guggguuucuaaagcugccagcc

SEQ ID NO: 1665128 - RNA, 13 nt, Human
guggggcagcuug

SEQ ID NO: 1665129 - RNA, 17 nt, Human
guggggcagcuugaggg

SEQ ID NO: 1665130 - RNA, 19 nt, Human
guggcuggguuggagggug

SEQ ID NO: 1665131 - RNA, 23 nt, Human
guggcugcuucaaggauccugag

SEQ ID NO: 1665132 - RNA, 15 nt, Human
guggcugcuucaagg

SEQ ID NO: 1665133 - RNA, 16 nt, Human
guggcugcuucaagga

SEQ ID NO: 1665134 - RNA, 19 nt, Human
guggcugcuucaaggaucc

SEQ ID NO: 1665135 - RNA, 22 nt, Human
guggcugcuucaaggauccuga

SEQ ID NO: 1665136 - RNA, 18 nt, Human
guggcuucccgcucagcc

SEQ ID NO: 1665137 - RNA, 19 nt, Human
guggcuucccgcucagccc

SEQ ID NO: 1665138 - RNA, 20 nt, Human
guggcuucccgcucagcccu

SEQ ID NO: 1665139 - RNA, 22 nt, Human
guggcuuaaaacaacacucaca

SEQ ID NO: 1665140 - RNA, 13 nt, Human
guggcuccucccg

SEQ ID NO: 1665141 - RNA, 20 nt, Human
guggcuccucccggugccca

SEQ ID NO: 1665142 - RNA, 12 nt, Human
guggcugcuuca

SEQ ID NO: 1665143 - RNA, 14 nt, Human
guggcugcuucaag

SEQ ID NO: 1665144 - RNA, 13 nt, Human
gugcuaauuuuga

SEQ ID NO: 1665145 - RNA, 15 nt, Human
gugcuaauuuugaaa

SEQ ID NO: 1665146 - RNA, 15 nt, Human
gugcuacaaaaacac

SEQ ID NO: 1665147 - RNA, 20 nt, Human
gugcuacaaaaacacagcaa

SEQ ID NO: 1665148 - RNA, 14 nt, Human
guggcucacgccug

SEQ ID NO: 1665149 - RNA, 21 nt, Human
gugcuacaaaaacacagcaag

SEQ ID NO: 1665150 - RNA, 14 nt, Human
guggucccacccca

SEQ ID NO: 1665151 - RNA, 15 nt, Human
guggucccaccccac

SEQ ID NO: 1665152 - RNA, 16 nt, Human
guggucccaccccaca

SEQ ID NO: 1665153 - RNA, 17 nt, Human
guggucccaccccacac

SEQ ID NO: 1665154 - RNA, 18 nt, Human
gugguccuaaucuucuga

SEQ ID NO: 1665155 - RNA, 19 nt, Human
gugguaugaucacggcuca

SEQ ID NO: 1665156 - RNA, 17 nt, Human
gugguagagugugccug

SEQ ID NO: 1665157 - RNA, 13 nt, Human
guggugacuuugg

SEQ ID NO: 1665158 - RNA, 15 nt, Human
guggugacuuuggau

SEQ ID NO: 1665159 - RNA, 21 nt, Human
guggugagaggcauccaguau

SEQ ID NO: 1665160 - RNA, 14 nt, Human
guggugaccucugc

SEQ ID NO: 1665161 - RNA, 17 nt, Human
guggugaccucugccug

SEQ ID NO: 1665162 - RNA, 17 nt, Human
guguaagacaaaaagcu

SEQ ID NO: 1665163 - RNA, 19 nt, Human
guggugcgaucuggguuca

SEQ ID NO: 1665164 - RNA, 16 nt, Human
guggugacuuuggaua

SEQ ID NO: 1665165 - RNA, 21 nt, Human
guguaaguauucuuauuuaau

SEQ ID NO: 1665166 - RNA, 21 nt, Human
guguaaguagauaggccaugg

SEQ ID NO: 1665167 - RNA, 13 nt, Human
gugucccugcacu

SEQ ID NO: 1665168 - RNA, 16 nt, Human
gugucccugcacuugc

SEQ ID NO: 1665169 - RNA, 18 nt, Human
gugucccugcacuugcag

SEQ ID NO: 1665170 - RNA, 17 nt, Human
guguacauggaauaaca

SEQ ID NO: 1665171 - RNA, 22 nt, Human
guguacauggaauaacauguaa

SEQ ID NO: 1665172 - RNA, 23 nt, Human
gugcccaagaauagaugcugacu

SEQ ID NO: 1665173 - RNA, 20 nt, Human
gugcccaagaauagaugcug

SEQ ID NO: 1665174 - RNA, 14 nt, Human
gugccaugugccag

SEQ ID NO: 1665175 - RNA, 16 nt, Human
gugccaugugccaggu

SEQ ID NO: 1665176 - RNA, 15 nt, Human
gugccuucagcucua

SEQ ID NO: 1665177 - RNA, 21 nt, Human
gugcgaucuggguucacugca

SEQ ID NO: 1665178 - RNA, 13 nt, Human
gugcuaaggacuu

SEQ ID NO: 1665179 - RNA, 14 nt, Human
gugcuaaggacuug

SEQ ID NO: 1665180 - RNA, 20 nt, Human
gugcuaaggacuuguuagau

SEQ ID NO: 1665181 - RNA, 12 nt, Human
gugcuaaggacu

SEQ ID NO: 1665182 - RNA, 21 nt, Human
gugcgcuaaacuuuucugaua

SEQ ID NO: 1665183 - RNA, 17 nt, Human
gugcgcuaaacuuuucu

SEQ ID NO: 1665184 - RNA, 14 nt, Human
gugcgccuacagga

SEQ ID NO: 1665185 - RNA, 14 nt, Human
gugcggccuuuggc

SEQ ID NO: 1665186 - RNA, 22 nt, Human
gugcacuaauguguaagacaaa

SEQ ID NO: 1665187 - RNA, 23 nt, Human
gugauccacccaccucagccucc

SEQ ID NO: 1665188 - RNA, 24 nt, Human
gugauccacccaccucagccuccc

SEQ ID NO: 1665189 - RNA, 18 nt, Human
gugauuuuuguaauuuuu

SEQ ID NO: 1665190 - RNA, 13 nt, Human
gugauuuuuguaa

SEQ ID NO: 1665191 - RNA, 12 nt, Human
gugauuuucauu

SEQ ID NO: 1665192 - RNA, 20 nt, Human
gugcaguggugcgaucuggg

SEQ ID NO: 1665193 - RNA, 23 nt, Human
gugcaguggugcgaucuggguuc

SEQ ID NO: 1665194 - RNA, 13 nt, Human
gugcaucucagcc

SEQ ID NO: 1665195 - RNA, 14 nt, Human
gugcaucucagccc

SEQ ID NO: 1665196 - RNA, 22 nt, Human
gugcauaccacuuuuguucuug

SEQ ID NO: 1665197 - RNA, 17 nt, Human
gugauacaaugcugugc

SEQ ID NO: 1665198 - RNA, 15 nt, Human
gugauacaaugcugu

SEQ ID NO: 1665199 - RNA, 17 nt, Human
gugaguugauagcacag

SEQ ID NO: 1665200 - RNA, 19 nt, Human
gugauauaaguguguguuu

SEQ ID NO: 1665201 - RNA, 15 nt, Human
gugagccacugcacc

SEQ ID NO: 1665202 - RNA, 20 nt, Human
gugagccacugcaccgggcc

SEQ ID NO: 1665203 - RNA, 18 nt, Human
gugaggagcuugaaaccc

SEQ ID NO: 1665204 - RNA, 17 nt, Human
gugaggaugaaaaaaua

SEQ ID NO: 1665205 - RNA, 19 nt, Human
gugagccgagaucacgcca

SEQ ID NO: 1665206 - RNA, 14 nt, Human
gugagcuacaaaug

SEQ ID NO: 1665207 - RNA, 12 nt, Human
gugacagaggca

SEQ ID NO: 1665208 - RNA, 13 nt, Human
gugacagaggcag

SEQ ID NO: 1665209 - RNA, 14 nt, Human
gugacagaggcagc

SEQ ID NO: 1665210 - RNA, 15 nt, Human
gugacagaggcagcc

SEQ ID NO: 1665211 - RNA, 13 nt, Human
gugaccucugccu

SEQ ID NO: 1665212 - RNA, 14 nt, Human
gugaccucugccug

SEQ ID NO: 1665213 - RNA, 15 nt, Human
gugaccucugccuga

SEQ ID NO: 1665214 - RNA, 21 nt, Human
gugaacaaauuuacagagaca

SEQ ID NO: 1665215 - RNA, 13 nt, Human
gugaacacaucag

SEQ ID NO: 1665216 - RNA, 21 nt, Human
gugaaugaugauccuaggcau

SEQ ID NO: 1665217 - RNA, 20 nt, Human
gugacaaggauugcuacugu

SEQ ID NO: 1665218 - RNA, 21 nt, Human
gucuugaacuccuggccucaa

SEQ ID NO: 1665219 - RNA, 18 nt, Human
gucuugaacuccuggccu

SEQ ID NO: 1665220 - RNA, 20 nt, Human
gucuugaacuccuggccuca

SEQ ID NO: 1665221 - RNA, 16 nt, Human
gucuugcaauggcagc

SEQ ID NO: 1665222 - RNA, 17 nt, Human
gucuugcaauggcagcc

SEQ ID NO: 1665223 - RNA, 18 nt, Human
gucuugcaauggcagccu

SEQ ID NO: 1665224 - RNA, 19 nt, Human
gucuugcaauggcagccuu

SEQ ID NO: 1665225 - RNA, 21 nt, Human
gucuuaaaaaguggaaaaaua

SEQ ID NO: 1665226 - RNA, 16 nt, Human
gucuugaacuccuggc

SEQ ID NO: 1665227 - RNA, 17 nt, Human
gucuugaacuccuggcc

SEQ ID NO: 1665228 - RNA, 15 nt, Human
gucuugucucagauu

SEQ ID NO: 1665229 - RNA, 20 nt, Human
gucuugucucagauuuuauu

SEQ ID NO: 1665230 - RNA, 22 nt, Human
gucuugucucagauuuuauuau

SEQ ID NO: 1665231 - RNA, 15 nt, Human
gucuugccuuuuuca

SEQ ID NO: 1665232 - RNA, 16 nt, Human
gucuugccuuuuucau

SEQ ID NO: 1665233 - RNA, 17 nt, Human
gucuugccuuuuucauu

SEQ ID NO: 1665234 - RNA, 18 nt, Human
gucuugccuuuuucauua

SEQ ID NO: 1665235 - RNA, 20 nt, Human
gucuugccuuuuucauuauu

SEQ ID NO: 1665236 - RNA, 23 nt, Human
gucuugcaauggcagccuuggca

SEQ ID NO: 1665237 - RNA, 20 nt, Human
gucuugcaauggcagccuug

SEQ ID NO: 1665238 - RNA, 21 nt, Human
gucuugcaauggcagccuugg

SEQ ID NO: 1665239 - RNA, 17 nt, Human
gucuguucuuuccaaag

SEQ ID NO: 1665240 - RNA, 14 nt, Human
gucuguucuuucca

SEQ ID NO: 1665241 - RNA, 13 nt, Human
gucuguuuuauga

SEQ ID NO: 1665242 - RNA, 15 nt, Human
gucuguuuuaugacu

SEQ ID NO: 1665243 - RNA, 18 nt, Human
gucugugccauuuuguau

SEQ ID NO: 1665244 - RNA, 22 nt, Human
gucugugagaugcuagaacucc

SEQ ID NO: 1665245 - RNA, 23 nt, Human
gucugugagaugcuagaacuccc

SEQ ID NO: 1665246 - RNA, 15 nt, Human
gucugugagaugcua

SEQ ID NO: 1665247 - RNA, 16 nt, Human
gucugugagaugcuag

SEQ ID NO: 1665248 - RNA, 17 nt, Human
gucugugagaugcuaga

SEQ ID NO: 1665249 - RNA, 21 nt, Human
gucugugagaugcuagaacuc

SEQ ID NO: 1665250 - RNA, 17 nt, Human
gucucagauuuuauuau

SEQ ID NO: 1665251 - RNA, 21 nt, Human
gucucagauuuuauuauguaa

SEQ ID NO: 1665252 - RNA, 15 nt, Human
gucucagauuuuauu

SEQ ID NO: 1665253 - RNA, 16 nt, Human
gucucagauuuuauua

SEQ ID NO: 1665254 - RNA, 14 nt, Human
gucucagauuuuau

SEQ ID NO: 1665255 - RNA, 22 nt, Human
gucucacucugucgcccagucu

SEQ ID NO: 1665256 - RNA, 15 nt, Human
gucucacucugucgc

SEQ ID NO: 1665257 - RNA, 16 nt, Human
gucucacucugucgcc

SEQ ID NO: 1665258 - RNA, 18 nt, Human
gucucacucugucgccca

SEQ ID NO: 1665259 - RNA, 19 nt, Human
gucucacucugucgcccag

SEQ ID NO: 1665260 - RNA, 13 nt, Human
gucucugagcauu

SEQ ID NO: 1665261 - RNA, 15 nt, Human
gucucugaagugaaa

SEQ ID NO: 1665262 - RNA, 21 nt, Human
gucucugaagugaaacugcuu

SEQ ID NO: 1665263 - RNA, 17 nt, Human
gucucuggaauuugaaa

SEQ ID NO: 1665264 - RNA, 16 nt, Human
gucucugguuccuccc

SEQ ID NO: 1665265 - RNA, 17 nt, Human
gucucugguuccucccc

SEQ ID NO: 1665266 - RNA, 18 nt, Human
gucucuucuccacuggau

SEQ ID NO: 1665267 - RNA, 21 nt, Human
gucucuggauuauauuaugaa

SEQ ID NO: 1665268 - RNA, 13 nt, Human
gucugacuguuuc

SEQ ID NO: 1665269 - RNA, 13 nt, Human
gucucuugguccu

SEQ ID NO: 1665270 - RNA, 15 nt, Human
gucccugccaaugga

SEQ ID NO: 1665271 - RNA, 11 nt, Human
gucccugccaa

SEQ ID NO: 1665272 - RNA, 14 nt, Human
gucccugccaaugg

SEQ ID NO: 1665273 - RNA, 21 nt, Human
guccuuaccagcagagcaccu

SEQ ID NO: 1665274 - RNA, 19 nt, Human
guccuuaccagcagagcac

SEQ ID NO: 1665275 - RNA, 21 nt, Human
gucggaaaacaugcuacacac

SEQ ID NO: 1665276 - RNA, 16 nt, Human
gucgggcaugacacga

SEQ ID NO: 1665277 - RNA, 23 nt, Human
gucggguuuuauuguuuaaaauc

SEQ ID NO: 1665278 - RNA, 18 nt, Human
gucgucaaagcugaaaug

SEQ ID NO: 1665279 - RNA, 18 nt, Human
gucucacuauguugccca

SEQ ID NO: 1665280 - RNA, 19 nt, Human
gucucacuauguugcccag

SEQ ID NO: 1665281 - RNA, 21 nt, Human
gucccuaccgagucucuucuc

SEQ ID NO: 1665282 - RNA, 22 nt, Human
gucccuaccgagucucuucucc

SEQ ID NO: 1665283 - RNA, 23 nt, Human
gucccuaccgagucucuucucca

SEQ ID NO: 1665284 - RNA, 18 nt, Human
gucccuaauaaagcugug

SEQ ID NO: 1665285 - RNA, 20 nt, Human
gucccuaauaaagcugugug

SEQ ID NO: 1665286 - RNA, 16 nt, Human
gucccugcacuugcag

SEQ ID NO: 1665287 - RNA, 19 nt, Human
gucccugcacuugcagacu

SEQ ID NO: 1665288 - RNA, 21 nt, Human
gucccugcacuugcagacucu

SEQ ID NO: 1665289 - RNA, 16 nt, Human
gucccuaauaaagcug

SEQ ID NO: 1665290 - RNA, 17 nt, Human
gucccuaauaaagcugu

SEQ ID NO: 1665291 - RNA, 17 nt, Human
guccccaccgcagacag

SEQ ID NO: 1665292 - RNA, 18 nt, Human
gucccaggcugagccuca

SEQ ID NO: 1665293 - RNA, 19 nt, Human
gucccaggcugagccucag

SEQ ID NO: 1665294 - RNA, 21 nt, Human
gucccaggcugagccucaguc

SEQ ID NO: 1665295 - RNA, 15 nt, Human
gucccaggcugagcc

SEQ ID NO: 1665296 - RNA, 16 nt, Human
gucccaggcugagccu

SEQ ID NO: 1665297 - RNA, 17 nt, Human
gucccaggcugagccuc

SEQ ID NO: 1665298 - RNA, 23 nt, Human
gucccaccuuggcugcagggagu

SEQ ID NO: 1665299 - RNA, 13 nt, Human
guccacccaggag

SEQ ID NO: 1665300 - RNA, 12 nt, Human
guccacccagga

SEQ ID NO: 1665301 - RNA, 23 nt, Human
guccacccaggagccccgaggcc

SEQ ID NO: 1665302 - RNA, 21 nt, Human
gucccaccuuggcugcaggga

SEQ ID NO: 1665303 - RNA, 21 nt, Human
gucauucagauaugauucaaa

SEQ ID NO: 1665304 - RNA, 21 nt, Human
gucagcuccccucggagaaga

SEQ ID NO: 1665305 - RNA, 22 nt, Human
gucagcuccccucggagaagag

SEQ ID NO: 1665306 - RNA, 23 nt, Human
gucagcuccccucggagaagagc

SEQ ID NO: 1665307 - RNA, 22 nt, Human
gucaccccggccaccugcggug

SEQ ID NO: 1665308 - RNA, 17 nt, Human
gucaccccggccaccug

SEQ ID NO: 1665309 - RNA, 18 nt, Human
gucaccccggccaccugc

SEQ ID NO: 1665310 - RNA, 22 nt, Human
gucacucuggcagcucagagag

SEQ ID NO: 1665311 - RNA, 17 nt, Human
gucacucuggcagcuca

SEQ ID NO: 1665312 - RNA, 19 nt, Human
gucacucuggcagcucaga

SEQ ID NO: 1665313 - RNA, 12 nt, Human
gucacucuggca

SEQ ID NO: 1665314 - RNA, 13 nt, Human
gucacucuggcag

SEQ ID NO: 1665315 - RNA, 14 nt, Human
gucacucuggcagc

SEQ ID NO: 1665316 - RNA, 16 nt, Human
gucacucuggcagcuc

SEQ ID NO: 1665317 - RNA, 15 nt, Human
gucagagccugcagu

SEQ ID NO: 1665318 - RNA, 16 nt, Human
gucagagccugcaguu

SEQ ID NO: 1665319 - RNA, 14 nt, Human
gucagagccugcag

SEQ ID NO: 1665320 - RNA, 16 nt, Human
gucagaucugccuaag

SEQ ID NO: 1665321 - RNA, 18 nt, Human
gucagaucugccuaagga

SEQ ID NO: 1665322 - RNA, 19 nt, Human
gucagaucugccuaaggac

SEQ ID NO: 1665323 - RNA, 20 nt, Human
gucagaucugccuaaggacu

SEQ ID NO: 1665324 - RNA, 21 nt, Human
gucagaucugccuaaggacuu

SEQ ID NO: 1665325 - RNA, 22 nt, Human
gucagaugcugugcaaauguua

SEQ ID NO: 1665326 - RNA, 19 nt, Human
gucagcuccccucggagaa

SEQ ID NO: 1665327 - RNA, 14 nt, Human
guauuuuacuaaua

SEQ ID NO: 1665328 - RNA, 16 nt, Human
guauuaagcauauauu

SEQ ID NO: 1665329 - RNA, 17 nt, Human
guauuaagcauauauuu

SEQ ID NO: 1665330 - RNA, 15 nt, Human
guauuaagcauauau

SEQ ID NO: 1665331 - RNA, 16 nt, Human
guauuaagaaugaaau

SEQ ID NO: 1665332 - RNA, 18 nt, Human
guauuaagcauauauuuu

SEQ ID NO: 1665333 - RNA, 21 nt, Human
guauuaagcauauauuuuuau

SEQ ID NO: 1665334 - RNA, 20 nt, Human
guauuuuaaaagaaugauua

SEQ ID NO: 1665335 - RNA, 13 nt, Human
guauuuuaaucac

SEQ ID NO: 1665336 - RNA, 19 nt, Human
guauuuuguuuuugucuua

SEQ ID NO: 1665337 - RNA, 23 nt, Human
gucaauaaaauccauacauuugu

SEQ ID NO: 1665338 - RNA, 15 nt, Human
gucaagugaaaaagg

SEQ ID NO: 1665339 - RNA, 22 nt, Human
gucaauaaaauccauacauuug

SEQ ID NO: 1665340 - RNA, 15 nt, Human
gucaaugcagccccc

SEQ ID NO: 1665341 - RNA, 19 nt, Human
guauagaaccucuuugucu

SEQ ID NO: 1665342 - RNA, 14 nt, Human
guauagauuagaau

SEQ ID NO: 1665343 - RNA, 13 nt, Human
guauaugucucag

SEQ ID NO: 1665344 - RNA, 15 nt, Human
guauaugucucaggu

SEQ ID NO: 1665345 - RNA, 21 nt, Human
guauaugucucaggucccugc

SEQ ID NO: 1665346 - RNA, 16 nt, Human
guauauguugggugca

SEQ ID NO: 1665347 - RNA, 22 nt, Human
guauaugucaagccauaauugu

SEQ ID NO: 1665348 - RNA, 17 nt, Human
guauguugaagccuuug

SEQ ID NO: 1665349 - RNA, 20 nt, Human
guaugaggcauuuguuugaa

SEQ ID NO: 1665350 - RNA, 17 nt, Human
guaugaggcauuuguuu

SEQ ID NO: 1665351 - RNA, 20 nt, Human
guaugaucacggcucacugc

SEQ ID NO: 1665352 - RNA, 22 nt, Human
guaugaucacggcucacugcag

SEQ ID NO: 1665353 - RNA, 21 nt, Human
guaugaucacggcucacugca

SEQ ID NO: 1665354 - RNA, 17 nt, Human
guauguuagugcaaauu

SEQ ID NO: 1665355 - RNA, 22 nt, Human
guaugaaagauggcugugccuc

SEQ ID NO: 1665356 - RNA, 23 nt, Human
guaugaaagauggcugugccucu

SEQ ID NO: 1665357 - RNA, 12 nt, Human
guaucugagcag

SEQ ID NO: 1665358 - RNA, 12 nt, Human
guaucuggugac

SEQ ID NO: 1665359 - RNA, 19 nt, Human
guaucuggugacuuuccuc

SEQ ID NO: 1665360 - RNA, 15 nt, Human
guaugaggcauuugu

SEQ ID NO: 1665361 - RNA, 13 nt, Human
guaugaggcauuu

SEQ ID NO: 1665362 - RNA, 18 nt, Human
guaugaauaaagacaccu

SEQ ID NO: 1665363 - RNA, 19 nt, Human
guaugaauaaagacaccua

SEQ ID NO: 1665364 - RNA, 14 nt, Human
guagucaggugccu

SEQ ID NO: 1665365 - RNA, 14 nt, Human
guagggugggccuu

SEQ ID NO: 1665366 - RNA, 17 nt, Human
guagggugggccuucag

SEQ ID NO: 1665367 - RNA, 22 nt, Human
guagggugggccuucagggagu

SEQ ID NO: 1665368 - RNA, 16 nt, Human
guaggguuauaauaau

SEQ ID NO: 1665369 - RNA, 15 nt, Human
guauaauuaacaugu

SEQ ID NO: 1665370 - RNA, 17 nt, Human
guauaauuaacauguua

SEQ ID NO: 1665371 - RNA, 19 nt, Human
guauaauuaacauguuaaa

SEQ ID NO: 1665372 - RNA, 22 nt, Human
guauaauuaacauguuaaacca

SEQ ID NO: 1665373 - RNA, 23 nt, Human
guauaauuaacauguuaaaccau

SEQ ID NO: 1665374 - RNA, 17 nt, Human
guauaauucacauugua

SEQ ID NO: 1665375 - RNA, 14 nt, Human
guaguguuggagaa

SEQ ID NO: 1665376 - RNA, 15 nt, Human
guaguguuggagaag

SEQ ID NO: 1665377 - RNA, 13 nt, Human
guauaauuaacau

SEQ ID NO: 1665378 - RNA, 14 nt, Human
guauaauuaacaug

SEQ ID NO: 1665379 - RNA, 21 nt, Human
guagcauuuguguugaagagg

SEQ ID NO: 1665380 - RNA, 23 nt, Human
guagggcgggaggauguucuggg

SEQ ID NO: 1665381 - RNA, 21 nt, Human
guagggcgggaggauguucug

SEQ ID NO: 1665382 - RNA, 22 nt, Human
guagggcgggaggauguucugg

SEQ ID NO: 1665383 - RNA, 16 nt, Human
guagggcgggaggaug

SEQ ID NO: 1665384 - RNA, 15 nt, Human
guagagugugccuga

SEQ ID NO: 1665385 - RNA, 18 nt, Human
gcuauaggugcuacaaaa

SEQ ID NO: 1665386 - RNA, 16 nt, Human
guagcauccuggaaua

SEQ ID NO: 1665387 - RNA, 15 nt, Human
uuugcaucugaaaau

SEQ ID NO: 1665388 - RNA, 22 nt, Human
uuuggaauuuuccuccuuucuc

SEQ ID NO: 1665389 - RNA, 14 nt, Human
uuuggaauuuugug

SEQ ID NO: 1665390 - RNA, 16 nt, Human
uuugcuuugugauuuu

SEQ ID NO: 1665391 - RNA, 15 nt, Human
uuugcuuugugauuu

SEQ ID NO: 1665392 - RNA, 20 nt, Human
uuuggagucagacagaugug

SEQ ID NO: 1665393 - RNA, 16 nt, Human
uuuggauaauaaggaa

SEQ ID NO: 1665394 - RNA, 19 nt, Human
uuuggacaaaauggaauac

SEQ ID NO: 1665395 - RNA, 21 nt, Human
uuuggaauuuugugcccccau

SEQ ID NO: 1665396 - RNA, 19 nt, Human
uuugguuuucacauuggaa

SEQ ID NO: 1665397 - RNA, 19 nt, Human
uuuggugguuucagaaaug

SEQ ID NO: 1665398 - RNA, 13 nt, Human
uuuguauaaaaua

SEQ ID NO: 1665399 - RNA, 14 nt, Human
uuuguauaaaauaa

SEQ ID NO: 1665400 - RNA, 16 nt, Human
uuuguauaaaauaauu

SEQ ID NO: 1665401 - RNA, 21 nt, Human
uuuguucuggcucuuccaggc

SEQ ID NO: 1665402 - RNA, 18 nt, Human
uuuuaaagacuuuuauga

SEQ ID NO: 1665403 - RNA, 17 nt, Human
uuuuaaagaaugcucuu

SEQ ID NO: 1665404 - RNA, 21 nt, Human
uuuuaaaagaaugauuaugaa

SEQ ID NO: 1665405 - RNA, 21 nt, Human
uuuuaaaugcaccuggaauau

SEQ ID NO: 1665406 - RNA, 12 nt, Human
uuuuaaaugcac

SEQ ID NO: 1665407 - RNA, 11 nt, Human
uuuuaaaugca

SEQ ID NO: 1665408 - RNA, 20 nt, Human
uuuuaauaauguuucaaaca

SEQ ID NO: 1665409 - RNA, 17 nt, Human
uuaccacagacauacua

SEQ ID NO: 1665410 - RNA, 14 nt, Human
uuaccacagacaua

SEQ ID NO: 1665411 - RNA, 12 nt, Human
uuuccugcccug

SEQ ID NO: 1665412 - RNA, 13 nt, Human
uuuccugcccugg

SEQ ID NO: 1665413 - RNA, 16 nt, Human
uuuccugaggcugggc

SEQ ID NO: 1665414 - RNA, 23 nt, Human
uuucuacucgaguuacagacaaa

SEQ ID NO: 1665415 - RNA, 12 nt, Human
uuucuaaaguaa

SEQ ID NO: 1665416 - RNA, 14 nt, Human
uuucuaaaguaaaa

SEQ ID NO: 1665417 - RNA, 21 nt, Human
uuucuaaaggcuaccuuugua

SEQ ID NO: 1665418 - RNA, 20 nt, Human
uuucuaaaggcuaccuuugu

SEQ ID NO: 1665419 - RNA, 15 nt, Human
uuucucugauacaga

SEQ ID NO: 1665420 - RNA, 16 nt, Human
uuucucugauacagaa

SEQ ID NO: 1665421 - RNA, 17 nt, Human
uuucucugauacagaaa

SEQ ID NO: 1665422 - RNA, 18 nt, Human
uuucucugauacagaaaa

SEQ ID NO: 1665423 - RNA, 21 nt, Human
uuucugaaauuuccugggagc

SEQ ID NO: 1665424 - RNA, 19 nt, Human
uuucugaaauuuccuggga

SEQ ID NO: 1665425 - RNA, 20 nt, Human
uuucuguucuuucuggcuau

SEQ ID NO: 1665426 - RNA, 15 nt, Human
uuucugagaaagacu

SEQ ID NO: 1665427 - RNA, 13 nt, Human
uuucugagaaaga

SEQ ID NO: 1665428 - RNA, 11 nt, Human
uuucuuccucu

SEQ ID NO: 1665429 - RNA, 13 nt, Human
uuucuuccucugc

SEQ ID NO: 1665430 - RNA, 13 nt, Human
uuucuucucccuc

SEQ ID NO: 1665431 - RNA, 14 nt, Human
uuucuuccucugcu

SEQ ID NO: 1665432 - RNA, 16 nt, Human
uuucuuccucugcuga

SEQ ID NO: 1665433 - RNA, 12 nt, Human
uuucuucucccu

SEQ ID NO: 1665434 - RNA, 23 nt, Human
uuucuuagggaaggauacaaaag

SEQ ID NO: 1665435 - RNA, 18 nt, Human
uuucuuagggaaggauac

SEQ ID NO: 1665436 - RNA, 17 nt, Human
uuucuuauuucauuucu

SEQ ID NO: 1665437 - RNA, 19 nt, Human
uuugaacugauaaagauga

SEQ ID NO: 1665438 - RNA, 17 nt, Human
uuugaacugauaaagau

SEQ ID NO: 1665439 - RNA, 15 nt, Human
uuugaacugauaaag

SEQ ID NO: 1665440 - RNA, 14 nt, Human
uuugaacucuucaa

SEQ ID NO: 1665441 - RNA, 22 nt, Human
uuugaagaugccgcauuuggau

SEQ ID NO: 1665442 - RNA, 18 nt, Human
uuugaaucaucaagucuu

SEQ ID NO: 1665443 - RNA, 11 nt, Human
uuuuuccuuca

SEQ ID NO: 1665444 - RNA, 11 nt, Human
uuuuuaaaugc

SEQ ID NO: 1665445 - RNA, 18 nt, Human
uuuuuaagccuuaaagga

SEQ ID NO: 1665446 - RNA, 11 nt, Human
uuuuuccuuuu

SEQ ID NO: 1665447 - RNA, 19 nt, Human
uuuuuccuucagugccuua

SEQ ID NO: 1665448 - RNA, 23 nt, Human
uuuuucucugauacagaaaaguu

SEQ ID NO: 1665449 - RNA, 19 nt, Human
uuuuucucuaggaaauauu

SEQ ID NO: 1665450 - RNA, 18 nt, Human
uuuucuaaaguaaaaaca

SEQ ID NO: 1665451 - RNA, 14 nt, Human
uuuuccugaaaacc

SEQ ID NO: 1665452 - RNA, 14 nt, Human
uuuuggcugcugaa

SEQ ID NO: 1665453 - RNA, 15 nt, Human
uuuuggucuguguga

SEQ ID NO: 1665454 - RNA, 18 nt, Human
uuuuggucuggagggaag

SEQ ID NO: 1665455 - RNA, 21 nt, Human
uuuuggcauaacauaaaucug

SEQ ID NO: 1665456 - RNA, 20 nt, Human
uuuugacaaggggcaguggu

SEQ ID NO: 1665457 - RNA, 12 nt, Human
uuuuuaaagacu

SEQ ID NO: 1665458 - RNA, 13 nt, Human
uuuuuaaagacuu

SEQ ID NO: 1665459 - RNA, 18 nt, Human
uuuuuaaagacuuuuaug

SEQ ID NO: 1665460 - RNA, 16 nt, Human
uuuugucauauaagau

SEQ ID NO: 1665461 - RNA, 18 nt, Human
uuuuuaaaaaagaaacau

SEQ ID NO: 1665462 - RNA, 19 nt, Human
uuuuguagagccagggucu

SEQ ID NO: 1665463 - RNA, 16 nt, Human
uuuugguugcuuuaau

SEQ ID NO: 1665464 - RNA, 15 nt, Human
uuuugguugcuuuaa

SEQ ID NO: 1665465 - RNA, 12 nt, Human
gcccgacagccu

SEQ ID NO: 1665466 - RNA, 14 nt, Human
gcccgacagccugg

SEQ ID NO: 1665467 - RNA, 15 nt, Human
gcccgacagccuggc

SEQ ID NO: 1665468 - RNA, 17 nt, Human
gccccuguucuggcaga

SEQ ID NO: 1665469 - RNA, 16 nt, Human
gccccucagggucccu

SEQ ID NO: 1665470 - RNA, 18 nt, Human
gccccucagggucccugg

SEQ ID NO: 1665471 - RNA, 15 nt, Human
gccccgaggccuucu

SEQ ID NO: 1665472 - RNA, 14 nt, Human
gccccucagggucc

SEQ ID NO: 1665473 - RNA, 18 nt, Human
gccccgaggccuucucug

SEQ ID NO: 1665474 - RNA, 22 nt, Human
gccccgaggccuucucugaagg

SEQ ID NO: 1665475 - RNA, 19 nt, Human
gcccuccaagaccuucucc

SEQ ID NO: 1665476 - RNA, 21 nt, Human
gcccuccaagaccuucuccuu

SEQ ID NO: 1665477 - RNA, 20 nt, Human
gcccuccaucuaaacugccc

SEQ ID NO: 1665478 - RNA, 21 nt, Human
gcccuccaucuaaacugcccc

SEQ ID NO: 1665479 - RNA, 22 nt, Human
gcccuccaagaccuucuccuuc

SEQ ID NO: 1665480 - RNA, 23 nt, Human
gcccuccaagaccuucuccuuca

SEQ ID NO: 1665481 - RNA, 21 nt, Human
gcccucccugccccucccuuc

SEQ ID NO: 1665482 - RNA, 13 nt, Human
gcccucugcccac

SEQ ID NO: 1665483 - RNA, 16 nt, Human
gcccucugcccacucc

SEQ ID NO: 1665484 - RNA, 18 nt, Human
gcccucugcccacucccu

SEQ ID NO: 1665485 - RNA, 19 nt, Human
gcccucugcccacucccug

SEQ ID NO: 1665486 - RNA, 14 nt, Human
gcccugagcuuucu

SEQ ID NO: 1665487 - RNA, 16 nt, Human
gcccugcagagggcac

SEQ ID NO: 1665488 - RNA, 15 nt, Human
gcccugcagagggca

SEQ ID NO: 1665489 - RNA, 13 nt, Human
gcccugcagaggg

SEQ ID NO: 1665490 - RNA, 14 nt, Human
gcccugcagagggc

SEQ ID NO: 1665491 - RNA, 15 nt, Human
gccccauucugccug

SEQ ID NO: 1665492 - RNA, 14 nt, Human
gccccauucugccu

SEQ ID NO: 1665493 - RNA, 13 nt, Human
gccccauccucug

SEQ ID NO: 1665494 - RNA, 14 nt, Human
gccccauccucugu

SEQ ID NO: 1665495 - RNA, 22 nt, Human
gccccauccucuguacagagcc

SEQ ID NO: 1665496 - RNA, 15 nt, Human
gccccagugcccaca

SEQ ID NO: 1665497 - RNA, 13 nt, Human
gccccagugccca

SEQ ID NO: 1665498 - RNA, 14 nt, Human
gccccagugcccac

SEQ ID NO: 1665499 - RNA, 19 nt, Human
gccccaguuguauuuauuu

SEQ ID NO: 1665500 - RNA, 21 nt, Human
gccccauaauuuuuuuuuucc

SEQ ID NO: 1665501 - RNA, 18 nt, Human
gccccaucccaaacccuu

SEQ ID NO: 1665502 - RNA, 12 nt, Human
gccccagugccc

SEQ ID NO: 1665503 - RNA, 20 nt, Human
gcccaggcuggagugcaaug

SEQ ID NO: 1665504 - RNA, 13 nt, Human
gcccaggccuccu

SEQ ID NO: 1665505 - RNA, 21 nt, Human
gcccagagaggguggugaccu

SEQ ID NO: 1665506 - RNA, 23 nt, Human
gcccaggccccugccacccuggg

SEQ ID NO: 1665507 - RNA, 12 nt, Human
gcccaggcuggc

SEQ ID NO: 1665508 - RNA, 19 nt, Human
gccaggagccuccugcccu

SEQ ID NO: 1665509 - RNA, 20 nt, Human
gccaggagccuccugcccuu

SEQ ID NO: 1665510 - RNA, 14 nt, Human
gccaggagccuccu

SEQ ID NO: 1665511 - RNA, 16 nt, Human
gccaggagccuccugc

SEQ ID NO: 1665512 - RNA, 15 nt, Human
gccaggaagccagca

SEQ ID NO: 1665513 - RNA, 17 nt, Human
gccagcugcuugggcuu

SEQ ID NO: 1665514 - RNA, 18 nt, Human
gccagcugcuugggcuuc

SEQ ID NO: 1665515 - RNA, 20 nt, Human
gccagcugcuugggcuucau

SEQ ID NO: 1665516 - RNA, 12 nt, Human
gccaggaagcca

SEQ ID NO: 1665517 - RNA, 13 nt, Human
gccaggaagccag

SEQ ID NO: 1665518 - RNA, 14 nt, Human
gccaggaagccagc

SEQ ID NO: 1665519 - RNA, 14 nt, Human
gccagaugcaccag

SEQ ID NO: 1665520 - RNA, 17 nt, Human
gccagagggagugacag

SEQ ID NO: 1665521 - RNA, 22 nt, Human
gccagccgagauagccaaggcc

SEQ ID NO: 1665522 - RNA, 15 nt, Human
gccagaugcaccagc

SEQ ID NO: 1665523 - RNA, 20 nt, Human
gccagauucuuuccugaggc

SEQ ID NO: 1665524 - RNA, 24 nt, Human
gccagauucuuuccugaggcuggg

SEQ ID NO: 1665525 - RNA, 13 nt, Human
gccagauuucacu

SEQ ID NO: 1665526 - RNA, 20 nt, Human
gccaaggccaaaggaagcac

SEQ ID NO: 1665527 - RNA, 21 nt, Human
gccacuccagaccccuggcuu

SEQ ID NO: 1665528 - RNA, 20 nt, Human
gccacuccagaccccuggcu

SEQ ID NO: 1665529 - RNA, 24 nt, Human
gccaaggccaaaggaagcacaugc

SEQ ID NO: 1665530 - RNA, 22 nt, Human
gccacuccagaccccuggcuuu

SEQ ID NO: 1665531 - RNA, 20 nt, Human
gccacugcaccgggccacag

SEQ ID NO: 1665532 - RNA, 21 nt, Human
gccacugcaccgggccacaga

SEQ ID NO: 1665533 - RNA, 22 nt, Human
gccagagacacaagccuucggc

SEQ ID NO: 1665534 - RNA, 22 nt, Human
gccacugcaccgggccacagag

SEQ ID NO: 1665535 - RNA, 21 nt, Human
gccagagacacaagccuucgg

SEQ ID NO: 1665536 - RNA, 20 nt, Human
gcccacauagugaugguucc

SEQ ID NO: 1665537 - RNA, 21 nt, Human
gcccaagaauagaugcugacu

SEQ ID NO: 1665538 - RNA, 22 nt, Human
gcccaagaauagaugcugacug

SEQ ID NO: 1665539 - RNA, 24 nt, Human
gcccaaccugcucuccucuugcca

SEQ ID NO: 1665540 - RNA, 24 nt, Human
gccaugcuccuggcccacugcauc

SEQ ID NO: 1665541 - RNA, 19 nt, Human
gccaugggcacugugggua

SEQ ID NO: 1665542 - RNA, 15 nt, Human
gccaugggccuccug

SEQ ID NO: 1665543 - RNA, 16 nt, Human
gccaugggccuccugu

SEQ ID NO: 1665544 - RNA, 15 nt, Human
gcccaccuggccucu

SEQ ID NO: 1665545 - RNA, 16 nt, Human
gcccaccuggccucug

SEQ ID NO: 1665546 - RNA, 17 nt, Human
gcccaccuggccucugc

SEQ ID NO: 1665547 - RNA, 20 nt, Human
gcccaccuggccucugcacu

SEQ ID NO: 1665548 - RNA, 21 nt, Human
gcccaccuggccucugcacuc

SEQ ID NO: 1665549 - RNA, 24 nt, Human
gcccaccuggccucugcacucccc

SEQ ID NO: 1665550 - RNA, 14 nt, Human
gcccacuucugcca

SEQ ID NO: 1665551 - RNA, 13 nt, Human
gcccaccuuggcu

SEQ ID NO: 1665552 - RNA, 15 nt, Human
gcccaccuuggcuca

SEQ ID NO: 1665553 - RNA, 16 nt, Human
gcccaccuuggcucaa

SEQ ID NO: 1665554 - RNA, 17 nt, Human
gcccaccuuggcucaag

SEQ ID NO: 1665555 - RNA, 17 nt, Human
gccaggcugggucgccc

SEQ ID NO: 1665556 - RNA, 23 nt, Human
gccaggcugggucgcccuggacu

SEQ ID NO: 1665557 - RNA, 13 nt, Human
gccaggcuggucu

SEQ ID NO: 1665558 - RNA, 15 nt, Human
gccaggcuggucuca

SEQ ID NO: 1665559 - RNA, 23 nt, Human
gccaguaaaugggggugcauuug

SEQ ID NO: 1665560 - RNA, 14 nt, Human
gccaugcuccuggc

SEQ ID NO: 1665561 - RNA, 14 nt, Human
gccauccagguuca

SEQ ID NO: 1665562 - RNA, 23 nt, Human
gccaucccucccuccaccucccu

SEQ ID NO: 1665563 - RNA, 18 nt, Human
gccaucccucccuccacc

SEQ ID NO: 1665564 - RNA, 15 nt, Human
gccgucuaccugagg

SEQ ID NO: 1665565 - RNA, 16 nt, Human
gccgucuaccugaggg

SEQ ID NO: 1665566 - RNA, 17 nt, Human
gccgucuaccugagggg

SEQ ID NO: 1665567 - RNA, 14 nt, Human
gccgugccuucagc

SEQ ID NO: 1665568 - RNA, 15 nt, Human
gccgugccuucagcu

SEQ ID NO: 1665569 - RNA, 17 nt, Human
gccgugccuucagcucu

SEQ ID NO: 1665570 - RNA, 19 nt, Human
gccgugccuucagcucuac

SEQ ID NO: 1665571 - RNA, 19 nt, Human
gccguggcuucccgcucag

SEQ ID NO: 1665572 - RNA, 21 nt, Human
gccguggcuucccgcucagcc

SEQ ID NO: 1665573 - RNA, 22 nt, Human
gccguggcuucccgcucagccc

SEQ ID NO: 1665574 - RNA, 20 nt, Human
gccguguaaccauggaccca

SEQ ID NO: 1665575 - RNA, 22 nt, Human
gccuaugugcaugcagcaucua

SEQ ID NO: 1665576 - RNA, 18 nt, Human
gccucaaccuccugggcu

SEQ ID NO: 1665577 - RNA, 19 nt, Human
gccucaaccuccugggcua

SEQ ID NO: 1665578 - RNA, 13 nt, Human
gccucacaguccu

SEQ ID NO: 1665579 - RNA, 17 nt, Human
gccucacaguccuuacc

SEQ ID NO: 1665580 - RNA, 22 nt, Human
gccuaaauccauuuggaaaucu

SEQ ID NO: 1665581 - RNA, 23 nt, Human
gccuaaauccauuuggaaaucuu

SEQ ID NO: 1665582 - RNA, 12 nt, Human
gccuaaauccau

SEQ ID NO: 1665583 - RNA, 13 nt, Human
gccuaaauccauu

SEQ ID NO: 1665584 - RNA, 19 nt, Human
gccuaaauccauuuggaaa

SEQ ID NO: 1665585 - RNA, 21 nt, Human
gccuaaauccauuuggaaauc

SEQ ID NO: 1665586 - RNA, 14 nt, Human
gcccugcuuucaga

SEQ ID NO: 1665587 - RNA, 16 nt, Human
gcccugcuuucagaua

SEQ ID NO: 1665588 - RNA, 16 nt, Human
gcccugcuuugggcug

SEQ ID NO: 1665589 - RNA, 18 nt, Human
gcccugcuuugggcugcc

SEQ ID NO: 1665590 - RNA, 14 nt, Human
gcccuucucuccag

SEQ ID NO: 1665591 - RNA, 16 nt, Human
gcccuucucuccagcc

SEQ ID NO: 1665592 - RNA, 17 nt, Human
gcccuucucuccagccc

SEQ ID NO: 1665593 - RNA, 18 nt, Human
gcccuucucuccagcccc

SEQ ID NO: 1665594 - RNA, 22 nt, Human
gccgagaucacgccacugcacu

SEQ ID NO: 1665595 - RNA, 20 nt, Human
gccgagaucacgccacugca

SEQ ID NO: 1665596 - RNA, 21 nt, Human
gccgagaucacgccacugcac

SEQ ID NO: 1665597 - RNA, 11 nt, Human
gccgcagcccu

SEQ ID NO: 1665598 - RNA, 12 nt, Human
gccgcagcccug

SEQ ID NO: 1665599 - RNA, 13 nt, Human
gccgcagcccugc

SEQ ID NO: 1665600 - RNA, 21 nt, Human
gccgggcgcgguggcucacgc

SEQ ID NO: 1665601 - RNA, 20 nt, Human
gccgggcgugguggugagug

SEQ ID NO: 1665602 - RNA, 13 nt, Human
gccucucucaggc

SEQ ID NO: 1665603 - RNA, 14 nt, Human
gccucucucaggcc

SEQ ID NO: 1665604 - RNA, 16 nt, Human
gccucucucaggccaa

SEQ ID NO: 1665605 - RNA, 17 nt, Human
gccucugacacacagcu

SEQ ID NO: 1665606 - RNA, 18 nt, Human
gccucugacacacagcuc

SEQ ID NO: 1665607 - RNA, 14 nt, Human
gccucugcacuccc

SEQ ID NO: 1665608 - RNA, 19 nt, Human
gccucugacacacagcucu

SEQ ID NO: 1665609 - RNA, 20 nt, Human
gccucugacacacagcucug

SEQ ID NO: 1665610 - RNA, 21 nt, Human
gccucugacacacagcucugu

SEQ ID NO: 1665611 - RNA, 18 nt, Human
gccucugccucugacaca

SEQ ID NO: 1665612 - RNA, 15 nt, Human
gccucugcacucccc

SEQ ID NO: 1665613 - RNA, 12 nt, Human
gccucugccucu

SEQ ID NO: 1665614 - RNA, 13 nt, Human
gccucugccucug

SEQ ID NO: 1665615 - RNA, 13 nt, Human
gccugcaagggag

SEQ ID NO: 1665616 - RNA, 15 nt, Human
gccugcaagggagug

SEQ ID NO: 1665617 - RNA, 21 nt, Human
gccucacaguccuuaccagca

SEQ ID NO: 1665618 - RNA, 18 nt, Human
gccucacaguccuuacca

SEQ ID NO: 1665619 - RNA, 15 nt, Human
gccucagcauccugg

SEQ ID NO: 1665620 - RNA, 16 nt, Human
gccucagcauccuggc

SEQ ID NO: 1665621 - RNA, 17 nt, Human
gccucagcauccuggca

SEQ ID NO: 1665622 - RNA, 18 nt, Human
gccucccaaagugcuggg

SEQ ID NO: 1665623 - RNA, 19 nt, Human
gccucccaaagugcuggga

SEQ ID NO: 1665624 - RNA, 13 nt, Human
gccucccaacuca

SEQ ID NO: 1665625 - RNA, 14 nt, Human
gccucccaucaccc

SEQ ID NO: 1665626 - RNA, 16 nt, Human
gccucccaucacccgc

SEQ ID NO: 1665627 - RNA, 16 nt, Human
gccucccaacucaccc

SEQ ID NO: 1665628 - RNA, 17 nt, Human
gccucccaacucacccc

SEQ ID NO: 1665629 - RNA, 18 nt, Human
gccucccaacucacccca

SEQ ID NO: 1665630 - RNA, 19 nt, Human
gccucccaacucaccccag

SEQ ID NO: 1665631 - RNA, 20 nt, Human
gccucccgaguagcugggac

SEQ ID NO: 1665632 - RNA, 18 nt, Human
gccucccgaguagcuggg

SEQ ID NO: 1665633 - RNA, 19 nt, Human
gccucccgaguagcuggga

SEQ ID NO: 1665634 - RNA, 23 nt, Human
gccuccccuccucugcuugccau

SEQ ID NO: 1665635 - RNA, 22 nt, Human
gccuccccuccucugcuugcca

SEQ ID NO: 1665636 - RNA, 20 nt, Human
gccuccccuccucugcuugc

SEQ ID NO: 1665637 - RNA, 17 nt, Human
gccucccaucacccgcu

SEQ ID NO: 1665638 - RNA, 19 nt, Human
gccuccccuccucugcuug

SEQ ID NO: 1665639 - RNA, 17 nt, Human
gccuccccuccucugcu

SEQ ID NO: 1665640 - RNA, 21 nt, Human
gcuaagagggagggagggcuc

SEQ ID NO: 1665641 - RNA, 20 nt, Human
gcuaagagggagggagggcu

SEQ ID NO: 1665642 - RNA, 20 nt, Human
gcuacacacugcauguuugu

SEQ ID NO: 1665643 - RNA, 13 nt, Human
gcuacacacugca

SEQ ID NO: 1665644 - RNA, 22 nt, Human
gcuacacaggggaaaagaggag

SEQ ID NO: 1665645 - RNA, 14 nt, Human
gcuacacaggggaa

SEQ ID NO: 1665646 - RNA, 13 nt, Human
gcuaaacuuuucu

SEQ ID NO: 1665647 - RNA, 15 nt, Human
gcuaaacuuuucuga

SEQ ID NO: 1665648 - RNA, 17 nt, Human
gcuaaacuuuucugaua

SEQ ID NO: 1665649 - RNA, 13 nt, Human
gcuaagagggagg

SEQ ID NO: 1665650 - RNA, 20 nt, Human
gcuaccuuuguauucucucc

SEQ ID NO: 1665651 - RNA, 16 nt, Human
gcuaccuuuguauucu

SEQ ID NO: 1665652 - RNA, 19 nt, Human
gcuagaacucccuuucaac

SEQ ID NO: 1665653 - RNA, 19 nt, Human
gcuaggaaauccagggugg

SEQ ID NO: 1665654 - RNA, 15 nt, Human
gcuaggaacacuccu

SEQ ID NO: 1665655 - RNA, 22 nt, Human
gcuaggaaauccaggguggugg

SEQ ID NO: 1665656 - RNA, 16 nt, Human
gcuaggaacacuccuu

SEQ ID NO: 1665657 - RNA, 13 nt, Human
gcuauaggugcua

SEQ ID NO: 1665658 - RNA, 13 nt, Human
gcgggucacagga

SEQ ID NO: 1665659 - RNA, 15 nt, Human
gcgggucacaggagg

SEQ ID NO: 1665660 - RNA, 16 nt, Human
gcggacagccacggcc

SEQ ID NO: 1665661 - RNA, 15 nt, Human
gcggacagccacggc

SEQ ID NO: 1665662 - RNA, 19 nt, Human
gcgggucacaggagggagg

SEQ ID NO: 1665663 - RNA, 20 nt, Human
gcgggucacaggagggaggg

SEQ ID NO: 1665664 - RNA, 19 nt, Human
gcgucucauacucaccuca

SEQ ID NO: 1665665 - RNA, 11 nt, Human
gcggacagcca

SEQ ID NO: 1665666 - RNA, 13 nt, Human
gcggacagccacg

SEQ ID NO: 1665667 - RNA, 18 nt, Human
gcgccuacaggagugagc

SEQ ID NO: 1665668 - RNA, 15 nt, Human
gcgccuacaggagug

SEQ ID NO: 1665669 - RNA, 22 nt, Human
gcgacagugagacucugucuca

SEQ ID NO: 1665670 - RNA, 12 nt, Human
gcgacagugaga

SEQ ID NO: 1665671 - RNA, 22 nt, Human
gccuuuggaaacagcucgacuu

SEQ ID NO: 1665672 - RNA, 13 nt, Human
gccuuuggcuuca

SEQ ID NO: 1665673 - RNA, 23 nt, Human
gcgacaaugcaaaccaucauuga

SEQ ID NO: 1665674 - RNA, 23 nt, Human
gccuucgauacaccgggccugga

SEQ ID NO: 1665675 - RNA, 18 nt, Human
gccuucgauacaccgggc

SEQ ID NO: 1665676 - RNA, 22 nt, Human
gccuucgauacaccgggccugg

SEQ ID NO: 1665677 - RNA, 15 nt, Human
gccuuccaggggugg

SEQ ID NO: 1665678 - RNA, 16 nt, Human
gccuuccagggguggg

SEQ ID NO: 1665679 - RNA, 21 nt, Human
gccuuccaggggugggacacc

SEQ ID NO: 1665680 - RNA, 13 nt, Human
gccuucagggagu

SEQ ID NO: 1665681 - RNA, 21 nt, Human
gccuucagggagugagggauu

SEQ ID NO: 1665682 - RNA, 13 nt, Human
gccuucaucuccc

SEQ ID NO: 1665683 - RNA, 12 nt, Human
gccuuccagggg

SEQ ID NO: 1665684 - RNA, 16 nt, Human
gccuuauggaacacuc

SEQ ID NO: 1665685 - RNA, 18 nt, Human
gccuuauggaacacucug

SEQ ID NO: 1665686 - RNA, 19 nt, Human
gccuuauggaacacucuga

SEQ ID NO: 1665687 - RNA, 20 nt, Human
gccuuauggaacacucugag

SEQ ID NO: 1665688 - RNA, 12 nt, Human
gccuguuuaaga

SEQ ID NO: 1665689 - RNA, 13 nt, Human
gccuguuuaagag

SEQ ID NO: 1665690 - RNA, 18 nt, Human
gccuuacccucauguucu

SEQ ID NO: 1665691 - RNA, 21 nt, Human
gccuuacacaaugguuuucuu

SEQ ID NO: 1665692 - RNA, 20 nt, Human
gccuuacacaaugguuuucu

SEQ ID NO: 1665693 - RNA, 19 nt, Human
gccuuacccucauguucuu

SEQ ID NO: 1665694 - RNA, 19 nt, Human
gccuuagaagucacacagu

SEQ ID NO: 1665695 - RNA, 17 nt, Human
gccuuagaagucacaca

SEQ ID NO: 1665696 - RNA, 18 nt, Human
gccuuagaagucacacag

SEQ ID NO: 1665697 - RNA, 10 nt, Human
gccuuaugga

SEQ ID NO: 1665698 - RNA, 14 nt, Human
gccuuauggaacac

SEQ ID NO: 1665699 - RNA, 13 nt, Human
gccugguggcagc

SEQ ID NO: 1665700 - RNA, 14 nt, Human
gccugguggcagcu

SEQ ID NO: 1665701 - RNA, 18 nt, Human
gccugguggcagcugcgg

SEQ ID NO: 1665702 - RNA, 19 nt, Human
gccugguggcagcugcggu

SEQ ID NO: 1665703 - RNA, 21 nt, Human
gccugguggcagcugcggucc

SEQ ID NO: 1665704 - RNA, 22 nt, Human
gccugggggcugggcagaggaa

SEQ ID NO: 1665705 - RNA, 19 nt, Human
gauuccagagaguggcucc

SEQ ID NO: 1665706 - RNA, 20 nt, Human
gauuccagagaguggcuccu

SEQ ID NO: 1665707 - RNA, 22 nt, Human
gauuccagagaguggcuccucc

SEQ ID NO: 1665708 - RNA, 17 nt, Human
gauucauauuuacuucu

SEQ ID NO: 1665709 - RNA, 18 nt, Human
gauucauauuuacuucuu

SEQ ID NO: 1665710 - RNA, 19 nt, Human
gauucauauuuacuucuua

SEQ ID NO: 1665711 - RNA, 19 nt, Human
gauucagacagcugccugg

SEQ ID NO: 1665712 - RNA, 13 nt, Human
gauucagcucugc

SEQ ID NO: 1665713 - RNA, 15 nt, Human
gauucagcucugcaa

SEQ ID NO: 1665714 - RNA, 23 nt, Human
gauggggcugcaccggcuggccu

SEQ ID NO: 1665715 - RNA, 21 nt, Human
gauucccaagcucugcuccuc

SEQ ID NO: 1665716 - RNA, 19 nt, Human
gauucccaagcucugcucc

SEQ ID NO: 1665717 - RNA, 20 nt, Human
gauucccaagcucugcuccu

SEQ ID NO: 1665718 - RNA, 12 nt, Human
gauucuuuccug

SEQ ID NO: 1665719 - RNA, 21 nt, Human
gauugcaacaggcugggcuuc

SEQ ID NO: 1665720 - RNA, 16 nt, Human
gauugcaccacugcac

SEQ ID NO: 1665721 - RNA, 23 nt, Human
gauugcaccacugcacuccagcc

SEQ ID NO: 1665722 - RNA, 16 nt, Human
gauucuuuccugaggc

SEQ ID NO: 1665723 - RNA, 17 nt, Human
gauucuuuccugaggcu

SEQ ID NO: 1665724 - RNA, 18 nt, Human
gauucuuuccugaggcug

SEQ ID NO: 1665725 - RNA, 20 nt, Human
gauugcaacaggcugggcuu

SEQ ID NO: 1665726 - RNA, 18 nt, Human
gauuuccguuaaaauacc

SEQ ID NO: 1665727 - RNA, 15 nt, Human
gauuuccguuaaaau

SEQ ID NO: 1665728 - RNA, 22 nt, Human
gauuuggucaacacuaacauga

SEQ ID NO: 1665729 - RNA, 19 nt, Human
gauuucuguuuagauaaua

SEQ ID NO: 1665730 - RNA, 11 nt, Human
gauuucuguuu

SEQ ID NO: 1665731 - RNA, 13 nt, Human
gauuuuauuaugu

SEQ ID NO: 1665732 - RNA, 15 nt, Human
gauuuuauuauguaa

SEQ ID NO: 1665733 - RNA, 18 nt, Human
gauuuuauuauguaaauc

SEQ ID NO: 1665734 - RNA, 19 nt, Human
gauuuuauuauguaaaucc

SEQ ID NO: 1665735 - RNA, 20 nt, Human
gauuuuauuauguaaauccc

SEQ ID NO: 1665736 - RNA, 23 nt, Human
gauuuuauuauguaaaucccauu

SEQ ID NO: 1665737 - RNA, 19 nt, Human
gauuuguuaaugauagcua

SEQ ID NO: 1665738 - RNA, 14 nt, Human
gauuuuaugcuuua

SEQ ID NO: 1665739 - RNA, 19 nt, Human
gauuuuaugcuuuaaacau

SEQ ID NO: 1665740 - RNA, 15 nt, Human
gauuuuccugaaaac

SEQ ID NO: 1665741 - RNA, 14 nt, Human
gcaaggucauuuuu

SEQ ID NO: 1665742 - RNA, 15 nt, Human
gcaaucaaaucugcu

SEQ ID NO: 1665743 - RNA, 17 nt, Human
gcaaucaaaucugcuuu

SEQ ID NO: 1665744 - RNA, 17 nt, Human
gcaaugaccuuucaaua

SEQ ID NO: 1665745 - RNA, 20 nt, Human
gcaaugaccuuucaauagga

SEQ ID NO: 1665746 - RNA, 22 nt, Human
gcaaugaccuuucaauaggaaa

SEQ ID NO: 1665747 - RNA, 23 nt, Human
gcaaugaccuuucaauaggaaaa

SEQ ID NO: 1665748 - RNA, 13 nt, Human
gcaaugcuggcug

SEQ ID NO: 1665749 - RNA, 14 nt, Human
gcaaugcuggcugu

SEQ ID NO: 1665750 - RNA, 22 nt, Human
gcaaugcuggcuguuggcuggg

SEQ ID NO: 1665751 - RNA, 23 nt, Human
gcaaugcuggcuguuggcugggg

SEQ ID NO: 1665752 - RNA, 11 nt, Human
gcaaggcuguc

SEQ ID NO: 1665753 - RNA, 13 nt, Human
gcaaggcugucaa

SEQ ID NO: 1665754 - RNA, 14 nt, Human
gcaagggugauggg

SEQ ID NO: 1665755 - RNA, 18 nt, Human
gcaaggagauuuacaacu

SEQ ID NO: 1665756 - RNA, 10 nt, Human
gcaagccaga

SEQ ID NO: 1665757 - RNA, 17 nt, Human
gcaagaauugaagcagg

SEQ ID NO: 1665758 - RNA, 23 nt, Human
gcaagacgcugugcugcccugcc

SEQ ID NO: 1665759 - RNA, 14 nt, Human
gcaagacgcugugc

SEQ ID NO: 1665760 - RNA, 20 nt, Human
gcaagacgcugugcugcccu

SEQ ID NO: 1665761 - RNA, 21 nt, Human
gcaagacgcugugcugcccug

SEQ ID NO: 1665762 - RNA, 22 nt, Human
gcaagacgcugugcugcccugc

SEQ ID NO: 1665763 - RNA, 16 nt, Human
gcaaaguaucccuacu

SEQ ID NO: 1665764 - RNA, 21 nt, Human
gcaaagcccagcuugaaaccu

SEQ ID NO: 1665765 - RNA, 13 nt, Human
gcaaagcccagcu

SEQ ID NO: 1665766 - RNA, 23 nt, Human
gcaaagcacugacuucuaaguaa

SEQ ID NO: 1665767 - RNA, 14 nt, Human
gaucauugugaaau

SEQ ID NO: 1665768 - RNA, 20 nt, Human
gaucauugugaaauuauuca

SEQ ID NO: 1665769 - RNA, 20 nt, Human
gauccccaagccuggcaagg

SEQ ID NO: 1665770 - RNA, 17 nt, Human
gaucauccacugugcca

SEQ ID NO: 1665771 - RNA, 19 nt, Human
gaucauccacugugccaug

SEQ ID NO: 1665772 - RNA, 21 nt, Human
gaucauccacugugccaugug

SEQ ID NO: 1665773 - RNA, 12 nt, Human
gaucacggcuca

SEQ ID NO: 1665774 - RNA, 22 nt, Human
gaucagucugauucccaagcuc

SEQ ID NO: 1665775 - RNA, 12 nt, Human
gaucagccuggg

SEQ ID NO: 1665776 - RNA, 15 nt, Human
gaucagccugggcaa

SEQ ID NO: 1665777 - RNA, 21 nt, Human
gaucaaguuauuuuuaauuug

SEQ ID NO: 1665778 - RNA, 18 nt, Human
gaucacgccacugcacua

SEQ ID NO: 1665779 - RNA, 22 nt, Human
gauaauacaccacuacauucug

SEQ ID NO: 1665780 - RNA, 21 nt, Human
gauaauacaccacuacauucu

SEQ ID NO: 1665781 - RNA, 18 nt, Human
gauaauacaccacuacau

SEQ ID NO: 1665782 - RNA, 14 nt, Human
gauaauacaccacu

SEQ ID NO: 1665783 - RNA, 19 nt, Human
gauacaccgggccuggaga

SEQ ID NO: 1665784 - RNA, 11 nt, Human
gauacagaaaa

SEQ ID NO: 1665785 - RNA, 23 nt, Human
gauagauaggucagugcaaauac

SEQ ID NO: 1665786 - RNA, 18 nt, Human
gauacaggaaaagcugcu

SEQ ID NO: 1665787 - RNA, 19 nt, Human
gauacaggaaaagcugcug

SEQ ID NO: 1665788 - RNA, 21 nt, Human
gauagcacagacccugcccug

SEQ ID NO: 1665789 - RNA, 22 nt, Human
gauagcacagacccugcccugu

SEQ ID NO: 1665790 - RNA, 13 nt, Human
gauagcagggcau

SEQ ID NO: 1665791 - RNA, 19 nt, Human
gauaaaguugguaaaccuu

SEQ ID NO: 1665792 - RNA, 13 nt, Human
gaggaaggaaacc

SEQ ID NO: 1665793 - RNA, 19 nt, Human
gaggaaggaaacccagcuc

SEQ ID NO: 1665794 - RNA, 20 nt, Human
gaggaaggaaacccagcucu

SEQ ID NO: 1665795 - RNA, 21 nt, Human
gaggaaggaaacccagcucug

SEQ ID NO: 1665796 - RNA, 22 nt, Human
gauaaauaguuuaugauuccac

SEQ ID NO: 1665797 - RNA, 15 nt, Human
gaucccucauccuca

SEQ ID NO: 1665798 - RNA, 16 nt, Human
gaucccucauccucau

SEQ ID NO: 1665799 - RNA, 21 nt, Human
gauccugagccagauuucacu

SEQ ID NO: 1665800 - RNA, 22 nt, Human
gauccugagccagauuucacuc

SEQ ID NO: 1665801 - RNA, 13 nt, Human
gauccuggaaauc

SEQ ID NO: 1665802 - RNA, 18 nt, Human
gaucuuugcagacaggca

SEQ ID NO: 1665803 - RNA, 14 nt, Human
gaugaaaauauuug

SEQ ID NO: 1665804 - RNA, 22 nt, Human
gauggauuuccagccaaagccu

SEQ ID NO: 1665805 - RNA, 20 nt, Human
gaugccugguggcagcugcg

SEQ ID NO: 1665806 - RNA, 18 nt, Human
gaugccugguggcagcug

SEQ ID NO: 1665807 - RNA, 19 nt, Human
gaugccugguggcagcugc

SEQ ID NO: 1665808 - RNA, 20 nt, Human
gauggcugugccucugccug

SEQ ID NO: 1665809 - RNA, 13 nt, Human
gauggggcccugc

SEQ ID NO: 1665810 - RNA, 14 nt, Human
gauggggcccugcc

SEQ ID NO: 1665811 - RNA, 22 nt, Human
gauggggcccugccuccuuugu

SEQ ID NO: 1665812 - RNA, 13 nt, Human
gauggcugugccu

SEQ ID NO: 1665813 - RNA, 17 nt, Human
gauggcugugccucugc

SEQ ID NO: 1665814 - RNA, 18 nt, Human
gauggcugugccucugcc

SEQ ID NO: 1665815 - RNA, 19 nt, Human
gauggcugugccucugccu

SEQ ID NO: 1665816 - RNA, 21 nt, Human
gauggcuaguaucaaaagaaa

SEQ ID NO: 1665817 - RNA, 19 nt, Human
gaugcagccucacaguccu

SEQ ID NO: 1665818 - RNA, 14 nt, Human
gaugcagccucaca

SEQ ID NO: 1665819 - RNA, 12 nt, Human
gaugcagccuca

SEQ ID NO: 1665820 - RNA, 20 nt, Human
gaugccaaguuguuugagaa

SEQ ID NO: 1665821 - RNA, 14 nt, Human
gaugcaccagcccu

SEQ ID NO: 1665822 - RNA, 13 nt, Human
gaugcaccagccc

SEQ ID NO: 1665823 - RNA, 22 nt, Human
gaugcacagaguuguuacauuu

SEQ ID NO: 1665824 - RNA, 21 nt, Human
gaugcacagaguuguuacauu

SEQ ID NO: 1665825 - RNA, 18 nt, Human
gcacggugaauggcuuug

SEQ ID NO: 1665826 - RNA, 12 nt, Human
gcacgauuucug

SEQ ID NO: 1665827 - RNA, 19 nt, Human
gcaccuuagacagucccug

SEQ ID NO: 1665828 - RNA, 18 nt, Human
gcaccuuagacagucccu

SEQ ID NO: 1665829 - RNA, 21 nt, Human
gcaccuggaauauauaaccag

SEQ ID NO: 1665830 - RNA, 18 nt, Human
gcaccuggaauauauaac

SEQ ID NO: 1665831 - RNA, 15 nt, Human
gcacccucaggcagg

SEQ ID NO: 1665832 - RNA, 22 nt, Human
gcaccuggaauauauaaccagu

SEQ ID NO: 1665833 - RNA, 14 nt, Human
gcaccuuagacagu

SEQ ID NO: 1665834 - RNA, 17 nt, Human
gcaccuuagacaguccc

SEQ ID NO: 1665835 - RNA, 16 nt, Human
gcaccagcagccugga

SEQ ID NO: 1665836 - RNA, 22 nt, Human
gcacccaccaucaugucuggcu

SEQ ID NO: 1665837 - RNA, 19 nt, Human
gcacccggccccugcuggu

SEQ ID NO: 1665838 - RNA, 15 nt, Human
gcaccagcagccugg

SEQ ID NO: 1665839 - RNA, 21 nt, Human
gcaccacugcacuccagccug

SEQ ID NO: 1665840 - RNA, 22 nt, Human
gcaccacugcacuccagccugg

SEQ ID NO: 1665841 - RNA, 12 nt, Human
gcaauggcagcc

SEQ ID NO: 1665842 - RNA, 13 nt, Human
gcaauggcagccu

SEQ ID NO: 1665843 - RNA, 14 nt, Human
gcaauggcagccuu

SEQ ID NO: 1665844 - RNA, 23 nt, Human
gcagacaggcaagcaccuccugc

SEQ ID NO: 1665845 - RNA, 18 nt, Human
gcagacaggaccagggau

SEQ ID NO: 1665846 - RNA, 19 nt, Human
gcagacaggcaagcaccuc

SEQ ID NO: 1665847 - RNA, 12 nt, Human
gcagacaggacc

SEQ ID NO: 1665848 - RNA, 13 nt, Human
gcagacaggacca

SEQ ID NO: 1665849 - RNA, 15 nt, Human
gcagacaggaccagg

SEQ ID NO: 1665850 - RNA, 16 nt, Human
gcacugcuuccaguga

SEQ ID NO: 1665851 - RNA, 18 nt, Human
gcacugcuuccagugagg

SEQ ID NO: 1665852 - RNA, 22 nt, Human
gcacugguggcccgacagccug

SEQ ID NO: 1665853 - RNA, 23 nt, Human
gcacugguggcccgacagccugg

SEQ ID NO: 1665854 - RNA, 24 nt, Human
gcacugguggcccgacagccuggc

SEQ ID NO: 1665855 - RNA, 12 nt, Human
gcacugcugccc

SEQ ID NO: 1665856 - RNA, 22 nt, Human
gcacugcuuccagugaggcucu

SEQ ID NO: 1665857 - RNA, 20 nt, Human
gcacugcuuccagugaggcu

SEQ ID NO: 1665858 - RNA, 18 nt, Human
gcacgguggugaggcagu

SEQ ID NO: 1665859 - RNA, 13 nt, Human
gcagcccugcuuu

SEQ ID NO: 1665860 - RNA, 14 nt, Human
gcagcccugcagag

SEQ ID NO: 1665861 - RNA, 15 nt, Human
gcagcccugcagagg

SEQ ID NO: 1665862 - RNA, 16 nt, Human
gcagcccugcagaggg

SEQ ID NO: 1665863 - RNA, 17 nt, Human
gcagcccugcagagggc

SEQ ID NO: 1665864 - RNA, 15 nt, Human
gcagcucaccucucc

SEQ ID NO: 1665865 - RNA, 15 nt, Human
gcagccuuggcaaac

SEQ ID NO: 1665866 - RNA, 14 nt, Human
gcagcucaccucuc

SEQ ID NO: 1665867 - RNA, 20 nt, Human
gcaggaaggcugagaggaga

SEQ ID NO: 1665868 - RNA, 23 nt, Human
gcaggaggaucacuugaguccag

SEQ ID NO: 1665869 - RNA, 12 nt, Human
gcaggcagccag

SEQ ID NO: 1665870 - RNA, 13 nt, Human
gcaggcagccagg

SEQ ID NO: 1665871 - RNA, 14 nt, Human
gcaggcagccaggc

SEQ ID NO: 1665872 - RNA, 18 nt, Human
gcagauuauucacugauu

SEQ ID NO: 1665873 - RNA, 22 nt, Human
gcagauacaggaaaagcugcug

SEQ ID NO: 1665874 - RNA, 17 nt, Human
gcagacaguuaagagaa

SEQ ID NO: 1665875 - RNA, 21 nt, Human
gcagaguugaagacagagcua

SEQ ID NO: 1665876 - RNA, 18 nt, Human
gcagauaaacaguaguga

SEQ ID NO: 1665877 - RNA, 17 nt, Human
gcagccccauucugccu

SEQ ID NO: 1665878 - RNA, 23 nt, Human
gcagcaauaaagcagcguuucua

SEQ ID NO: 1665879 - RNA, 16 nt, Human
gcagcaauaaagcagc

SEQ ID NO: 1665880 - RNA, 18 nt, Human
gcagccccauucugccug

SEQ ID NO: 1665881 - RNA, 19 nt, Human
gcagccccauucugccugc

SEQ ID NO: 1665882 - RNA, 21 nt, Human
gcagccccauucugccugccc

SEQ ID NO: 1665883 - RNA, 24 nt, Human
gcagccccauucugccugcccagg

SEQ ID NO: 1665884 - RNA, 13 nt, Human
gcagcccugcaga

SEQ ID NO: 1665885 - RNA, 20 nt, Human
gcagccccuguucuggcaga

SEQ ID NO: 1665886 - RNA, 21 nt, Human
gcagccccuguucuggcagag

SEQ ID NO: 1665887 - RNA, 20 nt, Human
gcagccccgugggguuccuc

SEQ ID NO: 1665888 - RNA, 19 nt, Human
gcauucaaauguauuacag

SEQ ID NO: 1665889 - RNA, 19 nt, Human
gcauuaucuagauacugua

SEQ ID NO: 1665890 - RNA, 17 nt, Human
gcauuaucuagauacug

SEQ ID NO: 1665891 - RNA, 16 nt, Human
gcauuuguguugaaga

SEQ ID NO: 1665892 - RNA, 16 nt, Human
gcauuuguuugaacug

SEQ ID NO: 1665893 - RNA, 14 nt, Human
gcauuugcugaaua

SEQ ID NO: 1665894 - RNA, 17 nt, Human
gcauuugcugaauacag

SEQ ID NO: 1665895 - RNA, 13 nt, Human
gcauuugcugaau

SEQ ID NO: 1665896 - RNA, 18 nt, Human
gcauuuguuugaacugau

SEQ ID NO: 1665897 - RNA, 14 nt, Human
gccaaacucaccug

SEQ ID NO: 1665898 - RNA, 16 nt, Human
gccaaacucaccugcc

SEQ ID NO: 1665899 - RNA, 13 nt, Human
gccaaagccaaag

SEQ ID NO: 1665900 - RNA, 20 nt, Human
gccaaagccaaagcuaggcc

SEQ ID NO: 1665901 - RNA, 16 nt, Human
gccaaagccuccucca

SEQ ID NO: 1665902 - RNA, 19 nt, Human
gccaaagccuccuccagcc

SEQ ID NO: 1665903 - RNA, 16 nt, Human
gccaaagcuaggccug

SEQ ID NO: 1665904 - RNA, 22 nt, Human
gccaaagcuaggccuggccaga

SEQ ID NO: 1665905 - RNA, 12 nt, Human
gccaaaggaagc

SEQ ID NO: 1665906 - RNA, 18 nt, Human
gcaugaaguaauaugcac

SEQ ID NO: 1665907 - RNA, 16 nt, Human
gcaucugaaaauugau

SEQ ID NO: 1665908 - RNA, 12 nt, Human
gcaucagcugcu

SEQ ID NO: 1665909 - RNA, 18 nt, Human
gcaugcgggcuuccuccu

SEQ ID NO: 1665910 - RNA, 20 nt, Human
gcauggcaaggacugcaggg

SEQ ID NO: 1665911 - RNA, 15 nt, Human
gcauguucucugagg

SEQ ID NO: 1665912 - RNA, 21 nt, Human
gcauguucucugaggacacua

SEQ ID NO: 1665913 - RNA, 22 nt, Human
gcauguucucugaggacacuaa

SEQ ID NO: 1665914 - RNA, 13 nt, Human
gcauuauauuuau

SEQ ID NO: 1665915 - RNA, 15 nt, Human
gcagugcaugcuguc

SEQ ID NO: 1665916 - RNA, 16 nt, Human
gcagugcaugcugucc

SEQ ID NO: 1665917 - RNA, 22 nt, Human
gcagguccaggguuugaguuca

SEQ ID NO: 1665918 - RNA, 19 nt, Human
gcaggucuugaacuccugg

SEQ ID NO: 1665919 - RNA, 20 nt, Human
gcaggucuugaacuccuggc

SEQ ID NO: 1665920 - RNA, 22 nt, Human
gcagggcucagcggggacagcu

SEQ ID NO: 1665921 - RNA, 17 nt, Human
gcagggucucacucugu

SEQ ID NO: 1665922 - RNA, 18 nt, Human
gcagggucucacucuguc

SEQ ID NO: 1665923 - RNA, 15 nt, Human
gcaggcagccaggcc

SEQ ID NO: 1665924 - RNA, 16 nt, Human
gcaggcagccaggcca

SEQ ID NO: 1665925 - RNA, 19 nt, Human
gcagggcucagcggggaca

SEQ ID NO: 1665926 - RNA, 21 nt, Human
gcagggcucagcggggacagc

SEQ ID NO: 1665927 - RNA, 23 nt, Human
gcaguggugguuuucuguucuuu

SEQ ID NO: 1665928 - RNA, 13 nt, Human
gcagugggagcug

SEQ ID NO: 1665929 - RNA, 14 nt, Human
gcagugggagcugc

SEQ ID NO: 1665930 - RNA, 15 nt, Human
gcagugggagcugcc

SEQ ID NO: 1665931 - RNA, 13 nt, Human
gcauagaaguaaa

SEQ ID NO: 1665932 - RNA, 17 nt, Human
gcaguucugaagaagau

SEQ ID NO: 1665933 - RNA, 18 nt, Human
gcaguucagagcugcccu

SEQ ID NO: 1665934 - RNA, 17 nt, Human
gcaguucagagcugccc

SEQ ID NO: 1665935 - RNA, 15 nt, Human
gcaguucugaagaag

SEQ ID NO: 1665936 - RNA, 17 nt, Human
gcaguuauuaacacuaa

SEQ ID NO: 1665937 - RNA, 16 nt, Human
gcaguucagagcugcc

SEQ ID NO: 1665938 - RNA, 17 nt, Human
gcauagguuuaauaauu

SEQ ID NO: 1665939 - RNA, 15 nt, Human
gcaguugaaaagacu

SEQ ID NO: 1665940 - RNA, 17 nt, Human
gacaccuacugaguggc

SEQ ID NO: 1665941 - RNA, 22 nt, Human
gacacccugugauggggcccug

SEQ ID NO: 1665942 - RNA, 23 nt, Human
gacacccugugauggggcccugc

SEQ ID NO: 1665943 - RNA, 12 nt, Human
gacacccuguga

SEQ ID NO: 1665944 - RNA, 13 nt, Human
gacacccugugau

SEQ ID NO: 1665945 - RNA, 17 nt, Human
gacacagugaccauacu

SEQ ID NO: 1665946 - RNA, 18 nt, Human
gacacaggcccggcucca

SEQ ID NO: 1665947 - RNA, 15 nt, Human
gacacgaauauugcu

SEQ ID NO: 1665948 - RNA, 18 nt, Human
gacaccuugacagggcac

SEQ ID NO: 1665949 - RNA, 20 nt, Human
gacaccuugacagggcacac

SEQ ID NO: 1665950 - RNA, 15 nt, Human
gacaccuugacaggg

SEQ ID NO: 1665951 - RNA, 17 nt, Human
gacaccuugacagggca

SEQ ID NO: 1665952 - RNA, 19 nt, Human
gacacgaauauugcugaug

SEQ ID NO: 1665953 - RNA, 17 nt, Human
gacacgaauauugcuga

SEQ ID NO: 1665954 - RNA, 18 nt, Human
gacacgaauauugcugau

SEQ ID NO: 1665955 - RNA, 15 nt, Human
gacacuaaccacgcu

SEQ ID NO: 1665956 - RNA, 16 nt, Human
gacacuaaccacgcug

SEQ ID NO: 1665957 - RNA, 17 nt, Human
gacacuaaccacgcugg

SEQ ID NO: 1665958 - RNA, 18 nt, Human
gacacuaaccacgcugga

SEQ ID NO: 1665959 - RNA, 12 nt, Human
gacaauuuauua

SEQ ID NO: 1665960 - RNA, 16 nt, Human
gacaaugcaaaccauc

SEQ ID NO: 1665961 - RNA, 18 nt, Human
gacaaugcaaaccaucau

SEQ ID NO: 1665962 - RNA, 21 nt, Human
gacaaugacuuacuguacaug

SEQ ID NO: 1665963 - RNA, 12 nt, Human
gacaaugcaaac

SEQ ID NO: 1665964 - RNA, 20 nt, Human
gacaaugacuuacuguacau

SEQ ID NO: 1665965 - RNA, 17 nt, Human
gacaaugacuuacugua

SEQ ID NO: 1665966 - RNA, 19 nt, Human
gacaauuuauuauggcaca

SEQ ID NO: 1665967 - RNA, 13 nt, Human
gacaauuuauuau

SEQ ID NO: 1665968 - RNA, 13 nt, Human
gacacacagcucu

SEQ ID NO: 1665969 - RNA, 15 nt, Human
gacacaggcccggcu

SEQ ID NO: 1665970 - RNA, 17 nt, Human
gacacaggcccggcucc

SEQ ID NO: 1665971 - RNA, 16 nt, Human
gacaaugacccagugg

SEQ ID NO: 1665972 - RNA, 14 nt, Human
gaagucuuuguaca

SEQ ID NO: 1665973 - RNA, 16 nt, Human
gaagucuuuguacaga

SEQ ID NO: 1665974 - RNA, 22 nt, Human
gacaaggauugcuacuguccua

SEQ ID NO: 1665975 - RNA, 15 nt, Human
gacaagcucacagac

SEQ ID NO: 1665976 - RNA, 14 nt, Human
gacaggcaaugcug

SEQ ID NO: 1665977 - RNA, 16 nt, Human
gacaggcaaugcuggc

SEQ ID NO: 1665978 - RNA, 17 nt, Human
gacaggcaaugcuggcu

SEQ ID NO: 1665979 - RNA, 18 nt, Human
gacaggcaaugcuggcug

SEQ ID NO: 1665980 - RNA, 18 nt, Human
gacaggcauguucucuga

SEQ ID NO: 1665981 - RNA, 19 nt, Human
gacaggcauguucucugag

SEQ ID NO: 1665982 - RNA, 14 nt, Human
gacagcugccuggg

SEQ ID NO: 1665983 - RNA, 15 nt, Human
gacagcugccuggga

SEQ ID NO: 1665984 - RNA, 19 nt, Human
gacagccaacuauggccug

SEQ ID NO: 1665985 - RNA, 22 nt, Human
gacagccaacuauggccugugg

SEQ ID NO: 1665986 - RNA, 13 nt, Human
gacagccacggcc

SEQ ID NO: 1665987 - RNA, 12 nt, Human
gacagcugccug

SEQ ID NO: 1665988 - RNA, 13 nt, Human
gacagcugccugg

SEQ ID NO: 1665989 - RNA, 14 nt, Human
gacagacacaggcc

SEQ ID NO: 1665990 - RNA, 20 nt, Human
gacacuaaccacgcuggacc

SEQ ID NO: 1665991 - RNA, 21 nt, Human
gacacuaaccacgcuggaccu

SEQ ID NO: 1665992 - RNA, 19 nt, Human
gacagaucucugcuuugga

SEQ ID NO: 1665993 - RNA, 21 nt, Human
gacagaucucugcuuuggaaa

SEQ ID NO: 1665994 - RNA, 23 nt, Human
gacagaucucugcuuuggaaauc

SEQ ID NO: 1665995 - RNA, 15 nt, Human
gacagacacaggccc

SEQ ID NO: 1665996 - RNA, 16 nt, Human
gacagacacaggcccg

SEQ ID NO: 1665997 - RNA, 20 nt, Human
gacaggcauguucucugagg

SEQ ID NO: 1665998 - RNA, 16 nt, Human
gacauacuaaccagca

SEQ ID NO: 1665999 - RNA, 15 nt, Human
gacauacuaaccagc

SEQ ID NO: 1666000 - RNA, 16 nt, Human
gacauagucuggcugu

SEQ ID NO: 1666001 - RNA, 23 nt, Human
gacauacuaaccagcagaaaugc

SEQ ID NO: 1666002 - RNA, 14 nt, Human
gacaucaacagaua

SEQ ID NO: 1666003 - RNA, 13 nt, Human
gaccaaaaaccag

SEQ ID NO: 1666004 - RNA, 19 nt, Human
gaccaaaaaccaguauugu

SEQ ID NO: 1666005 - RNA, 20 nt, Human
gaccaaaaaccaguauugua

SEQ ID NO: 1666006 - RNA, 21 nt, Human
gacaugucuuuucuugcauga

SEQ ID NO: 1666007 - RNA, 17 nt, Human
gacaugucuuuucuugc

SEQ ID NO: 1666008 - RNA, 17 nt, Human
gacaugggacauuugcu

SEQ ID NO: 1666009 - RNA, 22 nt, Human
gacaugggacauuugcucaugg

SEQ ID NO: 1666010 - RNA, 14 nt, Human
gacauggcuguuca

SEQ ID NO: 1666011 - RNA, 17 nt, Human
gacgggguuucaccaug

SEQ ID NO: 1666012 - RNA, 23 nt, Human
gacggagucccaccuuggcugca

SEQ ID NO: 1666013 - RNA, 21 nt, Human
gacggagucccaccuuggcug

SEQ ID NO: 1666014 - RNA, 18 nt, Human
gacggagucccaccuugg

SEQ ID NO: 1666015 - RNA, 17 nt, Human
gacguguuaugacucca

SEQ ID NO: 1666016 - RNA, 20 nt, Human
gacguguuaugacuccagaa

SEQ ID NO: 1666017 - RNA, 19 nt, Human
gaccugccucggccuccca

SEQ ID NO: 1666018 - RNA, 23 nt, Human
gaccuugaacuggguacuugugg

SEQ ID NO: 1666019 - RNA, 22 nt, Human
gaccuuuaagagaaaugagcug

SEQ ID NO: 1666020 - RNA, 21 nt, Human
gaccuuucaauaggaaaaacu

SEQ ID NO: 1666021 - RNA, 12 nt, Human
gacuacaggcac

SEQ ID NO: 1666022 - RNA, 17 nt, Human
gacuacucccccaggug

SEQ ID NO: 1666023 - RNA, 22 nt, Human
gacguguuaugacuccagaauu

SEQ ID NO: 1666024 - RNA, 15 nt, Human
gacucaguggggagg

SEQ ID NO: 1666025 - RNA, 15 nt, Human
gacucagguugucug

SEQ ID NO: 1666026 - RNA, 14 nt, Human
gacuccugcaggca

SEQ ID NO: 1666027 - RNA, 15 nt, Human
gacuccugcaggcag

SEQ ID NO: 1666028 - RNA, 16 nt, Human
gacuccugcaggcagc

SEQ ID NO: 1666029 - RNA, 19 nt, Human
gacccugaggcccagaggg

SEQ ID NO: 1666030 - RNA, 20 nt, Human
gacccugaggcccagagggc

SEQ ID NO: 1666031 - RNA, 21 nt, Human
gacccugaggcccagagggcc

SEQ ID NO: 1666032 - RNA, 13 nt, Human
gacccugcccugu

SEQ ID NO: 1666033 - RNA, 15 nt, Human
gacccugcccugugg

SEQ ID NO: 1666034 - RNA, 16 nt, Human
gacccugcccuguggg

SEQ ID NO: 1666035 - RNA, 23 nt, Human
gacccugucucaaaaaaagaaaa

SEQ ID NO: 1666036 - RNA, 22 nt, Human
gaccccucauagcccucacccu

SEQ ID NO: 1666037 - RNA, 23 nt, Human
gaccccucauagcccucacccug

SEQ ID NO: 1666038 - RNA, 13 nt, Human
gaccccuccaugu

SEQ ID NO: 1666039 - RNA, 11 nt, Human
gacccacugcu

SEQ ID NO: 1666040 - RNA, 12 nt, Human
gacccacugcuu

SEQ ID NO: 1666041 - RNA, 14 nt, Human
gacccaugcugccc

SEQ ID NO: 1666042 - RNA, 15 nt, Human
gacccaugcugcccu

SEQ ID NO: 1666043 - RNA, 16 nt, Human
gacccaugcugcccug

SEQ ID NO: 1666044 - RNA, 17 nt, Human
gacccaugcugcccugu

SEQ ID NO: 1666045 - RNA, 14 nt, Human
gaccgugaggccag

SEQ ID NO: 1666046 - RNA, 15 nt, Human
gaccgugaggccaga

SEQ ID NO: 1666047 - RNA, 17 nt, Human
gacccugcccugugggc

SEQ ID NO: 1666048 - RNA, 18 nt, Human
gaccugaggcccuucucu

SEQ ID NO: 1666049 - RNA, 21 nt, Human
gaccugaggcccuucucucca

SEQ ID NO: 1666050 - RNA, 11 nt, Human
gaccucaggcc

SEQ ID NO: 1666051 - RNA, 12 nt, Human
gaccucaggccu

SEQ ID NO: 1666052 - RNA, 13 nt, Human
gaccucaggccug

SEQ ID NO: 1666053 - RNA, 15 nt, Human
gaccugaggcccuuc

SEQ ID NO: 1666054 - RNA, 21 nt, Human
gaccugccccuccucucugcc

SEQ ID NO: 1666055 - RNA, 15 nt, Human
gaccugccucggccu

SEQ ID NO: 1666056 - RNA, 23 nt, Human
gaccugauuucugagcauuuaau

SEQ ID NO: 1666057 - RNA, 22 nt, Human
gagaaugcacaaacagaggccg

SEQ ID NO: 1666058 - RNA, 20 nt, Human
gagaaugcacaaacagaggc

SEQ ID NO: 1666059 - RNA, 21 nt, Human
gagaaugcacaaacagaggcc

SEQ ID NO: 1666060 - RNA, 13 nt, Human
gagaagaacugaa

SEQ ID NO: 1666061 - RNA, 14 nt, Human
gagaagaacugaaa

SEQ ID NO: 1666062 - RNA, 16 nt, Human
gagaagaacugaaauc

SEQ ID NO: 1666063 - RNA, 15 nt, Human
gagaagagcuguuca

SEQ ID NO: 1666064 - RNA, 22 nt, Human
gagaagagcuguucacagccag

SEQ ID NO: 1666065 - RNA, 16 nt, Human
gagacagccaacuaug

SEQ ID NO: 1666066 - RNA, 12 nt, Human
gagacagcccgg

SEQ ID NO: 1666067 - RNA, 19 nt, Human
gagacagaguuuucacucu

SEQ ID NO: 1666068 - RNA, 15 nt, Human
gagacacaagccuuc

SEQ ID NO: 1666069 - RNA, 17 nt, Human
gagacacaagccuucgg

SEQ ID NO: 1666070 - RNA, 18 nt, Human
gagacacacugaagaagc

SEQ ID NO: 1666071 - RNA, 12 nt, Human
gacuuguuagau

SEQ ID NO: 1666072 - RNA, 19 nt, Human
gacuugugacgguguaccu

SEQ ID NO: 1666073 - RNA, 21 nt, Human
gagaaaauggacguguuauga

SEQ ID NO: 1666074 - RNA, 14 nt, Human
gacuuggaagcucc

SEQ ID NO: 1666075 - RNA, 15 nt, Human
gacuuggaagcuccg

SEQ ID NO: 1666076 - RNA, 16 nt, Human
gacuuggaagcuccgc

SEQ ID NO: 1666077 - RNA, 19 nt, Human
gacucgcgacaaugcaaac

SEQ ID NO: 1666078 - RNA, 17 nt, Human
gacuccugcaggcagcc

SEQ ID NO: 1666079 - RNA, 18 nt, Human
gacucgcgacaaugcaaa

SEQ ID NO: 1666080 - RNA, 12 nt, Human
gagaaaugaaaa

SEQ ID NO: 1666081 - RNA, 14 nt, Human
gagaaauuuauaaa

SEQ ID NO: 1666082 - RNA, 23 nt, Human
gagaaaguacuucuccacccugc

SEQ ID NO: 1666083 - RNA, 16 nt, Human
gagaaacagccugugu

SEQ ID NO: 1666084 - RNA, 13 nt, Human
gagaaagacuauu

SEQ ID NO: 1666085 - RNA, 15 nt, Human
gagaaagacuauuca

SEQ ID NO: 1666086 - RNA, 17 nt, Human
gagaaagacuauucaaa

SEQ ID NO: 1666087 - RNA, 18 nt, Human
gagaaagacuauucaaac

SEQ ID NO: 1666088 - RNA, 17 nt, Human
gagagaagagaaugcac

SEQ ID NO: 1666089 - RNA, 19 nt, Human
gagagacacacugaagaag

SEQ ID NO: 1666090 - RNA, 21 nt, Human
gagagggugggagugggccca

SEQ ID NO: 1666091 - RNA, 13 nt, Human
gagaggggaacag

SEQ ID NO: 1666092 - RNA, 18 nt, Human
gagaggggaacagacugg

SEQ ID NO: 1666093 - RNA, 13 nt, Human
gagagccuuccag

SEQ ID NO: 1666094 - RNA, 14 nt, Human
gagagccuuccagg

SEQ ID NO: 1666095 - RNA, 17 nt, Human
gagauacagaauuuuau

SEQ ID NO: 1666096 - RNA, 19 nt, Human
gagagugaacaaauuuaca

SEQ ID NO: 1666097 - RNA, 15 nt, Human
gagagugaacaaauu

SEQ ID NO: 1666098 - RNA, 12 nt, Human
gagaccaucccu

SEQ ID NO: 1666099 - RNA, 16 nt, Human
gagacucgcgacaaug

SEQ ID NO: 1666100 - RNA, 18 nt, Human
gagacucgcgacaaugca

SEQ ID NO: 1666101 - RNA, 23 nt, Human
gagacugucucaagagggcacug

SEQ ID NO: 1666102 - RNA, 13 nt, Human
gagacuuguauga

SEQ ID NO: 1666103 - RNA, 22 nt, Human
gagacugucucaagagggcacu

SEQ ID NO: 1666104 - RNA, 14 nt, Human
gagacucugucuca

SEQ ID NO: 1666105 - RNA, 14 nt, Human
gagacagcccgggc

SEQ ID NO: 1666106 - RNA, 17 nt, Human
gagacagcccgggcucu

SEQ ID NO: 1666107 - RNA, 18 nt, Human
gagacagcccgggcucug

SEQ ID NO: 1666108 - RNA, 19 nt, Human
gagacagcccgggcucugc

SEQ ID NO: 1666109 - RNA, 20 nt, Human
gagacagcccgggcucugcc

SEQ ID NO: 1666110 - RNA, 21 nt, Human
gagacagcccgggcucugccu

SEQ ID NO: 1666111 - RNA, 22 nt, Human
gagacagcccgggcucugccuc

SEQ ID NO: 1666112 - RNA, 23 nt, Human
gagacagcccgggcucugccucc

SEQ ID NO: 1666113 - RNA, 15 nt, Human
gagacagcucugcau

SEQ ID NO: 1666114 - RNA, 18 nt, Human
gagacagcucugcauacu

SEQ ID NO: 1666115 - RNA, 24 nt, Human
gagacagcccgggcucugccuccc

SEQ ID NO: 1666116 - RNA, 13 nt, Human
gagacagcucugc

SEQ ID NO: 1666117 - RNA, 20 nt, Human
gagccagauuucacucuccu

SEQ ID NO: 1666118 - RNA, 13 nt, Human
gagcccaccuugg

SEQ ID NO: 1666119 - RNA, 15 nt, Human
gagcccaccuuggcu

SEQ ID NO: 1666120 - RNA, 17 nt, Human
gagcccaccuuggcuca

SEQ ID NO: 1666121 - RNA, 18 nt, Human
gagccacugcaccgggcc

SEQ ID NO: 1666122 - RNA, 19 nt, Human
gagccacugcaccgggcca

SEQ ID NO: 1666123 - RNA, 20 nt, Human
gagccacugcaccgggccac

SEQ ID NO: 1666124 - RNA, 15 nt, Human
gagccagauuucacu

SEQ ID NO: 1666125 - RNA, 18 nt, Human
gagccagauuucacucuc

SEQ ID NO: 1666126 - RNA, 19 nt, Human
gagccagauuucacucucc

SEQ ID NO: 1666127 - RNA, 21 nt, Human
gagcagccacauuccugaugc

SEQ ID NO: 1666128 - RNA, 22 nt, Human
gagcagccacauuccugaugcu

SEQ ID NO: 1666129 - RNA, 23 nt, Human
gagcagagaccaucccugaaggc

SEQ ID NO: 1666130 - RNA, 19 nt, Human
gagcagagaccaucccuga

SEQ ID NO: 1666131 - RNA, 21 nt, Human
gagcagagaccaucccugaag

SEQ ID NO: 1666132 - RNA, 20 nt, Human
gagauagccaaggccaaagg

SEQ ID NO: 1666133 - RNA, 21 nt, Human
gagauagccaaggccaaagga

SEQ ID NO: 1666134 - RNA, 17 nt, Human
gagcagagaccaucccu

SEQ ID NO: 1666135 - RNA, 18 nt, Human
gagcagagaccaucccug

SEQ ID NO: 1666136 - RNA, 16 nt, Human
gagcagagaccauccc

SEQ ID NO: 1666137 - RNA, 12 nt, Human
gagccugcaguu

SEQ ID NO: 1666138 - RNA, 13 nt, Human
gagccuccugccc

SEQ ID NO: 1666139 - RNA, 13 nt, Human
gagccucagcauc

SEQ ID NO: 1666140 - RNA, 19 nt, Human
gagccucagucucccuccc

SEQ ID NO: 1666141 - RNA, 17 nt, Human
gagccucagcauccugg

SEQ ID NO: 1666142 - RNA, 14 nt, Human
gagccucagcaucc

SEQ ID NO: 1666143 - RNA, 15 nt, Human
gagccucagcauccu

SEQ ID NO: 1666144 - RNA, 21 nt, Human
gagccgagaucacgccacugc

SEQ ID NO: 1666145 - RNA, 22 nt, Human
gagccgagaucacgccacugca

SEQ ID NO: 1666146 - RNA, 18 nt, Human
gagcccacuguacuugcu

SEQ ID NO: 1666147 - RNA, 21 nt, Human
gagcccacuguacuugcucuu

SEQ ID NO: 1666148 - RNA, 11 nt, Human
gagcccacgcc

SEQ ID NO: 1666149 - RNA, 18 nt, Human
gagcccacgcccccacug

SEQ ID NO: 1666150 - RNA, 19 nt, Human
gagccgagaucacgccacu

SEQ ID NO: 1666151 - RNA, 20 nt, Human
gagccgagaucacgccacug

SEQ ID NO: 1666152 - RNA, 15 nt, Human
gagccugcaguuauu

SEQ ID NO: 1666153 - RNA, 15 nt, Human
gagcuagcagcaggg

SEQ ID NO: 1666154 - RNA, 17 nt, Human
gagcuagcagcagggag

SEQ ID NO: 1666155 - RNA, 15 nt, Human
gagcugaguggggga

SEQ ID NO: 1666156 - RNA, 16 nt, Human
gagcucgugggacagu

SEQ ID NO: 1666157 - RNA, 17 nt, Human
gaggaagagaaaaaaua

SEQ ID NO: 1666158 - RNA, 13 nt, Human
gaggaagccgcug

SEQ ID NO: 1666159 - RNA, 18 nt, Human
gaggaagccugauuaaag

SEQ ID NO: 1666160 - RNA, 19 nt, Human
gaggaagccugauuaaaga

SEQ ID NO: 1666161 - RNA, 18 nt, Human
gaggaagccgcuggggcc

SEQ ID NO: 1666162 - RNA, 14 nt, Human
gaggaagccgcugg

SEQ ID NO: 1666163 - RNA, 17 nt, Human
gaggaagccgcuggggc

SEQ ID NO: 1666164 - RNA, 14 nt, Human
gaggaacaaggcaa

SEQ ID NO: 1666165 - RNA, 16 nt, Human
gaggaacaaggcaagg

SEQ ID NO: 1666166 - RNA, 20 nt, Human
gaggaaaaccaagccguggc

SEQ ID NO: 1666167 - RNA, 21 nt, Human
gaggaaaaccaagccguggcu

SEQ ID NO: 1666168 - RNA, 23 nt, Human
gaggaaaaccaagccguggcuuc

SEQ ID NO: 1666169 - RNA, 14 nt, Human
gagcuuuuguagaa

SEQ ID NO: 1666170 - RNA, 16 nt, Human
gaggaaagcaaaggag

SEQ ID NO: 1666171 - RNA, 17 nt, Human
gaggaaagcaaaggaga

SEQ ID NO: 1666172 - RNA, 20 nt, Human
gagcuuugaaaauucagugg

SEQ ID NO: 1666173 - RNA, 22 nt, Human
gagcuuucugcuaucaaagagg

SEQ ID NO: 1666174 - RNA, 23 nt, Human
gagcugcccucuccugggcagcu

SEQ ID NO: 1666175 - RNA, 21 nt, Human
gagcugcccucuccugggcag

SEQ ID NO: 1666176 - RNA, 19 nt, Human
gagcugcccucuccugggc

SEQ ID NO: 1666177 - RNA, 18 nt, Human
gagcugcccucuccuggg

SEQ ID NO: 1666178 - RNA, 11 nt, Human
gaaaugagcug

SEQ ID NO: 1666179 - RNA, 18 nt, Human
gaaaugaggucagagccu

SEQ ID NO: 1666180 - RNA, 16 nt, Human
gaaaugggcagagcag

SEQ ID NO: 1666181 - RNA, 15 nt, Human
gaaaugggcagagca

SEQ ID NO: 1666182 - RNA, 17 nt, Human
gaaauguacagcaagga

SEQ ID NO: 1666183 - RNA, 17 nt, Human
gaaaugggcagagcaga

SEQ ID NO: 1666184 - RNA, 19 nt, Human
gaaaugggcagagcagaga

SEQ ID NO: 1666185 - RNA, 14 nt, Human
gaaauaaacgucuu

SEQ ID NO: 1666186 - RNA, 16 nt, Human
gaaauaaacgucuuaa

SEQ ID NO: 1666187 - RNA, 17 nt, Human
gaaauaaacgucuuaaa

SEQ ID NO: 1666188 - RNA, 18 nt, Human
gaaauaaacgucuuaaau

SEQ ID NO: 1666189 - RNA, 21 nt, Human
gaaauaaacgucuuaaauauu

SEQ ID NO: 1666190 - RNA, 15 nt, Human
gaaauauuuauuuua

SEQ ID NO: 1666191 - RNA, 16 nt, Human
gaaauauuuauuuuaa

SEQ ID NO: 1666192 - RNA, 18 nt, Human
gaaauaucugaaaaugua

SEQ ID NO: 1666193 - RNA, 19 nt, Human
gaaauaucugaaaauguau

SEQ ID NO: 1666194 - RNA, 20 nt, Human
gaaauaucugaaaauguaug

SEQ ID NO: 1666195 - RNA, 13 nt, Human
gaaauauuuauuu

SEQ ID NO: 1666196 - RNA, 16 nt, Human
gaaauuugaauuuugu

SEQ ID NO: 1666197 - RNA, 24 nt, Human
gaaauuugaauuuuguguuagaga

SEQ ID NO: 1666198 - RNA, 13 nt, Human
gaaauuugaauuu

SEQ ID NO: 1666199 - RNA, 21 nt, Human
gaaauuuccugggagcuuuug

SEQ ID NO: 1666200 - RNA, 15 nt, Human
gaacacuccuucaca

SEQ ID NO: 1666201 - RNA, 16 nt, Human
gaacacuccuucacag

SEQ ID NO: 1666202 - RNA, 17 nt, Human
gaacacuccuucacaga

SEQ ID NO: 1666203 - RNA, 20 nt, Human
gaacagacuggaagcacagc

SEQ ID NO: 1666204 - RNA, 23 nt, Human
gaaauuaguacuccccuccuuga

SEQ ID NO: 1666205 - RNA, 22 nt, Human
gaacaguuguguuugaagcaca

SEQ ID NO: 1666206 - RNA, 20 nt, Human
gaacaguuguguuugaagca

SEQ ID NO: 1666207 - RNA, 24 nt, Human
gaacaguuaccucugccucagaaa

SEQ ID NO: 1666208 - RNA, 17 nt, Human
gaacaggauauucucac

SEQ ID NO: 1666209 - RNA, 22 nt, Human
gaacagacuggaagcacagcuu

SEQ ID NO: 1666210 - RNA, 16 nt, Human
gaaaaaugagccuggc

SEQ ID NO: 1666211 - RNA, 16 nt, Human
gaaacggaugauuucu

SEQ ID NO: 1666212 - RNA, 20 nt, Human
gaaacuaggugcauauuuau

SEQ ID NO: 1666213 - RNA, 13 nt, Human
gaaacugccagca

SEQ ID NO: 1666214 - RNA, 15 nt, Human
gaaacugccagcaac

SEQ ID NO: 1666215 - RNA, 17 nt, Human
gaaagacuguacaaagu

SEQ ID NO: 1666216 - RNA, 19 nt, Human
gaaagacuauucaaacagu

SEQ ID NO: 1666217 - RNA, 22 nt, Human
gaaagacuauucaaacagucuc

SEQ ID NO: 1666218 - RNA, 23 nt, Human
gaaagacuauucaaacagucuca

SEQ ID NO: 1666219 - RNA, 22 nt, Human
gaaagauggcugugccucugcc

SEQ ID NO: 1666220 - RNA, 16 nt, Human
gaaagaucaaaagguu

SEQ ID NO: 1666221 - RNA, 23 nt, Human
gaaagauggcugugccucugccu

SEQ ID NO: 1666222 - RNA, 13 nt, Human
gaaagcagaacag

SEQ ID NO: 1666223 - RNA, 14 nt, Human
gaaagcagaacagu

SEQ ID NO: 1666224 - RNA, 11 nt, Human
gaaaggaaaga

SEQ ID NO: 1666225 - RNA, 16 nt, Human
gaaaggaaagaggcuc

SEQ ID NO: 1666226 - RNA, 14 nt, Human
gaaaguuuacagga

SEQ ID NO: 1666227 - RNA, 16 nt, Human
gaaaguuuacaggaaa

SEQ ID NO: 1666228 - RNA, 13 nt, Human
gaaaguucaugcu

SEQ ID NO: 1666229 - RNA, 19 nt, Human
gaaggaagacuucaucccu

SEQ ID NO: 1666230 - RNA, 21 nt, Human
gaaggaaacccagcucugguc

SEQ ID NO: 1666231 - RNA, 22 nt, Human
gaaggaaacccagcucuggucc

SEQ ID NO: 1666232 - RNA, 15 nt, Human
gaaggaacguccccu

SEQ ID NO: 1666233 - RNA, 22 nt, Human
gaaggacccggaggggccuggc

SEQ ID NO: 1666234 - RNA, 23 nt, Human
gaaggacccggaggggccuggca

SEQ ID NO: 1666235 - RNA, 22 nt, Human
gaaggaauaaauugcuccuuga

SEQ ID NO: 1666236 - RNA, 19 nt, Human
gaaggacauugcggacagc

SEQ ID NO: 1666237 - RNA, 20 nt, Human
gaaggacauugcggacagcc

SEQ ID NO: 1666238 - RNA, 21 nt, Human
gaaggacauugcggacagcca

SEQ ID NO: 1666239 - RNA, 19 nt, Human
gaaggaaacccagcucugg

SEQ ID NO: 1666240 - RNA, 20 nt, Human
gaaggaaacccagcucuggu

SEQ ID NO: 1666241 - RNA, 14 nt, Human
gaagccgcuggggc

SEQ ID NO: 1666242 - RNA, 18 nt, Human
gaagccaaaccucuguga

SEQ ID NO: 1666243 - RNA, 15 nt, Human
gaagcauuuuauaaa

SEQ ID NO: 1666244 - RNA, 17 nt, Human
gaagcauuuuauaaauc

SEQ ID NO: 1666245 - RNA, 13 nt, Human
gaagcauuuuaua

SEQ ID NO: 1666246 - RNA, 18 nt, Human
gaagccgcuggggccagu

SEQ ID NO: 1666247 - RNA, 20 nt, Human
gaagccgcuggggccaguug

SEQ ID NO: 1666248 - RNA, 21 nt, Human
gaagccgcuggggccaguugg

SEQ ID NO: 1666249 - RNA, 20 nt, Human
gaaggcagggagggccuggg

SEQ ID NO: 1666250 - RNA, 22 nt, Human
gaaggcagggagggccugggcc

SEQ ID NO: 1666251 - RNA, 23 nt, Human
gaaggcagggagggccugggccc

SEQ ID NO: 1666252 - RNA, 18 nt, Human
gaaggcagggagggccug

SEQ ID NO: 1666253 - RNA, 13 nt, Human
gaagggggcuggg

SEQ ID NO: 1666254 - RNA, 15 nt, Human
gaagggggcugggac

SEQ ID NO: 1666255 - RNA, 21 nt, Human
gaaguaauaugcacacauuuu

SEQ ID NO: 1666256 - RNA, 13 nt, Human
gaagucacacagu

SEQ ID NO: 1666257 - RNA, 20 nt, Human
gaaguaauaugcacacauuu

SEQ ID NO: 1666258 - RNA, 19 nt, Human
gaaguaauaugcacacauu

SEQ ID NO: 1666259 - RNA, 21 nt, Human
gaaggugaggagcuugaaacc

SEQ ID NO: 1666260 - RNA, 22 nt, Human
gaagucagaucugccuaaggac

SEQ ID NO: 1666261 - RNA, 23 nt, Human
gaagucagaucugccuaaggacu

SEQ ID NO: 1666262 - RNA, 14 nt, Human
gaagucagaucugc

SEQ ID NO: 1666263 - RNA, 15 nt, Human
gaagucacugcacag

SEQ ID NO: 1666264 - RNA, 21 nt, Human
gaagucacauuccugaacagg

SEQ ID NO: 1666265 - RNA, 16 nt, Human
gaagucacauuccuga

SEQ ID NO: 1666266 - RNA, 20 nt, Human
gaagucacauuccugaacag

SEQ ID NO: 1666267 - RNA, 23 nt, Human
gaaguccaagcauuuagauguau

SEQ ID NO: 1666268 - RNA, 12 nt, Human
gaacuugaaauu

SEQ ID NO: 1666269 - RNA, 13 nt, Human
gaacuugaaauuu

SEQ ID NO: 1666270 - RNA, 15 nt, Human
gaacuugaaauuuga

SEQ ID NO: 1666271 - RNA, 22 nt, Human
gaacuugaaauuugaauuuugu

SEQ ID NO: 1666272 - RNA, 17 nt, Human
gaacuuaaauaauguga

SEQ ID NO: 1666273 - RNA, 14 nt, Human
gaacuuaaauaaug

SEQ ID NO: 1666274 - RNA, 20 nt, Human
gaaccacaucuugcucugcu

SEQ ID NO: 1666275 - RNA, 18 nt, Human
gaaccacaucuugcucug

SEQ ID NO: 1666276 - RNA, 14 nt, Human
gaaccacaagacug

SEQ ID NO: 1666277 - RNA, 15 nt, Human
gaaccacaagacugc

SEQ ID NO: 1666278 - RNA, 16 nt, Human
gaacuccuaaaucaag

SEQ ID NO: 1666279 - RNA, 13 nt, Human
gaacuccugaccu

SEQ ID NO: 1666280 - RNA, 15 nt, Human
gaacuccuaaaucaa

SEQ ID NO: 1666281 - RNA, 16 nt, Human
gaacucccuuucaaca

SEQ ID NO: 1666282 - RNA, 22 nt, Human
gaacuuugaccucugcagcaau

SEQ ID NO: 1666283 - RNA, 16 nt, Human
gaacuuugaccucugc

SEQ ID NO: 1666284 - RNA, 17 nt, Human
gaacuuuccaggaaggc

SEQ ID NO: 1666285 - RNA, 12 nt, Human
gaacuugguucc

SEQ ID NO: 1666286 - RNA, 15 nt, Human
gaacuuguuuucugg

SEQ ID NO: 1666287 - RNA, 18 nt, Human
gaacuuggcgcugccccu

SEQ ID NO: 1666288 - RNA, 17 nt, Human
gaacuugggccacugug

SEQ ID NO: 1666289 - RNA, 22 nt, Human
gaacuuguaaaggaauuuaaaa

SEQ ID NO: 1666290 - RNA, 17 nt, Human
gaagauugagauguguu

SEQ ID NO: 1666291 - RNA, 22 nt, Human
gaagauugagauguguucacaa

SEQ ID NO: 1666292 - RNA, 23 nt, Human
gaagauuuugaaauuuuuauuaa

SEQ ID NO: 1666293 - RNA, 17 nt, Human
gaagauguagaggagaa

SEQ ID NO: 1666294 - RNA, 15 nt, Human
gaagacuucaucccu

SEQ ID NO: 1666295 - RNA, 16 nt, Human
gaagacuucaucccuc

SEQ ID NO: 1666296 - RNA, 12 nt, Human
gaagagccuugc

SEQ ID NO: 1666297 - RNA, 17 nt, Human
gaagacuucaucccucu

SEQ ID NO: 1666298 - RNA, 19 nt, Human
gaagacuucaucccucugg

SEQ ID NO: 1666299 - RNA, 13 nt, Human
gaagagcuguuca

SEQ ID NO: 1666300 - RNA, 15 nt, Human
gaagagcuguucaca

SEQ ID NO: 1666301 - RNA, 20 nt, Human
gaagagcuguucacagccag

SEQ ID NO: 1666302 - RNA, 23 nt, Human
gaagagcuguucacagccagacu

SEQ ID NO: 1666303 - RNA, 21 nt, Human
cuuguaugaaagauggcugug

SEQ ID NO: 1666304 - RNA, 13 nt, Human
cuuguauuaugug

SEQ ID NO: 1666305 - RNA, 14 nt, Human
cuuguauuaagaau

SEQ ID NO: 1666306 - RNA, 18 nt, Human
cuuguauuauguguguuu

SEQ ID NO: 1666307 - RNA, 15 nt, Human
cuuguauuaagaaug

SEQ ID NO: 1666308 - RNA, 17 nt, Human
cuuguggacacagcucu

SEQ ID NO: 1666309 - RNA, 18 nt, Human
cuuguggacacagcucuu

SEQ ID NO: 1666310 - RNA, 14 nt, Human
cuuggcugcaggga

SEQ ID NO: 1666311 - RNA, 17 nt, Human
cuuggggaccagagcug

SEQ ID NO: 1666312 - RNA, 18 nt, Human
cuuggggaccagagcugc

SEQ ID NO: 1666313 - RNA, 19 nt, Human
cuuggggaccagagcugcc

SEQ ID NO: 1666314 - RNA, 15 nt, Human
cuuggggccuaugca

SEQ ID NO: 1666315 - RNA, 18 nt, Human
cuuguaaaaauuaaaagu

SEQ ID NO: 1666316 - RNA, 18 nt, Human
cuuguaaaggaauuuaaa

SEQ ID NO: 1666317 - RNA, 23 nt, Human
cuuggcucaaguccucuuuucug

SEQ ID NO: 1666318 - RNA, 13 nt, Human
cuuggauuguccc

SEQ ID NO: 1666319 - RNA, 14 nt, Human
cuuggauugucccc

SEQ ID NO: 1666320 - RNA, 12 nt, Human
cuuggcugcagg

SEQ ID NO: 1666321 - RNA, 13 nt, Human
cuuggcugcaggg

SEQ ID NO: 1666322 - RNA, 15 nt, Human
cuugcuuuuaaaauc

SEQ ID NO: 1666323 - RNA, 13 nt, Human
cuugcuugcuuuu

SEQ ID NO: 1666324 - RNA, 17 nt, Human
cuugccaaauauaaaua

SEQ ID NO: 1666325 - RNA, 17 nt, Human
cuucuuuuuuugugaug

SEQ ID NO: 1666326 - RNA, 19 nt, Human
cuugaaauauaggaacuua

SEQ ID NO: 1666327 - RNA, 13 nt, Human
cuucuuuccacag

SEQ ID NO: 1666328 - RNA, 19 nt, Human
cuucuuuccacagaagcuc

SEQ ID NO: 1666329 - RNA, 19 nt, Human
cuugaacuccuggccucaa

SEQ ID NO: 1666330 - RNA, 16 nt, Human
cuugaacuggguacuu

SEQ ID NO: 1666331 - RNA, 15 nt, Human
cuugaacuuugaccu

SEQ ID NO: 1666332 - RNA, 18 nt, Human
cuugaacuggguacuugu

SEQ ID NO: 1666333 - RNA, 20 nt, Human
cuugaacuggguacuugugg

SEQ ID NO: 1666334 - RNA, 14 nt, Human
cuugaacuccuggc

SEQ ID NO: 1666335 - RNA, 15 nt, Human
cuugaacuccuggcc

SEQ ID NO: 1666336 - RNA, 17 nt, Human
cuugaacuccuggccuc

SEQ ID NO: 1666337 - RNA, 18 nt, Human
cuugaacuccuggccuca

SEQ ID NO: 1666338 - RNA, 14 nt, Human
cuugaacccgggag

SEQ ID NO: 1666339 - RNA, 19 nt, Human
cuugaaauuugaauuuugu

SEQ ID NO: 1666340 - RNA, 20 nt, Human
cuugaaauuugaauuuugug

SEQ ID NO: 1666341 - RNA, 19 nt, Human
cuugaacccgggaggcaga

SEQ ID NO: 1666342 - RNA, 20 nt, Human
cuugaacccgggaggcagag

SEQ ID NO: 1666343 - RNA, 13 nt, Human
cuugagcucagga

SEQ ID NO: 1666344 - RNA, 22 nt, Human
cuugagccuugaacuuugaccu

SEQ ID NO: 1666345 - RNA, 20 nt, Human
cuugagccuugaacuuugac

SEQ ID NO: 1666346 - RNA, 19 nt, Human
cuugagccuugaacuuuga

SEQ ID NO: 1666347 - RNA, 17 nt, Human
cuugaccauucuccacc

SEQ ID NO: 1666348 - RNA, 20 nt, Human
cuugaccauucuccaccugc

SEQ ID NO: 1666349 - RNA, 14 nt, Human
cuugagagggugga

SEQ ID NO: 1666350 - RNA, 21 nt, Human
cuugaccauucuccaccugcc

SEQ ID NO: 1666351 - RNA, 22 nt, Human
cuugcaaaguaucccuacugua

SEQ ID NO: 1666352 - RNA, 14 nt, Human
cuugcaauggcagc

SEQ ID NO: 1666353 - RNA, 20 nt, Human
cuugcagacucuacagaggc

SEQ ID NO: 1666354 - RNA, 18 nt, Human
cuugcagacucuacagag

SEQ ID NO: 1666355 - RNA, 21 nt, Human
cuugcaugguuuagaaagcuu

SEQ ID NO: 1666356 - RNA, 21 nt, Human
cuugcaugaggcuaguguggu

SEQ ID NO: 1666357 - RNA, 23 nt, Human
cuugcaucaauuuuucuuauuuc

SEQ ID NO: 1666358 - RNA, 17 nt, Human
cuuuccugaggcugggc

SEQ ID NO: 1666359 - RNA, 16 nt, Human
cuuuccugaggcuggg

SEQ ID NO: 1666360 - RNA, 20 nt, Human
cuuuccugaggcugggcucc

SEQ ID NO: 1666361 - RNA, 21 nt, Human
cuuuccugaggcugggcuccc

SEQ ID NO: 1666362 - RNA, 16 nt, Human
cuuugcagacaggcaa

SEQ ID NO: 1666363 - RNA, 19 nt, Human
cuuuggaaagaguaggaag

SEQ ID NO: 1666364 - RNA, 23 nt, Human
cuuuggaaagaguaggaagacuu

SEQ ID NO: 1666365 - RNA, 14 nt, Human
cuuugcagacaggc

SEQ ID NO: 1666366 - RNA, 15 nt, Human
cuuugcagacaggca

SEQ ID NO: 1666367 - RNA, 19 nt, Human
cuuuauuuuguguuuagga

SEQ ID NO: 1666368 - RNA, 20 nt, Human
cuuguguguuuauugucaaa

SEQ ID NO: 1666369 - RNA, 21 nt, Human
cuuguggacacagcucuucuc

SEQ ID NO: 1666370 - RNA, 22 nt, Human
cuuuccaaaguacacuguuuca

SEQ ID NO: 1666371 - RNA, 16 nt, Human
cuuuccaaaugcccag

SEQ ID NO: 1666372 - RNA, 16 nt, Human
cuuuccaaaguacacu

SEQ ID NO: 1666373 - RNA, 14 nt, Human
cuuuccaggaaggc

SEQ ID NO: 1666374 - RNA, 15 nt, Human
cuuuccccaugucuc

SEQ ID NO: 1666375 - RNA, 20 nt, Human
cuuuccccaugucucgacuc

SEQ ID NO: 1666376 - RNA, 21 nt, Human
cuuuccccaugucucgacuca

SEQ ID NO: 1666377 - RNA, 15 nt, Human
cuuuccaggaaggcu

SEQ ID NO: 1666378 - RNA, 21 nt, Human
cuuuccgguguuuaagacauu

SEQ ID NO: 1666379 - RNA, 11 nt, Human
gaaaaagaaaa

SEQ ID NO: 1666380 - RNA, 16 nt, Human
gaaaaagaaaaaauau

SEQ ID NO: 1666381 - RNA, 19 nt, Human
cuuuuuuaucaugugaaau

SEQ ID NO: 1666382 - RNA, 18 nt, Human
cuuuuuuauacauaaaca

SEQ ID NO: 1666383 - RNA, 15 nt, Human
cuuuuuuauacauaa

SEQ ID NO: 1666384 - RNA, 17 nt, Human
cuuuuuuauacauaaac

SEQ ID NO: 1666385 - RNA, 16 nt, Human
cuuuuuuauacauaaa

SEQ ID NO: 1666386 - RNA, 22 nt, Human
cuuuuuaauauugauaugcuua

SEQ ID NO: 1666387 - RNA, 13 nt, Human
cuuuucuuuucuu

SEQ ID NO: 1666388 - RNA, 23 nt, Human
cuuuugauaaucaacugggcuga

SEQ ID NO: 1666389 - RNA, 17 nt, Human
cuuuucuuucagccaag

SEQ ID NO: 1666390 - RNA, 12 nt, Human
cuuuucacugcu

SEQ ID NO: 1666391 - RNA, 22 nt, Human
cuuuucauuuaggugaggaagc

SEQ ID NO: 1666392 - RNA, 13 nt, Human
cuuuuccaacccu

SEQ ID NO: 1666393 - RNA, 23 nt, Human
cuuuuccaacccucaucaccaac

SEQ ID NO: 1666394 - RNA, 16 nt, Human
cuuuucacugcuggcu

SEQ ID NO: 1666395 - RNA, 14 nt, Human
cuuuucccuucuuu

SEQ ID NO: 1666396 - RNA, 20 nt, Human
cuuuucgcaggauucuuccu

SEQ ID NO: 1666397 - RNA, 21 nt, Human
cuuuucgcaggauucuuccuc

SEQ ID NO: 1666398 - RNA, 15 nt, Human
cuuuuaauccuggcu

SEQ ID NO: 1666399 - RNA, 18 nt, Human
cuuuuaaaacacuuccau

SEQ ID NO: 1666400 - RNA, 19 nt, Human
cugcaggucccuaauaaag

SEQ ID NO: 1666401 - RNA, 20 nt, Human
cugcaggucccuaauaaagc

SEQ ID NO: 1666402 - RNA, 21 nt, Human
cugcaggucccuaauaaagcu

SEQ ID NO: 1666403 - RNA, 22 nt, Human
cugcaggucccuaauaaagcug

SEQ ID NO: 1666404 - RNA, 23 nt, Human
cugcaggucccuaauaaagcugu

SEQ ID NO: 1666405 - RNA, 17 nt, Human
cugcaguugccagucac

SEQ ID NO: 1666406 - RNA, 13 nt, Human
cugcaguugccag

SEQ ID NO: 1666407 - RNA, 16 nt, Human
cugcaguugccaguca

SEQ ID NO: 1666408 - RNA, 11 nt, Human
cugcagguccc

SEQ ID NO: 1666409 - RNA, 12 nt, Human
cugcaggucccu

SEQ ID NO: 1666410 - RNA, 13 nt, Human
cugcaggucccua

SEQ ID NO: 1666411 - RNA, 14 nt, Human
cugcaggucccuaa

SEQ ID NO: 1666412 - RNA, 15 nt, Human
cugcaggucccuaau

SEQ ID NO: 1666413 - RNA, 16 nt, Human
cugcaggucccuaaua

SEQ ID NO: 1666414 - RNA, 17 nt, Human
cugcaggucccuaauaa

SEQ ID NO: 1666415 - RNA, 18 nt, Human
cugcaggucccuaauaaa

SEQ ID NO: 1666416 - RNA, 17 nt, Human
cugcagcaauaaagcag

SEQ ID NO: 1666417 - RNA, 14 nt, Human
cugcaccggcuggc

SEQ ID NO: 1666418 - RNA, 22 nt, Human
cugaggcccuucucuccagccc

SEQ ID NO: 1666419 - RNA, 23 nt, Human
cugaggcccuucucuccagcccc

SEQ ID NO: 1666420 - RNA, 15 nt, Human
cugcaccggcuggcc

SEQ ID NO: 1666421 - RNA, 16 nt, Human
cugcaccggcuggccu

SEQ ID NO: 1666422 - RNA, 14 nt, Human
cugcaccgggccac

SEQ ID NO: 1666423 - RNA, 15 nt, Human
cugcaccgggccaca

SEQ ID NO: 1666424 - RNA, 20 nt, Human
cugcacuccagccuggguga

SEQ ID NO: 1666425 - RNA, 18 nt, Human
cugcaccgggccacagag

SEQ ID NO: 1666426 - RNA, 20 nt, Human
cugcaccgggccacagagaa

SEQ ID NO: 1666427 - RNA, 14 nt, Human
cugcacuccccugc

SEQ ID NO: 1666428 - RNA, 13 nt, Human
cugcacuccccug

SEQ ID NO: 1666429 - RNA, 19 nt, Human
cugcacuccccugcugggu

SEQ ID NO: 1666430 - RNA, 20 nt, Human
cugcacuccccugcugggug

SEQ ID NO: 1666431 - RNA, 10 nt, Human
cugcagaggg

SEQ ID NO: 1666432 - RNA, 16 nt, Human
cugcagcaauaaagca

SEQ ID NO: 1666433 - RNA, 15 nt, Human
cugcagcaauaaagc

SEQ ID NO: 1666434 - RNA, 13 nt, Human
cugcagagggcac

SEQ ID NO: 1666435 - RNA, 21 nt, Human
cugcacuccccugcugggugu

SEQ ID NO: 1666436 - RNA, 12 nt, Human
cugcacugucaa

SEQ ID NO: 1666437 - RNA, 20 nt, Human
cugcccuaaugcgcaggcug

SEQ ID NO: 1666438 - RNA, 21 nt, Human
cugcccuaaugcgcaggcugg

SEQ ID NO: 1666439 - RNA, 22 nt, Human
cugcccuaaugcgcaggcuggc

SEQ ID NO: 1666440 - RNA, 19 nt, Human
cugccccuggcagccccug

SEQ ID NO: 1666441 - RNA, 18 nt, Human
cugccccuggcagccccu

SEQ ID NO: 1666442 - RNA, 13 nt, Human
cugcccggcaggg

SEQ ID NO: 1666443 - RNA, 20 nt, Human
cugcccggcaggguccuaga

SEQ ID NO: 1666444 - RNA, 15 nt, Human
cugccauuucugaga

SEQ ID NO: 1666445 - RNA, 12 nt, Human
cugcccaccugg

SEQ ID NO: 1666446 - RNA, 14 nt, Human
cugcccaggccccu

SEQ ID NO: 1666447 - RNA, 15 nt, Human
cugcccaggccccug

SEQ ID NO: 1666448 - RNA, 17 nt, Human
cugcccaggccugccug

SEQ ID NO: 1666449 - RNA, 16 nt, Human
cugcccaggccccugc

SEQ ID NO: 1666450 - RNA, 18 nt, Human
cugcccaggccccugcca

SEQ ID NO: 1666451 - RNA, 19 nt, Human
cugcccaggccccugccac

SEQ ID NO: 1666452 - RNA, 20 nt, Human
cugcccaggccccugccacc

SEQ ID NO: 1666453 - RNA, 20 nt, Human
cugccaucucaccuccugcu

SEQ ID NO: 1666454 - RNA, 22 nt, Human
cugccaggaagccagcaggcuc

SEQ ID NO: 1666455 - RNA, 21 nt, Human
cugccauccagguucagcuug

SEQ ID NO: 1666456 - RNA, 15 nt, Human
cugccauccucccaa

SEQ ID NO: 1666457 - RNA, 13 nt, Human
cugccaggaagcc

SEQ ID NO: 1666458 - RNA, 14 nt, Human
cugccaggaagcca

SEQ ID NO: 1666459 - RNA, 20 nt, Human
cugccaggaagccagcaggc

SEQ ID NO: 1666460 - RNA, 21 nt, Human
cugccaggaagccagcaggcu

SEQ ID NO: 1666461 - RNA, 15 nt, Human
cugccagcaacgcag

SEQ ID NO: 1666462 - RNA, 21 nt, Human
cugccacccuggggagaaagu

SEQ ID NO: 1666463 - RNA, 12 nt, Human
cugccacccugg

SEQ ID NO: 1666464 - RNA, 14 nt, Human
cugccacccugggg

SEQ ID NO: 1666465 - RNA, 15 nt, Human
cugcauaugaaagga

SEQ ID NO: 1666466 - RNA, 20 nt, Human
cugcaucaagaugugacaug

SEQ ID NO: 1666467 - RNA, 20 nt, Human
cugcaucagcugcugaaaca

SEQ ID NO: 1666468 - RNA, 14 nt, Human
cugcugccugcuuu

SEQ ID NO: 1666469 - RNA, 23 nt, Human
cugcugccugcuuuuuauggccu

SEQ ID NO: 1666470 - RNA, 15 nt, Human
cugcugcaguugcca

SEQ ID NO: 1666471 - RNA, 14 nt, Human
cugcugcaguugcc

SEQ ID NO: 1666472 - RNA, 10 nt, Human
cugcugcagu

SEQ ID NO: 1666473 - RNA, 13 nt, Human
cugcugcaguugc

SEQ ID NO: 1666474 - RNA, 16 nt, Human
cugcucuugaacuccu

SEQ ID NO: 1666475 - RNA, 18 nt, Human
cugcucuugaacuccuga

SEQ ID NO: 1666476 - RNA, 19 nt, Human
cugcucuugaacuccugac

SEQ ID NO: 1666477 - RNA, 12 nt, Human
cugcucugguua

SEQ ID NO: 1666478 - RNA, 20 nt, Human
cugcucugaugaagaggagu

SEQ ID NO: 1666479 - RNA, 20 nt, Human
cugcggugcuaucuccccca

SEQ ID NO: 1666480 - RNA, 21 nt, Human
cugcggugcuaucucccccag

SEQ ID NO: 1666481 - RNA, 22 nt, Human
cugcggugcuaucucccccagc

SEQ ID NO: 1666482 - RNA, 23 nt, Human
cugcggugcuaucucccccagcc

SEQ ID NO: 1666483 - RNA, 23 nt, Human
cugcuccucuccccagcaaguga

SEQ ID NO: 1666484 - RNA, 19 nt, Human
cugcuccucuccccagcaa

SEQ ID NO: 1666485 - RNA, 20 nt, Human
cugcuccucuccccagcaag

SEQ ID NO: 1666486 - RNA, 15 nt, Human
cugcucuccgaccag

SEQ ID NO: 1666487 - RNA, 19 nt, Human
cugcucuccgaccagacac

SEQ ID NO: 1666488 - RNA, 22 nt, Human
cugccugcuuuuuauggccugu

SEQ ID NO: 1666489 - RNA, 15 nt, Human
cugcgggucacagga

SEQ ID NO: 1666490 - RNA, 21 nt, Human
cugcgggucacaggagggagg

SEQ ID NO: 1666491 - RNA, 22 nt, Human
cugcgggucacaggagggaggg

SEQ ID NO: 1666492 - RNA, 23 nt, Human
cugcgggucacaggagggagggg

SEQ ID NO: 1666493 - RNA, 23 nt, Human
cugcgguccacccaggagccccg

SEQ ID NO: 1666494 - RNA, 18 nt, Human
cugcggugcuaucucccc

SEQ ID NO: 1666495 - RNA, 19 nt, Human
cugcggugcuaucuccccc

SEQ ID NO: 1666496 - RNA, 20 nt, Human
cugccugcaguacuuuaccu

SEQ ID NO: 1666497 - RNA, 21 nt, Human
cugccugcaguacuuuaccuc

SEQ ID NO: 1666498 - RNA, 23 nt, Human
cugccugaagucacacagugagu

SEQ ID NO: 1666499 - RNA, 19 nt, Human
cugccugaagucacacagu

SEQ ID NO: 1666500 - RNA, 18 nt, Human
cugccugaagucacacag

SEQ ID NO: 1666501 - RNA, 16 nt, Human
cugccugaagucacac

SEQ ID NO: 1666502 - RNA, 21 nt, Human
cugcccugcccaccuggccuc

SEQ ID NO: 1666503 - RNA, 15 nt, Human
cugcccucuccuggg

SEQ ID NO: 1666504 - RNA, 20 nt, Human
cugcccugcccaccuggccu

SEQ ID NO: 1666505 - RNA, 17 nt, Human
cugcccugcccaccugg

SEQ ID NO: 1666506 - RNA, 14 nt, Human
cugcccucuccugg

SEQ ID NO: 1666507 - RNA, 13 nt, Human
cugcccucuccug

SEQ ID NO: 1666508 - RNA, 12 nt, Human
cugcccucuccu

SEQ ID NO: 1666509 - RNA, 13 nt, Human
cugcuugaggcaa

SEQ ID NO: 1666510 - RNA, 20 nt, Human
cugcuugaggcaacucaucu

SEQ ID NO: 1666511 - RNA, 21 nt, Human
cugcuugaggcaacucaucuu

SEQ ID NO: 1666512 - RNA, 12 nt, Human
cugcugcuggcu

SEQ ID NO: 1666513 - RNA, 13 nt, Human
cugcugcuggcug

SEQ ID NO: 1666514 - RNA, 14 nt, Human
cugcuggcugccuu

SEQ ID NO: 1666515 - RNA, 15 nt, Human
cugcuggcugccuua

SEQ ID NO: 1666516 - RNA, 13 nt, Human
cugcuggcugccu

SEQ ID NO: 1666517 - RNA, 14 nt, Human
cugcugcuggcugg

SEQ ID NO: 1666518 - RNA, 14 nt, Human
cugcuggguguggc

SEQ ID NO: 1666519 - RNA, 15 nt, Human
cugcuggguguggcg

SEQ ID NO: 1666520 - RNA, 17 nt, Human
cugcuggguguggcgca

SEQ ID NO: 1666521 - RNA, 19 nt, Human
cugcuuuugucuaugggac

SEQ ID NO: 1666522 - RNA, 17 nt, Human
cugcuuuuggucugugu

SEQ ID NO: 1666523 - RNA, 12 nt, Human
cugcuuucagau

SEQ ID NO: 1666524 - RNA, 15 nt, Human
cugcuuucagauacu

SEQ ID NO: 1666525 - RNA, 16 nt, Human
cugcuuucagauacug

SEQ ID NO: 1666526 - RNA, 14 nt, Human
cugcuuguuuccua

SEQ ID NO: 1666527 - RNA, 13 nt, Human
cugcuuguuuccu

SEQ ID NO: 1666528 - RNA, 16 nt, Human
cugcuuugggcugccc

SEQ ID NO: 1666529 - RNA, 13 nt, Human
cugcuuuggaaau

SEQ ID NO: 1666530 - RNA, 17 nt, Human
cugcuuugggcugcccu

SEQ ID NO: 1666531 - RNA, 15 nt, Human
cugcuuuuggucugu

SEQ ID NO: 1666532 - RNA, 19 nt, Human
cugcuugggcuucauccuc

SEQ ID NO: 1666533 - RNA, 19 nt, Human
cugcuugugaaaggaaaga

SEQ ID NO: 1666534 - RNA, 13 nt, Human
cugcuugggcuuc

SEQ ID NO: 1666535 - RNA, 15 nt, Human
cugcuugggcuucau

SEQ ID NO: 1666536 - RNA, 17 nt, Human
cugcuugggcuucaucc

SEQ ID NO: 1666537 - RNA, 18 nt, Human
cugcuugggcuucauccu

SEQ ID NO: 1666538 - RNA, 22 nt, Human
cugcuugaggcaacucaucuua

SEQ ID NO: 1666539 - RNA, 15 nt, Human
cugcuugccaucccu

SEQ ID NO: 1666540 - RNA, 16 nt, Human
cugcuugccaucccuc

SEQ ID NO: 1666541 - RNA, 20 nt, Human
cugcuugcuugcuuuuuaau

SEQ ID NO: 1666542 - RNA, 22 nt, Human
cugcuugccaucccucccucca

SEQ ID NO: 1666543 - RNA, 20 nt, Human
cugcuugccaucccucccuc

SEQ ID NO: 1666544 - RNA, 19 nt, Human
cugcuugccaucccucccu

SEQ ID NO: 1666545 - RNA, 18 nt, Human
cugcuugccaucccuccc

SEQ ID NO: 1666546 - RNA, 14 nt, Human
cugggaggcaguga

SEQ ID NO: 1666547 - RNA, 18 nt, Human
cugggaggcucuggagcc

SEQ ID NO: 1666548 - RNA, 20 nt, Human
cugggaggcucuggagccca

SEQ ID NO: 1666549 - RNA, 21 nt, Human
cugggaggcucuggagcccac

SEQ ID NO: 1666550 - RNA, 17 nt, Human
cugggaggcucuggagc

SEQ ID NO: 1666551 - RNA, 22 nt, Human
cugggaggcucuggagcccacu

SEQ ID NO: 1666552 - RNA, 19 nt, Human
cugggaggucaaggcugca

SEQ ID NO: 1666553 - RNA, 21 nt, Human
cugggaggucaaggcugcagu

SEQ ID NO: 1666554 - RNA, 15 nt, Human
cugggccccaguugu

SEQ ID NO: 1666555 - RNA, 19 nt, Human
cugggccccaguuguauuu

SEQ ID NO: 1666556 - RNA, 12 nt, Human
cugggagugagc

SEQ ID NO: 1666557 - RNA, 20 nt, Human
cugggaucccucauccucau

SEQ ID NO: 1666558 - RNA, 18 nt, Human
cugggaugauuggagggg

SEQ ID NO: 1666559 - RNA, 16 nt, Human
cugggauuacaggugu

SEQ ID NO: 1666560 - RNA, 18 nt, Human
cugggauuacagguguga

SEQ ID NO: 1666561 - RNA, 20 nt, Human
cugggauuacaggugugaac

SEQ ID NO: 1666562 - RNA, 17 nt, Human
cugggauuacaggugug

SEQ ID NO: 1666563 - RNA, 13 nt, Human
cuggcugucgaga

SEQ ID NO: 1666564 - RNA, 16 nt, Human
cuggcuguuggcuggg

SEQ ID NO: 1666565 - RNA, 17 nt, Human
cuggcuguuggcugggg

SEQ ID NO: 1666566 - RNA, 20 nt, Human
cuggcugguuagagguuccc

SEQ ID NO: 1666567 - RNA, 14 nt, Human
cuggccuuucauau

SEQ ID NO: 1666568 - RNA, 23 nt, Human
cuggcuuuucacugcuggcugcc

SEQ ID NO: 1666569 - RNA, 18 nt, Human
cuggcuguuggcuggggg

SEQ ID NO: 1666570 - RNA, 17 nt, Human
cugggagagccuuccag

SEQ ID NO: 1666571 - RNA, 18 nt, Human
cugggagagccuuccagg

SEQ ID NO: 1666572 - RNA, 21 nt, Human
cugggagagccuuccaggggu

SEQ ID NO: 1666573 - RNA, 19 nt, Human
cugggagagccuuccaggg

SEQ ID NO: 1666574 - RNA, 20 nt, Human
cugggagagccuuccagggg

SEQ ID NO: 1666575 - RNA, 20 nt, Human
cuggaagugcuaauuuugaa

SEQ ID NO: 1666576 - RNA, 18 nt, Human
cuggaauauauaaccagu

SEQ ID NO: 1666577 - RNA, 14 nt, Human
cuggcaagaaugug

SEQ ID NO: 1666578 - RNA, 14 nt, Human
cuggaaugcagugg

SEQ ID NO: 1666579 - RNA, 15 nt, Human
cuggcacagggcagu

SEQ ID NO: 1666580 - RNA, 16 nt, Human
cuggcacagggcagug

SEQ ID NO: 1666581 - RNA, 16 nt, Human
cuggcacccggccccu

SEQ ID NO: 1666582 - RNA, 17 nt, Human
cuggcacccggccccug

SEQ ID NO: 1666583 - RNA, 18 nt, Human
cuggcacccggccccugc

SEQ ID NO: 1666584 - RNA, 19 nt, Human
cuggcacccggccccugcu

SEQ ID NO: 1666585 - RNA, 24 nt, Human
cuggcaugggaaugaaugucagug

SEQ ID NO: 1666586 - RNA, 15 nt, Human
cuggcacuauaaugu

SEQ ID NO: 1666587 - RNA, 16 nt, Human
cuggcacuauaaugua

SEQ ID NO: 1666588 - RNA, 22 nt, Human
cuggcacuauaauguaagcucu

SEQ ID NO: 1666589 - RNA, 16 nt, Human
cuggcaugggaaugaa

SEQ ID NO: 1666590 - RNA, 18 nt, Human
cuggcaugggaaugaaug

SEQ ID NO: 1666591 - RNA, 19 nt, Human
cuggcaugggaaugaaugu

SEQ ID NO: 1666592 - RNA, 22 nt, Human
cuggcaugggaaugaaugucag

SEQ ID NO: 1666593 - RNA, 12 nt, Human
cuggccucugca

SEQ ID NO: 1666594 - RNA, 23 nt, Human
cuggccucaagugauucuccugc

SEQ ID NO: 1666595 - RNA, 14 nt, Human
cuggccuggccccu

SEQ ID NO: 1666596 - RNA, 18 nt, Human
cuggccugagcugggaug

SEQ ID NO: 1666597 - RNA, 13 nt, Human
cuggccucugcac

SEQ ID NO: 1666598 - RNA, 14 nt, Human
cuggccucugcacu

SEQ ID NO: 1666599 - RNA, 16 nt, Human
cuggccucugcacucc

SEQ ID NO: 1666600 - RNA, 16 nt, Human
cuggccugagcuggga

SEQ ID NO: 1666601 - RNA, 16 nt, Human
cuggccuucggccucc

SEQ ID NO: 1666602 - RNA, 17 nt, Human
cuggccuucggccucca

SEQ ID NO: 1666603 - RNA, 18 nt, Human
cuggccuucggccuccau

SEQ ID NO: 1666604 - RNA, 21 nt, Human
cuggccuucggccuccauccu

SEQ ID NO: 1666605 - RNA, 16 nt, Human
cuggccuggccccuca

SEQ ID NO: 1666606 - RNA, 17 nt, Human
cuggccuggccccucag

SEQ ID NO: 1666607 - RNA, 19 nt, Human
cuggccuggccccucaggg

SEQ ID NO: 1666608 - RNA, 15 nt, Human
cuggccuucggccuc

SEQ ID NO: 1666609 - RNA, 18 nt, Human
cuguaaggcaaucauggu

SEQ ID NO: 1666610 - RNA, 16 nt, Human
cugguuccauggccuc

SEQ ID NO: 1666611 - RNA, 23 nt, Human
cugguuaauauuuauaggucacu

SEQ ID NO: 1666612 - RNA, 20 nt, Human
cugguucaggguuggccccu

SEQ ID NO: 1666613 - RNA, 16 nt, Human
cuggucucgaacuccu

SEQ ID NO: 1666614 - RNA, 21 nt, Human
cuggucucgaacuccugaccu

SEQ ID NO: 1666615 - RNA, 12 nt, Human
cugguggcagcu

SEQ ID NO: 1666616 - RNA, 16 nt, Human
cugguggcagcucacc

SEQ ID NO: 1666617 - RNA, 13 nt, Human
cugguggcagcuc

SEQ ID NO: 1666618 - RNA, 14 nt, Human
cugguggcagcuca

SEQ ID NO: 1666619 - RNA, 17 nt, Human
cuguaauuugugauaca

SEQ ID NO: 1666620 - RNA, 18 nt, Human
cuguaauuugugauacaa

SEQ ID NO: 1666621 - RNA, 22 nt, Human
cuguaauuugugauacaaugcu

SEQ ID NO: 1666622 - RNA, 21 nt, Human
cuguaauuugugauacaaugc

SEQ ID NO: 1666623 - RNA, 23 nt, Human
cuguacagagcccacgcccccac

SEQ ID NO: 1666624 - RNA, 23 nt, Human
cuguacaugaaaacacauuuuuc

SEQ ID NO: 1666625 - RNA, 22 nt, Human
cuguacaugaaaacacauuuuu

SEQ ID NO: 1666626 - RNA, 21 nt, Human
cuguaccucuugagccuugaa

SEQ ID NO: 1666627 - RNA, 17 nt, Human
cugggucgcccuggacu

SEQ ID NO: 1666628 - RNA, 18 nt, Human
cugggucgcccuggacug

SEQ ID NO: 1666629 - RNA, 22 nt, Human
cugggucgcccuggacugugug

SEQ ID NO: 1666630 - RNA, 15 nt, Human
cuggguuggagggug

SEQ ID NO: 1666631 - RNA, 20 nt, Human
cugggcucccuucccaccuc

SEQ ID NO: 1666632 - RNA, 21 nt, Human
cugggcucccuucccaccucu

SEQ ID NO: 1666633 - RNA, 22 nt, Human
cugggcucccuucccaccucuc

SEQ ID NO: 1666634 - RNA, 19 nt, Human
cuggguacuuguggacaca

SEQ ID NO: 1666635 - RNA, 18 nt, Human
cuggguacuuguggacac

SEQ ID NO: 1666636 - RNA, 16 nt, Human
cuggguacuuguggac

SEQ ID NO: 1666637 - RNA, 20 nt, Human
cuggucacaggacucugccu

SEQ ID NO: 1666638 - RNA, 21 nt, Human
cuggucacaggacucugccuc

SEQ ID NO: 1666639 - RNA, 22 nt, Human
cuggucacaggacucugccucc

SEQ ID NO: 1666640 - RNA, 23 nt, Human
cuggucacaggacucugccuccu

SEQ ID NO: 1666641 - RNA, 23 nt, Human
cuggucucaaacucuugaccuca

SEQ ID NO: 1666642 - RNA, 14 nt, Human
cuggucccacucag

SEQ ID NO: 1666643 - RNA, 13 nt, Human
cuggucccacuca

SEQ ID NO: 1666644 - RNA, 15 nt, Human
cuguauagauuagag

SEQ ID NO: 1666645 - RNA, 20 nt, Human
cuguauagauuagaauucug

SEQ ID NO: 1666646 - RNA, 16 nt, Human
cuguauagauuagaga

SEQ ID NO: 1666647 - RNA, 22 nt, Human
cuguaccucuugagccuugaac

SEQ ID NO: 1666648 - RNA, 15 nt, Human
cuguaucccaugagc

SEQ ID NO: 1666649 - RNA, 19 nt, Human
cuguaucccaugagccuca

SEQ ID NO: 1666650 - RNA, 18 nt, Human
cuguaucccaugagccuc

SEQ ID NO: 1666651 - RNA, 15 nt, Human
cuguaugauucccag

SEQ ID NO: 1666652 - RNA, 20 nt, Human
cuguccaggcacugcugccc

SEQ ID NO: 1666653 - RNA, 21 nt, Human
cuguccaggcacugcugccca

SEQ ID NO: 1666654 - RNA, 22 nt, Human
cuguccaggcacugcugcccag

SEQ ID NO: 1666655 - RNA, 23 nt, Human
cuguccaggcacugcugcccagc

SEQ ID NO: 1666656 - RNA, 18 nt, Human
cuguccaggcacugcugc

SEQ ID NO: 1666657 - RNA, 19 nt, Human
cuguccaggcacugcugcc

SEQ ID NO: 1666658 - RNA, 22 nt, Human
cugucccagugccgagaaggaa

SEQ ID NO: 1666659 - RNA, 13 nt, Human
cuguauuuuaaaa

SEQ ID NO: 1666660 - RNA, 16 nt, Human
cuguauuuuaaaagaa

SEQ ID NO: 1666661 - RNA, 13 nt, Human
cugucccccugac

SEQ ID NO: 1666662 - RNA, 14 nt, Human
cugucccccugaca

SEQ ID NO: 1666663 - RNA, 16 nt, Human
cuguccuacucugugu

SEQ ID NO: 1666664 - RNA, 17 nt, Human
cuguccuacucuguguc

SEQ ID NO: 1666665 - RNA, 18 nt, Human
cuguccuacucuguguca

SEQ ID NO: 1666666 - RNA, 20 nt, Human
cuguccuacucugugucagg

SEQ ID NO: 1666667 - RNA, 18 nt, Human
cugucucaagagggcacu

SEQ ID NO: 1666668 - RNA, 19 nt, Human
cugucucaagagggcacug

SEQ ID NO: 1666669 - RNA, 20 nt, Human
cugucucaagagggcacugg

SEQ ID NO: 1666670 - RNA, 21 nt, Human
cugucucaagagggcacuggu

SEQ ID NO: 1666671 - RNA, 14 nt, Human
cuguccgagcuuug

SEQ ID NO: 1666672 - RNA, 21 nt, Human
cuguccuacucugugucaggu

SEQ ID NO: 1666673 - RNA, 22 nt, Human
cugucucaaaaaaagaaaaaga

SEQ ID NO: 1666674 - RNA, 18 nt, Human
cugucucuacuaaaaaua

SEQ ID NO: 1666675 - RNA, 18 nt, Human
cucuuuaaugucacaggc

SEQ ID NO: 1666676 - RNA, 13 nt, Human
cucuugguccugc

SEQ ID NO: 1666677 - RNA, 15 nt, Human
cucuugguccugcug

SEQ ID NO: 1666678 - RNA, 16 nt, Human
cucuugguccugcugc

SEQ ID NO: 1666679 - RNA, 17 nt, Human
cucuugguccugcugca

SEQ ID NO: 1666680 - RNA, 17 nt, Human
cucuuucccucccuucc

SEQ ID NO: 1666681 - RNA, 20 nt, Human
cucuuuaaugucacaggcag

SEQ ID NO: 1666682 - RNA, 21 nt, Human
cucuuuaaugucacaggcagg

SEQ ID NO: 1666683 - RNA, 22 nt, Human
cucuuuaaugucacaggcaggu

SEQ ID NO: 1666684 - RNA, 23 nt, Human
cucuuuaaugucacaggcagguc

SEQ ID NO: 1666685 - RNA, 21 nt, Human
cucuuggguucaagcgauucu

SEQ ID NO: 1666686 - RNA, 15 nt, Human
cucuugaacuccuga

SEQ ID NO: 1666687 - RNA, 19 nt, Human
cucuuggguucaagcgauu

SEQ ID NO: 1666688 - RNA, 22 nt, Human
cucuugaaauauaggaacuuaa

SEQ ID NO: 1666689 - RNA, 22 nt, Human
cucuucuuuaaagggauggcaa

SEQ ID NO: 1666690 - RNA, 22 nt, Human
cugaaauagacccacaagaggc

SEQ ID NO: 1666691 - RNA, 21 nt, Human
cugaaauaaacgucuuaaaua

SEQ ID NO: 1666692 - RNA, 23 nt, Human
cugaaagcccugagcuuucugcu

SEQ ID NO: 1666693 - RNA, 16 nt, Human
cugaaagcccugagcu

SEQ ID NO: 1666694 - RNA, 17 nt, Human
cugaaagcccugagcuu

SEQ ID NO: 1666695 - RNA, 18 nt, Human
cugaaagcccugagcuuu

SEQ ID NO: 1666696 - RNA, 19 nt, Human
cugaaagcccugagcuuuc

SEQ ID NO: 1666697 - RNA, 17 nt, Human
cucuuucuauuguuucu

SEQ ID NO: 1666698 - RNA, 15 nt, Human
cugaaagcccugagc

SEQ ID NO: 1666699 - RNA, 13 nt, Human
cugaaauuuccug

SEQ ID NO: 1666700 - RNA, 23 nt, Human
cugaaauuuccugggagcuuuug

SEQ ID NO: 1666701 - RNA, 16 nt, Human
cugaaauuuccuggga

SEQ ID NO: 1666702 - RNA, 18 nt, Human
cugaacacuccaauuaag

SEQ ID NO: 1666703 - RNA, 23 nt, Human
cugaacacuccaauuaaggauuu

SEQ ID NO: 1666704 - RNA, 16 nt, Human
cugaacucugacaaca

SEQ ID NO: 1666705 - RNA, 17 nt, Human
cugaacucugacaacag

SEQ ID NO: 1666706 - RNA, 19 nt, Human
cugaagaauugaaaaacca

SEQ ID NO: 1666707 - RNA, 23 nt, Human
cugaagaagcaccaaucaugaau

SEQ ID NO: 1666708 - RNA, 22 nt, Human
cucuggcuccagcuggccggga

SEQ ID NO: 1666709 - RNA, 22 nt, Human
cucugugagcaucacaguuuug

SEQ ID NO: 1666710 - RNA, 18 nt, Human
cucugugagcaucacagu

SEQ ID NO: 1666711 - RNA, 21 nt, Human
cucugugagcaucacaguuuu

SEQ ID NO: 1666712 - RNA, 19 nt, Human
cucugugucagguggggca

SEQ ID NO: 1666713 - RNA, 15 nt, Human
cucugugucaggugg

SEQ ID NO: 1666714 - RNA, 13 nt, Human
cucuuagaaaaac

SEQ ID NO: 1666715 - RNA, 15 nt, Human
cucuuagaaaaacca

SEQ ID NO: 1666716 - RNA, 13 nt, Human
cucuuccaggcug

SEQ ID NO: 1666717 - RNA, 14 nt, Human
cucuuccaggcugg

SEQ ID NO: 1666718 - RNA, 15 nt, Human
cucuuccaggcuggg

SEQ ID NO: 1666719 - RNA, 16 nt, Human
cucuggacaggcaugu

SEQ ID NO: 1666720 - RNA, 22 nt, Human
cucuggacaggcauguucucug

SEQ ID NO: 1666721 - RNA, 12 nt, Human
cucuggcagcuc

SEQ ID NO: 1666722 - RNA, 14 nt, Human
cucuggcagcucag

SEQ ID NO: 1666723 - RNA, 15 nt, Human
cucuggcagcucaga

SEQ ID NO: 1666724 - RNA, 16 nt, Human
cucuggcagcucagag

SEQ ID NO: 1666725 - RNA, 12 nt, Human
cucuggccuucg

SEQ ID NO: 1666726 - RNA, 15 nt, Human
cucuggcuccagcug

SEQ ID NO: 1666727 - RNA, 16 nt, Human
cucuggcuccagcugg

SEQ ID NO: 1666728 - RNA, 19 nt, Human
cucuggccuucggccucca

SEQ ID NO: 1666729 - RNA, 13 nt, Human
cucucuccucccu

SEQ ID NO: 1666730 - RNA, 21 nt, Human
cucugccugaagucacacagu

SEQ ID NO: 1666731 - RNA, 22 nt, Human
cucugccugaagucacacagug

SEQ ID NO: 1666732 - RNA, 15 nt, Human
cucuggacaggcaug

SEQ ID NO: 1666733 - RNA, 20 nt, Human
cucugcuugccaucccuccc

SEQ ID NO: 1666734 - RNA, 17 nt, Human
cucugcuugccaucccu

SEQ ID NO: 1666735 - RNA, 14 nt, Human
cucugcuugccauc

SEQ ID NO: 1666736 - RNA, 12 nt, Human
cucugcuugcca

SEQ ID NO: 1666737 - RNA, 17 nt, Human
cugaggaucagaguaau

SEQ ID NO: 1666738 - RNA, 19 nt, Human
cugaggaucagaguaaucc

SEQ ID NO: 1666739 - RNA, 12 nt, Human
cugaggcccaga

SEQ ID NO: 1666740 - RNA, 13 nt, Human
cugaggcccagag

SEQ ID NO: 1666741 - RNA, 14 nt, Human
cugaggcccagagg

SEQ ID NO: 1666742 - RNA, 15 nt, Human
cugaggcccagaggg

SEQ ID NO: 1666743 - RNA, 16 nt, Human
cugaggcccagagggc

SEQ ID NO: 1666744 - RNA, 17 nt, Human
cugaggcccagagggcc

SEQ ID NO: 1666745 - RNA, 18 nt, Human
cugaggcccagagggccu

SEQ ID NO: 1666746 - RNA, 19 nt, Human
cugaggcccagagggccug

SEQ ID NO: 1666747 - RNA, 21 nt, Human
cugaggcccagagggccugca

SEQ ID NO: 1666748 - RNA, 23 nt, Human
cugaggcccagagggccugcaag

SEQ ID NO: 1666749 - RNA, 14 nt, Human
cugaggcccuucuc

SEQ ID NO: 1666750 - RNA, 15 nt, Human
cugaggcccuucucu

SEQ ID NO: 1666751 - RNA, 18 nt, Human
cugaggcccuucucucca

SEQ ID NO: 1666752 - RNA, 19 nt, Human
cugaggcccuucucuccag

SEQ ID NO: 1666753 - RNA, 20 nt, Human
cugaggcccuucucuccagc

SEQ ID NO: 1666754 - RNA, 16 nt, Human
cugagccucagucucc

SEQ ID NO: 1666755 - RNA, 21 nt, Human
cugagccucagucucccuccc

SEQ ID NO: 1666756 - RNA, 16 nt, Human
cugagacagcccgggc

SEQ ID NO: 1666757 - RNA, 17 nt, Human
cugagacagcccgggcu

SEQ ID NO: 1666758 - RNA, 18 nt, Human
cugagacagcccgggcuc

SEQ ID NO: 1666759 - RNA, 17 nt, Human
cugagccagauuucacu

SEQ ID NO: 1666760 - RNA, 18 nt, Human
cugagccagauuucacuc

SEQ ID NO: 1666761 - RNA, 19 nt, Human
cugagccagauuucacucu

SEQ ID NO: 1666762 - RNA, 20 nt, Human
cugagccagauuucacucuc

SEQ ID NO: 1666763 - RNA, 21 nt, Human
cugagccagauuucacucucc

SEQ ID NO: 1666764 - RNA, 22 nt, Human
cugagccucagucucccucccu

SEQ ID NO: 1666765 - RNA, 16 nt, Human
cugagcgacagugaga

SEQ ID NO: 1666766 - RNA, 20 nt, Human
cugagcgacagugagacucu

SEQ ID NO: 1666767 - RNA, 16 nt, Human
cugacccaugcugccc

SEQ ID NO: 1666768 - RNA, 14 nt, Human
cugacccaugcugc

SEQ ID NO: 1666769 - RNA, 15 nt, Human
cugacccaugcugcc

SEQ ID NO: 1666770 - RNA, 13 nt, Human
cugacccaugcug

SEQ ID NO: 1666771 - RNA, 13 nt, Human
cugacccacugcu

SEQ ID NO: 1666772 - RNA, 14 nt, Human
cugacccacugcuu

SEQ ID NO: 1666773 - RNA, 22 nt, Human
cugacauuguuggccaaagcca

SEQ ID NO: 1666774 - RNA, 19 nt, Human
cugaagacucauucuucug

SEQ ID NO: 1666775 - RNA, 14 nt, Human
cugacaucucugca

SEQ ID NO: 1666776 - RNA, 15 nt, Human
cugacaucucugcaa

SEQ ID NO: 1666777 - RNA, 16 nt, Human
cugacaucucugcaau

SEQ ID NO: 1666778 - RNA, 14 nt, Human
cugagacagcccgg

SEQ ID NO: 1666779 - RNA, 15 nt, Human
cugagacagcccggg

SEQ ID NO: 1666780 - RNA, 11 nt, Human
cugagaaauuu

SEQ ID NO: 1666781 - RNA, 14 nt, Human
cugagaaauuuaua

SEQ ID NO: 1666782 - RNA, 22 nt, Human
cugagaaagacuauucaaacag

SEQ ID NO: 1666783 - RNA, 23 nt, Human
cugagaaagacuauucaaacagu

SEQ ID NO: 1666784 - RNA, 16 nt, Human
cugacuucuaaguaaa

SEQ ID NO: 1666785 - RNA, 18 nt, Human
cugacuguuuucucuuga

SEQ ID NO: 1666786 - RNA, 13 nt, Human
cugacuucuaagu

SEQ ID NO: 1666787 - RNA, 15 nt, Human
cugacuucuaaguaa

SEQ ID NO: 1666788 - RNA, 16 nt, Human
cugacuguuuucucuu

SEQ ID NO: 1666789 - RNA, 17 nt, Human
cugacucuuaagaagac

SEQ ID NO: 1666790 - RNA, 16 nt, Human
cuccugccucagccuc

SEQ ID NO: 1666791 - RNA, 15 nt, Human
cuccugccucagccu

SEQ ID NO: 1666792 - RNA, 16 nt, Human
cuccugugugugcgcc

SEQ ID NO: 1666793 - RNA, 19 nt, Human
cuccugugugugcgccuac

SEQ ID NO: 1666794 - RNA, 11 nt, Human
cuccugcaggc

SEQ ID NO: 1666795 - RNA, 12 nt, Human
cuccugcaggca

SEQ ID NO: 1666796 - RNA, 17 nt, Human
cuccugcaggcagccag

SEQ ID NO: 1666797 - RNA, 18 nt, Human
cuccugcaggcagccagg

SEQ ID NO: 1666798 - RNA, 20 nt, Human
cuccugcaggcagccaggcc

SEQ ID NO: 1666799 - RNA, 13 nt, Human
cuccugccucagc

SEQ ID NO: 1666800 - RNA, 14 nt, Human
cuccugccucagcc

SEQ ID NO: 1666801 - RNA, 11 nt, Human
cuccugcccuu

SEQ ID NO: 1666802 - RNA, 15 nt, Human
cuccucccggugccc

SEQ ID NO: 1666803 - RNA, 17 nt, Human
cuccucccggugcccaa

SEQ ID NO: 1666804 - RNA, 14 nt, Human
cuccucccggugcc

SEQ ID NO: 1666805 - RNA, 22 nt, Human
cuccucuccccagcaagugaga

SEQ ID NO: 1666806 - RNA, 15 nt, Human
cuccgccucccgggu

SEQ ID NO: 1666807 - RNA, 19 nt, Human
cucccuuuuaauccuggcu

SEQ ID NO: 1666808 - RNA, 20 nt, Human
cucccuuuuaauccuggcug

SEQ ID NO: 1666809 - RNA, 15 nt, Human
cuccgaccagacacc

SEQ ID NO: 1666810 - RNA, 13 nt, Human
cucccucauucca

SEQ ID NO: 1666811 - RNA, 19 nt, Human
cucccuauuuuuuuucugu

SEQ ID NO: 1666812 - RNA, 20 nt, Human
cucccuauuuuuuuucuguu

SEQ ID NO: 1666813 - RNA, 21 nt, Human
cucccuauuuuuuuucuguua

SEQ ID NO: 1666814 - RNA, 17 nt, Human
cucccuccaccucccug

SEQ ID NO: 1666815 - RNA, 15 nt, Human
cucccuccaccuccc

SEQ ID NO: 1666816 - RNA, 20 nt, Human
cucccggcuaugggggcacu

SEQ ID NO: 1666817 - RNA, 17 nt, Human
cucccuauuuuuuuucu

SEQ ID NO: 1666818 - RNA, 19 nt, Human
cucccgaauagcugggacu

SEQ ID NO: 1666819 - RNA, 18 nt, Human
cucccgaguagcugggac

SEQ ID NO: 1666820 - RNA, 13 nt, Human
cuccccugcuggg

SEQ ID NO: 1666821 - RNA, 14 nt, Human
cuccccugcugggu

SEQ ID NO: 1666822 - RNA, 17 nt, Human
cucccgaauagcuggga

SEQ ID NO: 1666823 - RNA, 16 nt, Human
cucccgaauagcuggg

SEQ ID NO: 1666824 - RNA, 18 nt, Human
cucccgaauagcugggac

SEQ ID NO: 1666825 - RNA, 16 nt, Human
cucccgaguagcuggg

SEQ ID NO: 1666826 - RNA, 17 nt, Human
cucccgaguagcuggga

SEQ ID NO: 1666827 - RNA, 12 nt, Human
cuccccagcaag

SEQ ID NO: 1666828 - RNA, 20 nt, Human
cuccccagcaagugagagcu

SEQ ID NO: 1666829 - RNA, 21 nt, Human
cuccccagcaagugagagcug

SEQ ID NO: 1666830 - RNA, 12 nt, Human
cuccccugcugg

SEQ ID NO: 1666831 - RNA, 22 nt, Human
cucccaacucaccccagcccca

SEQ ID NO: 1666832 - RNA, 22 nt, Human
cucccaaagugcugggauuaca

SEQ ID NO: 1666833 - RNA, 18 nt, Human
cucccaaagugcugggau

SEQ ID NO: 1666834 - RNA, 14 nt, Human
cuccaugugggcua

SEQ ID NO: 1666835 - RNA, 17 nt, Human
cucccaacucaccccag

SEQ ID NO: 1666836 - RNA, 11 nt, Human
cucccaucugu

SEQ ID NO: 1666837 - RNA, 14 nt, Human
cucccaucugugaa

SEQ ID NO: 1666838 - RNA, 15 nt, Human
cucccaucugugaaa

SEQ ID NO: 1666839 - RNA, 18 nt, Human
cucccaucugugaaagga

SEQ ID NO: 1666840 - RNA, 23 nt, Human
cucccaucugugaaaggaaagag

SEQ ID NO: 1666841 - RNA, 16 nt, Human
cuccaucuccacucca

SEQ ID NO: 1666842 - RNA, 13 nt, Human
cuccaugcugccu

SEQ ID NO: 1666843 - RNA, 13 nt, Human
cuccaugucucug

SEQ ID NO: 1666844 - RNA, 22 nt, Human
cuccaugucucugagcauuaga

SEQ ID NO: 1666845 - RNA, 17 nt, Human
cucccaaagugcuggga

SEQ ID NO: 1666846 - RNA, 13 nt, Human
cuccaugugggcu

SEQ ID NO: 1666847 - RNA, 18 nt, Human
cucacuauguugcccagg

SEQ ID NO: 1666848 - RNA, 11 nt, Human
cuccauccuga

SEQ ID NO: 1666849 - RNA, 16 nt, Human
cuccauccugaggcuc

SEQ ID NO: 1666850 - RNA, 18 nt, Human
cuccauccugaggcucca

SEQ ID NO: 1666851 - RNA, 20 nt, Human
cuccauccugaggcuccacu

SEQ ID NO: 1666852 - RNA, 13 nt, Human
cucuacaaaaagc

SEQ ID NO: 1666853 - RNA, 13 nt, Human
cucuacagaggcc

SEQ ID NO: 1666854 - RNA, 21 nt, Human
cucuacagcuaaucagcauuc

SEQ ID NO: 1666855 - RNA, 19 nt, Human
cucuacagaggccaugggc

SEQ ID NO: 1666856 - RNA, 14 nt, Human
cucuacagaggcca

SEQ ID NO: 1666857 - RNA, 16 nt, Human
cucuacagaggccaug

SEQ ID NO: 1666858 - RNA, 14 nt, Human
cucggcucacugca

SEQ ID NO: 1666859 - RNA, 17 nt, Human
cucggcucacugcaucc

SEQ ID NO: 1666860 - RNA, 18 nt, Human
cucggcucacugcauccu

SEQ ID NO: 1666861 - RNA, 13 nt, Human
cuccuucaccuuu

SEQ ID NO: 1666862 - RNA, 19 nt, Human
cuccuucacagaugggugc

SEQ ID NO: 1666863 - RNA, 20 nt, Human
cuccugugugugcgccuaca

SEQ ID NO: 1666864 - RNA, 16 nt, Human
cuccuucacagauggg

SEQ ID NO: 1666865 - RNA, 17 nt, Human
cuccuucacagaugggu

SEQ ID NO: 1666866 - RNA, 17 nt, Human
cucuacuuagcaugucc

SEQ ID NO: 1666867 - RNA, 19 nt, Human
cucuacuuagcaugucccu

SEQ ID NO: 1666868 - RNA, 20 nt, Human
cucuacuuagcaugucccua

SEQ ID NO: 1666869 - RNA, 16 nt, Human
cucuacuuagcauguc

SEQ ID NO: 1666870 - RNA, 20 nt, Human
cucuaccauccccuguagag

SEQ ID NO: 1666871 - RNA, 13 nt, Human
cucuacccuggca

SEQ ID NO: 1666872 - RNA, 15 nt, Human
cucuaggaaauauuu

SEQ ID NO: 1666873 - RNA, 23 nt, Human
cucuagggaaaaaccagcgugug

SEQ ID NO: 1666874 - RNA, 17 nt, Human
cucuaggaaauauuuau

SEQ ID NO: 1666875 - RNA, 22 nt, Human
cucucaggccagcugcuugggc

SEQ ID NO: 1666876 - RNA, 17 nt, Human
cucucaggccagcugcu

SEQ ID NO: 1666877 - RNA, 18 nt, Human
cucucaggccagcugcuu

SEQ ID NO: 1666878 - RNA, 19 nt, Human
cucucaggccagcugcuug

SEQ ID NO: 1666879 - RNA, 21 nt, Human
cucucaggccagcugcuuggg

SEQ ID NO: 1666880 - RNA, 11 nt, Human
cucuccacugc

SEQ ID NO: 1666881 - RNA, 12 nt, Human
cucuccacugcc

SEQ ID NO: 1666882 - RNA, 14 nt, Human
cucuccacugccuu

SEQ ID NO: 1666883 - RNA, 14 nt, Human
cucuccagccccug

SEQ ID NO: 1666884 - RNA, 15 nt, Human
cucuccagccccugg

SEQ ID NO: 1666885 - RNA, 16 nt, Human
cucuccagccccugga

SEQ ID NO: 1666886 - RNA, 17 nt, Human
cucuccagccccuggau

SEQ ID NO: 1666887 - RNA, 18 nt, Human
cucuccagccccuggaug

SEQ ID NO: 1666888 - RNA, 12 nt, Human
cucucaggccaa

SEQ ID NO: 1666889 - RNA, 20 nt, Human
cucucaggccaaacucaccu

SEQ ID NO: 1666890 - RNA, 21 nt, Human
cucucaggccaaacucaccug

SEQ ID NO: 1666891 - RNA, 22 nt, Human
cucucaggccaaacucaccugc

SEQ ID NO: 1666892 - RNA, 23 nt, Human
cucucaggccaaacucaccugcc

SEQ ID NO: 1666893 - RNA, 13 nt, Human
cucucaggccagc

SEQ ID NO: 1666894 - RNA, 15 nt, Human
cucucaggccagcug

SEQ ID NO: 1666895 - RNA, 15 nt, Human
cucuaguuugauuaa

SEQ ID NO: 1666896 - RNA, 20 nt, Human
cucuaguuugauuaaauucu

SEQ ID NO: 1666897 - RNA, 19 nt, Human
cucuaguuugauuaaauuc

SEQ ID NO: 1666898 - RNA, 21 nt, Human
cucuaguuugauuaaauucuu

SEQ ID NO: 1666899 - RNA, 14 nt, Human
cucucucacuccuu

SEQ ID NO: 1666900 - RNA, 12 nt, Human
cucucucacucc

SEQ ID NO: 1666901 - RNA, 19 nt, Human
cucuccugggcagcugccu

SEQ ID NO: 1666902 - RNA, 18 nt, Human
cucuccugggcagcugcc

SEQ ID NO: 1666903 - RNA, 16 nt, Human
cucuccugggcagcug

SEQ ID NO: 1666904 - RNA, 15 nt, Human
cucuccugggcagcu

SEQ ID NO: 1666905 - RNA, 12 nt, Human
cucuccugggca

SEQ ID NO: 1666906 - RNA, 20 nt, Human
cucuccugggcagcugccuc

SEQ ID NO: 1666907 - RNA, 15 nt, Human
cucuccacugccuuc

SEQ ID NO: 1666908 - RNA, 19 nt, Human
cucuccagccccuggaugc

SEQ ID NO: 1666909 - RNA, 14 nt, Human
cucuccccagcaag

SEQ ID NO: 1666910 - RNA, 22 nt, Human
cucuccccagcaagugagagcu

SEQ ID NO: 1666911 - RNA, 12 nt, Human
cucuccucugcu

SEQ ID NO: 1666912 - RNA, 24 nt, Human
cucuccccagcaagugagagcugg

SEQ ID NO: 1666913 - RNA, 13 nt, Human
cucuccucugcug

SEQ ID NO: 1666914 - RNA, 14 nt, Human
cucuccucugcugc

SEQ ID NO: 1666915 - RNA, 15 nt, Human
cucuccucugcugcu

SEQ ID NO: 1666916 - RNA, 18 nt, Human
cucuccucugcugcuggc

SEQ ID NO: 1666917 - RNA, 14 nt, Human
cucuccucuugcca

SEQ ID NO: 1666918 - RNA, 15 nt, Human
cucuccucuugccac

SEQ ID NO: 1666919 - RNA, 16 nt, Human
cucuccucuugccacu

SEQ ID NO: 1666920 - RNA, 17 nt, Human
cucuccucuugccacug

SEQ ID NO: 1666921 - RNA, 19 nt, Human
cucuccucuugccacugcc

SEQ ID NO: 1666922 - RNA, 22 nt, Human
cucuccucuugccacugccucu

SEQ ID NO: 1666923 - RNA, 13 nt, Human
cgccccuuccccc

SEQ ID NO: 1666924 - RNA, 16 nt, Human
cgcccuggacugugug

SEQ ID NO: 1666925 - RNA, 12 nt, Human
cgcccagucugg

SEQ ID NO: 1666926 - RNA, 22 nt, Human
cgcccaggcuuagucacugaga

SEQ ID NO: 1666927 - RNA, 22 nt, Human
cgccagauucuuuccugaggcu

SEQ ID NO: 1666928 - RNA, 17 nt, Human
ccucugcccacucccug

SEQ ID NO: 1666929 - RNA, 19 nt, Human
ccucugcccacucccugca

SEQ ID NO: 1666930 - RNA, 20 nt, Human
ccucugcccacucccugcaa

SEQ ID NO: 1666931 - RNA, 23 nt, Human
cgccaggggaaaaucagccugcu

SEQ ID NO: 1666932 - RNA, 14 nt, Human
cgccaucccagccc

SEQ ID NO: 1666933 - RNA, 16 nt, Human
cgccaucccagcccca

SEQ ID NO: 1666934 - RNA, 17 nt, Human
cgccaucccagccccaa

SEQ ID NO: 1666935 - RNA, 22 nt, Human
cgcuaagagggagggagggcuc

SEQ ID NO: 1666936 - RNA, 16 nt, Human
cgcuacccgggaaggg

SEQ ID NO: 1666937 - RNA, 16 nt, Human
cgcucagcccucccug

SEQ ID NO: 1666938 - RNA, 21 nt, Human
cgcucagcccucccugccccu

SEQ ID NO: 1666939 - RNA, 12 nt, Human
cgcucagcccuc

SEQ ID NO: 1666940 - RNA, 17 nt, Human
cgcuacccgggaagggg

SEQ ID NO: 1666941 - RNA, 14 nt, Human
cgcucucuggccuu

SEQ ID NO: 1666942 - RNA, 15 nt, Human
cgcucucuggccuuc

SEQ ID NO: 1666943 - RNA, 18 nt, Human
cgcugugcugcccugccc

SEQ ID NO: 1666944 - RNA, 20 nt, Human
cggaaaacaugcuacacacu

SEQ ID NO: 1666945 - RNA, 15 nt, Human
cggaaaacaugcuac

SEQ ID NO: 1666946 - RNA, 15 nt, Human
cgcugugcugcccug

SEQ ID NO: 1666947 - RNA, 16 nt, Human
cgcugugcugcccugc

SEQ ID NO: 1666948 - RNA, 17 nt, Human
cgcugugcugcccugcc

SEQ ID NO: 1666949 - RNA, 22 nt, Human
cgcugucagccauuccuguucc

SEQ ID NO: 1666950 - RNA, 18 nt, Human
cgcucucuggccuucggc

SEQ ID NO: 1666951 - RNA, 13 nt, Human
cggaagagccuug

SEQ ID NO: 1666952 - RNA, 14 nt, Human
cggaauaguuggcu

SEQ ID NO: 1666953 - RNA, 11 nt, Human
cggccaccugc

SEQ ID NO: 1666954 - RNA, 15 nt, Human
cggccaccugcggug

SEQ ID NO: 1666955 - RNA, 16 nt, Human
cggccaccugcggugc

SEQ ID NO: 1666956 - RNA, 17 nt, Human
cggccaccugcggugcu

SEQ ID NO: 1666957 - RNA, 13 nt, Human
cggccccugcugg

SEQ ID NO: 1666958 - RNA, 18 nt, Human
cggccccugcugguucag

SEQ ID NO: 1666959 - RNA, 19 nt, Human
cggccccugcugguucagg

SEQ ID NO: 1666960 - RNA, 24 nt, Human
cggccaggccagagggagugacag

SEQ ID NO: 1666961 - RNA, 11 nt, Human
cggcugcccuu

SEQ ID NO: 1666962 - RNA, 12 nt, Human
cggcugcccuuu

SEQ ID NO: 1666963 - RNA, 12 nt, Human
cggccuccaucc

SEQ ID NO: 1666964 - RNA, 14 nt, Human
cggccuccauccug

SEQ ID NO: 1666965 - RNA, 23 nt, Human
cggggacagcuccuucuguccua

SEQ ID NO: 1666966 - RNA, 15 nt, Human
cgggggcagagaggg

SEQ ID NO: 1666967 - RNA, 23 nt, Human
cggcuggccuggccccucagggu

SEQ ID NO: 1666968 - RNA, 22 nt, Human
cggcuggccuggccccucaggg

SEQ ID NO: 1666969 - RNA, 17 nt, Human
cgggauuaguacacacu

SEQ ID NO: 1666970 - RNA, 18 nt, Human
cgggaggucgaggcagga

SEQ ID NO: 1666971 - RNA, 20 nt, Human
cgggaggucgaggcaggagg

SEQ ID NO: 1666972 - RNA, 22 nt, Human
cggggacagcuccuucuguccu

SEQ ID NO: 1666973 - RNA, 14 nt, Human
cgggcacucagaag

SEQ ID NO: 1666974 - RNA, 22 nt, Human
cgggcacucagaagacacugau

SEQ ID NO: 1666975 - RNA, 19 nt, Human
cgggucacaggagggaggg

SEQ ID NO: 1666976 - RNA, 11 nt, Human
cgggucacagg

SEQ ID NO: 1666977 - RNA, 14 nt, Human
cgguccacccagga

SEQ ID NO: 1666978 - RNA, 15 nt, Human
cgguccacccaggag

SEQ ID NO: 1666979 - RNA, 16 nt, Human
cgguccacccaggagc

SEQ ID NO: 1666980 - RNA, 20 nt, Human
cgguccacccaggagccccg

SEQ ID NO: 1666981 - RNA, 21 nt, Human
cggguuuuauuguuuaaaauc

SEQ ID NO: 1666982 - RNA, 18 nt, Human
cggugaauggcuuuguau

SEQ ID NO: 1666983 - RNA, 20 nt, Human
cggugaauggcuuuguauag

SEQ ID NO: 1666984 - RNA, 22 nt, Human
cggugaauggcuuuguauagaa

SEQ ID NO: 1666985 - RNA, 20 nt, Human
cggugagaggggaacagacu

SEQ ID NO: 1666986 - RNA, 21 nt, Human
cggugagaggggaacagacug

SEQ ID NO: 1666987 - RNA, 17 nt, Human
cggugagcuacaaaugc

SEQ ID NO: 1666988 - RNA, 13 nt, Human
cggugaauggcuu

SEQ ID NO: 1666989 - RNA, 14 nt, Human
cggugaauggcuuu

SEQ ID NO: 1666990 - RNA, 15 nt, Human
cggugaauggcuuug

SEQ ID NO: 1666991 - RNA, 16 nt, Human
cggugaauggcuuugu

SEQ ID NO: 1666992 - RNA, 22 nt, Human
cggucggguuuuauuguuuaaa

SEQ ID NO: 1666993 - RNA, 16 nt, Human
cgucucauacucaccu

SEQ ID NO: 1666994 - RNA, 16 nt, Human
cgucuaccugaggggc

SEQ ID NO: 1666995 - RNA, 18 nt, Human
cggugcuaucucccccag

SEQ ID NO: 1666996 - RNA, 20 nt, Human
cggugcuaucucccccagcc

SEQ ID NO: 1666997 - RNA, 21 nt, Human
cggugcuaucucccccagccc

SEQ ID NO: 1666998 - RNA, 22 nt, Human
cggugcuaucucccccagcccc

SEQ ID NO: 1666999 - RNA, 16 nt, Human
cgugcacacaccagag

SEQ ID NO: 1667000 - RNA, 20 nt, Human
cgucugacaggcaaugcugg

SEQ ID NO: 1667001 - RNA, 21 nt, Human
cgucugacaggcaaugcuggc

SEQ ID NO: 1667002 - RNA, 22 nt, Human
cgucugacaggcaaugcuggcu

SEQ ID NO: 1667003 - RNA, 21 nt, Human
cgugcaguggugcgaucuggg

SEQ ID NO: 1667004 - RNA, 22 nt, Human
cgugcaguggugcgaucugggu

SEQ ID NO: 1667005 - RNA, 18 nt, Human
cgugcacacaccagagcc

SEQ ID NO: 1667006 - RNA, 19 nt, Human
cgugcacacaccagagccc

SEQ ID NO: 1667007 - RNA, 23 nt, Human
cguugaaauuguaauuauaucug

SEQ ID NO: 1667008 - RNA, 20 nt, Human
cguggcuucccgcucagccc

SEQ ID NO: 1667009 - RNA, 21 nt, Human
cguggcuucccgcucagcccu

SEQ ID NO: 1667010 - RNA, 18 nt, Human
cguggcuucccgcucagc

SEQ ID NO: 1667011 - RNA, 19 nt, Human
cguggcuucccgcucagcc

SEQ ID NO: 1667012 - RNA, 16 nt, Human
cgugcuaaggacuugu

SEQ ID NO: 1667013 - RNA, 12 nt, Human
cgugcuaaggac

SEQ ID NO: 1667014 - RNA, 13 nt, Human
cgugcuaaggacu

SEQ ID NO: 1667015 - RNA, 14 nt, Human
cgugcuaaggacuu

SEQ ID NO: 1667016 - RNA, 15 nt, Human
cgugcuaaggacuug

SEQ ID NO: 1667017 - RNA, 17 nt, Human
cuaaauccauuuggaaa

SEQ ID NO: 1667018 - RNA, 19 nt, Human
cuaaauccauuuggaaauc

SEQ ID NO: 1667019 - RNA, 20 nt, Human
cuaaauccauuuggaaaucu

SEQ ID NO: 1667020 - RNA, 16 nt, Human
cuaaauccauuuggaa

SEQ ID NO: 1667021 - RNA, 18 nt, Human
cuaaauauauuuuaagac

SEQ ID NO: 1667022 - RNA, 20 nt, Human
cuaaauauauuuuaagacga

SEQ ID NO: 1667023 - RNA, 20 nt, Human
cuaaaucuccaaaauaaaac

SEQ ID NO: 1667024 - RNA, 15 nt, Human
cuaaauggaaccacu

SEQ ID NO: 1667025 - RNA, 17 nt, Human
cuaaauggaaccacucu

SEQ ID NO: 1667026 - RNA, 16 nt, Human
cuaaauggaaccacuc

SEQ ID NO: 1667027 - RNA, 18 nt, Human
cuaaauggaaccacucua

SEQ ID NO: 1667028 - RNA, 16 nt, Human
cuaaauguugaaagau

SEQ ID NO: 1667029 - RNA, 23 nt, Human
cuaaauugacacuuaaaaauggu

SEQ ID NO: 1667030 - RNA, 15 nt, Human
cuaacaugauuuggg

SEQ ID NO: 1667031 - RNA, 15 nt, Human
cuaacauggaaguac

SEQ ID NO: 1667032 - RNA, 17 nt, Human
cuaacauggaaguacua

SEQ ID NO: 1667033 - RNA, 18 nt, Human
cuauuuuaauaaacacuc

SEQ ID NO: 1667034 - RNA, 22 nt, Human
cuauuuuaauaaacacucuuga

SEQ ID NO: 1667035 - RNA, 14 nt, Human
cuaugcauuugaaa

SEQ ID NO: 1667036 - RNA, 19 nt, Human
cucaagagggcacuggugg

SEQ ID NO: 1667037 - RNA, 21 nt, Human
cucaagagggcacugguggcc

SEQ ID NO: 1667038 - RNA, 17 nt, Human
cucaagagggcacuggu

SEQ ID NO: 1667039 - RNA, 13 nt, Human
cucaaauuucuaa

SEQ ID NO: 1667040 - RNA, 20 nt, Human
cucaacucuccuccagaguc

SEQ ID NO: 1667041 - RNA, 21 nt, Human
cucaacucuccuccagaguca

SEQ ID NO: 1667042 - RNA, 18 nt, Human
cucaagugauucuccugc

SEQ ID NO: 1667043 - RNA, 19 nt, Human
cucaagugauucuccugcc

SEQ ID NO: 1667044 - RNA, 20 nt, Human
cucaagugauucuccugccu

SEQ ID NO: 1667045 - RNA, 21 nt, Human
cucaagugauucuccugccuc

SEQ ID NO: 1667046 - RNA, 20 nt, Human
cucaccagccccagugccca

SEQ ID NO: 1667047 - RNA, 21 nt, Human
cucaccagccccagugcccac

SEQ ID NO: 1667048 - RNA, 19 nt, Human
cucaccagccccagugccc

SEQ ID NO: 1667049 - RNA, 13 nt, Human
cucacauuuauau

SEQ ID NO: 1667050 - RNA, 14 nt, Human
cucaccccagcccc

SEQ ID NO: 1667051 - RNA, 12 nt, Human
cucaccccagcc

SEQ ID NO: 1667052 - RNA, 13 nt, Human
cucaccccagccc

SEQ ID NO: 1667053 - RNA, 20 nt, Human
cucacuaucccggcugcccu

SEQ ID NO: 1667054 - RNA, 21 nt, Human
cucacuaucccggcugcccuu

SEQ ID NO: 1667055 - RNA, 20 nt, Human
cucacuaggcuucugguuga

SEQ ID NO: 1667056 - RNA, 16 nt, Human
cucacuauguugccca

SEQ ID NO: 1667057 - RNA, 17 nt, Human
cucacuauguugcccag

SEQ ID NO: 1667058 - RNA, 13 nt, Human
cucacuaggcuuc

SEQ ID NO: 1667059 - RNA, 16 nt, Human
cucacuaggcuucugg

SEQ ID NO: 1667060 - RNA, 17 nt, Human
cucaccccuugccauaa

SEQ ID NO: 1667061 - RNA, 21 nt, Human
cuaugcauuugaaaauuuuga

SEQ ID NO: 1667062 - RNA, 12 nt, Human
cuaugcauuuga

SEQ ID NO: 1667063 - RNA, 11 nt, Human
cuaugcauuug

SEQ ID NO: 1667064 - RNA, 14 nt, Human
cuaguuccaccauc

SEQ ID NO: 1667065 - RNA, 12 nt, Human
cuaguucacucu

SEQ ID NO: 1667066 - RNA, 18 nt, Human
cuauauaugugaugaucu

SEQ ID NO: 1667067 - RNA, 23 nt, Human
cuauauaugugaugaucuaccag

SEQ ID NO: 1667068 - RNA, 22 nt, Human
cuauauuguuuucaguguacau

SEQ ID NO: 1667069 - RNA, 19 nt, Human
cuauauuguuugcuaagca

SEQ ID NO: 1667070 - RNA, 23 nt, Human
cuauauuguuuucaguguacaug

SEQ ID NO: 1667071 - RNA, 20 nt, Human
cuauauuuuuuguuaaauga

SEQ ID NO: 1667072 - RNA, 20 nt, Human
cuaucaaguauuauaccuuu

SEQ ID NO: 1667073 - RNA, 22 nt, Human
cuauauuuuuuguuaaaugauu

SEQ ID NO: 1667074 - RNA, 13 nt, Human
cuaugaaauauua

SEQ ID NO: 1667075 - RNA, 18 nt, Human
cuaugaaauauuauguua

SEQ ID NO: 1667076 - RNA, 14 nt, Human
cuaugacacaugca

SEQ ID NO: 1667077 - RNA, 22 nt, Human
cuaggacugaauuaugaaacuu

SEQ ID NO: 1667078 - RNA, 22 nt, Human
cuaggaccccuccaugugggcu

SEQ ID NO: 1667079 - RNA, 17 nt, Human
cuaggaggucucuaaga

SEQ ID NO: 1667080 - RNA, 16 nt, Human
cuaggaaauccagggu

SEQ ID NO: 1667081 - RNA, 17 nt, Human
cuaggaaauccagggug

SEQ ID NO: 1667082 - RNA, 21 nt, Human
cuaggaagacuuuggaaagag

SEQ ID NO: 1667083 - RNA, 13 nt, Human
cuaggaacacucc

SEQ ID NO: 1667084 - RNA, 15 nt, Human
cuaggaacacuccuu

SEQ ID NO: 1667085 - RNA, 12 nt, Human
cuagcagcaggg

SEQ ID NO: 1667086 - RNA, 19 nt, Human
cuagugugguguuuccugg

SEQ ID NO: 1667087 - RNA, 23 nt, Human
cuagugugguguuuccuggcacu

SEQ ID NO: 1667088 - RNA, 21 nt, Human
cuagugugguguuuccuggca

SEQ ID NO: 1667089 - RNA, 22 nt, Human
cuagugugguguuuccuggcac

SEQ ID NO: 1667090 - RNA, 21 nt, Human
cuaggcauuugcugaauacag

SEQ ID NO: 1667091 - RNA, 22 nt, Human
cuaguauuucuaugaaauauua

SEQ ID NO: 1667092 - RNA, 19 nt, Human
cuaguauuucuaugaaaua

SEQ ID NO: 1667093 - RNA, 20 nt, Human
cuaguauuucuaugaaauau

SEQ ID NO: 1667094 - RNA, 15 nt, Human
cuaguaucaaaagaa

SEQ ID NO: 1667095 - RNA, 17 nt, Human
cuaguaucaaaagaaag

SEQ ID NO: 1667096 - RNA, 23 nt, Human
cuaguaucaaaagaaagaaaauc

SEQ ID NO: 1667097 - RNA, 21 nt, Human
cuacuguaauuugugauacaa

SEQ ID NO: 1667098 - RNA, 17 nt, Human
cuagcacuuugggaggc

SEQ ID NO: 1667099 - RNA, 17 nt, Human
cuagagugaacuugggc

SEQ ID NO: 1667100 - RNA, 21 nt, Human
cuagagugaacuugggccacu

SEQ ID NO: 1667101 - RNA, 15 nt, Human
cuagagguucaaaga

SEQ ID NO: 1667102 - RNA, 18 nt, Human
cuagacucccaagcugga

SEQ ID NO: 1667103 - RNA, 20 nt, Human
cuagacgagcaggcuucuuc

SEQ ID NO: 1667104 - RNA, 21 nt, Human
cuagacgagcaggcuucuucc

SEQ ID NO: 1667105 - RNA, 21 nt, Human
cuacuguaaggcaaucauggu

SEQ ID NO: 1667106 - RNA, 16 nt, Human
cuacuguaauuuguga

SEQ ID NO: 1667107 - RNA, 17 nt, Human
cuacuguaauuugugau

SEQ ID NO: 1667108 - RNA, 14 nt, Human
cuacugaggugcua

SEQ ID NO: 1667109 - RNA, 16 nt, Human
cuacucugugucaggu

SEQ ID NO: 1667110 - RNA, 21 nt, Human
cuacucugugucagguggggc

SEQ ID NO: 1667111 - RNA, 14 nt, Human
cuacccgggaaggg

SEQ ID NO: 1667112 - RNA, 15 nt, Human
cuacccgggaagggg

SEQ ID NO: 1667113 - RNA, 20 nt, Human
cuacccgggaagggggcugg

SEQ ID NO: 1667114 - RNA, 21 nt, Human
cuacccgggaagggggcuggg

SEQ ID NO: 1667115 - RNA, 20 nt, Human
cuacuuccugugacuucagc

SEQ ID NO: 1667116 - RNA, 14 nt, Human
cuacuuccccuucc

SEQ ID NO: 1667117 - RNA, 15 nt, Human
cuacuuccccuuccu

SEQ ID NO: 1667118 - RNA, 20 nt, Human
cuacuuccccuuccuaauuc

SEQ ID NO: 1667119 - RNA, 22 nt, Human
cuacuuauuguagcauccugga

SEQ ID NO: 1667120 - RNA, 15 nt, Human
cuacuugggaggcug

SEQ ID NO: 1667121 - RNA, 18 nt, Human
cuacuugggaggcugaga

SEQ ID NO: 1667122 - RNA, 19 nt, Human
cuacuugggaggcugagau

SEQ ID NO: 1667123 - RNA, 14 nt, Human
cuaaggcugaacuu

SEQ ID NO: 1667124 - RNA, 15 nt, Human
cuaaggugugcucug

SEQ ID NO: 1667125 - RNA, 16 nt, Human
cuaaggacuuguuaga

SEQ ID NO: 1667126 - RNA, 17 nt, Human
cuaaggacuuguuagau

SEQ ID NO: 1667127 - RNA, 11 nt, Human
cuaaggacuug

SEQ ID NO: 1667128 - RNA, 19 nt, Human
cuaagcuauucaguaauaa

SEQ ID NO: 1667129 - RNA, 21 nt, Human
cuaagcuauucaguaauaacu

SEQ ID NO: 1667130 - RNA, 15 nt, Human
cuaagcaaaauguga

SEQ ID NO: 1667131 - RNA, 18 nt, Human
cuaagcaaaaugugauau

SEQ ID NO: 1667132 - RNA, 16 nt, Human
cuaaccagcagaaaug

SEQ ID NO: 1667133 - RNA, 17 nt, Human
cuaaccacgcuggaccu

SEQ ID NO: 1667134 - RNA, 17 nt, Human
cuaaccagcagaaaugc

SEQ ID NO: 1667135 - RNA, 14 nt, Human
cuaagcaaaaugug

SEQ ID NO: 1667136 - RNA, 17 nt, Human
cuacagaggccaugggc

SEQ ID NO: 1667137 - RNA, 18 nt, Human
cuaccauccccuguagag

SEQ ID NO: 1667138 - RNA, 17 nt, Human
cuacccacccuccuuuc

SEQ ID NO: 1667139 - RNA, 22 nt, Human
cuacccacccuccuuucaccac

SEQ ID NO: 1667140 - RNA, 12 nt, Human
cuacccaggugc

SEQ ID NO: 1667141 - RNA, 20 nt, Human
cuacccagcgagcccuggug

SEQ ID NO: 1667142 - RNA, 19 nt, Human
cuacccagcgagcccuggu

SEQ ID NO: 1667143 - RNA, 15 nt, Human
cuacagaggccaugg

SEQ ID NO: 1667144 - RNA, 15 nt, Human
cuacacacugcaugu

SEQ ID NO: 1667145 - RNA, 13 nt, Human
cuacacacugcau

SEQ ID NO: 1667146 - RNA, 21 nt, Human
cuacacacugcauguuuguga

SEQ ID NO: 1667147 - RNA, 16 nt, Human
cuacacuccagugaga

SEQ ID NO: 1667148 - RNA, 17 nt, Human
cuacacuccagugagac

SEQ ID NO: 1667149 - RNA, 17 nt, Human
cuaaucagcauucucac

SEQ ID NO: 1667150 - RNA, 19 nt, Human
cuaaucagcauucucacuc

SEQ ID NO: 1667151 - RNA, 16 nt, Human
cuaauccucuuuuucu

SEQ ID NO: 1667152 - RNA, 13 nt, Human
cuaauaaagcugu

SEQ ID NO: 1667153 - RNA, 12 nt, Human
cuaauaaagcug

SEQ ID NO: 1667154 - RNA, 21 nt, Human
cuaauaaaauuuaaaagucuu

SEQ ID NO: 1667155 - RNA, 16 nt, Human
cuaaggugugcucuga

SEQ ID NO: 1667156 - RNA, 19 nt, Human
cuaaugaaugcauaaaaug

SEQ ID NO: 1667157 - RNA, 22 nt, Human
cuaaugaaugcauaaaauguua

SEQ ID NO: 1667158 - RNA, 16 nt, Human
cuaauguacugcauau

SEQ ID NO: 1667159 - RNA, 14 nt, Human
cuaauguacugcau

SEQ ID NO: 1667160 - RNA, 16 nt, Human
ccuccucucugcccua

SEQ ID NO: 1667161 - RNA, 13 nt, Human
ccuccucucugcc

SEQ ID NO: 1667162 - RNA, 15 nt, Human
ccuccucucugcccu

SEQ ID NO: 1667163 - RNA, 21 nt, Human
ccuccuccagccgccaugcuc

SEQ ID NO: 1667164 - RNA, 20 nt, Human
ccucuccccagcaagugaga

SEQ ID NO: 1667165 - RNA, 13 nt, Human
ccucucccuugga

SEQ ID NO: 1667166 - RNA, 22 nt, Human
ccucucccuuggauuguccccg

SEQ ID NO: 1667167 - RNA, 15 nt, Human
ccucuccccagcaag

SEQ ID NO: 1667168 - RNA, 21 nt, Human
ccucugacacacagcucuguc

SEQ ID NO: 1667169 - RNA, 13 nt, Human
ccucugacacaca

SEQ ID NO: 1667170 - RNA, 15 nt, Human
ccucugacacacagc

SEQ ID NO: 1667171 - RNA, 14 nt, Human
ccucugacacacag

SEQ ID NO: 1667172 - RNA, 19 nt, Human
ccucugacacacagcucug

SEQ ID NO: 1667173 - RNA, 20 nt, Human
ccucugacacacagcucugu

SEQ ID NO: 1667174 - RNA, 19 nt, Human
ccucugcagcaauaaagca

SEQ ID NO: 1667175 - RNA, 19 nt, Human
ccucugcacuccccugcug

SEQ ID NO: 1667176 - RNA, 13 nt, Human
ccucugcccacuc

SEQ ID NO: 1667177 - RNA, 16 nt, Human
ccucugcccacucccu

SEQ ID NO: 1667178 - RNA, 18 nt, Human
ccucugcagcaauaaagc

SEQ ID NO: 1667179 - RNA, 14 nt, Human
ccucugcagcaaua

SEQ ID NO: 1667180 - RNA, 23 nt, Human
ccucugcacuccccugcugggug

SEQ ID NO: 1667181 - RNA, 18 nt, Human
ccucugcacuccccugcu

SEQ ID NO: 1667182 - RNA, 13 nt, Human
ccucugaggcuga

SEQ ID NO: 1667183 - RNA, 11 nt, Human
ccucugagccu

SEQ ID NO: 1667184 - RNA, 12 nt, Human
ccucugagccuu

SEQ ID NO: 1667185 - RNA, 16 nt, Human
ccucugcacuccccug

SEQ ID NO: 1667186 - RNA, 17 nt, Human
ccucugcacuccccugc

SEQ ID NO: 1667187 - RNA, 21 nt, Human
ccucccgaauagcugggacua

SEQ ID NO: 1667188 - RNA, 12 nt, Human
ccucauacccac

SEQ ID NO: 1667189 - RNA, 17 nt, Human
ccucaggugagaagcag

SEQ ID NO: 1667190 - RNA, 18 nt, Human
ccucaggugagaagcaga

SEQ ID NO: 1667191 - RNA, 20 nt, Human
ccucaggugagaagcagagg

SEQ ID NO: 1667192 - RNA, 17 nt, Human
ccuccaggugcacaagc

SEQ ID NO: 1667193 - RNA, 11 nt, Human
ccuccaggugc

SEQ ID NO: 1667194 - RNA, 12 nt, Human
ccuccaggugca

SEQ ID NO: 1667195 - RNA, 12 nt, Human
ccuccauguggg

SEQ ID NO: 1667196 - RNA, 15 nt, Human
ccuccaugugggcua

SEQ ID NO: 1667197 - RNA, 17 nt, Human
ccucccaaagugcuggg

SEQ ID NO: 1667198 - RNA, 14 nt, Human
ccucccaacucacc

SEQ ID NO: 1667199 - RNA, 19 nt, Human
ccuccaugcugccuccaga

SEQ ID NO: 1667200 - RNA, 14 nt, Human
ccuccauccugagg

SEQ ID NO: 1667201 - RNA, 16 nt, Human
ccuccaugcugccucc

SEQ ID NO: 1667202 - RNA, 12 nt, Human
ccuccauccuga

SEQ ID NO: 1667203 - RNA, 13 nt, Human
ccuccauccugag

SEQ ID NO: 1667204 - RNA, 19 nt, Human
ccucccgaguagcugggac

SEQ ID NO: 1667205 - RNA, 17 nt, Human
ccucccgaguagcuggg

SEQ ID NO: 1667206 - RNA, 18 nt, Human
ccucccgaguagcuggga

SEQ ID NO: 1667207 - RNA, 19 nt, Human
ccucccgaauagcugggac

SEQ ID NO: 1667208 - RNA, 20 nt, Human
ccucccgaauagcugggacu

SEQ ID NO: 1667209 - RNA, 13 nt, Human
ccucccucuuucc

SEQ ID NO: 1667210 - RNA, 11 nt, Human
ccuccucagau

SEQ ID NO: 1667211 - RNA, 12 nt, Human
ccuccuccagcc

SEQ ID NO: 1667212 - RNA, 15 nt, Human
ccucccaacucaccc

SEQ ID NO: 1667213 - RNA, 18 nt, Human
ccucccgaauagcuggga

SEQ ID NO: 1667214 - RNA, 14 nt, Human
ccuccccuccucug

SEQ ID NO: 1667215 - RNA, 13 nt, Human
ccuccccuccucu

SEQ ID NO: 1667216 - RNA, 15 nt, Human
ccuccccuccuccug

SEQ ID NO: 1667217 - RNA, 12 nt, Human
ccuccccuccuc

SEQ ID NO: 1667218 - RNA, 16 nt, Human
ccucagagccaccccu

SEQ ID NO: 1667219 - RNA, 14 nt, Human
ccucacccuggggc

SEQ ID NO: 1667220 - RNA, 14 nt, Human
ccucagcauccugg

SEQ ID NO: 1667221 - RNA, 16 nt, Human
ccucagaucuucugug

SEQ ID NO: 1667222 - RNA, 16 nt, Human
ccucagggucccuggu

SEQ ID NO: 1667223 - RNA, 17 nt, Human
ccucagggucccuggug

SEQ ID NO: 1667224 - RNA, 20 nt, Human
ccucagggucccugguggca

SEQ ID NO: 1667225 - RNA, 22 nt, Human
ccucagggucccugguggcagc

SEQ ID NO: 1667226 - RNA, 17 nt, Human
ccuauuagagaagagau

SEQ ID NO: 1667227 - RNA, 16 nt, Human
ccuauuagagaagaga

SEQ ID NO: 1667228 - RNA, 24 nt, Human
ccucacaguccuuaccagcagagc

SEQ ID NO: 1667229 - RNA, 23 nt, Human
ccucacaguccuuaccagcagag

SEQ ID NO: 1667230 - RNA, 18 nt, Human
ccuaggugacagagugag

SEQ ID NO: 1667231 - RNA, 15 nt, Human
ccuaggugacagagu

SEQ ID NO: 1667232 - RNA, 22 nt, Human
ccucaggugagaagcagaggaa

SEQ ID NO: 1667233 - RNA, 14 nt, Human
cccuguucacucua

SEQ ID NO: 1667234 - RNA, 22 nt, Human
cccuguucacucuacuuagcau

SEQ ID NO: 1667235 - RNA, 13 nt, Human
cccuguucacucu

SEQ ID NO: 1667236 - RNA, 13 nt, Human
cccuuccuaauuc

SEQ ID NO: 1667237 - RNA, 14 nt, Human
cccuuccuaauucc

SEQ ID NO: 1667238 - RNA, 19 nt, Human
cccuuccuaauuccacagc

SEQ ID NO: 1667239 - RNA, 20 nt, Human
cccuuccuaauuccacagcu

SEQ ID NO: 1667240 - RNA, 11 nt, Human
cccuucauuug

SEQ ID NO: 1667241 - RNA, 12 nt, Human
cccuucccaccu

SEQ ID NO: 1667242 - RNA, 13 nt, Human
cccuucccaccuc

SEQ ID NO: 1667243 - RNA, 22 nt, Human
cccuuguggucccaccccacac

SEQ ID NO: 1667244 - RNA, 22 nt, Human
cccuugguuaggcauuguggga

SEQ ID NO: 1667245 - RNA, 23 nt, Human
cccuugguuaggcauugugggaa

SEQ ID NO: 1667246 - RNA, 21 nt, Human
cccuuccuaauuccacagcug

SEQ ID NO: 1667247 - RNA, 11 nt, Human
cccuucuuuuu

SEQ ID NO: 1667248 - RNA, 19 nt, Human
cccuucuuuuucuucuuuu

SEQ ID NO: 1667249 - RNA, 17 nt, Human
cccuuggauuguccccg

SEQ ID NO: 1667250 - RNA, 17 nt, Human
ccggaggggccuggcag

SEQ ID NO: 1667251 - RNA, 21 nt, Human
ccggaggggccuggcagccgu

SEQ ID NO: 1667252 - RNA, 17 nt, Human
ccgggaagggggcuggg

SEQ ID NO: 1667253 - RNA, 16 nt, Human
ccgggagccugaucac

SEQ ID NO: 1667254 - RNA, 23 nt, Human
ccgggagccugaucaccugcccu

SEQ ID NO: 1667255 - RNA, 22 nt, Human
ccgggaggcagagguugcagug

SEQ ID NO: 1667256 - RNA, 12 nt, Human
ccguuauuaaaa

SEQ ID NO: 1667257 - RNA, 22 nt, Human
ccuagguauaauucacauugua

SEQ ID NO: 1667258 - RNA, 13 nt, Human
ccuaggugacaga

SEQ ID NO: 1667259 - RNA, 16 nt, Human
ccuacuuccccuuccu

SEQ ID NO: 1667260 - RNA, 13 nt, Human
ccuacuuccccuu

SEQ ID NO: 1667261 - RNA, 21 nt, Human
ccuagaaauuccccacccuga

SEQ ID NO: 1667262 - RNA, 19 nt, Human
ccuacuguaauuugugaua

SEQ ID NO: 1667263 - RNA, 18 nt, Human
ccuacccacccuccuuuc

SEQ ID NO: 1667264 - RNA, 18 nt, Human
ccuacaggagugagcacu

SEQ ID NO: 1667265 - RNA, 13 nt, Human
ccuacccacccuc

SEQ ID NO: 1667266 - RNA, 22 nt, Human
ccuacauguauuuguuugcaua

SEQ ID NO: 1667267 - RNA, 20 nt, Human
ccuaaauccauuuggaaauc

SEQ ID NO: 1667268 - RNA, 21 nt, Human
ccuaaauccauuuggaaaucu

SEQ ID NO: 1667269 - RNA, 22 nt, Human
ccuacaguugaaaaacagcuga

SEQ ID NO: 1667270 - RNA, 19 nt, Human
ccuacagcuugaccgugag

SEQ ID NO: 1667271 - RNA, 16 nt, Human
ccuaaaauucagugga

SEQ ID NO: 1667272 - RNA, 19 nt, Human
ccuaaauccauuuggaaau

SEQ ID NO: 1667273 - RNA, 13 nt, Human
ccuaaacauauga

SEQ ID NO: 1667274 - RNA, 14 nt, Human
cccugguggcagcu

SEQ ID NO: 1667275 - RNA, 21 nt, Human
cccugccucucugcagguccc

SEQ ID NO: 1667276 - RNA, 22 nt, Human
cccugccucucugcaggucccu

SEQ ID NO: 1667277 - RNA, 13 nt, Human
cccugcugguuca

SEQ ID NO: 1667278 - RNA, 23 nt, Human
cccugcuuugggcugcccuggug

SEQ ID NO: 1667279 - RNA, 19 nt, Human
cccugcugguucaggguug

SEQ ID NO: 1667280 - RNA, 20 nt, Human
cccugcugguucaggguugg

SEQ ID NO: 1667281 - RNA, 16 nt, Human
cccugggaggcucugg

SEQ ID NO: 1667282 - RNA, 17 nt, Human
cccugggaggcucugga

SEQ ID NO: 1667283 - RNA, 18 nt, Human
cccugggaggcucuggag

SEQ ID NO: 1667284 - RNA, 17 nt, Human
cccuggugcugccacac

SEQ ID NO: 1667285 - RNA, 21 nt, Human
cccuggugcugccacacuuca

SEQ ID NO: 1667286 - RNA, 22 nt, Human
cccugguggcagugggagcugc

SEQ ID NO: 1667287 - RNA, 11 nt, Human
cccugccucuc

SEQ ID NO: 1667288 - RNA, 18 nt, Human
cccugccucucugcaggu

SEQ ID NO: 1667289 - RNA, 16 nt, Human
cccugccuccuuugug

SEQ ID NO: 1667290 - RNA, 23 nt, Human
cccugccuccuuugugaggaagc

SEQ ID NO: 1667291 - RNA, 13 nt, Human
cccugcccaccug

SEQ ID NO: 1667292 - RNA, 17 nt, Human
cccugccacccugggga

SEQ ID NO: 1667293 - RNA, 18 nt, Human
cccugccacccuggggag

SEQ ID NO: 1667294 - RNA, 12 nt, Human
cccugccacccu

SEQ ID NO: 1667295 - RNA, 14 nt, Human
cccugccacccugg

SEQ ID NO: 1667296 - RNA, 15 nt, Human
cccugccacccuggg

SEQ ID NO: 1667297 - RNA, 12 nt, Human
cccugcagaggg

SEQ ID NO: 1667298 - RNA, 20 nt, Human
cccugcagagggcacagaaa

SEQ ID NO: 1667299 - RNA, 18 nt, Human
cccugcagagggcacaga

SEQ ID NO: 1667300 - RNA, 22 nt, Human
cccugcaaccugauugugucuc

SEQ ID NO: 1667301 - RNA, 16 nt, Human
cccugcaaccugauug

SEQ ID NO: 1667302 - RNA, 15 nt, Human
cccugcaauaaaaug

SEQ ID NO: 1667303 - RNA, 14 nt, Human
cccugcaauaaaau

SEQ ID NO: 1667304 - RNA, 12 nt, Human
cccuaauaaagc

SEQ ID NO: 1667305 - RNA, 13 nt, Human
cccuaauaaagcu

SEQ ID NO: 1667306 - RNA, 14 nt, Human
cccuaauaaagcug

SEQ ID NO: 1667307 - RNA, 15 nt, Human
cccuaauaaagcugu

SEQ ID NO: 1667308 - RNA, 18 nt, Human
cccuaauaaagcugugug

SEQ ID NO: 1667309 - RNA, 15 nt, Human
cccucagggucccug

SEQ ID NO: 1667310 - RNA, 16 nt, Human
cccucagggucccugg

SEQ ID NO: 1667311 - RNA, 17 nt, Human
cccucagggucccuggu

SEQ ID NO: 1667312 - RNA, 18 nt, Human
cccucagggucccuggug

SEQ ID NO: 1667313 - RNA, 19 nt, Human
cccucagggucccuggugg

SEQ ID NO: 1667314 - RNA, 22 nt, Human
cccuaaaguguauuuuuuuacu

SEQ ID NO: 1667315 - RNA, 17 nt, Human
cccuaaaguguauuuuu

SEQ ID NO: 1667316 - RNA, 17 nt, Human
cccggaggggccuggca

SEQ ID NO: 1667317 - RNA, 18 nt, Human
cccggaggggccuggcag

SEQ ID NO: 1667318 - RNA, 16 nt, Human
cccggcaggguccuag

SEQ ID NO: 1667319 - RNA, 22 nt, Human
cccucauccucauacccacccc

SEQ ID NO: 1667320 - RNA, 22 nt, Human
cccucauuccaccuucccaugc

SEQ ID NO: 1667321 - RNA, 21 nt, Human
cccuccaagaccuucuccuuc

SEQ ID NO: 1667322 - RNA, 13 nt, Human
cccucauagcccu

SEQ ID NO: 1667323 - RNA, 15 nt, Human
cccucauagcccuca

SEQ ID NO: 1667324 - RNA, 21 nt, Human
cccucagggucccugguggca

SEQ ID NO: 1667325 - RNA, 20 nt, Human
cccucagucuggcccuuccu

SEQ ID NO: 1667326 - RNA, 19 nt, Human
cccucauagcccucacccu

SEQ ID NO: 1667327 - RNA, 22 nt, Human
cccucaucaccaacgucugugc

SEQ ID NO: 1667328 - RNA, 17 nt, Human
cccucauccucauaccc

SEQ ID NO: 1667329 - RNA, 20 nt, Human
cccucauccucauacccacc

SEQ ID NO: 1667330 - RNA, 19 nt, Human
cccuccaucuaaacugccc

SEQ ID NO: 1667331 - RNA, 17 nt, Human
cccuccaugugggcuag

SEQ ID NO: 1667332 - RNA, 14 nt, Human
cccucccuucaacc

SEQ ID NO: 1667333 - RNA, 12 nt, Human
cccucccuccac

SEQ ID NO: 1667334 - RNA, 13 nt, Human
cccucccuccacc

SEQ ID NO: 1667335 - RNA, 13 nt, Human
cccucccucuuuc

SEQ ID NO: 1667336 - RNA, 20 nt, Human
cccucccuccaccucccugc

SEQ ID NO: 1667337 - RNA, 23 nt, Human
cccgcucagcccucccugccccu

SEQ ID NO: 1667338 - RNA, 23 nt, Human
cccggaagccaaaccucugugag

SEQ ID NO: 1667339 - RNA, 19 nt, Human
cccgcucagcccucccugc

SEQ ID NO: 1667340 - RNA, 22 nt, Human
cccgcuaagagggagggagggc

SEQ ID NO: 1667341 - RNA, 21 nt, Human
cccgaggccuucucugaagga

SEQ ID NO: 1667342 - RNA, 20 nt, Human
cccgaggccuucucugaagg

SEQ ID NO: 1667343 - RNA, 15 nt, Human
cccgaggccuucucu

SEQ ID NO: 1667344 - RNA, 20 nt, Human
ccccuuccuaauuccacagc

SEQ ID NO: 1667345 - RNA, 21 nt, Human
ccccuuccuaauuccacagcu

SEQ ID NO: 1667346 - RNA, 22 nt, Human
ccccuuccuaauuccacagcug

SEQ ID NO: 1667347 - RNA, 12 nt, Human
ccccuucccccu

SEQ ID NO: 1667348 - RNA, 20 nt, Human
ccccuguucuggcagaguug

SEQ ID NO: 1667349 - RNA, 14 nt, Human
ccccuuaccacugc

SEQ ID NO: 1667350 - RNA, 23 nt, Human
ccccuggcuuuucacugcuggcu

SEQ ID NO: 1667351 - RNA, 22 nt, Human
ccccuguccccgcacugggcuu

SEQ ID NO: 1667352 - RNA, 21 nt, Human
ccccagcuggggccaggcugg

SEQ ID NO: 1667353 - RNA, 22 nt, Human
ccccagcuggggccaggcuggg

SEQ ID NO: 1667354 - RNA, 13 nt, Human
ccccagccugcua

SEQ ID NO: 1667355 - RNA, 16 nt, Human
ccccagccccauccca

SEQ ID NO: 1667356 - RNA, 19 nt, Human
ccccagcccuccuuaucaa

SEQ ID NO: 1667357 - RNA, 15 nt, Human
ccccagccccauccu

SEQ ID NO: 1667358 - RNA, 12 nt, Human
ccccaggaggcc

SEQ ID NO: 1667359 - RNA, 15 nt, Human
ccccuggcagccccu

SEQ ID NO: 1667360 - RNA, 12 nt, Human
ccccuggcagcc

SEQ ID NO: 1667361 - RNA, 14 nt, Human
ccccuggcagcccc

SEQ ID NO: 1667362 - RNA, 22 nt, Human
ccccaggugguuauggagaggg

SEQ ID NO: 1667363 - RNA, 14 nt, Human
ccccaggugccagu

SEQ ID NO: 1667364 - RNA, 13 nt, Human
cccagguuucuau

SEQ ID NO: 1667365 - RNA, 19 nt, Human
cccagggugggaagggcua

SEQ ID NO: 1667366 - RNA, 17 nt, Human
cccaggcauuccccagg

SEQ ID NO: 1667367 - RNA, 18 nt, Human
cccaggcauuccccagga

SEQ ID NO: 1667368 - RNA, 15 nt, Human
cccaggaggccagcc

SEQ ID NO: 1667369 - RNA, 16 nt, Human
cccaggaggccagccu

SEQ ID NO: 1667370 - RNA, 23 nt, Human
cccaggcaggucuugaacuccug

SEQ ID NO: 1667371 - RNA, 15 nt, Human
cccaggcauucccca

SEQ ID NO: 1667372 - RNA, 15 nt, Human
cccagugccgagaag

SEQ ID NO: 1667373 - RNA, 21 nt, Human
cccagugcccacaggaucagu

SEQ ID NO: 1667374 - RNA, 10 nt, Human
cccagucugg

SEQ ID NO: 1667375 - RNA, 18 nt, Human
cccagucuggaaugcagu

SEQ ID NO: 1667376 - RNA, 19 nt, Human
cccagucuggaaugcagug

SEQ ID NO: 1667377 - RNA, 17 nt, Human
cccagugccgagaagga

SEQ ID NO: 1667378 - RNA, 20 nt, Human
cccagugguuccuaauccuc

SEQ ID NO: 1667379 - RNA, 14 nt, Human
cccaguuagcucuc

SEQ ID NO: 1667380 - RNA, 18 nt, Human
cccaucucacacaugagc

SEQ ID NO: 1667381 - RNA, 13 nt, Human
cccaucucacaca

SEQ ID NO: 1667382 - RNA, 20 nt, Human
cccaucugugaaaggaaaga

SEQ ID NO: 1667383 - RNA, 14 nt, Human
cccaugcugcccug

SEQ ID NO: 1667384 - RNA, 12 nt, Human
cccaugcugccc

SEQ ID NO: 1667385 - RNA, 13 nt, Human
cccaugcugcccu

SEQ ID NO: 1667386 - RNA, 15 nt, Human
cccaugagccucagc

SEQ ID NO: 1667387 - RNA, 16 nt, Human
cccaugagccucagca

SEQ ID NO: 1667388 - RNA, 20 nt, Human
cccaugagccucagcauccu

SEQ ID NO: 1667389 - RNA, 12 nt, Human
cccauuauucaa

SEQ ID NO: 1667390 - RNA, 16 nt, Human
cccaugucucgacuca

SEQ ID NO: 1667391 - RNA, 17 nt, Human
cccaugucucgacucau

SEQ ID NO: 1667392 - RNA, 21 nt, Human
ccccaaauggaaaugggcaga

SEQ ID NO: 1667393 - RNA, 22 nt, Human
cccaugagccucagcauccugg

SEQ ID NO: 1667394 - RNA, 18 nt, Human
cccaggaggccagccuug

SEQ ID NO: 1667395 - RNA, 16 nt, Human
cccagaggcuggguga

SEQ ID NO: 1667396 - RNA, 13 nt, Human
cccagccccaaug

SEQ ID NO: 1667397 - RNA, 17 nt, Human
cccagccccaaugaaca

SEQ ID NO: 1667398 - RNA, 11 nt, Human
cccagccccau

SEQ ID NO: 1667399 - RNA, 12 nt, Human
cccagccccauc

SEQ ID NO: 1667400 - RNA, 18 nt, Human
cccagccuccaagcucca

SEQ ID NO: 1667401 - RNA, 20 nt, Human
cccagccuccaagcuccauc

SEQ ID NO: 1667402 - RNA, 23 nt, Human
cccagcccuccuuaucaaaggac

SEQ ID NO: 1667403 - RNA, 18 nt, Human
cccagccccauccucugu

SEQ ID NO: 1667404 - RNA, 19 nt, Human
cccagccccauccucugua

SEQ ID NO: 1667405 - RNA, 13 nt, Human
cccagccccaucc

SEQ ID NO: 1667406 - RNA, 14 nt, Human
cccagccccauccc

SEQ ID NO: 1667407 - RNA, 14 nt, Human
cccagccccauccu

SEQ ID NO: 1667408 - RNA, 15 nt, Human
cccagccccauccuc

SEQ ID NO: 1667409 - RNA, 13 nt, Human
cccaggagccccg

SEQ ID NO: 1667410 - RNA, 14 nt, Human
cccaggagccccga

SEQ ID NO: 1667411 - RNA, 18 nt, Human
cccaggagccccgaggcc

SEQ ID NO: 1667412 - RNA, 14 nt, Human
cccaggaggccagc

SEQ ID NO: 1667413 - RNA, 15 nt, Human
cccagcgagcccugg

SEQ ID NO: 1667414 - RNA, 14 nt, Human
cccagcgagcccug

SEQ ID NO: 1667415 - RNA, 13 nt, Human
cccagcucugguc

SEQ ID NO: 1667416 - RNA, 14 nt, Human
cccagcucuggucc

SEQ ID NO: 1667417 - RNA, 12 nt, Human
cccagcucuggu

SEQ ID NO: 1667418 - RNA, 15 nt, Human
cccagcucuggucca

SEQ ID NO: 1667419 - RNA, 16 nt, Human
cccagcucugguccau

SEQ ID NO: 1667420 - RNA, 18 nt, Human
cccagcucugguccauag

SEQ ID NO: 1667421 - RNA, 16 nt, Human
ccauguuggccaggcu

SEQ ID NO: 1667422 - RNA, 15 nt, Human
ccauguuggccaggc

SEQ ID NO: 1667423 - RNA, 19 nt, Human
ccauguuggccaggcuggu

SEQ ID NO: 1667424 - RNA, 21 nt, Human
ccauguuggccaggcuggucu

SEQ ID NO: 1667425 - RNA, 12 nt, Human
cccaccuggccu

SEQ ID NO: 1667426 - RNA, 15 nt, Human
cccaccuggccucug

SEQ ID NO: 1667427 - RNA, 16 nt, Human
cccaccuggccucugc

SEQ ID NO: 1667428 - RNA, 17 nt, Human
cccaccuuggcugcagg

SEQ ID NO: 1667429 - RNA, 19 nt, Human
cccaccuuggcugcaggga

SEQ ID NO: 1667430 - RNA, 20 nt, Human
cccaccuuggcugcagggag

SEQ ID NO: 1667431 - RNA, 15 nt, Human
cccacgcccccacug

SEQ ID NO: 1667432 - RNA, 13 nt, Human
cccacgcccccac

SEQ ID NO: 1667433 - RNA, 14 nt, Human
cccacgcccccacu

SEQ ID NO: 1667434 - RNA, 17 nt, Human
cccagacgaugucuuca

SEQ ID NO: 1667435 - RNA, 15 nt, Human
cccagacgaugucuu

SEQ ID NO: 1667436 - RNA, 14 nt, Human
ccaugcugccucca

SEQ ID NO: 1667437 - RNA, 16 nt, Human
ccaugcugcccuguga

SEQ ID NO: 1667438 - RNA, 17 nt, Human
ccaugcugcccugugag

SEQ ID NO: 1667439 - RNA, 15 nt, Human
ccaugcuccuggccc

SEQ ID NO: 1667440 - RNA, 18 nt, Human
ccaugcuccuggcccacu

SEQ ID NO: 1667441 - RNA, 13 nt, Human
ccauguuggccag

SEQ ID NO: 1667442 - RNA, 14 nt, Human
ccauguuggccagg

SEQ ID NO: 1667443 - RNA, 13 nt, Human
ccaugugccaggu

SEQ ID NO: 1667444 - RNA, 23 nt, Human
ccauggcacucuauguucuaaga

SEQ ID NO: 1667445 - RNA, 20 nt, Human
ccaggaagccagcaggcucu

SEQ ID NO: 1667446 - RNA, 22 nt, Human
ccagcugugcucuggacaggca

SEQ ID NO: 1667447 - RNA, 23 nt, Human
ccagcugugcucuggacaggcau

SEQ ID NO: 1667448 - RNA, 15 nt, Human
ccaggaagccagcag

SEQ ID NO: 1667449 - RNA, 17 nt, Human
ccaggaagccagcaggc

SEQ ID NO: 1667450 - RNA, 19 nt, Human
ccaggaagccagcaggcuc

SEQ ID NO: 1667451 - RNA, 12 nt, Human
ccaggagcagcc

SEQ ID NO: 1667452 - RNA, 13 nt, Human
ccaggagcagcca

SEQ ID NO: 1667453 - RNA, 15 nt, Human
ccaggagcagccaca

SEQ ID NO: 1667454 - RNA, 14 nt, Human
ccaggagcagccac

SEQ ID NO: 1667455 - RNA, 14 nt, Human
ccaggccagaggga

SEQ ID NO: 1667456 - RNA, 21 nt, Human
ccaggccagagggagugacag

SEQ ID NO: 1667457 - RNA, 21 nt, Human
ccaggccccugccacccuggg

SEQ ID NO: 1667458 - RNA, 23 nt, Human
ccaggccccugccacccugggga

SEQ ID NO: 1667459 - RNA, 17 nt, Human
ccaggcccucugcccac

SEQ ID NO: 1667460 - RNA, 18 nt, Human
ccaggcccucugcccacu

SEQ ID NO: 1667461 - RNA, 19 nt, Human
ccaggcccucugcccacuc

SEQ ID NO: 1667462 - RNA, 20 nt, Human
ccaggcccucugcccacucc

SEQ ID NO: 1667463 - RNA, 13 nt, Human
ccaggccuccuac

SEQ ID NO: 1667464 - RNA, 18 nt, Human
ccaggccuccuacagcuu

SEQ ID NO: 1667465 - RNA, 19 nt, Human
ccaggccuccuacagcuug

SEQ ID NO: 1667466 - RNA, 14 nt, Human
ccagcuggccggga

SEQ ID NO: 1667467 - RNA, 20 nt, Human
ccagcuggccgggagccuga

SEQ ID NO: 1667468 - RNA, 12 nt, Human
ccagcuggccgg

SEQ ID NO: 1667469 - RNA, 16 nt, Human
ccagcugcuugggcuu

SEQ ID NO: 1667470 - RNA, 18 nt, Human
ccagcugcuugggcuuca

SEQ ID NO: 1667471 - RNA, 15 nt, Human
ccagcugcuugggcu

SEQ ID NO: 1667472 - RNA, 16 nt, Human
ccagcuggguuggaaa

SEQ ID NO: 1667473 - RNA, 17 nt, Human
ccagcuggguuggaaaa

SEQ ID NO: 1667474 - RNA, 18 nt, Human
ccagcugugcucuggaca

SEQ ID NO: 1667475 - RNA, 20 nt, Human
ccagcugugcucuggacagg

SEQ ID NO: 1667476 - RNA, 21 nt, Human
ccagcugugcucuggacaggc

SEQ ID NO: 1667477 - RNA, 12 nt, Human
ccaggccugccu

SEQ ID NO: 1667478 - RNA, 23 nt, Human
ccagggacagaggggguggccuc

SEQ ID NO: 1667479 - RNA, 12 nt, Human
ccaucaagccac

SEQ ID NO: 1667480 - RNA, 12 nt, Human
ccaucacccgcu

SEQ ID NO: 1667481 - RNA, 23 nt, Human
ccauagagagcaagacgcugugc

SEQ ID NO: 1667482 - RNA, 15 nt, Human
ccauauucuguuggc

SEQ ID NO: 1667483 - RNA, 18 nt, Human
ccauauucuguuggccag

SEQ ID NO: 1667484 - RNA, 19 nt, Human
ccauauucuguuggccagu

SEQ ID NO: 1667485 - RNA, 19 nt, Human
ccaucucaccuccugcugg

SEQ ID NO: 1667486 - RNA, 21 nt, Human
ccaucucaccuccugcugggc

SEQ ID NO: 1667487 - RNA, 18 nt, Human
ccaucucaccuccugcug

SEQ ID NO: 1667488 - RNA, 16 nt, Human
ccaucgcugucaucuc

SEQ ID NO: 1667489 - RNA, 23 nt, Human
ccaucucaccuccugcugggcag

SEQ ID NO: 1667490 - RNA, 14 nt, Human
ccaucaugucuggc

SEQ ID NO: 1667491 - RNA, 16 nt, Human
ccaucaugucuggcua

SEQ ID NO: 1667492 - RNA, 16 nt, Human
ccauccugaggcucca

SEQ ID NO: 1667493 - RNA, 21 nt, Human
ccauccucuguacagagccca

SEQ ID NO: 1667494 - RNA, 15 nt, Human
ccauccugaggcucc

SEQ ID NO: 1667495 - RNA, 17 nt, Human
cauuauuuuauuaugaa

SEQ ID NO: 1667496 - RNA, 13 nt, Human
cauugaccugagg

SEQ ID NO: 1667497 - RNA, 22 nt, Human
cauugaccugaggcccuucucu

SEQ ID NO: 1667498 - RNA, 12 nt, Human
cauuauuuuauu

SEQ ID NO: 1667499 - RNA, 14 nt, Human
cauuauuuuauuau

SEQ ID NO: 1667500 - RNA, 16 nt, Human
cauuauuuuauuauga

SEQ ID NO: 1667501 - RNA, 19 nt, Human
cauugaaaucuuuuugcuu

SEQ ID NO: 1667502 - RNA, 15 nt, Human
cauuuccuaaauaua

SEQ ID NO: 1667503 - RNA, 21 nt, Human
cauuucuuccacaagagccca

SEQ ID NO: 1667504 - RNA, 23 nt, Human
cauuucugcaucagcugcugaaa

SEQ ID NO: 1667505 - RNA, 17 nt, Human
cauuuacuuuguguuca

SEQ ID NO: 1667506 - RNA, 21 nt, Human
cauuuacuuuguguucaccuu

SEQ ID NO: 1667507 - RNA, 19 nt, Human
cauuuaaagcuuauuaaaa

SEQ ID NO: 1667508 - RNA, 19 nt, Human
cauuugaggucuguucuuu

SEQ ID NO: 1667509 - RNA, 18 nt, Human
cauuugaggucuguucuu

SEQ ID NO: 1667510 - RNA, 17 nt, Human
cauuugaggucuguucu

SEQ ID NO: 1667511 - RNA, 16 nt, Human
cauuugagcagggcuc

SEQ ID NO: 1667512 - RNA, 14 nt, Human
cauuugagcagggc

SEQ ID NO: 1667513 - RNA, 23 nt, Human
cauuucuuccacaagagcccagg

SEQ ID NO: 1667514 - RNA, 23 nt, Human
cauuuugggguacccacugcucu

SEQ ID NO: 1667515 - RNA, 19 nt, Human
cauuuuuaguagagacagg

SEQ ID NO: 1667516 - RNA, 20 nt, Human
cauuuuuaagugcugcauuu

SEQ ID NO: 1667517 - RNA, 15 nt, Human
cauuuuuaagugcug

SEQ ID NO: 1667518 - RNA, 20 nt, Human
cauuuugggguacccacugc

SEQ ID NO: 1667519 - RNA, 21 nt, Human
cauuuugggguacccacugcu

SEQ ID NO: 1667520 - RNA, 22 nt, Human
cauuuugggguacccacugcuc

SEQ ID NO: 1667521 - RNA, 18 nt, Human
cauuuugcuaaaugugaa

SEQ ID NO: 1667522 - RNA, 21 nt, Human
cauuuugcuaaaugugaauga

SEQ ID NO: 1667523 - RNA, 24 nt, Human
cauuuugcuaaaugugaaugauga

SEQ ID NO: 1667524 - RNA, 19 nt, Human
cauuuuauuuuauuaugca

SEQ ID NO: 1667525 - RNA, 21 nt, Human
cauuuuauuuuauuaugcaug

SEQ ID NO: 1667526 - RNA, 22 nt, Human
cauuuuauuuuauuaugcauga

SEQ ID NO: 1667527 - RNA, 15 nt, Human
cauuugcucauggaa

SEQ ID NO: 1667528 - RNA, 14 nt, Human
cauuugcucaugga

SEQ ID NO: 1667529 - RNA, 22 nt, Human
cauuugaggucuguucuuucca

SEQ ID NO: 1667530 - RNA, 16 nt, Human
cauuugcucauggaau

SEQ ID NO: 1667531 - RNA, 20 nt, Human
cauuuuuaguagagacaggg

SEQ ID NO: 1667532 - RNA, 21 nt, Human
ccaaaauaaaacuuuuuaaaa

SEQ ID NO: 1667533 - RNA, 18 nt, Human
ccaaaauaaaacuuuuua

SEQ ID NO: 1667534 - RNA, 17 nt, Human
ccaaaccucugugagca

SEQ ID NO: 1667535 - RNA, 17 nt, Human
ccaaagaaauguaaggg

SEQ ID NO: 1667536 - RNA, 13 nt, Human
ccaaagaugcagc

SEQ ID NO: 1667537 - RNA, 14 nt, Human
ccaaagaugcagcc

SEQ ID NO: 1667538 - RNA, 15 nt, Human
ccaagaccuucuccu

SEQ ID NO: 1667539 - RNA, 18 nt, Human
ccaacccuggcacccagg

SEQ ID NO: 1667540 - RNA, 13 nt, Human
ccaacccucauca

SEQ ID NO: 1667541 - RNA, 15 nt, Human
ccaacccucaucacc

SEQ ID NO: 1667542 - RNA, 16 nt, Human
ccaacaucaacaucuu

SEQ ID NO: 1667543 - RNA, 14 nt, Human
ccaacauacuccca

SEQ ID NO: 1667544 - RNA, 21 nt, Human
ccaacacgagcaggcuacugu

SEQ ID NO: 1667545 - RNA, 15 nt, Human
ccaaauucuuucagu

SEQ ID NO: 1667546 - RNA, 22 nt, Human
ccaaauucuuucaguggcuacc

SEQ ID NO: 1667547 - RNA, 14 nt, Human
ccaacacgagcagg

SEQ ID NO: 1667548 - RNA, 20 nt, Human
ccacaagagcccaggccucc

SEQ ID NO: 1667549 - RNA, 21 nt, Human
ccacaagagcccaggccuccu

SEQ ID NO: 1667550 - RNA, 16 nt, Human
ccacaagagcccaggc

SEQ ID NO: 1667551 - RNA, 17 nt, Human
ccacaagagcccaggcc

SEQ ID NO: 1667552 - RNA, 18 nt, Human
ccacaagagcccaggccu

SEQ ID NO: 1667553 - RNA, 19 nt, Human
ccacaagagcccaggccuc

SEQ ID NO: 1667554 - RNA, 15 nt, Human
ccacaaguuaaauaa

SEQ ID NO: 1667555 - RNA, 20 nt, Human
ccacaaguuaaauaaaucau

SEQ ID NO: 1667556 - RNA, 15 nt, Human
ccaagccguggcuuc

SEQ ID NO: 1667557 - RNA, 16 nt, Human
ccaagccguggcuucc

SEQ ID NO: 1667558 - RNA, 17 nt, Human
ccaagccguggcuuccc

SEQ ID NO: 1667559 - RNA, 21 nt, Human
ccaagccguggcuucccgcuc

SEQ ID NO: 1667560 - RNA, 14 nt, Human
ccaagcaggacaug

SEQ ID NO: 1667561 - RNA, 14 nt, Human
ccaagccguggcuu

SEQ ID NO: 1667562 - RNA, 23 nt, Human
ccaagccguggcuucccgcucag

SEQ ID NO: 1667563 - RNA, 12 nt, Human
ccaagcucccag

SEQ ID NO: 1667564 - RNA, 13 nt, Human
ccaagcucccagg

SEQ ID NO: 1667565 - RNA, 14 nt, Human
ccaagcuccaucuc

SEQ ID NO: 1667566 - RNA, 18 nt, Human
ccaaggcuagaaccaccu

SEQ ID NO: 1667567 - RNA, 13 nt, Human
ccacaacacacag

SEQ ID NO: 1667568 - RNA, 18 nt, Human
ccacaaaggagagcuagc

SEQ ID NO: 1667569 - RNA, 16 nt, Human
ccacaagacccuugug

SEQ ID NO: 1667570 - RNA, 13 nt, Human
ccacaagagccca

SEQ ID NO: 1667571 - RNA, 16 nt, Human
ccacaagaaaugaaag

SEQ ID NO: 1667572 - RNA, 22 nt, Human
ccacaagaaaugaaagcaggga

SEQ ID NO: 1667573 - RNA, 14 nt, Human
ccaaggcuggggga

SEQ ID NO: 1667574 - RNA, 16 nt, Human
ccaaggcucugagcaa

SEQ ID NO: 1667575 - RNA, 19 nt, Human
ccaaggcugauuaaaccaa

SEQ ID NO: 1667576 - RNA, 13 nt, Human
ccaaguggcuccc

SEQ ID NO: 1667577 - RNA, 16 nt, Human
ccaaguggcucccaca

SEQ ID NO: 1667578 - RNA, 20 nt, Human
ccaauauucauagcagcuua

SEQ ID NO: 1667579 - RNA, 15 nt, Human
caugugaaaucauuc

SEQ ID NO: 1667580 - RNA, 16 nt, Human
caugugaaaucauuca

SEQ ID NO: 1667581 - RNA, 17 nt, Human
caugugaaaucauucau

SEQ ID NO: 1667582 - RNA, 14 nt, Human
caugucuuuucuug

SEQ ID NO: 1667583 - RNA, 19 nt, Human
caugucuuuucuugcauga

SEQ ID NO: 1667584 - RNA, 21 nt, Human
caugucuuuucuugcaugagg

SEQ ID NO: 1667585 - RNA, 23 nt, Human
caugucuuuucuugcaugaggcu

SEQ ID NO: 1667586 - RNA, 18 nt, Human
caugucgccucugcauuc

SEQ ID NO: 1667587 - RNA, 20 nt, Human
caugucgccucugcauucag

SEQ ID NO: 1667588 - RNA, 14 nt, Human
caugucgccucugc

SEQ ID NO: 1667589 - RNA, 15 nt, Human
caugucgccucugca

SEQ ID NO: 1667590 - RNA, 18 nt, Human
cauguaauuaaguacuau

SEQ ID NO: 1667591 - RNA, 21 nt, Human
cauguaauuaaguacuaugua

SEQ ID NO: 1667592 - RNA, 16 nt, Human
cauggucggaaaacau

SEQ ID NO: 1667593 - RNA, 12 nt, Human
cauguuuauuac

SEQ ID NO: 1667594 - RNA, 13 nt, Human
cauguuuauuaca

SEQ ID NO: 1667595 - RNA, 18 nt, Human
cauguuuauuacaguaua

SEQ ID NO: 1667596 - RNA, 19 nt, Human
cauguuuauuacaguauaa

SEQ ID NO: 1667597 - RNA, 20 nt, Human
cauguuuauuacaguauaau

SEQ ID NO: 1667598 - RNA, 22 nt, Human
cauguuuauuacaguauaauua

SEQ ID NO: 1667599 - RNA, 21 nt, Human
cauguuucuuuguaaugaaaa

SEQ ID NO: 1667600 - RNA, 22 nt, Human
cauguuucuuuguaaugaaaac

SEQ ID NO: 1667601 - RNA, 23 nt, Human
cauguuugauguaucugagcagg

SEQ ID NO: 1667602 - RNA, 15 nt, Human
caugugcacaugcac

SEQ ID NO: 1667603 - RNA, 21 nt, Human
caugugccagguuuuuggucu

SEQ ID NO: 1667604 - RNA, 22 nt, Human
caugugccagguuuuuggucug

SEQ ID NO: 1667605 - RNA, 17 nt, Human
cauuagcaguuugcuuu

SEQ ID NO: 1667606 - RNA, 18 nt, Human
cauuagcaguuugcuuug

SEQ ID NO: 1667607 - RNA, 11 nt, Human
cauuauuuuau

SEQ ID NO: 1667608 - RNA, 21 nt, Human
cauuaaagccugaguuugcuu

SEQ ID NO: 1667609 - RNA, 15 nt, Human
cauguuuuguuuacg

SEQ ID NO: 1667610 - RNA, 18 nt, Human
cauguuuuucuucucccu

SEQ ID NO: 1667611 - RNA, 19 nt, Human
caugccagcuuaucucagg

SEQ ID NO: 1667612 - RNA, 20 nt, Human
caugccagcuuaucucaggg

SEQ ID NO: 1667613 - RNA, 13 nt, Human
caugccccugaac

SEQ ID NO: 1667614 - RNA, 14 nt, Human
caugccucucucag

SEQ ID NO: 1667615 - RNA, 15 nt, Human
caugccucucucagg

SEQ ID NO: 1667616 - RNA, 16 nt, Human
caugccucucucaggc

SEQ ID NO: 1667617 - RNA, 17 nt, Human
caugccucucucaggcc

SEQ ID NO: 1667618 - RNA, 18 nt, Human
caugccucucucaggcca

SEQ ID NO: 1667619 - RNA, 19 nt, Human
caugccucucucaggccaa

SEQ ID NO: 1667620 - RNA, 13 nt, Human
caugccuggaugg

SEQ ID NO: 1667621 - RNA, 16 nt, Human
cauggaauaacaugua

SEQ ID NO: 1667622 - RNA, 18 nt, Human
cauggacaugaucuucuu

SEQ ID NO: 1667623 - RNA, 18 nt, Human
cauggaacgcguugaaau

SEQ ID NO: 1667624 - RNA, 19 nt, Human
cauggaacgcguugaaauu

SEQ ID NO: 1667625 - RNA, 20 nt, Human
cauggaacgcguugaaauug

SEQ ID NO: 1667626 - RNA, 23 nt, Human
cauggaacgcguugaaauuguaa

SEQ ID NO: 1667627 - RNA, 20 nt, Human
cauggaaguacuauaauuua

SEQ ID NO: 1667628 - RNA, 22 nt, Human
cauggaaguacuauaauuuacc

SEQ ID NO: 1667629 - RNA, 18 nt, Human
caugccuggauggggcug

SEQ ID NO: 1667630 - RNA, 21 nt, Human
caugccuggauggggcugcac

SEQ ID NO: 1667631 - RNA, 23 nt, Human
caugccuggauggggcugcaccg

SEQ ID NO: 1667632 - RNA, 20 nt, Human
caugcuguucaugaaagauu

SEQ ID NO: 1667633 - RNA, 22 nt, Human
caugcugucccuuacgugaguc

SEQ ID NO: 1667634 - RNA, 23 nt, Human
caugcugucuacacuaagagaga

SEQ ID NO: 1667635 - RNA, 16 nt, Human
cauggaguauauguca

SEQ ID NO: 1667636 - RNA, 18 nt, Human
caugggaaugaaugucag

SEQ ID NO: 1667637 - RNA, 11 nt, Human
cauggacuuug

SEQ ID NO: 1667638 - RNA, 13 nt, Human
cauggacuuuguu

SEQ ID NO: 1667639 - RNA, 17 nt, Human
cauggagguuugaagau

SEQ ID NO: 1667640 - RNA, 16 nt, Human
caugggccuccugugu

SEQ ID NO: 1667641 - RNA, 17 nt, Human
caugggccuccugugug

SEQ ID NO: 1667642 - RNA, 15 nt, Human
caugggccuccugug

SEQ ID NO: 1667643 - RNA, 22 nt, Human
caugggaaugaaugucagugug

SEQ ID NO: 1667644 - RNA, 17 nt, Human
caugggacagggaggac

SEQ ID NO: 1667645 - RNA, 22 nt, Human
caguguuguggauuuaacagaa

SEQ ID NO: 1667646 - RNA, 20 nt, Human
caguguuguggauuuaacag

SEQ ID NO: 1667647 - RNA, 19 nt, Human
caguguuguggauuuaaca

SEQ ID NO: 1667648 - RNA, 20 nt, Human
caguuaagccuuuggaaaca

SEQ ID NO: 1667649 - RNA, 14 nt, Human
caguuaagccuuug

SEQ ID NO: 1667650 - RNA, 15 nt, Human
caguuaagccuuugg

SEQ ID NO: 1667651 - RNA, 17 nt, Human
caguuaagccuuuggaa

SEQ ID NO: 1667652 - RNA, 13 nt, Human
caguuaagagaaa

SEQ ID NO: 1667653 - RNA, 14 nt, Human
caguuaagagaaau

SEQ ID NO: 1667654 - RNA, 14 nt, Human
caguuacucagaau

SEQ ID NO: 1667655 - RNA, 21 nt, Human
caguuaccucugccucagaaa

SEQ ID NO: 1667656 - RNA, 12 nt, Human
caguugaaaaac

SEQ ID NO: 1667657 - RNA, 18 nt, Human
caguugaaaaacagcuga

SEQ ID NO: 1667658 - RNA, 19 nt, Human
caguugaaaaacagcugag

SEQ ID NO: 1667659 - RNA, 15 nt, Human
caguucugaagaaga

SEQ ID NO: 1667660 - RNA, 16 nt, Human
caguucugaagaagau

SEQ ID NO: 1667661 - RNA, 22 nt, Human
caguucugaagaagaugguacc

SEQ ID NO: 1667662 - RNA, 13 nt, Human
caguucugaagaa

SEQ ID NO: 1667663 - RNA, 14 nt, Human
caguucugaagaag

SEQ ID NO: 1667664 - RNA, 22 nt, Human
caguucucuccuucuucccccc

SEQ ID NO: 1667665 - RNA, 12 nt, Human
caguucugaaga

SEQ ID NO: 1667666 - RNA, 13 nt, Human
caguucucuccuu

SEQ ID NO: 1667667 - RNA, 14 nt, Human
caguucucuccuuc

SEQ ID NO: 1667668 - RNA, 15 nt, Human
caguucucuccuucu

SEQ ID NO: 1667669 - RNA, 22 nt, Human
caguucggugagcuacaaaugc

SEQ ID NO: 1667670 - RNA, 12 nt, Human
caguggcagcug

SEQ ID NO: 1667671 - RNA, 13 nt, Human
caguggcagcugc

SEQ ID NO: 1667672 - RNA, 14 nt, Human
caguggcagcugcu

SEQ ID NO: 1667673 - RNA, 15 nt, Human
caguggcagcugcuu

SEQ ID NO: 1667674 - RNA, 16 nt, Human
caguggcagcugcuuu

SEQ ID NO: 1667675 - RNA, 11 nt, Human
cagugggaacu

SEQ ID NO: 1667676 - RNA, 16 nt, Human
cagugggacagggcau

SEQ ID NO: 1667677 - RNA, 22 nt, Human
cagugguuccuaauccucuagg

SEQ ID NO: 1667678 - RNA, 16 nt, Human
caguguacauggaaua

SEQ ID NO: 1667679 - RNA, 20 nt, Human
caguguacauggaauaacau

SEQ ID NO: 1667680 - RNA, 23 nt, Human
caguguacauggaauaacaugua

SEQ ID NO: 1667681 - RNA, 14 nt, Human
cagugucaaugcag

SEQ ID NO: 1667682 - RNA, 14 nt, Human
cagugugacaagga

SEQ ID NO: 1667683 - RNA, 12 nt, Human
cagugugacuga

SEQ ID NO: 1667684 - RNA, 20 nt, Human
cauacuaauuauacccccug

SEQ ID NO: 1667685 - RNA, 21 nt, Human
cauacuaaccagcagaaaugc

SEQ ID NO: 1667686 - RNA, 14 nt, Human
cauacuaaccagca

SEQ ID NO: 1667687 - RNA, 18 nt, Human
cauacguacacauuuuau

SEQ ID NO: 1667688 - RNA, 17 nt, Human
cauacguacacauuuua

SEQ ID NO: 1667689 - RNA, 16 nt, Human
cauacguacacauuuu

SEQ ID NO: 1667690 - RNA, 15 nt, Human
cauacguacacauuu

SEQ ID NO: 1667691 - RNA, 13 nt, Human
cauacguacacau

SEQ ID NO: 1667692 - RNA, 14 nt, Human
cauacccaccccca

SEQ ID NO: 1667693 - RNA, 17 nt, Human
cauacccacccccaccc

SEQ ID NO: 1667694 - RNA, 18 nt, Human
cauacccacccccaccca

SEQ ID NO: 1667695 - RNA, 21 nt, Human
cauacccacccccacccaagg

SEQ ID NO: 1667696 - RNA, 15 nt, Human
cauaccuacauguau

SEQ ID NO: 1667697 - RNA, 23 nt, Human
caguugaaaagacuccaaagaaa

SEQ ID NO: 1667698 - RNA, 20 nt, Human
caguugagaaaauuugaaug

SEQ ID NO: 1667699 - RNA, 21 nt, Human
caguugaaaagacuccaaaga

SEQ ID NO: 1667700 - RNA, 22 nt, Human
caguugaaaagacuccaaagaa

SEQ ID NO: 1667701 - RNA, 18 nt, Human
caguugaaaagacuccaa

SEQ ID NO: 1667702 - RNA, 14 nt, Human
caguugaaaagacu

SEQ ID NO: 1667703 - RNA, 16 nt, Human
caguuggguggaugcc

SEQ ID NO: 1667704 - RNA, 23 nt, Human
caguugccagucaccccggccac

SEQ ID NO: 1667705 - RNA, 18 nt, Human
caguuggguggaugccug

SEQ ID NO: 1667706 - RNA, 19 nt, Human
caguuggguggaugccugg

SEQ ID NO: 1667707 - RNA, 18 nt, Human
caguuggucccccuucca

SEQ ID NO: 1667708 - RNA, 19 nt, Human
caguuggucccccuuccau

SEQ ID NO: 1667709 - RNA, 20 nt, Human
caguuggucccccuuccaug

SEQ ID NO: 1667710 - RNA, 21 nt, Human
caguuggucccccuuccaugg

SEQ ID NO: 1667711 - RNA, 22 nt, Human
caguuggucccccuuccaugga

SEQ ID NO: 1667712 - RNA, 17 nt, Human
caguuguuagugugucu

SEQ ID NO: 1667713 - RNA, 14 nt, Human
caguuuucugagaa

SEQ ID NO: 1667714 - RNA, 15 nt, Human
caguuuucugagaaa

SEQ ID NO: 1667715 - RNA, 21 nt, Human
caguuuuguuuggaccaaaaa

SEQ ID NO: 1667716 - RNA, 18 nt, Human
caguuuugguugcuuuaa

SEQ ID NO: 1667717 - RNA, 19 nt, Human
caguuuugguugcuuuaau

SEQ ID NO: 1667718 - RNA, 18 nt, Human
caguuguuagugugucuu

SEQ ID NO: 1667719 - RNA, 17 nt, Human
caguuuugguugcuuua

SEQ ID NO: 1667720 - RNA, 19 nt, Human
caguuuucugagaaagacu

SEQ ID NO: 1667721 - RNA, 20 nt, Human
caguuuucugagaaagacua

SEQ ID NO: 1667722 - RNA, 16 nt, Human
cauaaaucugugaacu

SEQ ID NO: 1667723 - RNA, 18 nt, Human
cauaaaucugugaacuug

SEQ ID NO: 1667724 - RNA, 22 nt, Human
cauaaaucugugaacuugaaau

SEQ ID NO: 1667725 - RNA, 23 nt, Human
cauaaaucugugaacuugaaauu

SEQ ID NO: 1667726 - RNA, 14 nt, Human
cauaaaucugugaa

SEQ ID NO: 1667727 - RNA, 12 nt, Human
cauaacauaaau

SEQ ID NO: 1667728 - RNA, 19 nt, Human
cauaacauaaaucugugaa

SEQ ID NO: 1667729 - RNA, 19 nt, Human
cauaaauuuaguauuuugu

SEQ ID NO: 1667730 - RNA, 20 nt, Human
cauaaauuuaguauuuuguu

SEQ ID NO: 1667731 - RNA, 21 nt, Human
cauaacauaaaucugugaacu

SEQ ID NO: 1667732 - RNA, 16 nt, Human
cauaaccuagccuuag

SEQ ID NO: 1667733 - RNA, 14 nt, Human
cauaaagcaggcag

SEQ ID NO: 1667734 - RNA, 16 nt, Human
cauaaagcaggcagaa

SEQ ID NO: 1667735 - RNA, 21 nt, Human
cauaaacaagaccacguuucu

SEQ ID NO: 1667736 - RNA, 20 nt, Human
cauaaacaagaccacguuuc

SEQ ID NO: 1667737 - RNA, 22 nt, Human
cauaaacaagaccacguuucua

SEQ ID NO: 1667738 - RNA, 21 nt, Human
cauaaaaauuagccaagugug

SEQ ID NO: 1667739 - RNA, 14 nt, Human
cauaagauaaaugu

SEQ ID NO: 1667740 - RNA, 17 nt, Human
cauaaggaaacuggguu

SEQ ID NO: 1667741 - RNA, 19 nt, Human
cauaccacuuuuguucuug

SEQ ID NO: 1667742 - RNA, 11 nt, Human
cauacccaccc

SEQ ID NO: 1667743 - RNA, 12 nt, Human
cauacccacccc

SEQ ID NO: 1667744 - RNA, 18 nt, Human
cauaccacuuuuguucuu

SEQ ID NO: 1667745 - RNA, 15 nt, Human
cauaccacuuuuguu

SEQ ID NO: 1667746 - RNA, 14 nt, Human
cauaccacuuuugu

SEQ ID NO: 1667747 - RNA, 13 nt, Human
cauaccacuuuug

SEQ ID NO: 1667748 - RNA, 15 nt, Human
cauaauacuugcuuu

SEQ ID NO: 1667749 - RNA, 17 nt, Human
cauaccaacacgagcag

SEQ ID NO: 1667750 - RNA, 19 nt, Human
cauaaucuggacuccucug

SEQ ID NO: 1667751 - RNA, 16 nt, Human
caucucuuguuuaaau

SEQ ID NO: 1667752 - RNA, 22 nt, Human
caucuuccaaggguacuaagga

SEQ ID NO: 1667753 - RNA, 14 nt, Human
caucuccacuccag

SEQ ID NO: 1667754 - RNA, 22 nt, Human
caucucuucuggguuccuuccu

SEQ ID NO: 1667755 - RNA, 13 nt, Human
caucuugcucugc

SEQ ID NO: 1667756 - RNA, 15 nt, Human
caucuugcucugcug

SEQ ID NO: 1667757 - RNA, 14 nt, Human
caucuugcucugcu

SEQ ID NO: 1667758 - RNA, 20 nt, Human
caucuugcucugcugacaga

SEQ ID NO: 1667759 - RNA, 16 nt, Human
cauccuacaagacaca

SEQ ID NO: 1667760 - RNA, 15 nt, Human
cauccucauacccac

SEQ ID NO: 1667761 - RNA, 16 nt, Human
cauccucauacccacc

SEQ ID NO: 1667762 - RNA, 13 nt, Human
cauccucccaagg

SEQ ID NO: 1667763 - RNA, 17 nt, Human
cauccucauacccaccc

SEQ ID NO: 1667764 - RNA, 18 nt, Human
cauccucauacccacccc

SEQ ID NO: 1667765 - RNA, 21 nt, Human
cauccucauacccacccccac

SEQ ID NO: 1667766 - RNA, 22 nt, Human
cauccucauacccacccccacc

SEQ ID NO: 1667767 - RNA, 20 nt, Human
cauccuccgccucccggguu

SEQ ID NO: 1667768 - RNA, 11 nt, Human
cauccuccuca

SEQ ID NO: 1667769 - RNA, 12 nt, Human
cauccuccucag

SEQ ID NO: 1667770 - RNA, 15 nt, Human
cauccuccucagauc

SEQ ID NO: 1667771 - RNA, 16 nt, Human
cauccuccucagaucu

SEQ ID NO: 1667772 - RNA, 18 nt, Human
cauccuccucagaucuuc

SEQ ID NO: 1667773 - RNA, 19 nt, Human
cauccuccucagaucuucu

SEQ ID NO: 1667774 - RNA, 21 nt, Human
cauccucuguacagagcccac

SEQ ID NO: 1667775 - RNA, 19 nt, Human
cauccucuguacagagccc

SEQ ID NO: 1667776 - RNA, 15 nt, Human
cauccucuguacaga

SEQ ID NO: 1667777 - RNA, 18 nt, Human
cauccucuguacagagcc

SEQ ID NO: 1667778 - RNA, 12 nt, Human
caucuaggauuu

SEQ ID NO: 1667779 - RNA, 15 nt, Human
caucuacccuccgau

SEQ ID NO: 1667780 - RNA, 17 nt, Human
caucuagguaaauuaca

SEQ ID NO: 1667781 - RNA, 18 nt, Human
caucuagguaaauuacag

SEQ ID NO: 1667782 - RNA, 14 nt, Human
caucuagugagcag

SEQ ID NO: 1667783 - RNA, 13 nt, Human
caucucagcccac

SEQ ID NO: 1667784 - RNA, 16 nt, Human
caucucaccuccugcu

SEQ ID NO: 1667785 - RNA, 17 nt, Human
caucucaccuccugcug

SEQ ID NO: 1667786 - RNA, 18 nt, Human
caucucaccuccugcugg

SEQ ID NO: 1667787 - RNA, 20 nt, Human
caucucacacaugagcauca

SEQ ID NO: 1667788 - RNA, 16 nt, Human
caucucacacaugagc

SEQ ID NO: 1667789 - RNA, 17 nt, Human
caucucacacaugagca

SEQ ID NO: 1667790 - RNA, 22 nt, Human
caucuagugagcagucaggaaa

SEQ ID NO: 1667791 - RNA, 21 nt, Human
cauccuaacuccaugucucug

SEQ ID NO: 1667792 - RNA, 14 nt, Human
cauccuaacuccau

SEQ ID NO: 1667793 - RNA, 22 nt, Human
caucccugaaggccccgcccag

SEQ ID NO: 1667794 - RNA, 17 nt, Human
caucccugaaggccccg

SEQ ID NO: 1667795 - RNA, 18 nt, Human
caucccugaaggccccgc

SEQ ID NO: 1667796 - RNA, 19 nt, Human
caucccugaaggccccgcc

SEQ ID NO: 1667797 - RNA, 21 nt, Human
caucccugaaggccccgccca

SEQ ID NO: 1667798 - RNA, 17 nt, Human
cauccuacaagacacag

SEQ ID NO: 1667799 - RNA, 13 nt, Human
caucauugaaauc

SEQ ID NO: 1667800 - RNA, 15 nt, Human
caucaccaacgucug

SEQ ID NO: 1667801 - RNA, 13 nt, Human
caucacaguuuug

SEQ ID NO: 1667802 - RNA, 21 nt, Human
caucacaguuuugguugcuuu

SEQ ID NO: 1667803 - RNA, 22 nt, Human
caucacaguuuugguugcuuua

SEQ ID NO: 1667804 - RNA, 14 nt, Human
caucauugaaaucu

SEQ ID NO: 1667805 - RNA, 15 nt, Human
caucauugaaaucuu

SEQ ID NO: 1667806 - RNA, 20 nt, Human
caucauugaaaucuuuuugc

SEQ ID NO: 1667807 - RNA, 21 nt, Human
caucauugaaaucuuuuugcu

SEQ ID NO: 1667808 - RNA, 15 nt, Human
cauccagguucagcu

SEQ ID NO: 1667809 - RNA, 17 nt, Human
cauccagguucagcuug

SEQ ID NO: 1667810 - RNA, 13 nt, Human
caucccucccucc

SEQ ID NO: 1667811 - RNA, 12 nt, Human
caucccucccuc

SEQ ID NO: 1667812 - RNA, 11 nt, Human
caucccugaag

SEQ ID NO: 1667813 - RNA, 13 nt, Human
caucccugaaggc

SEQ ID NO: 1667814 - RNA, 19 nt, Human
caucccucuggggcuguuc

SEQ ID NO: 1667815 - RNA, 14 nt, Human
caucccucccucca

SEQ ID NO: 1667816 - RNA, 15 nt, Human
cauaugauguacaug

SEQ ID NO: 1667817 - RNA, 17 nt, Human
cauaugauguacaugua

SEQ ID NO: 1667818 - RNA, 21 nt, Human
cauaugauguacauguacuga

SEQ ID NO: 1667819 - RNA, 23 nt, Human
cauauauauguuuuaagaggcag

SEQ ID NO: 1667820 - RNA, 22 nt, Human
cauauauauguuuuaagaggca

SEQ ID NO: 1667821 - RNA, 22 nt, Human
cauaguggcuuaaaacaacacu

SEQ ID NO: 1667822 - RNA, 20 nt, Human
cauaguaugguggcuggguu

SEQ ID NO: 1667823 - RNA, 22 nt, Human
cauagugaugguuccccuguuc

SEQ ID NO: 1667824 - RNA, 18 nt, Human
cauaguaugguggcuggg

SEQ ID NO: 1667825 - RNA, 19 nt, Human
cauaguaugguggcugggu

SEQ ID NO: 1667826 - RNA, 14 nt, Human
cauagagcagcacu

SEQ ID NO: 1667827 - RNA, 11 nt, Human
cauacucugcu

SEQ ID NO: 1667828 - RNA, 16 nt, Human
cauacucccaucugug

SEQ ID NO: 1667829 - RNA, 15 nt, Human
cauacucccaucugu

SEQ ID NO: 1667830 - RNA, 18 nt, Human
cauacucccaucugugaa

SEQ ID NO: 1667831 - RNA, 20 nt, Human
cauacucccaucugugaaag

SEQ ID NO: 1667832 - RNA, 14 nt, Human
cauagaauaaaauu

SEQ ID NO: 1667833 - RNA, 20 nt, Human
cauagaauaaaauuuuuaau

SEQ ID NO: 1667834 - RNA, 23 nt, Human
cauagagagcaagacgcugugcu

SEQ ID NO: 1667835 - RNA, 19 nt, Human
cauagagagcaagacgcug

SEQ ID NO: 1667836 - RNA, 21 nt, Human
cauagagagcaagacgcugug

SEQ ID NO: 1667837 - RNA, 17 nt, Human
cauauuuauaaaaauaa

SEQ ID NO: 1667838 - RNA, 13 nt, Human
cauauuuuagcua

SEQ ID NO: 1667839 - RNA, 12 nt, Human
cauauuuauaaa

SEQ ID NO: 1667840 - RNA, 20 nt, Human
cauauuuacuucuuauacau

SEQ ID NO: 1667841 - RNA, 16 nt, Human
cauauuuacuucuuau

SEQ ID NO: 1667842 - RNA, 17 nt, Human
cauauuuacuucuuaua

SEQ ID NO: 1667843 - RNA, 13 nt, Human
cauaugccugggc

SEQ ID NO: 1667844 - RNA, 14 nt, Human
cauauuuacuucuu

SEQ ID NO: 1667845 - RNA, 14 nt, Human
caucaagaugugac

SEQ ID NO: 1667846 - RNA, 22 nt, Human
caucaagucuuucacauuuaaa

SEQ ID NO: 1667847 - RNA, 18 nt, Human
caucaaugaaugaaugaa

SEQ ID NO: 1667848 - RNA, 12 nt, Human
cauauuuucaug

SEQ ID NO: 1667849 - RNA, 17 nt, Human
cugaucucucgugauug

SEQ ID NO: 1667850 - RNA, 18 nt, Human
cugaucucucgugauuga

SEQ ID NO: 1667851 - RNA, 19 nt, Human
cugacccugcuucaaauau

SEQ ID NO: 1667852 - RNA, 23 nt, Human
cugacccugcuucaaauauuucc

SEQ ID NO: 1667853 - RNA, 12 nt, Human
cugagcugggau

SEQ ID NO: 1667854 - RNA, 22 nt, Human
cugagcugggaugauuggaggg

SEQ ID NO: 1667855 - RNA, 22 nt, Human
cugagcuugcagagaugaggcc

SEQ ID NO: 1667856 - RNA, 14 nt, Human
cugaggaauccaga

SEQ ID NO: 1667857 - RNA, 13 nt, Human
cugaggugggagg

SEQ ID NO: 1667858 - RNA, 22 nt, Human
cugaggugggaggaucucuuga

SEQ ID NO: 1667859 - RNA, 14 nt, Human
cugaggggccucuu

SEQ ID NO: 1667860 - RNA, 18 nt, Human
cugaggaauucuguauag

SEQ ID NO: 1667861 - RNA, 19 nt, Human
cugaggaauucuguauaga

SEQ ID NO: 1667862 - RNA, 15 nt, Human
cugaggaauucugua

SEQ ID NO: 1667863 - RNA, 16 nt, Human
cugaggaauucuguau

SEQ ID NO: 1667864 - RNA, 23 nt, Human
cugaggaauccagacccggcugc

SEQ ID NO: 1667865 - RNA, 14 nt, Human
cugaaaauguaugu

SEQ ID NO: 1667866 - RNA, 13 nt, Human
cugacacacagcu

SEQ ID NO: 1667867 - RNA, 15 nt, Human
cugacacacagcucu

SEQ ID NO: 1667868 - RNA, 16 nt, Human
cugacacacagcucug

SEQ ID NO: 1667869 - RNA, 17 nt, Human
cugacacacagcucugu

SEQ ID NO: 1667870 - RNA, 18 nt, Human
cugacacacagcucuguc

SEQ ID NO: 1667871 - RNA, 19 nt, Human
cugacacacagcucugucc

SEQ ID NO: 1667872 - RNA, 20 nt, Human
cugacacacagcucuguccu

SEQ ID NO: 1667873 - RNA, 21 nt, Human
cugacacacagcucuguccug

SEQ ID NO: 1667874 - RNA, 22 nt, Human
cugacacacagcucuguccugg

SEQ ID NO: 1667875 - RNA, 23 nt, Human
cugacacacagcucuguccuggg

SEQ ID NO: 1667876 - RNA, 20 nt, Human
cugaccccucauagcccuca

SEQ ID NO: 1667877 - RNA, 21 nt, Human
cugaccccucauagcccucac

SEQ ID NO: 1667878 - RNA, 17 nt, Human
cugaccccucauagccc

SEQ ID NO: 1667879 - RNA, 17 nt, Human
cucugcacaagcugcac

SEQ ID NO: 1667880 - RNA, 18 nt, Human
cucugcacaagcugcacc

SEQ ID NO: 1667881 - RNA, 19 nt, Human
cucugcacaagcugcaccc

SEQ ID NO: 1667882 - RNA, 22 nt, Human
cucuugauucauaaugacuuaa

SEQ ID NO: 1667883 - RNA, 15 nt, Human
cucuugagccuggga

SEQ ID NO: 1667884 - RNA, 16 nt, Human
cucuugagccugggag

SEQ ID NO: 1667885 - RNA, 14 nt, Human
cucuugagccuggg

SEQ ID NO: 1667886 - RNA, 24 nt, Human
cucuugauucauaaugacuuaagc

SEQ ID NO: 1667887 - RNA, 22 nt, Human
cucuugccacugccucuuccuc

SEQ ID NO: 1667888 - RNA, 13 nt, Human
cugaaagaggaau

SEQ ID NO: 1667889 - RNA, 17 nt, Human
cugaaagaggaaugaag

SEQ ID NO: 1667890 - RNA, 13 nt, Human
cuccuuucucuuu

SEQ ID NO: 1667891 - RNA, 22 nt, Human
cuccuuuagcgcccaguugggu

SEQ ID NO: 1667892 - RNA, 22 nt, Human
cuccuagccugugccucuggga

SEQ ID NO: 1667893 - RNA, 16 nt, Human
cuccuuuagcgcccag

SEQ ID NO: 1667894 - RNA, 17 nt, Human
cuccuuuagcgcccagu

SEQ ID NO: 1667895 - RNA, 13 nt, Human
cucgaacuccuga

SEQ ID NO: 1667896 - RNA, 24 nt, Human
cuccuuuucacaguucucuccuuc

SEQ ID NO: 1667897 - RNA, 16 nt, Human
cucgaacuccugaccu

SEQ ID NO: 1667898 - RNA, 17 nt, Human
cucgaacuccugaccuu

SEQ ID NO: 1667899 - RNA, 20 nt, Human
cucguauaugucucaggucc

SEQ ID NO: 1667900 - RNA, 18 nt, Human
cucguauaugucucaggu

SEQ ID NO: 1667901 - RNA, 11 nt, Human
cucggugccuu

SEQ ID NO: 1667902 - RNA, 16 nt, Human
cucugcacaagcugca

SEQ ID NO: 1667903 - RNA, 13 nt, Human
cucucccuuggau

SEQ ID NO: 1667904 - RNA, 21 nt, Human
cucuccgaccagacaccuuga

SEQ ID NO: 1667905 - RNA, 16 nt, Human
cucuccgaccagacac

SEQ ID NO: 1667906 - RNA, 13 nt, Human
cucuccuccuuuu

SEQ ID NO: 1667907 - RNA, 20 nt, Human
cucuccuccuuuucacaguu

SEQ ID NO: 1667908 - RNA, 19 nt, Human
cucucuggccuucggccuc

SEQ ID NO: 1667909 - RNA, 22 nt, Human
cucucuggccuucggccuccau

SEQ ID NO: 1667910 - RNA, 10 nt, Human
cucuccucug

SEQ ID NO: 1667911 - RNA, 17 nt, Human
cucucuggccuucggcc

SEQ ID NO: 1667912 - RNA, 14 nt, Human
cucccaccucagcc

SEQ ID NO: 1667913 - RNA, 16 nt, Human
cucccaccucagccuc

SEQ ID NO: 1667914 - RNA, 17 nt, Human
cucccaccucagccucc

SEQ ID NO: 1667915 - RNA, 18 nt, Human
cuccaggugcacaagcuc

SEQ ID NO: 1667916 - RNA, 19 nt, Human
cuccaggugcacaagcucc

SEQ ID NO: 1667917 - RNA, 20 nt, Human
cuccaggugcacaagcucca

SEQ ID NO: 1667918 - RNA, 22 nt, Human
cuccaggugcacaagcuccaag

SEQ ID NO: 1667919 - RNA, 23 nt, Human
cuccaggcuguaucccaugagcc

SEQ ID NO: 1667920 - RNA, 16 nt, Human
cuccagacacaugucc

SEQ ID NO: 1667921 - RNA, 22 nt, Human
cuccagaauuucccaaagcagu

SEQ ID NO: 1667922 - RNA, 11 nt, Human
cuccagacaca

SEQ ID NO: 1667923 - RNA, 16 nt, Human
cucagaaucucaaaua

SEQ ID NO: 1667924 - RNA, 17 nt, Human
cucagaaucucaaauaa

SEQ ID NO: 1667925 - RNA, 14 nt, Human
cuccgucaacucau

SEQ ID NO: 1667926 - RNA, 23 nt, Human
cuccgcuuucuacccagcgagcc

SEQ ID NO: 1667927 - RNA, 22 nt, Human
cuccgcuuucuacccagcgagc

SEQ ID NO: 1667928 - RNA, 21 nt, Human
cuccgcuuucuacccagcgag

SEQ ID NO: 1667929 - RNA, 20 nt, Human
cuccgcuuucuacccagcga

SEQ ID NO: 1667930 - RNA, 19 nt, Human
cucccucuuucccucccuu

SEQ ID NO: 1667931 - RNA, 15 nt, Human
cucccucuuucccuc

SEQ ID NO: 1667932 - RNA, 16 nt, Human
cucccucccucuuucc

SEQ ID NO: 1667933 - RNA, 19 nt, Human
cuccccaugauguuuagaa

SEQ ID NO: 1667934 - RNA, 18 nt, Human
cgauacaccgggccugga

SEQ ID NO: 1667935 - RNA, 20 nt, Human
cgauacaccgggccuggaga

SEQ ID NO: 1667936 - RNA, 21 nt, Human
cgauacaccgggccuggagaa

SEQ ID NO: 1667937 - RNA, 19 nt, Human
cgaguagcugagauuauag

SEQ ID NO: 1667938 - RNA, 13 nt, Human
cgaguagcuggga

SEQ ID NO: 1667939 - RNA, 17 nt, Human
cgcuggggccaguuggu

SEQ ID NO: 1667940 - RNA, 20 nt, Human
cgcuggggccaguugguccc

SEQ ID NO: 1667941 - RNA, 16 nt, Human
cgccuuaaggauguuc

SEQ ID NO: 1667942 - RNA, 18 nt, Human
cgcugccccuggcagccc

SEQ ID NO: 1667943 - RNA, 19 nt, Human
cgcuggaccuugaacuggg

SEQ ID NO: 1667944 - RNA, 23 nt, Human
cgcuggaccuugaacuggguacu

SEQ ID NO: 1667945 - RNA, 16 nt, Human
cgcugccccuggcagc

SEQ ID NO: 1667946 - RNA, 17 nt, Human
cgcugccccuggcagcc

SEQ ID NO: 1667947 - RNA, 13 nt, Human
cgcugccccuggc

SEQ ID NO: 1667948 - RNA, 16 nt, Human
cguacacauuuuauuu

SEQ ID NO: 1667949 - RNA, 13 nt, Human
cguacacauuuua

SEQ ID NO: 1667950 - RNA, 13 nt, Human
cgguguggagaag

SEQ ID NO: 1667951 - RNA, 15 nt, Human
cgguuuauauaagcu

SEQ ID NO: 1667952 - RNA, 15 nt, Human
cggagacggaguccc

SEQ ID NO: 1667953 - RNA, 23 nt, Human
cggagaagagcuguucacagcca

SEQ ID NO: 1667954 - RNA, 24 nt, Human
cggagaagagcuguucacagccag

SEQ ID NO: 1667955 - RNA, 15 nt, Human
cgguggugaggcagu

SEQ ID NO: 1667956 - RNA, 15 nt, Human
cuaaagcugccagcc

SEQ ID NO: 1667957 - RNA, 16 nt, Human
cuaaaggcuaccuuug

SEQ ID NO: 1667958 - RNA, 15 nt, Human
cuaaaggcuaccuuu

SEQ ID NO: 1667959 - RNA, 21 nt, Human
cuaaagaagguuucagaaaga

SEQ ID NO: 1667960 - RNA, 14 nt, Human
cuaaagcugccagc

SEQ ID NO: 1667961 - RNA, 19 nt, Human
cuaaaggcuaccuuuguau

SEQ ID NO: 1667962 - RNA, 17 nt, Human
cuaaaggcuaccuuugu

SEQ ID NO: 1667963 - RNA, 22 nt, Human
cuaaaguguauuuuuuuacuaa

SEQ ID NO: 1667964 - RNA, 14 nt, Human
cguuaccaggcagg

SEQ ID NO: 1667965 - RNA, 16 nt, Human
cuaaacuuuucugaua

SEQ ID NO: 1667966 - RNA, 13 nt, Human
cguuaaaauacca

SEQ ID NO: 1667967 - RNA, 22 nt, Human
cguguccccuauccuacuuccc

SEQ ID NO: 1667968 - RNA, 14 nt, Human
cuaacuggacuggu

SEQ ID NO: 1667969 - RNA, 20 nt, Human
cuacuagggaaaugccuuug

SEQ ID NO: 1667970 - RNA, 14 nt, Human
cuacuauauaugug

SEQ ID NO: 1667971 - RNA, 18 nt, Human
cuaccuuccaguuccuca

SEQ ID NO: 1667972 - RNA, 16 nt, Human
cuaccugaggggccuc

SEQ ID NO: 1667973 - RNA, 19 nt, Human
cuaccugaggggccucuua

SEQ ID NO: 1667974 - RNA, 23 nt, Human
cuaccugaggggccucuuauggg

SEQ ID NO: 1667975 - RNA, 14 nt, Human
cuagggaagauaau

SEQ ID NO: 1667976 - RNA, 13 nt, Human
cuaggguccuggg

SEQ ID NO: 1667977 - RNA, 14 nt, Human
cuaggguccugggg

SEQ ID NO: 1667978 - RNA, 15 nt, Human
cuaggguccugggga

SEQ ID NO: 1667979 - RNA, 19 nt, Human
cuaguuugauuaaauucuu

SEQ ID NO: 1667980 - RNA, 17 nt, Human
cuaguuugauuaaauuc

SEQ ID NO: 1667981 - RNA, 21 nt, Human
cuaguuugauuaaauucuugc

SEQ ID NO: 1667982 - RNA, 20 nt, Human
cuaguuugauuaaauucuug

SEQ ID NO: 1667983 - RNA, 12 nt, Human
cuaggccugggg

SEQ ID NO: 1667984 - RNA, 13 nt, Human
cuaggccugggga

SEQ ID NO: 1667985 - RNA, 14 nt, Human
cuaggccuggccag

SEQ ID NO: 1667986 - RNA, 15 nt, Human
cuaggccuggccaga

SEQ ID NO: 1667987 - RNA, 18 nt, Human
cuaggccuggccagaugc

SEQ ID NO: 1667988 - RNA, 19 nt, Human
cuaggccuggccagaugca

SEQ ID NO: 1667989 - RNA, 19 nt, Human
cuagccagaggagagagga

SEQ ID NO: 1667990 - RNA, 17 nt, Human
cuagccagaggagagag

SEQ ID NO: 1667991 - RNA, 13 nt, Human
cuaggccuggcca

SEQ ID NO: 1667992 - RNA, 21 nt, Human
cuagacccacuggacucaccu

SEQ ID NO: 1667993 - RNA, 20 nt, Human
cuagcauacguacacauuuu

SEQ ID NO: 1667994 - RNA, 19 nt, Human
cuagcauacguacacauuu

SEQ ID NO: 1667995 - RNA, 18 nt, Human
cuagcauacguacacauu

SEQ ID NO: 1667996 - RNA, 16 nt, Human
cuagcauacguacaca

SEQ ID NO: 1667997 - RNA, 14 nt, Human
cucacaaaggaugc

SEQ ID NO: 1667998 - RNA, 12 nt, Human
cucaaauaacua

SEQ ID NO: 1667999 - RNA, 14 nt, Human
cucacacaugagca

SEQ ID NO: 1668000 - RNA, 21 nt, Human
cucacacaugagcaucaggcc

SEQ ID NO: 1668001 - RNA, 18 nt, Human
cucaaaaaaagaaaaaga

SEQ ID NO: 1668002 - RNA, 16 nt, Human
cuauguugcccaggca

SEQ ID NO: 1668003 - RNA, 17 nt, Human
cuauguugcccaggcag

SEQ ID NO: 1668004 - RNA, 17 nt, Human
cucaaaacugcacuguc

SEQ ID NO: 1668005 - RNA, 13 nt, Human
cucaaaacugcac

SEQ ID NO: 1668006 - RNA, 19 nt, Human
cuauguaucaaugaguaac

SEQ ID NO: 1668007 - RNA, 20 nt, Human
cuaucucccccagccccauc

SEQ ID NO: 1668008 - RNA, 22 nt, Human
cuauguguagggcgggaggaug

SEQ ID NO: 1668009 - RNA, 15 nt, Human
cuauguugcccaggc

SEQ ID NO: 1668010 - RNA, 23 nt, Human
cuaugucauuugcuggagcucug

SEQ ID NO: 1668011 - RNA, 14 nt, Human
cucacccuggggcu

SEQ ID NO: 1668012 - RNA, 14 nt, Human
cucaccuccugcug

SEQ ID NO: 1668013 - RNA, 13 nt, Human
cucaccugccccu

SEQ ID NO: 1668014 - RNA, 18 nt, Human
cucaccugccccucaacu

SEQ ID NO: 1668015 - RNA, 14 nt, Human
cucaccugccccuc

SEQ ID NO: 1668016 - RNA, 16 nt, Human
cucaccugccccucaa

SEQ ID NO: 1668017 - RNA, 13 nt, Human
cucaccuccugcu

SEQ ID NO: 1668018 - RNA, 16 nt, Human
cucaccucccccaucu

SEQ ID NO: 1668019 - RNA, 13 nt, Human
cucaccucucccu

SEQ ID NO: 1668020 - RNA, 14 nt, Human
cucaccucucccuu

SEQ ID NO: 1668021 - RNA, 15 nt, Human
cucaccucucccuug

SEQ ID NO: 1668022 - RNA, 16 nt, Human
cucaccucucccuugg

SEQ ID NO: 1668023 - RNA, 17 nt, Human
cucaccucucccuugga

SEQ ID NO: 1668024 - RNA, 18 nt, Human
cucacuuguuuuauuuaa

SEQ ID NO: 1668025 - RNA, 19 nt, Human
cucagaaaacaaggaugaa

SEQ ID NO: 1668026 - RNA, 23 nt, Human
cucagaaaacaaggaugaauuaa

SEQ ID NO: 1668027 - RNA, 20 nt, Human
cucagaaggcaaaugacuuu

SEQ ID NO: 1668028 - RNA, 18 nt, Human
ccagucccccugccccag

SEQ ID NO: 1668029 - RNA, 21 nt, Human
ccaggcugcucuugaacuccu

SEQ ID NO: 1668030 - RNA, 23 nt, Human
ccaggcaggucuugaacuccugg

SEQ ID NO: 1668031 - RNA, 12 nt, Human
ccaggcaggucu

SEQ ID NO: 1668032 - RNA, 14 nt, Human
ccaggcaggucuug

SEQ ID NO: 1668033 - RNA, 21 nt, Human
ccaggggaaaaucagccugcu

SEQ ID NO: 1668034 - RNA, 12 nt, Human
ccaggcuggcgu

SEQ ID NO: 1668035 - RNA, 16 nt, Human
ccaggcuggcgugcag

SEQ ID NO: 1668036 - RNA, 23 nt, Human
ccagccccuucugacccaugcug

SEQ ID NO: 1668037 - RNA, 24 nt, Human
ccagccccuucugacccaugcugc

SEQ ID NO: 1668038 - RNA, 12 nt, Human
ccagcagaaaug

SEQ ID NO: 1668039 - RNA, 18 nt, Human
ccagccccauccucugua

SEQ ID NO: 1668040 - RNA, 15 nt, Human
ccagccccauccucu

SEQ ID NO: 1668041 - RNA, 17 nt, Human
ccagccccauccucugu

SEQ ID NO: 1668042 - RNA, 12 nt, Human
ccagcagagcac

SEQ ID NO: 1668043 - RNA, 13 nt, Human
ccagcagagcacc

SEQ ID NO: 1668044 - RNA, 14 nt, Human
ccagcagagcaccu

SEQ ID NO: 1668045 - RNA, 17 nt, Human
ccagccccagugcccac

SEQ ID NO: 1668046 - RNA, 21 nt, Human
ccauuucauuugugccagaau

SEQ ID NO: 1668047 - RNA, 22 nt, Human
ccauuucauuugugccagaaug

SEQ ID NO: 1668048 - RNA, 15 nt, Human
cccaacucaccccag

SEQ ID NO: 1668049 - RNA, 16 nt, Human
cccaacucaccccagc

SEQ ID NO: 1668050 - RNA, 12 nt, Human
cccacccccacc

SEQ ID NO: 1668051 - RNA, 13 nt, Human
cccacucccugca

SEQ ID NO: 1668052 - RNA, 23 nt, Human
cccacugcuuuuggucuguguga

SEQ ID NO: 1668053 - RNA, 13 nt, Human
cccaagcucugcu

SEQ ID NO: 1668054 - RNA, 14 nt, Human
cccaagcucugcuc

SEQ ID NO: 1668055 - RNA, 12 nt, Human
cccaagcucugc

SEQ ID NO: 1668056 - RNA, 15 nt, Human
cccaagcucugcucc

SEQ ID NO: 1668057 - RNA, 17 nt, Human
cccaacucaccccagcc

SEQ ID NO: 1668058 - RNA, 20 nt, Human
cccaacucaccccagcccca

SEQ ID NO: 1668059 - RNA, 20 nt, Human
cccaacuaauuuuuguauuu

SEQ ID NO: 1668060 - RNA, 13 nt, Human
cccaacuccagaa

SEQ ID NO: 1668061 - RNA, 13 nt, Human
ccaguuggucccc

SEQ ID NO: 1668062 - RNA, 18 nt, Human
ccaguuggucccccuucc

SEQ ID NO: 1668063 - RNA, 20 nt, Human
ccaguuggucccccuuccau

SEQ ID NO: 1668064 - RNA, 14 nt, Human
ccauaaucuggacu

SEQ ID NO: 1668065 - RNA, 21 nt, Human
ccauaaucuggacuccucugu

SEQ ID NO: 1668066 - RNA, 18 nt, Human
ccauccagguucagcuug

SEQ ID NO: 1668067 - RNA, 19 nt, Human
ccauccagguucagcuugu

SEQ ID NO: 1668068 - RNA, 20 nt, Human
ccaucccaaacccuucagug

SEQ ID NO: 1668069 - RNA, 19 nt, Human
ccaucccauaugccugggc

SEQ ID NO: 1668070 - RNA, 20 nt, Human
ccaucccauaugccugggca

SEQ ID NO: 1668071 - RNA, 21 nt, Human
ccaucccauaugccugggcag

SEQ ID NO: 1668072 - RNA, 13 nt, Human
ccaucccucccuc

SEQ ID NO: 1668073 - RNA, 15 nt, Human
ccaugucgccucugc

SEQ ID NO: 1668074 - RNA, 16 nt, Human
ccaugucgccucugca

SEQ ID NO: 1668075 - RNA, 17 nt, Human
ccaugucgccucugcau

SEQ ID NO: 1668076 - RNA, 19 nt, Human
ccaugucgccucugcauuc

SEQ ID NO: 1668077 - RNA, 12 nt, Human
ccaugucgccuc

SEQ ID NO: 1668078 - RNA, 18 nt, Human
ccaugaguccccuguuug

SEQ ID NO: 1668079 - RNA, 23 nt, Human
ccaugaggaacaaggcaaggcug

SEQ ID NO: 1668080 - RNA, 20 nt, Human
ccaugaggaacaaggcaagg

SEQ ID NO: 1668081 - RNA, 15 nt, Human
ccaucccucccucca

SEQ ID NO: 1668082 - RNA, 14 nt, Human
ccaucccucccucc

SEQ ID NO: 1668083 - RNA, 20 nt, Human
cccagcuggggccaggcugg

SEQ ID NO: 1668084 - RNA, 16 nt, Human
cccaggaaaggcucca

SEQ ID NO: 1668085 - RNA, 16 nt, Human
cccacuggacucaccu

SEQ ID NO: 1668086 - RNA, 13 nt, Human
cccaggcuggagu

SEQ ID NO: 1668087 - RNA, 18 nt, Human
cccaggcugagccucagu

SEQ ID NO: 1668088 - RNA, 22 nt, Human
cccaggcuuagucacugagaca

SEQ ID NO: 1668089 - RNA, 16 nt, Human
cccaggcugagccuca

SEQ ID NO: 1668090 - RNA, 17 nt, Human
cccaggcugagccucag

SEQ ID NO: 1668091 - RNA, 17 nt, Human
cccaggaaaggcuccag

SEQ ID NO: 1668092 - RNA, 18 nt, Human
cccaggaaaggcuccagg

SEQ ID NO: 1668093 - RNA, 21 nt, Human
cccauccucuguacagagccc

SEQ ID NO: 1668094 - RNA, 22 nt, Human
cccauccucuguacagagccca

SEQ ID NO: 1668095 - RNA, 17 nt, Human
ccccagaggcuggguga

SEQ ID NO: 1668096 - RNA, 15 nt, Human
ccccagauugcaaca

SEQ ID NO: 1668097 - RNA, 20 nt, Human
ccccagauugcaacaggcug

SEQ ID NO: 1668098 - RNA, 10 nt, Human
ccccagcccc

SEQ ID NO: 1668099 - RNA, 15 nt, Human
cccauuugcuccuuu

SEQ ID NO: 1668100 - RNA, 20 nt, Human
cccauucugccugcccaggc

SEQ ID NO: 1668101 - RNA, 19 nt, Human
cccauucugccugcccagg

SEQ ID NO: 1668102 - RNA, 14 nt, Human
cccauucugccugc

SEQ ID NO: 1668103 - RNA, 15 nt, Human
cccauucugccugcc

SEQ ID NO: 1668104 - RNA, 14 nt, Human
ccccgcacugggcu

SEQ ID NO: 1668105 - RNA, 16 nt, Human
cccuccucucugcccu

SEQ ID NO: 1668106 - RNA, 15 nt, Human
cccuccucucugccc

SEQ ID NO: 1668107 - RNA, 22 nt, Human
cccuccucugcuugccaucccu

SEQ ID NO: 1668108 - RNA, 13 nt, Human
cccuccucugcuu

SEQ ID NO: 1668109 - RNA, 16 nt, Human
cccucaacucuccucc

SEQ ID NO: 1668110 - RNA, 16 nt, Human
cccucacccuggggcu

SEQ ID NO: 1668111 - RNA, 20 nt, Human
cccucaacucuccuccagag

SEQ ID NO: 1668112 - RNA, 22 nt, Human
cccgggaagggggcugggacau

SEQ ID NO: 1668113 - RNA, 16 nt, Human
cccucaacaccucugc

SEQ ID NO: 1668114 - RNA, 18 nt, Human
cccgggaagggggcuggg

SEQ ID NO: 1668115 - RNA, 21 nt, Human
cccgggaagggggcugggaca

SEQ ID NO: 1668116 - RNA, 13 nt, Human
ccccuucugaccc

SEQ ID NO: 1668117 - RNA, 14 nt, Human
ccccuucugaccca

SEQ ID NO: 1668118 - RNA, 16 nt, Human
ccccuucugacccaug

SEQ ID NO: 1668119 - RNA, 16 nt, Human
cccgaauagcugggac

SEQ ID NO: 1668120 - RNA, 17 nt, Human
cccgaauagcugggacu

SEQ ID NO: 1668121 - RNA, 18 nt, Human
cccgaauagcugggacua

SEQ ID NO: 1668122 - RNA, 22 nt, Human
cccgaauagcugggacuacagg

SEQ ID NO: 1668123 - RNA, 20 nt, Human
cccggcuaauuuuuguauuu

SEQ ID NO: 1668124 - RNA, 11 nt, Human
cccggcuccag

SEQ ID NO: 1668125 - RNA, 15 nt, Human
cccgggaagggggcu

SEQ ID NO: 1668126 - RNA, 15 nt, Human
cccggccccugcugg

SEQ ID NO: 1668127 - RNA, 16 nt, Human
cccggccccugcuggu

SEQ ID NO: 1668128 - RNA, 15 nt, Human
ccccucugcccugcg

SEQ ID NO: 1668129 - RNA, 20 nt, Human
ccccucugcccugcggguca

SEQ ID NO: 1668130 - RNA, 23 nt, Human
ccccucugcccugcgggucacag

SEQ ID NO: 1668131 - RNA, 14 nt, Human
ccccugccacccug

SEQ ID NO: 1668132 - RNA, 16 nt, Human
ccccugccacccuggg

SEQ ID NO: 1668133 - RNA, 16 nt, Human
ccccucuggcuccagc

SEQ ID NO: 1668134 - RNA, 18 nt, Human
ccccucuggcuccagcug

SEQ ID NO: 1668135 - RNA, 13 nt, Human
ccccugaauuuaa

SEQ ID NO: 1668136 - RNA, 15 nt, Human
ccccugacaacacuc

SEQ ID NO: 1668137 - RNA, 18 nt, Human
ccccugcaaagcccagcu

SEQ ID NO: 1668138 - RNA, 20 nt, Human
ccccugcaaagcccagcuug

SEQ ID NO: 1668139 - RNA, 17 nt, Human
ccccugaauuuaaauag

SEQ ID NO: 1668140 - RNA, 21 nt, Human
ccccugcaaagcccagcuuga

SEQ ID NO: 1668141 - RNA, 13 nt, Human
ccccugcacucca

SEQ ID NO: 1668142 - RNA, 21 nt, Human
ccuaaugcgcaggcuggcccu

SEQ ID NO: 1668143 - RNA, 13 nt, Human
ccuaauuccacag

SEQ ID NO: 1668144 - RNA, 12 nt, Human
ccuaauaaagcu

SEQ ID NO: 1668145 - RNA, 13 nt, Human
ccuaauaaagcug

SEQ ID NO: 1668146 - RNA, 22 nt, Human
ccuagccuuagaagucacacag

SEQ ID NO: 1668147 - RNA, 23 nt, Human
ccuagccugugccucugggacug

SEQ ID NO: 1668148 - RNA, 19 nt, Human
ccuagccuuagaagucaca

SEQ ID NO: 1668149 - RNA, 14 nt, Human
ccgucccccucugg

SEQ ID NO: 1668150 - RNA, 17 nt, Human
ccggccaccugcggugc

SEQ ID NO: 1668151 - RNA, 18 nt, Human
ccggcaggguccuagaaa

SEQ ID NO: 1668152 - RNA, 18 nt, Human
ccggccaccugcggugcu

SEQ ID NO: 1668153 - RNA, 14 nt, Human
ccgcagcccugcag

SEQ ID NO: 1668154 - RNA, 18 nt, Human
ccgcagcccugcagaggg

SEQ ID NO: 1668155 - RNA, 23 nt, Human
ccgcagcccugcagagggcacag

SEQ ID NO: 1668156 - RNA, 15 nt, Human
cccugugggccccca

SEQ ID NO: 1668157 - RNA, 14 nt, Human
cccuccuuucacca

SEQ ID NO: 1668158 - RNA, 21 nt, Human
cccugugaguacuacaguccu

SEQ ID NO: 1668159 - RNA, 23 nt, Human
cccugugaguacuacaguccucc

SEQ ID NO: 1668160 - RNA, 15 nt, Human
cccugugauggggcc

SEQ ID NO: 1668161 - RNA, 14 nt, Human
cccuucucuccagc

SEQ ID NO: 1668162 - RNA, 19 nt, Human
cccuucucuccagccccug

SEQ ID NO: 1668163 - RNA, 21 nt, Human
cccuuuuuuggcugcugaagg

SEQ ID NO: 1668164 - RNA, 22 nt, Human
cccuuuuuuggcugcugaaggc

SEQ ID NO: 1668165 - RNA, 23 nt, Human
cccuuuuuuggcugcugaaggcu

SEQ ID NO: 1668166 - RNA, 15 nt, Human
ccgacagccuggcac

SEQ ID NO: 1668167 - RNA, 22 nt, Human
ccgacagccuggcacagggcag

SEQ ID NO: 1668168 - RNA, 13 nt, Human
ccgacagccuggc

SEQ ID NO: 1668169 - RNA, 14 nt, Human
ccgacagccuggca

SEQ ID NO: 1668170 - RNA, 12 nt, Human
ccgacagccugg

SEQ ID NO: 1668171 - RNA, 16 nt, Human
ccucaacaccucugca

SEQ ID NO: 1668172 - RNA, 19 nt, Human
ccucaacucuccuccagag

SEQ ID NO: 1668173 - RNA, 15 nt, Human
ccucaaccuccuggg

SEQ ID NO: 1668174 - RNA, 21 nt, Human
ccucaacucuccuccagaguc

SEQ ID NO: 1668175 - RNA, 23 nt, Human
ccucaacucuccuccagagucag

SEQ ID NO: 1668176 - RNA, 23 nt, Human
ccucaagugauucuccugccuca

SEQ ID NO: 1668177 - RNA, 16 nt, Human
ccucaaccuccugggc

SEQ ID NO: 1668178 - RNA, 20 nt, Human
ccucaagugauucuccugcc

SEQ ID NO: 1668179 - RNA, 21 nt, Human
ccucauuccaccuucccaugc

SEQ ID NO: 1668180 - RNA, 10 nt, Human
ccucaggccu

SEQ ID NO: 1668181 - RNA, 12 nt, Human
ccucaggcaggu

SEQ ID NO: 1668182 - RNA, 18 nt, Human
ccucaggcaggugggaug

SEQ ID NO: 1668183 - RNA, 17 nt, Human
ccucccaucacccgcua

SEQ ID NO: 1668184 - RNA, 20 nt, Human
ccuccaagaccuucuccuuc

SEQ ID NO: 1668185 - RNA, 12 nt, Human
ccucccaucacc

SEQ ID NO: 1668186 - RNA, 16 nt, Human
ccuccaagaccuucuc

SEQ ID NO: 1668187 - RNA, 17 nt, Human
ccuccaagaccuucucc

SEQ ID NO: 1668188 - RNA, 19 nt, Human
ccuccaagaccuucuccuu

SEQ ID NO: 1668189 - RNA, 19 nt, Human
ccuccuaucagaaguuucu

SEQ ID NO: 1668190 - RNA, 23 nt, Human
ccuccuuugugaggaagccgcug

SEQ ID NO: 1668191 - RNA, 18 nt, Human
ccuccuuuucacaguucu

SEQ ID NO: 1668192 - RNA, 19 nt, Human
ccucggacuuagcugggag

SEQ ID NO: 1668193 - RNA, 20 nt, Human
ccucggacuuagcugggaga

SEQ ID NO: 1668194 - RNA, 12 nt, Human
ccucggagaaga

SEQ ID NO: 1668195 - RNA, 14 nt, Human
ccucggagaagagc

SEQ ID NO: 1668196 - RNA, 14 nt, Human
ccuccgccucuugg

SEQ ID NO: 1668197 - RNA, 20 nt, Human
ccucccuuggggccuaugca

SEQ ID NO: 1668198 - RNA, 16 nt, Human
ccucccuucucuucac

SEQ ID NO: 1668199 - RNA, 17 nt, Human
ccugccucagccucccg

SEQ ID NO: 1668200 - RNA, 13 nt, Human
ccugccucucugc

SEQ ID NO: 1668201 - RNA, 18 nt, Human
ccugcugagucccaggcu

SEQ ID NO: 1668202 - RNA, 19 nt, Human
ccugcugagucccaggcug

SEQ ID NO: 1668203 - RNA, 20 nt, Human
ccugcugagucccaggcuga

SEQ ID NO: 1668204 - RNA, 14 nt, Human
ccugccucucugca

SEQ ID NO: 1668205 - RNA, 15 nt, Human
ccugccucucugcag

SEQ ID NO: 1668206 - RNA, 16 nt, Human
ccugccucagccuccc

SEQ ID NO: 1668207 - RNA, 15 nt, Human
ccugccucagccucc

SEQ ID NO: 1668208 - RNA, 21 nt, Human
ccugcccaggccccugccacc

SEQ ID NO: 1668209 - RNA, 22 nt, Human
ccugcccaggccccugccaccc

SEQ ID NO: 1668210 - RNA, 18 nt, Human
ccugcccaccuggccucu

SEQ ID NO: 1668211 - RNA, 19 nt, Human
ccugcccaccuggccucug

SEQ ID NO: 1668212 - RNA, 19 nt, Human
ccugcccaggccccugcca

SEQ ID NO: 1668213 - RNA, 15 nt, Human
ccugcccaccuggcc

SEQ ID NO: 1668214 - RNA, 17 nt, Human
ccugcccaccuggccuc

SEQ ID NO: 1668215 - RNA, 23 nt, Human
ccucuugccacugccucuuccuc

SEQ ID NO: 1668216 - RNA, 22 nt, Human
ccucuugccacugccucuuccu

SEQ ID NO: 1668217 - RNA, 15 nt, Human
ccucuuugagugaag

SEQ ID NO: 1668218 - RNA, 19 nt, Human
ccucuuucccucccuuccu

SEQ ID NO: 1668219 - RNA, 18 nt, Human
ccugaccccucauagccc

SEQ ID NO: 1668220 - RNA, 15 nt, Human
ccugcaggcagccag

SEQ ID NO: 1668221 - RNA, 14 nt, Human
ccugcaggcagcca

SEQ ID NO: 1668222 - RNA, 12 nt, Human
ccugcaggcagc

SEQ ID NO: 1668223 - RNA, 13 nt, Human
ccugcaggcagcc

SEQ ID NO: 1668224 - RNA, 20 nt, Human
ccugguggcagugggagcug

SEQ ID NO: 1668225 - RNA, 18 nt, Human
ccugguggcagugggagc

SEQ ID NO: 1668226 - RNA, 19 nt, Human
ccugguggcagugggagcu

SEQ ID NO: 1668227 - RNA, 18 nt, Human
ccugguuuccugcccugg

SEQ ID NO: 1668228 - RNA, 19 nt, Human
ccugguuuccugcccuggg

SEQ ID NO: 1668229 - RNA, 20 nt, Human
ccugguuuccugcccuggga

SEQ ID NO: 1668230 - RNA, 21 nt, Human
ccugguuuccugcccugggag

SEQ ID NO: 1668231 - RNA, 13 nt, Human
ccugguguggaag

SEQ ID NO: 1668232 - RNA, 18 nt, Human
ccuggggaaccugacccc

SEQ ID NO: 1668233 - RNA, 15 nt, Human
ccuggggagaaagua

SEQ ID NO: 1668234 - RNA, 20 nt, Human
ccuggccccucagggucccu

SEQ ID NO: 1668235 - RNA, 21 nt, Human
ccuggccccucagggucccug

SEQ ID NO: 1668236 - RNA, 18 nt, Human
ccuggccccucagggucc

SEQ ID NO: 1668237 - RNA, 17 nt, Human
ccuggauggggcugcac

SEQ ID NO: 1668238 - RNA, 18 nt, Human
ccuggauggggcugcacc

SEQ ID NO: 1668239 - RNA, 15 nt, Human
ccuggauggggcugc

SEQ ID NO: 1668240 - RNA, 22 nt, Human
ccugguuuccugcccugggagg

SEQ ID NO: 1668241 - RNA, 17 nt, Human
ccugucucuacuaaaaa

SEQ ID NO: 1668242 - RNA, 21 nt, Human
cacauuuuauuuuauuaugca

SEQ ID NO: 1668243 - RNA, 20 nt, Human
cacauuuuauuuuauuaugc

SEQ ID NO: 1668244 - RNA, 19 nt, Human
cacauuuuauuuuauuaug

SEQ ID NO: 1668245 - RNA, 17 nt, Human
cacauuuuauuuuauua

SEQ ID NO: 1668246 - RNA, 17 nt, Human
caccaacauacucccau

SEQ ID NO: 1668247 - RNA, 16 nt, Human
caccaacgucugugcc

SEQ ID NO: 1668248 - RNA, 13 nt, Human
caccaacccucag

SEQ ID NO: 1668249 - RNA, 14 nt, Human
caccaacgucugug

SEQ ID NO: 1668250 - RNA, 18 nt, Human
caccagggaaggggacaa

SEQ ID NO: 1668251 - RNA, 21 nt, Human
caccagggaaggggacaagga

SEQ ID NO: 1668252 - RNA, 13 nt, Human
caccagggaaggg

SEQ ID NO: 1668253 - RNA, 17 nt, Human
cacccaccucagccucc

SEQ ID NO: 1668254 - RNA, 13 nt, Human
caccagccccagu

SEQ ID NO: 1668255 - RNA, 16 nt, Human
caccagccccagugcc

SEQ ID NO: 1668256 - RNA, 18 nt, Human
cacccaccucagccuccc

SEQ ID NO: 1668257 - RNA, 16 nt, Human
cacccaggagccccga

SEQ ID NO: 1668258 - RNA, 23 nt, Human
cacagaaaagaaaguucaugcuu

SEQ ID NO: 1668259 - RNA, 13 nt, Human
cacagaacccuug

SEQ ID NO: 1668260 - RNA, 11 nt, Human
cacacauuuuu

SEQ ID NO: 1668261 - RNA, 10 nt, Human
cacacauuuu

SEQ ID NO: 1668262 - RNA, 20 nt, Human
cacacauuuuuuaaaugcac

SEQ ID NO: 1668263 - RNA, 19 nt, Human
cacacauuuuuuaaaugca

SEQ ID NO: 1668264 - RNA, 16 nt, Human
cacacauuuuuuaaau

SEQ ID NO: 1668265 - RNA, 12 nt, Human
cacacauuuuuu

SEQ ID NO: 1668266 - RNA, 18 nt, Human
cacagcucuucuccaggc

SEQ ID NO: 1668267 - RNA, 17 nt, Human
cacagcucuucuccagg

SEQ ID NO: 1668268 - RNA, 14 nt, Human
cacagcucuucucc

SEQ ID NO: 1668269 - RNA, 15 nt, Human
cacagcucuucucca

SEQ ID NO: 1668270 - RNA, 15 nt, Human
cacagcucuguccug

SEQ ID NO: 1668271 - RNA, 16 nt, Human
cacagcucuguccugg

SEQ ID NO: 1668272 - RNA, 18 nt, Human
cacagcucuguccuggga

SEQ ID NO: 1668273 - RNA, 19 nt, Human
cacagcucuguccugggag

SEQ ID NO: 1668274 - RNA, 18 nt, Human
cacagacccugcccugug

SEQ ID NO: 1668275 - RNA, 11 nt, Human
cacagcucugu

SEQ ID NO: 1668276 - RNA, 14 nt, Human
cacagcucuguccu

SEQ ID NO: 1668277 - RNA, 14 nt, Human
cacagacccugccc

SEQ ID NO: 1668278 - RNA, 16 nt, Human
cacagacccugcccug

SEQ ID NO: 1668279 - RNA, 17 nt, Human
cacagacccugcccugu

SEQ ID NO: 1668280 - RNA, 15 nt, Human
caaugggagcucaug

SEQ ID NO: 1668281 - RNA, 18 nt, Human
cacaagagcccaggccuc

SEQ ID NO: 1668282 - RNA, 19 nt, Human
cacaagagcccaggccucc

SEQ ID NO: 1668283 - RNA, 20 nt, Human
cacaagagcccaggccuccu

SEQ ID NO: 1668284 - RNA, 18 nt, Human
cacaagcuccaagcuccc

SEQ ID NO: 1668285 - RNA, 19 nt, Human
cacaagcuccaagcuccca

SEQ ID NO: 1668286 - RNA, 16 nt, Human
caaucccaccaacccu

SEQ ID NO: 1668287 - RNA, 17 nt, Human
caaucccaccaacccuc

SEQ ID NO: 1668288 - RNA, 22 nt, Human
caaucccaccaacccucagagc

SEQ ID NO: 1668289 - RNA, 23 nt, Human
caaucccaccaacccucagagcc

SEQ ID NO: 1668290 - RNA, 13 nt, Human
caaugcuggcugu

SEQ ID NO: 1668291 - RNA, 20 nt, Human
caaugcuggcuguuggcugg

SEQ ID NO: 1668292 - RNA, 21 nt, Human
caaugcuggcuguuggcuggg

SEQ ID NO: 1668293 - RNA, 20 nt, Human
cacaagcuccaagcucccag

SEQ ID NO: 1668294 - RNA, 21 nt, Human
cacaagcuccaagcucccagg

SEQ ID NO: 1668295 - RNA, 20 nt, Human
caauaaaaucuugaaaaugc

SEQ ID NO: 1668296 - RNA, 15 nt, Human
caauaaaauggguuu

SEQ ID NO: 1668297 - RNA, 17 nt, Human
caaggcaaggcugucaa

SEQ ID NO: 1668298 - RNA, 18 nt, Human
caaggcaaggcugucaau

SEQ ID NO: 1668299 - RNA, 21 nt, Human
caaggccaaaggaagcacaug

SEQ ID NO: 1668300 - RNA, 19 nt, Human
caaggccaaaggaagcaca

SEQ ID NO: 1668301 - RNA, 20 nt, Human
caaggccaaaggaagcacau

SEQ ID NO: 1668302 - RNA, 15 nt, Human
caaggcucugagcaa

SEQ ID NO: 1668303 - RNA, 21 nt, Human
caagucagucauucagauaug

SEQ ID NO: 1668304 - RNA, 20 nt, Human
caauaaaauccauacauuug

SEQ ID NO: 1668305 - RNA, 23 nt, Human
caauaaaauccauacauuugugu

SEQ ID NO: 1668306 - RNA, 13 nt, Human
caaguuguuugag

SEQ ID NO: 1668307 - RNA, 17 nt, Human
caaguuguuugagaaau

SEQ ID NO: 1668308 - RNA, 21 nt, Human
caaguuguuugagaaauuaag

SEQ ID NO: 1668309 - RNA, 23 nt, Human
caaguuguuugagaaauuaagua

SEQ ID NO: 1668310 - RNA, 12 nt, Human
caccuacugagu

SEQ ID NO: 1668311 - RNA, 12 nt, Human
caccucagccuc

SEQ ID NO: 1668312 - RNA, 14 nt, Human
caccuuugaagaag

SEQ ID NO: 1668313 - RNA, 14 nt, Human
caccuuucccaucu

SEQ ID NO: 1668314 - RNA, 21 nt, Human
caccuuucagauaacuguuau

SEQ ID NO: 1668315 - RNA, 22 nt, Human
caccuuucagauaacuguuauu

SEQ ID NO: 1668316 - RNA, 18 nt, Human
caccugcccaaccugcuc

SEQ ID NO: 1668317 - RNA, 19 nt, Human
caccugcccaaccugcucu

SEQ ID NO: 1668318 - RNA, 13 nt, Human
caccugcccaacc

SEQ ID NO: 1668319 - RNA, 23 nt, Human
caccuuuauucuggcagaggagg

SEQ ID NO: 1668320 - RNA, 18 nt, Human
caccuuggcugcagggag

SEQ ID NO: 1668321 - RNA, 15 nt, Human
caccuuggcugcagg

SEQ ID NO: 1668322 - RNA, 16 nt, Human
caccuuggcugcaggg

SEQ ID NO: 1668323 - RNA, 20 nt, Human
cacucuuauugcccacgcug

SEQ ID NO: 1668324 - RNA, 21 nt, Human
cacucuuauugcccacgcugg

SEQ ID NO: 1668325 - RNA, 22 nt, Human
cacucuuauugcccacgcugga

SEQ ID NO: 1668326 - RNA, 15 nt, Human
cacggcucacugcag

SEQ ID NO: 1668327 - RNA, 14 nt, Human
cacggcucacugca

SEQ ID NO: 1668328 - RNA, 12 nt, Human
cacggccaggcc

SEQ ID NO: 1668329 - RNA, 13 nt, Human
cacggccaggcca

SEQ ID NO: 1668330 - RNA, 13 nt, Human
cacuccagccugg

SEQ ID NO: 1668331 - RNA, 14 nt, Human
cacuccagccuggg

SEQ ID NO: 1668332 - RNA, 23 nt, Human
cacuccagccugagcgacaguga

SEQ ID NO: 1668333 - RNA, 17 nt, Human
cacuacauucuguuaau

SEQ ID NO: 1668334 - RNA, 16 nt, Human
cacuacauucuguuaa

SEQ ID NO: 1668335 - RNA, 21 nt, Human
cacuacauuauaaaugucucu

SEQ ID NO: 1668336 - RNA, 21 nt, Human
cacuacauucuguuaaucauu

SEQ ID NO: 1668337 - RNA, 13 nt, Human
cacuccagccuga

SEQ ID NO: 1668338 - RNA, 12 nt, Human
cacuccagccug

SEQ ID NO: 1668339 - RNA, 17 nt, Human
cagaaauguguuaucac

SEQ ID NO: 1668340 - RNA, 16 nt, Human
cagaaauguacagcaa

SEQ ID NO: 1668341 - RNA, 11 nt, Human
cagaacaguga

SEQ ID NO: 1668342 - RNA, 12 nt, Human
cagaacagugau

SEQ ID NO: 1668343 - RNA, 17 nt, Human
cagaacagugauuacca

SEQ ID NO: 1668344 - RNA, 14 nt, Human
cagaaguuucugcc

SEQ ID NO: 1668345 - RNA, 16 nt, Human
cagaaguuucugccgc

SEQ ID NO: 1668346 - RNA, 15 nt, Human
cagaaguuucucagc

SEQ ID NO: 1668347 - RNA, 19 nt, Human
cagaaguuucucagcuccc

SEQ ID NO: 1668348 - RNA, 18 nt, Human
cagaacagugauuaccag

SEQ ID NO: 1668349 - RNA, 13 nt, Human
cacuuucuagcca

SEQ ID NO: 1668350 - RNA, 18 nt, Human
cacuuucuagccagagga

SEQ ID NO: 1668351 - RNA, 16 nt, Human
cacuuucuagccagag

SEQ ID NO: 1668352 - RNA, 17 nt, Human
cacuuucuagccagagg

SEQ ID NO: 1668353 - RNA, 19 nt, Human
cacuuguugauuaauggaa

SEQ ID NO: 1668354 - RNA, 18 nt, Human
cacuuguguuaugaagca

SEQ ID NO: 1668355 - RNA, 17 nt, Human
cacuuguguuuugcaag

SEQ ID NO: 1668356 - RNA, 17 nt, Human
cacugccaugccagcuu

SEQ ID NO: 1668357 - RNA, 20 nt, Human
cacugcagccucaaccuccu

SEQ ID NO: 1668358 - RNA, 21 nt, Human
cacugcagccucaaccuccug

SEQ ID NO: 1668359 - RNA, 22 nt, Human
cacugcagccucaaccuccugg

SEQ ID NO: 1668360 - RNA, 23 nt, Human
cacugcagccucaaccuccuggg

SEQ ID NO: 1668361 - RNA, 19 nt, Human
cacugcagccucaaccucc

SEQ ID NO: 1668362 - RNA, 14 nt, Human
cacugcagccucaa

SEQ ID NO: 1668363 - RNA, 19 nt, Human
cacugggagaaaugaaaaa

SEQ ID NO: 1668364 - RNA, 13 nt, Human
cacugggcuucua

SEQ ID NO: 1668365 - RNA, 20 nt, Human
cacugggcuuggggaccaga

SEQ ID NO: 1668366 - RNA, 18 nt, Human
cacuguugcccaggcugg

SEQ ID NO: 1668367 - RNA, 19 nt, Human
cacuguugcccaggcuggc

SEQ ID NO: 1668368 - RNA, 23 nt, Human
cacuguugcccaggcuggcgugc

SEQ ID NO: 1668369 - RNA, 15 nt, Human
cacuuaaaaaugguu

SEQ ID NO: 1668370 - RNA, 18 nt, Human
auuuuuuuguuguuuguu

SEQ ID NO: 1668371 - RNA, 23 nt, Human
auuuuuuuuuccuucagugccuu

SEQ ID NO: 1668372 - RNA, 20 nt, Human
auuuuuuuuuccuucagugc

SEQ ID NO: 1668373 - RNA, 22 nt, Human
auuuuuuuuuccuucagugccu

SEQ ID NO: 1668374 - RNA, 13 nt, Human
auuuuuuuguugu

SEQ ID NO: 1668375 - RNA, 18 nt, Human
auuuuuuuuuccuucagu

SEQ ID NO: 1668376 - RNA, 16 nt, Human
auuuuuuugagacaga

SEQ ID NO: 1668377 - RNA, 15 nt, Human
auuuuuauauuuacu

SEQ ID NO: 1668378 - RNA, 16 nt, Human
auuuuuauauuuacua

SEQ ID NO: 1668379 - RNA, 15 nt, Human
auuuuuauauuugaa

SEQ ID NO: 1668380 - RNA, 16 nt, Human
auuuuuauauuugaaa

SEQ ID NO: 1668381 - RNA, 21 nt, Human
caaaaggauaaugaauacuuu

SEQ ID NO: 1668382 - RNA, 17 nt, Human
caaacauauauaacaau

SEQ ID NO: 1668383 - RNA, 16 nt, Human
caaacagucucaggaa

SEQ ID NO: 1668384 - RNA, 17 nt, Human
caaacagucucaggaaa

SEQ ID NO: 1668385 - RNA, 18 nt, Human
caaaccccgaccaccugc

SEQ ID NO: 1668386 - RNA, 21 nt, Human
caaaccccgaccaccugccca

SEQ ID NO: 1668387 - RNA, 14 nt, Human
caaacccuucagug

SEQ ID NO: 1668388 - RNA, 14 nt, Human
auuuuuagacagag

SEQ ID NO: 1668389 - RNA, 19 nt, Human
auuuuuaagugcugcauuu

SEQ ID NO: 1668390 - RNA, 18 nt, Human
auuuuuaagugcugcauu

SEQ ID NO: 1668391 - RNA, 16 nt, Human
auuuuuaagugcugca

SEQ ID NO: 1668392 - RNA, 19 nt, Human
auuuuagggguagcauuug

SEQ ID NO: 1668393 - RNA, 21 nt, Human
auuuuauaucaauuuaaaaaa

SEQ ID NO: 1668394 - RNA, 18 nt, Human
auuuuagcuacuauauau

SEQ ID NO: 1668395 - RNA, 18 nt, Human
auuuuaugcuuuaaacau

SEQ ID NO: 1668396 - RNA, 19 nt, Human
auuuuaugcuuuaaacauu

SEQ ID NO: 1668397 - RNA, 21 nt, Human
caacacacagauuugagcuca

SEQ ID NO: 1668398 - RNA, 22 nt, Human
caacacacagauuugagcucag

SEQ ID NO: 1668399 - RNA, 23 nt, Human
caaaugcuguaacuuucugaaau

SEQ ID NO: 1668400 - RNA, 21 nt, Human
caaaucuuaacuugaaggagu

SEQ ID NO: 1668401 - RNA, 14 nt, Human
caaagguaaaucag

SEQ ID NO: 1668402 - RNA, 22 nt, Human
caaagguaaaucagacuaugaa

SEQ ID NO: 1668403 - RNA, 22 nt, Human
caaaguagaagucuuagaugua

SEQ ID NO: 1668404 - RNA, 21 nt, Human
caaaguaucccuacuguaauu

SEQ ID NO: 1668405 - RNA, 19 nt, Human
caaaguaucccuacuguaa

SEQ ID NO: 1668406 - RNA, 16 nt, Human
caaagauauuuugcuu

SEQ ID NO: 1668407 - RNA, 14 nt, Human
caaagauauuuugc

SEQ ID NO: 1668408 - RNA, 18 nt, Human
caaagcagugcaugcugu

SEQ ID NO: 1668409 - RNA, 21 nt, Human
caaagcagugcaugcuguccc

SEQ ID NO: 1668410 - RNA, 18 nt, Human
caaagauauuuugcuuug

SEQ ID NO: 1668411 - RNA, 22 nt, Human
caaagcagugcaugcugucccu

SEQ ID NO: 1668412 - RNA, 18 nt, Human
caacuaauuuuuguauuu

SEQ ID NO: 1668413 - RNA, 17 nt, Human
caacucauauuuucaug

SEQ ID NO: 1668414 - RNA, 18 nt, Human
caacucaccccagcccca

SEQ ID NO: 1668415 - RNA, 22 nt, Human
caagaauugaagcaggacuaaa

SEQ ID NO: 1668416 - RNA, 14 nt, Human
caacucuccuccag

SEQ ID NO: 1668417 - RNA, 18 nt, Human
caagaccacguuucuaaa

SEQ ID NO: 1668418 - RNA, 17 nt, Human
caagaccacguuucuaa

SEQ ID NO: 1668419 - RNA, 20 nt, Human
caagaauuucuaggacugaa

SEQ ID NO: 1668420 - RNA, 19 nt, Human
caagacccaaaaggcagaa

SEQ ID NO: 1668421 - RNA, 18 nt, Human
auuccugcauuugugaaa

SEQ ID NO: 1668422 - RNA, 15 nt, Human
auuccugcauuugug

SEQ ID NO: 1668423 - RNA, 18 nt, Human
auucucuaguuugauuaa

SEQ ID NO: 1668424 - RNA, 17 nt, Human
auucucuaguuugauua

SEQ ID NO: 1668425 - RNA, 22 nt, Human
auucuccuuguguuacuaaguu

SEQ ID NO: 1668426 - RNA, 21 nt, Human
auucuccuuguguuacuaagu

SEQ ID NO: 1668427 - RNA, 19 nt, Human
auucuccuuguguuacuaa

SEQ ID NO: 1668428 - RNA, 18 nt, Human
auucuccuuguguuacua

SEQ ID NO: 1668429 - RNA, 19 nt, Human
auucucuaguuugauuaaa

SEQ ID NO: 1668430 - RNA, 19 nt, Human
auucuucugcuucagccuc

SEQ ID NO: 1668431 - RNA, 20 nt, Human
auucuucugcuucagccucc

SEQ ID NO: 1668432 - RNA, 22 nt, Human
auucuucuguacgucugacagg

SEQ ID NO: 1668433 - RNA, 14 nt, Human
auucuugcaaagua

SEQ ID NO: 1668434 - RNA, 16 nt, Human
auucuugcaaaguauc

SEQ ID NO: 1668435 - RNA, 15 nt, Human
auucuugcaaaguau

SEQ ID NO: 1668436 - RNA, 12 nt, Human
auuauguaaauc

SEQ ID NO: 1668437 - RNA, 18 nt, Human
auucaaauguauuacagu

SEQ ID NO: 1668438 - RNA, 16 nt, Human
auucaaaugucuauaa

SEQ ID NO: 1668439 - RNA, 18 nt, Human
auucaacagguuuuccug

SEQ ID NO: 1668440 - RNA, 14 nt, Human
auuaggauuucaug

SEQ ID NO: 1668441 - RNA, 16 nt, Human
auuaggauuucaugau

SEQ ID NO: 1668442 - RNA, 11 nt, Human
auuaaauuaug

SEQ ID NO: 1668443 - RNA, 17 nt, Human
auuaaaugcccagcccc

SEQ ID NO: 1668444 - RNA, 19 nt, Human
auuaaaugcccagccccuu

SEQ ID NO: 1668445 - RNA, 20 nt, Human
auuaguacuccccuccuuga

SEQ ID NO: 1668446 - RNA, 19 nt, Human
auuaugaauuacauuugua

SEQ ID NO: 1668447 - RNA, 20 nt, Human
auuaugaauuacauuuguau

SEQ ID NO: 1668448 - RNA, 22 nt, Human
auuaugaauuacauuuguauaa

SEQ ID NO: 1668449 - RNA, 16 nt, Human
auuuaugcauauuauu

SEQ ID NO: 1668450 - RNA, 22 nt, Human
auuuaugcauauuauuuuaugu

SEQ ID NO: 1668451 - RNA, 15 nt, Human
auuuauaaucacuuu

SEQ ID NO: 1668452 - RNA, 16 nt, Human
auuuaaugaaagacug

SEQ ID NO: 1668453 - RNA, 20 nt, Human
auuuaaugaaagacuguaca

SEQ ID NO: 1668454 - RNA, 21 nt, Human
auuuaaugaaagacuguacaa

SEQ ID NO: 1668455 - RNA, 13 nt, Human
auuuauaaucacu

SEQ ID NO: 1668456 - RNA, 22 nt, Human
auuuauaaucacuuuuuuccac

SEQ ID NO: 1668457 - RNA, 16 nt, Human
auuuaauaaaugugcc

SEQ ID NO: 1668458 - RNA, 19 nt, Human
auuucuauauuuucauucu

SEQ ID NO: 1668459 - RNA, 19 nt, Human
auuucuaugcugaguuugu

SEQ ID NO: 1668460 - RNA, 21 nt, Human
auuucuaugcugaguuugugc

SEQ ID NO: 1668461 - RNA, 22 nt, Human
auuucuaugcugaguuugugcu

SEQ ID NO: 1668462 - RNA, 20 nt, Human
auuucauaccuaucaucuua

SEQ ID NO: 1668463 - RNA, 17 nt, Human
auuucuauauuuucauu

SEQ ID NO: 1668464 - RNA, 18 nt, Human
auuucuauauuuucauuc

SEQ ID NO: 1668465 - RNA, 14 nt, Human
auuucuaugaaaua

SEQ ID NO: 1668466 - RNA, 15 nt, Human
auuucuauauuuuca

SEQ ID NO: 1668467 - RNA, 16 nt, Human
auuucuauauuuucau

SEQ ID NO: 1668468 - RNA, 15 nt, Human
auuguuuaaaaucau

SEQ ID NO: 1668469 - RNA, 16 nt, Human
auuguugucugcaacu

SEQ ID NO: 1668470 - RNA, 16 nt, Human
auuguaauuauaucug

SEQ ID NO: 1668471 - RNA, 17 nt, Human
auuguaauuauaucuga

SEQ ID NO: 1668472 - RNA, 15 nt, Human
auuguaauuauaucu

SEQ ID NO: 1668473 - RNA, 18 nt, Human
auuguaagcaugcacaaa

SEQ ID NO: 1668474 - RNA, 21 nt, Human
auuguaauuauaucugaggaa

SEQ ID NO: 1668475 - RNA, 16 nt, Human
auuguacaaaguauua

SEQ ID NO: 1668476 - RNA, 17 nt, Human
auuguacaaaguauuaa

SEQ ID NO: 1668477 - RNA, 19 nt, Human
auuguacaaaguauuaagc

SEQ ID NO: 1668478 - RNA, 16 nt, Human
cagcuccaagaauuuc

SEQ ID NO: 1668479 - RNA, 19 nt, Human
cagcuccaagaauuucuag

SEQ ID NO: 1668480 - RNA, 13 nt, Human
cagcuccagcuca

SEQ ID NO: 1668481 - RNA, 14 nt, Human
cagcuccagcucac

SEQ ID NO: 1668482 - RNA, 15 nt, Human
cagcuccagcucacc

SEQ ID NO: 1668483 - RNA, 21 nt, Human
cagcucccaaggcucugagca

SEQ ID NO: 1668484 - RNA, 22 nt, Human
cagcuccagcucaccagcccca

SEQ ID NO: 1668485 - RNA, 16 nt, Human
cagcuccagcucacca

SEQ ID NO: 1668486 - RNA, 17 nt, Human
cagcuccagcucaccag

SEQ ID NO: 1668487 - RNA, 18 nt, Human
cagcuccagcucaccagc

SEQ ID NO: 1668488 - RNA, 20 nt, Human
cagcuccagcucaccagccc

SEQ ID NO: 1668489 - RNA, 22 nt, Human
cagcugccuccccuccucugcu

SEQ ID NO: 1668490 - RNA, 21 nt, Human
cagcugccuccccuccucugc

SEQ ID NO: 1668491 - RNA, 24 nt, Human
cagcugccuccccuccucugcuug

SEQ ID NO: 1668492 - RNA, 23 nt, Human
cagcugccuccccuccucugcuu

SEQ ID NO: 1668493 - RNA, 16 nt, Human
cagcuccccucggaga

SEQ ID NO: 1668494 - RNA, 17 nt, Human
cagcuccccucggagaa

SEQ ID NO: 1668495 - RNA, 18 nt, Human
cagcuccccucggagaag

SEQ ID NO: 1668496 - RNA, 20 nt, Human
cagcuccccucggagaagag

SEQ ID NO: 1668497 - RNA, 19 nt, Human
cagcugugcucuggacagg

SEQ ID NO: 1668498 - RNA, 18 nt, Human
cagcugugcucuggacag

SEQ ID NO: 1668499 - RNA, 15 nt, Human
cagcuucauuuccug

SEQ ID NO: 1668500 - RNA, 18 nt, Human
cagcuucauuuccugugu

SEQ ID NO: 1668501 - RNA, 19 nt, Human
cagcuucauuuccuguguc

SEQ ID NO: 1668502 - RNA, 14 nt, Human
caggaaaggcucca

SEQ ID NO: 1668503 - RNA, 15 nt, Human
caggaaaggcuccag

SEQ ID NO: 1668504 - RNA, 23 nt, Human
caggaaaucaaauaugcaaagca

SEQ ID NO: 1668505 - RNA, 12 nt, Human
cagccccuggau

SEQ ID NO: 1668506 - RNA, 13 nt, Human
cagccccuggaug

SEQ ID NO: 1668507 - RNA, 14 nt, Human
cagccccuggaugc

SEQ ID NO: 1668508 - RNA, 22 nt, Human
cagccccuggaugcagccucac

SEQ ID NO: 1668509 - RNA, 16 nt, Human
cagcccuuagcaggga

SEQ ID NO: 1668510 - RNA, 21 nt, Human
cagcccuuagcagggaaacag

SEQ ID NO: 1668511 - RNA, 17 nt, Human
cagccccuggaugcagc

SEQ ID NO: 1668512 - RNA, 18 nt, Human
cagccccuggaugcagcc

SEQ ID NO: 1668513 - RNA, 19 nt, Human
cagccccuggaugcagccu

SEQ ID NO: 1668514 - RNA, 21 nt, Human
cagccccuggaugcagccuca

SEQ ID NO: 1668515 - RNA, 21 nt, Human
cagccgagauagccaaggcca

SEQ ID NO: 1668516 - RNA, 15 nt, Human
cagcccuucuuucca

SEQ ID NO: 1668517 - RNA, 19 nt, Human
cagcccuucuuuccacaga

SEQ ID NO: 1668518 - RNA, 20 nt, Human
cagcccuucuuuccacagaa

SEQ ID NO: 1668519 - RNA, 15 nt, Human
cagcggggacagcuc

SEQ ID NO: 1668520 - RNA, 16 nt, Human
cagcggggacagcucc

SEQ ID NO: 1668521 - RNA, 17 nt, Human
cagcggggacagcuccu

SEQ ID NO: 1668522 - RNA, 18 nt, Human
cagccugagcgacaguga

SEQ ID NO: 1668523 - RNA, 19 nt, Human
cagccugagcgacagugag

SEQ ID NO: 1668524 - RNA, 22 nt, Human
cagccugagcgacagugagacu

SEQ ID NO: 1668525 - RNA, 22 nt, Human
cagcacagccucuuagaugcag

SEQ ID NO: 1668526 - RNA, 22 nt, Human
cagccaggccacaagacccuug

SEQ ID NO: 1668527 - RNA, 12 nt, Human
cagccaggccac

SEQ ID NO: 1668528 - RNA, 13 nt, Human
cagccaggccaca

SEQ ID NO: 1668529 - RNA, 14 nt, Human
cagccagcaguuca

SEQ ID NO: 1668530 - RNA, 21 nt, Human
cagccagcaguucagagcugc

SEQ ID NO: 1668531 - RNA, 15 nt, Human
cagccagcaguucag

SEQ ID NO: 1668532 - RNA, 22 nt, Human
cagccagcaguucagagcugcc

SEQ ID NO: 1668533 - RNA, 19 nt, Human
cagcauauucaggaagcuc

SEQ ID NO: 1668534 - RNA, 22 nt, Human
cagcauauucaggaagcucagg

SEQ ID NO: 1668535 - RNA, 23 nt, Human
cagcauauucaggaagcucaggg

SEQ ID NO: 1668536 - RNA, 22 nt, Human
cagcaguugaaaagacuccaaa

SEQ ID NO: 1668537 - RNA, 17 nt, Human
cagcaguugaaaagacu

SEQ ID NO: 1668538 - RNA, 20 nt, Human
cagcaguugaaaagacucca

SEQ ID NO: 1668539 - RNA, 21 nt, Human
cagcaguugaaaagacuccaa

SEQ ID NO: 1668540 - RNA, 15 nt, Human
cagauaugauucaaa

SEQ ID NO: 1668541 - RNA, 16 nt, Human
cagauaugauucaaau

SEQ ID NO: 1668542 - RNA, 17 nt, Human
cagauaugauucaaaug

SEQ ID NO: 1668543 - RNA, 19 nt, Human
cagauaugauucaaauguc

SEQ ID NO: 1668544 - RNA, 20 nt, Human
cagagucagaaguuucugcc

SEQ ID NO: 1668545 - RNA, 18 nt, Human
cagaggggguggccuccc

SEQ ID NO: 1668546 - RNA, 19 nt, Human
cagaggggguggccuccca

SEQ ID NO: 1668547 - RNA, 20 nt, Human
cagaggggguggccucccaa

SEQ ID NO: 1668548 - RNA, 22 nt, Human
cagagggccugcaagggaguga

SEQ ID NO: 1668549 - RNA, 19 nt, Human
cagaaguuucugccgcagc

SEQ ID NO: 1668550 - RNA, 20 nt, Human
cagaaguuugagaucagccu

SEQ ID NO: 1668551 - RNA, 22 nt, Human
cagaaguuugagaucagccugg

SEQ ID NO: 1668552 - RNA, 23 nt, Human
cagaaguuugagaucagccuggg

SEQ ID NO: 1668553 - RNA, 18 nt, Human
cagagcugccaccugccu

SEQ ID NO: 1668554 - RNA, 15 nt, Human
cagagcugcccucuc

SEQ ID NO: 1668555 - RNA, 13 nt, Human
cagagcugcccuc

SEQ ID NO: 1668556 - RNA, 17 nt, Human
cagagcugcccucuccu

SEQ ID NO: 1668557 - RNA, 23 nt, Human
caggccagagggagugacagagg

SEQ ID NO: 1668558 - RNA, 19 nt, Human
caggccagagggagugaca

SEQ ID NO: 1668559 - RNA, 21 nt, Human
caggccagagggagugacaga

SEQ ID NO: 1668560 - RNA, 15 nt, Human
caggaggccagccuu

SEQ ID NO: 1668561 - RNA, 16 nt, Human
caggaggccagccuug

SEQ ID NO: 1668562 - RNA, 18 nt, Human
caggcacccaccaucaug

SEQ ID NO: 1668563 - RNA, 22 nt, Human
caggcacccaccaucaugucug

SEQ ID NO: 1668564 - RNA, 23 nt, Human
caggcacccaccaucaugucugg

SEQ ID NO: 1668565 - RNA, 23 nt, Human
caggagggagggggaaggcaggg

SEQ ID NO: 1668566 - RNA, 17 nt, Human
caggaggccagccuuga

SEQ ID NO: 1668567 - RNA, 15 nt, Human
caggagggaggggga

SEQ ID NO: 1668568 - RNA, 17 nt, Human
cagggagggccugggcc

SEQ ID NO: 1668569 - RNA, 22 nt, Human
cagggaguccgaaagggacuug

SEQ ID NO: 1668570 - RNA, 14 nt, Human
cagggagggccugg

SEQ ID NO: 1668571 - RNA, 16 nt, Human
cagggagggccugggc

SEQ ID NO: 1668572 - RNA, 18 nt, Human
cagggaggugaccccagg

SEQ ID NO: 1668573 - RNA, 20 nt, Human
caggccugccuguucccauu

SEQ ID NO: 1668574 - RNA, 15 nt, Human
caggcgccccuuccc

SEQ ID NO: 1668575 - RNA, 18 nt, Human
caggcuggcccugcccug

SEQ ID NO: 1668576 - RNA, 19 nt, Human
caggcuggcccugcccugg

SEQ ID NO: 1668577 - RNA, 17 nt, Human
caggcgccccuuccccc

SEQ ID NO: 1668578 - RNA, 20 nt, Human
caggcuggcccugcccuggu

SEQ ID NO: 1668579 - RNA, 15 nt, Human
caggcuggcgugcag

SEQ ID NO: 1668580 - RNA, 16 nt, Human
caggcugggcuucagu

SEQ ID NO: 1668581 - RNA, 12 nt, Human
cagggagggccu

SEQ ID NO: 1668582 - RNA, 13 nt, Human
cagggagggccug

SEQ ID NO: 1668583 - RNA, 19 nt, Human
cagggaggacgcucucugg

SEQ ID NO: 1668584 - RNA, 17 nt, Human
caggcugggcuucagug

SEQ ID NO: 1668585 - RNA, 19 nt, Human
caggcugggcuucaguggc

SEQ ID NO: 1668586 - RNA, 17 nt, Human
cagggaggacgcucucu

SEQ ID NO: 1668587 - RNA, 18 nt, Human
cagggaggacgcucucug

SEQ ID NO: 1668588 - RNA, 22 nt, Human
cagugcacuaauguguaagaca

SEQ ID NO: 1668589 - RNA, 19 nt, Human
cagucugauucccaagcuc

SEQ ID NO: 1668590 - RNA, 20 nt, Human
cagucugauucccaagcucu

SEQ ID NO: 1668591 - RNA, 19 nt, Human
cagugcaugcugucccuua

SEQ ID NO: 1668592 - RNA, 22 nt, Human
cagugcaugcugucccuuacgu

SEQ ID NO: 1668593 - RNA, 23 nt, Human
cagugcaugcugucccuuacgug

SEQ ID NO: 1668594 - RNA, 11 nt, Human
cagugggagcu

SEQ ID NO: 1668595 - RNA, 19 nt, Human
cagugggacagggcauggc

SEQ ID NO: 1668596 - RNA, 12 nt, Human
cagugcccacag

SEQ ID NO: 1668597 - RNA, 15 nt, Human
cagugccaaaaacaa

SEQ ID NO: 1668598 - RNA, 14 nt, Human
cagucucccucccu

SEQ ID NO: 1668599 - RNA, 15 nt, Human
cagucucaggaaauc

SEQ ID NO: 1668600 - RNA, 14 nt, Human
caggugcgaaagga

SEQ ID NO: 1668601 - RNA, 18 nt, Human
caggugcuaggaacacuc

SEQ ID NO: 1668602 - RNA, 20 nt, Human
caggugcuaggaacacuccu

SEQ ID NO: 1668603 - RNA, 14 nt, Human
cagguugguggggg

SEQ ID NO: 1668604 - RNA, 20 nt, Human
caggugauccacccaccuca

SEQ ID NO: 1668605 - RNA, 14 nt, Human
caggguuggccccu

SEQ ID NO: 1668606 - RNA, 12 nt, Human
caggguuggccc

SEQ ID NO: 1668607 - RNA, 16 nt, Human
caggugauccacccac

SEQ ID NO: 1668608 - RNA, 17 nt, Human
caggugauccacccacc

SEQ ID NO: 1668609 - RNA, 22 nt, Human
cagggucucacucugucgccca

SEQ ID NO: 1668610 - RNA, 21 nt, Human
cagggucucacucugucgccc

SEQ ID NO: 1668611 - RNA, 18 nt, Human
cagggucucacucugucg

SEQ ID NO: 1668612 - RNA, 16 nt, Human
caguauuguacaaagu

SEQ ID NO: 1668613 - RNA, 17 nt, Human
caguauuguacaaagua

SEQ ID NO: 1668614 - RNA, 18 nt, Human
caguauuguacaaaguau

SEQ ID NO: 1668615 - RNA, 19 nt, Human
caguauuguacaaaguauu

SEQ ID NO: 1668616 - RNA, 12 nt, Human
caguauuguaca

SEQ ID NO: 1668617 - RNA, 13 nt, Human
caguauuguacaa

SEQ ID NO: 1668618 - RNA, 18 nt, Human
cagguuuaagcuguuacu

SEQ ID NO: 1668619 - RNA, 21 nt, Human
cagguuggugggggccucggu

SEQ ID NO: 1668620 - RNA, 16 nt, Human
cagguuuaagcuguua

SEQ ID NO: 1668621 - RNA, 21 nt, Human
caguauuguacaaaguauuaa

SEQ ID NO: 1668622 - RNA, 20 nt, Human
cagucaccccggccaccugc

SEQ ID NO: 1668623 - RNA, 19 nt, Human
cagucaccccggccaccug

SEQ ID NO: 1668624 - RNA, 22 nt, Human
cagucaccccggccaccugcgg

SEQ ID NO: 1668625 - RNA, 15 nt, Human
cagucaccucaugga

SEQ ID NO: 1668626 - RNA, 14 nt, Human
cauggccagguggc

SEQ ID NO: 1668627 - RNA, 13 nt, Human
cauggccaggugg

SEQ ID NO: 1668628 - RNA, 14 nt, Human
caugcugcccugug

SEQ ID NO: 1668629 - RNA, 15 nt, Human
caugcugcccuguga

SEQ ID NO: 1668630 - RNA, 21 nt, Human
caugacacgaauauugcugau

SEQ ID NO: 1668631 - RNA, 23 nt, Human
caugacacgaauauugcugaugg

SEQ ID NO: 1668632 - RNA, 23 nt, Human
caugaaguaauaugcacacauuu

SEQ ID NO: 1668633 - RNA, 22 nt, Human
caugaaguaauaugcacacauu

SEQ ID NO: 1668634 - RNA, 19 nt, Human
caugaaguaauaugcacac

SEQ ID NO: 1668635 - RNA, 15 nt, Human
caugaaguaauaugc

SEQ ID NO: 1668636 - RNA, 12 nt, Human
caugcacaaauu

SEQ ID NO: 1668637 - RNA, 24 nt, Human
caugauuaaccacuucagcugacu

SEQ ID NO: 1668638 - RNA, 22 nt, Human
caugauuaaccacuucagcuga

SEQ ID NO: 1668639 - RNA, 23 nt, Human
caugauuaaccacuucagcugac

SEQ ID NO: 1668640 - RNA, 13 nt, Human
caugcuccuggcc

SEQ ID NO: 1668641 - RNA, 12 nt, Human
caugcugcccug

SEQ ID NO: 1668642 - RNA, 13 nt, Human
caugcugcccugu

SEQ ID NO: 1668643 - RNA, 16 nt, Human
caugcacgugugugca

SEQ ID NO: 1668644 - RNA, 14 nt, Human
cauucucacuccua

SEQ ID NO: 1668645 - RNA, 13 nt, Human
cauucucacuccu

SEQ ID NO: 1668646 - RNA, 18 nt, Human
cauucuagguuugcaaga

SEQ ID NO: 1668647 - RNA, 12 nt, Human
cauuccuguucc

SEQ ID NO: 1668648 - RNA, 18 nt, Human
cauguccaagaagcccag

SEQ ID NO: 1668649 - RNA, 19 nt, Human
cauguccaagaagcccagg

SEQ ID NO: 1668650 - RNA, 20 nt, Human
cauguccaagaagcccagga

SEQ ID NO: 1668651 - RNA, 12 nt, Human
cauguuggccag

SEQ ID NO: 1668652 - RNA, 13 nt, Human
cauguuggccagg

SEQ ID NO: 1668653 - RNA, 22 nt, Human
cauuaggugugacugaauuucu

SEQ ID NO: 1668654 - RNA, 23 nt, Human
cauuaucuagauacuguaucaug

SEQ ID NO: 1668655 - RNA, 12 nt, Human
cauuaucucaaa

SEQ ID NO: 1668656 - RNA, 13 nt, Human
cauuaucucaaaa

SEQ ID NO: 1668657 - RNA, 21 nt, Human
cauccccuguagagugggagc

SEQ ID NO: 1668658 - RNA, 14 nt, Human
cauccccuguagag

SEQ ID NO: 1668659 - RNA, 19 nt, Human
caucccauaugccugggca

SEQ ID NO: 1668660 - RNA, 20 nt, Human
caucaggccaggcccucugc

SEQ ID NO: 1668661 - RNA, 16 nt, Human
caucaggccaggcccu

SEQ ID NO: 1668662 - RNA, 19 nt, Human
caucaggccaggcccucug

SEQ ID NO: 1668663 - RNA, 15 nt, Human
caucaggccaggccc

SEQ ID NO: 1668664 - RNA, 22 nt, Human
cauaugccugggcagaaggaag

SEQ ID NO: 1668665 - RNA, 15 nt, Human
cauaugccugggcag

SEQ ID NO: 1668666 - RNA, 20 nt, Human
cauaugccugggcagaagga

SEQ ID NO: 1668667 - RNA, 22 nt, Human
cauauucaggaagcucagggcc

SEQ ID NO: 1668668 - RNA, 20 nt, Human
cauauucaggaagcucaggg

SEQ ID NO: 1668669 - RNA, 14 nt, Human
cauauucaggaagc

SEQ ID NO: 1668670 - RNA, 15 nt, Human
cauauucaggaagcu

SEQ ID NO: 1668671 - RNA, 19 nt, Human
cauagcagagaaugaaagg

SEQ ID NO: 1668672 - RNA, 22 nt, Human
cauagcagagaaugaaagggcc

SEQ ID NO: 1668673 - RNA, 15 nt, Human
cagugggagcugccu

SEQ ID NO: 1668674 - RNA, 19 nt, Human
ccaccgggcugggagcucu

SEQ ID NO: 1668675 - RNA, 18 nt, Human
ccaccaucaugucuggcu

SEQ ID NO: 1668676 - RNA, 19 nt, Human
ccaccaucaugucuggcua

SEQ ID NO: 1668677 - RNA, 22 nt, Human
ccaccgggcugggagcucugca

SEQ ID NO: 1668678 - RNA, 12 nt, Human
ccaccuuggcug

SEQ ID NO: 1668679 - RNA, 14 nt, Human
ccaccuuggcugca

SEQ ID NO: 1668680 - RNA, 15 nt, Human
ccaccuuggcugcag

SEQ ID NO: 1668681 - RNA, 16 nt, Human
ccaccuuggcugcagg

SEQ ID NO: 1668682 - RNA, 13 nt, Human
ccacgcuggagug

SEQ ID NO: 1668683 - RNA, 18 nt, Human
ccacgcuggaccuugaac

SEQ ID NO: 1668684 - RNA, 18 nt, Human
ccaccuuggcugcaggga

SEQ ID NO: 1668685 - RNA, 19 nt, Human
ccaccuuggcugcagggag

SEQ ID NO: 1668686 - RNA, 13 nt, Human
ccacgcccccacu

SEQ ID NO: 1668687 - RNA, 16 nt, Human
ccacacuucaggcucu

SEQ ID NO: 1668688 - RNA, 20 nt, Human
ccacacuucaggcucuucuc

SEQ ID NO: 1668689 - RNA, 21 nt, Human
ccacacuucaggcucuucucc

SEQ ID NO: 1668690 - RNA, 16 nt, Human
ccacagaagcuccagg

SEQ ID NO: 1668691 - RNA, 15 nt, Human
ccaccacgcccggcu

SEQ ID NO: 1668692 - RNA, 18 nt, Human
ccaccagucugacuguuu

SEQ ID NO: 1668693 - RNA, 22 nt, Human
ccacagagaaaguacuucucca

SEQ ID NO: 1668694 - RNA, 18 nt, Human
ccacagaagcuccaggua

SEQ ID NO: 1668695 - RNA, 15 nt, Human
ccaaggccaaaggaa

SEQ ID NO: 1668696 - RNA, 18 nt, Human
ccaaggaugccccguccc

SEQ ID NO: 1668697 - RNA, 20 nt, Human
ccaagcuggucccacucagu

SEQ ID NO: 1668698 - RNA, 14 nt, Human
ccaagaagcccagg

SEQ ID NO: 1668699 - RNA, 12 nt, Human
ccaagcuggucc

SEQ ID NO: 1668700 - RNA, 19 nt, Human
ccaagcuggucccacucag

SEQ ID NO: 1668701 - RNA, 22 nt, Human
ccaaauggaaaugggcagagca

SEQ ID NO: 1668702 - RNA, 13 nt, Human
ccaacgucugugc

SEQ ID NO: 1668703 - RNA, 15 nt, Human
ccaacgucugugcca

SEQ ID NO: 1668704 - RNA, 16 nt, Human
ccaacgucugugccau

SEQ ID NO: 1668705 - RNA, 13 nt, Human
ccaagaagcccag

SEQ ID NO: 1668706 - RNA, 13 nt, Human
ccaaaugcagcuu

SEQ ID NO: 1668707 - RNA, 15 nt, Human
ccaaaugcagcuuua

SEQ ID NO: 1668708 - RNA, 18 nt, Human
ccaaaugcagcuuuaaaa

SEQ ID NO: 1668709 - RNA, 16 nt, Human
ccaaggccaaaggaag

SEQ ID NO: 1668710 - RNA, 16 nt, Human
cauuuuuuaaaugcac

SEQ ID NO: 1668711 - RNA, 15 nt, Human
cauuuuuuaaaugca

SEQ ID NO: 1668712 - RNA, 19 nt, Human
cauuuuuuaaaugcaccug

SEQ ID NO: 1668713 - RNA, 14 nt, Human
cauuuauucugcuc

SEQ ID NO: 1668714 - RNA, 15 nt, Human
cauuuauucugcuca

SEQ ID NO: 1668715 - RNA, 14 nt, Human
cauuugugaaauga

SEQ ID NO: 1668716 - RNA, 16 nt, Human
cauuugugaaaugaug

SEQ ID NO: 1668717 - RNA, 17 nt, Human
cauuugucacacacuuu

SEQ ID NO: 1668718 - RNA, 15 nt, Human
cauuuggauuggaug

SEQ ID NO: 1668719 - RNA, 18 nt, Human
cauugguucuuguauuaa

SEQ ID NO: 1668720 - RNA, 22 nt, Human
cauugguucuuguauuaagaau

SEQ ID NO: 1668721 - RNA, 21 nt, Human
cugugcugcccugcccaccug

SEQ ID NO: 1668722 - RNA, 17 nt, Human
cugugucagcauagaag

SEQ ID NO: 1668723 - RNA, 19 nt, Human
cugugucagcauagaagua

SEQ ID NO: 1668724 - RNA, 15 nt, Human
cugugcugcccugcc

SEQ ID NO: 1668725 - RNA, 17 nt, Human
cugugcugcccugccca

SEQ ID NO: 1668726 - RNA, 18 nt, Human
cugugcugcccugcccac

SEQ ID NO: 1668727 - RNA, 19 nt, Human
cugugcugcccugcccacc

SEQ ID NO: 1668728 - RNA, 13 nt, Human
cuguuauaaucuu

SEQ ID NO: 1668729 - RNA, 19 nt, Human
cuguuauaaucuuucacag

SEQ ID NO: 1668730 - RNA, 12 nt, Human
cugugcugcccu

SEQ ID NO: 1668731 - RNA, 13 nt, Human
cugugcugcccug

SEQ ID NO: 1668732 - RNA, 14 nt, Human
cugugcugcccugc

SEQ ID NO: 1668733 - RNA, 20 nt, Human
cugucaauuacaggaaguac

SEQ ID NO: 1668734 - RNA, 23 nt, Human
cugucaauuacaggaaguacugg

SEQ ID NO: 1668735 - RNA, 16 nt, Human
cugucgcccagucugg

SEQ ID NO: 1668736 - RNA, 13 nt, Human
cuguagaguggga

SEQ ID NO: 1668737 - RNA, 13 nt, Human
cugguuuccugcc

SEQ ID NO: 1668738 - RNA, 14 nt, Human
cugguuuccugccc

SEQ ID NO: 1668739 - RNA, 16 nt, Human
cugguuuccugcccug

SEQ ID NO: 1668740 - RNA, 22 nt, Human
cuggugacaugucuuuucuugc

SEQ ID NO: 1668741 - RNA, 16 nt, Human
cuuaccagcagagcac

SEQ ID NO: 1668742 - RNA, 22 nt, Human
cuuagcucauucuccuuguguu

SEQ ID NO: 1668743 - RNA, 13 nt, Human
cuuagcugggaga

SEQ ID NO: 1668744 - RNA, 23 nt, Human
cuuagcucauucuccuuguguua

SEQ ID NO: 1668745 - RNA, 19 nt, Human
cuuagggaaggauacaaaa

SEQ ID NO: 1668746 - RNA, 21 nt, Human
cuuagggaaggauacaaaagc

SEQ ID NO: 1668747 - RNA, 22 nt, Human
cuuaaaguugaauuuauuggcu

SEQ ID NO: 1668748 - RNA, 13 nt, Human
cuuaaauaauaaa

SEQ ID NO: 1668749 - RNA, 13 nt, Human
cuuaaauaaugug

SEQ ID NO: 1668750 - RNA, 22 nt, Human
cuuaaauaauaaagaucaugua

SEQ ID NO: 1668751 - RNA, 15 nt, Human
cuuaaaguugaauuu

SEQ ID NO: 1668752 - RNA, 18 nt, Human
cuuaaaguugaauuuauu

SEQ ID NO: 1668753 - RNA, 14 nt, Human
cuuaaaacaacacu

SEQ ID NO: 1668754 - RNA, 21 nt, Human
cuuacauuagcaguuugcuuu

SEQ ID NO: 1668755 - RNA, 22 nt, Human
cuuacauuagcaguuugcuuug

SEQ ID NO: 1668756 - RNA, 15 nt, Human
cuuaccagcagagca

SEQ ID NO: 1668757 - RNA, 12 nt, Human
cuguuuaagaga

SEQ ID NO: 1668758 - RNA, 14 nt, Human
cuguuuaagagaca

SEQ ID NO: 1668759 - RNA, 14 nt, Human
cuguuggcuggggg

SEQ ID NO: 1668760 - RNA, 19 nt, Human
cuguuggcugggggccuca

SEQ ID NO: 1668761 - RNA, 22 nt, Human
cuguuggcugggggccucagug

SEQ ID NO: 1668762 - RNA, 12 nt, Human
cuguucacagcc

SEQ ID NO: 1668763 - RNA, 14 nt, Human
cuguuauuuauaau

SEQ ID NO: 1668764 - RNA, 20 nt, Human
cuguuauuuauaaucacuuu

SEQ ID NO: 1668765 - RNA, 23 nt, Human
cugccuguugggccaggagccuc

SEQ ID NO: 1668766 - RNA, 21 nt, Human
cugccuguugggccaggagcc

SEQ ID NO: 1668767 - RNA, 22 nt, Human
cugccuguugggccaggagccu

SEQ ID NO: 1668768 - RNA, 17 nt, Human
cugcuaucaaagagguu

SEQ ID NO: 1668769 - RNA, 18 nt, Human
cugcugacuguuuucucu

SEQ ID NO: 1668770 - RNA, 21 nt, Human
cugcugacuguuuucucuuga

SEQ ID NO: 1668771 - RNA, 13 nt, Human
cugccuccucuuc

SEQ ID NO: 1668772 - RNA, 14 nt, Human
cugccuccucuuca

SEQ ID NO: 1668773 - RNA, 15 nt, Human
cugccuccucuucaa

SEQ ID NO: 1668774 - RNA, 24 nt, Human
cugccuccucuucaacugaccagc

SEQ ID NO: 1668775 - RNA, 23 nt, Human
cugccucucccaucacuucccua

SEQ ID NO: 1668776 - RNA, 15 nt, Human
cugccucucccauca

SEQ ID NO: 1668777 - RNA, 22 nt, Human
cugccucucccaucacuucccu

SEQ ID NO: 1668778 - RNA, 17 nt, Human
cugccuguucagcucca

SEQ ID NO: 1668779 - RNA, 18 nt, Human
cugccuguucagcuccag

SEQ ID NO: 1668780 - RNA, 20 nt, Human
cugccuguugggccaggagc

SEQ ID NO: 1668781 - RNA, 19 nt, Human
cugccuguucagcuccagc

SEQ ID NO: 1668782 - RNA, 20 nt, Human
cugaucugaugcaagcaaga

SEQ ID NO: 1668783 - RNA, 19 nt, Human
cugcuucaaauauuucccu

SEQ ID NO: 1668784 - RNA, 12 nt, Human
cugcuucaagga

SEQ ID NO: 1668785 - RNA, 13 nt, Human
cugcuucaaggau

SEQ ID NO: 1668786 - RNA, 21 nt, Human
cugcuucaaggauccugagcc

SEQ ID NO: 1668787 - RNA, 22 nt, Human
cugcuucaaggauccugagcca

SEQ ID NO: 1668788 - RNA, 23 nt, Human
cugcuucaaggauccugagccag

SEQ ID NO: 1668789 - RNA, 20 nt, Human
cugcuuuugucuaugggacu

SEQ ID NO: 1668790 - RNA, 14 nt, Human
cugcuucaaauauu

SEQ ID NO: 1668791 - RNA, 14 nt, Human
cuggagaaaaugga

SEQ ID NO: 1668792 - RNA, 14 nt, Human
cuggaagcacagcu

SEQ ID NO: 1668793 - RNA, 21 nt, Human
cugcuuuugucuaugggacuc

SEQ ID NO: 1668794 - RNA, 19 nt, Human
cugcuuuuuaaagaaugcu

SEQ ID NO: 1668795 - RNA, 15 nt, Human
cuggggccaggcugg

SEQ ID NO: 1668796 - RNA, 18 nt, Human
cuggguucacugcaaccu

SEQ ID NO: 1668797 - RNA, 20 nt, Human
cuggguucacugcaaccucc

SEQ ID NO: 1668798 - RNA, 12 nt, Human
cugggccagaau

SEQ ID NO: 1668799 - RNA, 14 nt, Human
cugggccagaauuu

SEQ ID NO: 1668800 - RNA, 12 nt, Human
cugggcagaagg

SEQ ID NO: 1668801 - RNA, 15 nt, Human
cugggcagaaggaag

SEQ ID NO: 1668802 - RNA, 16 nt, Human
cugggcagaaggaaga

SEQ ID NO: 1668803 - RNA, 20 nt, Human
cugggcaccggggccucgga

SEQ ID NO: 1668804 - RNA, 14 nt, Human
cuggcagaggaggg

SEQ ID NO: 1668805 - RNA, 19 nt, Human
cuggcagaguugaagacag

SEQ ID NO: 1668806 - RNA, 11 nt, Human
cuggcagccca

SEQ ID NO: 1668807 - RNA, 12 nt, Human
cuggcagccccu

SEQ ID NO: 1668808 - RNA, 21 nt, Human
cuggcagccgugccuucagcu

SEQ ID NO: 1668809 - RNA, 22 nt, Human
cuggcagccgugccuucagcuc

SEQ ID NO: 1668810 - RNA, 20 nt, Human
cuggcagccgugccuucagc

SEQ ID NO: 1668811 - RNA, 13 nt, Human
cuggcagccccug

SEQ ID NO: 1668812 - RNA, 17 nt, Human
cuggcagaguugaagac

SEQ ID NO: 1668813 - RNA, 18 nt, Human
cuggcagaguugaagaca

SEQ ID NO: 1668814 - RNA, 15 nt, Human
cuggcccugcccugg

SEQ ID NO: 1668815 - RNA, 16 nt, Human
cuggccgggagccuga

SEQ ID NO: 1668816 - RNA, 14 nt, Human
cuggccuagcauac

SEQ ID NO: 1668817 - RNA, 11 nt, Human
cuggcccugcc

SEQ ID NO: 1668818 - RNA, 13 nt, Human
cuggcccugcccu

SEQ ID NO: 1668819 - RNA, 14 nt, Human
cuggcccugcccug

SEQ ID NO: 1668820 - RNA, 22 nt, Human
cuggccccucagggucccuggu

SEQ ID NO: 1668821 - RNA, 11 nt, Human
cugggacacag

SEQ ID NO: 1668822 - RNA, 17 nt, Human
gaacacauaauucagga

SEQ ID NO: 1668823 - RNA, 20 nt, Human
gaacacauaauucaggaagc

SEQ ID NO: 1668824 - RNA, 18 nt, Human
gaacacuccaauuaagga

SEQ ID NO: 1668825 - RNA, 20 nt, Human
gaacacuccaauuaaggauu

SEQ ID NO: 1668826 - RNA, 15 nt, Human
gaaagggcccagaga

SEQ ID NO: 1668827 - RNA, 16 nt, Human
gaaagggcccagagag

SEQ ID NO: 1668828 - RNA, 12 nt, Human
gaaaucuuuaaa

SEQ ID NO: 1668829 - RNA, 15 nt, Human
gaaaucuuuaaaaaa

SEQ ID NO: 1668830 - RNA, 11 nt, Human
gaaaugaaaaa

SEQ ID NO: 1668831 - RNA, 17 nt, Human
gaaaugaaagcagggac

SEQ ID NO: 1668832 - RNA, 13 nt, Human
gaaagggcccaga

SEQ ID NO: 1668833 - RNA, 16 nt, Human
gaaaggcuccaggagc

SEQ ID NO: 1668834 - RNA, 13 nt, Human
gaaaggcuccagg

SEQ ID NO: 1668835 - RNA, 14 nt, Human
gaaaggcuccagga

SEQ ID NO: 1668836 - RNA, 15 nt, Human
gaaaggcuccaggag

SEQ ID NO: 1668837 - RNA, 17 nt, Human
gaaacuggauuaaacuu

SEQ ID NO: 1668838 - RNA, 13 nt, Human
gaaacuggauuaa

SEQ ID NO: 1668839 - RNA, 21 nt, Human
gaaacugcuuguuuccuagca

SEQ ID NO: 1668840 - RNA, 18 nt, Human
gaaagaaaaucaggcugg

SEQ ID NO: 1668841 - RNA, 17 nt, Human
gaaacuggguuccugca

SEQ ID NO: 1668842 - RNA, 19 nt, Human
gaaaacuuguauuaugugu

SEQ ID NO: 1668843 - RNA, 22 nt, Human
gaaaacuuguauuauguguguu

SEQ ID NO: 1668844 - RNA, 15 nt, Human
gaaaaaaggaagugg

SEQ ID NO: 1668845 - RNA, 23 nt, Human
gaaaagaaaaaugagccuggcaa

SEQ ID NO: 1668846 - RNA, 21 nt, Human
gaaaacuuuaugcuaagugaa

SEQ ID NO: 1668847 - RNA, 14 nt, Human
gaaaagacuccaaa

SEQ ID NO: 1668848 - RNA, 18 nt, Human
gaaaagacuccaaagaaa

SEQ ID NO: 1668849 - RNA, 16 nt, Human
gaaaagacuccaaaga

SEQ ID NO: 1668850 - RNA, 17 nt, Human
gaaaagacuccaaagaa

SEQ ID NO: 1668851 - RNA, 12 nt, Human
gaaaaugugugu

SEQ ID NO: 1668852 - RNA, 15 nt, Human
gaaaaugugugugug

SEQ ID NO: 1668853 - RNA, 21 nt, Human
gaaacaagucagucauucaga

SEQ ID NO: 1668854 - RNA, 17 nt, Human
gaagcacagugaucaag

SEQ ID NO: 1668855 - RNA, 14 nt, Human
gaagcacaugccuc

SEQ ID NO: 1668856 - RNA, 22 nt, Human
gaagcacaugccucucucaggc

SEQ ID NO: 1668857 - RNA, 13 nt, Human
gaagcacagcuuc

SEQ ID NO: 1668858 - RNA, 14 nt, Human
gaagcacagcuuca

SEQ ID NO: 1668859 - RNA, 16 nt, Human
gaagacucauucuucu

SEQ ID NO: 1668860 - RNA, 17 nt, Human
gaagacucauucuucug

SEQ ID NO: 1668861 - RNA, 18 nt, Human
gaagacucauucuucugu

SEQ ID NO: 1668862 - RNA, 16 nt, Human
gaagcaccauaacuuu

SEQ ID NO: 1668863 - RNA, 21 nt, Human
gaagacacugaugggcaaccc

SEQ ID NO: 1668864 - RNA, 16 nt, Human
gaagacacugaugggc

SEQ ID NO: 1668865 - RNA, 13 nt, Human
gaagacagagcua

SEQ ID NO: 1668866 - RNA, 15 nt, Human
gaagacagagcuaca

SEQ ID NO: 1668867 - RNA, 12 nt, Human
gaagacagcucu

SEQ ID NO: 1668868 - RNA, 13 nt, Human
gaagacagcucuu

SEQ ID NO: 1668869 - RNA, 14 nt, Human
gaagacagcucuua

SEQ ID NO: 1668870 - RNA, 15 nt, Human
gaagacagcucuuau

SEQ ID NO: 1668871 - RNA, 17 nt, Human
gaacugauguaaguaaa

SEQ ID NO: 1668872 - RNA, 13 nt, Human
gaacugaaaucau

SEQ ID NO: 1668873 - RNA, 15 nt, Human
gaacuccuggccuca

SEQ ID NO: 1668874 - RNA, 14 nt, Human
gaacuccuggccuc

SEQ ID NO: 1668875 - RNA, 14 nt, Human
gaacuccugaccuc

SEQ ID NO: 1668876 - RNA, 13 nt, Human
gaacuccuggccu

SEQ ID NO: 1668877 - RNA, 17 nt, Human
gaacccgggaggcagag

SEQ ID NO: 1668878 - RNA, 19 nt, Human
gaacccgggaggcagaggu

SEQ ID NO: 1668879 - RNA, 16 nt, Human
gaacccaaguccaagc

SEQ ID NO: 1668880 - RNA, 17 nt, Human
gaacccaaguccaagca

SEQ ID NO: 1668881 - RNA, 22 nt, Human
gaaccauggucggaaaacaugc

SEQ ID NO: 1668882 - RNA, 23 nt, Human
gaaccaccacacccagcccacuu

SEQ ID NO: 1668883 - RNA, 18 nt, Human
gaaccaccacacccagcc

SEQ ID NO: 1668884 - RNA, 20 nt, Human
gaaccaccacacccagccca

SEQ ID NO: 1668885 - RNA, 21 nt, Human
gaaccaccacacccagcccac

SEQ ID NO: 1668886 - RNA, 22 nt, Human
gaaccaccacacccagcccacu

SEQ ID NO: 1668887 - RNA, 14 nt, Human
cuugucucagauuu

SEQ ID NO: 1668888 - RNA, 17 nt, Human
cuugucucagauuuuau

SEQ ID NO: 1668889 - RNA, 13 nt, Human
cuugucucagauu

SEQ ID NO: 1668890 - RNA, 19 nt, Human
cuuggugucgggcaugaca

SEQ ID NO: 1668891 - RNA, 20 nt, Human
cuuggugucgggcaugacac

SEQ ID NO: 1668892 - RNA, 18 nt, Human
cuugucucagauuuuauu

SEQ ID NO: 1668893 - RNA, 19 nt, Human
cuugucuuuggacccugag

SEQ ID NO: 1668894 - RNA, 18 nt, Human
cuugucuuuggacccuga

SEQ ID NO: 1668895 - RNA, 13 nt, Human
cuugucuuuggac

SEQ ID NO: 1668896 - RNA, 15 nt, Human
cuugucuuuggaccc

SEQ ID NO: 1668897 - RNA, 22 nt, Human
cuugguagaagcccuucuaccu

SEQ ID NO: 1668898 - RNA, 19 nt, Human
cuuggucugugagaugcua

SEQ ID NO: 1668899 - RNA, 14 nt, Human
cuugguccugcugc

SEQ ID NO: 1668900 - RNA, 16 nt, Human
cuuggucugugagaug

SEQ ID NO: 1668901 - RNA, 23 nt, Human
cuuuaaugucacaggcaggucca

SEQ ID NO: 1668902 - RNA, 14 nt, Human
cuuucagauacugg

SEQ ID NO: 1668903 - RNA, 20 nt, Human
cuuucacccuuuucuguuug

SEQ ID NO: 1668904 - RNA, 14 nt, Human
cuuucacccuuuuc

SEQ ID NO: 1668905 - RNA, 15 nt, Human
cuuucacccuuuucu

SEQ ID NO: 1668906 - RNA, 15 nt, Human
cuuucagauacugga

SEQ ID NO: 1668907 - RNA, 17 nt, Human
cuuucagauacuggauu

SEQ ID NO: 1668908 - RNA, 22 nt, Human
cuuucagauacuggauuguacu

SEQ ID NO: 1668909 - RNA, 18 nt, Human
cuuugacgccaucccagc

SEQ ID NO: 1668910 - RNA, 16 nt, Human
cuuugacgccauccca

SEQ ID NO: 1668911 - RNA, 17 nt, Human
cuuugacgccaucccag

SEQ ID NO: 1668912 - RNA, 17 nt, Human
cuuucuacccagcgagc

SEQ ID NO: 1668913 - RNA, 15 nt, Human
cuuucuacccagcga

SEQ ID NO: 1668914 - RNA, 16 nt, Human
cuuucuacccagcgag

SEQ ID NO: 1668915 - RNA, 14 nt, Human
cuuuguaaugaaaa

SEQ ID NO: 1668916 - RNA, 15 nt, Human
cuuuguaaugaaaac

SEQ ID NO: 1668917 - RNA, 16 nt, Human
cuuuguaaugaaaacc

SEQ ID NO: 1668918 - RNA, 12 nt, Human
cuuuguaugcac

SEQ ID NO: 1668919 - RNA, 17 nt, Human
cuuuguauucucuccug

SEQ ID NO: 1668920 - RNA, 22 nt, Human
cuuuguauucucuccuguaccu

SEQ ID NO: 1668921 - RNA, 21 nt, Human
cuuuuauaaacuuuaccuuuu

SEQ ID NO: 1668922 - RNA, 20 nt, Human
cuuuuauaaacuuuaccuuu

SEQ ID NO: 1668923 - RNA, 15 nt, Human
cuucugacccaugcu

SEQ ID NO: 1668924 - RNA, 13 nt, Human
cuucuucagagac

SEQ ID NO: 1668925 - RNA, 14 nt, Human
cuucuucagagacu

SEQ ID NO: 1668926 - RNA, 18 nt, Human
cuucuucagagacuccug

SEQ ID NO: 1668927 - RNA, 20 nt, Human
cuucucacauuuauauuuuu

SEQ ID NO: 1668928 - RNA, 13 nt, Human
cuucucacauuua

SEQ ID NO: 1668929 - RNA, 13 nt, Human
cuucuaaguaaaa

SEQ ID NO: 1668930 - RNA, 17 nt, Human
cuucuaaguaaaaccac

SEQ ID NO: 1668931 - RNA, 21 nt, Human
cuucuaaguaaaaccacagca

SEQ ID NO: 1668932 - RNA, 13 nt, Human
cuuccucuccacu

SEQ ID NO: 1668933 - RNA, 14 nt, Human
cuuccucuccacug

SEQ ID NO: 1668934 - RNA, 15 nt, Human
cuuccucuccacugc

SEQ ID NO: 1668935 - RNA, 14 nt, Human
cuuccucugagccu

SEQ ID NO: 1668936 - RNA, 15 nt, Human
cuuccucugagccuu

SEQ ID NO: 1668937 - RNA, 16 nt, Human
cuuccucugaggcuga

SEQ ID NO: 1668938 - RNA, 21 nt, Human
cuuccucuuuccaucuacccu

SEQ ID NO: 1668939 - RNA, 22 nt, Human
cuuccucugaggcugaaauuca

SEQ ID NO: 1668940 - RNA, 22 nt, Human
cuuccucuuuccaucuacccuc

SEQ ID NO: 1668941 - RNA, 13 nt, Human
cuuccuccuggug

SEQ ID NO: 1668942 - RNA, 18 nt, Human
cuugaauuguaaggaaug

SEQ ID NO: 1668943 - RNA, 16 nt, Human
cuugacaucaacugca

SEQ ID NO: 1668944 - RNA, 22 nt, Human
cuugauauccucuuugagugaa

SEQ ID NO: 1668945 - RNA, 17 nt, Human
cuugauauccucuuuga

SEQ ID NO: 1668946 - RNA, 18 nt, Human
cuugauguguuaucucuu

SEQ ID NO: 1668947 - RNA, 13 nt, Human
cuugauuaaaagu

SEQ ID NO: 1668948 - RNA, 12 nt, Human
cuugauucauaa

SEQ ID NO: 1668949 - RNA, 12 nt, Human
cuugcaaaguau

SEQ ID NO: 1668950 - RNA, 23 nt, Human
cuuggauuguccccgacccuugc

SEQ ID NO: 1668951 - RNA, 24 nt, Human
cuuggauuguccccgacccuugcc

SEQ ID NO: 1668952 - RNA, 14 nt, Human
gccaacuauggccu

SEQ ID NO: 1668953 - RNA, 15 nt, Human
gccaacuauggccug

SEQ ID NO: 1668954 - RNA, 19 nt, Human
gccaacuauggccugugga

SEQ ID NO: 1668955 - RNA, 14 nt, Human
gccaagaauucuua

SEQ ID NO: 1668956 - RNA, 18 nt, Human
gccaagaauucuuaaaua

SEQ ID NO: 1668957 - RNA, 15 nt, Human
gcauuuaaaagauac

SEQ ID NO: 1668958 - RNA, 12 nt, Human
gcauuuaaaaga

SEQ ID NO: 1668959 - RNA, 16 nt, Human
gcauuugaaaauuuug

SEQ ID NO: 1668960 - RNA, 14 nt, Human
gcauuugaaaauuu

SEQ ID NO: 1668961 - RNA, 19 nt, Human
gcaugggaaugaaugucag

SEQ ID NO: 1668962 - RNA, 16 nt, Human
gcaugggaaugaaugu

SEQ ID NO: 1668963 - RNA, 23 nt, Human
gcaugucccuaccgagucucuuc

SEQ ID NO: 1668964 - RNA, 17 nt, Human
gcaugugaugagaggaa

SEQ ID NO: 1668965 - RNA, 18 nt, Human
gcaugugaugagaggaaa

SEQ ID NO: 1668966 - RNA, 16 nt, Human
gcauuguaaaugugcu

SEQ ID NO: 1668967 - RNA, 17 nt, Human
gcauccuggcacccggc

SEQ ID NO: 1668968 - RNA, 21 nt, Human
gcauccuggcacccggccccu

SEQ ID NO: 1668969 - RNA, 13 nt, Human
gcaucgcaaugua

SEQ ID NO: 1668970 - RNA, 22 nt, Human
gcauccuggcacccggccccug

SEQ ID NO: 1668971 - RNA, 23 nt, Human
gcauccuggcacccggccccugc

SEQ ID NO: 1668972 - RNA, 14 nt, Human
gcauggccaggugg

SEQ ID NO: 1668973 - RNA, 17 nt, Human
gcauggccagguggcca

SEQ ID NO: 1668974 - RNA, 13 nt, Human
gcauggccaggug

SEQ ID NO: 1668975 - RNA, 22 nt, Human
gccaagcaccuagccucgcucu

SEQ ID NO: 1668976 - RNA, 19 nt, Human
gccaaggccaaaggaagca

SEQ ID NO: 1668977 - RNA, 17 nt, Human
gccaaggccaaaggaag

SEQ ID NO: 1668978 - RNA, 11 nt, Human
gccaaggccaa

SEQ ID NO: 1668979 - RNA, 18 nt, Human
gcaggcucucaggccagc

SEQ ID NO: 1668980 - RNA, 17 nt, Human
gcaggcucucaggccag

SEQ ID NO: 1668981 - RNA, 13 nt, Human
gcaggcuggcccu

SEQ ID NO: 1668982 - RNA, 22 nt, Human
gcagggaaacagcuaaugggac

SEQ ID NO: 1668983 - RNA, 19 nt, Human
gcagcuugaggguugggcu

SEQ ID NO: 1668984 - RNA, 21 nt, Human
gcagcuugaggguugggcugg

SEQ ID NO: 1668985 - RNA, 22 nt, Human
gcaggcucgggcuccccagccc

SEQ ID NO: 1668986 - RNA, 12 nt, Human
gcaggcucucag

SEQ ID NO: 1668987 - RNA, 13 nt, Human
gcaggcucucagg

SEQ ID NO: 1668988 - RNA, 14 nt, Human
gcaggcucucaggc

SEQ ID NO: 1668989 - RNA, 15 nt, Human
gcaggcucucaggcc

SEQ ID NO: 1668990 - RNA, 16 nt, Human
gcaggcucucaggcca

SEQ ID NO: 1668991 - RNA, 22 nt, Human
gcagcugcgguccacccaggag

SEQ ID NO: 1668992 - RNA, 23 nt, Human
gcagcugcgguccacccaggagc

SEQ ID NO: 1668993 - RNA, 13 nt, Human
gcagcugcuuuug

SEQ ID NO: 1668994 - RNA, 20 nt, Human
gcagcugcuuuugucuaugg

SEQ ID NO: 1668995 - RNA, 16 nt, Human
gcagcuugaggguugg

SEQ ID NO: 1668996 - RNA, 15 nt, Human
gcagcuuauucacaa

SEQ ID NO: 1668997 - RNA, 16 nt, Human
gcacuuuguucuggcu

SEQ ID NO: 1668998 - RNA, 22 nt, Human
gcaguugaaaagacuccaaaga

SEQ ID NO: 1668999 - RNA, 21 nt, Human
gcaguugagaaaauuugaaug

SEQ ID NO: 1669000 - RNA, 13 nt, Human
gcauaacauaaau

SEQ ID NO: 1669001 - RNA, 15 nt, Human
gcauaacauaaaucu

SEQ ID NO: 1669002 - RNA, 15 nt, Human
gcauaaaaauuagcc

SEQ ID NO: 1669003 - RNA, 14 nt, Human
gcaguugccaguca

SEQ ID NO: 1669004 - RNA, 23 nt, Human
gcaguugccagucaccccggcca

SEQ ID NO: 1669005 - RNA, 16 nt, Human
gcauaccacuuuuguu

SEQ ID NO: 1669006 - RNA, 15 nt, Human
gcauaccacuuuugu

SEQ ID NO: 1669007 - RNA, 14 nt, Human
gaugaugacuaugg

SEQ ID NO: 1669008 - RNA, 23 nt, Human
gaugcuucucacugccaugccag

SEQ ID NO: 1669009 - RNA, 23 nt, Human
gauggaggaaaaccaagccgugg

SEQ ID NO: 1669010 - RNA, 16 nt, Human
gaugcuuguacauaau

SEQ ID NO: 1669011 - RNA, 14 nt, Human
gaugcuuguacaua

SEQ ID NO: 1669012 - RNA, 18 nt, Human
gaugucccaacuuguaaa

SEQ ID NO: 1669013 - RNA, 17 nt, Human
gaugucccaacuuguaa

SEQ ID NO: 1669014 - RNA, 17 nt, Human
gauguagaggagaaacu

SEQ ID NO: 1669015 - RNA, 20 nt, Human
gaucuggguucacugcaacc

SEQ ID NO: 1669016 - RNA, 22 nt, Human
gaguugauagcacagacccugc

SEQ ID NO: 1669017 - RNA, 18 nt, Human
gaucuggguucacugcaa

SEQ ID NO: 1669018 - RNA, 17 nt, Human
gcaaaaauauuuuauga

SEQ ID NO: 1669019 - RNA, 22 nt, Human
gcaaaaauauuuuaugauccag

SEQ ID NO: 1669020 - RNA, 23 nt, Human
gcaaaaauauuuuaugauccagc

SEQ ID NO: 1669021 - RNA, 16 nt, Human
gcaaaaauauuuuaug

SEQ ID NO: 1669022 - RNA, 22 nt, Human
gauuuuuuuuuccuucagugcc

SEQ ID NO: 1669023 - RNA, 23 nt, Human
gauuuuuuuuuccuucagugccu

SEQ ID NO: 1669024 - RNA, 13 nt, Human
gauuucacucucc

SEQ ID NO: 1669025 - RNA, 16 nt, Human
gauuucacucuccuug

SEQ ID NO: 1669026 - RNA, 15 nt, Human
gauuucagcucacug

SEQ ID NO: 1669027 - RNA, 17 nt, Human
gauuucagcucacugca

SEQ ID NO: 1669028 - RNA, 20 nt, Human
gauuucagcucacugcaacc

SEQ ID NO: 1669029 - RNA, 17 nt, Human
gauuucacucuccuugg

SEQ ID NO: 1669030 - RNA, 18 nt, Human
gauuucacucuccuuggu

SEQ ID NO: 1669031 - RNA, 21 nt, Human
gauucuuaaaguugaauuuau

SEQ ID NO: 1669032 - RNA, 21 nt, Human
gauucuucugcuucagccucc

SEQ ID NO: 1669033 - RNA, 16 nt, Human
gauucuuaaaguugaa

SEQ ID NO: 1669034 - RNA, 17 nt, Human
gauucuuaaaguugaau

SEQ ID NO: 1669035 - RNA, 23 nt, Human
gauucuuauggacaaugacccag

SEQ ID NO: 1669036 - RNA, 23 nt, Human
gauuuaacagaaauguacagcaa

SEQ ID NO: 1669037 - RNA, 20 nt, Human
gauuuaacagaaauguacag

SEQ ID NO: 1669038 - RNA, 20 nt, Human
gauucuccugccucagccuc

SEQ ID NO: 1669039 - RNA, 21 nt, Human
gauucuccugccucagccucc

SEQ ID NO: 1669040 - RNA, 15 nt, Human
gauucuuaaaguuga

SEQ ID NO: 1669041 - RNA, 19 nt, Human
gauucuccugccucagccu

SEQ ID NO: 1669042 - RNA, 14 nt, Human
gaugucuucauacc

SEQ ID NO: 1669043 - RNA, 18 nt, Human
gaugucuucauaccuaca

SEQ ID NO: 1669044 - RNA, 15 nt, Human
gcaaaagaugcuucu

SEQ ID NO: 1669045 - RNA, 18 nt, Human
gcaacccccagccugcua

SEQ ID NO: 1669046 - RNA, 16 nt, Human
gcaaaagaugcuucuc

SEQ ID NO: 1669047 - RNA, 22 nt, Human
gcaacccuggugaccagcacca

SEQ ID NO: 1669048 - RNA, 18 nt, Human
gcaaccuccgccucuugg

SEQ ID NO: 1669049 - RNA, 19 nt, Human
gcaaccuccgccucuuggg

SEQ ID NO: 1669050 - RNA, 12 nt, Human
gcacacaccaga

SEQ ID NO: 1669051 - RNA, 14 nt, Human
gcacacaccagagc

SEQ ID NO: 1669052 - RNA, 15 nt, Human
gcacacaccagagcc

SEQ ID NO: 1669053 - RNA, 16 nt, Human
gcacacaccagagccc

SEQ ID NO: 1669054 - RNA, 17 nt, Human
gcacacaccagagccca

SEQ ID NO: 1669055 - RNA, 18 nt, Human
gcacacaccagagcccac

SEQ ID NO: 1669056 - RNA, 19 nt, Human
gcacacaccagagcccacc

SEQ ID NO: 1669057 - RNA, 21 nt, Human
gcaauaaagcagcguuucuau

SEQ ID NO: 1669058 - RNA, 18 nt, Human
gcaauagucaaauugugu

SEQ ID NO: 1669059 - RNA, 11 nt, Human
gcaauaaagca

SEQ ID NO: 1669060 - RNA, 16 nt, Human
gcaauaaaauggguuu

SEQ ID NO: 1669061 - RNA, 17 nt, Human
gcacuccagccugggug

SEQ ID NO: 1669062 - RNA, 12 nt, Human
gcacuccccugc

SEQ ID NO: 1669063 - RNA, 22 nt, Human
gcacuauagccuaggugacaga

SEQ ID NO: 1669064 - RNA, 11 nt, Human
gcacacagcac

SEQ ID NO: 1669065 - RNA, 23 nt, Human
gcacacagcacgggggccaagga

SEQ ID NO: 1669066 - RNA, 20 nt, Human
gcacacaccagagcccaccu

SEQ ID NO: 1669067 - RNA, 11 nt, Human
gcacacauuuu

SEQ ID NO: 1669068 - RNA, 12 nt, Human
gcacacauuuuu

SEQ ID NO: 1669069 - RNA, 14 nt, Human
gcacacauuuuuua

SEQ ID NO: 1669070 - RNA, 17 nt, Human
gcaccuaccaccacgcc

SEQ ID NO: 1669071 - RNA, 18 nt, Human
gcaccuaccaccacgccc

SEQ ID NO: 1669072 - RNA, 18 nt, Human
gcaccggcuggccuggcc

SEQ ID NO: 1669073 - RNA, 17 nt, Human
gcaccggcuggccuggc

SEQ ID NO: 1669074 - RNA, 15 nt, Human
gcaccggcuggccug

SEQ ID NO: 1669075 - RNA, 16 nt, Human
gcaccggcuggccugg

SEQ ID NO: 1669076 - RNA, 12 nt, Human
gcaccuccugcc

SEQ ID NO: 1669077 - RNA, 20 nt, Human
gagcugccuguucagcucca

SEQ ID NO: 1669078 - RNA, 21 nt, Human
gagcugugagaaggguguugu

SEQ ID NO: 1669079 - RNA, 17 nt, Human
gagcggagaaaggaagg

SEQ ID NO: 1669080 - RNA, 15 nt, Human
gagcugccuguucag

SEQ ID NO: 1669081 - RNA, 16 nt, Human
gagcugccuguucagc

SEQ ID NO: 1669082 - RNA, 19 nt, Human
gagcugccuguucagcucc

SEQ ID NO: 1669083 - RNA, 17 nt, Human
gagcuguucacagccag

SEQ ID NO: 1669084 - RNA, 12 nt, Human
gagccuuccagg

SEQ ID NO: 1669085 - RNA, 13 nt, Human
gagccuuccaggg

SEQ ID NO: 1669086 - RNA, 13 nt, Human
gagcgacagugag

SEQ ID NO: 1669087 - RNA, 15 nt, Human
gagcgacagugagac

SEQ ID NO: 1669088 - RNA, 20 nt, Human
gagcaucaggccaggcccuc

SEQ ID NO: 1669089 - RNA, 22 nt, Human
gagcaucaggccaggcccucug

SEQ ID NO: 1669090 - RNA, 12 nt, Human
gaggggaacaga

SEQ ID NO: 1669091 - RNA, 12 nt, Human
gagggcuccaga

SEQ ID NO: 1669092 - RNA, 13 nt, Human
gagggcuccagac

SEQ ID NO: 1669093 - RNA, 14 nt, Human
gagggcuccagaca

SEQ ID NO: 1669094 - RNA, 15 nt, Human
gagggcuccagacac

SEQ ID NO: 1669095 - RNA, 14 nt, Human
gaggcugccucucc

SEQ ID NO: 1669096 - RNA, 14 nt, Human
gaggcucuggagcc

SEQ ID NO: 1669097 - RNA, 19 nt, Human
gaggcucuggagcccacug

SEQ ID NO: 1669098 - RNA, 15 nt, Human
gaggcucugcccuug

SEQ ID NO: 1669099 - RNA, 17 nt, Human
gaggcucugcccuuggu

SEQ ID NO: 1669100 - RNA, 12 nt, Human
gaggcucugccc

SEQ ID NO: 1669101 - RNA, 13 nt, Human
gaggcucugcccu

SEQ ID NO: 1669102 - RNA, 14 nt, Human
gaggcucugcccuu

SEQ ID NO: 1669103 - RNA, 20 nt, Human
gaggccagagacacaagccu

SEQ ID NO: 1669104 - RNA, 18 nt, Human
gagucagaaguuucugcc

SEQ ID NO: 1669105 - RNA, 14 nt, Human
gagugagacucugu

SEQ ID NO: 1669106 - RNA, 18 nt, Human
gagugagacucugucuca

SEQ ID NO: 1669107 - RNA, 24 nt, Human
gagugagcacuaaggugugcucug

SEQ ID NO: 1669108 - RNA, 18 nt, Human
gagugcagugagccgaga

SEQ ID NO: 1669109 - RNA, 22 nt, Human
gaguugauacuacaguuuguua

SEQ ID NO: 1669110 - RNA, 21 nt, Human
gaguugauagcacagacccug

SEQ ID NO: 1669111 - RNA, 19 nt, Human
gaguugauacuacaguuug

SEQ ID NO: 1669112 - RNA, 18 nt, Human
gagugccuuacacaaugg

SEQ ID NO: 1669113 - RNA, 17 nt, Human
gaggugggauccuccag

SEQ ID NO: 1669114 - RNA, 14 nt, Human
gagucacuggaaca

SEQ ID NO: 1669115 - RNA, 21 nt, Human
gagucacuggaacacuaauga

SEQ ID NO: 1669116 - RNA, 15 nt, Human
gaggugggauccucc

SEQ ID NO: 1669117 - RNA, 16 nt, Human
gaggugggauccucca

SEQ ID NO: 1669118 - RNA, 13 nt, Human
gaggugggauccu

SEQ ID NO: 1669119 - RNA, 17 nt, Human
gacaggguuucaccaug

SEQ ID NO: 1669120 - RNA, 20 nt, Human
gacaguauggcagcuuuccu

SEQ ID NO: 1669121 - RNA, 16 nt, Human
gaccaucccugaaggc

SEQ ID NO: 1669122 - RNA, 17 nt, Human
gaccaucccugaaggcc

SEQ ID NO: 1669123 - RNA, 16 nt, Human
gaccauucuccaccug

SEQ ID NO: 1669124 - RNA, 13 nt, Human
gaccccuggcuuu

SEQ ID NO: 1669125 - RNA, 17 nt, Human
gaccauucuccaccugc

SEQ ID NO: 1669126 - RNA, 16 nt, Human
gacccuauugcugcuu

SEQ ID NO: 1669127 - RNA, 21 nt, Human
gaccccuggcuuuucacugcu

SEQ ID NO: 1669128 - RNA, 22 nt, Human
gaccccuggcuuuucacugcug

SEQ ID NO: 1669129 - RNA, 12 nt, Human
gacccggcugcg

SEQ ID NO: 1669130 - RNA, 13 nt, Human
gacccggcugcgu

SEQ ID NO: 1669131 - RNA, 15 nt, Human
gaccaucccugaagg

SEQ ID NO: 1669132 - RNA, 16 nt, Human
gacagcuccuucuguc

SEQ ID NO: 1669133 - RNA, 11 nt, Human
gacagccuggc

SEQ ID NO: 1669134 - RNA, 12 nt, Human
gacagccuggca

SEQ ID NO: 1669135 - RNA, 13 nt, Human
gacagcuccuucu

SEQ ID NO: 1669136 - RNA, 14 nt, Human
gacagcuccuucug

SEQ ID NO: 1669137 - RNA, 15 nt, Human
gacagcuccuucugu

SEQ ID NO: 1669138 - RNA, 21 nt, Human
gacagcccuucuuuccacaga

SEQ ID NO: 1669139 - RNA, 20 nt, Human
gacagaaagcagaacaguga

SEQ ID NO: 1669140 - RNA, 14 nt, Human
gacagaaagcagaa

SEQ ID NO: 1669141 - RNA, 22 nt, Human
gacuauucaaacagucucagga

SEQ ID NO: 1669142 - RNA, 15 nt, Human
gacuauucaaacagu

SEQ ID NO: 1669143 - RNA, 16 nt, Human
gacuauucaaacaguc

SEQ ID NO: 1669144 - RNA, 12 nt, Human
gacgcugugcug

SEQ ID NO: 1669145 - RNA, 13 nt, Human
gacgcugugcugc

SEQ ID NO: 1669146 - RNA, 15 nt, Human
gacgcugugcugccc

SEQ ID NO: 1669147 - RNA, 22 nt, Human
gacugucucaagagggcacugg

SEQ ID NO: 1669148 - RNA, 23 nt, Human
gacugucucaagagggcacuggu

SEQ ID NO: 1669149 - RNA, 21 nt, Human
gacugucucaagagggcacug

SEQ ID NO: 1669150 - RNA, 14 nt, Human
gacugugugcucag

SEQ ID NO: 1669151 - RNA, 16 nt, Human
gacugugugcucagga

SEQ ID NO: 1669152 - RNA, 17 nt, Human
gacugugugcucaggag

SEQ ID NO: 1669153 - RNA, 20 nt, Human
gacugugugcucaggagccc

SEQ ID NO: 1669154 - RNA, 14 nt, Human
gacucaaugcacug

SEQ ID NO: 1669155 - RNA, 17 nt, Human
gacucaaugcacugaca

SEQ ID NO: 1669156 - RNA, 16 nt, Human
gacuguacuccuccca

SEQ ID NO: 1669157 - RNA, 17 nt, Human
gacuguacuccucccag

SEQ ID NO: 1669158 - RNA, 22 nt, Human
gacuguacaaaguagaagucuu

SEQ ID NO: 1669159 - RNA, 16 nt, Human
gacuguuuucucuuga

SEQ ID NO: 1669160 - RNA, 18 nt, Human
gacuguuuucucuugaga

SEQ ID NO: 1669161 - RNA, 14 nt, Human
gacuuuggaaagac

SEQ ID NO: 1669162 - RNA, 14 nt, Human
gacuuuggaaagag

SEQ ID NO: 1669163 - RNA, 19 nt, Human
gacuuuggauaauaaggaa

SEQ ID NO: 1669164 - RNA, 22 nt, Human
gacuuuguuaguuucuccaagc

SEQ ID NO: 1669165 - RNA, 21 nt, Human
gacuuuucuguccgagcuuug

SEQ ID NO: 1669166 - RNA, 23 nt, Human
gacuuuucuguccgagcuuugaa

SEQ ID NO: 1669167 - RNA, 17 nt, Human
gagaagcggcuggcagc

SEQ ID NO: 1669168 - RNA, 15 nt, Human
aaauccacuuuaucu

SEQ ID NO: 1669169 - RNA, 19 nt, Human
aaaucauuucugcaucagc

SEQ ID NO: 1669170 - RNA, 21 nt, Human
aaaucauuucugcaucagcug

SEQ ID NO: 1669171 - RNA, 22 nt, Human
aaaucauuucugcaucagcugc

SEQ ID NO: 1669172 - RNA, 23 nt, Human
aaaucauuucugcaucagcugcu

SEQ ID NO: 1669173 - RNA, 19 nt, Human
aaaucagccguguaaccau

SEQ ID NO: 1669174 - RNA, 12 nt, Human
aaaucagccugc

SEQ ID NO: 1669175 - RNA, 16 nt, Human
aaaucagcugcuacua

SEQ ID NO: 1669176 - RNA, 18 nt, Human
aaaucagccugcuccagc

SEQ ID NO: 1669177 - RNA, 12 nt, Human
aaaucauuucug

SEQ ID NO: 1669178 - RNA, 17 nt, Human
aaauauuauguuaaaac

SEQ ID NO: 1669179 - RNA, 14 nt, Human
aaaucagacuauga

SEQ ID NO: 1669180 - RNA, 21 nt, Human
aaaucagacuaugaaguuuuu

SEQ ID NO: 1669181 - RNA, 15 nt, Human
aaauauuccugcauu

SEQ ID NO: 1669182 - RNA, 20 nt, Human
guacaugaaaacacauuuuu

SEQ ID NO: 1669183 - RNA, 19 nt, Human
guacaugaaaacacauuuu

SEQ ID NO: 1669184 - RNA, 18 nt, Human
guacaugaaaacacauuu

SEQ ID NO: 1669185 - RNA, 17 nt, Human
guacaugaaaacacauu

SEQ ID NO: 1669186 - RNA, 19 nt, Human
guacauggaauaacaugua

SEQ ID NO: 1669187 - RNA, 16 nt, Human
guacaugaaaacacau

SEQ ID NO: 1669188 - RNA, 15 nt, Human
guacaugaaaacaca

SEQ ID NO: 1669189 - RNA, 14 nt, Human
guacaugaaaacac

SEQ ID NO: 1669190 - RNA, 15 nt, Human
aaauccauacauuug

SEQ ID NO: 1669191 - RNA, 18 nt, Human
aaauccauacauuugugu

SEQ ID NO: 1669192 - RNA, 12 nt, Human
guacccacugcu

SEQ ID NO: 1669193 - RNA, 20 nt, Human
guaccaagacuacuagggaa

SEQ ID NO: 1669194 - RNA, 23 nt, Human
guaccaagacuacuagggaaaug

SEQ ID NO: 1669195 - RNA, 11 nt, Human
guagagacagg

SEQ ID NO: 1669196 - RNA, 12 nt, Human
guagagacaggg

SEQ ID NO: 1669197 - RNA, 15 nt, Human
guagagccagggucu

SEQ ID NO: 1669198 - RNA, 18 nt, Human
guagagccagggucucac

SEQ ID NO: 1669199 - RNA, 13 nt, Human
guagagacagggu

SEQ ID NO: 1669200 - RNA, 10 nt, Human
guagagccag

SEQ ID NO: 1669201 - RNA, 11 nt, Human
guagagccagg

SEQ ID NO: 1669202 - RNA, 21 nt, Human
guagaagucuuagauguauau

SEQ ID NO: 1669203 - RNA, 18 nt, Human
guagaagcccuucuaccu

SEQ ID NO: 1669204 - RNA, 20 nt, Human
guagaaauaucugaaaaugu

SEQ ID NO: 1669205 - RNA, 21 nt, Human
guagaaauaucugaaaaugua

SEQ ID NO: 1669206 - RNA, 23 nt, Human
guagaaauaucugaaaauguaug

SEQ ID NO: 1669207 - RNA, 14 nt, Human
guacuccucccagg

SEQ ID NO: 1669208 - RNA, 15 nt, Human
guacuauguaucaau

SEQ ID NO: 1669209 - RNA, 17 nt, Human
guacuauguaucaauga

SEQ ID NO: 1669210 - RNA, 13 nt, Human
guacuauguauca

SEQ ID NO: 1669211 - RNA, 13 nt, Human
guacccacugcuc

SEQ ID NO: 1669212 - RNA, 14 nt, Human
guacccacugcucu

SEQ ID NO: 1669213 - RNA, 18 nt, Human
guacuacaguccucccau

SEQ ID NO: 1669214 - RNA, 19 nt, Human
guacuacaguccucccauc

SEQ ID NO: 1669215 - RNA, 16 nt, Human
guacuggagaaaaugg

SEQ ID NO: 1669216 - RNA, 21 nt, Human
guacuucaaauccuugaagau

SEQ ID NO: 1669217 - RNA, 22 nt, Human
guacuucaaauccuugaagauu

SEQ ID NO: 1669218 - RNA, 15 nt, Human
guacuucaugcuguc

SEQ ID NO: 1669219 - RNA, 23 nt, Human
aaaguacuucuccacccugcucu

SEQ ID NO: 1669220 - RNA, 20 nt, Human
aaaguacuucuccacccugc

SEQ ID NO: 1669221 - RNA, 21 nt, Human
aaaguacuucuccacccugcu

SEQ ID NO: 1669222 - RNA, 18 nt, Human
aaaguaucccuacuguaa

SEQ ID NO: 1669223 - RNA, 18 nt, Human
aaaguauguuagugcaaa

SEQ ID NO: 1669224 - RNA, 19 nt, Human
aaaguacuucuccacccug

SEQ ID NO: 1669225 - RNA, 20 nt, Human
aaaguacacuguuucaaacu

SEQ ID NO: 1669226 - RNA, 20 nt, Human
aaagguauuuuaaucaccaa

SEQ ID NO: 1669227 - RNA, 13 nt, Human
aaaguauuaagca

SEQ ID NO: 1669228 - RNA, 18 nt, Human
aaaguauuaagcauauau

SEQ ID NO: 1669229 - RNA, 19 nt, Human
aaaguauuaagcauauauu

SEQ ID NO: 1669230 - RNA, 20 nt, Human
aaaguauuaagcauauauuu

SEQ ID NO: 1669231 - RNA, 13 nt, Human
aaaguugccuaaa

SEQ ID NO: 1669232 - RNA, 14 nt, Human
aaaguugccuaaau

SEQ ID NO: 1669233 - RNA, 12 nt, Human
aaaguugaauuu

SEQ ID NO: 1669234 - RNA, 23 nt, Human
aaaguucugcagauaaacaguag

SEQ ID NO: 1669235 - RNA, 12 nt, Human
aaaguuuaauau

SEQ ID NO: 1669236 - RNA, 14 nt, Human
aaaguuuaauauua

SEQ ID NO: 1669237 - RNA, 16 nt, Human
aaaguugccuaaaucc

SEQ ID NO: 1669238 - RNA, 17 nt, Human
aaaguugccuaaaucca

SEQ ID NO: 1669239 - RNA, 16 nt, Human
aaaguugguaaaccuu

SEQ ID NO: 1669240 - RNA, 23 nt, Human
aaaguugccuaaauccauuugga

SEQ ID NO: 1669241 - RNA, 17 nt, Human
aaaguugguaaaccuuu

SEQ ID NO: 1669242 - RNA, 22 nt, Human
aaauacgugggcauucaaaugu

SEQ ID NO: 1669243 - RNA, 18 nt, Human
aaauaccagccaguaaau

SEQ ID NO: 1669244 - RNA, 17 nt, Human
aaauacagauagauaua

SEQ ID NO: 1669245 - RNA, 19 nt, Human
aaauacacacucaaaucaa

SEQ ID NO: 1669246 - RNA, 13 nt, Human
aaauacaauuuug

SEQ ID NO: 1669247 - RNA, 22 nt, Human
aaauaauuuuuauauuugaaau

SEQ ID NO: 1669248 - RNA, 23 nt, Human
aaauaauuuuuauauuugaaaua

SEQ ID NO: 1669249 - RNA, 14 nt, Human
aaauacaauuuugu

SEQ ID NO: 1669250 - RNA, 17 nt, Human
aaauacaauuuuguuuc

SEQ ID NO: 1669251 - RNA, 18 nt, Human
aaauacaauuuuguuucu

SEQ ID NO: 1669252 - RNA, 20 nt, Human
aaauacaauuuuguuucugu

SEQ ID NO: 1669253 - RNA, 21 nt, Human
aaauacaauuuuguuucugua

SEQ ID NO: 1669254 - RNA, 22 nt, Human
aaauacaauuuuguuucuguac

SEQ ID NO: 1669255 - RNA, 15 nt, Human
aaauacacacucaaa

SEQ ID NO: 1669256 - RNA, 21 nt, Human
guaauuuuuuuaucgucacug

SEQ ID NO: 1669257 - RNA, 20 nt, Human
guaauuuuaugagcugugag

SEQ ID NO: 1669258 - RNA, 23 nt, Human
guacacugccuucucaacuccaa

SEQ ID NO: 1669259 - RNA, 21 nt, Human
aaauaauuuuuauauuugaaa

SEQ ID NO: 1669260 - RNA, 21 nt, Human
guaauccaagcaaaugugaau

SEQ ID NO: 1669261 - RNA, 18 nt, Human
guaauaugcacacauuuu

SEQ ID NO: 1669262 - RNA, 17 nt, Human
guaauaugcacacauuu

SEQ ID NO: 1669263 - RNA, 16 nt, Human
guaauaugcacacauu

SEQ ID NO: 1669264 - RNA, 14 nt, Human
guaauaugcacaca

SEQ ID NO: 1669265 - RNA, 20 nt, Human
guaauaggcguaacuaauuu

SEQ ID NO: 1669266 - RNA, 19 nt, Human
gggggugcugggccccugc

SEQ ID NO: 1669267 - RNA, 13 nt, Human
gggucgcccugga

SEQ ID NO: 1669268 - RNA, 15 nt, Human
gggucgcccuggacu

SEQ ID NO: 1669269 - RNA, 18 nt, Human
aaaccuuuguuugcaucu

SEQ ID NO: 1669270 - RNA, 18 nt, Human
aaaccuuuuauauuuagu

SEQ ID NO: 1669271 - RNA, 15 nt, Human
aaacgggcucagcaa

SEQ ID NO: 1669272 - RNA, 15 nt, Human
aaaccucugugagca

SEQ ID NO: 1669273 - RNA, 15 nt, Human
aaacauuaugaugug

SEQ ID NO: 1669274 - RNA, 23 nt, Human
aaaccaagucaagugaaaaagga

SEQ ID NO: 1669275 - RNA, 12 nt, Human
aaaccacagcag

SEQ ID NO: 1669276 - RNA, 19 nt, Human
aaacuuaaucuaaauggaa

SEQ ID NO: 1669277 - RNA, 18 nt, Human
aaacuuaaucuaaaugga

SEQ ID NO: 1669278 - RNA, 17 nt, Human
aaacuuaaucuaaaugg

SEQ ID NO: 1669279 - RNA, 16 nt, Human
aaacuuaaucuaaaug

SEQ ID NO: 1669280 - RNA, 19 nt, Human
aaacuguuaauaguucagg

SEQ ID NO: 1669281 - RNA, 22 nt, Human
aaacugcccccucugcccugcg

SEQ ID NO: 1669282 - RNA, 13 nt, Human
aaacucuccucug

SEQ ID NO: 1669283 - RNA, 13 nt, Human
aaacugcuuguuu

SEQ ID NO: 1669284 - RNA, 14 nt, Human
aaacugcuuguuuc

SEQ ID NO: 1669285 - RNA, 17 nt, Human
aaacugcuuguuuccua

SEQ ID NO: 1669286 - RNA, 19 nt, Human
aaacugcuuguuuccuagc

SEQ ID NO: 1669287 - RNA, 22 nt, Human
aaacugcuuguuuccuagcaca

SEQ ID NO: 1669288 - RNA, 22 nt, Human
aaacuaggugcauauuuauaaa

SEQ ID NO: 1669289 - RNA, 13 nt, Human
aaacgucuuaaau

SEQ ID NO: 1669290 - RNA, 18 nt, Human
aaacuaggugcauauuua

SEQ ID NO: 1669291 - RNA, 14 nt, Human
aaacgucuuaaaua

SEQ ID NO: 1669292 - RNA, 15 nt, Human
aaacucguuaauuug

SEQ ID NO: 1669293 - RNA, 15 nt, Human
aaaauuuuuaaucuu

SEQ ID NO: 1669294 - RNA, 20 nt, Human
aaaauuuugauguuuuaagg

SEQ ID NO: 1669295 - RNA, 19 nt, Human
aaaauuuagaaauauaauu

SEQ ID NO: 1669296 - RNA, 13 nt, Human
gggaugagaaagg

SEQ ID NO: 1669297 - RNA, 19 nt, Human
aaacacaaacgggcucagc

SEQ ID NO: 1669298 - RNA, 11 nt, Human
aaacacagcaa

SEQ ID NO: 1669299 - RNA, 12 nt, Human
aaacacauuuuu

SEQ ID NO: 1669300 - RNA, 11 nt, Human
aaacacauuuu

SEQ ID NO: 1669301 - RNA, 12 nt, Human
aaacacagcaag

SEQ ID NO: 1669302 - RNA, 14 nt, Human
aaacacagcaaggg

SEQ ID NO: 1669303 - RNA, 15 nt, Human
ggggccucagugcca

SEQ ID NO: 1669304 - RNA, 12 nt, Human
gggggccucagu

SEQ ID NO: 1669305 - RNA, 15 nt, Human
gggggccucagugcc

SEQ ID NO: 1669306 - RNA, 17 nt, Human
gggggccucagugccac

SEQ ID NO: 1669307 - RNA, 18 nt, Human
gggggccucagugccacu

SEQ ID NO: 1669308 - RNA, 11 nt, Human
ggggagaaagu

SEQ ID NO: 1669309 - RNA, 13 nt, Human
ggggaaggcaggg

SEQ ID NO: 1669310 - RNA, 18 nt, Human
ggggaauguuugccucug

SEQ ID NO: 1669311 - RNA, 22 nt, Human
ggggaauguuugccucugccuc

SEQ ID NO: 1669312 - RNA, 16 nt, Human
ggggaccagagcugcc

SEQ ID NO: 1669313 - RNA, 19 nt, Human
ggggaauugaggacacuga

SEQ ID NO: 1669314 - RNA, 17 nt, Human
aaacauggccuuugcuu

SEQ ID NO: 1669315 - RNA, 14 nt, Human
aaacaguagugaua

SEQ ID NO: 1669316 - RNA, 16 nt, Human
aaacauggccuuugcu

SEQ ID NO: 1669317 - RNA, 15 nt, Human
aaacagucucaggaa

SEQ ID NO: 1669318 - RNA, 21 nt, Human
aaagauggcugugccucugcc

SEQ ID NO: 1669319 - RNA, 22 nt, Human
aaagauggcugugccucugccu

SEQ ID NO: 1669320 - RNA, 23 nt, Human
aaagauggcugugccucugccug

SEQ ID NO: 1669321 - RNA, 11 nt, Human
gguccugcugc

SEQ ID NO: 1669322 - RNA, 12 nt, Human
gguccugcugca

SEQ ID NO: 1669323 - RNA, 14 nt, Human
gguccugcugcagu

SEQ ID NO: 1669324 - RNA, 14 nt, Human
aaagacuguacaaa

SEQ ID NO: 1669325 - RNA, 23 nt, Human
aaagacugaguacguugugcauu

SEQ ID NO: 1669326 - RNA, 13 nt, Human
aaagacuguacaa

SEQ ID NO: 1669327 - RNA, 19 nt, Human
aaagaugcuucucacugcc

SEQ ID NO: 1669328 - RNA, 17 nt, Human
aaagaugcuucucacug

SEQ ID NO: 1669329 - RNA, 14 nt, Human
aaagaugcuucuca

SEQ ID NO: 1669330 - RNA, 15 nt, Human
aaagaggaaugaagu

SEQ ID NO: 1669331 - RNA, 15 nt, Human
aaagaggcagcuuga

SEQ ID NO: 1669332 - RNA, 15 nt, Human
aaacuuguguaaaua

SEQ ID NO: 1669333 - RNA, 16 nt, Human
aaacuuguauuaugug

SEQ ID NO: 1669334 - RNA, 14 nt, Human
ggguggccucccaa

SEQ ID NO: 1669335 - RNA, 15 nt, Human
ggguggggggggugc

SEQ ID NO: 1669336 - RNA, 19 nt, Human
aaacuucagacauagaauu

SEQ ID NO: 1669337 - RNA, 23 nt, Human
aaacuucagcgguuuauauaagc

SEQ ID NO: 1669338 - RNA, 11 nt, Human
aaacuuuucug

SEQ ID NO: 1669339 - RNA, 12 nt, Human
aaacuuuucuga

SEQ ID NO: 1669340 - RNA, 13 nt, Human
aaagacagugaaa

SEQ ID NO: 1669341 - RNA, 21 nt, Human
aaagacuauucaaacagucuc

SEQ ID NO: 1669342 - RNA, 15 nt, Human
aaagacuccaaagaa

SEQ ID NO: 1669343 - RNA, 21 nt, Human
aaagacuccaaagaaauguaa

SEQ ID NO: 1669344 - RNA, 18 nt, Human
aaagacuauucaaacagu

SEQ ID NO: 1669345 - RNA, 19 nt, Human
aaagacuauucaaacaguc

SEQ ID NO: 1669346 - RNA, 17 nt, Human
aaagacuauucaaacag

SEQ ID NO: 1669347 - RNA, 12 nt, Human
aaagcugaaaac

SEQ ID NO: 1669348 - RNA, 13 nt, Human
aaagcugcugaca

SEQ ID NO: 1669349 - RNA, 15 nt, Human
aaagcuuguuaagau

SEQ ID NO: 1669350 - RNA, 15 nt, Human
aaagcugaaaacugc

SEQ ID NO: 1669351 - RNA, 15 nt, Human
aaagcucacuuuacu

SEQ ID NO: 1669352 - RNA, 17 nt, Human
aaagcacugacuucuaa

SEQ ID NO: 1669353 - RNA, 21 nt, Human
aaagcacugacuucuaaguaa

SEQ ID NO: 1669354 - RNA, 17 nt, Human
aaaggagauuggaagga

SEQ ID NO: 1669355 - RNA, 21 nt, Human
aaaggagagcuagcagcaggg

SEQ ID NO: 1669356 - RNA, 20 nt, Human
aaaggaagguucugguguga

SEQ ID NO: 1669357 - RNA, 22 nt, Human
aaaggaaagagggagguaagga

SEQ ID NO: 1669358 - RNA, 22 nt, Human
aaagggacuuggaagcuccgcu

SEQ ID NO: 1669359 - RNA, 20 nt, Human
aaagggauggcaagaugugg

SEQ ID NO: 1669360 - RNA, 14 nt, Human
aaagguaaaucaga

SEQ ID NO: 1669361 - RNA, 14 nt, Human
aaagguacuucaaa

SEQ ID NO: 1669362 - RNA, 19 nt, Human
ggugcugggccccugccuc

SEQ ID NO: 1669363 - RNA, 13 nt, Human
gguggaugccugg

SEQ ID NO: 1669364 - RNA, 11 nt, Human
ggugcugggcc

SEQ ID NO: 1669365 - RNA, 13 nt, Human
ggugcugggcccc

SEQ ID NO: 1669366 - RNA, 15 nt, Human
ggugcugggccccug

SEQ ID NO: 1669367 - RNA, 16 nt, Human
ggugcugggccccugc

SEQ ID NO: 1669368 - RNA, 21 nt, Human
ggugcauauuuauaaaaauaa

SEQ ID NO: 1669369 - RNA, 21 nt, Human
ggugcauuugaggucuguucu

SEQ ID NO: 1669370 - RNA, 18 nt, Human
ggugauccacccaccuca

SEQ ID NO: 1669371 - RNA, 23 nt, Human
ggugauccacccaccucagccuc

SEQ ID NO: 1669372 - RNA, 24 nt, Human
ggugauccacccaccucagccucc

SEQ ID NO: 1669373 - RNA, 12 nt, Human
ggugcaaugacc

SEQ ID NO: 1669374 - RNA, 13 nt, Human
ggugcaaugaccu

SEQ ID NO: 1669375 - RNA, 16 nt, Human
ggugcaaugaccuuuc

SEQ ID NO: 1669376 - RNA, 14 nt, Human
ggucgcccuggacu

SEQ ID NO: 1669377 - RNA, 13 nt, Human
ggucgaggcagga

SEQ ID NO: 1669378 - RNA, 13 nt, Human
ggugaacagaaca

SEQ ID NO: 1669379 - RNA, 20 nt, Human
ggucgcccuggacugugugc

SEQ ID NO: 1669380 - RNA, 13 nt, Human
gggaagagacuug

SEQ ID NO: 1669381 - RNA, 13 nt, Human
gggacagagcaga

SEQ ID NO: 1669382 - RNA, 12 nt, Human
gggacagcuccu

SEQ ID NO: 1669383 - RNA, 13 nt, Human
gggacagcuccuu

SEQ ID NO: 1669384 - RNA, 15 nt, Human
gggacagcuccuucu

SEQ ID NO: 1669385 - RNA, 16 nt, Human
gggacagcuccuucug

SEQ ID NO: 1669386 - RNA, 20 nt, Human
gggacagucaccucauggaa

SEQ ID NO: 1669387 - RNA, 21 nt, Human
gggacagucaccucauggaau

SEQ ID NO: 1669388 - RNA, 22 nt, Human
gggacagucaccucauggaauu

SEQ ID NO: 1669389 - RNA, 22 nt, Human
ggcuucccgcucagcccucccu

SEQ ID NO: 1669390 - RNA, 21 nt, Human
ggcuuccuccugguguggaag

SEQ ID NO: 1669391 - RNA, 18 nt, Human
gggaagaagcucucuccu

SEQ ID NO: 1669392 - RNA, 13 nt, Human
gggaaccugaccc

SEQ ID NO: 1669393 - RNA, 20 nt, Human
gggaacccaaguccaagcau

SEQ ID NO: 1669394 - RNA, 15 nt, Human
ggcuguacccaggaa

SEQ ID NO: 1669395 - RNA, 18 nt, Human
ggcuguaucccaugagcc

SEQ ID NO: 1669396 - RNA, 18 nt, Human
ggcuucaguggcagcugc

SEQ ID NO: 1669397 - RNA, 17 nt, Human
ggcuucaguggcagcug

SEQ ID NO: 1669398 - RNA, 19 nt, Human
ggcuucaguggcagcugcu

SEQ ID NO: 1669399 - RNA, 20 nt, Human
ggcuucaguggcagcugcuu

SEQ ID NO: 1669400 - RNA, 14 nt, Human
ggcuucccgcucag

SEQ ID NO: 1669401 - RNA, 22 nt, Human
ggcuucauccuccucagaucuu

SEQ ID NO: 1669402 - RNA, 18 nt, Human
ggcuucauccuccucaga

SEQ ID NO: 1669403 - RNA, 15 nt, Human
ggcuucccgcucagc

SEQ ID NO: 1669404 - RNA, 16 nt, Human
ggcuucccgcucagcc

SEQ ID NO: 1669405 - RNA, 17 nt, Human
ggcuucccgcucagccc

SEQ ID NO: 1669406 - RNA, 18 nt, Human
ggcuucccgcucagcccu

SEQ ID NO: 1669407 - RNA, 19 nt, Human
ggcuucccgcucagcccuc

SEQ ID NO: 1669408 - RNA, 21 nt, Human
ggcuucccgcucagcccuccc

SEQ ID NO: 1669409 - RNA, 16 nt, Human
ggcuuccucauaguau

SEQ ID NO: 1669410 - RNA, 14 nt, Human
ggcugggucgcccu

SEQ ID NO: 1669411 - RNA, 17 nt, Human
ggcugggucgcccugga

SEQ ID NO: 1669412 - RNA, 20 nt, Human
ggcugggucgcccuggacug

SEQ ID NO: 1669413 - RNA, 19 nt, Human
ggcuggguggcaccagcag

SEQ ID NO: 1669414 - RNA, 19 nt, Human
ggcuggguucuacccaggu

SEQ ID NO: 1669415 - RNA, 21 nt, Human
ggcuggguucuacccaggugc

SEQ ID NO: 1669416 - RNA, 15 nt, Human
ggcugggggccucag

SEQ ID NO: 1669417 - RNA, 16 nt, Human
ggcugggggccucagu

SEQ ID NO: 1669418 - RNA, 17 nt, Human
ggcugggggccucagug

SEQ ID NO: 1669419 - RNA, 19 nt, Human
ggcugggggccucagugcc

SEQ ID NO: 1669420 - RNA, 14 nt, Human
aaaaauaacaauga

SEQ ID NO: 1669421 - RNA, 21 nt, Human
gggagaaccaaaaagaggcua

SEQ ID NO: 1669422 - RNA, 15 nt, Human
gggacuuggaagcuc

SEQ ID NO: 1669423 - RNA, 17 nt, Human
gggacuuggaagcuccg

SEQ ID NO: 1669424 - RNA, 18 nt, Human
gggacuuggaagcuccgc

SEQ ID NO: 1669425 - RNA, 23 nt, Human
gggacuuggaagcuccgcuuucu

SEQ ID NO: 1669426 - RNA, 15 nt, Human
gggaggucgaggcag

SEQ ID NO: 1669427 - RNA, 18 nt, Human
gggaggucaaggcugcag

SEQ ID NO: 1669428 - RNA, 15 nt, Human
gggagggagggcucc

SEQ ID NO: 1669429 - RNA, 16 nt, Human
gggagggagggcucca

SEQ ID NO: 1669430 - RNA, 23 nt, Human
gggagcaggcucgggcuccccag

SEQ ID NO: 1669431 - RNA, 15 nt, Human
gggagagccuuccag

SEQ ID NO: 1669432 - RNA, 19 nt, Human
gggagagccuuccaggggu

SEQ ID NO: 1669433 - RNA, 14 nt, Human
aaaacaugcuacac

SEQ ID NO: 1669434 - RNA, 13 nt, Human
aaaacaugcuaca

SEQ ID NO: 1669435 - RNA, 17 nt, Human
aaaaccaguauuguaca

SEQ ID NO: 1669436 - RNA, 12 nt, Human
aaaacccaagug

SEQ ID NO: 1669437 - RNA, 14 nt, Human
gggaccagagcugc

SEQ ID NO: 1669438 - RNA, 20 nt, Human
gggaccagagcugccaccug

SEQ ID NO: 1669439 - RNA, 19 nt, Human
gggacauuugcucauggaa

SEQ ID NO: 1669440 - RNA, 17 nt, Human
aaaaaugguuuaaaugg

SEQ ID NO: 1669441 - RNA, 18 nt, Human
aaaacucuccucugcugc

SEQ ID NO: 1669442 - RNA, 22 nt, Human
aaaacuugauguguuaucucuu

SEQ ID NO: 1669443 - RNA, 15 nt, Human
aaaacuucagacaua

SEQ ID NO: 1669444 - RNA, 19 nt, Human
ggcucagcggggacagcuc

SEQ ID NO: 1669445 - RNA, 20 nt, Human
ggcucagcggggacagcucc

SEQ ID NO: 1669446 - RNA, 19 nt, Human
ggcucagguggggucacuc

SEQ ID NO: 1669447 - RNA, 20 nt, Human
ggcucagguggggucacucu

SEQ ID NO: 1669448 - RNA, 19 nt, Human
ggcucagcaaaagaugcuu

SEQ ID NO: 1669449 - RNA, 18 nt, Human
ggcucagcggggacagcu

SEQ ID NO: 1669450 - RNA, 14 nt, Human
ggcuccacuugguc

SEQ ID NO: 1669451 - RNA, 22 nt, Human
ggcugcccuggugcugccacac

SEQ ID NO: 1669452 - RNA, 16 nt, Human
ggcugccuuagaaccu

SEQ ID NO: 1669453 - RNA, 22 nt, Human
ggcugcggaaugaaccacaucu

SEQ ID NO: 1669454 - RNA, 14 nt, Human
ggcugcccuggugc

SEQ ID NO: 1669455 - RNA, 15 nt, Human
ggcugcccuggugcu

SEQ ID NO: 1669456 - RNA, 16 nt, Human
ggcugcccuggugcug

SEQ ID NO: 1669457 - RNA, 19 nt, Human
ggcugcccuggugcugcca

SEQ ID NO: 1669458 - RNA, 13 nt, Human
ggcugcccuggug

SEQ ID NO: 1669459 - RNA, 21 nt, Human
ggcugccaaugggagcucaug

SEQ ID NO: 1669460 - RNA, 14 nt, Human
ggcucuucuccuuu

SEQ ID NO: 1669461 - RNA, 15 nt, Human
ggcucuucuccuuuc

SEQ ID NO: 1669462 - RNA, 23 nt, Human
ggcucuucuccuuucacaaccuu

SEQ ID NO: 1669463 - RNA, 22 nt, Human
ggcugacagacagcccuccauc

SEQ ID NO: 1669464 - RNA, 16 nt, Human
ggcucuucuccuuuca

SEQ ID NO: 1669465 - RNA, 19 nt, Human
ggcugccaaugggagcuca

SEQ ID NO: 1669466 - RNA, 20 nt, Human
ggcugccaaugggagcucau

SEQ ID NO: 1669467 - RNA, 12 nt, Human
ggcucuucuccu

SEQ ID NO: 1669468 - RNA, 13 nt, Human
ggcucuucuccuu

SEQ ID NO: 1669469 - RNA, 14 nt, Human
ggcucuuccaggcu

SEQ ID NO: 1669470 - RNA, 12 nt, Human
ggcucuuccagg

SEQ ID NO: 1669471 - RNA, 14 nt, Human
ggcucucaggccag

SEQ ID NO: 1669472 - RNA, 13 nt, Human
ggcucucaggcca

SEQ ID NO: 1669473 - RNA, 11 nt, Human
ggcucucaggc

SEQ ID NO: 1669474 - RNA, 13 nt, Human
ggcugcugaaggc

SEQ ID NO: 1669475 - RNA, 14 nt, Human
ggcugggagagccu

SEQ ID NO: 1669476 - RNA, 15 nt, Human
ggcugggagagccuu

SEQ ID NO: 1669477 - RNA, 16 nt, Human
ggcugggagagccuuc

SEQ ID NO: 1669478 - RNA, 18 nt, Human
ggcugggagagccuucca

SEQ ID NO: 1669479 - RNA, 16 nt, Human
ggcauaacauaaaucu

SEQ ID NO: 1669480 - RNA, 17 nt, Human
ggcauaacauaaaucug

SEQ ID NO: 1669481 - RNA, 20 nt, Human
ggccagugugacaaggauug

SEQ ID NO: 1669482 - RNA, 14 nt, Human
ggccaguugguccc

SEQ ID NO: 1669483 - RNA, 17 nt, Human
ggccaguuggucccccu

SEQ ID NO: 1669484 - RNA, 15 nt, Human
ggcccggcuccaggc

SEQ ID NO: 1669485 - RNA, 20 nt, Human
ggcccuucucuccagccccu

SEQ ID NO: 1669486 - RNA, 21 nt, Human
ggcccuucucuccagccccug

SEQ ID NO: 1669487 - RNA, 13 nt, Human
ggccccugcuggu

SEQ ID NO: 1669488 - RNA, 14 nt, Human
ggccccugcugguu

SEQ ID NO: 1669489 - RNA, 13 nt, Human
ggcccggcuccag

SEQ ID NO: 1669490 - RNA, 23 nt, Human
ggccccugcugguucaggguugg

SEQ ID NO: 1669491 - RNA, 19 nt, Human
ggccucacuaggcuucugg

SEQ ID NO: 1669492 - RNA, 22 nt, Human
ggcccuucucuccagccccugg

SEQ ID NO: 1669493 - RNA, 23 nt, Human
ggcccuucucuccagccccugga

SEQ ID NO: 1669494 - RNA, 14 nt, Human
ggccuccauccuga

SEQ ID NO: 1669495 - RNA, 15 nt, Human
ggccuccauccugag

SEQ ID NO: 1669496 - RNA, 16 nt, Human
ggccuccauccugagg

SEQ ID NO: 1669497 - RNA, 15 nt, Human
ggcacugguggcccg

SEQ ID NO: 1669498 - RNA, 11 nt, Human
ggcagccccug

SEQ ID NO: 1669499 - RNA, 20 nt, Human
ggcacagaaaauggaagaca

SEQ ID NO: 1669500 - RNA, 21 nt, Human
ggcacagaaaauggaagacag

SEQ ID NO: 1669501 - RNA, 19 nt, Human
ggcacagaaaauggaagac

SEQ ID NO: 1669502 - RNA, 13 nt, Human
ggcacaucagcac

SEQ ID NO: 1669503 - RNA, 23 nt, Human
ggcacucagaagacacugauggg

SEQ ID NO: 1669504 - RNA, 23 nt, Human
ggcacagaaaauggaagacagcu

SEQ ID NO: 1669505 - RNA, 21 nt, Human
ggcacaguuuucugagaaaga

SEQ ID NO: 1669506 - RNA, 22 nt, Human
ggagacugcugagucaacccaa

SEQ ID NO: 1669507 - RNA, 16 nt, Human
ggagagaagagaaugc

SEQ ID NO: 1669508 - RNA, 22 nt, Human
ggcagccccuguucuggcagag

SEQ ID NO: 1669509 - RNA, 21 nt, Human
ggcaguggugguuuucuguuc

SEQ ID NO: 1669510 - RNA, 20 nt, Human
ggcaguggugguuuucuguu

SEQ ID NO: 1669511 - RNA, 16 nt, Human
gcuaaucagcauucuc

SEQ ID NO: 1669512 - RNA, 17 nt, Human
gcuaaucagcauucuca

SEQ ID NO: 1669513 - RNA, 22 nt, Human
gcuaaucagcauucucacuccu

SEQ ID NO: 1669514 - RNA, 14 nt, Human
gcuaaucagcauuc

SEQ ID NO: 1669515 - RNA, 23 nt, Human
gcuaagugauccucccaccucag

SEQ ID NO: 1669516 - RNA, 15 nt, Human
gcuaaugggacacua

SEQ ID NO: 1669517 - RNA, 13 nt, Human
gcuaaugggacac

SEQ ID NO: 1669518 - RNA, 18 nt, Human
gcguuucuaugacacaug

SEQ ID NO: 1669519 - RNA, 23 nt, Human
gcgugcacacaccagagcccacc

SEQ ID NO: 1669520 - RNA, 21 nt, Human
gcgggaggauguucugggaca

SEQ ID NO: 1669521 - RNA, 22 nt, Human
gcgggaggauguucugggacac

SEQ ID NO: 1669522 - RNA, 20 nt, Human
gcgugcacacaccagagccc

SEQ ID NO: 1669523 - RNA, 20 nt, Human
gcgggaggauguucugggac

SEQ ID NO: 1669524 - RNA, 16 nt, Human
gcuagaacucccuuuc

SEQ ID NO: 1669525 - RNA, 18 nt, Human
gcuagaacucccuuucaa

SEQ ID NO: 1669526 - RNA, 12 nt, Human
gcuagaacuccc

SEQ ID NO: 1669527 - RNA, 13 nt, Human
gcuagaacucccu

SEQ ID NO: 1669528 - RNA, 14 nt, Human
gcuagaacucccuu

SEQ ID NO: 1669529 - RNA, 15 nt, Human
gcuagaacucccuuu

SEQ ID NO: 1669530 - RNA, 16 nt, Human
gcucacugcauccucc

SEQ ID NO: 1669531 - RNA, 17 nt, Human
gcucacugcagccucaa

SEQ ID NO: 1669532 - RNA, 15 nt, Human
gcucacugcagccuc

SEQ ID NO: 1669533 - RNA, 16 nt, Human
gcucacugcagccuca

SEQ ID NO: 1669534 - RNA, 11 nt, Human
gcucacugcag

SEQ ID NO: 1669535 - RNA, 12 nt, Human
gcucacugcagc

SEQ ID NO: 1669536 - RNA, 13 nt, Human
gcucacugcagcc

SEQ ID NO: 1669537 - RNA, 14 nt, Human
gcucacugcagccu

SEQ ID NO: 1669538 - RNA, 20 nt, Human
gcuauucaguaauaacucua

SEQ ID NO: 1669539 - RNA, 14 nt, Human
gcucagagagggug

SEQ ID NO: 1669540 - RNA, 20 nt, Human
gcucacugcauccuccgccu

SEQ ID NO: 1669541 - RNA, 13 nt, Human
gcucagagagggu

SEQ ID NO: 1669542 - RNA, 23 nt, Human
gcucagguggggucacucuggca

SEQ ID NO: 1669543 - RNA, 14 nt, Human
gcucaggugucccu

SEQ ID NO: 1669544 - RNA, 16 nt, Human
gcucaggugucccugc

SEQ ID NO: 1669545 - RNA, 17 nt, Human
gcucaggugucccugca

SEQ ID NO: 1669546 - RNA, 13 nt, Human
gcuaugcauuuga

SEQ ID NO: 1669547 - RNA, 19 nt, Human
gcuauucaguaauaacucu

SEQ ID NO: 1669548 - RNA, 12 nt, Human
gcuaugcauuug

SEQ ID NO: 1669549 - RNA, 21 nt, Human
gcuagugugguguuuccuggc

SEQ ID NO: 1669550 - RNA, 22 nt, Human
gcuagugugguguuuccuggca

SEQ ID NO: 1669551 - RNA, 17 nt, Human
gcuaggccuggccagau

SEQ ID NO: 1669552 - RNA, 23 nt, Human
gcuaggccuggccagaugcacca

SEQ ID NO: 1669553 - RNA, 16 nt, Human
gcuaggccuggccaga

SEQ ID NO: 1669554 - RNA, 22 nt, Human
gcucccacaggcccuuccucuc

SEQ ID NO: 1669555 - RNA, 17 nt, Human
gcucccaggcauucccc

SEQ ID NO: 1669556 - RNA, 16 nt, Human
gcucccacaggcccuu

SEQ ID NO: 1669557 - RNA, 17 nt, Human
gcucccacaggcccuuc

SEQ ID NO: 1669558 - RNA, 20 nt, Human
gcucccacaggcccuuccuc

SEQ ID NO: 1669559 - RNA, 21 nt, Human
gcucccacaggcccuuccucu

SEQ ID NO: 1669560 - RNA, 20 nt, Human
gcuccagcucaccagcccca

SEQ ID NO: 1669561 - RNA, 21 nt, Human
gcuccagcucaccagccccag

SEQ ID NO: 1669562 - RNA, 18 nt, Human
gcuccagcucaccagccc

SEQ ID NO: 1669563 - RNA, 18 nt, Human
gcuccacuuggucuguga

SEQ ID NO: 1669564 - RNA, 19 nt, Human
gcuccacuuggucugugag

SEQ ID NO: 1669565 - RNA, 21 nt, Human
gcuccugccaccacgcccggc

SEQ ID NO: 1669566 - RNA, 14 nt, Human
gcuccuggcccacu

SEQ ID NO: 1669567 - RNA, 15 nt, Human
gcuccuggcccacug

SEQ ID NO: 1669568 - RNA, 20 nt, Human
gcuccuggcccacugcaucg

SEQ ID NO: 1669569 - RNA, 18 nt, Human
gcuccuggcccacugcau

SEQ ID NO: 1669570 - RNA, 19 nt, Human
gcuccuggcccacugcauc

SEQ ID NO: 1669571 - RNA, 12 nt, Human
gcuccugccacc

SEQ ID NO: 1669572 - RNA, 18 nt, Human
gcuccugccaccacgccc

SEQ ID NO: 1669573 - RNA, 21 nt, Human
gcuccccucggagaagagcug

SEQ ID NO: 1669574 - RNA, 15 nt, Human
gcuccacuuggucug

SEQ ID NO: 1669575 - RNA, 23 nt, Human
gcucugcaagaauugaagcagga

SEQ ID NO: 1669576 - RNA, 17 nt, Human
gcucugaucauccacug

SEQ ID NO: 1669577 - RNA, 11 nt, Human
gcucugcccuu

SEQ ID NO: 1669578 - RNA, 22 nt, Human
gcgaucuggguucacugcaacc

SEQ ID NO: 1669579 - RNA, 20 nt, Human
gcgcagcauauucaggaagc

SEQ ID NO: 1669580 - RNA, 17 nt, Human
gcgagcccugguggcag

SEQ ID NO: 1669581 - RNA, 15 nt, Human
gcgagcccugguggc

SEQ ID NO: 1669582 - RNA, 17 nt, Human
gccuugaccauucucca

SEQ ID NO: 1669583 - RNA, 19 nt, Human
gccuugaccauucuccacc

SEQ ID NO: 1669584 - RNA, 20 nt, Human
gccuugaccauucuccaccu

SEQ ID NO: 1669585 - RNA, 21 nt, Human
gccuugaccauucuccaccug

SEQ ID NO: 1669586 - RNA, 21 nt, Human
gccuucggccuccauccugag

SEQ ID NO: 1669587 - RNA, 23 nt, Human
gccuucggccuccauccugaggc

SEQ ID NO: 1669588 - RNA, 21 nt, Human
gccuguugggccaggagccuc

SEQ ID NO: 1669589 - RNA, 20 nt, Human
gccuucggccuccauccuga

SEQ ID NO: 1669590 - RNA, 18 nt, Human
gccugugccucugggacu

SEQ ID NO: 1669591 - RNA, 13 nt, Human
gccuggcucaggu

SEQ ID NO: 1669592 - RNA, 16 nt, Human
gccugugccucuggga

SEQ ID NO: 1669593 - RNA, 17 nt, Human
gccugugccucugggac

SEQ ID NO: 1669594 - RNA, 19 nt, Human
gccuguucccauucuugca

SEQ ID NO: 1669595 - RNA, 23 nt, Human
gccuguucccauucuugcauggc

SEQ ID NO: 1669596 - RNA, 14 nt, Human
gccuguugggccag

SEQ ID NO: 1669597 - RNA, 15 nt, Human
gccuguugggccagg

SEQ ID NO: 1669598 - RNA, 16 nt, Human
gccuguugggccagga

SEQ ID NO: 1669599 - RNA, 18 nt, Human
gccuguugggccaggagc

SEQ ID NO: 1669600 - RNA, 20 nt, Human
gccuguugggccaggagccu

SEQ ID NO: 1669601 - RNA, 20 nt, Human
gccuggccugagcugggaug

SEQ ID NO: 1669602 - RNA, 14 nt, Human
gccuggccugagcu

SEQ ID NO: 1669603 - RNA, 18 nt, Human
gccuggccugagcuggga

SEQ ID NO: 1669604 - RNA, 13 nt, Human
gccuggccugagc

SEQ ID NO: 1669605 - RNA, 14 nt, Human
gccucuuggguuca

SEQ ID NO: 1669606 - RNA, 21 nt, Human
gccucuuaugggcuggguucu

SEQ ID NO: 1669607 - RNA, 13 nt, Human
gccugcccaggcc

SEQ ID NO: 1669608 - RNA, 14 nt, Human
gccugcccaggccc

SEQ ID NO: 1669609 - RNA, 20 nt, Human
gccucgaacuggcugcaaag

SEQ ID NO: 1669610 - RNA, 22 nt, Human
gccucgaacuggcugcaaaggg

SEQ ID NO: 1669611 - RNA, 17 nt, Human
gccucuuaugggcuggg

SEQ ID NO: 1669612 - RNA, 18 nt, Human
gccucuuaugggcugggu

SEQ ID NO: 1669613 - RNA, 16 nt, Human
gccucuuaugggcugg

SEQ ID NO: 1669614 - RNA, 15 nt, Human
gccucuuagaugcag

SEQ ID NO: 1669615 - RNA, 17 nt, Human
gccucgaacuggcugca

SEQ ID NO: 1669616 - RNA, 19 nt, Human
gccuccugugugugcgccu

SEQ ID NO: 1669617 - RNA, 23 nt, Human
gccuccugugugugcgccuacag

SEQ ID NO: 1669618 - RNA, 16 nt, Human
gccucccaaagugcug

SEQ ID NO: 1669619 - RNA, 17 nt, Human
gccucccaaagugcugg

SEQ ID NO: 1669620 - RNA, 12 nt, Human
gccuccauccug

SEQ ID NO: 1669621 - RNA, 22 nt, Human
gccugcccaggccccugccacc

SEQ ID NO: 1669622 - RNA, 15 nt, Human
gccugcccaggcccc

SEQ ID NO: 1669623 - RNA, 17 nt, Human
gccugcccaggccccug

SEQ ID NO: 1669624 - RNA, 22 nt, Human
gcccuuagcagggaaacagcua

SEQ ID NO: 1669625 - RNA, 20 nt, Human
gccgcagcccugcagagggc

SEQ ID NO: 1669626 - RNA, 22 nt, Human
gcccuguccugccuaaggcuga

SEQ ID NO: 1669627 - RNA, 20 nt, Human
gcccuuagcagggaaacagc

SEQ ID NO: 1669628 - RNA, 18 nt, Human
gcccugcccugguuuccu

SEQ ID NO: 1669629 - RNA, 14 nt, Human
gcccugccuccuuu

SEQ ID NO: 1669630 - RNA, 12 nt, Human
gcccugccuccu

SEQ ID NO: 1669631 - RNA, 13 nt, Human
gcccugccuccuu

SEQ ID NO: 1669632 - RNA, 11 nt, Human
gcccugcccug

SEQ ID NO: 1669633 - RNA, 12 nt, Human
gcccugcccugg

SEQ ID NO: 1669634 - RNA, 16 nt, Human
gcccugcccugguuuc

SEQ ID NO: 1669635 - RNA, 11 nt, Human
gcccugccucc

SEQ ID NO: 1669636 - RNA, 17 nt, Human
gcccugcccaccuggcc

SEQ ID NO: 1669637 - RNA, 20 nt, Human
gcccugcccaccuggccucu

SEQ ID NO: 1669638 - RNA, 21 nt, Human
gcccugcccaccuggccucug

SEQ ID NO: 1669639 - RNA, 22 nt, Human
gcccugcccaccuggccucugc

SEQ ID NO: 1669640 - RNA, 18 nt, Human
gcccugcagagggcacag

SEQ ID NO: 1669641 - RNA, 23 nt, Human
gccuagcauacguacacauuuua

SEQ ID NO: 1669642 - RNA, 22 nt, Human
gccuagcauacguacacauuuu

SEQ ID NO: 1669643 - RNA, 21 nt, Human
gccuagcauacguacacauuu

SEQ ID NO: 1669644 - RNA, 20 nt, Human
gccuagcauacguacacauu

SEQ ID NO: 1669645 - RNA, 13 nt, Human
gccuaggugacag

SEQ ID NO: 1669646 - RNA, 14 nt, Human
gccuaggugacaga

SEQ ID NO: 1669647 - RNA, 15 nt, Human
gccuaggugacagag

SEQ ID NO: 1669648 - RNA, 20 nt, Human
gccuaggugacagagugaga

SEQ ID NO: 1669649 - RNA, 20 nt, Human
gccccugccucucugcaggu

SEQ ID NO: 1669650 - RNA, 23 nt, Human
gccccugccucucugcagguccc

SEQ ID NO: 1669651 - RNA, 23 nt, Human
gcccgggcucugccucccaucac

SEQ ID NO: 1669652 - RNA, 16 nt, Human
gcccuaaugcgcaggc

SEQ ID NO: 1669653 - RNA, 17 nt, Human
gcccuaaugcgcaggcu

SEQ ID NO: 1669654 - RNA, 19 nt, Human
gcccuaaugcgcaggcugg

SEQ ID NO: 1669655 - RNA, 20 nt, Human
gcccuaaugcgcaggcuggc

SEQ ID NO: 1669656 - RNA, 23 nt, Human
gcccuaaugcgcaggcuggcccu

SEQ ID NO: 1669657 - RNA, 15 nt, Human
gcccucacccugggg

SEQ ID NO: 1669658 - RNA, 17 nt, Human
gccccugccacccuggg

SEQ ID NO: 1669659 - RNA, 16 nt, Human
gccccugccacccugg

SEQ ID NO: 1669660 - RNA, 12 nt, Human
gcccccacuggu

SEQ ID NO: 1669661 - RNA, 12 nt, Human
ggacccugaggc

SEQ ID NO: 1669662 - RNA, 13 nt, Human
ggacccugaggcc

SEQ ID NO: 1669663 - RNA, 13 nt, Human
ggaccucaggccu

SEQ ID NO: 1669664 - RNA, 20 nt, Human
ggaccucaggccugggggcu

SEQ ID NO: 1669665 - RNA, 14 nt, Human
ggaccucaggccug

SEQ ID NO: 1669666 - RNA, 15 nt, Human
ggaccucaggccugg

SEQ ID NO: 1669667 - RNA, 20 nt, Human
ggacguguuaugacuccaga

SEQ ID NO: 1669668 - RNA, 11 nt, Human
ggacccugagg

SEQ ID NO: 1669669 - RNA, 12 nt, Human
ggacccccugaa

SEQ ID NO: 1669670 - RNA, 22 nt, Human
ggacuucuuuaauuuuggaauu

SEQ ID NO: 1669671 - RNA, 21 nt, Human
ggacuucuuuaauuuuggaau

SEQ ID NO: 1669672 - RNA, 18 nt, Human
ggacuucuuuaauuuugg

SEQ ID NO: 1669673 - RNA, 15 nt, Human
ggacuuguuagaucu

SEQ ID NO: 1669674 - RNA, 14 nt, Human
ggacuuggaagcuc

SEQ ID NO: 1669675 - RNA, 18 nt, Human
ggagaaaugaaaaaauau

SEQ ID NO: 1669676 - RNA, 9 nt, Human
ggacuuugu

SEQ ID NO: 1669677 - RNA, 16 nt, Human
ggagaaaggaagggcu

SEQ ID NO: 1669678 - RNA, 13 nt, Human
ggagaaacuggaa

SEQ ID NO: 1669679 - RNA, 15 nt, Human
ggacucaaugcacug

SEQ ID NO: 1669680 - RNA, 24 nt, Human
ggacuaacuugucuuuggacccug

SEQ ID NO: 1669681 - RNA, 14 nt, Human
ggacuacaggugug

SEQ ID NO: 1669682 - RNA, 20 nt, Human
ggacuaacuugucuuuggac

SEQ ID NO: 1669683 - RNA, 16 nt, Human
ggacucaaugcacuga

SEQ ID NO: 1669684 - RNA, 18 nt, Human
ggacucaaugcacugaca

SEQ ID NO: 1669685 - RNA, 22 nt, Human
ggacucauuuuaaaaaauggaa

SEQ ID NO: 1669686 - RNA, 23 nt, Human
ggacaggcauguucucugaggac

SEQ ID NO: 1669687 - RNA, 18 nt, Human
ggaaugaagcaaugcuuc

SEQ ID NO: 1669688 - RNA, 19 nt, Human
ggaaugaagauacugaaau

SEQ ID NO: 1669689 - RNA, 13 nt, Human
ggacaagagcagg

SEQ ID NO: 1669690 - RNA, 22 nt, Human
ggacaaggaugaucuaggaaga

SEQ ID NO: 1669691 - RNA, 23 nt, Human
ggacaaggaugaucuaggaagac

SEQ ID NO: 1669692 - RNA, 16 nt, Human
ggaauccagacccggc

SEQ ID NO: 1669693 - RNA, 18 nt, Human
ggaauaacauguaauuaa

SEQ ID NO: 1669694 - RNA, 19 nt, Human
ggacaaggacuaggguccu

SEQ ID NO: 1669695 - RNA, 21 nt, Human
ggacacagcucuucuccaggc

SEQ ID NO: 1669696 - RNA, 15 nt, Human
ggacacagcucuucu

SEQ ID NO: 1669697 - RNA, 18 nt, Human
ggacacagcucuucucca

SEQ ID NO: 1669698 - RNA, 17 nt, Human
ggacacuaaccacgcug

SEQ ID NO: 1669699 - RNA, 22 nt, Human
ggacacuaaccacgcuggaccu

SEQ ID NO: 1669700 - RNA, 19 nt, Human
ggacagcuccuucuguccu

SEQ ID NO: 1669701 - RNA, 20 nt, Human
ggacagcuccuucuguccua

SEQ ID NO: 1669702 - RNA, 19 nt, Human
ggaaggaaacccagcucug

SEQ ID NO: 1669703 - RNA, 20 nt, Human
ggaaggaaacccagcucugg

SEQ ID NO: 1669704 - RNA, 16 nt, Human
ggaaggaaacccagcu

SEQ ID NO: 1669705 - RNA, 11 nt, Human
ggaagcuccgc

SEQ ID NO: 1669706 - RNA, 15 nt, Human
ggaagcucagggccu

SEQ ID NO: 1669707 - RNA, 23 nt, Human
ggaagcucagggccuggcucagg

SEQ ID NO: 1669708 - RNA, 15 nt, Human
ggaagccgcuggggc

SEQ ID NO: 1669709 - RNA, 13 nt, Human
ggaagacuuugga

SEQ ID NO: 1669710 - RNA, 17 nt, Human
ggaagacuuuggaaaga

SEQ ID NO: 1669711 - RNA, 13 nt, Human
ggaagacagcucu

SEQ ID NO: 1669712 - RNA, 14 nt, Human
ggaagacagcucuu

SEQ ID NO: 1669713 - RNA, 15 nt, Human
ggaagagaaaaaaua

SEQ ID NO: 1669714 - RNA, 18 nt, Human
ggaagacuuuggaaagag

SEQ ID NO: 1669715 - RNA, 13 nt, Human
ggaagagaaaaaa

SEQ ID NO: 1669716 - RNA, 17 nt, Human
ggaacagacuggaagca

SEQ ID NO: 1669717 - RNA, 15 nt, Human
ggaacacucugagac

SEQ ID NO: 1669718 - RNA, 16 nt, Human
ggaacacucugagacu

SEQ ID NO: 1669719 - RNA, 12 nt, Human
ggaacacucuga

SEQ ID NO: 1669720 - RNA, 14 nt, Human
ggaacacucugaga

SEQ ID NO: 1669721 - RNA, 13 nt, Human
gcucugcccuugg

SEQ ID NO: 1669722 - RNA, 15 nt, Human
gcucugguccauaga

SEQ ID NO: 1669723 - RNA, 16 nt, Human
gcucugguccauagag

SEQ ID NO: 1669724 - RNA, 23 nt, Human
gcucugguccauagagagcaaga

SEQ ID NO: 1669725 - RNA, 13 nt, Human
gcugcugaaggcu

SEQ ID NO: 1669726 - RNA, 14 nt, Human
gcugcugaaggcuc

SEQ ID NO: 1669727 - RNA, 15 nt, Human
gcugcugaaggcucg

SEQ ID NO: 1669728 - RNA, 18 nt, Human
gcugcugaaggcucgagc

SEQ ID NO: 1669729 - RNA, 13 nt, Human
gcugcuggcuggu

SEQ ID NO: 1669730 - RNA, 18 nt, Human
gcuggagugcagugagcc

SEQ ID NO: 1669731 - RNA, 17 nt, Human
gcuggagugcagugagc

SEQ ID NO: 1669732 - RNA, 22 nt, Human
gcuggagugcagugagccgaga

SEQ ID NO: 1669733 - RNA, 20 nt, Human
gcuggccuggccccucaggg

SEQ ID NO: 1669734 - RNA, 21 nt, Human
gcugggccccugccucucugc

SEQ ID NO: 1669735 - RNA, 22 nt, Human
gcugggccccugccucucugca

SEQ ID NO: 1669736 - RNA, 23 nt, Human
gcugggccccugccucucugcag

SEQ ID NO: 1669737 - RNA, 12 nt, Human
gcugggucgccc

SEQ ID NO: 1669738 - RNA, 22 nt, Human
gcugggguuaucugaagucaga

SEQ ID NO: 1669739 - RNA, 23 nt, Human
gcugggguuaucugaagucagau

SEQ ID NO: 1669740 - RNA, 14 nt, Human
gcugggguuaucug

SEQ ID NO: 1669741 - RNA, 12 nt, Human
gcugggcucccu

SEQ ID NO: 1669742 - RNA, 15 nt, Human
gcuggcuguuggcug

SEQ ID NO: 1669743 - RNA, 16 nt, Human
gcuggcuguuggcugg

SEQ ID NO: 1669744 - RNA, 17 nt, Human
gcuggcuguuggcuggg

SEQ ID NO: 1669745 - RNA, 21 nt, Human
gcuggguggcaccagcagccu

SEQ ID NO: 1669746 - RNA, 22 nt, Human
gcuggguggcaccagcagccug

SEQ ID NO: 1669747 - RNA, 23 nt, Human
gcuggguggcaccagcagccugg

SEQ ID NO: 1669748 - RNA, 19 nt, Human
gcuucacggaagagccuug

SEQ ID NO: 1669749 - RNA, 18 nt, Human
gcuucacggaagagccuu

SEQ ID NO: 1669750 - RNA, 12 nt, Human
gcuucagccucc

SEQ ID NO: 1669751 - RNA, 19 nt, Human
gcuucaaggauccugagcc

SEQ ID NO: 1669752 - RNA, 20 nt, Human
gcuucaaggauccugagcca

SEQ ID NO: 1669753 - RNA, 21 nt, Human
gcuucaaggauccugagccag

SEQ ID NO: 1669754 - RNA, 17 nt, Human
gcuucacggaagagccu

SEQ ID NO: 1669755 - RNA, 15 nt, Human
gcuucacggaagagc

SEQ ID NO: 1669756 - RNA, 12 nt, Human
gcuuguacauaa

SEQ ID NO: 1669757 - RNA, 14 nt, Human
gcuugagcucagga

SEQ ID NO: 1669758 - RNA, 20 nt, Human
gcuuguaaauagcucaggug

SEQ ID NO: 1669759 - RNA, 22 nt, Human
gcuuccucauaguaugguggcu

SEQ ID NO: 1669760 - RNA, 22 nt, Human
auuuguaguguuggagaagaac

SEQ ID NO: 1669761 - RNA, 14 nt, Human
auuuguauaaaaua

SEQ ID NO: 1669762 - RNA, 15 nt, Human
auuuguauaaaauaa

SEQ ID NO: 1669763 - RNA, 23 nt, Human
auuuuaaaagaaugauuaugaau

SEQ ID NO: 1669764 - RNA, 18 nt, Human
auuugugaagguggaaau

SEQ ID NO: 1669765 - RNA, 21 nt, Human
auuugugaagguggaaauaaa

SEQ ID NO: 1669766 - RNA, 23 nt, Human
auuugugaaaugauggugaaagu

SEQ ID NO: 1669767 - RNA, 23 nt, Human
auuugugaagguggaaauaaacu

SEQ ID NO: 1669768 - RNA, 22 nt, Human
auuuuaaaaauacagauagaua

SEQ ID NO: 1669769 - RNA, 16 nt, Human
auuuuaaaagaaugau

SEQ ID NO: 1669770 - RNA, 17 nt, Human
auuucuaggacugaauu

SEQ ID NO: 1669771 - RNA, 18 nt, Human
auuucuaggacugaauua

SEQ ID NO: 1669772 - RNA, 20 nt, Human
auuucuaggacugaauuaug

SEQ ID NO: 1669773 - RNA, 23 nt, Human
auuucuaggacugaauuaugaaa

SEQ ID NO: 1669774 - RNA, 20 nt, Human
auuucuuccacaagagccca

SEQ ID NO: 1669775 - RNA, 23 nt, Human
auuucuuccacaagagcccaggc

SEQ ID NO: 1669776 - RNA, 16 nt, Human
auuugacauagucugg

SEQ ID NO: 1669777 - RNA, 17 nt, Human
auuugacauagucuggc

SEQ ID NO: 1669778 - RNA, 21 nt, Human
auuugacauagucuggcugua

SEQ ID NO: 1669779 - RNA, 18 nt, Human
auuugaaacacuuugcau

SEQ ID NO: 1669780 - RNA, 16 nt, Human
auuugaaaauuuugau

SEQ ID NO: 1669781 - RNA, 20 nt, Human
auuucuugagguaaaagcau

SEQ ID NO: 1669782 - RNA, 19 nt, Human
auuucccaaagcagugcau

SEQ ID NO: 1669783 - RNA, 12 nt, Human
auuuauuuaaau

SEQ ID NO: 1669784 - RNA, 14 nt, Human
auuuauuuaaauuu

SEQ ID NO: 1669785 - RNA, 14 nt, Human
auuuauuuuaauaa

SEQ ID NO: 1669786 - RNA, 21 nt, Human
auuguuuggggaugagaaagg

SEQ ID NO: 1669787 - RNA, 17 nt, Human
auuuaaaagauacaguu

SEQ ID NO: 1669788 - RNA, 16 nt, Human
auuuaaaagauacagu

SEQ ID NO: 1669789 - RNA, 14 nt, Human
auuuaaaagauaca

SEQ ID NO: 1669790 - RNA, 14 nt, Human
auugugggaagggg

SEQ ID NO: 1669791 - RNA, 13 nt, Human
auugugggaaggg

SEQ ID NO: 1669792 - RNA, 13 nt, Human
auugucuagugaa

SEQ ID NO: 1669793 - RNA, 23 nt, Human
auugucaaaguggugagaggcau

SEQ ID NO: 1669794 - RNA, 16 nt, Human
auugucaaagugguga

SEQ ID NO: 1669795 - RNA, 13 nt, Human
auuggcuuuucug

SEQ ID NO: 1669796 - RNA, 15 nt, Human
auuggcuuuucugau

SEQ ID NO: 1669797 - RNA, 16 nt, Human
auuggcuuuucugauc

SEQ ID NO: 1669798 - RNA, 19 nt, Human
auuggcuuuucugauccag

SEQ ID NO: 1669799 - RNA, 20 nt, Human
auuggcuuuucugauccagu

SEQ ID NO: 1669800 - RNA, 18 nt, Human
auugguaaagaauggaag

SEQ ID NO: 1669801 - RNA, 15 nt, Human
auugguucuuguauu

SEQ ID NO: 1669802 - RNA, 16 nt, Human
auugguucuuguauua

SEQ ID NO: 1669803 - RNA, 19 nt, Human
auuggacaguaaaauccac

SEQ ID NO: 1669804 - RNA, 19 nt, Human
auuggagcucgugggacag

SEQ ID NO: 1669805 - RNA, 13 nt, Human
auugacuuuuuau

SEQ ID NO: 1669806 - RNA, 18 nt, Human
auugacuuuuuauggcac

SEQ ID NO: 1669807 - RNA, 21 nt, Human
auugauuuccguuaaaauacc

SEQ ID NO: 1669808 - RNA, 18 nt, Human
auuuugccagugggaacu

SEQ ID NO: 1669809 - RNA, 21 nt, Human
auuuugcugucccuuuuccuu

SEQ ID NO: 1669810 - RNA, 20 nt, Human
auuuugcuaaaugugaauga

SEQ ID NO: 1669811 - RNA, 19 nt, Human
auuuugauccaagcugguc

SEQ ID NO: 1669812 - RNA, 17 nt, Human
auuuugauguuuuaagg

SEQ ID NO: 1669813 - RNA, 15 nt, Human
auuuugauguuuuaa

SEQ ID NO: 1669814 - RNA, 15 nt, Human
auuuuaauaaacacu

SEQ ID NO: 1669815 - RNA, 16 nt, Human
auuuuaauaaacacuc

SEQ ID NO: 1669816 - RNA, 17 nt, Human
auuuuaauaaacacucu

SEQ ID NO: 1669817 - RNA, 12 nt, Human
auuuuaauaaug

SEQ ID NO: 1669818 - RNA, 15 nt, Human
auuuucuauaauuua

SEQ ID NO: 1669819 - RNA, 14 nt, Human
auuuucuauaauuu

SEQ ID NO: 1669820 - RNA, 16 nt, Human
auuuuccugccaggca

SEQ ID NO: 1669821 - RNA, 19 nt, Human
auuuucccuauuagagaag

SEQ ID NO: 1669822 - RNA, 14 nt, Human
auuuuccugaaaac

SEQ ID NO: 1669823 - RNA, 20 nt, Human
auuuugcuuugugauuuuug

SEQ ID NO: 1669824 - RNA, 18 nt, Human
auuuugcuuugugauuuu

SEQ ID NO: 1669825 - RNA, 12 nt, Human
auuuugcuuugu

SEQ ID NO: 1669826 - RNA, 12 nt, Human
auuuuggaauuu

SEQ ID NO: 1669827 - RNA, 20 nt, Human
auuuuggaaaauaaauuauu

SEQ ID NO: 1669828 - RNA, 14 nt, Human
auuuuggaaaauaa

SEQ ID NO: 1669829 - RNA, 19 nt, Human
auuuuggaaaauaaauuau

SEQ ID NO: 1669830 - RNA, 19 nt, Human
auuuugugcccccauguaa

SEQ ID NO: 1669831 - RNA, 23 nt, Human
auuuugucauauaagauucauau

SEQ ID NO: 1669832 - RNA, 11 nt, Human
auuuuguuucu

SEQ ID NO: 1669833 - RNA, 16 nt, Human
auuuuguuucagugca

SEQ ID NO: 1669834 - RNA, 17 nt, Human
auuuuguguuuaggaac

SEQ ID NO: 1669835 - RNA, 14 nt, Human
auuuuguuucugua

SEQ ID NO: 1669836 - RNA, 15 nt, Human
auuuuguuucuguac

SEQ ID NO: 1669837 - RNA, 21 nt, Human
auuuuguuuuugucuuaaaaa

SEQ ID NO: 1669838 - RNA, 21 nt, Human
auuuuucuuagggaaggauac

SEQ ID NO: 1669839 - RNA, 22 nt, Human
auuuuucuuagggaaggauaca

SEQ ID NO: 1669840 - RNA, 15 nt, Human
auuuuucuuauuuca

SEQ ID NO: 1669841 - RNA, 19 nt, Human
auuuuucuuauuucauuuc

SEQ ID NO: 1669842 - RNA, 20 nt, Human
auuuuucuuauuucauuucu

SEQ ID NO: 1669843 - RNA, 19 nt, Human
auuuuuuacagcugccugc

SEQ ID NO: 1669844 - RNA, 20 nt, Human
auuuuuucucuaggaaauau

SEQ ID NO: 1669845 - RNA, 23 nt, Human
auuuuuucucuaggaaauauuua

SEQ ID NO: 1669846 - RNA, 18 nt, Human
auuuuuuguuaaaugauu

SEQ ID NO: 1669847 - RNA, 18 nt, Human
auuuuuuaaauugaauuc

SEQ ID NO: 1669848 - RNA, 14 nt, Human
auuuuuuaaaugca

SEQ ID NO: 1669849 - RNA, 13 nt, Human
auuuuuuaaaugc

SEQ ID NO: 1669850 - RNA, 21 nt, Human
auuuuuguuuucauuaucuca

SEQ ID NO: 1669851 - RNA, 22 nt, Human
auuuuugugauuuugugauuga

SEQ ID NO: 1669852 - RNA, 12 nt, Human
auuuuuguaauu

SEQ ID NO: 1669853 - RNA, 19 nt, Human
auuuuuguagagccagggu

SEQ ID NO: 1669854 - RNA, 13 nt, Human
auucuuccucccu

SEQ ID NO: 1669855 - RNA, 21 nt, Human
auucuuaaaguugaauuuauu

SEQ ID NO: 1669856 - RNA, 15 nt, Human
auucuguauagauua

SEQ ID NO: 1669857 - RNA, 19 nt, Human
auucuuaaaguugaauuua

SEQ ID NO: 1669858 - RNA, 20 nt, Human
auucuuaaaguugaauuuau

SEQ ID NO: 1669859 - RNA, 14 nt, Human
auucuuaaauaugu

SEQ ID NO: 1669860 - RNA, 15 nt, Human
auugaaaaaccauuu

SEQ ID NO: 1669861 - RNA, 20 nt, Human
auugaaaucuuuuugcuuug

SEQ ID NO: 1669862 - RNA, 17 nt, Human
auugaaaucuuuuugcu

SEQ ID NO: 1669863 - RNA, 18 nt, Human
auugaaaucuuuuugcuu

SEQ ID NO: 1669864 - RNA, 15 nt, Human
auugacacuuaaaaa

SEQ ID NO: 1669865 - RNA, 17 nt, Human
auugacacuuaaaaaug

SEQ ID NO: 1669866 - RNA, 22 nt, Human
auugaagcauuuuauaaaucgc

SEQ ID NO: 1669867 - RNA, 11 nt, Human
auugacuucuu

SEQ ID NO: 1669868 - RNA, 19 nt, Human
auugacacuuaaaaauggu

SEQ ID NO: 1669869 - RNA, 11 nt, Human
auucuguauag

SEQ ID NO: 1669870 - RNA, 12 nt, Human
auucuguauaga

SEQ ID NO: 1669871 - RNA, 13 nt, Human
auucuguauagau

SEQ ID NO: 1669872 - RNA, 14 nt, Human
auucuguuggccag

SEQ ID NO: 1669873 - RNA, 19 nt, Human
auucuguuggccaguguga

SEQ ID NO: 1669874 - RNA, 21 nt, Human
auucuguuggccagugugaca

SEQ ID NO: 1669875 - RNA, 18 nt, Human
auucugcucacauaucug

SEQ ID NO: 1669876 - RNA, 20 nt, Human
auucugccugcccaggcccc

SEQ ID NO: 1669877 - RNA, 21 nt, Human
auucugccugcccaggccccu

SEQ ID NO: 1669878 - RNA, 19 nt, Human
auucugcucacauaucugu

SEQ ID NO: 1669879 - RNA, 20 nt, Human
auucugcucacauaucuguc

SEQ ID NO: 1669880 - RNA, 21 nt, Human
auucugcucacauaucuguca

SEQ ID NO: 1669881 - RNA, 22 nt, Human
auucugcucacauaucugucau

SEQ ID NO: 1669882 - RNA, 11 nt, Human
auucugccugc

SEQ ID NO: 1669883 - RNA, 13 nt, Human
auucugccugccc

SEQ ID NO: 1669884 - RNA, 14 nt, Human
auucugccugccca

SEQ ID NO: 1669885 - RNA, 15 nt, Human
auucugccugcccag

SEQ ID NO: 1669886 - RNA, 16 nt, Human
auucugccugcccagg

SEQ ID NO: 1669887 - RNA, 17 nt, Human
auucugccugcccaggc

SEQ ID NO: 1669888 - RNA, 18 nt, Human
auucugccugcccaggcc

SEQ ID NO: 1669889 - RNA, 19 nt, Human
auucugccugcccaggccc

SEQ ID NO: 1669890 - RNA, 22 nt, Human
auucucaugccucagccuccug

SEQ ID NO: 1669891 - RNA, 17 nt, Human
auucucauuugucacac

SEQ ID NO: 1669892 - RNA, 15 nt, Human
auucuagcuuugagc

SEQ ID NO: 1669893 - RNA, 19 nt, Human
auucagacagcugccuggg

SEQ ID NO: 1669894 - RNA, 11 nt, Human
uuuguggaaaa

SEQ ID NO: 1669895 - RNA, 19 nt, Human
auuauacccccugcaaagc

SEQ ID NO: 1669896 - RNA, 14 nt, Human
auuauauuaugaag

SEQ ID NO: 1669897 - RNA, 15 nt, Human
auuauauuuacaaau

SEQ ID NO: 1669898 - RNA, 15 nt, Human
auuauuauuuggccc

SEQ ID NO: 1669899 - RNA, 15 nt, Human
auuauauuuauuacu

SEQ ID NO: 1669900 - RNA, 18 nt, Human
auuauauuuauuacugua

SEQ ID NO: 1669901 - RNA, 18 nt, Human
auuaucuagauacuguau

SEQ ID NO: 1669902 - RNA, 14 nt, Human
auuaucuagauacu

SEQ ID NO: 1669903 - RNA, 21 nt, Human
auuauguuaaaacugggacag

SEQ ID NO: 1669904 - RNA, 17 nt, Human
auuauucaaaguugccu

SEQ ID NO: 1669905 - RNA, 14 nt, Human
auuauucaaaguug

SEQ ID NO: 1669906 - RNA, 15 nt, Human
auuauucaaaguugc

SEQ ID NO: 1669907 - RNA, 13 nt, Human
auuauucaaaguu

SEQ ID NO: 1669908 - RNA, 19 nt, Human
auucaaacagucucaggaa

SEQ ID NO: 1669909 - RNA, 20 nt, Human
auucaaacagucucaggaaa

SEQ ID NO: 1669910 - RNA, 16 nt, Human
auucaaacagucucag

SEQ ID NO: 1669911 - RNA, 18 nt, Human
auucaaacagucucagga

SEQ ID NO: 1669912 - RNA, 21 nt, Human
auuccagagaguggcuccucc

SEQ ID NO: 1669913 - RNA, 19 nt, Human
auuccagagaguggcuccu

SEQ ID NO: 1669914 - RNA, 13 nt, Human
auucaggaagcuc

SEQ ID NO: 1669915 - RNA, 23 nt, Human
auuccccgucucugguuccuccc

SEQ ID NO: 1669916 - RNA, 22 nt, Human
auuccccacccugaaagcccug

SEQ ID NO: 1669917 - RNA, 18 nt, Human
auucagacagcugccugg

SEQ ID NO: 1669918 - RNA, 22 nt, Human
auucaggaagcagcuuucccca

SEQ ID NO: 1669919 - RNA, 12 nt, Human
auucaggaagcu

SEQ ID NO: 1669920 - RNA, 14 nt, Human
auucagacagcugc

SEQ ID NO: 1669921 - RNA, 15 nt, Human
auucagacagcugcc

SEQ ID NO: 1669922 - RNA, 16 nt, Human
auucagacagcugccu

SEQ ID NO: 1669923 - RNA, 17 nt, Human
auucagacagcugccug

SEQ ID NO: 1669924 - RNA, 12 nt, Human
auucagacagcu

SEQ ID NO: 1669925 - RNA, 13 nt, Human
auucagacagcug

SEQ ID NO: 1669926 - RNA, 11 nt, Human
auucagacagc

SEQ ID NO: 1669927 - RNA, 13 nt, Human
auucacauuguau

SEQ ID NO: 1669928 - RNA, 20 nt, Human
auucacauuguauucagagu

SEQ ID NO: 1669929 - RNA, 18 nt, Human
augggccuccugugugug

SEQ ID NO: 1669930 - RNA, 20 nt, Human
augggcuggguucuacccag

SEQ ID NO: 1669931 - RNA, 15 nt, Human
uuugaaauauugacu

SEQ ID NO: 1669932 - RNA, 15 nt, Human
augggggugcauuug

SEQ ID NO: 1669933 - RNA, 17 nt, Human
augggggcacugaggac

SEQ ID NO: 1669934 - RNA, 14 nt, Human
augggggugcauuu

SEQ ID NO: 1669935 - RNA, 24 nt, Human
auggggcugcaccggcuggccugg

SEQ ID NO: 1669936 - RNA, 20 nt, Human
uuucuguacuuuuuggcaua

SEQ ID NO: 1669937 - RNA, 19 nt, Human
uuucuguacuuuuuggcau

SEQ ID NO: 1669938 - RNA, 23 nt, Human
uuucugggcaccggggccucgga

SEQ ID NO: 1669939 - RNA, 21 nt, Human
uuucugcagccacuauuguua

SEQ ID NO: 1669940 - RNA, 19 nt, Human
uuucuguuauauaaauggu

SEQ ID NO: 1669941 - RNA, 19 nt, Human
uuucuggcuaugcauuuga

SEQ ID NO: 1669942 - RNA, 18 nt, Human
uuucuggcuaugcauuug

SEQ ID NO: 1669943 - RNA, 16 nt, Human
uuucuggcuaugcauu

SEQ ID NO: 1669944 - RNA, 15 nt, Human
uuucuggcuaugcau

SEQ ID NO: 1669945 - RNA, 19 nt, Human
uuucugcagccacuauugu

SEQ ID NO: 1669946 - RNA, 15 nt, Human
augggauaaaugcca

SEQ ID NO: 1669947 - RNA, 16 nt, Human
augggauaaaugccau

SEQ ID NO: 1669948 - RNA, 20 nt, Human
augggauaaaugccaucaau

SEQ ID NO: 1669949 - RNA, 15 nt, Human
augggauccuggagu

SEQ ID NO: 1669950 - RNA, 18 nt, Human
augggcaacccccagccu

SEQ ID NO: 1669951 - RNA, 17 nt, Human
uuucucccagucauuua

SEQ ID NO: 1669952 - RNA, 18 nt, Human
uuucucccagucauuuaa

SEQ ID NO: 1669953 - RNA, 19 nt, Human
auggugcaaugaccuuuca

SEQ ID NO: 1669954 - RNA, 16 nt, Human
auggugcaaugaccuu

SEQ ID NO: 1669955 - RNA, 17 nt, Human
auggugcaaugaccuuu

SEQ ID NO: 1669956 - RNA, 16 nt, Human
auggugaugaaaugua

SEQ ID NO: 1669957 - RNA, 17 nt, Human
auggugaugaaauguaa

SEQ ID NO: 1669958 - RNA, 14 nt, Human
auggugaugaaaug

SEQ ID NO: 1669959 - RNA, 15 nt, Human
augggugcuuggagg

SEQ ID NO: 1669960 - RNA, 20 nt, Human
auggugagggauacccaucc

SEQ ID NO: 1669961 - RNA, 20 nt, Human
augggugcuuggaggaagga

SEQ ID NO: 1669962 - RNA, 12 nt, Human
auggugcaauga

SEQ ID NO: 1669963 - RNA, 13 nt, Human
auggugcaaugac

SEQ ID NO: 1669964 - RNA, 15 nt, Human
auggugcaaugaccu

SEQ ID NO: 1669965 - RNA, 12 nt, Human
augguggcuggg

SEQ ID NO: 1669966 - RNA, 13 nt, Human
augguggcugggu

SEQ ID NO: 1669967 - RNA, 15 nt, Human
augguggcuggguug

SEQ ID NO: 1669968 - RNA, 17 nt, Human
augguggcuggguugga

SEQ ID NO: 1669969 - RNA, 14 nt, Human
auguaaaucccauu

SEQ ID NO: 1669970 - RNA, 20 nt, Human
auguaaaucccauuauucaa

SEQ ID NO: 1669971 - RNA, 22 nt, Human
auguaaaucccauuauucaaag

SEQ ID NO: 1669972 - RNA, 23 nt, Human
auguaaaucccauuauucaaagu

SEQ ID NO: 1669973 - RNA, 16 nt, Human
augguuuucaaaauaa

SEQ ID NO: 1669974 - RNA, 14 nt, Human
augguuuucuugug

SEQ ID NO: 1669975 - RNA, 14 nt, Human
augguuuucaaaau

SEQ ID NO: 1669976 - RNA, 15 nt, Human
augguuuucaaaaua

SEQ ID NO: 1669977 - RNA, 13 nt, Human
augguuguacaua

SEQ ID NO: 1669978 - RNA, 16 nt, Human
augguuuaacaaaaug

SEQ ID NO: 1669979 - RNA, 19 nt, Human
augguuccccuguucacuc

SEQ ID NO: 1669980 - RNA, 20 nt, Human
augguuccccuguucacucu

SEQ ID NO: 1669981 - RNA, 21 nt, Human
augguucccuugaugaagaag

SEQ ID NO: 1669982 - RNA, 18 nt, Human
auguaugagguacaaccu

SEQ ID NO: 1669983 - RNA, 21 nt, Human
uuuggcauaacauaaaucugu

SEQ ID NO: 1669984 - RNA, 20 nt, Human
uuuggcauaacauaaaucug

SEQ ID NO: 1669985 - RNA, 22 nt, Human
auguauuacaguggggaaugaa

SEQ ID NO: 1669986 - RNA, 16 nt, Human
auguauguguaaguau

SEQ ID NO: 1669987 - RNA, 17 nt, Human
augucucaggucccugc

SEQ ID NO: 1669988 - RNA, 22 nt, Human
augucucaggucccugcagggc

SEQ ID NO: 1669989 - RNA, 15 nt, Human
augucgccucugcau

SEQ ID NO: 1669990 - RNA, 13 nt, Human
augucgccucugc

SEQ ID NO: 1669991 - RNA, 14 nt, Human
augucgccucugca

SEQ ID NO: 1669992 - RNA, 17 nt, Human
augucucugagcauuag

SEQ ID NO: 1669993 - RNA, 12 nt, Human
augucaguguga

SEQ ID NO: 1669994 - RNA, 13 nt, Human
augucagugugac

SEQ ID NO: 1669995 - RNA, 17 nt, Human
auguccacugguucuuc

SEQ ID NO: 1669996 - RNA, 23 nt, Human
augucucuuuaaugucacaggca

SEQ ID NO: 1669997 - RNA, 16 nt, Human
augugaugagaggaaa

SEQ ID NO: 1669998 - RNA, 17 nt, Human
augugaugagaggaaau

SEQ ID NO: 1669999 - RNA, 19 nt, Human
augugaugagaggaaauca

SEQ ID NO: 1670000 - RNA, 23 nt, Human
augugcacaugcacgugugugca

SEQ ID NO: 1670001 - RNA, 13 nt, Human
uuuguaaugaaaa

SEQ ID NO: 1670002 - RNA, 14 nt, Human
uuuguaaugaaaac

SEQ ID NO: 1670003 - RNA, 12 nt, Human
uuuguauaaaag

SEQ ID NO: 1670004 - RNA, 19 nt, Human
uuuguaguguuggagaaga

SEQ ID NO: 1670005 - RNA, 21 nt, Human
uuuguaguguuggagaagaac

SEQ ID NO: 1670006 - RNA, 19 nt, Human
uuugugcugguguaugugu

SEQ ID NO: 1670007 - RNA, 20 nt, Human
uuugugaagguggaaauaaa

SEQ ID NO: 1670008 - RNA, 22 nt, Human
uuugugaaaugauggugaaagu

SEQ ID NO: 1670009 - RNA, 17 nt, Human
uuugugaagcaaaauuu

SEQ ID NO: 1670010 - RNA, 20 nt, Human
uuugacgccaucccagcccc

SEQ ID NO: 1670011 - RNA, 13 nt, Human
uuugacgccaucc

SEQ ID NO: 1670012 - RNA, 14 nt, Human
uuugacgccauccc

SEQ ID NO: 1670013 - RNA, 16 nt, Human
uuugacgccaucccag

SEQ ID NO: 1670014 - RNA, 19 nt, Human
uuugacgccaucccagccc

SEQ ID NO: 1670015 - RNA, 23 nt, Human
uuugauuaaauucuugcaaagua

SEQ ID NO: 1670016 - RNA, 21 nt, Human
uuugauucagacagcugccug

SEQ ID NO: 1670017 - RNA, 21 nt, Human
uuugauuaaauucuugcaaag

SEQ ID NO: 1670018 - RNA, 18 nt, Human
uuugauuaaauucuugca

SEQ ID NO: 1670019 - RNA, 13 nt, Human
uuugauuaaauuc

SEQ ID NO: 1670020 - RNA, 22 nt, Human
uuugauguucuuucacccuuuu

SEQ ID NO: 1670021 - RNA, 13 nt, Human
uuugccucugccu

SEQ ID NO: 1670022 - RNA, 22 nt, Human
uuugauucagacagcugccugg

SEQ ID NO: 1670023 - RNA, 15 nt, Human
uuugccguuauuaaa

SEQ ID NO: 1670024 - RNA, 14 nt, Human
uuugcaagccagau

SEQ ID NO: 1670025 - RNA, 16 nt, Human
auguacuucaugcugu

SEQ ID NO: 1670026 - RNA, 17 nt, Human
auguagaggagaaacug

SEQ ID NO: 1670027 - RNA, 19 nt, Human
auguagaggagaaacugga

SEQ ID NO: 1670028 - RNA, 12 nt, Human
auguagaggaga

SEQ ID NO: 1670029 - RNA, 13 nt, Human
auguagaggagaa

SEQ ID NO: 1670030 - RNA, 19 nt, Human
auguagccccucuccugga

SEQ ID NO: 1670031 - RNA, 12 nt, Human
uuugaccucugc

SEQ ID NO: 1670032 - RNA, 18 nt, Human
uuugaccucugcagcaau

SEQ ID NO: 1670033 - RNA, 17 nt, Human
augcagcaucuaaguaa

SEQ ID NO: 1670034 - RNA, 18 nt, Human
augcagccucacaguccu

SEQ ID NO: 1670035 - RNA, 12 nt, Human
uuuaauucaguu

SEQ ID NO: 1670036 - RNA, 21 nt, Human
uuuaaauaaauaaauagcuag

SEQ ID NO: 1670037 - RNA, 18 nt, Human
uuuaaauauaugcuaagu

SEQ ID NO: 1670038 - RNA, 14 nt, Human
augcccuggaucca

SEQ ID NO: 1670039 - RNA, 16 nt, Human
augccucagccuccug

SEQ ID NO: 1670040 - RNA, 12 nt, Human
augcccagcccc

SEQ ID NO: 1670041 - RNA, 13 nt, Human
augcccagccccu

SEQ ID NO: 1670042 - RNA, 14 nt, Human
augcccagccccuu

SEQ ID NO: 1670043 - RNA, 15 nt, Human
augcccagccccuuc

SEQ ID NO: 1670044 - RNA, 20 nt, Human
augcgugcauaccacuuuug

SEQ ID NO: 1670045 - RNA, 21 nt, Human
augcgggccagugcuccagcc

SEQ ID NO: 1670046 - RNA, 13 nt, Human
augcagugcuucc

SEQ ID NO: 1670047 - RNA, 23 nt, Human
augcagugguaugaucacggcuc

SEQ ID NO: 1670048 - RNA, 13 nt, Human
augcaguucugaa

SEQ ID NO: 1670049 - RNA, 17 nt, Human
augccauuuaaagcuua

SEQ ID NO: 1670050 - RNA, 21 nt, Human
augccauuuaaagcuuauuaa

SEQ ID NO: 1670051 - RNA, 17 nt, Human
augcacuuuguucuggc

SEQ ID NO: 1670052 - RNA, 19 nt, Human
augcacuuuguucuggcuc

SEQ ID NO: 1670053 - RNA, 20 nt, Human
augcacuuuguucuggcucu

SEQ ID NO: 1670054 - RNA, 13 nt, Human
augcaccuggaau

SEQ ID NO: 1670055 - RNA, 22 nt, Human
augcaccagcccuuagcaggga

SEQ ID NO: 1670056 - RNA, 13 nt, Human
uuuaaagaaugcu

SEQ ID NO: 1670057 - RNA, 21 nt, Human
augcacuuuguucuggcucuu

SEQ ID NO: 1670058 - RNA, 10 nt, Human
augauccagc

SEQ ID NO: 1670059 - RNA, 19 nt, Human
augauccagcagauuauuc

SEQ ID NO: 1670060 - RNA, 20 nt, Human
augauccagcagauuauuca

SEQ ID NO: 1670061 - RNA, 17 nt, Human
augauacuugaaaauua

SEQ ID NO: 1670062 - RNA, 21 nt, Human
augauacuugaaaauuaacau

SEQ ID NO: 1670063 - RNA, 22 nt, Human
augauccagcagauuauucacu

SEQ ID NO: 1670064 - RNA, 17 nt, Human
augaucuaggaagacuu

SEQ ID NO: 1670065 - RNA, 20 nt, Human
augaucuaggaagacuuugg

SEQ ID NO: 1670066 - RNA, 14 nt, Human
augauuaaguaaug

SEQ ID NO: 1670067 - RNA, 18 nt, Human
augauuaaguaaugauaa

SEQ ID NO: 1670068 - RNA, 20 nt, Human
uuguguuacuaaguuuuuau

SEQ ID NO: 1670069 - RNA, 15 nt, Human
uuguguuacuaaguu

SEQ ID NO: 1670070 - RNA, 13 nt, Human
uuguguuacuaag

SEQ ID NO: 1670071 - RNA, 13 nt, Human
uuguguucaccuu

SEQ ID NO: 1670072 - RNA, 21 nt, Human
uuguuccacaaguuaaauaaa

SEQ ID NO: 1670073 - RNA, 15 nt, Human
augauaacuggaaac

SEQ ID NO: 1670074 - RNA, 14 nt, Human
augggauaaaugcc

SEQ ID NO: 1670075 - RNA, 19 nt, Human
augggagagaagagaaugc

SEQ ID NO: 1670076 - RNA, 15 nt, Human
augggagagaagaga

SEQ ID NO: 1670077 - RNA, 18 nt, Human
auggcuaauguacugcau

SEQ ID NO: 1670078 - RNA, 19 nt, Human
auggcuaagcaaaauguga

SEQ ID NO: 1670079 - RNA, 18 nt, Human
auggagacugucucaaga

SEQ ID NO: 1670080 - RNA, 14 nt, Human
auggcacuaguauu

SEQ ID NO: 1670081 - RNA, 16 nt, Human
auggcacuaguauuuc

SEQ ID NO: 1670082 - RNA, 16 nt, Human
auggacuguggugacu

SEQ ID NO: 1670083 - RNA, 17 nt, Human
auggacuguggugacuu

SEQ ID NO: 1670084 - RNA, 22 nt, Human
auggacuguggugacuuuggau

SEQ ID NO: 1670085 - RNA, 11 nt, Human
auggacuuugu

SEQ ID NO: 1670086 - RNA, 12 nt, Human
auggacuuuguu

SEQ ID NO: 1670087 - RNA, 19 nt, Human
uuucauuauuuuauuauga

SEQ ID NO: 1670088 - RNA, 20 nt, Human
uuucauuauuuuauuaugaa

SEQ ID NO: 1670089 - RNA, 17 nt, Human
uuuccaugaguccccug

SEQ ID NO: 1670090 - RNA, 18 nt, Human
uuuccaugaguccccugu

SEQ ID NO: 1670091 - RNA, 13 nt, Human
uuucauuauuuua

SEQ ID NO: 1670092 - RNA, 15 nt, Human
uuucauuauuuuauu

SEQ ID NO: 1670093 - RNA, 13 nt, Human
augcugcuuuuuc

SEQ ID NO: 1670094 - RNA, 17 nt, Human
augcuguucaugaaaga

SEQ ID NO: 1670095 - RNA, 22 nt, Human
augcugugcccuaaaguguauu

SEQ ID NO: 1670096 - RNA, 23 nt, Human
augcuguucaugaaagauucaau

SEQ ID NO: 1670097 - RNA, 19 nt, Human
augcuguucaugaaagauu

SEQ ID NO: 1670098 - RNA, 15 nt, Human
auggaacgcguugaa

SEQ ID NO: 1670099 - RNA, 16 nt, Human
auggaacgcguugaaa

SEQ ID NO: 1670100 - RNA, 17 nt, Human
auggaacgcguugaaau

SEQ ID NO: 1670101 - RNA, 13 nt, Human
augcuucucacug

SEQ ID NO: 1670102 - RNA, 18 nt, Human
auggaacgcguugaaauu

SEQ ID NO: 1670103 - RNA, 19 nt, Human
auggaacgcguugaaauug

SEQ ID NO: 1670104 - RNA, 20 nt, Human
uuuauuuuguguuuaggaac

SEQ ID NO: 1670105 - RNA, 23 nt, Human
auggaacgcguugaaauuguaau

SEQ ID NO: 1670106 - RNA, 16 nt, Human
uuuauuuuguguuuag

SEQ ID NO: 1670107 - RNA, 22 nt, Human
uuucaaaauuguuacaaauugu

SEQ ID NO: 1670108 - RNA, 16 nt, Human
uuucaaacauauauaa

SEQ ID NO: 1670109 - RNA, 22 nt, Human
uuucaaacuuuacuauggcccu

SEQ ID NO: 1670110 - RNA, 16 nt, Human
uuucaaacuuuacuau

SEQ ID NO: 1670111 - RNA, 17 nt, Human
uuucaaacauauauaac

SEQ ID NO: 1670112 - RNA, 14 nt, Human
uuuauuacaguaua

SEQ ID NO: 1670113 - RNA, 18 nt, Human
uuuauuacaguauaauua

SEQ ID NO: 1670114 - RNA, 20 nt, Human
augcuagaacucccuuucaa

SEQ ID NO: 1670115 - RNA, 21 nt, Human
augcuagaacucccuuucaac

SEQ ID NO: 1670116 - RNA, 22 nt, Human
augcuagaacucccuuucaaca

SEQ ID NO: 1670117 - RNA, 21 nt, Human
augcuauuucuauauuuucau

SEQ ID NO: 1670118 - RNA, 22 nt, Human
augcuauuucuauauuuucauu

SEQ ID NO: 1670119 - RNA, 23 nt, Human
augcuauuucuauauuuucauuc

SEQ ID NO: 1670120 - RNA, 13 nt, Human
augcuauuucuau

SEQ ID NO: 1670121 - RNA, 14 nt, Human
augcuauuucuaua

SEQ ID NO: 1670122 - RNA, 15 nt, Human
augcuauuucuauau

SEQ ID NO: 1670123 - RNA, 20 nt, Human
augcuauuucuauauuuuca

SEQ ID NO: 1670124 - RNA, 11 nt, Human
augcuauuucu

SEQ ID NO: 1670125 - RNA, 16 nt, Human
uuuauauuuacuaaaa

SEQ ID NO: 1670126 - RNA, 13 nt, Human
uuuauauuuacua

SEQ ID NO: 1670127 - RNA, 16 nt, Human
augcuaagacucagug

SEQ ID NO: 1670128 - RNA, 13 nt, Human
augcuaagugaaa

SEQ ID NO: 1670129 - RNA, 17 nt, Human
uuuaucaugugaaauca

SEQ ID NO: 1670130 - RNA, 18 nt, Human
uuuaucaugugaaaucau

SEQ ID NO: 1670131 - RNA, 20 nt, Human
aucauuuuaccuuugacaaa

SEQ ID NO: 1670132 - RNA, 18 nt, Human
auccaagcuggucccacu

SEQ ID NO: 1670133 - RNA, 21 nt, Human
auccaagcuggucccacucag

SEQ ID NO: 1670134 - RNA, 13 nt, Human
auccacccaccuc

SEQ ID NO: 1670135 - RNA, 15 nt, Human
auccacccaccucag

SEQ ID NO: 1670136 - RNA, 16 nt, Human
auccacccaccucagc

SEQ ID NO: 1670137 - RNA, 16 nt, Human
auccaguaucuugaag

SEQ ID NO: 1670138 - RNA, 21 nt, Human
auccauuuggaaaucuuuaaa

SEQ ID NO: 1670139 - RNA, 13 nt, Human
auccaucaggcca

SEQ ID NO: 1670140 - RNA, 17 nt, Human
auccaguuuuguuugga

SEQ ID NO: 1670141 - RNA, 21 nt, Human
auccaguaucuugaagacuuu

SEQ ID NO: 1670142 - RNA, 18 nt, Human
aucccauaugccugggca

SEQ ID NO: 1670143 - RNA, 19 nt, Human
aucccaaacccuucagugc

SEQ ID NO: 1670144 - RNA, 20 nt, Human
aucccaaacccuucagugcc

SEQ ID NO: 1670145 - RNA, 23 nt, Human
uucugaacuuggcgcugccccug

SEQ ID NO: 1670146 - RNA, 15 nt, Human
uucugccauauucug

SEQ ID NO: 1670147 - RNA, 19 nt, Human
uucugaacuuggcgcugcc

SEQ ID NO: 1670148 - RNA, 22 nt, Human
uucugaacuuggcgcugccccu

SEQ ID NO: 1670149 - RNA, 21 nt, Human
uucugccugcccaggccccug

SEQ ID NO: 1670150 - RNA, 17 nt, Human
uucugccugcccaggcc

SEQ ID NO: 1670151 - RNA, 18 nt, Human
uucugccugcccaggccc

SEQ ID NO: 1670152 - RNA, 16 nt, Human
uucuggcucuuccagg

SEQ ID NO: 1670153 - RNA, 17 nt, Human
uucuggcucuuccaggc

SEQ ID NO: 1670154 - RNA, 14 nt, Human
aucaggugcugcca

SEQ ID NO: 1670155 - RNA, 21 nt, Human
uucuccuuguguuacuaaguu

SEQ ID NO: 1670156 - RNA, 20 nt, Human
uucucuaguuugauuaaauu

SEQ ID NO: 1670157 - RNA, 17 nt, Human
uucucuaguuugauuaa

SEQ ID NO: 1670158 - RNA, 15 nt, Human
uucucuaguuugauu

SEQ ID NO: 1670159 - RNA, 17 nt, Human
uucuccuuucacaaccu

SEQ ID NO: 1670160 - RNA, 12 nt, Human
uucucuaggaaa

SEQ ID NO: 1670161 - RNA, 14 nt, Human
uucuuuuuuuguga

SEQ ID NO: 1670162 - RNA, 15 nt, Human
uucuuuguaaugaaa

SEQ ID NO: 1670163 - RNA, 16 nt, Human
uucuuuguaaugaaaa

SEQ ID NO: 1670164 - RNA, 20 nt, Human
uucuucugcuucagccuccc

SEQ ID NO: 1670165 - RNA, 14 nt, Human
uucuucucccucag

SEQ ID NO: 1670166 - RNA, 13 nt, Human
uucuucugcuuca

SEQ ID NO: 1670167 - RNA, 15 nt, Human
uucuucugcuucagc

SEQ ID NO: 1670168 - RNA, 13 nt, Human
uucuucucccuca

SEQ ID NO: 1670169 - RNA, 24 nt, Human
aucccauaugccugggcagaagga

SEQ ID NO: 1670170 - RNA, 13 nt, Human
aucccaugagccu

SEQ ID NO: 1670171 - RNA, 14 nt, Human
aucccucauccuca

SEQ ID NO: 1670172 - RNA, 21 nt, Human
aucccucauccucauacccac

SEQ ID NO: 1670173 - RNA, 23 nt, Human
aucccucauccucauacccaccc

SEQ ID NO: 1670174 - RNA, 16 nt, Human
auccuccucagaucuu

SEQ ID NO: 1670175 - RNA, 16 nt, Human
auccuaggcauuugcu

SEQ ID NO: 1670176 - RNA, 18 nt, Human
auccuacaagacacagug

SEQ ID NO: 1670177 - RNA, 19 nt, Human
auccuacaagacacaguga

SEQ ID NO: 1670178 - RNA, 21 nt, Human
auccuaagcuauucaguaaua

SEQ ID NO: 1670179 - RNA, 12 nt, Human
auccuaagcuau

SEQ ID NO: 1670180 - RNA, 13 nt, Human
uugaaauuguaau

SEQ ID NO: 1670181 - RNA, 14 nt, Human
uugaaauuguaauu

SEQ ID NO: 1670182 - RNA, 15 nt, Human
uugaaauuguaauua

SEQ ID NO: 1670183 - RNA, 17 nt, Human
uugaaauuguaauuaua

SEQ ID NO: 1670184 - RNA, 17 nt, Human
uugaaauuguauuacaa

SEQ ID NO: 1670185 - RNA, 19 nt, Human
uugaacccgggaggcagag

SEQ ID NO: 1670186 - RNA, 14 nt, Human
uuccucugagccuu

SEQ ID NO: 1670187 - RNA, 17 nt, Human
uuccucugagccuuggg

SEQ ID NO: 1670188 - RNA, 21 nt, Human
uuccucugaggcugaaauuca

SEQ ID NO: 1670189 - RNA, 16 nt, Human
uuccuaauuccacagc

SEQ ID NO: 1670190 - RNA, 17 nt, Human
uuccuaauuccacagcu

SEQ ID NO: 1670191 - RNA, 18 nt, Human
uuccuaauuccacagcug

SEQ ID NO: 1670192 - RNA, 20 nt, Human
uuccuaaauauauuuuaaga

SEQ ID NO: 1670193 - RNA, 14 nt, Human
uuccugaacaggau

SEQ ID NO: 1670194 - RNA, 14 nt, Human
uuccugaaccgaug

SEQ ID NO: 1670195 - RNA, 15 nt, Human
uuccugaacaggaua

SEQ ID NO: 1670196 - RNA, 18 nt, Human
uuccugaagaauugaaaa

SEQ ID NO: 1670197 - RNA, 13 nt, Human
uuccucuuuccau

SEQ ID NO: 1670198 - RNA, 17 nt, Human
uuccucuuuccaucuac

SEQ ID NO: 1670199 - RNA, 22 nt, Human
uuccucuuuccaucuacccucc

SEQ ID NO: 1670200 - RNA, 16 nt, Human
uucccgcucagcccuc

SEQ ID NO: 1670201 - RNA, 18 nt, Human
uucccgcucagcccuccc

SEQ ID NO: 1670202 - RNA, 21 nt, Human
uucccgcucagcccucccugc

SEQ ID NO: 1670203 - RNA, 22 nt, Human
uucccgcucagcccucccugcc

SEQ ID NO: 1670204 - RNA, 20 nt, Human
uucccucaccuuucccaucu

SEQ ID NO: 1670205 - RNA, 16 nt, Human
uuccguuaaaauacca

SEQ ID NO: 1670206 - RNA, 14 nt, Human
uuccguuaaaauac

SEQ ID NO: 1670207 - RNA, 19 nt, Human
uuccguagguuauuuucag

SEQ ID NO: 1670208 - RNA, 23 nt, Human
aucaccugucuugccuuuuucau

SEQ ID NO: 1670209 - RNA, 14 nt, Human
aucaaugaguaaca

SEQ ID NO: 1670210 - RNA, 18 nt, Human
aucacggcucacugcagc

SEQ ID NO: 1670211 - RNA, 19 nt, Human
aucacggcucacugcagcc

SEQ ID NO: 1670212 - RNA, 13 nt, Human
aucacgccacugc

SEQ ID NO: 1670213 - RNA, 14 nt, Human
aucacgccacugca

SEQ ID NO: 1670214 - RNA, 15 nt, Human
aucacggcucacugc

SEQ ID NO: 1670215 - RNA, 14 nt, Human
aucaacagauaaau

SEQ ID NO: 1670216 - RNA, 20 nt, Human
auauuuuuuguuaaaugauu

SEQ ID NO: 1670217 - RNA, 18 nt, Human
auauuuuuuguuaaauga

SEQ ID NO: 1670218 - RNA, 11 nt, Human
uuccugugucu

SEQ ID NO: 1670219 - RNA, 13 nt, Human
aucagcacgauuu

SEQ ID NO: 1670220 - RNA, 15 nt, Human
aucaggccaggcccu

SEQ ID NO: 1670221 - RNA, 16 nt, Human
aucaggccaggcccuc

SEQ ID NO: 1670222 - RNA, 18 nt, Human
aucaggccaggcccucug

SEQ ID NO: 1670223 - RNA, 12 nt, Human
aucagaauucuc

SEQ ID NO: 1670224 - RNA, 20 nt, Human
aucaggccaggcccucugcc

SEQ ID NO: 1670225 - RNA, 17 nt, Human
aucaggguuaguauugu

SEQ ID NO: 1670226 - RNA, 18 nt, Human
uucucacuccuaccuggu

SEQ ID NO: 1670227 - RNA, 16 nt, Human
uucucacuccuaccug

SEQ ID NO: 1670228 - RNA, 13 nt, Human
uucuaggacugaa

SEQ ID NO: 1670229 - RNA, 14 nt, Human
uucuaggacugaau

SEQ ID NO: 1670230 - RNA, 16 nt, Human
uucuaggacugaauua

SEQ ID NO: 1670231 - RNA, 18 nt, Human
aucagaaguuucucagcu

SEQ ID NO: 1670232 - RNA, 11 nt, Human
aucagaauucu

SEQ ID NO: 1670233 - RNA, 22 nt, Human
aucacuugucaauaaaauccau

SEQ ID NO: 1670234 - RNA, 13 nt, Human
uucuaaaguaaaa

SEQ ID NO: 1670235 - RNA, 21 nt, Human
uucuaaaucuccaaaauaaaa

SEQ ID NO: 1670236 - RNA, 21 nt, Human
uucuaaaggcuaccuuuguau

SEQ ID NO: 1670237 - RNA, 20 nt, Human
uucuaaaggcuaccuuugua

SEQ ID NO: 1670238 - RNA, 15 nt, Human
uucggccuccauccu

SEQ ID NO: 1670239 - RNA, 15 nt, Human
uucgcuccugugucu

SEQ ID NO: 1670240 - RNA, 19 nt, Human
uucgcuccugugucuugca

SEQ ID NO: 1670241 - RNA, 14 nt, Human
uucggccuccaucc

SEQ ID NO: 1670242 - RNA, 15 nt, Human
uucuaaguaaaacca

SEQ ID NO: 1670243 - RNA, 16 nt, Human
uucuaaguaaaaccac

SEQ ID NO: 1670244 - RNA, 23 nt, Human
uucuaagaagugaaaaucuacac

SEQ ID NO: 1670245 - RNA, 16 nt, Human
uucuagcauggcugcc

SEQ ID NO: 1670246 - RNA, 15 nt, Human
aucucuugagccugg

SEQ ID NO: 1670247 - RNA, 18 nt, Human
aucucuugagccugggag

SEQ ID NO: 1670248 - RNA, 14 nt, Human
aucugaaaauguau

SEQ ID NO: 1670249 - RNA, 16 nt, Human
aucugaaaauguaugu

SEQ ID NO: 1670250 - RNA, 19 nt, Human
aucugaaaauguaugugua

SEQ ID NO: 1670251 - RNA, 20 nt, Human
aucugaaaauguauguguaa

SEQ ID NO: 1670252 - RNA, 22 nt, Human
aucugaaaauguauguguaagu

SEQ ID NO: 1670253 - RNA, 15 nt, Human
aucucccccagcccc

SEQ ID NO: 1670254 - RNA, 21 nt, Human
aucucuucuggguuccuuccu

SEQ ID NO: 1670255 - RNA, 21 nt, Human
aucucccccagccccauccuc

SEQ ID NO: 1670256 - RNA, 16 nt, Human
aucucccccagcccca

SEQ ID NO: 1670257 - RNA, 17 nt, Human
aucucccccagccccau

SEQ ID NO: 1670258 - RNA, 16 nt, Human
aucucagggccugguc

SEQ ID NO: 1670259 - RNA, 21 nt, Human
aucuccaaaauaaaacuuuuu

SEQ ID NO: 1670260 - RNA, 20 nt, Human
aucuccaaaauaaaacuuuu

SEQ ID NO: 1670261 - RNA, 17 nt, Human
aucuccaaaauaaaacu

SEQ ID NO: 1670262 - RNA, 14 nt, Human
aucuccaaaauaaa

SEQ ID NO: 1670263 - RNA, 14 nt, Human
aucucauuuccaag

SEQ ID NO: 1670264 - RNA, 23 nt, Human
aucugaaaauguauguguaagua

SEQ ID NO: 1670265 - RNA, 15 nt, Human
aucugacaucucugc

SEQ ID NO: 1670266 - RNA, 16 nt, Human
aucugacaucucugca

SEQ ID NO: 1670267 - RNA, 20 nt, Human
aucugacaucucugcaaucu

SEQ ID NO: 1670268 - RNA, 23 nt, Human
uugauguuuuaaggaugcuugua

SEQ ID NO: 1670269 - RNA, 13 nt, Human
uugauuaaauucu

SEQ ID NO: 1670270 - RNA, 14 nt, Human
uugauuaaauucuu

SEQ ID NO: 1670271 - RNA, 16 nt, Human
uugcaauggcagccuu

SEQ ID NO: 1670272 - RNA, 17 nt, Human
uugcaauggcagccuug

SEQ ID NO: 1670273 - RNA, 19 nt, Human
uugcaauggcagccuuggc

SEQ ID NO: 1670274 - RNA, 15 nt, Human
uugcaccacugcacu

SEQ ID NO: 1670275 - RNA, 16 nt, Human
uugcaccacugcacuc

SEQ ID NO: 1670276 - RNA, 18 nt, Human
uugcaccacugcacucca

SEQ ID NO: 1670277 - RNA, 13 nt, Human
uugcaucaauuuu

SEQ ID NO: 1670278 - RNA, 16 nt, Human
auccucuguacagagc

SEQ ID NO: 1670279 - RNA, 17 nt, Human
auccucuguacagagcc

SEQ ID NO: 1670280 - RNA, 20 nt, Human
auccucucaaccaccuuuca

SEQ ID NO: 1670281 - RNA, 19 nt, Human
aucuaaauggaaccacucu

SEQ ID NO: 1670282 - RNA, 18 nt, Human
aucuaaauggaaccacuc

SEQ ID NO: 1670283 - RNA, 17 nt, Human
aucuaaauggaaccacu

SEQ ID NO: 1670284 - RNA, 13 nt, Human
aucuaaauggaac

SEQ ID NO: 1670285 - RNA, 13 nt, Human
uugaagccuuugu

SEQ ID NO: 1670286 - RNA, 17 nt, Human
uugaagggaaauuucag

SEQ ID NO: 1670287 - RNA, 13 nt, Human
uugaaucacagua

SEQ ID NO: 1670288 - RNA, 20 nt, Human
uugaguugauucagcucugc

SEQ ID NO: 1670289 - RNA, 20 nt, Human
uugagugaagcugggagaac

SEQ ID NO: 1670290 - RNA, 11 nt, Human
uugagugccuu

SEQ ID NO: 1670291 - RNA, 15 nt, Human
uugauacuacaguuu

SEQ ID NO: 1670292 - RNA, 18 nt, Human
aucuaauauguaacaagc

SEQ ID NO: 1670293 - RNA, 20 nt, Human
aucuaauauguaacaagcca

SEQ ID NO: 1670294 - RNA, 18 nt, Human
aucuacacuccagugaga

SEQ ID NO: 1670295 - RNA, 19 nt, Human
aucuacacuccagugagac

SEQ ID NO: 1670296 - RNA, 16 nt, Human
uugagauguguucaca

SEQ ID NO: 1670297 - RNA, 16 nt, Human
uugagaucagccuggg

SEQ ID NO: 1670298 - RNA, 18 nt, Human
aucuuugcagacaggcaa

SEQ ID NO: 1670299 - RNA, 22 nt, Human
aucuuuucauuuaggugaggaa

SEQ ID NO: 1670300 - RNA, 17 nt, Human
aucuuugcagacaggca

SEQ ID NO: 1670301 - RNA, 18 nt, Human
augaaagggcccagagag

SEQ ID NO: 1670302 - RNA, 16 nt, Human
uuggagggugucccaa

SEQ ID NO: 1670303 - RNA, 18 nt, Human
uuggccccugcccggcug

SEQ ID NO: 1670304 - RNA, 14 nt, Human
uugcuugaaagaaa

SEQ ID NO: 1670305 - RNA, 11 nt, Human
uuggagacaga

SEQ ID NO: 1670306 - RNA, 15 nt, Human
augaauuacauuugu

SEQ ID NO: 1670307 - RNA, 21 nt, Human
augaauauuuaguguucauaa

SEQ ID NO: 1670308 - RNA, 23 nt, Human
augaauggcuaagcaaaauguga

SEQ ID NO: 1670309 - RNA, 18 nt, Human
uuggggaccagagcugcc

SEQ ID NO: 1670310 - RNA, 16 nt, Human
augaauuacauuugua

SEQ ID NO: 1670311 - RNA, 17 nt, Human
augaauuacauuuguau

SEQ ID NO: 1670312 - RNA, 11 nt, Human
augaagaggag

SEQ ID NO: 1670313 - RNA, 16 nt, Human
augaauauuuaguguu

SEQ ID NO: 1670314 - RNA, 18 nt, Human
augaacuuguaaaggaau

SEQ ID NO: 1670315 - RNA, 19 nt, Human
augaaagggcccagagagg

SEQ ID NO: 1670316 - RNA, 11 nt, Human
aucugccuaag

SEQ ID NO: 1670317 - RNA, 21 nt, Human
aucugccuaaggacuucuuua

SEQ ID NO: 1670318 - RNA, 22 nt, Human
aucugccuaaggacuucuuuaa

SEQ ID NO: 1670319 - RNA, 23 nt, Human
aucugccuaaggacuucuuuaau

SEQ ID NO: 1670320 - RNA, 10 nt, Human
aucuggugac

SEQ ID NO: 1670321 - RNA, 16 nt, Human
aucuggugacuuuccu

SEQ ID NO: 1670322 - RNA, 17 nt, Human
aucuggugacuuuccuc

SEQ ID NO: 1670323 - RNA, 17 nt, Human
aucugugaaaggaaaga

SEQ ID NO: 1670324 - RNA, 12 nt, Human
uugcuccuugac

SEQ ID NO: 1670325 - RNA, 23 nt, Human
aucugugaaaggaaagagggagg

SEQ ID NO: 1670326 - RNA, 18 nt, Human
aucugugaaaggaaagag

SEQ ID NO: 1670327 - RNA, 14 nt, Human
aucuuauaauuuaa

SEQ ID NO: 1670328 - RNA, 13 nt, Human
aucuugcucugcu

SEQ ID NO: 1670329 - RNA, 20 nt, Human
aucuuggucagauuugaacu

SEQ ID NO: 1670330 - RNA, 23 nt, Human
uuacuguacagacagaaaaaacu

SEQ ID NO: 1670331 - RNA, 12 nt, Human
uuacuguacaug

SEQ ID NO: 1670332 - RNA, 23 nt, Human
uuacuguacaugaaaacacauuu

SEQ ID NO: 1670333 - RNA, 22 nt, Human
uuacuguacaugaaaacacauu

SEQ ID NO: 1670334 - RNA, 14 nt, Human
uuacuguacaugaa

SEQ ID NO: 1670335 - RNA, 13 nt, Human
uuacuguacauga

SEQ ID NO: 1670336 - RNA, 15 nt, Human
uuacugcagcuuugu

SEQ ID NO: 1670337 - RNA, 16 nt, Human
uuagaagucacacagu

SEQ ID NO: 1670338 - RNA, 14 nt, Human
uuagaauucuguau

SEQ ID NO: 1670339 - RNA, 15 nt, Human
uuagaauucuguaua

SEQ ID NO: 1670340 - RNA, 17 nt, Human
uuagaauucuguauaga

SEQ ID NO: 1670341 - RNA, 14 nt, Human
auaagauucauauu

SEQ ID NO: 1670342 - RNA, 13 nt, Human
auaaauugcuccu

SEQ ID NO: 1670343 - RNA, 16 nt, Human
auaaauugcuccuuga

SEQ ID NO: 1670344 - RNA, 15 nt, Human
auaaaucugugaacu

SEQ ID NO: 1670345 - RNA, 16 nt, Human
auaaaucugugaacuu

SEQ ID NO: 1670346 - RNA, 19 nt, Human
auaaaucugugaacuugaa

SEQ ID NO: 1670347 - RNA, 17 nt, Human
auaaaugccaucaauaa

SEQ ID NO: 1670348 - RNA, 18 nt, Human
auaaaugccaucaauaaa

SEQ ID NO: 1670349 - RNA, 16 nt, Human
auaaaucgcuuuugau

SEQ ID NO: 1670350 - RNA, 19 nt, Human
auaaaucgcuuuugauaau

SEQ ID NO: 1670351 - RNA, 21 nt, Human
auaaaucgcuuuugauaauca

SEQ ID NO: 1670352 - RNA, 17 nt, Human
uuacaguggggaaugaa

SEQ ID NO: 1670353 - RNA, 19 nt, Human
uuaccagcagagcaccuua

SEQ ID NO: 1670354 - RNA, 20 nt, Human
uuacauaagauaaaugugcu

SEQ ID NO: 1670355 - RNA, 14 nt, Human
uuacaggugugaac

SEQ ID NO: 1670356 - RNA, 15 nt, Human
auaacuauguugaua

SEQ ID NO: 1670357 - RNA, 18 nt, Human
auaaauugcuccuugaca

SEQ ID NO: 1670358 - RNA, 21 nt, Human
uuauaaaaauaaaaaacacug

SEQ ID NO: 1670359 - RNA, 22 nt, Human
uuauaaaaauaaaaaacacugg

SEQ ID NO: 1670360 - RNA, 13 nt, Human
uuauaaacuuuac

SEQ ID NO: 1670361 - RNA, 19 nt, Human
uuaguacuccccuccuuga

SEQ ID NO: 1670362 - RNA, 13 nt, Human
uuaguagagacag

SEQ ID NO: 1670363 - RNA, 15 nt, Human
uuauaaaaauaaaaa

SEQ ID NO: 1670364 - RNA, 17 nt, Human
uuaguagagacaggguu

SEQ ID NO: 1670365 - RNA, 14 nt, Human
uuaguagagacagg

SEQ ID NO: 1670366 - RNA, 14 nt, Human
uuaguaaucauauu

SEQ ID NO: 1670367 - RNA, 13 nt, Human
uuaguaaucauau

SEQ ID NO: 1670368 - RNA, 18 nt, Human
uuagguuggcaaaaaggc

SEQ ID NO: 1670369 - RNA, 19 nt, Human
uuaggugugggggaagcac

SEQ ID NO: 1670370 - RNA, 15 nt, Human
uuaggugaggaagca

SEQ ID NO: 1670371 - RNA, 14 nt, Human
uuaggguuaugauu

SEQ ID NO: 1670372 - RNA, 16 nt, Human
uuaggguuaugauuaa

SEQ ID NO: 1670373 - RNA, 15 nt, Human
uuagggagagaagau

SEQ ID NO: 1670374 - RNA, 21 nt, Human
auaagauucauauuuacuucu

SEQ ID NO: 1670375 - RNA, 22 nt, Human
auaagccaaaaaaugcuugcuu

SEQ ID NO: 1670376 - RNA, 14 nt, Human
auaagccagacauc

SEQ ID NO: 1670377 - RNA, 23 nt, Human
auaauucacauuguauucagagu

SEQ ID NO: 1670378 - RNA, 14 nt, Human
auaaucuuucacag

SEQ ID NO: 1670379 - RNA, 20 nt, Human
auaauucaggaagcagcuuu

SEQ ID NO: 1670380 - RNA, 12 nt, Human
auaauuuuaaau

SEQ ID NO: 1670381 - RNA, 13 nt, Human
auaauuuuaaaug

SEQ ID NO: 1670382 - RNA, 14 nt, Human
auaauuuuaaaugu

SEQ ID NO: 1670383 - RNA, 13 nt, Human
uuaaucuuuaauu

SEQ ID NO: 1670384 - RNA, 17 nt, Human
uuaaucuuuaauuuuac

SEQ ID NO: 1670385 - RNA, 14 nt, Human
uuaauuuuggaauu

SEQ ID NO: 1670386 - RNA, 15 nt, Human
uuaauuuuggaauuu

SEQ ID NO: 1670387 - RNA, 13 nt, Human
uuaauuuuggaau

SEQ ID NO: 1670388 - RNA, 16 nt, Human
uuaauuugguuuucac

SEQ ID NO: 1670389 - RNA, 22 nt, Human
uuaagacgaaacauuuguucua

SEQ ID NO: 1670390 - RNA, 22 nt, Human
uuaagagagucuauuuacggaa

SEQ ID NO: 1670391 - RNA, 15 nt, Human
uuaaucuaaauggaa

SEQ ID NO: 1670392 - RNA, 19 nt, Human
auaaaagccuguuuaagag

SEQ ID NO: 1670393 - RNA, 20 nt, Human
auaaaagccuguuuaagaga

SEQ ID NO: 1670394 - RNA, 22 nt, Human
auaaaagggacugagaaauuua

SEQ ID NO: 1670395 - RNA, 22 nt, Human
uuaacuuuuauaaacuuuaccu

SEQ ID NO: 1670396 - RNA, 23 nt, Human
uuaacuuuuauaaacuuuaccuu

SEQ ID NO: 1670397 - RNA, 23 nt, Human
uuaagacauuuuuggaaggggac

SEQ ID NO: 1670398 - RNA, 18 nt, Human
uuaagacauuuuuggaag

SEQ ID NO: 1670399 - RNA, 19 nt, Human
uuaagacgaaacauuuguu

SEQ ID NO: 1670400 - RNA, 19 nt, Human
uuaagaaaaaggaugcaca

SEQ ID NO: 1670401 - RNA, 14 nt, Human
uuaagaaugaaaua

SEQ ID NO: 1670402 - RNA, 20 nt, Human
uuaagaaugaaauacuguuu

SEQ ID NO: 1670403 - RNA, 22 nt, Human
uuaagaaugaaauacuguuuga

SEQ ID NO: 1670404 - RNA, 18 nt, Human
aguuuuguuuggaccaaa

SEQ ID NO: 1670405 - RNA, 15 nt, Human
aguuuuuuuuauaca

SEQ ID NO: 1670406 - RNA, 14 nt, Human
aguuuuguuuggac

SEQ ID NO: 1670407 - RNA, 16 nt, Human
aguuuuguuuggacca

SEQ ID NO: 1670408 - RNA, 12 nt, Human
aguuuuguuugg

SEQ ID NO: 1670409 - RNA, 16 nt, Human
aguuuuauaugcuucu

SEQ ID NO: 1670410 - RNA, 17 nt, Human
uuaaaccaugggauaaa

SEQ ID NO: 1670411 - RNA, 22 nt, Human
uuaaacauugguucuuguauua

SEQ ID NO: 1670412 - RNA, 20 nt, Human
uuaaacauugguucuuguau

SEQ ID NO: 1670413 - RNA, 12 nt, Human
uuaaaaugagaa

SEQ ID NO: 1670414 - RNA, 19 nt, Human
uuaaaaugagaaaucuaaa

SEQ ID NO: 1670415 - RNA, 20 nt, Human
uuaaaaaucucaaauuucua

SEQ ID NO: 1670416 - RNA, 19 nt, Human
uuaaaaaucucaaauuucu

SEQ ID NO: 1670417 - RNA, 16 nt, Human
uuaaaaaauggaacau

SEQ ID NO: 1670418 - RNA, 20 nt, Human
uuaaaaaugguuuaaauggu

SEQ ID NO: 1670419 - RNA, 22 nt, Human
uuaaaaucauuucugcaucagc

SEQ ID NO: 1670420 - RNA, 19 nt, Human
uuaaaaaagaaacauuugg

SEQ ID NO: 1670421 - RNA, 16 nt, Human
aguuuagcuggaaaag

SEQ ID NO: 1670422 - RNA, 15 nt, Human
aguuuagcuggaaaa

SEQ ID NO: 1670423 - RNA, 20 nt, Human
aguuuaaauuguaauaggcg

SEQ ID NO: 1670424 - RNA, 17 nt, Human
aguuuaaauuguaauag

SEQ ID NO: 1670425 - RNA, 15 nt, Human
aguuuguugaaacac

SEQ ID NO: 1670426 - RNA, 19 nt, Human
aguuucugccgcagcccug

SEQ ID NO: 1670427 - RNA, 22 nt, Human
aguuuguuaguaugaggcauuu

SEQ ID NO: 1670428 - RNA, 15 nt, Human
aguuucugccgcagc

SEQ ID NO: 1670429 - RNA, 13 nt, Human
aguuucucagcuc

SEQ ID NO: 1670430 - RNA, 15 nt, Human
aguuucucagcuccc

SEQ ID NO: 1670431 - RNA, 14 nt, Human
aguuucucuuuuca

SEQ ID NO: 1670432 - RNA, 16 nt, Human
uuaacagaaauguaca

SEQ ID NO: 1670433 - RNA, 14 nt, Human
uuaacagaaaugua

SEQ ID NO: 1670434 - RNA, 13 nt, Human
uuaacagaaaugu

SEQ ID NO: 1670435 - RNA, 12 nt, Human
uuaacagaaaug

SEQ ID NO: 1670436 - RNA, 13 nt, Human
uuaaaguugaauu

SEQ ID NO: 1670437 - RNA, 16 nt, Human
uuaaaguugaauuuau

SEQ ID NO: 1670438 - RNA, 17 nt, Human
uuaaaguugaauuuauu

SEQ ID NO: 1670439 - RNA, 22 nt, Human
uuaaaguugaauuuauuggcuu

SEQ ID NO: 1670440 - RNA, 21 nt, Human
uuaaaccaugggauaaaugcc

SEQ ID NO: 1670441 - RNA, 22 nt, Human
uuaaaccaugggauaaaugcca

SEQ ID NO: 1670442 - RNA, 23 nt, Human
uuaaaccaugggauaaaugccau

SEQ ID NO: 1670443 - RNA, 15 nt, Human
uuaugugaaacaugu

SEQ ID NO: 1670444 - RNA, 22 nt, Human
uuaugugccagauuuaugcaua

SEQ ID NO: 1670445 - RNA, 16 nt, Human
uuaugugcgcugauaa

SEQ ID NO: 1670446 - RNA, 13 nt, Human
uuaugugaaacau

SEQ ID NO: 1670447 - RNA, 11 nt, Human
uuauguaaauc

SEQ ID NO: 1670448 - RNA, 12 nt, Human
uuauguaaaucc

SEQ ID NO: 1670449 - RNA, 13 nt, Human
uuauguaaauccc

SEQ ID NO: 1670450 - RNA, 19 nt, Human
uuauguaaaucccauuauu

SEQ ID NO: 1670451 - RNA, 21 nt, Human
uuauguaaaucccauuauuca

SEQ ID NO: 1670452 - RNA, 22 nt, Human
uuauguaaaucccauuauucaa

SEQ ID NO: 1670453 - RNA, 23 nt, Human
uuauguaaaucccauuauucaaa

SEQ ID NO: 1670454 - RNA, 22 nt, Human
uuaugggcuggguucuacccag

SEQ ID NO: 1670455 - RNA, 22 nt, Human
uuaugauccagcagauuauuca

SEQ ID NO: 1670456 - RNA, 23 nt, Human
uuaugauccagcagauuauucac

SEQ ID NO: 1670457 - RNA, 19 nt, Human
uuaugauuaaguaaugaua

SEQ ID NO: 1670458 - RNA, 13 nt, Human
uuaugggcugggu

SEQ ID NO: 1670459 - RNA, 19 nt, Human
uuauggcuuuugugcauua

SEQ ID NO: 1670460 - RNA, 22 nt, Human
uuaugauuaaguaaugauaacu

SEQ ID NO: 1670461 - RNA, 16 nt, Human
uuaugaaacuugugua

SEQ ID NO: 1670462 - RNA, 18 nt, Human
uuaugaaacuuguguaaa

SEQ ID NO: 1670463 - RNA, 13 nt, Human
uuaugaaacuugu

SEQ ID NO: 1670464 - RNA, 19 nt, Human
uuaugaaacuuguguaaau

SEQ ID NO: 1670465 - RNA, 14 nt, Human
uuaugaaacuuuug

SEQ ID NO: 1670466 - RNA, 17 nt, Human
uuaugaaacuuuuggaa

SEQ ID NO: 1670467 - RNA, 18 nt, Human
uuaugaaacuuuuggaag

SEQ ID NO: 1670468 - RNA, 20 nt, Human
uuaugaagcuuuuaugugaa

SEQ ID NO: 1670469 - RNA, 19 nt, Human
uuaugaaacuuuuggaagg

SEQ ID NO: 1670470 - RNA, 21 nt, Human
uuaucacccagaagaaaauag

SEQ ID NO: 1670471 - RNA, 19 nt, Human
uuaucacccagaagaaaau

SEQ ID NO: 1670472 - RNA, 18 nt, Human
uuaucacccagaagaaaa

SEQ ID NO: 1670473 - RNA, 17 nt, Human
uuaucacccagaagaaa

SEQ ID NO: 1670474 - RNA, 13 nt, Human
uuaugauccagca

SEQ ID NO: 1670475 - RNA, 18 nt, Human
uuaugauccagcagauua

SEQ ID NO: 1670476 - RNA, 20 nt, Human
uuaugauacuugaaaauuaa

SEQ ID NO: 1670477 - RNA, 19 nt, Human
uuaugacuucauuaauaau

SEQ ID NO: 1670478 - RNA, 22 nt, Human
uuaugacuucauuaauaauaaa

SEQ ID NO: 1670479 - RNA, 14 nt, Human
uuaugagcugugag

SEQ ID NO: 1670480 - RNA, 21 nt, Human
uuaugagcugugagaagggug

SEQ ID NO: 1670481 - RNA, 14 nt, Human
uuaugaauuacauu

SEQ ID NO: 1670482 - RNA, 16 nt, Human
uuaugaauuacauuug

SEQ ID NO: 1670483 - RNA, 17 nt, Human
uuaugaauuacauuugu

SEQ ID NO: 1670484 - RNA, 11 nt, Human
uuaugacucca

SEQ ID NO: 1670485 - RNA, 21 nt, Human
uuaugaauuacauuuguauaa

SEQ ID NO: 1670486 - RNA, 21 nt, Human
auacaggaugaugacuaugga

SEQ ID NO: 1670487 - RNA, 18 nt, Human
auacaguuacucagaauu

SEQ ID NO: 1670488 - RNA, 23 nt, Human
auacagauagauauaugcucugc

SEQ ID NO: 1670489 - RNA, 23 nt, Human
auacaggaaaagcugcugacagu

SEQ ID NO: 1670490 - RNA, 20 nt, Human
auacaguuacucagaauucu

SEQ ID NO: 1670491 - RNA, 22 nt, Human
uuauaaacuuuuuucuuacugu

SEQ ID NO: 1670492 - RNA, 12 nt, Human
uuauaaacuuuu

SEQ ID NO: 1670493 - RNA, 16 nt, Human
uuauaaacuuuuuucu

SEQ ID NO: 1670494 - RNA, 18 nt, Human
uuauaaacuuuaccuuuu

SEQ ID NO: 1670495 - RNA, 17 nt, Human
uuauaaacuuuaccuuu

SEQ ID NO: 1670496 - RNA, 16 nt, Human
auacagaggcaacugc

SEQ ID NO: 1670497 - RNA, 17 nt, Human
auacagaggcaacugca

SEQ ID NO: 1670498 - RNA, 19 nt, Human
uuauauuugaaauauugac

SEQ ID NO: 1670499 - RNA, 20 nt, Human
auacuaaccagcagaaaugc

SEQ ID NO: 1670500 - RNA, 19 nt, Human
auacuaaccagcagaaaug

SEQ ID NO: 1670501 - RNA, 13 nt, Human
auacuaaccagca

SEQ ID NO: 1670502 - RNA, 17 nt, Human
auacuauggaauuucuc

SEQ ID NO: 1670503 - RNA, 14 nt, Human
auaccuuuuuuaga

SEQ ID NO: 1670504 - RNA, 17 nt, Human
auaccagccaguaaaug

SEQ ID NO: 1670505 - RNA, 18 nt, Human
auaccacuuuuguucuug

SEQ ID NO: 1670506 - RNA, 17 nt, Human
auaccacuuuuguucuu

SEQ ID NO: 1670507 - RNA, 18 nt, Human
auacgugggcauucaaau

SEQ ID NO: 1670508 - RNA, 19 nt, Human
auacgugggcauucaaaug

SEQ ID NO: 1670509 - RNA, 16 nt, Human
auacguacacauuuua

SEQ ID NO: 1670510 - RNA, 15 nt, Human
auacguacacauuuu

SEQ ID NO: 1670511 - RNA, 14 nt, Human
auacguacacauuu

SEQ ID NO: 1670512 - RNA, 13 nt, Human
auacguacacauu

SEQ ID NO: 1670513 - RNA, 15 nt, Human
auacuggauuguacu

SEQ ID NO: 1670514 - RNA, 18 nt, Human
auacucuuauagacaaca

SEQ ID NO: 1670515 - RNA, 14 nt, Human
auacucuuauaucu

SEQ ID NO: 1670516 - RNA, 18 nt, Human
auacucuuauaucuauau

SEQ ID NO: 1670517 - RNA, 16 nt, Human
auacucugcuuagaau

SEQ ID NO: 1670518 - RNA, 17 nt, Human
auacuccuccaagguua

SEQ ID NO: 1670519 - RNA, 14 nt, Human
auacucccaucugu

SEQ ID NO: 1670520 - RNA, 11 nt, Human
auacucccauc

SEQ ID NO: 1670521 - RNA, 16 nt, Human
auacucauuaggaugg

SEQ ID NO: 1670522 - RNA, 20 nt, Human
uuauucacuuuuauuuagca

SEQ ID NO: 1670523 - RNA, 14 nt, Human
uuauucacugauuu

SEQ ID NO: 1670524 - RNA, 12 nt, Human
uuauucauaauu

SEQ ID NO: 1670525 - RNA, 13 nt, Human
uuauucaaaguug

SEQ ID NO: 1670526 - RNA, 15 nt, Human
uuauucaaaguugcc

SEQ ID NO: 1670527 - RNA, 19 nt, Human
uuauucaaaguugccuaaa

SEQ ID NO: 1670528 - RNA, 16 nt, Human
uuauuauguaaauccc

SEQ ID NO: 1670529 - RNA, 22 nt, Human
uuauuauguaaaucccauuauu

SEQ ID NO: 1670530 - RNA, 13 nt, Human
uuauuauguaaau

SEQ ID NO: 1670531 - RNA, 14 nt, Human
uuauuauguaaauc

SEQ ID NO: 1670532 - RNA, 13 nt, Human
uuauuaugcauga

SEQ ID NO: 1670533 - RNA, 14 nt, Human
uuauuauauuuaca

SEQ ID NO: 1670534 - RNA, 19 nt, Human
uuauguuaaaacugggaca

SEQ ID NO: 1670535 - RNA, 17 nt, Human
uuauuaugaaacuugug

SEQ ID NO: 1670536 - RNA, 20 nt, Human
uuauuaugaaacuuguguaa

SEQ ID NO: 1670537 - RNA, 21 nt, Human
uuauuaugaaacuuguguaaa

SEQ ID NO: 1670538 - RNA, 22 nt, Human
uuauuaugaaacuuguguaaau

SEQ ID NO: 1670539 - RNA, 23 nt, Human
uuauuaugaaacuuguguaaaua

SEQ ID NO: 1670540 - RNA, 12 nt, Human
uuauuaugcaug

SEQ ID NO: 1670541 - RNA, 11 nt, Human
uuauuaugaaa

SEQ ID NO: 1670542 - RNA, 15 nt, Human
uuauuauauuuacaa

SEQ ID NO: 1670543 - RNA, 14 nt, Human
auagaaccucuuug

SEQ ID NO: 1670544 - RNA, 20 nt, Human
auagaaccucuuugucuaca

SEQ ID NO: 1670545 - RNA, 13 nt, Human
auagaaguaaaaa

SEQ ID NO: 1670546 - RNA, 23 nt, Human
auagacaauuuauuauggcacau

SEQ ID NO: 1670547 - RNA, 22 nt, Human
auagacaauuuauuauggcaca

SEQ ID NO: 1670548 - RNA, 16 nt, Human
auagacaauuuauuau

SEQ ID NO: 1670549 - RNA, 14 nt, Human
auagaauaaaauuu

SEQ ID NO: 1670550 - RNA, 19 nt, Human
auagaauaaaauuuuuaau

SEQ ID NO: 1670551 - RNA, 22 nt, Human
auagaauaaaauuuuuaaucuu

SEQ ID NO: 1670552 - RNA, 17 nt, Human
auagaauuaacacauga

SEQ ID NO: 1670553 - RNA, 22 nt, Human
auagauuagagaguguugaaac

SEQ ID NO: 1670554 - RNA, 13 nt, Human
auagauuagaauu

SEQ ID NO: 1670555 - RNA, 15 nt, Human
auagauuagaauucu

SEQ ID NO: 1670556 - RNA, 16 nt, Human
auagauuagaauucug

SEQ ID NO: 1670557 - RNA, 21 nt, Human
auagauuagagaguguugaaa

SEQ ID NO: 1670558 - RNA, 18 nt, Human
auagacccacaagaggca

SEQ ID NO: 1670559 - RNA, 14 nt, Human
auagagagagacca

SEQ ID NO: 1670560 - RNA, 21 nt, Human
auagaggaagccugauuaaag

SEQ ID NO: 1670561 - RNA, 22 nt, Human
auagaggaagccugauuaaaga

SEQ ID NO: 1670562 - RNA, 18 nt, Human
auagauaggucagugcaa

SEQ ID NO: 1670563 - RNA, 21 nt, Human
ugugcucaggagcccugggag

SEQ ID NO: 1670564 - RNA, 12 nt, Human
ugugcucugauc

SEQ ID NO: 1670565 - RNA, 18 nt, Human
ugugcugagucugaaggc

SEQ ID NO: 1670566 - RNA, 19 nt, Human
ugugcugagucugaaggcu

SEQ ID NO: 1670567 - RNA, 12 nt, Human
ugugcugcccug

SEQ ID NO: 1670568 - RNA, 21 nt, Human
uguggaucaaauccagccugc

SEQ ID NO: 1670569 - RNA, 14 nt, Human
uguggaugauaaaa

SEQ ID NO: 1670570 - RNA, 22 nt, Human
uguggauuuaacagaaauguac

SEQ ID NO: 1670571 - RNA, 23 nt, Human
agugagcugguuuuuagcggaga

SEQ ID NO: 1670572 - RNA, 20 nt, Human
uguggauuuaacagaaaugu

SEQ ID NO: 1670573 - RNA, 19 nt, Human
uguggauuuaacagaaaug

SEQ ID NO: 1670574 - RNA, 19 nt, Human
ugugcugggguuaucugaa

SEQ ID NO: 1670575 - RNA, 20 nt, Human
ugugcugguguaugugugaa

SEQ ID NO: 1670576 - RNA, 18 nt, Human
ugugcugcccugcccacc

SEQ ID NO: 1670577 - RNA, 19 nt, Human
ugugcugcccugcccaccu

SEQ ID NO: 1670578 - RNA, 20 nt, Human
ugugcugcccugcccaccug

SEQ ID NO: 1670579 - RNA, 21 nt, Human
ugugcugcccugcccaccugg

SEQ ID NO: 1670580 - RNA, 14 nt, Human
agugccaaaaacaa

SEQ ID NO: 1670581 - RNA, 16 nt, Human
agugcaugcugucccu

SEQ ID NO: 1670582 - RNA, 17 nt, Human
agugcacuaauguguaa

SEQ ID NO: 1670583 - RNA, 21 nt, Human
agugcacuaauguguaagaca

SEQ ID NO: 1670584 - RNA, 17 nt, Human
agugcagugagccgaga

SEQ ID NO: 1670585 - RNA, 16 nt, Human
agugaggaugaaaaaa

SEQ ID NO: 1670586 - RNA, 21 nt, Human
agugaguuggguguauugugc

SEQ ID NO: 1670587 - RNA, 13 nt, Human
agugaggcucugc

SEQ ID NO: 1670588 - RNA, 12 nt, Human
agugaggcucug

SEQ ID NO: 1670589 - RNA, 14 nt, Human
agugcaaauuguca

SEQ ID NO: 1670590 - RNA, 12 nt, Human
agucugaaggcu

SEQ ID NO: 1670591 - RNA, 13 nt, Human
agucuuagaugua

SEQ ID NO: 1670592 - RNA, 17 nt, Human
agucuugucucagauuu

SEQ ID NO: 1670593 - RNA, 19 nt, Human
agucuugucucagauuuua

SEQ ID NO: 1670594 - RNA, 16 nt, Human
agucuugucucagauu

SEQ ID NO: 1670595 - RNA, 23 nt, Human
agucuuagauguauauauuuccu

SEQ ID NO: 1670596 - RNA, 14 nt, Human
agucuuagauguau

SEQ ID NO: 1670597 - RNA, 16 nt, Human
agucuuagauguauau

SEQ ID NO: 1670598 - RNA, 19 nt, Human
agucucuucuccacuggau

SEQ ID NO: 1670599 - RNA, 21 nt, Human
agucucuucuccacuggaugg

SEQ ID NO: 1670600 - RNA, 16 nt, Human
agucucuugauucaua

SEQ ID NO: 1670601 - RNA, 17 nt, Human
agucucuugauucauaa

SEQ ID NO: 1670602 - RNA, 18 nt, Human
ugugacuucagcucuguu

SEQ ID NO: 1670603 - RNA, 19 nt, Human
ugugacuucagcucuguuu

SEQ ID NO: 1670604 - RNA, 16 nt, Human
ugugacugaucucucg

SEQ ID NO: 1670605 - RNA, 11 nt, Human
ugugaggaagc

SEQ ID NO: 1670606 - RNA, 12 nt, Human
ugugaggaagcc

SEQ ID NO: 1670607 - RNA, 14 nt, Human
agugagcacuaagg

SEQ ID NO: 1670608 - RNA, 22 nt, Human
agugagcacuaaggugugcucu

SEQ ID NO: 1670609 - RNA, 22 nt, Human
ugugaugaugaaaugaggucag

SEQ ID NO: 1670610 - RNA, 19 nt, Human
ugugaugagaggaaaucac

SEQ ID NO: 1670611 - RNA, 12 nt, Human
agugagcugguu

SEQ ID NO: 1670612 - RNA, 18 nt, Human
agucuuucacauuuaaau

SEQ ID NO: 1670613 - RNA, 21 nt, Human
agugaacaaauuuacagagac

SEQ ID NO: 1670614 - RNA, 20 nt, Human
agucuugucucagauuuuau

SEQ ID NO: 1670615 - RNA, 21 nt, Human
agucuugucucagauuuuauu

SEQ ID NO: 1670616 - RNA, 16 nt, Human
agucuuucacauuuaa

SEQ ID NO: 1670617 - RNA, 20 nt, Human
agugaacuugggccacugug

SEQ ID NO: 1670618 - RNA, 21 nt, Human
agugacugauggcuaauguac

SEQ ID NO: 1670619 - RNA, 16 nt, Human
agugaacuugggccac

SEQ ID NO: 1670620 - RNA, 22 nt, Human
agugaacaaauuuacagagaca

SEQ ID NO: 1670621 - RNA, 23 nt, Human
agugaacaaauuuacagagacag

SEQ ID NO: 1670622 - RNA, 13 nt, Human
uguuaugacucca

SEQ ID NO: 1670623 - RNA, 17 nt, Human
uguuaugacuccagaau

SEQ ID NO: 1670624 - RNA, 22 nt, Human
agugugguguuuccuggcacug

SEQ ID NO: 1670625 - RNA, 19 nt, Human
uguuccacaaguuaaauaa

SEQ ID NO: 1670626 - RNA, 15 nt, Human
aguguggcaaaauaa

SEQ ID NO: 1670627 - RNA, 21 nt, Human
agugugccugaagucccagau

SEQ ID NO: 1670628 - RNA, 20 nt, Human
agugugacugaucucucgug

SEQ ID NO: 1670629 - RNA, 18 nt, Human
aguguguguuuuucauaa

SEQ ID NO: 1670630 - RNA, 19 nt, Human
aguguguguuuuucauaaa

SEQ ID NO: 1670631 - RNA, 16 nt, Human
aguguuguggauuuaa

SEQ ID NO: 1670632 - RNA, 23 nt, Human
aguuacuaucaugucaaacguga

SEQ ID NO: 1670633 - RNA, 13 nt, Human
aguuacucagaau

SEQ ID NO: 1670634 - RNA, 20 nt, Human
aguguuguggauuuaacaga

SEQ ID NO: 1670635 - RNA, 19 nt, Human
aguguuguggauuuaacag

SEQ ID NO: 1670636 - RNA, 15 nt, Human
uguugcauagaauaa

SEQ ID NO: 1670637 - RNA, 15 nt, Human
uguucuaagaaguga

SEQ ID NO: 1670638 - RNA, 23 nt, Human
uguugcccaggcuggcgugcagu

SEQ ID NO: 1670639 - RNA, 20 nt, Human
uguugcccaggcuggcgugc

SEQ ID NO: 1670640 - RNA, 22 nt, Human
uguugcccacagcuguaugauu

SEQ ID NO: 1670641 - RNA, 20 nt, Human
ugugucuugcaauggcagcc

SEQ ID NO: 1670642 - RNA, 11 nt, Human
uguguguuuau

SEQ ID NO: 1670643 - RNA, 16 nt, Human
agugcccuccaggaua

SEQ ID NO: 1670644 - RNA, 17 nt, Human
aguggauggaaggggcu

SEQ ID NO: 1670645 - RNA, 15 nt, Human
aguggggacagagca

SEQ ID NO: 1670646 - RNA, 14 nt, Human
aguggggaggggcu

SEQ ID NO: 1670647 - RNA, 16 nt, Human
aguggggaaugaagau

SEQ ID NO: 1670648 - RNA, 11 nt, Human
aguggcagcug

SEQ ID NO: 1670649 - RNA, 22 nt, Human
uguuaaguugauggugaugaaa

SEQ ID NO: 1670650 - RNA, 17 nt, Human
uguuacaaauuguagaa

SEQ ID NO: 1670651 - RNA, 18 nt, Human
uguuacaaauuguagaag

SEQ ID NO: 1670652 - RNA, 19 nt, Human
uguuacauaagauaaaugu

SEQ ID NO: 1670653 - RNA, 22 nt, Human
uguguuaucacccagaagaaaa

SEQ ID NO: 1670654 - RNA, 16 nt, Human
uguguuagagauuuuu

SEQ ID NO: 1670655 - RNA, 23 nt, Human
uguguuaucacccagaagaaaau

SEQ ID NO: 1670656 - RNA, 16 nt, Human
uguuaacugagugccu

SEQ ID NO: 1670657 - RNA, 22 nt, Human
uguuaacugagugccuuuuggu

SEQ ID NO: 1670658 - RNA, 17 nt, Human
agucaccccggccaccu

SEQ ID NO: 1670659 - RNA, 15 nt, Human
agucaccaagcccag

SEQ ID NO: 1670660 - RNA, 19 nt, Human
aguauucuuauuuaaugaa

SEQ ID NO: 1670661 - RNA, 13 nt, Human
aguauaauuaaca

SEQ ID NO: 1670662 - RNA, 14 nt, Human
aguauaauuaacau

SEQ ID NO: 1670663 - RNA, 16 nt, Human
aguauaauuaacaugu

SEQ ID NO: 1670664 - RNA, 23 nt, Human
aguauaauuaacauguuaaacca

SEQ ID NO: 1670665 - RNA, 12 nt, Human
aguauuaagcau

SEQ ID NO: 1670666 - RNA, 14 nt, Human
aguauuaagcauau

SEQ ID NO: 1670667 - RNA, 14 nt, Human
uguccaagaagccc

SEQ ID NO: 1670668 - RNA, 15 nt, Human
uguccaagaagccca

SEQ ID NO: 1670669 - RNA, 17 nt, Human
ugucagguggggcagcu

SEQ ID NO: 1670670 - RNA, 18 nt, Human
ugucagguggggcagcuu

SEQ ID NO: 1670671 - RNA, 20 nt, Human
ugucagguggggcagcuuga

SEQ ID NO: 1670672 - RNA, 20 nt, Human
ugucauuugagcagggcuca

SEQ ID NO: 1670673 - RNA, 21 nt, Human
ugucauuugagcagggcucag

SEQ ID NO: 1670674 - RNA, 22 nt, Human
ugucauuugagcagggcucagc

SEQ ID NO: 1670675 - RNA, 16 nt, Human
uguccaagaagcccag

SEQ ID NO: 1670676 - RNA, 17 nt, Human
uguccaagaagcccagg

SEQ ID NO: 1670677 - RNA, 18 nt, Human
uguccaagaagcccagga

SEQ ID NO: 1670678 - RNA, 22 nt, Human
uguccaagaagcccaggaaagg

SEQ ID NO: 1670679 - RNA, 20 nt, Human
ugucccugcacuugcagacu

SEQ ID NO: 1670680 - RNA, 22 nt, Human
ugucccugcacuugcagacucu

SEQ ID NO: 1670681 - RNA, 23 nt, Human
ugucccugcacuugcagacucua

SEQ ID NO: 1670682 - RNA, 17 nt, Human
agucccaggcugagccu

SEQ ID NO: 1670683 - RNA, 18 nt, Human
agucccaggcugagccuc

SEQ ID NO: 1670684 - RNA, 19 nt, Human
agucccaggcugagccuca

SEQ ID NO: 1670685 - RNA, 18 nt, Human
agucccaccuuggcugca

SEQ ID NO: 1670686 - RNA, 19 nt, Human
agucccaccuuggcugcag

SEQ ID NO: 1670687 - RNA, 20 nt, Human
agucccaccuuggcugcagg

SEQ ID NO: 1670688 - RNA, 15 nt, Human
agucccaccuuggcu

SEQ ID NO: 1670689 - RNA, 16 nt, Human
agucccaccuuggcug

SEQ ID NO: 1670690 - RNA, 14 nt, Human
ugucgccucugcau

SEQ ID NO: 1670691 - RNA, 19 nt, Human
ugucccuuacgugaguccu

SEQ ID NO: 1670692 - RNA, 23 nt, Human
ugucccuuacgugaguccuggca

SEQ ID NO: 1670693 - RNA, 22 nt, Human
agucagaaguuucugccgcagc

SEQ ID NO: 1670694 - RNA, 14 nt, Human
agucaggaaagaga

SEQ ID NO: 1670695 - RNA, 16 nt, Human
agucccccugccccag

SEQ ID NO: 1670696 - RNA, 14 nt, Human
aguccucccaucuc

SEQ ID NO: 1670697 - RNA, 16 nt, Human
aguccucccaucucac

SEQ ID NO: 1670698 - RNA, 15 nt, Human
agucuauuuacggaa

SEQ ID NO: 1670699 - RNA, 20 nt, Human
agucuauuuacggaacucaa

SEQ ID NO: 1670700 - RNA, 23 nt, Human
agucucacuguugcccaggcugg

SEQ ID NO: 1670701 - RNA, 13 nt, Human
agucucaggaaau

SEQ ID NO: 1670702 - RNA, 16 nt, Human
agucucaggaaaucaa

SEQ ID NO: 1670703 - RNA, 12 nt, Human
aggugugcucug

SEQ ID NO: 1670704 - RNA, 14 nt, Human
agguugaagcacca

SEQ ID NO: 1670705 - RNA, 16 nt, Human
aggugucccugcacuu

SEQ ID NO: 1670706 - RNA, 20 nt, Human
aggugucccugcacuugcag

SEQ ID NO: 1670707 - RNA, 21 nt, Human
aggugugagucaccaagccca

SEQ ID NO: 1670708 - RNA, 22 nt, Human
aggugugagucaccaagcccag

SEQ ID NO: 1670709 - RNA, 13 nt, Human
ugggcugcccugg

SEQ ID NO: 1670710 - RNA, 14 nt, Human
ugggcugcccuggu

SEQ ID NO: 1670711 - RNA, 15 nt, Human
ugggcugcccuggug

SEQ ID NO: 1670712 - RNA, 16 nt, Human
ugggcugcccuggugc

SEQ ID NO: 1670713 - RNA, 12 nt, Human
aggugggaggau

SEQ ID NO: 1670714 - RNA, 16 nt, Human
aggugcuacaaaaaca

SEQ ID NO: 1670715 - RNA, 14 nt, Human
uguacauauaagug

SEQ ID NO: 1670716 - RNA, 14 nt, Human
uguacaugaaaaca

SEQ ID NO: 1670717 - RNA, 16 nt, Human
uguacaugaaaacaca

SEQ ID NO: 1670718 - RNA, 20 nt, Human
uguacauaaugcgugcauac

SEQ ID NO: 1670719 - RNA, 19 nt, Human
uguacauaaugcgugcaua

SEQ ID NO: 1670720 - RNA, 20 nt, Human
uguaauuuuuuuaucgucac

SEQ ID NO: 1670721 - RNA, 20 nt, Human
agguuggcaaaaaggcagga

SEQ ID NO: 1670722 - RNA, 13 nt, Human
uguaagggaaacu

SEQ ID NO: 1670723 - RNA, 18 nt, Human
uguaagggaaacugccag

SEQ ID NO: 1670724 - RNA, 23 nt, Human
uguaauuaaguacuauguaucaa

SEQ ID NO: 1670725 - RNA, 19 nt, Human
uguaauuaaguacuaugua

SEQ ID NO: 1670726 - RNA, 21 nt, Human
uguaauuaaguacuauguauc

SEQ ID NO: 1670727 - RNA, 18 nt, Human
uguaauuaaguacuaugu

SEQ ID NO: 1670728 - RNA, 19 nt, Human
uguaagggaaacugccagc

SEQ ID NO: 1670729 - RNA, 21 nt, Human
aguacacuguuucaaacuuua

SEQ ID NO: 1670730 - RNA, 23 nt, Human
aguacacuguuucaaacuuuacu

SEQ ID NO: 1670731 - RNA, 13 nt, Human
aguaaugauaacu

SEQ ID NO: 1670732 - RNA, 12 nt, Human
aguaauuggaaa

SEQ ID NO: 1670733 - RNA, 13 nt, Human
aguaauuggaaag

SEQ ID NO: 1670734 - RNA, 16 nt, Human
aguaaaaacaaagaaa

SEQ ID NO: 1670735 - RNA, 23 nt, Human
aguaaaaacaaagaaauuaugug

SEQ ID NO: 1670736 - RNA, 21 nt, Human
uguacauggaauaacauguaa

SEQ ID NO: 1670737 - RNA, 16 nt, Human
aguaaaaccacagcag

SEQ ID NO: 1670738 - RNA, 17 nt, Human
aguaaaaccacagcagu

SEQ ID NO: 1670739 - RNA, 19 nt, Human
aguaaaaccacagcaguug

SEQ ID NO: 1670740 - RNA, 20 nt, Human
aguaaaaccacagcaguuga

SEQ ID NO: 1670741 - RNA, 17 nt, Human
uguaguguuggagaaga

SEQ ID NO: 1670742 - RNA, 18 nt, Human
uguaguguuggagaagaa

SEQ ID NO: 1670743 - RNA, 18 nt, Human
uguauauauuuccuauau

SEQ ID NO: 1670744 - RNA, 22 nt, Human
uguauauauuuccuauauuguu

SEQ ID NO: 1670745 - RNA, 16 nt, Human
uguaggguuauaauaa

SEQ ID NO: 1670746 - RNA, 17 nt, Human
uguaggguuauaauaau

SEQ ID NO: 1670747 - RNA, 16 nt, Human
uguaguguuggagaag

SEQ ID NO: 1670748 - RNA, 21 nt, Human
uggaggaaaaccaagccgugg

SEQ ID NO: 1670749 - RNA, 23 nt, Human
uggaggaaaaccaagccguggcu

SEQ ID NO: 1670750 - RNA, 15 nt, Human
aggcaaugcuggcug

SEQ ID NO: 1670751 - RNA, 16 nt, Human
aggcaaugcuggcugu

SEQ ID NO: 1670752 - RNA, 23 nt, Human
uggagccugcacggugaauggcu

SEQ ID NO: 1670753 - RNA, 22 nt, Human
uggacuuuguuaguuucuccaa

SEQ ID NO: 1670754 - RNA, 11 nt, Human
uggacuuuguu

SEQ ID NO: 1670755 - RNA, 19 nt, Human
uggagcccacuguacuugc

SEQ ID NO: 1670756 - RNA, 23 nt, Human
uggagcccacuguacuugcucuu

SEQ ID NO: 1670757 - RNA, 16 nt, Human
uggagcccacuguacu

SEQ ID NO: 1670758 - RNA, 24 nt, Human
uggacuuuguuaguuucuccaagc

SEQ ID NO: 1670759 - RNA, 16 nt, Human
uggagaagaacugaaa

SEQ ID NO: 1670760 - RNA, 21 nt, Human
aggcaggucuugaacuccugg

SEQ ID NO: 1670761 - RNA, 22 nt, Human
aggcaguugagaaaauuugaau

SEQ ID NO: 1670762 - RNA, 22 nt, Human
aggcagggucucacucugucgc

SEQ ID NO: 1670763 - RNA, 14 nt, Human
aggcagguccaggg

SEQ ID NO: 1670764 - RNA, 19 nt, Human
aggcagggucucacucugu

SEQ ID NO: 1670765 - RNA, 18 nt, Human
aggcagggucucacucug

SEQ ID NO: 1670766 - RNA, 20 nt, Human
aggcagggucucacucuguc

SEQ ID NO: 1670767 - RNA, 21 nt, Human
aggcagggucucacucugucg

SEQ ID NO: 1670768 - RNA, 16 nt, Human
aggcagggagggccug

SEQ ID NO: 1670769 - RNA, 20 nt, Human
aggcaggaguuucguuuuca

SEQ ID NO: 1670770 - RNA, 12 nt, Human
aggcaggauggc

SEQ ID NO: 1670771 - RNA, 15 nt, Human
aggcacccaccauca

SEQ ID NO: 1670772 - RNA, 19 nt, Human
aggcagccccauucugccu

SEQ ID NO: 1670773 - RNA, 20 nt, Human
aggcagccccauucugccug

SEQ ID NO: 1670774 - RNA, 21 nt, Human
aggcagccccauucugccugc

SEQ ID NO: 1670775 - RNA, 22 nt, Human
aggcagccccauucugccugcc

SEQ ID NO: 1670776 - RNA, 20 nt, Human
aggcagcucuaaaugucaau

SEQ ID NO: 1670777 - RNA, 17 nt, Human
uggacaaaauggaauac

SEQ ID NO: 1670778 - RNA, 14 nt, Human
uggacaaaauggaa

SEQ ID NO: 1670779 - RNA, 15 nt, Human
uggacaccggaaaca

SEQ ID NO: 1670780 - RNA, 17 nt, Human
uggaauuuuccuccuuu

SEQ ID NO: 1670781 - RNA, 21 nt, Human
uggaauuuuccuccuuucucu

SEQ ID NO: 1670782 - RNA, 14 nt, Human
uggaauuugaaaca

SEQ ID NO: 1670783 - RNA, 16 nt, Human
aggcaacuugggaacu

SEQ ID NO: 1670784 - RNA, 16 nt, Human
aggauuuuaugcuuua

SEQ ID NO: 1670785 - RNA, 17 nt, Human
aggauuuuaugcuuuaa

SEQ ID NO: 1670786 - RNA, 14 nt, Human
aggcaagcaccucc

SEQ ID NO: 1670787 - RNA, 18 nt, Human
aggaugcuuguacauaau

SEQ ID NO: 1670788 - RNA, 22 nt, Human
aggauugcuacuguccuaccca

SEQ ID NO: 1670789 - RNA, 11 nt, Human
aggauuuuaug

SEQ ID NO: 1670790 - RNA, 14 nt, Human
aggauuuuaugcuu

SEQ ID NO: 1670791 - RNA, 15 nt, Human
aggauuuuaugcuuu

SEQ ID NO: 1670792 - RNA, 12 nt, Human
aggaucagucug

SEQ ID NO: 1670793 - RNA, 21 nt, Human
aggauccugagccagauuuca

SEQ ID NO: 1670794 - RNA, 16 nt, Human
aggaugcuuguacaua

SEQ ID NO: 1670795 - RNA, 15 nt, Human
aggaugcuuguacau

SEQ ID NO: 1670796 - RNA, 12 nt, Human
aggaucucuuga

SEQ ID NO: 1670797 - RNA, 14 nt, Human
uggaagugcuaauu

SEQ ID NO: 1670798 - RNA, 15 nt, Human
aggaggccagccuug

SEQ ID NO: 1670799 - RNA, 19 nt, Human
aggaguuucguuuucaaaa

SEQ ID NO: 1670800 - RNA, 21 nt, Human
aggaguuugagaccaaccugg

SEQ ID NO: 1670801 - RNA, 20 nt, Human
uggaaguacuauaauuuacc

SEQ ID NO: 1670802 - RNA, 13 nt, Human
uggaagcuccgcu

SEQ ID NO: 1670803 - RNA, 14 nt, Human
uggaacacucugag

SEQ ID NO: 1670804 - RNA, 12 nt, Human
uggaacacucug

SEQ ID NO: 1670805 - RNA, 10 nt, Human
ugcugcccug

SEQ ID NO: 1670806 - RNA, 12 nt, Human
ugcugcccugcc

SEQ ID NO: 1670807 - RNA, 13 nt, Human
aggccuggccaga

SEQ ID NO: 1670808 - RNA, 12 nt, Human
aggccuggccag

SEQ ID NO: 1670809 - RNA, 17 nt, Human
aggcccggcuccaggcu

SEQ ID NO: 1670810 - RNA, 14 nt, Human
aggcccggcuccag

SEQ ID NO: 1670811 - RNA, 15 nt, Human
aggcccggcuccagg

SEQ ID NO: 1670812 - RNA, 16 nt, Human
aggcccggcuccaggc

SEQ ID NO: 1670813 - RNA, 19 nt, Human
aggcccagagggccugcaa

SEQ ID NO: 1670814 - RNA, 20 nt, Human
aggcccagagggccugcaag

SEQ ID NO: 1670815 - RNA, 13 nt, Human
aggccccugccac

SEQ ID NO: 1670816 - RNA, 15 nt, Human
aggccccugccaccc

SEQ ID NO: 1670817 - RNA, 17 nt, Human
aggccccugccacccug

SEQ ID NO: 1670818 - RNA, 18 nt, Human
aggccccugccacccugg

SEQ ID NO: 1670819 - RNA, 21 nt, Human
aggccccugccacccugggga

SEQ ID NO: 1670820 - RNA, 17 nt, Human
uggcagccgugccuuca

SEQ ID NO: 1670821 - RNA, 18 nt, Human
uggcaccagcagccugga

SEQ ID NO: 1670822 - RNA, 16 nt, Human
uggcaccagcagccug

SEQ ID NO: 1670823 - RNA, 17 nt, Human
uggcaccagcagccugg

SEQ ID NO: 1670824 - RNA, 16 nt, Human
uggcacagggcagugg

SEQ ID NO: 1670825 - RNA, 15 nt, Human
uggcacagggcagug

SEQ ID NO: 1670826 - RNA, 20 nt, Human
aggccauuccccgucucugg

SEQ ID NO: 1670827 - RNA, 15 nt, Human
aggcccagagggccu

SEQ ID NO: 1670828 - RNA, 16 nt, Human
aggcccagagggccug

SEQ ID NO: 1670829 - RNA, 22 nt, Human
uggcagccgugccuucagcucu

SEQ ID NO: 1670830 - RNA, 23 nt, Human
aggccagagacacaagccuucgg

SEQ ID NO: 1670831 - RNA, 18 nt, Human
aggccaugggccuccugu

SEQ ID NO: 1670832 - RNA, 18 nt, Human
uggcagccgugccuucag

SEQ ID NO: 1670833 - RNA, 19 nt, Human
uggcagccgugccuucagc

SEQ ID NO: 1670834 - RNA, 20 nt, Human
uggcagccgugccuucagcu

SEQ ID NO: 1670835 - RNA, 21 nt, Human
uggcagccgugccuucagcuc

SEQ ID NO: 1670836 - RNA, 14 nt, Human
uggcagcucagaga

SEQ ID NO: 1670837 - RNA, 15 nt, Human
uggcagcucagagag

SEQ ID NO: 1670838 - RNA, 16 nt, Human
uggcagcucagagagg

SEQ ID NO: 1670839 - RNA, 18 nt, Human
uggcagcucagagagggu

SEQ ID NO: 1670840 - RNA, 13 nt, Human
aggccagagacac

SEQ ID NO: 1670841 - RNA, 18 nt, Human
aggccagagacacaagcc

SEQ ID NO: 1670842 - RNA, 13 nt, Human
uggcccugcccug

SEQ ID NO: 1670843 - RNA, 21 nt, Human
uggccucugcugauccuccca

SEQ ID NO: 1670844 - RNA, 20 nt, Human
uggccucugcacuccccugc

SEQ ID NO: 1670845 - RNA, 19 nt, Human
uggccucugcacuccccug

SEQ ID NO: 1670846 - RNA, 12 nt, Human
uggcccugcccu

SEQ ID NO: 1670847 - RNA, 19 nt, Human
uggcccacgcacuucggga

SEQ ID NO: 1670848 - RNA, 13 nt, Human
uggcccacugcau

SEQ ID NO: 1670849 - RNA, 14 nt, Human
uggcccacugcauc

SEQ ID NO: 1670850 - RNA, 14 nt, Human
aggcgccccuuccc

SEQ ID NO: 1670851 - RNA, 17 nt, Human
aggccuucucugaagga

SEQ ID NO: 1670852 - RNA, 18 nt, Human
aggccuucucugaaggac

SEQ ID NO: 1670853 - RNA, 13 nt, Human
aggcuccaggagc

SEQ ID NO: 1670854 - RNA, 14 nt, Human
aggcuccaggagca

SEQ ID NO: 1670855 - RNA, 16 nt, Human
aggcuccaggagcagc

SEQ ID NO: 1670856 - RNA, 11 nt, Human
aggcuccacuu

SEQ ID NO: 1670857 - RNA, 17 nt, Human
aggcuccacuuggucug

SEQ ID NO: 1670858 - RNA, 21 nt, Human
aggcuccacuuggucugugag

SEQ ID NO: 1670859 - RNA, 22 nt, Human
aggcuccacuuggucugugaga

SEQ ID NO: 1670860 - RNA, 22 nt, Human
uggcugugccucugccugucuc

SEQ ID NO: 1670861 - RNA, 18 nt, Human
uggcugugccucugccug

SEQ ID NO: 1670862 - RNA, 19 nt, Human
uggcugugccucugccugu

SEQ ID NO: 1670863 - RNA, 16 nt, Human
uggcuguuggcugggg

SEQ ID NO: 1670864 - RNA, 18 nt, Human
uggcuguuggcugggggc

SEQ ID NO: 1670865 - RNA, 23 nt, Human
uggcuguuggcugggggccucag

SEQ ID NO: 1670866 - RNA, 14 nt, Human
uggcuucacggaag

SEQ ID NO: 1670867 - RNA, 14 nt, Human
uggcugugccucug

SEQ ID NO: 1670868 - RNA, 15 nt, Human
uggcugugccucugc

SEQ ID NO: 1670869 - RNA, 16 nt, Human
uggcugugccucugcc

SEQ ID NO: 1670870 - RNA, 17 nt, Human
uggcugugccucugccu

SEQ ID NO: 1670871 - RNA, 23 nt, Human
uggcugcaaaggguaucaggugc

SEQ ID NO: 1670872 - RNA, 16 nt, Human
uggcuuuugugcauua

SEQ ID NO: 1670873 - RNA, 22 nt, Human
uggcuucacggaagagccuugc

SEQ ID NO: 1670874 - RNA, 17 nt, Human
uggcuucacggaagagc

SEQ ID NO: 1670875 - RNA, 20 nt, Human
uggcuucacggaagagccuu

SEQ ID NO: 1670876 - RNA, 21 nt, Human
uggcuuuugugcauuaucuag

SEQ ID NO: 1670877 - RNA, 18 nt, Human
ugggaaacaaaaggauaa

SEQ ID NO: 1670878 - RNA, 14 nt, Human
ugggaaagcauugu

SEQ ID NO: 1670879 - RNA, 16 nt, Human
ugggaaagcauuguaa

SEQ ID NO: 1670880 - RNA, 20 nt, Human
ugggaacaccauaggucacc

SEQ ID NO: 1670881 - RNA, 21 nt, Human
ugggaaagcauuguaaaugug

SEQ ID NO: 1670882 - RNA, 17 nt, Human
ugggaaagcauuguaaa

SEQ ID NO: 1670883 - RNA, 18 nt, Human
ugggaaagcauuguaaau

SEQ ID NO: 1670884 - RNA, 13 nt, Human
uggcucacgccug

SEQ ID NO: 1670885 - RNA, 23 nt, Human
uggcuauaggugcuacaaaaaca

SEQ ID NO: 1670886 - RNA, 17 nt, Human
aggcuccaggagcagcc

SEQ ID NO: 1670887 - RNA, 18 nt, Human
aggcuccaggagcagcca

SEQ ID NO: 1670888 - RNA, 19 nt, Human
aggcuccaggagcagccac

SEQ ID NO: 1670889 - RNA, 23 nt, Human
aggcuccaggagcagccacauuc

SEQ ID NO: 1670890 - RNA, 13 nt, Human
aggcuccugccac

SEQ ID NO: 1670891 - RNA, 18 nt, Human
uggcuaagcaaaauguga

SEQ ID NO: 1670892 - RNA, 17 nt, Human
uggcuaauguacugcau

SEQ ID NO: 1670893 - RNA, 19 nt, Human
uggcuaauguacugcauau

SEQ ID NO: 1670894 - RNA, 15 nt, Human
uggcuauaggugcua

SEQ ID NO: 1670895 - RNA, 19 nt, Human
uggcuauaggugcuacaaa

SEQ ID NO: 1670896 - RNA, 20 nt, Human
aggcugggucgcccuggacu

SEQ ID NO: 1670897 - RNA, 21 nt, Human
aggcugggucgcccuggacug

SEQ ID NO: 1670898 - RNA, 14 nt, Human
aggcuggguucuga

SEQ ID NO: 1670899 - RNA, 17 nt, Human
aggcuggguucugaucc

SEQ ID NO: 1670900 - RNA, 15 nt, Human
aggcugggucgcccu

SEQ ID NO: 1670901 - RNA, 18 nt, Human
aggcugggucgcccugga

SEQ ID NO: 1670902 - RNA, 10 nt, Human
aggcuggguc

SEQ ID NO: 1670903 - RNA, 22 nt, Human
aggcugggggaagaagcucucu

SEQ ID NO: 1670904 - RNA, 18 nt, Human
aggcugggcuucaguggc

SEQ ID NO: 1670905 - RNA, 19 nt, Human
aggcugggcuucaguggca

SEQ ID NO: 1670906 - RNA, 20 nt, Human
aggcugggcuucaguggcag

SEQ ID NO: 1670907 - RNA, 21 nt, Human
aggcugggcuucaguggcagc

SEQ ID NO: 1670908 - RNA, 22 nt, Human
aggcugggcuucaguggcagcu

SEQ ID NO: 1670909 - RNA, 23 nt, Human
aggcugggcuucaguggcagcug

SEQ ID NO: 1670910 - RNA, 17 nt, Human
aggcugggggaagaagc

SEQ ID NO: 1670911 - RNA, 13 nt, Human
aggcugggcuccc

SEQ ID NO: 1670912 - RNA, 14 nt, Human
aggcugggcucccu

SEQ ID NO: 1670913 - RNA, 18 nt, Human
aggcugggcucccuuccc

SEQ ID NO: 1670914 - RNA, 14 nt, Human
aggcugggcuucag

SEQ ID NO: 1670915 - RNA, 21 nt, Human
aggcugggcucccuucccacc

SEQ ID NO: 1670916 - RNA, 23 nt, Human
aggcugggcucccuucccaccuc

SEQ ID NO: 1670917 - RNA, 22 nt, Human
aggcugggagagccuuccaggg

SEQ ID NO: 1670918 - RNA, 20 nt, Human
aggcugggagagccuuccag

SEQ ID NO: 1670919 - RNA, 21 nt, Human
aggcugggagagccuuccagg

SEQ ID NO: 1670920 - RNA, 19 nt, Human
aggcugggagagccuucca

SEQ ID NO: 1670921 - RNA, 16 nt, Human
aggcugggagagccuu

SEQ ID NO: 1670922 - RNA, 20 nt, Human
ugggaacccaaguccaagca

SEQ ID NO: 1670923 - RNA, 23 nt, Human
aggcuucugguugaugccuguga

SEQ ID NO: 1670924 - RNA, 23 nt, Human
aggcuuagucacugagacagccc

SEQ ID NO: 1670925 - RNA, 22 nt, Human
aggcuuagucacugagacagcc

SEQ ID NO: 1670926 - RNA, 15 nt, Human
aggcuuuuuuaucau

SEQ ID NO: 1670927 - RNA, 18 nt, Human
aggcuuuuuuaucaugug

SEQ ID NO: 1670928 - RNA, 21 nt, Human
aggcuuuuuuaucaugugaaa

SEQ ID NO: 1670929 - RNA, 14 nt, Human
agggaaacugccag

SEQ ID NO: 1670930 - RNA, 15 nt, Human
agggaaacugccagc

SEQ ID NO: 1670931 - RNA, 16 nt, Human
agggaaacugccagca

SEQ ID NO: 1670932 - RNA, 19 nt, Human
agggaaacugccagcaacg

SEQ ID NO: 1670933 - RNA, 21 nt, Human
agggaaacugccagcaacgca

SEQ ID NO: 1670934 - RNA, 23 nt, Human
agggaaacugccagcaacgcagg

SEQ ID NO: 1670935 - RNA, 13 nt, Human
agggagggccugg

SEQ ID NO: 1670936 - RNA, 15 nt, Human
agggagggccugggc

SEQ ID NO: 1670937 - RNA, 12 nt, Human
agggagggcucc

SEQ ID NO: 1670938 - RNA, 13 nt, Human
agggagggcucca

SEQ ID NO: 1670939 - RNA, 19 nt, Human
agggagggcuccagacaca

SEQ ID NO: 1670940 - RNA, 22 nt, Human
agggagggcuccagacacaugu

SEQ ID NO: 1670941 - RNA, 20 nt, Human
agggaguccgaaagggacuu

SEQ ID NO: 1670942 - RNA, 23 nt, Human
agggaguccgaaagggacuugga

SEQ ID NO: 1670943 - RNA, 20 nt, Human
agggagugaguugauagcac

SEQ ID NO: 1670944 - RNA, 20 nt, Human
agggagugacagaggcagcc

SEQ ID NO: 1670945 - RNA, 12 nt, Human
agggcccagaga

SEQ ID NO: 1670946 - RNA, 13 nt, Human
agggcccagagag

SEQ ID NO: 1670947 - RNA, 17 nt, Human
agggcacugguggcccg

SEQ ID NO: 1670948 - RNA, 16 nt, Human
agggauacccauccca

SEQ ID NO: 1670949 - RNA, 20 nt, Human
agggcuccagacacaugucc

SEQ ID NO: 1670950 - RNA, 14 nt, Human
agggcccagagagg

SEQ ID NO: 1670951 - RNA, 18 nt, Human
agggcccagagagggugg

SEQ ID NO: 1670952 - RNA, 14 nt, Human
ugggcucccuuccc

SEQ ID NO: 1670953 - RNA, 15 nt, Human
ugggcucccuuccca

SEQ ID NO: 1670954 - RNA, 22 nt, Human
agggcuguuauaaucuuucaca

SEQ ID NO: 1670955 - RNA, 14 nt, Human
ugggcauucaaaug

SEQ ID NO: 1670956 - RNA, 13 nt, Human
ugggcauucaaau

SEQ ID NO: 1670957 - RNA, 23 nt, Human
ugggcagaaggaagacuucaucc

SEQ ID NO: 1670958 - RNA, 16 nt, Human
ugggcagaaggaagac

SEQ ID NO: 1670959 - RNA, 20 nt, Human
ugggcagaaggaagacuuca

SEQ ID NO: 1670960 - RNA, 13 nt, Human
ugggcagaaggaa

SEQ ID NO: 1670961 - RNA, 17 nt, Human
ugggaggucaaggcugc

SEQ ID NO: 1670962 - RNA, 16 nt, Human
ugggauuuggucaaca

SEQ ID NO: 1670963 - RNA, 16 nt, Human
ugggagaaaugaaaaa

SEQ ID NO: 1670964 - RNA, 21 nt, Human
ugggagaaccaaaaagaggcu

SEQ ID NO: 1670965 - RNA, 22 nt, Human
ugggagaaccaaaaagaggcua

SEQ ID NO: 1670966 - RNA, 22 nt, Human
ugggaggauugcuugagcucag

SEQ ID NO: 1670967 - RNA, 18 nt, Human
ugggaggauugcuugagc

SEQ ID NO: 1670968 - RNA, 21 nt, Human
ugggaggauugcuugagcuca

SEQ ID NO: 1670969 - RNA, 14 nt, Human
ugggaggcucugga

SEQ ID NO: 1670970 - RNA, 17 nt, Human
ugggaggcucuggagcc

SEQ ID NO: 1670971 - RNA, 23 nt, Human
ugggaggcucuggagcccacugu

SEQ ID NO: 1670972 - RNA, 19 nt, Human
ugggaggcugagaugggag

SEQ ID NO: 1670973 - RNA, 18 nt, Human
agggagcaucagugcccu

SEQ ID NO: 1670974 - RNA, 18 nt, Human
ugggacuacaggcaccca

SEQ ID NO: 1670975 - RNA, 14 nt, Human
ugggacuggccucu

SEQ ID NO: 1670976 - RNA, 16 nt, Human
ugggacuggccucugc

SEQ ID NO: 1670977 - RNA, 15 nt, Human
ugggagaaaugaaaa

SEQ ID NO: 1670978 - RNA, 13 nt, Human
ugggacuggccuc

SEQ ID NO: 1670979 - RNA, 18 nt, Human
ugggacucaaugcacuga

SEQ ID NO: 1670980 - RNA, 16 nt, Human
ugggacuacaggugug

SEQ ID NO: 1670981 - RNA, 20 nt, Human
agggacuuggaagcuccgcu

SEQ ID NO: 1670982 - RNA, 13 nt, Human
agggagagaagau

SEQ ID NO: 1670983 - RNA, 14 nt, Human
agggagagaagaua

SEQ ID NO: 1670984 - RNA, 13 nt, Human
agggaaauuucag

SEQ ID NO: 1670985 - RNA, 18 nt, Human
agggacuuggaagcuccg

SEQ ID NO: 1670986 - RNA, 19 nt, Human
agggacuuggaagcuccgc

SEQ ID NO: 1670987 - RNA, 15 nt, Human
agggacuuggaagcu

SEQ ID NO: 1670988 - RNA, 23 nt, Human
agggacuucugucuucacaacag

SEQ ID NO: 1670989 - RNA, 18 nt, Human
ugcucugaugaagaggag

SEQ ID NO: 1670990 - RNA, 19 nt, Human
ugcucugaugaagaggagu

SEQ ID NO: 1670991 - RNA, 22 nt, Human
ugcucugaucauccacugugcc

SEQ ID NO: 1670992 - RNA, 17 nt, Human
ugcugacuguuuucucu

SEQ ID NO: 1670993 - RNA, 15 nt, Human
ugcucugcauguuac

SEQ ID NO: 1670994 - RNA, 18 nt, Human
ugcucugcauguuacaua

SEQ ID NO: 1670995 - RNA, 21 nt, Human
ugcugacuguuuucucuugag

SEQ ID NO: 1670996 - RNA, 24 nt, Human
ugcugacuguuuucucuugagagg

SEQ ID NO: 1670997 - RNA, 15 nt, Human
ugcugagucccaggc

SEQ ID NO: 1670998 - RNA, 18 nt, Human
ugcugagucccaggcuga

SEQ ID NO: 1670999 - RNA, 22 nt, Human
ugcugagucccaggcugagccu

SEQ ID NO: 1671000 - RNA, 18 nt, Human
aggaaaggcuccaggagc

SEQ ID NO: 1671001 - RNA, 20 nt, Human
aggaaaggcuccaggagcag

SEQ ID NO: 1671002 - RNA, 22 nt, Human
aggaaaggcuccaggagcagcc

SEQ ID NO: 1671003 - RNA, 23 nt, Human
aggaaaggcuccaggagcagcca

SEQ ID NO: 1671004 - RNA, 14 nt, Human
aggaaauauuuauu

SEQ ID NO: 1671005 - RNA, 18 nt, Human
aggaaauauuuauuuuaa

SEQ ID NO: 1671006 - RNA, 22 nt, Human
aggaauuuuauuuuuuucugaa

SEQ ID NO: 1671007 - RNA, 15 nt, Human
ugcugccacacuuca

SEQ ID NO: 1671008 - RNA, 16 nt, Human
ugcugccacacuucag

SEQ ID NO: 1671009 - RNA, 19 nt, Human
ugcugccacacuucaggcu

SEQ ID NO: 1671010 - RNA, 22 nt, Human
ugcugccacacuucaggcucuu

SEQ ID NO: 1671011 - RNA, 11 nt, Human
ugcugccaucc

SEQ ID NO: 1671012 - RNA, 14 nt, Human
ugcugcccagccuc

SEQ ID NO: 1671013 - RNA, 16 nt, Human
ugcugcccagccucca

SEQ ID NO: 1671014 - RNA, 21 nt, Human
ugcugccauccagguucagcu

SEQ ID NO: 1671015 - RNA, 22 nt, Human
ugcugccauccagguucagcuu

SEQ ID NO: 1671016 - RNA, 12 nt, Human
ugcugccaucca

SEQ ID NO: 1671017 - RNA, 13 nt, Human
ugcugccauccag

SEQ ID NO: 1671018 - RNA, 14 nt, Human
ugcugccauccagg

SEQ ID NO: 1671019 - RNA, 15 nt, Human
ugcugccauccaggu

SEQ ID NO: 1671020 - RNA, 17 nt, Human
aggaagcucagggccug

SEQ ID NO: 1671021 - RNA, 18 nt, Human
aggaagcucagggccugg

SEQ ID NO: 1671022 - RNA, 22 nt, Human
aggaagcucagggccuggcuca

SEQ ID NO: 1671023 - RNA, 14 nt, Human
aggaagagaaaaaa

SEQ ID NO: 1671024 - RNA, 15 nt, Human
aggaagacuuuggaa

SEQ ID NO: 1671025 - RNA, 19 nt, Human
aggaaaucaaauaugcaaa

SEQ ID NO: 1671026 - RNA, 23 nt, Human
aggaauccagacccggcugcgug

SEQ ID NO: 1671027 - RNA, 17 nt, Human
aggaauucuguauagau

SEQ ID NO: 1671028 - RNA, 22 nt, Human
aggaauucuguauagauuagaa

SEQ ID NO: 1671029 - RNA, 16 nt, Human
aggaauucuguauaga

SEQ ID NO: 1671030 - RNA, 19 nt, Human
aggaauugacccacaagaa

SEQ ID NO: 1671031 - RNA, 23 nt, Human
aggaauucuguauagauuagaau

SEQ ID NO: 1671032 - RNA, 20 nt, Human
agcuuaaaggggcuagagug

SEQ ID NO: 1671033 - RNA, 12 nt, Human
agcuuaucucag

SEQ ID NO: 1671034 - RNA, 14 nt, Human
agcuuaucucaggg

SEQ ID NO: 1671035 - RNA, 15 nt, Human
agcuuaucucagggg

SEQ ID NO: 1671036 - RNA, 20 nt, Human
ugcggacagccacggccagg

SEQ ID NO: 1671037 - RNA, 21 nt, Human
ugcggacagccacggccaggc

SEQ ID NO: 1671038 - RNA, 19 nt, Human
agcuuguaaauagcucagg

SEQ ID NO: 1671039 - RNA, 20 nt, Human
agcuuguaaauagcucaggu

SEQ ID NO: 1671040 - RNA, 21 nt, Human
agcuuguaaauagcucaggug

SEQ ID NO: 1671041 - RNA, 21 nt, Human
agcuuauugucuagugaaacu

SEQ ID NO: 1671042 - RNA, 15 nt, Human
agcuuauuaaaacuc

SEQ ID NO: 1671043 - RNA, 20 nt, Human
agcuuauuaaaacucauuuu

SEQ ID NO: 1671044 - RNA, 23 nt, Human
aggaaaaguuuaauauuaaagcc

SEQ ID NO: 1671045 - RNA, 24 nt, Human
aggaaaaguuuaauauuaaagcca

SEQ ID NO: 1671046 - RNA, 21 nt, Human
aggaaaaguuuaauauuaaag

SEQ ID NO: 1671047 - RNA, 12 nt, Human
agcuuugaaaau

SEQ ID NO: 1671048 - RNA, 16 nt, Human
agcuuugaaaauucag

SEQ ID NO: 1671049 - RNA, 18 nt, Human
agcuuugaaaauucagug

SEQ ID NO: 1671050 - RNA, 19 nt, Human
agcuuugaaaauucagugg

SEQ ID NO: 1671051 - RNA, 21 nt, Human
aggaaacccagcucuggucca

SEQ ID NO: 1671052 - RNA, 18 nt, Human
aggaaacccagcucuggu

SEQ ID NO: 1671053 - RNA, 20 nt, Human
aggaaacccagcucuggucc

SEQ ID NO: 1671054 - RNA, 15 nt, Human
aggaaacccagcucu

SEQ ID NO: 1671055 - RNA, 16 nt, Human
aggaaacccagcucug

SEQ ID NO: 1671056 - RNA, 17 nt, Human
aggaaacccagcucugg

SEQ ID NO: 1671057 - RNA, 12 nt, Human
aggaaagaggcu

SEQ ID NO: 1671058 - RNA, 13 nt, Human
aggaaagaggcuc

SEQ ID NO: 1671059 - RNA, 13 nt, Human
aggaaagagaacu

SEQ ID NO: 1671060 - RNA, 19 nt, Human
aggaaagagaacuuccaga

SEQ ID NO: 1671061 - RNA, 19 nt, Human
aggaaacuggguuccugca

SEQ ID NO: 1671062 - RNA, 21 nt, Human
ugcuauaacuauguugauaaa

SEQ ID NO: 1671063 - RNA, 16 nt, Human
ugcuaguaauuggaaa

SEQ ID NO: 1671064 - RNA, 16 nt, Human
aggaaagaggcucugg

SEQ ID NO: 1671065 - RNA, 17 nt, Human
aggaaagcaaaggagau

SEQ ID NO: 1671066 - RNA, 19 nt, Human
aggaaagcaaaggagauug

SEQ ID NO: 1671067 - RNA, 14 nt, Human
ugcuaguaauugga

SEQ ID NO: 1671068 - RNA, 19 nt, Human
ugccucucugcaggucccu

SEQ ID NO: 1671069 - RNA, 20 nt, Human
ugccucucugcaggucccua

SEQ ID NO: 1671070 - RNA, 20 nt, Human
ugccucugacacacagcucu

SEQ ID NO: 1671071 - RNA, 21 nt, Human
ugccucugacacacagcucug

SEQ ID NO: 1671072 - RNA, 16 nt, Human
ugccucucugcagguc

SEQ ID NO: 1671073 - RNA, 18 nt, Human
ugccucucugcagguccc

SEQ ID NO: 1671074 - RNA, 16 nt, Human
ugccucucucaggcca

SEQ ID NO: 1671075 - RNA, 15 nt, Human
ugccucucucaggcc

SEQ ID NO: 1671076 - RNA, 13 nt, Human
ugccucccaucac

SEQ ID NO: 1671077 - RNA, 14 nt, Human
ugccucccaucacc

SEQ ID NO: 1671078 - RNA, 19 nt, Human
ugccucccaucacccgcua

SEQ ID NO: 1671079 - RNA, 13 nt, Human
ugccucucucagg

SEQ ID NO: 1671080 - RNA, 14 nt, Human
ugccucucucaggc

SEQ ID NO: 1671081 - RNA, 15 nt, Human
ugcccuuucugggca

SEQ ID NO: 1671082 - RNA, 18 nt, Human
agcugcauacaguuugca

SEQ ID NO: 1671083 - RNA, 14 nt, Human
agcugccagccgag

SEQ ID NO: 1671084 - RNA, 13 nt, Human
agcugccaccugc

SEQ ID NO: 1671085 - RNA, 22 nt, Human
agcucuaucaccaaggagccaa

SEQ ID NO: 1671086 - RNA, 17 nt, Human
agcucuaucaccaagga

SEQ ID NO: 1671087 - RNA, 22 nt, Human
ugcccuccaagaccuucuccuu

SEQ ID NO: 1671088 - RNA, 19 nt, Human
ugcccuccaagaccuucuc

SEQ ID NO: 1671089 - RNA, 20 nt, Human
ugcccuccaagaccuucucc

SEQ ID NO: 1671090 - RNA, 16 nt, Human
agcucucuccucccuu

SEQ ID NO: 1671091 - RNA, 22 nt, Human
agcucugcuccucuccccagca

SEQ ID NO: 1671092 - RNA, 20 nt, Human
agcucugguccauagagagc

SEQ ID NO: 1671093 - RNA, 12 nt, Human
agcucugcuccu

SEQ ID NO: 1671094 - RNA, 13 nt, Human
agcugcacccuca

SEQ ID NO: 1671095 - RNA, 17 nt, Human
agcugcacccucaggca

SEQ ID NO: 1671096 - RNA, 18 nt, Human
agcugcacccucaggcag

SEQ ID NO: 1671097 - RNA, 19 nt, Human
agcugcacccucaggcagg

SEQ ID NO: 1671098 - RNA, 20 nt, Human
agcugcacccucaggcaggu

SEQ ID NO: 1671099 - RNA, 22 nt, Human
agcugcacccucaggcaggugg

SEQ ID NO: 1671100 - RNA, 18 nt, Human
agcucuucuccaggcugu

SEQ ID NO: 1671101 - RNA, 12 nt, Human
agcucuguccug

SEQ ID NO: 1671102 - RNA, 14 nt, Human
agcucuguccuggg

SEQ ID NO: 1671103 - RNA, 20 nt, Human
agcuggggccaggcuggguc

SEQ ID NO: 1671104 - RNA, 21 nt, Human
ugccuuagaaccuuucuuaca

SEQ ID NO: 1671105 - RNA, 14 nt, Human
ugccuuagaaccuu

SEQ ID NO: 1671106 - RNA, 17 nt, Human
ugccuuagaaccuuucu

SEQ ID NO: 1671107 - RNA, 15 nt, Human
ugccuguucagcucc

SEQ ID NO: 1671108 - RNA, 16 nt, Human
ugccuguucagcucca

SEQ ID NO: 1671109 - RNA, 17 nt, Human
ugccuguucagcuccag

SEQ ID NO: 1671110 - RNA, 13 nt, Human
ugccuuuuucauu

SEQ ID NO: 1671111 - RNA, 14 nt, Human
ugccuuuuucauua

SEQ ID NO: 1671112 - RNA, 15 nt, Human
ugccuuuuucauuau

SEQ ID NO: 1671113 - RNA, 16 nt, Human
ugccuuuuucauuauu

SEQ ID NO: 1671114 - RNA, 17 nt, Human
ugccuuuuucauuauuu

SEQ ID NO: 1671115 - RNA, 21 nt, Human
ugccuuuuucauuauuuuauu

SEQ ID NO: 1671116 - RNA, 13 nt, Human
ugcgaaaggauga

SEQ ID NO: 1671117 - RNA, 19 nt, Human
ugcgaaaggaugaaaguga

SEQ ID NO: 1671118 - RNA, 18 nt, Human
ugcggacagccacggcca

SEQ ID NO: 1671119 - RNA, 17 nt, Human
agcuggggccaggcugg

SEQ ID NO: 1671120 - RNA, 22 nt, Human
agcugggauuacaggcuccugc

SEQ ID NO: 1671121 - RNA, 23 nt, Human
agcugggauuacaggcuccugcc

SEQ ID NO: 1671122 - RNA, 14 nt, Human
agcugggcagguug

SEQ ID NO: 1671123 - RNA, 17 nt, Human
agcugggacuacaggug

SEQ ID NO: 1671124 - RNA, 19 nt, Human
agcugggacuacaggugug

SEQ ID NO: 1671125 - RNA, 22 nt, Human
agcugggaucacauguggacuu

SEQ ID NO: 1671126 - RNA, 18 nt, Human
agcugggauuacaggcuc

SEQ ID NO: 1671127 - RNA, 21 nt, Human
agcugggauuacaggcuccug

SEQ ID NO: 1671128 - RNA, 23 nt, Human
agcugggaugauuggagggggga

SEQ ID NO: 1671129 - RNA, 22 nt, Human
agcugccuccccuccucugcuu

SEQ ID NO: 1671130 - RNA, 21 nt, Human
agcugccuccccuccucugcu

SEQ ID NO: 1671131 - RNA, 23 nt, Human
agcugccuccccuccucugcuug

SEQ ID NO: 1671132 - RNA, 21 nt, Human
ugccucucugcaggucccuaa

SEQ ID NO: 1671133 - RNA, 22 nt, Human
ugccucugacacacagcucugu

SEQ ID NO: 1671134 - RNA, 20 nt, Human
agcugccuccccuccucugc

SEQ ID NO: 1671135 - RNA, 19 nt, Human
agcugccuccccuccucug

SEQ ID NO: 1671136 - RNA, 18 nt, Human
agcugccuccccuccucu

SEQ ID NO: 1671137 - RNA, 21 nt, Human
agcugccugggaucccucauc

SEQ ID NO: 1671138 - RNA, 13 nt, Human
agcugccugggau

SEQ ID NO: 1671139 - RNA, 19 nt, Human
agcugccugggaucccuca

SEQ ID NO: 1671140 - RNA, 10 nt, Human
agcugccugu

SEQ ID NO: 1671141 - RNA, 13 nt, Human
agcuggaaaagua

SEQ ID NO: 1671142 - RNA, 18 nt, Human
ugcauuugaggucuguuc

SEQ ID NO: 1671143 - RNA, 14 nt, Human
ugcauuuccugaca

SEQ ID NO: 1671144 - RNA, 13 nt, Human
ugcauuuccugac

SEQ ID NO: 1671145 - RNA, 23 nt, Human
ugcauuugaaaauuuugauguuu

SEQ ID NO: 1671146 - RNA, 19 nt, Human
ugcauuugaaaauuuugau

SEQ ID NO: 1671147 - RNA, 20 nt, Human
agcgcccacuagacccacug

SEQ ID NO: 1671148 - RNA, 14 nt, Human
agccugcuccagcu

SEQ ID NO: 1671149 - RNA, 14 nt, Human
agcgcccaguuggg

SEQ ID NO: 1671150 - RNA, 22 nt, Human
agcgcccaguuggguggaugcc

SEQ ID NO: 1671151 - RNA, 23 nt, Human
ugccacugccucuuccucccuca

SEQ ID NO: 1671152 - RNA, 12 nt, Human
ugccacacuuca

SEQ ID NO: 1671153 - RNA, 15 nt, Human
ugccagucaccccgg

SEQ ID NO: 1671154 - RNA, 16 nt, Human
ugccagucaccccggc

SEQ ID NO: 1671155 - RNA, 18 nt, Human
ugccagucaccccggcca

SEQ ID NO: 1671156 - RNA, 20 nt, Human
ugccagucaccccggccacc

SEQ ID NO: 1671157 - RNA, 19 nt, Human
ugccagucccccugcccca

SEQ ID NO: 1671158 - RNA, 20 nt, Human
ugccagucccccugccccag

SEQ ID NO: 1671159 - RNA, 17 nt, Human
ugccagucccccugccc

SEQ ID NO: 1671160 - RNA, 22 nt, Human
ugccagucaccccggccaccug

SEQ ID NO: 1671161 - RNA, 23 nt, Human
ugccagucaccccggccaccugc

SEQ ID NO: 1671162 - RNA, 15 nt, Human
ugccauauucuguug

SEQ ID NO: 1671163 - RNA, 16 nt, Human
ugccauauucuguugg

SEQ ID NO: 1671164 - RNA, 17 nt, Human
ugccauauucuguuggc

SEQ ID NO: 1671165 - RNA, 15 nt, Human
agcgugagccacugc

SEQ ID NO: 1671166 - RNA, 16 nt, Human
agcggggacagcuccu

SEQ ID NO: 1671167 - RNA, 17 nt, Human
agcggggacagcuccuu

SEQ ID NO: 1671168 - RNA, 15 nt, Human
agcggggacagcucc

SEQ ID NO: 1671169 - RNA, 20 nt, Human
ugccauauucuguuggccag

SEQ ID NO: 1671170 - RNA, 21 nt, Human
ugccauauucuguuggccagu

SEQ ID NO: 1671171 - RNA, 20 nt, Human
agcgugguggacaugcacag

SEQ ID NO: 1671172 - RNA, 16 nt, Human
agcgugagccacugca

SEQ ID NO: 1671173 - RNA, 17 nt, Human
agcgugagccacugcac

SEQ ID NO: 1671174 - RNA, 23 nt, Human
agcgugguggacaugcacagcua

SEQ ID NO: 1671175 - RNA, 16 nt, Human
ugccccgucccccucu

SEQ ID NO: 1671176 - RNA, 18 nt, Human
ugccccgucccccucugg

SEQ ID NO: 1671177 - RNA, 19 nt, Human
ugccccucaacucuccucc

SEQ ID NO: 1671178 - RNA, 12 nt, Human
ugccccccagcc

SEQ ID NO: 1671179 - RNA, 15 nt, Human
ugcccaggccugccu

SEQ ID NO: 1671180 - RNA, 17 nt, Human
ugcccaggccugccugu

SEQ ID NO: 1671181 - RNA, 12 nt, Human
ugcccaggcccc

SEQ ID NO: 1671182 - RNA, 16 nt, Human
ugcccacaggaucagu

SEQ ID NO: 1671183 - RNA, 14 nt, Human
ugcccaggccccug

SEQ ID NO: 1671184 - RNA, 20 nt, Human
ugcccaggccccugccaccc

SEQ ID NO: 1671185 - RNA, 22 nt, Human
ugcccaggccccugccacccug

SEQ ID NO: 1671186 - RNA, 14 nt, Human
ugcccacaggauca

SEQ ID NO: 1671187 - RNA, 15 nt, Human
ugcccaggcaggucu

SEQ ID NO: 1671188 - RNA, 16 nt, Human
ugcccaggcaggucuu

SEQ ID NO: 1671189 - RNA, 17 nt, Human
ugcccaggcaggucuug

SEQ ID NO: 1671190 - RNA, 20 nt, Human
ugcccaggcaggucuugaac

SEQ ID NO: 1671191 - RNA, 11 nt, Human
ugcccaggccc

SEQ ID NO: 1671192 - RNA, 23 nt, Human
ugcccaaccugcucuccucuugc

SEQ ID NO: 1671193 - RNA, 24 nt, Human
ugcccaaccugcucuccucuugcc

SEQ ID NO: 1671194 - RNA, 18 nt, Human
ugcccaaccugcucuccu

SEQ ID NO: 1671195 - RNA, 22 nt, Human
ugcccaaccugcucuccucuug

SEQ ID NO: 1671196 - RNA, 18 nt, Human
agcucagggccuggcuca

SEQ ID NO: 1671197 - RNA, 20 nt, Human
ugccauguuggccaggcugg

SEQ ID NO: 1671198 - RNA, 21 nt, Human
ugccauguuggccaggcuggu

SEQ ID NO: 1671199 - RNA, 15 nt, Human
agcucagggccuggc

SEQ ID NO: 1671200 - RNA, 16 nt, Human
agcucagggccuggcu

SEQ ID NO: 1671201 - RNA, 17 nt, Human
agcucagggccuggcuc

SEQ ID NO: 1671202 - RNA, 17 nt, Human
ugccauguuggccaggc

SEQ ID NO: 1671203 - RNA, 18 nt, Human
ugccauguuggccaggcu

SEQ ID NO: 1671204 - RNA, 19 nt, Human
ugccauguuggccaggcug

SEQ ID NO: 1671205 - RNA, 19 nt, Human
agcuauggugucauaggcu

SEQ ID NO: 1671206 - RNA, 14 nt, Human
ugcacaagcugcac

SEQ ID NO: 1671207 - RNA, 15 nt, Human
ugcacacaccagagc

SEQ ID NO: 1671208 - RNA, 15 nt, Human
ugcacaagcuccaag

SEQ ID NO: 1671209 - RNA, 16 nt, Human
ugcacaagcuccaagc

SEQ ID NO: 1671210 - RNA, 18 nt, Human
ugcacaagcuccaagcuc

SEQ ID NO: 1671211 - RNA, 20 nt, Human
ugcacaagcuccaagcuccc

SEQ ID NO: 1671212 - RNA, 22 nt, Human
ugcacaagcuccaagcucccag

SEQ ID NO: 1671213 - RNA, 23 nt, Human
ugcacaagcuccaagcucccagg

SEQ ID NO: 1671214 - RNA, 14 nt, Human
ugcaccacugcacu

SEQ ID NO: 1671215 - RNA, 15 nt, Human
ugcaccacugcacuc

SEQ ID NO: 1671216 - RNA, 22 nt, Human
ugcacuauagccuaggugacag

SEQ ID NO: 1671217 - RNA, 12 nt, Human
ugcacuccccug

SEQ ID NO: 1671218 - RNA, 13 nt, Human
ugcacuccccugc

SEQ ID NO: 1671219 - RNA, 19 nt, Human
ugcagacucuacagaggcc

SEQ ID NO: 1671220 - RNA, 20 nt, Human
ugcagacucuacagaggcca

SEQ ID NO: 1671221 - RNA, 15 nt, Human
ugcacuccccugcug

SEQ ID NO: 1671222 - RNA, 19 nt, Human
agcccuuccaugucgccuc

SEQ ID NO: 1671223 - RNA, 22 nt, Human
agcccuuccaugucgccucugc

SEQ ID NO: 1671224 - RNA, 23 nt, Human
agcccuuccaugucgccucugca

SEQ ID NO: 1671225 - RNA, 13 nt, Human
agcccuucauuug

SEQ ID NO: 1671226 - RNA, 14 nt, Human
agcccuucauuugg

SEQ ID NO: 1671227 - RNA, 22 nt, Human
ugcagacucuacagaggccaug

SEQ ID NO: 1671228 - RNA, 15 nt, Human
agccuaggugacaga

SEQ ID NO: 1671229 - RNA, 17 nt, Human
agccuaggugacagagu

SEQ ID NO: 1671230 - RNA, 15 nt, Human
agccucaaccuccug

SEQ ID NO: 1671231 - RNA, 23 nt, Human
agccguuuguuccccaagacauu

SEQ ID NO: 1671232 - RNA, 18 nt, Human
agcccuucuuuccacaga

SEQ ID NO: 1671233 - RNA, 19 nt, Human
agcccuucuuuccacagaa

SEQ ID NO: 1671234 - RNA, 20 nt, Human
ugcagccucaaccuccuggg

SEQ ID NO: 1671235 - RNA, 18 nt, Human
ugcagccucaaccuccug

SEQ ID NO: 1671236 - RNA, 19 nt, Human
ugcagccucaaccuccugg

SEQ ID NO: 1671237 - RNA, 19 nt, Human
agccugagcgacagugaga

SEQ ID NO: 1671238 - RNA, 17 nt, Human
agccucaaccuccuggg

SEQ ID NO: 1671239 - RNA, 18 nt, Human
agccucaaccuccugggc

SEQ ID NO: 1671240 - RNA, 13 nt, Human
agccucagcaucc

SEQ ID NO: 1671241 - RNA, 14 nt, Human
agccucagcauccu

SEQ ID NO: 1671242 - RNA, 16 nt, Human
agccucagcauccugg

SEQ ID NO: 1671243 - RNA, 15 nt, Human
agccucagcauccug

SEQ ID NO: 1671244 - RNA, 19 nt, Human
agccucaaccuccugggcu

SEQ ID NO: 1671245 - RNA, 18 nt, Human
agccugagcgacagugag

SEQ ID NO: 1671246 - RNA, 18 nt, Human
ugcaggucccuaauaaag

SEQ ID NO: 1671247 - RNA, 19 nt, Human
ugcaggucccuaauaaagc

SEQ ID NO: 1671248 - RNA, 20 nt, Human
ugcaggucccuaauaaagcu

SEQ ID NO: 1671249 - RNA, 21 nt, Human
ugcaggucccuaauaaagcug

SEQ ID NO: 1671250 - RNA, 17 nt, Human
ugcaggucccuaauaaa

SEQ ID NO: 1671251 - RNA, 14 nt, Human
ugcagugagccgag

SEQ ID NO: 1671252 - RNA, 15 nt, Human
ugcauaauggucaga

SEQ ID NO: 1671253 - RNA, 11 nt, Human
ugcauaaaaug

SEQ ID NO: 1671254 - RNA, 19 nt, Human
ugcagugagccgagauugu

SEQ ID NO: 1671255 - RNA, 20 nt, Human
ugcaugaaguaauaugcaca

SEQ ID NO: 1671256 - RNA, 22 nt, Human
ugcaugaaguaauaugcacaca

SEQ ID NO: 1671257 - RNA, 21 nt, Human
ugcaugaggcuaguguggugu

SEQ ID NO: 1671258 - RNA, 13 nt, Human
ugcaugcuguccc

SEQ ID NO: 1671259 - RNA, 14 nt, Human
ugcaugcugucccu

SEQ ID NO: 1671260 - RNA, 15 nt, Human
ugcaugcugucccuu

SEQ ID NO: 1671261 - RNA, 22 nt, Human
ugcauaccacuuuuguucuugg

SEQ ID NO: 1671262 - RNA, 12 nt, Human
agccugcccucc

SEQ ID NO: 1671263 - RNA, 16 nt, Human
agccugccucuucucu

SEQ ID NO: 1671264 - RNA, 19 nt, Human
agccugccucuucucuacu

SEQ ID NO: 1671265 - RNA, 23 nt, Human
agccugcaguuauuaacacuaac

SEQ ID NO: 1671266 - RNA, 18 nt, Human
agccugcacggugaaugg

SEQ ID NO: 1671267 - RNA, 16 nt, Human
agccugcacggugaau

SEQ ID NO: 1671268 - RNA, 18 nt, Human
agccugaucaccugcccu

SEQ ID NO: 1671269 - RNA, 16 nt, Human
ugcaugcugucccuua

SEQ ID NO: 1671270 - RNA, 14 nt, Human
agccugauuaaaga

SEQ ID NO: 1671271 - RNA, 19 nt, Human
agccugaucaccugcccug

SEQ ID NO: 1671272 - RNA, 16 nt, Human
ucuggcagcucagaga

SEQ ID NO: 1671273 - RNA, 15 nt, Human
agaagcggcuggcag

SEQ ID NO: 1671274 - RNA, 16 nt, Human
agaagcggcuggcagc

SEQ ID NO: 1671275 - RNA, 14 nt, Human
agaagcuccaggua

SEQ ID NO: 1671276 - RNA, 12 nt, Human
ucuggauuauau

SEQ ID NO: 1671277 - RNA, 18 nt, Human
ucuggauuauauuaugaa

SEQ ID NO: 1671278 - RNA, 14 nt, Human
ucuggcagcucaga

SEQ ID NO: 1671279 - RNA, 15 nt, Human
ucuggcagcucagag

SEQ ID NO: 1671280 - RNA, 14 nt, Human
ucugcuugccaucc

SEQ ID NO: 1671281 - RNA, 12 nt, Human
ucugcuugccau

SEQ ID NO: 1671282 - RNA, 14 nt, Human
ucugccuaaggacu

SEQ ID NO: 1671283 - RNA, 15 nt, Human
ucugccuaaggacuu

SEQ ID NO: 1671284 - RNA, 16 nt, Human
ucugccuaaggacuuc

SEQ ID NO: 1671285 - RNA, 13 nt, Human
ucugccuaaggac

SEQ ID NO: 1671286 - RNA, 14 nt, Human
ucugcccuccaaga

SEQ ID NO: 1671287 - RNA, 18 nt, Human
ucugcccuccaagaccuu

SEQ ID NO: 1671288 - RNA, 21 nt, Human
agaagaacugaaaucauacuu

SEQ ID NO: 1671289 - RNA, 17 nt, Human
ucugcucacauaucugu

SEQ ID NO: 1671290 - RNA, 16 nt, Human
ucugcucacauaucug

SEQ ID NO: 1671291 - RNA, 11 nt, Human
ucugcuugcca

SEQ ID NO: 1671292 - RNA, 16 nt, Human
ucugauacagaaaagu

SEQ ID NO: 1671293 - RNA, 17 nt, Human
ucugauacagaaaaguu

SEQ ID NO: 1671294 - RNA, 19 nt, Human
ucugauucccaagcucugc

SEQ ID NO: 1671295 - RNA, 20 nt, Human
ucugauucccaagcucugcu

SEQ ID NO: 1671296 - RNA, 21 nt, Human
ucugauucccaagcucugcuc

SEQ ID NO: 1671297 - RNA, 23 nt, Human
ucugagaaagacuauucaaacag

SEQ ID NO: 1671298 - RNA, 21 nt, Human
ucugagaaagacuauucaaac

SEQ ID NO: 1671299 - RNA, 22 nt, Human
ucugagaaagacuauucaaaca

SEQ ID NO: 1671300 - RNA, 21 nt, Human
ucugacuguuuccaucaaggg

SEQ ID NO: 1671301 - RNA, 14 nt, Human
ucugagaaagacua

SEQ ID NO: 1671302 - RNA, 15 nt, Human
ucugagaaagacuau

SEQ ID NO: 1671303 - RNA, 19 nt, Human
ucugagaaagacuauucaa

SEQ ID NO: 1671304 - RNA, 20 nt, Human
ucugagaaagacuauucaaa

SEQ ID NO: 1671305 - RNA, 19 nt, Human
ucugacccugcuucaaaua

SEQ ID NO: 1671306 - RNA, 19 nt, Human
agaaagacuauucaaacag

SEQ ID NO: 1671307 - RNA, 18 nt, Human
agaaagacuauucaaaca

SEQ ID NO: 1671308 - RNA, 20 nt, Human
agaaagacuauucaaacagu

SEQ ID NO: 1671309 - RNA, 23 nt, Human
agaaagacuauucaaacagucuc

SEQ ID NO: 1671310 - RNA, 16 nt, Human
agaaauguacagcaag

SEQ ID NO: 1671311 - RNA, 17 nt, Human
agaaauguacagcaagg

SEQ ID NO: 1671312 - RNA, 11 nt, Human
agaaauguguu

SEQ ID NO: 1671313 - RNA, 12 nt, Human
ucugcagagcag

SEQ ID NO: 1671314 - RNA, 22 nt, Human
agaaccucuuugucuacaccau

SEQ ID NO: 1671315 - RNA, 14 nt, Human
agaacucccuuuca

SEQ ID NO: 1671316 - RNA, 15 nt, Human
agaacucccuuucaa

SEQ ID NO: 1671317 - RNA, 22 nt, Human
acuuuuuauggcacuaguauuu

SEQ ID NO: 1671318 - RNA, 14 nt, Human
acuuuuggcauuuu

SEQ ID NO: 1671319 - RNA, 16 nt, Human
acuuuugguuaagucu

SEQ ID NO: 1671320 - RNA, 20 nt, Human
acuuuugguuaagucuguuu

SEQ ID NO: 1671321 - RNA, 22 nt, Human
acuuuugguuaagucuguuuua

SEQ ID NO: 1671322 - RNA, 14 nt, Human
acuuuuggaaggua

SEQ ID NO: 1671323 - RNA, 22 nt, Human
acuuuuuuuuuuuaagaguaaa

SEQ ID NO: 1671324 - RNA, 13 nt, Human
acuuuuuuccaca

SEQ ID NO: 1671325 - RNA, 23 nt, Human
acuuuggaaagacuuuuccaacc

SEQ ID NO: 1671326 - RNA, 17 nt, Human
acuuuggaaagacuuuu

SEQ ID NO: 1671327 - RNA, 13 nt, Human
acuuuggaaagac

SEQ ID NO: 1671328 - RNA, 14 nt, Human
acuuuggaaagacu

SEQ ID NO: 1671329 - RNA, 23 nt, Human
acuuugaccucugcagcaauaaa

SEQ ID NO: 1671330 - RNA, 19 nt, Human
acuuugaccucugcagcaa

SEQ ID NO: 1671331 - RNA, 23 nt, Human
acuuuaccuuuuuuauacauaaa

SEQ ID NO: 1671332 - RNA, 22 nt, Human
acuuuaccuuuuuuauacauaa

SEQ ID NO: 1671333 - RNA, 19 nt, Human
acuuuaccuuuuuuauaca

SEQ ID NO: 1671334 - RNA, 18 nt, Human
acuuuaccuuuuuuauac

SEQ ID NO: 1671335 - RNA, 19 nt, Human
acuuguugauuaauggaaa

SEQ ID NO: 1671336 - RNA, 21 nt, Human
acuuguugauuaauggaaaug

SEQ ID NO: 1671337 - RNA, 21 nt, Human
acuuguguaaauacaauuuug

SEQ ID NO: 1671338 - RNA, 22 nt, Human
acuuguguaaauacaauuuugu

SEQ ID NO: 1671339 - RNA, 23 nt, Human
acuuguguaaauacaauuuuguu

SEQ ID NO: 1671340 - RNA, 15 nt, Human
ucuccucugcugcug

SEQ ID NO: 1671341 - RNA, 13 nt, Human
ucuccucugcugc

SEQ ID NO: 1671342 - RNA, 14 nt, Human
ucuccucugcugcu

SEQ ID NO: 1671343 - RNA, 12 nt, Human
ucuccucugcug

SEQ ID NO: 1671344 - RNA, 19 nt, Human
ucucccuuggauugucccc

SEQ ID NO: 1671345 - RNA, 21 nt, Human
ucucccuuggauuguccccga

SEQ ID NO: 1671346 - RNA, 12 nt, Human
ucuccauuuaau

SEQ ID NO: 1671347 - RNA, 16 nt, Human
ucuccauuuaauaauu

SEQ ID NO: 1671348 - RNA, 19 nt, Human
ucuccauuuaauaauuaua

SEQ ID NO: 1671349 - RNA, 18 nt, Human
ucucccaaagugcuggga

SEQ ID NO: 1671350 - RNA, 11 nt, Human
ucucccuugga

SEQ ID NO: 1671351 - RNA, 18 nt, Human
ucucccuuggauuguccc

SEQ ID NO: 1671352 - RNA, 15 nt, Human
ucucccagucauuua

SEQ ID NO: 1671353 - RNA, 13 nt, Human
agaaacuggaacu

SEQ ID NO: 1671354 - RNA, 15 nt, Human
agaaacuggaacucu

SEQ ID NO: 1671355 - RNA, 22 nt, Human
ucucuuuaaugucacaggcagg

SEQ ID NO: 1671356 - RNA, 17 nt, Human
ucucuugagccugggag

SEQ ID NO: 1671357 - RNA, 15 nt, Human
ucucuugagccuggg

SEQ ID NO: 1671358 - RNA, 13 nt, Human
ucucuugagccug

SEQ ID NO: 1671359 - RNA, 14 nt, Human
ucucuugagccugg

SEQ ID NO: 1671360 - RNA, 19 nt, Human
agaaaaauaugaccacacu

SEQ ID NO: 1671361 - RNA, 17 nt, Human
agaaaaaugagccuggc

SEQ ID NO: 1671362 - RNA, 19 nt, Human
agaaaacaaggaugaauua

SEQ ID NO: 1671363 - RNA, 22 nt, Human
ucucuccuguaccucuugagcc

SEQ ID NO: 1671364 - RNA, 20 nt, Human
ucucuccuguaccucuugag

SEQ ID NO: 1671365 - RNA, 16 nt, Human
ucucuccagccccugg

SEQ ID NO: 1671366 - RNA, 15 nt, Human
ucucuccagccccug

SEQ ID NO: 1671367 - RNA, 13 nt, Human
ucucuccagcccc

SEQ ID NO: 1671368 - RNA, 14 nt, Human
ucucuccagccccu

SEQ ID NO: 1671369 - RNA, 20 nt, Human
ucuccuucaccuuugucccc

SEQ ID NO: 1671370 - RNA, 18 nt, Human
ucucuucuggguuccuuc

SEQ ID NO: 1671371 - RNA, 19 nt, Human
ucucuucuggguuccuucc

SEQ ID NO: 1671372 - RNA, 20 nt, Human
ucucuucuggguuccuuccu

SEQ ID NO: 1671373 - RNA, 21 nt, Human
ucucuucuggguuccuuccuc

SEQ ID NO: 1671374 - RNA, 12 nt, Human
ucucuucuuuaa

SEQ ID NO: 1671375 - RNA, 14 nt, Human
ucucuugagagggu

SEQ ID NO: 1671376 - RNA, 13 nt, Human
ucucuucuuuaaa

SEQ ID NO: 1671377 - RNA, 11 nt, Human
ucucugcccua

SEQ ID NO: 1671378 - RNA, 22 nt, Human
ucucugcccuaaugcgcaggcu

SEQ ID NO: 1671379 - RNA, 13 nt, Human
ucucuggccuucg

SEQ ID NO: 1671380 - RNA, 16 nt, Human
ucucuggccuucggcc

SEQ ID NO: 1671381 - RNA, 17 nt, Human
ucucuggccuucggccu

SEQ ID NO: 1671382 - RNA, 19 nt, Human
agacccuuguggucccacc

SEQ ID NO: 1671383 - RNA, 20 nt, Human
agacccuuguggucccaccc

SEQ ID NO: 1671384 - RNA, 22 nt, Human
agacccuuguggucccacccca

SEQ ID NO: 1671385 - RNA, 23 nt, Human
agacccuuguggucccaccccac

SEQ ID NO: 1671386 - RNA, 13 nt, Human
agacccuuguggu

SEQ ID NO: 1671387 - RNA, 15 nt, Human
agacccuuguggucc

SEQ ID NO: 1671388 - RNA, 16 nt, Human
agacccugcccugugg

SEQ ID NO: 1671389 - RNA, 19 nt, Human
agacccugcccugugggcc

SEQ ID NO: 1671390 - RNA, 21 nt, Human
agacccugcccugugggcccc

SEQ ID NO: 1671391 - RNA, 23 nt, Human
agacccugcccugugggccccca

SEQ ID NO: 1671392 - RNA, 12 nt, Human
agacccugcccu

SEQ ID NO: 1671393 - RNA, 13 nt, Human
agacccugcccug

SEQ ID NO: 1671394 - RNA, 14 nt, Human
agacccugcccugu

SEQ ID NO: 1671395 - RNA, 17 nt, Human
ucuugcaauggcagccu

SEQ ID NO: 1671396 - RNA, 13 nt, Human
ucuugcaauggca

SEQ ID NO: 1671397 - RNA, 16 nt, Human
ucuugcaauggcagcc

SEQ ID NO: 1671398 - RNA, 14 nt, Human
ucuugaugccuggc

SEQ ID NO: 1671399 - RNA, 20 nt, Human
ucuugaugccuggcggggug

SEQ ID NO: 1671400 - RNA, 16 nt, Human
agacuccaaagaaaug

SEQ ID NO: 1671401 - RNA, 19 nt, Human
agacuccaaagaaauguaa

SEQ ID NO: 1671402 - RNA, 13 nt, Human
agaccugccccuc

SEQ ID NO: 1671403 - RNA, 12 nt, Human
agaccugccccu

SEQ ID NO: 1671404 - RNA, 19 nt, Human
agacuaucuaaauguugaa

SEQ ID NO: 1671405 - RNA, 17 nt, Human
agacuaucuaaauguug

SEQ ID NO: 1671406 - RNA, 18 nt, Human
agacuaucuaaauguuga

SEQ ID NO: 1671407 - RNA, 17 nt, Human
agacucauucuucugua

SEQ ID NO: 1671408 - RNA, 21 nt, Human
agacuauucaaacagucucag

SEQ ID NO: 1671409 - RNA, 18 nt, Human
agacuauucaaacagucu

SEQ ID NO: 1671410 - RNA, 20 nt, Human
agacuauucaaacagucuca

SEQ ID NO: 1671411 - RNA, 18 nt, Human
agacucauucuucuguac

SEQ ID NO: 1671412 - RNA, 12 nt, Human
agacuccaaaga

SEQ ID NO: 1671413 - RNA, 13 nt, Human
agacuccaaagaa

SEQ ID NO: 1671414 - RNA, 14 nt, Human
agacuccaaagaaa

SEQ ID NO: 1671415 - RNA, 19 nt, Human
agacucuacagaggccaug

SEQ ID NO: 1671416 - RNA, 21 nt, Human
agacucgcgacaaugcaaacc

SEQ ID NO: 1671417 - RNA, 17 nt, Human
agacucuacagaggcca

SEQ ID NO: 1671418 - RNA, 18 nt, Human
agacuccugcaggcagcc

SEQ ID NO: 1671419 - RNA, 19 nt, Human
agacuccugcaggcagcca

SEQ ID NO: 1671420 - RNA, 20 nt, Human
agacuccugcaggcagccag

SEQ ID NO: 1671421 - RNA, 23 nt, Human
agacuccugcaggcagccaggcc

SEQ ID NO: 1671422 - RNA, 13 nt, Human
ucuuuccugaggc

SEQ ID NO: 1671423 - RNA, 14 nt, Human
ucuuuccugaggcu

SEQ ID NO: 1671424 - RNA, 15 nt, Human
ucuuuccugaggcug

SEQ ID NO: 1671425 - RNA, 16 nt, Human
ucuuuccugaggcugg

SEQ ID NO: 1671426 - RNA, 14 nt, Human
agacuccugcaggc

SEQ ID NO: 1671427 - RNA, 15 nt, Human
agacuccugcaggca

SEQ ID NO: 1671428 - RNA, 16 nt, Human
agacuccugcaggcag

SEQ ID NO: 1671429 - RNA, 17 nt, Human
agacuccugcaggcagc

SEQ ID NO: 1671430 - RNA, 14 nt, Human
ucuuuaauuuugga

SEQ ID NO: 1671431 - RNA, 15 nt, Human
ucuuuaauuuuggaa

SEQ ID NO: 1671432 - RNA, 16 nt, Human
ucuuuaauuuuggaau

SEQ ID NO: 1671433 - RNA, 17 nt, Human
ucuuuaauuuuggaauu

SEQ ID NO: 1671434 - RNA, 18 nt, Human
ucuuuaauuuuggaauuu

SEQ ID NO: 1671435 - RNA, 15 nt, Human
ucuuuacuucaugga

SEQ ID NO: 1671436 - RNA, 17 nt, Human
ucuuuaaaauacacacu

SEQ ID NO: 1671437 - RNA, 13 nt, Human
ucuuuaauuuugg

SEQ ID NO: 1671438 - RNA, 21 nt, Human
ucuuuaaagggauggcaagau

SEQ ID NO: 1671439 - RNA, 18 nt, Human
agagaccaucccugaagg

SEQ ID NO: 1671440 - RNA, 15 nt, Human
agagaccaucccuga

SEQ ID NO: 1671441 - RNA, 13 nt, Human
agagaccaucccu

SEQ ID NO: 1671442 - RNA, 14 nt, Human
agagaccaucccug

SEQ ID NO: 1671443 - RNA, 18 nt, Human
agagacacacugaagaag

SEQ ID NO: 1671444 - RNA, 20 nt, Human
agagacacacugaagaagca

SEQ ID NO: 1671445 - RNA, 12 nt, Human
agacuuuggaaa

SEQ ID NO: 1671446 - RNA, 14 nt, Human
agacuuuggaaaga

SEQ ID NO: 1671447 - RNA, 18 nt, Human
agagaaugaaagggccca

SEQ ID NO: 1671448 - RNA, 17 nt, Human
agagacacacugaagaa

SEQ ID NO: 1671449 - RNA, 15 nt, Human
agacuuuggaaagac

SEQ ID NO: 1671450 - RNA, 15 nt, Human
agagaaugagagaca

SEQ ID NO: 1671451 - RNA, 14 nt, Human
agacuucaucccuc

SEQ ID NO: 1671452 - RNA, 17 nt, Human
agacuucaucccucugg

SEQ ID NO: 1671453 - RNA, 18 nt, Human
agacuggcacaguuuucu

SEQ ID NO: 1671454 - RNA, 14 nt, Human
agacuggcacaguu

SEQ ID NO: 1671455 - RNA, 15 nt, Human
agacuggcacaguuu

SEQ ID NO: 1671456 - RNA, 18 nt, Human
agacagaaucucgcucug

SEQ ID NO: 1671457 - RNA, 22 nt, Human
agacagaaucucgcucugucgc

SEQ ID NO: 1671458 - RNA, 17 nt, Human
agaauuugauaugugaa

SEQ ID NO: 1671459 - RNA, 18 nt, Human
agaauuugauaugugaac

SEQ ID NO: 1671460 - RNA, 19 nt, Human
agaauuugauaugugaaca

SEQ ID NO: 1671461 - RNA, 20 nt, Human
agaauuugauaugugaacag

SEQ ID NO: 1671462 - RNA, 19 nt, Human
agacagucccugccaaugg

SEQ ID NO: 1671463 - RNA, 15 nt, Human
agacagucccugcca

SEQ ID NO: 1671464 - RNA, 16 nt, Human
agacagucccugccaa

SEQ ID NO: 1671465 - RNA, 17 nt, Human
agacagucccugccaau

SEQ ID NO: 1671466 - RNA, 21 nt, Human
agacaggguuuugccauguug

SEQ ID NO: 1671467 - RNA, 15 nt, Human
agacaggaccaggga

SEQ ID NO: 1671468 - RNA, 16 nt, Human
agacaggaccagggau

SEQ ID NO: 1671469 - RNA, 23 nt, Human
agacaggcaagcaccuccugccu

SEQ ID NO: 1671470 - RNA, 22 nt, Human
ucuuccaggcugggagagccuu

SEQ ID NO: 1671471 - RNA, 17 nt, Human
ucuucaaaaugagcccu

SEQ ID NO: 1671472 - RNA, 16 nt, Human
ucuucaaaauaucaag

SEQ ID NO: 1671473 - RNA, 14 nt, Human
ucuuauugcccacg

SEQ ID NO: 1671474 - RNA, 18 nt, Human
ucuuaugggcuggguucu

SEQ ID NO: 1671475 - RNA, 18 nt, Human
ucuuauugcccacgcugg

SEQ ID NO: 1671476 - RNA, 22 nt, Human
ucuuauugcccacgcuggagug

SEQ ID NO: 1671477 - RNA, 15 nt, Human
ucuuaugggcugggu

SEQ ID NO: 1671478 - RNA, 16 nt, Human
ucuuaugggcuggguu

SEQ ID NO: 1671479 - RNA, 14 nt, Human
ucuuaugggcuggg

SEQ ID NO: 1671480 - RNA, 22 nt, Human
ucuuagaugcaguucugaagaa

SEQ ID NO: 1671481 - RNA, 18 nt, Human
ucuuaauuaaaagaauau

SEQ ID NO: 1671482 - RNA, 21 nt, Human
ucuuaauuaaaagaauauuuu

SEQ ID NO: 1671483 - RNA, 16 nt, Human
ucuggguuccuuccuc

SEQ ID NO: 1671484 - RNA, 18 nt, Human
ucugguccauagagagca

SEQ ID NO: 1671485 - RNA, 11 nt, Human
ucuggggcugu

SEQ ID NO: 1671486 - RNA, 14 nt, Human
ucuggguucacugc

SEQ ID NO: 1671487 - RNA, 16 nt, Human
ucuggguucacugcaa

SEQ ID NO: 1671488 - RNA, 16 nt, Human
ucuguauagauuagag

SEQ ID NO: 1671489 - RNA, 15 nt, Human
ucugucauuugagca

SEQ ID NO: 1671490 - RNA, 20 nt, Human
ucugucauuugagcagggcu

SEQ ID NO: 1671491 - RNA, 23 nt, Human
ucugucauuugagcagggcucag

SEQ ID NO: 1671492 - RNA, 17 nt, Human
ucuguauagauuagaau

SEQ ID NO: 1671493 - RNA, 18 nt, Human
ucuguuggccagugugac

SEQ ID NO: 1671494 - RNA, 19 nt, Human
ucuguuggccagugugaca

SEQ ID NO: 1671495 - RNA, 20 nt, Human
ucuguuggccagugugacaa

SEQ ID NO: 1671496 - RNA, 22 nt, Human
ucugugaaaggaaagagggagg

SEQ ID NO: 1671497 - RNA, 24 nt, Human
ucuguccaggcacugcugcccagc

SEQ ID NO: 1671498 - RNA, 15 nt, Human
ucugugaaaggaaag

SEQ ID NO: 1671499 - RNA, 21 nt, Human
ucugugaaaggaaagagggag

SEQ ID NO: 1671500 - RNA, 13 nt, Human
agaauuucuagga

SEQ ID NO: 1671501 - RNA, 21 nt, Human
agaauuucuaggacugaauua

SEQ ID NO: 1671502 - RNA, 23 nt, Human
agaauuucccaaagcagugcaug

SEQ ID NO: 1671503 - RNA, 17 nt, Human
agaauuucccaaagcag

SEQ ID NO: 1671504 - RNA, 18 nt, Human
agaauuucccaaagcagu

SEQ ID NO: 1671505 - RNA, 20 nt, Human
ucuguuuuauaauuuuguga

SEQ ID NO: 1671506 - RNA, 18 nt, Human
ucuguuuuauaauuuugu

SEQ ID NO: 1671507 - RNA, 21 nt, Human
agaggcgcaugaauuugugaa

SEQ ID NO: 1671508 - RNA, 17 nt, Human
agaggcuaugugagcac

SEQ ID NO: 1671509 - RNA, 21 nt, Human
agagggagggagggcuccaga

SEQ ID NO: 1671510 - RNA, 15 nt, Human
agagggagguaagga

SEQ ID NO: 1671511 - RNA, 22 nt, Human
agagggagggagggcuccagac

SEQ ID NO: 1671512 - RNA, 18 nt, Human
ugaagauguagaggagaa

SEQ ID NO: 1671513 - RNA, 14 nt, Human
ugaagcauuuuaua

SEQ ID NO: 1671514 - RNA, 19 nt, Human
agagcuucuguugcugccu

SEQ ID NO: 1671515 - RNA, 20 nt, Human
agagcuucuguugcugccuc

SEQ ID NO: 1671516 - RNA, 21 nt, Human
agagcuucuguugcugccuca

SEQ ID NO: 1671517 - RNA, 22 nt, Human
agagcuucuguugcugccucau

SEQ ID NO: 1671518 - RNA, 15 nt, Human
agagcuucuggcacu

SEQ ID NO: 1671519 - RNA, 21 nt, Human
ugaagacaaugacuuacugua

SEQ ID NO: 1671520 - RNA, 19 nt, Human
agagcugggugucaagagg

SEQ ID NO: 1671521 - RNA, 12 nt, Human
agaggaaagcaa

SEQ ID NO: 1671522 - RNA, 16 nt, Human
agaggaaagcaaagga

SEQ ID NO: 1671523 - RNA, 18 nt, Human
agaggaaagcaaaggaga

SEQ ID NO: 1671524 - RNA, 19 nt, Human
agaggaaagcaaaggagau

SEQ ID NO: 1671525 - RNA, 11 nt, Human
agaggaaauca

SEQ ID NO: 1671526 - RNA, 12 nt, Human
agaggaaaucac

SEQ ID NO: 1671527 - RNA, 21 nt, Human
agaggaaaucaccgaaaacgu

SEQ ID NO: 1671528 - RNA, 18 nt, Human
agaggcaacugcauuggc

SEQ ID NO: 1671529 - RNA, 13 nt, Human
ucuuuguaaugaa

SEQ ID NO: 1671530 - RNA, 15 nt, Human
ucuuuguaaugaaaa

SEQ ID NO: 1671531 - RNA, 11 nt, Human
ugaacuuugac

SEQ ID NO: 1671532 - RNA, 12 nt, Human
ucuuuguaauga

SEQ ID NO: 1671533 - RNA, 14 nt, Human
ucuuuggucuacac

SEQ ID NO: 1671534 - RNA, 21 nt, Human
ucuuuggucuacacugugcug

SEQ ID NO: 1671535 - RNA, 17 nt, Human
ugaagacaaugacuuac

SEQ ID NO: 1671536 - RNA, 13 nt, Human
ugaagacaaugac

SEQ ID NO: 1671537 - RNA, 11 nt, Human
ugaagacaaug

SEQ ID NO: 1671538 - RNA, 22 nt, Human
ugaagaagcaccaaucaugaau

SEQ ID NO: 1671539 - RNA, 17 nt, Human
ugaacuuugaccucugc

SEQ ID NO: 1671540 - RNA, 16 nt, Human
ugaacuuugaccucug

SEQ ID NO: 1671541 - RNA, 14 nt, Human
ugaagaagauggua

SEQ ID NO: 1671542 - RNA, 20 nt, Human
ugaagaagcaccaaucauga

SEQ ID NO: 1671543 - RNA, 15 nt, Human
ugaaugcauaaaaug

SEQ ID NO: 1671544 - RNA, 16 nt, Human
ugaaugcauaaaaugu

SEQ ID NO: 1671545 - RNA, 18 nt, Human
ugaagguggaaauaaacu

SEQ ID NO: 1671546 - RNA, 14 nt, Human
ugaaugucagugug

SEQ ID NO: 1671547 - RNA, 15 nt, Human
ugaaugucaguguga

SEQ ID NO: 1671548 - RNA, 18 nt, Human
ugaaugucagugugacug

SEQ ID NO: 1671549 - RNA, 20 nt, Human
agagucucacuguugcccag

SEQ ID NO: 1671550 - RNA, 22 nt, Human
agagucucacuguugcccaggc

SEQ ID NO: 1671551 - RNA, 14 nt, Human
agagugaacaaauu

SEQ ID NO: 1671552 - RNA, 15 nt, Human
agagugagacucugu

SEQ ID NO: 1671553 - RNA, 16 nt, Human
agagugagacucuguc

SEQ ID NO: 1671554 - RNA, 18 nt, Human
agagucuauuuacggaac

SEQ ID NO: 1671555 - RNA, 22 nt, Human
agagugaacaaauuuacagaga

SEQ ID NO: 1671556 - RNA, 21 nt, Human
agaucaaccccuucgcuccug

SEQ ID NO: 1671557 - RNA, 14 nt, Human
agaucaaccccuuc

SEQ ID NO: 1671558 - RNA, 19 nt, Human
agaucaaccccuucgcucc

SEQ ID NO: 1671559 - RNA, 22 nt, Human
agauauuuugcuuugugauuuu

SEQ ID NO: 1671560 - RNA, 19 nt, Human
agauacaggaaaagcugcu

SEQ ID NO: 1671561 - RNA, 19 nt, Human
agagugagacucugucuca

SEQ ID NO: 1671562 - RNA, 19 nt, Human
agauaaggguaucugguga

SEQ ID NO: 1671563 - RNA, 18 nt, Human
agauaauucuagcuuuga

SEQ ID NO: 1671564 - RNA, 18 nt, Human
agauaauacaccacuaca

SEQ ID NO: 1671565 - RNA, 12 nt, Human
ugaauuuauugg

SEQ ID NO: 1671566 - RNA, 15 nt, Human
ugaauuuauuggcuu

SEQ ID NO: 1671567 - RNA, 16 nt, Human
ugaauuuauuggcuuu

SEQ ID NO: 1671568 - RNA, 17 nt, Human
ugaauuuauuggcuuuu

SEQ ID NO: 1671569 - RNA, 18 nt, Human
ugacauuguagagcuucu

SEQ ID NO: 1671570 - RNA, 22 nt, Human
ugacauuguagagcuucuggca

SEQ ID NO: 1671571 - RNA, 12 nt, Human
ugaccacacucc

SEQ ID NO: 1671572 - RNA, 17 nt, Human
ugaccacacuccagcug

SEQ ID NO: 1671573 - RNA, 19 nt, Human
ugaccacacuccagcuggg

SEQ ID NO: 1671574 - RNA, 20 nt, Human
ugaccacacuccagcuggga

SEQ ID NO: 1671575 - RNA, 21 nt, Human
agaucauugugaaauuauuca

SEQ ID NO: 1671576 - RNA, 15 nt, Human
agauguguucacaau

SEQ ID NO: 1671577 - RNA, 18 nt, Human
agauguguucacaaugga

SEQ ID NO: 1671578 - RNA, 12 nt, Human
ugacccaugcug

SEQ ID NO: 1671579 - RNA, 17 nt, Human
ugaccccucauagcccu

SEQ ID NO: 1671580 - RNA, 22 nt, Human
ugacccccaaccaaguggcucc

SEQ ID NO: 1671581 - RNA, 19 nt, Human
ugaccccucauagcccuca

SEQ ID NO: 1671582 - RNA, 20 nt, Human
ugaccccucauagcccucac

SEQ ID NO: 1671583 - RNA, 13 nt, Human
ugaccucugccug

SEQ ID NO: 1671584 - RNA, 23 nt, Human
ugaccccucauagcccucacccu

SEQ ID NO: 1671585 - RNA, 14 nt, Human
ugaccucugccuga

SEQ ID NO: 1671586 - RNA, 12 nt, Human
ugaccugaggcc

SEQ ID NO: 1671587 - RNA, 18 nt, Human
agaugcuucucacugcca

SEQ ID NO: 1671588 - RNA, 16 nt, Human
agaugcuucucacugc

SEQ ID NO: 1671589 - RNA, 23 nt, Human
agaugcuagaacucccuuucaac

SEQ ID NO: 1671590 - RNA, 20 nt, Human
agauuauaggcaccuaccac

SEQ ID NO: 1671591 - RNA, 23 nt, Human
agauuauauauauuuuuuucuga

SEQ ID NO: 1671592 - RNA, 16 nt, Human
agauuauucacugauu

SEQ ID NO: 1671593 - RNA, 16 nt, Human
agauucaaucccagga

SEQ ID NO: 1671594 - RNA, 21 nt, Human
agauucaaugccccugaauuu

SEQ ID NO: 1671595 - RNA, 22 nt, Human
agauucaaugccccugaauuua

SEQ ID NO: 1671596 - RNA, 22 nt, Human
ugacuucauuaauaauaaauuc

SEQ ID NO: 1671597 - RNA, 17 nt, Human
ugaccugaggcccuucu

SEQ ID NO: 1671598 - RNA, 14 nt, Human
ugaccugaggcccu

SEQ ID NO: 1671599 - RNA, 15 nt, Human
ugaccugaggcccuu

SEQ ID NO: 1671600 - RNA, 17 nt, Human
ugacuccagaauuuccc

SEQ ID NO: 1671601 - RNA, 19 nt, Human
ugacuccagaauuucccaa

SEQ ID NO: 1671602 - RNA, 20 nt, Human
ugacuccagaauuucccaaa

SEQ ID NO: 1671603 - RNA, 23 nt, Human
ugacuccagaauuucccaaagca

SEQ ID NO: 1671604 - RNA, 15 nt, Human
ugacuguuuccauca

SEQ ID NO: 1671605 - RNA, 13 nt, Human
agauuucacucuc

SEQ ID NO: 1671606 - RNA, 14 nt, Human
agauuucacucucc

SEQ ID NO: 1671607 - RNA, 17 nt, Human
agauuucacucuccuug

SEQ ID NO: 1671608 - RNA, 14 nt, Human
agauuuaugcauau

SEQ ID NO: 1671609 - RNA, 16 nt, Human
agauuuaccacuugug

SEQ ID NO: 1671610 - RNA, 16 nt, Human
agauugugccccugca

SEQ ID NO: 1671611 - RNA, 21 nt, Human
agauugugccccugcacucca

SEQ ID NO: 1671612 - RNA, 15 nt, Human
agcaaaaauauuuua

SEQ ID NO: 1671613 - RNA, 17 nt, Human
agcaaaaauauuuuaug

SEQ ID NO: 1671614 - RNA, 18 nt, Human
agcaaaaauauuuuauga

SEQ ID NO: 1671615 - RNA, 19 nt, Human
agcaaaaauauuuuaugau

SEQ ID NO: 1671616 - RNA, 23 nt, Human
agcaaaaauauuuuaugauccag

SEQ ID NO: 1671617 - RNA, 21 nt, Human
agauuuuauuauguaaauccc

SEQ ID NO: 1671618 - RNA, 22 nt, Human
agauuuuauuauguaaauccca

SEQ ID NO: 1671619 - RNA, 14 nt, Human
agauuuuccugaaa

SEQ ID NO: 1671620 - RNA, 21 nt, Human
agcacagcagccccugcacaa

SEQ ID NO: 1671621 - RNA, 22 nt, Human
agcaagugagagcuggguguca

SEQ ID NO: 1671622 - RNA, 14 nt, Human
agcaagugagagcu

SEQ ID NO: 1671623 - RNA, 17 nt, Human
ugagccagauuucacuc

SEQ ID NO: 1671624 - RNA, 22 nt, Human
ugagccagauuucacucuccuu

SEQ ID NO: 1671625 - RNA, 20 nt, Human
agcaagugagacccugucuc

SEQ ID NO: 1671626 - RNA, 13 nt, Human
agcaagugagagc

SEQ ID NO: 1671627 - RNA, 15 nt, Human
agcacagugaucaag

SEQ ID NO: 1671628 - RNA, 16 nt, Human
agcacagcuucauuuc

SEQ ID NO: 1671629 - RNA, 22 nt, Human
agcacagccucuuagaugcagu

SEQ ID NO: 1671630 - RNA, 13 nt, Human
agcacaugccucu

SEQ ID NO: 1671631 - RNA, 14 nt, Human
agcacaugccucuc

SEQ ID NO: 1671632 - RNA, 16 nt, Human
agcacaugccucucuc

SEQ ID NO: 1671633 - RNA, 16 nt, Human
agcaccaaucaugaau

SEQ ID NO: 1671634 - RNA, 21 nt, Human
ugagcaucaggccaggcccuc

SEQ ID NO: 1671635 - RNA, 15 nt, Human
ugagccaccacgccc

SEQ ID NO: 1671636 - RNA, 14 nt, Human
ugagccaccgugcc

SEQ ID NO: 1671637 - RNA, 22 nt, Human
ugagcaucaggccaggcccucu

SEQ ID NO: 1671638 - RNA, 24 nt, Human
ugagcaucaggccaggcccucugc

SEQ ID NO: 1671639 - RNA, 18 nt, Human
ugagccaccgugccuggc

SEQ ID NO: 1671640 - RNA, 19 nt, Human
ugagccaccgugccuggcc

SEQ ID NO: 1671641 - RNA, 20 nt, Human
ugagccaccgugccuggcca

SEQ ID NO: 1671642 - RNA, 21 nt, Human
ugagccaccgugccuggccac

SEQ ID NO: 1671643 - RNA, 21 nt, Human
ugagccacugcaccgggccac

SEQ ID NO: 1671644 - RNA, 18 nt, Human
ugagccacugcaccgggc

SEQ ID NO: 1671645 - RNA, 23 nt, Human
ugagccacugcaccgggccacag

SEQ ID NO: 1671646 - RNA, 13 nt, Human
ugagccagauuuc

SEQ ID NO: 1671647 - RNA, 14 nt, Human
ugagccagauuuca

SEQ ID NO: 1671648 - RNA, 16 nt, Human
ugagccagauuucacu

SEQ ID NO: 1671649 - RNA, 20 nt, Human
ugagcacuaaggugugcucu

SEQ ID NO: 1671650 - RNA, 21 nt, Human
ugagcacuaaggugugcucug

SEQ ID NO: 1671651 - RNA, 22 nt, Human
ugagcacuaaggugugcucuga

SEQ ID NO: 1671652 - RNA, 23 nt, Human
ugagcacuaaggugugcucugau

SEQ ID NO: 1671653 - RNA, 16 nt, Human
ugagcaaauguggcuc

SEQ ID NO: 1671654 - RNA, 18 nt, Human
ugagcaaauguggcuccu

SEQ ID NO: 1671655 - RNA, 19 nt, Human
ugagcaaauguggcuccug

SEQ ID NO: 1671656 - RNA, 15 nt, Human
ugagcaauccugcaa

SEQ ID NO: 1671657 - RNA, 14 nt, Human
agcaacgcaggccc

SEQ ID NO: 1671658 - RNA, 10 nt, Human
agcaccaggg

SEQ ID NO: 1671659 - RNA, 12 nt, Human
agcaccagggaa

SEQ ID NO: 1671660 - RNA, 13 nt, Human
agcaccagggaag

SEQ ID NO: 1671661 - RNA, 19 nt, Human
agcaccuuagacagucccu

SEQ ID NO: 1671662 - RNA, 20 nt, Human
agcaccuuagacagucccug

SEQ ID NO: 1671663 - RNA, 21 nt, Human
agcaccuuagacagucccugc

SEQ ID NO: 1671664 - RNA, 22 nt, Human
agcaccuuagacagucccugcc

SEQ ID NO: 1671665 - RNA, 23 nt, Human
agcaccuuagacagucccugcca

SEQ ID NO: 1671666 - RNA, 13 nt, Human
agcacgauuucug

SEQ ID NO: 1671667 - RNA, 15 nt, Human
agcacgauuucuguu

SEQ ID NO: 1671668 - RNA, 14 nt, Human
agcacgauuucugu

SEQ ID NO: 1671669 - RNA, 16 nt, Human
agcacgauuucuguuu

SEQ ID NO: 1671670 - RNA, 22 nt, Human
agcacuuugggaggccaaggug

SEQ ID NO: 1671671 - RNA, 23 nt, Human
agcacuuugggaggccaaggugg

SEQ ID NO: 1671672 - RNA, 13 nt, Human
agcagaaaugccu

SEQ ID NO: 1671673 - RNA, 12 nt, Human
agcagaaaugcc

SEQ ID NO: 1671674 - RNA, 19 nt, Human
agcagaaaugccuuacccu

SEQ ID NO: 1671675 - RNA, 14 nt, Human
agcagaacagugau

SEQ ID NO: 1671676 - RNA, 21 nt, Human
agcagagaaugaaagggccca

SEQ ID NO: 1671677 - RNA, 22 nt, Human
agcagagaaugaaagggcccag

SEQ ID NO: 1671678 - RNA, 23 nt, Human
agcagagaaugaaagggcccaga

SEQ ID NO: 1671679 - RNA, 14 nt, Human
agcagagaauucuc

SEQ ID NO: 1671680 - RNA, 21 nt, Human
agcagagaauucucuuaucca

SEQ ID NO: 1671681 - RNA, 15 nt, Human
agcagagaccauccc

SEQ ID NO: 1671682 - RNA, 16 nt, Human
agcagagaccaucccu

SEQ ID NO: 1671683 - RNA, 17 nt, Human
agcagagaccaucccug

SEQ ID NO: 1671684 - RNA, 10 nt, Human
ugagccuggc

SEQ ID NO: 1671685 - RNA, 11 nt, Human
ugagccuggca

SEQ ID NO: 1671686 - RNA, 16 nt, Human
ugagccuggcaagaau

SEQ ID NO: 1671687 - RNA, 14 nt, Human
ugagccugggaggu

SEQ ID NO: 1671688 - RNA, 19 nt, Human
ugagccugggaggucaagg

SEQ ID NO: 1671689 - RNA, 22 nt, Human
ugagccugggaggucaaggcug

SEQ ID NO: 1671690 - RNA, 14 nt, Human
ugagccuugaacuu

SEQ ID NO: 1671691 - RNA, 19 nt, Human
ugagccuugaacuuugacc

SEQ ID NO: 1671692 - RNA, 18 nt, Human
ugagccuugaacuuugac

SEQ ID NO: 1671693 - RNA, 17 nt, Human
ugagccuugaacuuuga

SEQ ID NO: 1671694 - RNA, 15 nt, Human
ugagccuugaacuuu

SEQ ID NO: 1671695 - RNA, 13 nt, Human
ugagcgacaguga

SEQ ID NO: 1671696 - RNA, 14 nt, Human
ugagcgacagugag

SEQ ID NO: 1671697 - RNA, 16 nt, Human
ugagcgacagugagac

SEQ ID NO: 1671698 - RNA, 20 nt, Human
ugagcgacagugagacucug

SEQ ID NO: 1671699 - RNA, 15 nt, Human
ugaggaagcaaaagc

SEQ ID NO: 1671700 - RNA, 22 nt, Human
ugaggaagcaaaagcaucuaug

SEQ ID NO: 1671701 - RNA, 14 nt, Human
ugaggaagccgcug

SEQ ID NO: 1671702 - RNA, 17 nt, Human
ugaggaagccgcugggg

SEQ ID NO: 1671703 - RNA, 18 nt, Human
ugaggaagccgcuggggc

SEQ ID NO: 1671704 - RNA, 19 nt, Human
ugaggaagccgcuggggcc

SEQ ID NO: 1671705 - RNA, 21 nt, Human
ugaggaagccgcuggggccag

SEQ ID NO: 1671706 - RNA, 14 nt, Human
ugagcuaggaauug

SEQ ID NO: 1671707 - RNA, 16 nt, Human
ugagcuacaaaugcau

SEQ ID NO: 1671708 - RNA, 14 nt, Human
ugagcuacaaaugc

SEQ ID NO: 1671709 - RNA, 13 nt, Human
ugagcuacaaaug

SEQ ID NO: 1671710 - RNA, 20 nt, Human
ugaggccagagacacaagcc

SEQ ID NO: 1671711 - RNA, 14 nt, Human
ugaggccagagaca

SEQ ID NO: 1671712 - RNA, 16 nt, Human
ugaggccagagacaca

SEQ ID NO: 1671713 - RNA, 12 nt, Human
ugaggcccagag

SEQ ID NO: 1671714 - RNA, 13 nt, Human
ugaggcccagagg

SEQ ID NO: 1671715 - RNA, 23 nt, Human
ugaggcccagagggccugcaagg

SEQ ID NO: 1671716 - RNA, 21 nt, Human
ugaggcccagagggccugcaa

SEQ ID NO: 1671717 - RNA, 22 nt, Human
ugaggcccagagggccugcaag

SEQ ID NO: 1671718 - RNA, 15 nt, Human
ugaggcccagagggc

SEQ ID NO: 1671719 - RNA, 17 nt, Human
ugaggcccagagggccu

SEQ ID NO: 1671720 - RNA, 18 nt, Human
ugaggcccagagggccug

SEQ ID NO: 1671721 - RNA, 20 nt, Human
ugaggcccagagggccugca

SEQ ID NO: 1671722 - RNA, 18 nt, Human
ugaggaauucuguauaga

SEQ ID NO: 1671723 - RNA, 19 nt, Human
ugaggaauucuguauagau

SEQ ID NO: 1671724 - RNA, 14 nt, Human
ugaggaauucugua

SEQ ID NO: 1671725 - RNA, 15 nt, Human
ugaggaauucuguau

SEQ ID NO: 1671726 - RNA, 16 nt, Human
ugaggaauucuguaua

SEQ ID NO: 1671727 - RNA, 21 nt, Human
ugaggaauccagacccggcug

SEQ ID NO: 1671728 - RNA, 22 nt, Human
ugaggaauccagacccggcugc

SEQ ID NO: 1671729 - RNA, 12 nt, Human
ugaggccagaga

SEQ ID NO: 1671730 - RNA, 21 nt, Human
ugaggacacuaaccacgcugg

SEQ ID NO: 1671731 - RNA, 15 nt, Human
ugaggacacugauau

SEQ ID NO: 1671732 - RNA, 15 nt, Human
ugagggauuaucuuu

SEQ ID NO: 1671733 - RNA, 19 nt, Human
ugagggauacccaucccau

SEQ ID NO: 1671734 - RNA, 16 nt, Human
ugaggcccuucucucc

SEQ ID NO: 1671735 - RNA, 18 nt, Human
ugaggcccuucucuccag

SEQ ID NO: 1671736 - RNA, 19 nt, Human
ugaggcccuucucuccagc

SEQ ID NO: 1671737 - RNA, 20 nt, Human
ugaggcccuucucuccagcc

SEQ ID NO: 1671738 - RNA, 22 nt, Human
ugaggcccuucucuccagcccc

SEQ ID NO: 1671739 - RNA, 23 nt, Human
ugaggcccuucucuccagccccu

SEQ ID NO: 1671740 - RNA, 24 nt, Human
ugaggcccuucucuccagccccug

SEQ ID NO: 1671741 - RNA, 12 nt, Human
ugaggggccucu

SEQ ID NO: 1671742 - RNA, 13 nt, Human
ugaggggccucuu

SEQ ID NO: 1671743 - RNA, 19 nt, Human
ugagguacaaccuguucug

SEQ ID NO: 1671744 - RNA, 20 nt, Human
agcagagaccaucccugaag

SEQ ID NO: 1671745 - RNA, 20 nt, Human
agcagagcaccuuagacagu

SEQ ID NO: 1671746 - RNA, 17 nt, Human
ugaggucagagccugca

SEQ ID NO: 1671747 - RNA, 18 nt, Human
agcagagaccaucccuga

SEQ ID NO: 1671748 - RNA, 19 nt, Human
agcagagaccaucccugaa

SEQ ID NO: 1671749 - RNA, 20 nt, Human
ugaggguugggcugguguca

SEQ ID NO: 1671750 - RNA, 17 nt, Human
ugagguacugagaguga

SEQ ID NO: 1671751 - RNA, 14 nt, Human
ugaggucagagccu

SEQ ID NO: 1671752 - RNA, 16 nt, Human
ugaggucagagccugc

SEQ ID NO: 1671753 - RNA, 13 nt, Human
ugaggucagagcc

SEQ ID NO: 1671754 - RNA, 22 nt, Human
ugagguacugagagugaacaaa

SEQ ID NO: 1671755 - RNA, 17 nt, Human
agcagaggaaggagagg

SEQ ID NO: 1671756 - RNA, 19 nt, Human
agcagauuauucacugauu

SEQ ID NO: 1671757 - RNA, 20 nt, Human
agcagauuauucacugauuu

SEQ ID NO: 1671758 - RNA, 19 nt, Human
agcagauggagaccccuug

SEQ ID NO: 1671759 - RNA, 15 nt, Human
agcagauuauucacu

SEQ ID NO: 1671760 - RNA, 16 nt, Human
agcagauuauucacug

SEQ ID NO: 1671761 - RNA, 14 nt, Human
agcagauuauucac

SEQ ID NO: 1671762 - RNA, 18 nt, Human
ucagcggggacagcuccu

SEQ ID NO: 1671763 - RNA, 15 nt, Human
ucagcggggacagcu

SEQ ID NO: 1671764 - RNA, 16 nt, Human
ucagcggggacagcuc

SEQ ID NO: 1671765 - RNA, 17 nt, Human
ucagcggggacagcucc

SEQ ID NO: 1671766 - RNA, 20 nt, Human
ucaggccaaacucaccugcc

SEQ ID NO: 1671767 - RNA, 23 nt, Human
ucaggccaaacucaccugccccu

SEQ ID NO: 1671768 - RNA, 12 nt, Human
ucaggaagcuca

SEQ ID NO: 1671769 - RNA, 17 nt, Human
ucaggaagcucagggcc

SEQ ID NO: 1671770 - RNA, 19 nt, Human
ucaggaagcucagggccug

SEQ ID NO: 1671771 - RNA, 20 nt, Human
ucaggaagcucagggccugg

SEQ ID NO: 1671772 - RNA, 15 nt, Human
ucaggccagcugcuu

SEQ ID NO: 1671773 - RNA, 20 nt, Human
ucaggccagcugcuugggcu

SEQ ID NO: 1671774 - RNA, 11 nt, Human
ucaggccaggc

SEQ ID NO: 1671775 - RNA, 12 nt, Human
ucaggccaggcc

SEQ ID NO: 1671776 - RNA, 13 nt, Human
ucagggucccugg

SEQ ID NO: 1671777 - RNA, 14 nt, Human
ucagggucccuggu

SEQ ID NO: 1671778 - RNA, 18 nt, Human
ucagggucccugguggca

SEQ ID NO: 1671779 - RNA, 13 nt, Human
ucagguaacaggc

SEQ ID NO: 1671780 - RNA, 15 nt, Human
ucagguaacaggcag

SEQ ID NO: 1671781 - RNA, 16 nt, Human
ucagguaacaggcaga

SEQ ID NO: 1671782 - RNA, 19 nt, Human
accccuucgcuccuguguc

SEQ ID NO: 1671783 - RNA, 20 nt, Human
accccuucgcuccugugucu

SEQ ID NO: 1671784 - RNA, 16 nt, Human
acccuuguggucccac

SEQ ID NO: 1671785 - RNA, 17 nt, Human
acccuuguggucccacc

SEQ ID NO: 1671786 - RNA, 19 nt, Human
acccuuguggucccacccc

SEQ ID NO: 1671787 - RNA, 20 nt, Human
acccuuguggucccacccca

SEQ ID NO: 1671788 - RNA, 14 nt, Human
acccugcccugugg

SEQ ID NO: 1671789 - RNA, 13 nt, Human
acccugcccugug

SEQ ID NO: 1671790 - RNA, 11 nt, Human
acccugcccug

SEQ ID NO: 1671791 - RNA, 12 nt, Human
acccugcccugu

SEQ ID NO: 1671792 - RNA, 14 nt, Human
acccucuuagaaaa

SEQ ID NO: 1671793 - RNA, 16 nt, Human
ucagauuuuauuaugu

SEQ ID NO: 1671794 - RNA, 19 nt, Human
ucagauuuuauuauguaaa

SEQ ID NO: 1671795 - RNA, 20 nt, Human
ucagauuuuauuauguaaau

SEQ ID NO: 1671796 - RNA, 22 nt, Human
ucagauuuuauuauguaaaucc

SEQ ID NO: 1671797 - RNA, 18 nt, Human
ucagcccucccugccccu

SEQ ID NO: 1671798 - RNA, 19 nt, Human
ucagcccucccugccccuc

SEQ ID NO: 1671799 - RNA, 13 nt, Human
acccagcucuggu

SEQ ID NO: 1671800 - RNA, 15 nt, Human
acccagcucuggucc

SEQ ID NO: 1671801 - RNA, 14 nt, Human
ucagauuuuauuau

SEQ ID NO: 1671802 - RNA, 15 nt, Human
ucagauuuuauuaug

SEQ ID NO: 1671803 - RNA, 13 nt, Human
ucagauuuuauua

SEQ ID NO: 1671804 - RNA, 13 nt, Human
ucagaucuucugu

SEQ ID NO: 1671805 - RNA, 13 nt, Human
ucagaagacacug

SEQ ID NO: 1671806 - RNA, 15 nt, Human
accccuggcuuuuca

SEQ ID NO: 1671807 - RNA, 17 nt, Human
accccuggcuuuucacu

SEQ ID NO: 1671808 - RNA, 19 nt, Human
ucagccuggcuucaaauug

SEQ ID NO: 1671809 - RNA, 10 nt, Human
ucagccuggg

SEQ ID NO: 1671810 - RNA, 12 nt, Human
ucagccugggca

SEQ ID NO: 1671811 - RNA, 12 nt, Human
accccuggcuuu

SEQ ID NO: 1671812 - RNA, 15 nt, Human
acccccagccugcua

SEQ ID NO: 1671813 - RNA, 19 nt, Human
ucacuguugcccaggcugg

SEQ ID NO: 1671814 - RNA, 17 nt, Human
ucacuguugcccaggcu

SEQ ID NO: 1671815 - RNA, 18 nt, Human
ucacuguugcccaggcug

SEQ ID NO: 1671816 - RNA, 21 nt, Human
accaguguuguggauuuaaca

SEQ ID NO: 1671817 - RNA, 13 nt, Human
ucacugagacagc

SEQ ID NO: 1671818 - RNA, 14 nt, Human
ucacugagacagcc

SEQ ID NO: 1671819 - RNA, 15 nt, Human
ucacugagacagccc

SEQ ID NO: 1671820 - RNA, 20 nt, Human
ucacugcacagugcaucuca

SEQ ID NO: 1671821 - RNA, 22 nt, Human
ucacugcacagugcaucucagc

SEQ ID NO: 1671822 - RNA, 24 nt, Human
ucacugcacagugcaucucagccc

SEQ ID NO: 1671823 - RNA, 13 nt, Human
ucacugcagccuc

SEQ ID NO: 1671824 - RNA, 12 nt, Human
ucacugcagccu

SEQ ID NO: 1671825 - RNA, 16 nt, Human
acccagcccacuucug

SEQ ID NO: 1671826 - RNA, 17 nt, Human
acccagcccacuucugc

SEQ ID NO: 1671827 - RNA, 18 nt, Human
acccagcccacuucugcc

SEQ ID NO: 1671828 - RNA, 19 nt, Human
acccacuugcuuuuaaaau

SEQ ID NO: 1671829 - RNA, 16 nt, Human
acccagaagaaaauag

SEQ ID NO: 1671830 - RNA, 21 nt, Human
acccaaauguucaucaaugaa

SEQ ID NO: 1671831 - RNA, 18 nt, Human
acccaaaaggcagaagca

SEQ ID NO: 1671832 - RNA, 15 nt, Human
accauuccccauggg

SEQ ID NO: 1671833 - RNA, 12 nt, Human
accauuccccau

SEQ ID NO: 1671834 - RNA, 23 nt, Human
accaugauuaaccacuucagcug

SEQ ID NO: 1671835 - RNA, 22 nt, Human
accaugauuaaccacuucagcu

SEQ ID NO: 1671836 - RNA, 18 nt, Human
accauucuccaccugcca

SEQ ID NO: 1671837 - RNA, 13 nt, Human
accauucuccacc

SEQ ID NO: 1671838 - RNA, 16 nt, Human
accauucuccaccugc

SEQ ID NO: 1671839 - RNA, 23 nt, Human
accauuuugggguacccacugcu

SEQ ID NO: 1671840 - RNA, 13 nt, Human
acccaaaaggcag

SEQ ID NO: 1671841 - RNA, 15 nt, Human
acccaaaaggcagaa

SEQ ID NO: 1671842 - RNA, 19 nt, Human
accaggcaacuugggaacu

SEQ ID NO: 1671843 - RNA, 13 nt, Human
ucaccucccccau

SEQ ID NO: 1671844 - RNA, 15 nt, Human
ucaccucccccaucu

SEQ ID NO: 1671845 - RNA, 12 nt, Human
ucaccuccugcu

SEQ ID NO: 1671846 - RNA, 13 nt, Human
ucaccuccugcug

SEQ ID NO: 1671847 - RNA, 14 nt, Human
ucaccuccugcugg

SEQ ID NO: 1671848 - RNA, 15 nt, Human
ucaccuccugcuggg

SEQ ID NO: 1671849 - RNA, 17 nt, Human
ucaccuccugcugggca

SEQ ID NO: 1671850 - RNA, 19 nt, Human
ucaccugaagacucauucu

SEQ ID NO: 1671851 - RNA, 23 nt, Human
ucaccugaagacucauucuucug

SEQ ID NO: 1671852 - RNA, 12 nt, Human
accagagcugcc

SEQ ID NO: 1671853 - RNA, 19 nt, Human
accagagcccaccuuggcu

SEQ ID NO: 1671854 - RNA, 22 nt, Human
accagagcccaccuuggcucaa

SEQ ID NO: 1671855 - RNA, 11 nt, Human
accagacaggu

SEQ ID NO: 1671856 - RNA, 22 nt, Human
accagacaccuugacagggcac

SEQ ID NO: 1671857 - RNA, 23 nt, Human
accagacaccuugacagggcaca

SEQ ID NO: 1671858 - RNA, 12 nt, Human
accacuuuuguu

SEQ ID NO: 1671859 - RNA, 19 nt, Human
accacuuguguuuugcaag

SEQ ID NO: 1671860 - RNA, 23 nt, Human
accacuuguguuuugcaagccag

SEQ ID NO: 1671861 - RNA, 20 nt, Human
accacucuaucaaguauuau

SEQ ID NO: 1671862 - RNA, 16 nt, Human
accacaucuugcucug

SEQ ID NO: 1671863 - RNA, 20 nt, Human
accacaucuugcucugcuga

SEQ ID NO: 1671864 - RNA, 21 nt, Human
accacaucuugcucugcugac

SEQ ID NO: 1671865 - RNA, 24 nt, Human
accacaucuugcucugcugacaga

SEQ ID NO: 1671866 - RNA, 15 nt, Human
accacuucagcugac

SEQ ID NO: 1671867 - RNA, 13 nt, Human
accacuucagcug

SEQ ID NO: 1671868 - RNA, 14 nt, Human
accacuucagcuga

SEQ ID NO: 1671869 - RNA, 14 nt, Human
accacugcagaaga

SEQ ID NO: 1671870 - RNA, 19 nt, Human
accacugcagaagacagua

SEQ ID NO: 1671871 - RNA, 22 nt, Human
accacagacauacuaaccagca

SEQ ID NO: 1671872 - RNA, 21 nt, Human
accacagacauacuaaccagc

SEQ ID NO: 1671873 - RNA, 14 nt, Human
accacaucuugcuc

SEQ ID NO: 1671874 - RNA, 11 nt, Human
accacagcagu

SEQ ID NO: 1671875 - RNA, 12 nt, Human
uauuucauuucu

SEQ ID NO: 1671876 - RNA, 12 nt, Human
accuucuccuuc

SEQ ID NO: 1671877 - RNA, 16 nt, Human
accuugacagggcaca

SEQ ID NO: 1671878 - RNA, 15 nt, Human
accuugacagggcac

SEQ ID NO: 1671879 - RNA, 15 nt, Human
accuugaaugaugcc

SEQ ID NO: 1671880 - RNA, 14 nt, Human
accuugacagggca

SEQ ID NO: 1671881 - RNA, 13 nt, Human
accuucuguggcu

SEQ ID NO: 1671882 - RNA, 15 nt, Human
accuucuguggcuca

SEQ ID NO: 1671883 - RNA, 16 nt, Human
accuucuguggcucac

SEQ ID NO: 1671884 - RNA, 12 nt, Human
accuucuguggc

SEQ ID NO: 1671885 - RNA, 14 nt, Human
accuucuccuucac

SEQ ID NO: 1671886 - RNA, 13 nt, Human
accuucuccuuca

SEQ ID NO: 1671887 - RNA, 14 nt, Human
accuuagccugccc

SEQ ID NO: 1671888 - RNA, 17 nt, Human
accuuagacagucccug

SEQ ID NO: 1671889 - RNA, 22 nt, Human
accuggucacaggacucugccu

SEQ ID NO: 1671890 - RNA, 23 nt, Human
accuggucacaggacucugccuc

SEQ ID NO: 1671891 - RNA, 15 nt, Human
uccaccaucaagcca

SEQ ID NO: 1671892 - RNA, 18 nt, Human
uccaccaucaagccacca

SEQ ID NO: 1671893 - RNA, 22 nt, Human
uccagaaguuugagaucagccu

SEQ ID NO: 1671894 - RNA, 19 nt, Human
accuuuguauucucuccug

SEQ ID NO: 1671895 - RNA, 15 nt, Human
accuuuguauucucu

SEQ ID NO: 1671896 - RNA, 23 nt, Human
accuuuguauucucuccuguacc

SEQ ID NO: 1671897 - RNA, 15 nt, Human
uccagaccccuggcu

SEQ ID NO: 1671898 - RNA, 16 nt, Human
uccagaccccuggcuu

SEQ ID NO: 1671899 - RNA, 17 nt, Human
uccagaccccuggcuuu

SEQ ID NO: 1671900 - RNA, 18 nt, Human
uccagaccccuggcuuuu

SEQ ID NO: 1671901 - RNA, 14 nt, Human
uccagacccggcug

SEQ ID NO: 1671902 - RNA, 15 nt, Human
uccagccccuggaug

SEQ ID NO: 1671903 - RNA, 16 nt, Human
uccagccccuggaugc

SEQ ID NO: 1671904 - RNA, 17 nt, Human
uccagccccuggaugca

SEQ ID NO: 1671905 - RNA, 19 nt, Human
uccagccccuggaugcagc

SEQ ID NO: 1671906 - RNA, 21 nt, Human
uccagccccuggaugcagccu

SEQ ID NO: 1671907 - RNA, 21 nt, Human
uccagccugagcgacagugag

SEQ ID NO: 1671908 - RNA, 23 nt, Human
uccagaccccuggcuuuucacug

SEQ ID NO: 1671909 - RNA, 22 nt, Human
uccagccccuggaugcagccuc

SEQ ID NO: 1671910 - RNA, 20 nt, Human
uccagccugagcgacaguga

SEQ ID NO: 1671911 - RNA, 15 nt, Human
accugaagucuuugu

SEQ ID NO: 1671912 - RNA, 22 nt, Human
accugaagucuuuguacagaca

SEQ ID NO: 1671913 - RNA, 18 nt, Human
accugcucuccucuugcc

SEQ ID NO: 1671914 - RNA, 17 nt, Human
accugcucuccucuugc

SEQ ID NO: 1671915 - RNA, 23 nt, Human
accugcggugcuaucucccccag

SEQ ID NO: 1671916 - RNA, 19 nt, Human
accugcggugcuaucuccc

SEQ ID NO: 1671917 - RNA, 22 nt, Human
accugcggugcuaucuccccca

SEQ ID NO: 1671918 - RNA, 19 nt, Human
accugcucuccucuugcca

SEQ ID NO: 1671919 - RNA, 19 nt, Human
ucauuugagcagggcucag

SEQ ID NO: 1671920 - RNA, 17 nt, Human
accuggaauauauaacc

SEQ ID NO: 1671921 - RNA, 14 nt, Human
accuggaauauaua

SEQ ID NO: 1671922 - RNA, 23 nt, Human
uccaaagucucuggaauuugaaa

SEQ ID NO: 1671923 - RNA, 17 nt, Human
ucauuuuuuuuaagaaa

SEQ ID NO: 1671924 - RNA, 13 nt, Human
ucauuuuuuuuaa

SEQ ID NO: 1671925 - RNA, 20 nt, Human
ucauuuuagggguagcauuu

SEQ ID NO: 1671926 - RNA, 18 nt, Human
ucauuugugccagaaugc

SEQ ID NO: 1671927 - RNA, 21 nt, Human
ucauuugagcagggcucagcg

SEQ ID NO: 1671928 - RNA, 16 nt, Human
uccaagcuggucccac

SEQ ID NO: 1671929 - RNA, 11 nt, Human
uccaagcuggu

SEQ ID NO: 1671930 - RNA, 22 nt, Human
uccacauaaggaaacuggguuc

SEQ ID NO: 1671931 - RNA, 18 nt, Human
uccacauaaggaaacugg

SEQ ID NO: 1671932 - RNA, 14 nt, Human
uccaaaugcagcuu

SEQ ID NO: 1671933 - RNA, 15 nt, Human
uccaaaugcagcuuu

SEQ ID NO: 1671934 - RNA, 18 nt, Human
uccaagcuccaucuccac

SEQ ID NO: 1671935 - RNA, 16 nt, Human
uccaagcucccaggca

SEQ ID NO: 1671936 - RNA, 14 nt, Human
uccaagcucccagg

SEQ ID NO: 1671937 - RNA, 15 nt, Human
uccaagcucccaggc

SEQ ID NO: 1671938 - RNA, 12 nt, Human
uccaagcuccca

SEQ ID NO: 1671939 - RNA, 13 nt, Human
uccaagcucccag

SEQ ID NO: 1671940 - RNA, 21 nt, Human
uccaacuaucucauuuccaag

SEQ ID NO: 1671941 - RNA, 21 nt, Human
accucuaaauucuuucauuuu

SEQ ID NO: 1671942 - RNA, 13 nt, Human
accucucccuugg

SEQ ID NO: 1671943 - RNA, 14 nt, Human
accucucccuugga

SEQ ID NO: 1671944 - RNA, 15 nt, Human
accucucccuuggau

SEQ ID NO: 1671945 - RNA, 12 nt, Human
accucugcacaa

SEQ ID NO: 1671946 - RNA, 23 nt, Human
accucucccuuggauuguccccg

SEQ ID NO: 1671947 - RNA, 14 nt, Human
accucucucacucc

SEQ ID NO: 1671948 - RNA, 19 nt, Human
accucucucacuccuugaa

SEQ ID NO: 1671949 - RNA, 18 nt, Human
accucuaaauucuuucau

SEQ ID NO: 1671950 - RNA, 17 nt, Human
accucggugccuuccuc

SEQ ID NO: 1671951 - RNA, 21 nt, Human
ucauucuccuuguguuacuaa

SEQ ID NO: 1671952 - RNA, 22 nt, Human
ucauugaccugaggcccuucuc

SEQ ID NO: 1671953 - RNA, 14 nt, Human
ucaugugaaaucau

SEQ ID NO: 1671954 - RNA, 13 nt, Human
ucaugucuggcua

SEQ ID NO: 1671955 - RNA, 17 nt, Human
ucauguucuuaauucuu

SEQ ID NO: 1671956 - RNA, 11 nt, Human
ucauguucuua

SEQ ID NO: 1671957 - RNA, 19 nt, Human
ucaugacaaagacugagua

SEQ ID NO: 1671958 - RNA, 19 nt, Human
ucauccacugugccaugug

SEQ ID NO: 1671959 - RNA, 21 nt, Human
ucauccacugugccaugugcc

SEQ ID NO: 1671960 - RNA, 23 nt, Human
ucauccacugugccaugugccag

SEQ ID NO: 1671961 - RNA, 22 nt, Human
ucaugaauuaguuuuauaugcu

SEQ ID NO: 1671962 - RNA, 13 nt, Human
accuagccuuaga

SEQ ID NO: 1671963 - RNA, 20 nt, Human
accuccgccucuuggguuca

SEQ ID NO: 1671964 - RNA, 17 nt, Human
accgccaaggcuggggg

SEQ ID NO: 1671965 - RNA, 20 nt, Human
accgagucucuucuccacug

SEQ ID NO: 1671966 - RNA, 21 nt, Human
accgagucucuucuccacugg

SEQ ID NO: 1671967 - RNA, 24 nt, Human
accgagucucuucuccacuggaug

SEQ ID NO: 1671968 - RNA, 20 nt, Human
accgcagacaggaccaggga

SEQ ID NO: 1671969 - RNA, 20 nt, Human
ucauauuuacuucuuauaca

SEQ ID NO: 1671970 - RNA, 21 nt, Human
ucauauuuacuucuuauacau

SEQ ID NO: 1671971 - RNA, 22 nt, Human
ucauauuuacuucuuauacauu

SEQ ID NO: 1671972 - RNA, 18 nt, Human
accgagucucuucuccac

SEQ ID NO: 1671973 - RNA, 10 nt, Human
acccuuuucu

SEQ ID NO: 1671974 - RNA, 19 nt, Human
uccuguucccaugagauga

SEQ ID NO: 1671975 - RNA, 18 nt, Human
uccugugugugcgccuac

SEQ ID NO: 1671976 - RNA, 13 nt, Human
uccugugugugcg

SEQ ID NO: 1671977 - RNA, 14 nt, Human
uccugugugugcgc

SEQ ID NO: 1671978 - RNA, 23 nt, Human
uccugugucuugcaauggcagcc

SEQ ID NO: 1671979 - RNA, 24 nt, Human
uccugugucuugcaauggcagccu

SEQ ID NO: 1671980 - RNA, 17 nt, Human
acugcagggacugccag

SEQ ID NO: 1671981 - RNA, 18 nt, Human
acugcagggacugccagu

SEQ ID NO: 1671982 - RNA, 16 nt, Human
acugcagggacugcca

SEQ ID NO: 1671983 - RNA, 23 nt, Human
acugcagccucaaccuccugggc

SEQ ID NO: 1671984 - RNA, 23 nt, Human
uccuuaaagaguguggcaaaaua

SEQ ID NO: 1671985 - RNA, 18 nt, Human
uccuuaaagaguguggca

SEQ ID NO: 1671986 - RNA, 17 nt, Human
uccuuaaagaguguggc

SEQ ID NO: 1671987 - RNA, 19 nt, Human
acugcagccucaaccuccu

SEQ ID NO: 1671988 - RNA, 21 nt, Human
acugcagccucaaccuccugg

SEQ ID NO: 1671989 - RNA, 22 nt, Human
acugcagccucaaccuccuggg

SEQ ID NO: 1671990 - RNA, 18 nt, Human
uccugugacuucagcucu

SEQ ID NO: 1671991 - RNA, 21 nt, Human
uccuggggguucuuucuuccu

SEQ ID NO: 1671992 - RNA, 22 nt, Human
uccuggggguucuuucuuccuc

SEQ ID NO: 1671993 - RNA, 23 nt, Human
uccuggggguucuuucuuccucu

SEQ ID NO: 1671994 - RNA, 18 nt, Human
uccuggggaaccugaccc

SEQ ID NO: 1671995 - RNA, 19 nt, Human
uccuggggaaccugacccc

SEQ ID NO: 1671996 - RNA, 23 nt, Human
uccugggcagcugccuccccucc

SEQ ID NO: 1671997 - RNA, 22 nt, Human
uccugggcagcugccuccccuc

SEQ ID NO: 1671998 - RNA, 19 nt, Human
uccugggcagcugccuccc

SEQ ID NO: 1671999 - RNA, 18 nt, Human
uccugggcagcugccucc

SEQ ID NO: 1672000 - RNA, 13 nt, Human
uccugcugcaguu

SEQ ID NO: 1672001 - RNA, 17 nt, Human
uccugggcagcugccuc

SEQ ID NO: 1672002 - RNA, 16 nt, Human
uccugggcagcugccu

SEQ ID NO: 1672003 - RNA, 21 nt, Human
uccugcugcaguugccaguca

SEQ ID NO: 1672004 - RNA, 15 nt, Human
uccugggcagcugcc

SEQ ID NO: 1672005 - RNA, 22 nt, Human
uccugcaggcagccaggccaca

SEQ ID NO: 1672006 - RNA, 19 nt, Human
uccugccucagccucccaa

SEQ ID NO: 1672007 - RNA, 16 nt, Human
uccugcaggcagccag

SEQ ID NO: 1672008 - RNA, 17 nt, Human
uccugcaggcagccagg

SEQ ID NO: 1672009 - RNA, 19 nt, Human
uccugcaggcagccaggcc

SEQ ID NO: 1672010 - RNA, 20 nt, Human
uccugcaggcagccaggcca

SEQ ID NO: 1672011 - RNA, 21 nt, Human
uccugccucgaacuggcugca

SEQ ID NO: 1672012 - RNA, 20 nt, Human
uccugccucgaacuggcugc

SEQ ID NO: 1672013 - RNA, 20 nt, Human
uccugaguagcugggauuac

SEQ ID NO: 1672014 - RNA, 16 nt, Human
acugcacagugcaucu

SEQ ID NO: 1672015 - RNA, 18 nt, Human
acugcacagugcaucuca

SEQ ID NO: 1672016 - RNA, 22 nt, Human
acugcacagugcaucucagccc

SEQ ID NO: 1672017 - RNA, 21 nt, Human
uccugcaaugaagucucugaa

SEQ ID NO: 1672018 - RNA, 15 nt, Human
uccugcaaugaaguc

SEQ ID NO: 1672019 - RNA, 18 nt, Human
uccugcaaugaagucucu

SEQ ID NO: 1672020 - RNA, 20 nt, Human
uccugcaaugaagucucuga

SEQ ID NO: 1672021 - RNA, 20 nt, Human
acugcaaccuucgccaccug

SEQ ID NO: 1672022 - RNA, 23 nt, Human
acugcaaccuucgccaccugggu

SEQ ID NO: 1672023 - RNA, 16 nt, Human
acugcaaccuccgccu

SEQ ID NO: 1672024 - RNA, 22 nt, Human
acugcaaccuccgccucuuggg

SEQ ID NO: 1672025 - RNA, 13 nt, Human
acugcaaccuccg

SEQ ID NO: 1672026 - RNA, 14 nt, Human
acugcaaccuccgc

SEQ ID NO: 1672027 - RNA, 16 nt, Human
acugagugccuuuugg

SEQ ID NO: 1672028 - RNA, 23 nt, Human
acugaguacguugugcauuuggu

SEQ ID NO: 1672029 - RNA, 22 nt, Human
acugaguacguugugcauuugg

SEQ ID NO: 1672030 - RNA, 21 nt, Human
acugaguacguugugcauuug

SEQ ID NO: 1672031 - RNA, 19 nt, Human
acugaguacguugugcauu

SEQ ID NO: 1672032 - RNA, 18 nt, Human
acugaguacguugugcau

SEQ ID NO: 1672033 - RNA, 15 nt, Human
uccucuccccagcaa

SEQ ID NO: 1672034 - RNA, 15 nt, Human
acugaggaccagcca

SEQ ID NO: 1672035 - RNA, 14 nt, Human
acugaggaucagag

SEQ ID NO: 1672036 - RNA, 17 nt, Human
acugaggggaggggagc

SEQ ID NO: 1672037 - RNA, 22 nt, Human
acugaggggaggggagcauggg

SEQ ID NO: 1672038 - RNA, 16 nt, Human
uccuuccucugagccu

SEQ ID NO: 1672039 - RNA, 17 nt, Human
uccuuccucugagccuu

SEQ ID NO: 1672040 - RNA, 16 nt, Human
uccuuccucugaggcu

SEQ ID NO: 1672041 - RNA, 14 nt, Human
uccuucagugccuu

SEQ ID NO: 1672042 - RNA, 22 nt, Human
uccuucagugccuuauggaaca

SEQ ID NO: 1672043 - RNA, 13 nt, Human
uccuucagugccu

SEQ ID NO: 1672044 - RNA, 20 nt, Human
uccuucagugccuuauggaa

SEQ ID NO: 1672045 - RNA, 12 nt, Human
uccuucagugcc

SEQ ID NO: 1672046 - RNA, 11 nt, Human
uccuucagugc

SEQ ID NO: 1672047 - RNA, 13 nt, Human
uccuucagccuga

SEQ ID NO: 1672048 - RNA, 22 nt, Human
acuggcugcaaaggguaucagg

SEQ ID NO: 1672049 - RNA, 23 nt, Human
acuggccucugcugauccuccca

SEQ ID NO: 1672050 - RNA, 22 nt, Human
acuggcacaguuuucugagaaa

SEQ ID NO: 1672051 - RNA, 13 nt, Human
acugcuggcugcc

SEQ ID NO: 1672052 - RNA, 16 nt, Human
acuggauuguacuuug

SEQ ID NO: 1672053 - RNA, 13 nt, Human
acuggauuguacu

SEQ ID NO: 1672054 - RNA, 21 nt, Human
acugcuugugaaaggaaagag

SEQ ID NO: 1672055 - RNA, 22 nt, Human
acuggauuaaacuuaaucuaaa

SEQ ID NO: 1672056 - RNA, 12 nt, Human
acugcuggcugc

SEQ ID NO: 1672057 - RNA, 16 nt, Human
acugcugcccagccuc

SEQ ID NO: 1672058 - RNA, 18 nt, Human
acugcugcccagccucca

SEQ ID NO: 1672059 - RNA, 21 nt, Human
acugcugcccagccuccaagc

SEQ ID NO: 1672060 - RNA, 18 nt, Human
acugcuuccagugaggcu

SEQ ID NO: 1672061 - RNA, 21 nt, Human
acugcuuccagugaggcucug

SEQ ID NO: 1672062 - RNA, 22 nt, Human
acugcuuccagugaggcucugc

SEQ ID NO: 1672063 - RNA, 23 nt, Human
acugcuuccagugaggcucugcc

SEQ ID NO: 1672064 - RNA, 12 nt, Human
acugcucugaug

SEQ ID NO: 1672065 - RNA, 22 nt, Human
acugccuucucaacuccaaacu

SEQ ID NO: 1672066 - RNA, 16 nt, Human
acuguaaggcaaucau

SEQ ID NO: 1672067 - RNA, 20 nt, Human
acuggguacuuguggacaca

SEQ ID NO: 1672068 - RNA, 23 nt, Human
acuggguacuuguggacacagcu

SEQ ID NO: 1672069 - RNA, 19 nt, Human
acuggguacuuguggacac

SEQ ID NO: 1672070 - RNA, 12 nt, Human
ucgcuccugugu

SEQ ID NO: 1672071 - RNA, 13 nt, Human
ucgcuccuguguc

SEQ ID NO: 1672072 - RNA, 14 nt, Human
ucgcuccugugucu

SEQ ID NO: 1672073 - RNA, 19 nt, Human
acuguaauuugugauacaa

SEQ ID NO: 1672074 - RNA, 13 nt, Human
acuguacaaagua

SEQ ID NO: 1672075 - RNA, 20 nt, Human
acuguacagacagaaaaaac

SEQ ID NO: 1672076 - RNA, 14 nt, Human
acuguacaaaguag

SEQ ID NO: 1672077 - RNA, 15 nt, Human
acuguacaaaguaga

SEQ ID NO: 1672078 - RNA, 13 nt, Human
acuguacuccucc

SEQ ID NO: 1672079 - RNA, 14 nt, Human
acuguacuccuccc

SEQ ID NO: 1672080 - RNA, 15 nt, Human
acuguacuccuccca

SEQ ID NO: 1672081 - RNA, 14 nt, Human
acuguacaugaaaa

SEQ ID NO: 1672082 - RNA, 13 nt, Human
acuguacaugaaa

SEQ ID NO: 1672083 - RNA, 23 nt, Human
acuguacaugaaaacacauuuuu

SEQ ID NO: 1672084 - RNA, 13 nt, Human
ucgaccugccucg

SEQ ID NO: 1672085 - RNA, 14 nt, Human
ucgagcaugccugg

SEQ ID NO: 1672086 - RNA, 15 nt, Human
ucgagcaugccugga

SEQ ID NO: 1672087 - RNA, 14 nt, Human
ucgaggacagggag

SEQ ID NO: 1672088 - RNA, 17 nt, Human
ucgaggacagggaggug

SEQ ID NO: 1672089 - RNA, 14 nt, Human
ucgcgacaaugcaa

SEQ ID NO: 1672090 - RNA, 13 nt, Human
ucgcgacaaugca

SEQ ID NO: 1672091 - RNA, 16 nt, Human
uccuuucacaaccuuc

SEQ ID NO: 1672092 - RNA, 18 nt, Human
uccuuucacaaccuucug

SEQ ID NO: 1672093 - RNA, 19 nt, Human
uccuuucacaaccuucugu

SEQ ID NO: 1672094 - RNA, 20 nt, Human
uccuuucacaaccuucugug

SEQ ID NO: 1672095 - RNA, 15 nt, Human
uccuuucaccacaug

SEQ ID NO: 1672096 - RNA, 14 nt, Human
ucgaacuggcugca

SEQ ID NO: 1672097 - RNA, 15 nt, Human
ucgaacuggcugcaa

SEQ ID NO: 1672098 - RNA, 23 nt, Human
acucuuauaucuauauuuuacau

SEQ ID NO: 1672099 - RNA, 13 nt, Human
acucugacaacag

SEQ ID NO: 1672100 - RNA, 21 nt, Human
acucuccucugcugcuggcug

SEQ ID NO: 1672101 - RNA, 18 nt, Human
acucuccucugcugcugg

SEQ ID NO: 1672102 - RNA, 19 nt, Human
acucuccucugcugcuggc

SEQ ID NO: 1672103 - RNA, 18 nt, Human
acucgcgacaaugcaaac

SEQ ID NO: 1672104 - RNA, 19 nt, Human
uccuaggcauuugcugaau

SEQ ID NO: 1672105 - RNA, 20 nt, Human
acucgcgacaaugcaaacca

SEQ ID NO: 1672106 - RNA, 23 nt, Human
acucgcgacaaugcaaaccauca

SEQ ID NO: 1672107 - RNA, 22 nt, Human
acucuccauuuaauaauuauau

SEQ ID NO: 1672108 - RNA, 17 nt, Human
acucuccucugcugcug

SEQ ID NO: 1672109 - RNA, 20 nt, Human
uccucagaucuucugugggu

SEQ ID NO: 1672110 - RNA, 16 nt, Human
acucuuauugcccacg

SEQ ID NO: 1672111 - RNA, 19 nt, Human
acucuuauugcccacgcug

SEQ ID NO: 1672112 - RNA, 22 nt, Human
uccuccccuccuccuggacucc

SEQ ID NO: 1672113 - RNA, 18 nt, Human
uccuccccuccuccugga

SEQ ID NO: 1672114 - RNA, 20 nt, Human
uccuccccuccuccuggacu

SEQ ID NO: 1672115 - RNA, 16 nt, Human
uccuccccuccuccug

SEQ ID NO: 1672116 - RNA, 22 nt, Human
uccucauacccacccccaccca

SEQ ID NO: 1672117 - RNA, 14 nt, Human
uccucauacccacc

SEQ ID NO: 1672118 - RNA, 18 nt, Human
uccucauacccaccccca

SEQ ID NO: 1672119 - RNA, 12 nt, Human
uccucuccacug

SEQ ID NO: 1672120 - RNA, 13 nt, Human
uccucuccacugc

SEQ ID NO: 1672121 - RNA, 14 nt, Human
uccucuccacugcc

SEQ ID NO: 1672122 - RNA, 15 nt, Human
uccucuccacugccu

SEQ ID NO: 1672123 - RNA, 16 nt, Human
uccucuccacugccuu

SEQ ID NO: 1672124 - RNA, 12 nt, Human
uccucuccccag

SEQ ID NO: 1672125 - RNA, 17 nt, Human
uccucccucccucuuuc

SEQ ID NO: 1672126 - RNA, 15 nt, Human
uccucccucccucuu

SEQ ID NO: 1672127 - RNA, 19 nt, Human
uccucccucccucuuuccc

SEQ ID NO: 1672128 - RNA, 23 nt, Human
acuccugcacacgcuccuuccuc

SEQ ID NO: 1672129 - RNA, 12 nt, Human
acuccugcaggc

SEQ ID NO: 1672130 - RNA, 22 nt, Human
ucccuuuccaaaugcccagcuu

SEQ ID NO: 1672131 - RNA, 11 nt, Human
ucccuucaacc

SEQ ID NO: 1672132 - RNA, 21 nt, Human
ucccuucaaccauuccccaug

SEQ ID NO: 1672133 - RNA, 22 nt, Human
ucccuucaaccauuccccaugg

SEQ ID NO: 1672134 - RNA, 18 nt, Human
ucccuuacgugaguccug

SEQ ID NO: 1672135 - RNA, 22 nt, Human
ucccuuacgugaguccuggcau

SEQ ID NO: 1672136 - RNA, 20 nt, Human
uccuagcacuuugggaggcc

SEQ ID NO: 1672137 - RNA, 14 nt, Human
uccuaggcauuugc

SEQ ID NO: 1672138 - RNA, 17 nt, Human
uccuagcacacacuuuu

SEQ ID NO: 1672139 - RNA, 18 nt, Human
uccuagcacacacuuuug

SEQ ID NO: 1672140 - RNA, 19 nt, Human
uccuagcacacacuuuugg

SEQ ID NO: 1672141 - RNA, 14 nt, Human
uccgugcuaaggac

SEQ ID NO: 1672142 - RNA, 15 nt, Human
uccgugcuaaggacu

SEQ ID NO: 1672143 - RNA, 16 nt, Human
uccgugcuaaggacuu

SEQ ID NO: 1672144 - RNA, 19 nt, Human
ucccuuuuaauccuggcug

SEQ ID NO: 1672145 - RNA, 18 nt, Human
ucccuuuuaauccuggcu

SEQ ID NO: 1672146 - RNA, 22 nt, Human
ucccuuugacgccaucccagcc

SEQ ID NO: 1672147 - RNA, 23 nt, Human
ucccuuugacgccaucccagccc

SEQ ID NO: 1672148 - RNA, 21 nt, Human
acucaucuagguaaauuacag

SEQ ID NO: 1672149 - RNA, 23 nt, Human
ucccucauuccaccuucccaugc

SEQ ID NO: 1672150 - RNA, 16 nt, Human
acucaucuagguaaau

SEQ ID NO: 1672151 - RNA, 18 nt, Human
acucaucuagguaaauua

SEQ ID NO: 1672152 - RNA, 22 nt, Human
ucccucauccucauacccaccc

SEQ ID NO: 1672153 - RNA, 21 nt, Human
ucccucagucuggcccuuccu

SEQ ID NO: 1672154 - RNA, 14 nt, Human
acuccuaccuggua

SEQ ID NO: 1672155 - RNA, 20 nt, Human
acuccagcuggguuggaaaa

SEQ ID NO: 1672156 - RNA, 20 nt, Human
acucauuuuaaaaaauggaa

SEQ ID NO: 1672157 - RNA, 17 nt, Human
acuccaauuaaggauuu

SEQ ID NO: 1672158 - RNA, 21 nt, Human
acuccaauuaaggauuuuaug

SEQ ID NO: 1672159 - RNA, 16 nt, Human
acuaaccagcagaaau

SEQ ID NO: 1672160 - RNA, 13 nt, Human
acuaaccacgcug

SEQ ID NO: 1672161 - RNA, 23 nt, Human
acuacaggugugagucaccaagc

SEQ ID NO: 1672162 - RNA, 17 nt, Human
acuaaccagcagaaaug

SEQ ID NO: 1672163 - RNA, 15 nt, Human
acuacaguccuccca

SEQ ID NO: 1672164 - RNA, 13 nt, Human
uccagccugggug

SEQ ID NO: 1672165 - RNA, 24 nt, Human
uccagccugggugacagagcaagu

SEQ ID NO: 1672166 - RNA, 15 nt, Human
uccagcucaccagcc

SEQ ID NO: 1672167 - RNA, 14 nt, Human
uccagcucaccagc

SEQ ID NO: 1672168 - RNA, 12 nt, Human
acguuucuaaag

SEQ ID NO: 1672169 - RNA, 14 nt, Human
acguuucuaaaggc

SEQ ID NO: 1672170 - RNA, 15 nt, Human
acguuucuaaaggcu

SEQ ID NO: 1672171 - RNA, 13 nt, Human
acuaaaaauacaa

SEQ ID NO: 1672172 - RNA, 15 nt, Human
uccccaagccuggca

SEQ ID NO: 1672173 - RNA, 15 nt, Human
ucccauaugccuggg

SEQ ID NO: 1672174 - RNA, 16 nt, Human
ucccauaugccugggc

SEQ ID NO: 1672175 - RNA, 13 nt, Human
ucccaucucacac

SEQ ID NO: 1672176 - RNA, 14 nt, Human
ucccaucucacaca

SEQ ID NO: 1672177 - RNA, 19 nt, Human
ucccaucucacacaugagc

SEQ ID NO: 1672178 - RNA, 17 nt, Human
acuacaguccucccauc

SEQ ID NO: 1672179 - RNA, 16 nt, Human
acuacaguccucccau

SEQ ID NO: 1672180 - RNA, 19 nt, Human
ucccagugccgagaaggaa

SEQ ID NO: 1672181 - RNA, 22 nt, Human
ucccagugccgagaaggaagcc

SEQ ID NO: 1672182 - RNA, 24 nt, Human
uccccaccgcagacaggaccaggg

SEQ ID NO: 1672183 - RNA, 23 nt, Human
acuauaauuuaccugaagucuuu

SEQ ID NO: 1672184 - RNA, 17 nt, Human
acuauagccuaggugac

SEQ ID NO: 1672185 - RNA, 18 nt, Human
acuauagccuaggugaca

SEQ ID NO: 1672186 - RNA, 13 nt, Human
acuauauauguga

SEQ ID NO: 1672187 - RNA, 19 nt, Human
acuauguugcccaggcagg

SEQ ID NO: 1672188 - RNA, 20 nt, Human
acuauguugcccaggcaggu

SEQ ID NO: 1672189 - RNA, 23 nt, Human
acuauguugcccaggcaggucuu

SEQ ID NO: 1672190 - RNA, 22 nt, Human
acuaucaugucaaacgugaaaa

SEQ ID NO: 1672191 - RNA, 16 nt, Human
acuaucccggcugccc

SEQ ID NO: 1672192 - RNA, 17 nt, Human
acuaucccggcugcccu

SEQ ID NO: 1672193 - RNA, 18 nt, Human
acuaucccggcugcccuu

SEQ ID NO: 1672194 - RNA, 22 nt, Human
acuaugaaguuuuuuuuauaca

SEQ ID NO: 1672195 - RNA, 18 nt, Human
acuauguugcccaggcag

SEQ ID NO: 1672196 - RNA, 18 nt, Human
ucccuauuagagaagaga

SEQ ID NO: 1672197 - RNA, 21 nt, Human
ucccuauuuuuuuucuguuau

SEQ ID NO: 1672198 - RNA, 22 nt, Human
ucccuauuuuuuuucuguuaua

SEQ ID NO: 1672199 - RNA, 13 nt, Human
ucccgcucagccc

SEQ ID NO: 1672200 - RNA, 14 nt, Human
ucccgcucagcccu

SEQ ID NO: 1672201 - RNA, 15 nt, Human
ucccgcucagcccuc

SEQ ID NO: 1672202 - RNA, 16 nt, Human
ucccgcucagcccucc

SEQ ID NO: 1672203 - RNA, 20 nt, Human
ucccgcucagcccucccugc

SEQ ID NO: 1672204 - RNA, 18 nt, Human
ucccgaauagcugggacu

SEQ ID NO: 1672205 - RNA, 15 nt, Human
ucccgaauagcuggg

SEQ ID NO: 1672206 - RNA, 16 nt, Human
ucccgaauagcuggga

SEQ ID NO: 1672207 - RNA, 12 nt, Human
uccccuccucug

SEQ ID NO: 1672208 - RNA, 15 nt, Human
acagcuccaagaauu

SEQ ID NO: 1672209 - RNA, 20 nt, Human
acagcuaaucagcauucuca

SEQ ID NO: 1672210 - RNA, 22 nt, Human
acagcuaaucagcauucucacu

SEQ ID NO: 1672211 - RNA, 17 nt, Human
acagcuaacauggaagu

SEQ ID NO: 1672212 - RNA, 14 nt, Human
acagccugugucuu

SEQ ID NO: 1672213 - RNA, 18 nt, Human
acagccugugucuuuaaa

SEQ ID NO: 1672214 - RNA, 23 nt, Human
acagccugugucuuuaaaugcug

SEQ ID NO: 1672215 - RNA, 14 nt, Human
acagcuaacaugga

SEQ ID NO: 1672216 - RNA, 15 nt, Human
acagcuaacauggaa

SEQ ID NO: 1672217 - RNA, 14 nt, Human
acagccuggcacag

SEQ ID NO: 1672218 - RNA, 15 nt, Human
acagccuggcacagg

SEQ ID NO: 1672219 - RNA, 16 nt, Human
uauggcuuuugugcau

SEQ ID NO: 1672220 - RNA, 17 nt, Human
uauggcuauaggugcua

SEQ ID NO: 1672221 - RNA, 20 nt, Human
uaugauccagcagauuauuc

SEQ ID NO: 1672222 - RNA, 21 nt, Human
uaugauccagcagauuauuca

SEQ ID NO: 1672223 - RNA, 22 nt, Human
uaugauccagcagauuauucac

SEQ ID NO: 1672224 - RNA, 18 nt, Human
uaugcucugcauguuaca

SEQ ID NO: 1672225 - RNA, 19 nt, Human
uaugcucugcauguuacau

SEQ ID NO: 1672226 - RNA, 15 nt, Human
uaugcugaguuugug

SEQ ID NO: 1672227 - RNA, 22 nt, Human
uauggccugugagcuaggaauu

SEQ ID NO: 1672228 - RNA, 14 nt, Human
uauggccuguggau

SEQ ID NO: 1672229 - RNA, 16 nt, Human
uauggcuauaggugcu

SEQ ID NO: 1672230 - RNA, 18 nt, Human
acagcagccccugcacaa

SEQ ID NO: 1672231 - RNA, 20 nt, Human
acagaguuuucacucuuauu

SEQ ID NO: 1672232 - RNA, 15 nt, Human
acagaguuguuacau

SEQ ID NO: 1672233 - RNA, 18 nt, Human
acagaguuuucacucuua

SEQ ID NO: 1672234 - RNA, 11 nt, Human
uaugauccagc

SEQ ID NO: 1672235 - RNA, 19 nt, Human
uaugauccagcagauuauu

SEQ ID NO: 1672236 - RNA, 10 nt, Human
uaugauccag

SEQ ID NO: 1672237 - RNA, 21 nt, Human
uaugaucacggcucacugcag

SEQ ID NO: 1672238 - RNA, 23 nt, Human
uaugaucacggcucacugcagcc

SEQ ID NO: 1672239 - RNA, 13 nt, Human
uaugaggcauuug

SEQ ID NO: 1672240 - RNA, 15 nt, Human
uaucuugaauaaugu

SEQ ID NO: 1672241 - RNA, 15 nt, Human
uaucuugaagacuuu

SEQ ID NO: 1672242 - RNA, 16 nt, Human
uauauugauccagaaa

SEQ ID NO: 1672243 - RNA, 17 nt, Human
acagacuggaagcacag

SEQ ID NO: 1672244 - RNA, 14 nt, Human
acagacuggaagca

SEQ ID NO: 1672245 - RNA, 18 nt, Human
acagacccugcccugugg

SEQ ID NO: 1672246 - RNA, 20 nt, Human
acagacccugcccugugggc

SEQ ID NO: 1672247 - RNA, 13 nt, Human
acagacagcccuc

SEQ ID NO: 1672248 - RNA, 15 nt, Human
acagacagcccucca

SEQ ID NO: 1672249 - RNA, 17 nt, Human
acagacccugcccugug

SEQ ID NO: 1672250 - RNA, 16 nt, Human
acagacccugcccugu

SEQ ID NO: 1672251 - RNA, 11 nt, Human
acacuccuuca

SEQ ID NO: 1672252 - RNA, 13 nt, Human
acacuccuucaca

SEQ ID NO: 1672253 - RNA, 23 nt, Human
acagacacaggcccggcuccagg

SEQ ID NO: 1672254 - RNA, 20 nt, Human
uaucaccugucuugccuuuu

SEQ ID NO: 1672255 - RNA, 18 nt, Human
uaucacccagaagaaaau

SEQ ID NO: 1672256 - RNA, 14 nt, Human
uauauuuacaaaug

SEQ ID NO: 1672257 - RNA, 19 nt, Human
uauauuuacuaaaauggac

SEQ ID NO: 1672258 - RNA, 21 nt, Human
uaucaaguauuauaccuuuuu

SEQ ID NO: 1672259 - RNA, 15 nt, Human
uauauuuacaaaugg

SEQ ID NO: 1672260 - RNA, 13 nt, Human
acagacuucugaa

SEQ ID NO: 1672261 - RNA, 14 nt, Human
acagacuucugaaa

SEQ ID NO: 1672262 - RNA, 21 nt, Human
acagagugagacucugucuca

SEQ ID NO: 1672263 - RNA, 18 nt, Human
acagagcuacacagggga

SEQ ID NO: 1672264 - RNA, 16 nt, Human
acagagcuacacaggg

SEQ ID NO: 1672265 - RNA, 20 nt, Human
acagagcccacgcccccacu

SEQ ID NO: 1672266 - RNA, 16 nt, Human
uaucuagauacuguau

SEQ ID NO: 1672267 - RNA, 15 nt, Human
uaucuagauacugua

SEQ ID NO: 1672268 - RNA, 10 nt, Human
uaucagaauu

SEQ ID NO: 1672269 - RNA, 18 nt, Human
uaucucccccagccccau

SEQ ID NO: 1672270 - RNA, 17 nt, Human
uaucucccccagcccca

SEQ ID NO: 1672271 - RNA, 19 nt, Human
uaucuagauacuguaucau

SEQ ID NO: 1672272 - RNA, 13 nt, Human
uagugaugguucc

SEQ ID NO: 1672273 - RNA, 20 nt, Human
uaguuccucauuagcauuuu

SEQ ID NO: 1672274 - RNA, 16 nt, Human
uaguuuuauaugcuuc

SEQ ID NO: 1672275 - RNA, 21 nt, Human
uagucaggugccucaagagaa

SEQ ID NO: 1672276 - RNA, 19 nt, Human
acaagcugcacccucaggc

SEQ ID NO: 1672277 - RNA, 21 nt, Human
acaagcugcacccucaggcag

SEQ ID NO: 1672278 - RNA, 22 nt, Human
acaagcugcacccucaggcagg

SEQ ID NO: 1672279 - RNA, 23 nt, Human
acaagcugcacccucaggcaggu

SEQ ID NO: 1672280 - RNA, 22 nt, Human
uagugagcagucaggaaagaga

SEQ ID NO: 1672281 - RNA, 19 nt, Human
acacccugugauggggccc

SEQ ID NO: 1672282 - RNA, 11 nt, Human
acacccuguga

SEQ ID NO: 1672283 - RNA, 12 nt, Human
acacccugugau

SEQ ID NO: 1672284 - RNA, 18 nt, Human
acacccugugauggggcc

SEQ ID NO: 1672285 - RNA, 19 nt, Human
acacccagcccacuucugc

SEQ ID NO: 1672286 - RNA, 20 nt, Human
acacccagcccacuucugcc

SEQ ID NO: 1672287 - RNA, 21 nt, Human
acacccagcccacuucugcca

SEQ ID NO: 1672288 - RNA, 21 nt, Human
acacaugcaaggucauuuuuu

SEQ ID NO: 1672289 - RNA, 12 nt, Human
uauaaaagccug

SEQ ID NO: 1672290 - RNA, 14 nt, Human
uauaaaagccuguu

SEQ ID NO: 1672291 - RNA, 17 nt, Human
uauaaaagccuguuuaa

SEQ ID NO: 1672292 - RNA, 21 nt, Human
uauaaaauaauuuuuauauuu

SEQ ID NO: 1672293 - RNA, 22 nt, Human
uauaaaauaauuuuuauauuug

SEQ ID NO: 1672294 - RNA, 20 nt, Human
acacaugcaaggucauuuuu

SEQ ID NO: 1672295 - RNA, 19 nt, Human
acacaugcaaggucauuuu

SEQ ID NO: 1672296 - RNA, 18 nt, Human
uauaaaagacugucuuaa

SEQ ID NO: 1672297 - RNA, 22 nt, Human
acacaucagcuugcccuguuaa

SEQ ID NO: 1672298 - RNA, 23 nt, Human
uauaaaauaauuuuuauauuuga

SEQ ID NO: 1672299 - RNA, 20 nt, Human
uauaaccaguguuguggauu

SEQ ID NO: 1672300 - RNA, 14 nt, Human
uauaauuuugugaa

SEQ ID NO: 1672301 - RNA, 19 nt, Human
uauagauuagagaguguug

SEQ ID NO: 1672302 - RNA, 22 nt, Human
uauagauuagagaguguugaaa

SEQ ID NO: 1672303 - RNA, 20 nt, Human
uauagauuagaauucuguau

SEQ ID NO: 1672304 - RNA, 14 nt, Human
uauacauuugauaa

SEQ ID NO: 1672305 - RNA, 14 nt, Human
uauacauaaacaag

SEQ ID NO: 1672306 - RNA, 13 nt, Human
uauacauaaacaa

SEQ ID NO: 1672307 - RNA, 21 nt, Human
uauacacuuacacuuuaugca

SEQ ID NO: 1672308 - RNA, 19 nt, Human
uauaauuuugugaagcaaa

SEQ ID NO: 1672309 - RNA, 23 nt, Human
uauaggugcuacaaaaacacagc

SEQ ID NO: 1672310 - RNA, 21 nt, Human
uauaggugcuacaaaaacaca

SEQ ID NO: 1672311 - RNA, 20 nt, Human
uauaggugcuacaaaaacac

SEQ ID NO: 1672312 - RNA, 20 nt, Human
uauagccuaggugacagagu

SEQ ID NO: 1672313 - RNA, 13 nt, Human
uauaggaauugac

SEQ ID NO: 1672314 - RNA, 14 nt, Human
uauaggaauugacc

SEQ ID NO: 1672315 - RNA, 19 nt, Human
uauaggaauugacccacaa

SEQ ID NO: 1672316 - RNA, 13 nt, Human
uauauaucaaaua

SEQ ID NO: 1672317 - RNA, 21 nt, Human
uauauauuuuuuucugaaauu

SEQ ID NO: 1672318 - RNA, 22 nt, Human
uauauauuuuuuucugaaauuu

SEQ ID NO: 1672319 - RNA, 20 nt, Human
uauauauuuuuuucugaaau

SEQ ID NO: 1672320 - RNA, 23 nt, Human
uauauauuuuuuucugaaauuuc

SEQ ID NO: 1672321 - RNA, 21 nt, Human
acacucauugaccugaggccc

SEQ ID NO: 1672322 - RNA, 23 nt, Human
acacucauugaccugaggcccuu

SEQ ID NO: 1672323 - RNA, 15 nt, Human
acacuccaauuaagg

SEQ ID NO: 1672324 - RNA, 16 nt, Human
acacuccaauuaagga

SEQ ID NO: 1672325 - RNA, 17 nt, Human
acacuccaauuaaggau

SEQ ID NO: 1672326 - RNA, 15 nt, Human
uauuggcuuuucuga

SEQ ID NO: 1672327 - RNA, 16 nt, Human
uauuggcuuuucugau

SEQ ID NO: 1672328 - RNA, 17 nt, Human
uauuggcuuuucugauc

SEQ ID NO: 1672329 - RNA, 18 nt, Human
uauuggcuuuucugaucc

SEQ ID NO: 1672330 - RNA, 14 nt, Human
uauuggcuuuucug

SEQ ID NO: 1672331 - RNA, 21 nt, Human
uauuggcuuuucugauccagu

SEQ ID NO: 1672332 - RNA, 22 nt, Human
uauuggcuuuucugauccaguu

SEQ ID NO: 1672333 - RNA, 12 nt, Human
uauugaagcauu

SEQ ID NO: 1672334 - RNA, 13 nt, Human
uauugaagcauuu

SEQ ID NO: 1672335 - RNA, 15 nt, Human
uauugaagcauuuua

SEQ ID NO: 1672336 - RNA, 16 nt, Human
uauugaagcauuuuau

SEQ ID NO: 1672337 - RNA, 17 nt, Human
uauugaagcauuuuaua

SEQ ID NO: 1672338 - RNA, 19 nt, Human
uauugaagcauuuuauaaa

SEQ ID NO: 1672339 - RNA, 17 nt, Human
acaguucucuccuucuu

SEQ ID NO: 1672340 - RNA, 24 nt, Human
uauucucuccuguaccucuugagc

SEQ ID NO: 1672341 - RNA, 20 nt, Human
uauucucuccuguaccucuu

SEQ ID NO: 1672342 - RNA, 15 nt, Human
uauucuuauuuaaug

SEQ ID NO: 1672343 - RNA, 16 nt, Human
uauucuguuggccagu

SEQ ID NO: 1672344 - RNA, 20 nt, Human
acaguucaauucucauuugu

SEQ ID NO: 1672345 - RNA, 20 nt, Human
acaguuacucagaauucucu

SEQ ID NO: 1672346 - RNA, 13 nt, Human
acaguuacucaga

SEQ ID NO: 1672347 - RNA, 22 nt, Human
acaguucggugagcuacaaaug

SEQ ID NO: 1672348 - RNA, 19 nt, Human
acaguucggugagcuacaa

SEQ ID NO: 1672349 - RNA, 16 nt, Human
acaguucucuccuucu

SEQ ID NO: 1672350 - RNA, 23 nt, Human
acaguucggugagcuacaaaugc

SEQ ID NO: 1672351 - RNA, 15 nt, Human
uauuguacaaaguau

SEQ ID NO: 1672352 - RNA, 16 nt, Human
uauuguacaaaguauu

SEQ ID NO: 1672353 - RNA, 21 nt, Human
uauuguacaaaguauuaagca

SEQ ID NO: 1672354 - RNA, 22 nt, Human
uauuguacaaaguauuaagcau

SEQ ID NO: 1672355 - RNA, 23 nt, Human
uauuguacaaaguauuaagcaua

SEQ ID NO: 1672356 - RNA, 17 nt, Human
uauuguagcauccugga

SEQ ID NO: 1672357 - RNA, 18 nt, Human
uauuguagcauccuggaa

SEQ ID NO: 1672358 - RNA, 20 nt, Human
uauuguagcauccuggaaua

SEQ ID NO: 1672359 - RNA, 21 nt, Human
uauuguagcauccuggaauau

SEQ ID NO: 1672360 - RNA, 13 nt, Human
uauugucaaagug

SEQ ID NO: 1672361 - RNA, 17 nt, Human
uauugucaaagugguga

SEQ ID NO: 1672362 - RNA, 14 nt, Human
uauuuaauagguuu

SEQ ID NO: 1672363 - RNA, 15 nt, Human
uauuuaaugaaagac

SEQ ID NO: 1672364 - RNA, 21 nt, Human
uauuuaaugaaagacuguaca

SEQ ID NO: 1672365 - RNA, 17 nt, Human
uauuuaaccucuaaauu

SEQ ID NO: 1672366 - RNA, 18 nt, Human
uauuuaaccucuaaauuc

SEQ ID NO: 1672367 - RNA, 17 nt, Human
uauugucuagugaaacu

SEQ ID NO: 1672368 - RNA, 19 nt, Human
uauuuaguguucauaaaua

SEQ ID NO: 1672369 - RNA, 13 nt, Human
uauuuauuuaaau

SEQ ID NO: 1672370 - RNA, 14 nt, Human
uauuuauuuaguau

SEQ ID NO: 1672371 - RNA, 14 nt, Human
uauuuauuuaaauu

SEQ ID NO: 1672372 - RNA, 14 nt, Human
uauuuauuuuaaua

SEQ ID NO: 1672373 - RNA, 16 nt, Human
uauuuauuuuaauaau

SEQ ID NO: 1672374 - RNA, 18 nt, Human
uauuuauuuuaauaaugu

SEQ ID NO: 1672375 - RNA, 18 nt, Human
uauuuacuaaaauggacu

SEQ ID NO: 1672376 - RNA, 20 nt, Human
uauuuagcaccagggaaggg

SEQ ID NO: 1672377 - RNA, 18 nt, Human
uauuuacuucuuauacau

SEQ ID NO: 1672378 - RNA, 14 nt, Human
uauuuaauucaugu

SEQ ID NO: 1672379 - RNA, 23 nt, Human
uauuuaauuuuuuugagacagag

SEQ ID NO: 1672380 - RNA, 15 nt, Human
acaguuaagagaaau

SEQ ID NO: 1672381 - RNA, 21 nt, Human
acaguuaccucugccucagaa

SEQ ID NO: 1672382 - RNA, 14 nt, Human
acagugagacucug

SEQ ID NO: 1672383 - RNA, 18 nt, Human
acagugagacucugucuc

SEQ ID NO: 1672384 - RNA, 20 nt, Human
acagugaaagaaaauaacaa

SEQ ID NO: 1672385 - RNA, 17 nt, Human
acagucucaggaaauca

SEQ ID NO: 1672386 - RNA, 21 nt, Human
acaguccuuaccagcagagca

SEQ ID NO: 1672387 - RNA, 22 nt, Human
acaguccuuaccagcagagcac

SEQ ID NO: 1672388 - RNA, 13 nt, Human
acagucucaggaa

SEQ ID NO: 1672389 - RNA, 14 nt, Human
acagucucaggaaa

SEQ ID NO: 1672390 - RNA, 15 nt, Human
acagucucaggaaau

SEQ ID NO: 1672391 - RNA, 16 nt, Human
acagucucaggaaauc

SEQ ID NO: 1672392 - RNA, 17 nt, Human
acaguccucccaucuca

SEQ ID NO: 1672393 - RNA, 18 nt, Human
acaguccuuaccagcaga

SEQ ID NO: 1672394 - RNA, 20 nt, Human
acaguccuuaccagcagagc

SEQ ID NO: 1672395 - RNA, 15 nt, Human
acagucccugccaau

SEQ ID NO: 1672396 - RNA, 13 nt, Human
acaguccucccau

SEQ ID NO: 1672397 - RNA, 14 nt, Human
acaguccucccauc

SEQ ID NO: 1672398 - RNA, 15 nt, Human
acaguccucccaucu

SEQ ID NO: 1672399 - RNA, 13 nt, Human
acagucccugcca

SEQ ID NO: 1672400 - RNA, 15 nt, Human
acaguauuacuucug

SEQ ID NO: 1672401 - RNA, 16 nt, Human
acaguauuacuucugc

SEQ ID NO: 1672402 - RNA, 17 nt, Human
acaguauuacuucugcu

SEQ ID NO: 1672403 - RNA, 19 nt, Human
acaguauuacuucugcuac

SEQ ID NO: 1672404 - RNA, 21 nt, Human
acaggcugggcuucaguggca

SEQ ID NO: 1672405 - RNA, 14 nt, Human
acaggcugggcuuc

SEQ ID NO: 1672406 - RNA, 17 nt, Human
acaggcugggcuucagu

SEQ ID NO: 1672407 - RNA, 22 nt, Human
acagguuuuccugaagaauuga

SEQ ID NO: 1672408 - RNA, 22 nt, Human
acagggcacaccgggcacucag

SEQ ID NO: 1672409 - RNA, 21 nt, Human
acaguauaauuaacauguuaa

SEQ ID NO: 1672410 - RNA, 23 nt, Human
acaguauaauuaacauguuaaac

SEQ ID NO: 1672411 - RNA, 21 nt, Human
acaguauggcagcuuuccuca

SEQ ID NO: 1672412 - RNA, 17 nt, Human
acagcuggugcccugcu

SEQ ID NO: 1672413 - RNA, 20 nt, Human
acagcuggugcccugcuuuc

SEQ ID NO: 1672414 - RNA, 22 nt, Human
uauuaaaaaucucaaauuucua

SEQ ID NO: 1672415 - RNA, 20 nt, Human
uauuaaaaaucucaaauuuc

SEQ ID NO: 1672416 - RNA, 18 nt, Human
uauuaaaaaucucaaauu

SEQ ID NO: 1672417 - RNA, 16 nt, Human
uauuaaaaaucucaaa

SEQ ID NO: 1672418 - RNA, 17 nt, Human
uauguuuuaagaggcag

SEQ ID NO: 1672419 - RNA, 19 nt, Human
uauguuuuaagaggcaggg

SEQ ID NO: 1672420 - RNA, 21 nt, Human
uauguuuucaggcuagaugua

SEQ ID NO: 1672421 - RNA, 17 nt, Human
uauuaaagccauguuua

SEQ ID NO: 1672422 - RNA, 18 nt, Human
uauuaaagccauguuuau

SEQ ID NO: 1672423 - RNA, 20 nt, Human
uauuaaagccauguuuauua

SEQ ID NO: 1672424 - RNA, 16 nt, Human
uauuacaguauaauua

SEQ ID NO: 1672425 - RNA, 18 nt, Human
uauuacaguauaauuaac

SEQ ID NO: 1672426 - RNA, 20 nt, Human
uauuacaguauaauuaacau

SEQ ID NO: 1672427 - RNA, 21 nt, Human
uauuacaguauaauuaacaug

SEQ ID NO: 1672428 - RNA, 23 nt, Human
uauuacaguggggaaugaagaua

SEQ ID NO: 1672429 - RNA, 13 nt, Human
uauuaaagccaug

SEQ ID NO: 1672430 - RNA, 14 nt, Human
uauuaaagccaugu

SEQ ID NO: 1672431 - RNA, 12 nt, Human
uauuaaagccau

SEQ ID NO: 1672432 - RNA, 23 nt, Human
uauuaaaaaucucaaauuucuaa

SEQ ID NO: 1672433 - RNA, 12 nt, Human
uauuaaaacuca

SEQ ID NO: 1672434 - RNA, 16 nt, Human
uauuaccacagacaua

SEQ ID NO: 1672435 - RNA, 15 nt, Human
uauuagaauaccaca

SEQ ID NO: 1672436 - RNA, 12 nt, Human
uauuagagaaga

SEQ ID NO: 1672437 - RNA, 18 nt, Human
uauucaaaguugccuaaa

SEQ ID NO: 1672438 - RNA, 21 nt, Human
uauucaaaguugccuaaaucc

SEQ ID NO: 1672439 - RNA, 22 nt, Human
uauucaaaguugccuaaaucca

SEQ ID NO: 1672440 - RNA, 23 nt, Human
uauucaaaguugccuaaauccau

SEQ ID NO: 1672441 - RNA, 13 nt, Human
uauucacugauuu

SEQ ID NO: 1672442 - RNA, 19 nt, Human
uauucacugauuugacaua

SEQ ID NO: 1672443 - RNA, 22 nt, Human
uauucacugauuugacauaguc

SEQ ID NO: 1672444 - RNA, 15 nt, Human
uauucagcucaugga

SEQ ID NO: 1672445 - RNA, 23 nt, Human
uauucauagcagcuuauucacaa

SEQ ID NO: 1672446 - RNA, 18 nt, Human
uauucaggaagcucaggg

SEQ ID NO: 1672447 - RNA, 22 nt, Human
uauucaggaagcucagggccug

SEQ ID NO: 1672448 - RNA, 13 nt, Human
aauuuaaaagucu

SEQ ID NO: 1672449 - RNA, 15 nt, Human
aauuuaaauagcuuu

SEQ ID NO: 1672450 - RNA, 16 nt, Human
aauuuaaauagcuuuu

SEQ ID NO: 1672451 - RNA, 19 nt, Human
aauuuacauacucugcuua

SEQ ID NO: 1672452 - RNA, 20 nt, Human
aauuguguuuauaauuuuaa

SEQ ID NO: 1672453 - RNA, 22 nt, Human
aauuguuuggggaugagaaagg

SEQ ID NO: 1672454 - RNA, 23 nt, Human
aauugugugaaagguacuucaaa

SEQ ID NO: 1672455 - RNA, 12 nt, Human
aauugcuccuug

SEQ ID NO: 1672456 - RNA, 13 nt, Human
uacuguaagaaaa

SEQ ID NO: 1672457 - RNA, 20 nt, Human
aauuugaaacacuuugcaua

SEQ ID NO: 1672458 - RNA, 13 nt, Human
aauuugaauuuug

SEQ ID NO: 1672459 - RNA, 16 nt, Human
aauuugaauuuugugu

SEQ ID NO: 1672460 - RNA, 18 nt, Human
aauuugaauuuuguguua

SEQ ID NO: 1672461 - RNA, 15 nt, Human
aauuugauaugugaa

SEQ ID NO: 1672462 - RNA, 16 nt, Human
aauuugauaugugaac

SEQ ID NO: 1672463 - RNA, 18 nt, Human
aauuugauaugugaacag

SEQ ID NO: 1672464 - RNA, 19 nt, Human
aauuugauaugugaacagu

SEQ ID NO: 1672465 - RNA, 14 nt, Human
uacuucaaauccuu

SEQ ID NO: 1672466 - RNA, 19 nt, Human
uacuucaaauccuugaaga

SEQ ID NO: 1672467 - RNA, 17 nt, Human
aauuuagaaauauaauu

SEQ ID NO: 1672468 - RNA, 15 nt, Human
aauuuaccugaaguc

SEQ ID NO: 1672469 - RNA, 21 nt, Human
aauuucuaaaucuccaaaaua

SEQ ID NO: 1672470 - RNA, 13 nt, Human
aauuucuaaaucu

SEQ ID NO: 1672471 - RNA, 20 nt, Human
aauuucucccagucauuuaa

SEQ ID NO: 1672472 - RNA, 12 nt, Human
uacucaauuuua

SEQ ID NO: 1672473 - RNA, 13 nt, Human
uacucaauuuuaa

SEQ ID NO: 1672474 - RNA, 14 nt, Human
uacucaauuuuaac

SEQ ID NO: 1672475 - RNA, 18 nt, Human
uacucuuauagacaacau

SEQ ID NO: 1672476 - RNA, 20 nt, Human
uacucuuauaucuauauuuu

SEQ ID NO: 1672477 - RNA, 22 nt, Human
uacucuucaguuaagccuuugg

SEQ ID NO: 1672478 - RNA, 22 nt, Human
uacucuuauaucuauauuuuac

SEQ ID NO: 1672479 - RNA, 16 nt, Human
uacuauaauuuaccug

SEQ ID NO: 1672480 - RNA, 16 nt, Human
uacuauguaucaauga

SEQ ID NO: 1672481 - RNA, 14 nt, Human
uacguugugcauuu

SEQ ID NO: 1672482 - RNA, 13 nt, Human
uacguugugcauu

SEQ ID NO: 1672483 - RNA, 14 nt, Human
uacguuaccaggca

SEQ ID NO: 1672484 - RNA, 14 nt, Human
uacgucugacaggc

SEQ ID NO: 1672485 - RNA, 14 nt, Human
aauucuuucauuuu

SEQ ID NO: 1672486 - RNA, 15 nt, Human
uacguacacauuuua

SEQ ID NO: 1672487 - RNA, 16 nt, Human
aauugacccacaagaa

SEQ ID NO: 1672488 - RNA, 19 nt, Human
aauugacccacaagaaaug

SEQ ID NO: 1672489 - RNA, 20 nt, Human
aauucuugcaaaguaucccu

SEQ ID NO: 1672490 - RNA, 14 nt, Human
aauucuugcaaagu

SEQ ID NO: 1672491 - RNA, 21 nt, Human
aauucuugccaaauauaaaua

SEQ ID NO: 1672492 - RNA, 22 nt, Human
aauucuucuccacuuucuagcc

SEQ ID NO: 1672493 - RNA, 19 nt, Human
uagcauuuguguugaagag

SEQ ID NO: 1672494 - RNA, 15 nt, Human
acaacaaccugguca

SEQ ID NO: 1672495 - RNA, 18 nt, Human
acaaauucugucucugga

SEQ ID NO: 1672496 - RNA, 15 nt, Human
acaacaacaaaauga

SEQ ID NO: 1672497 - RNA, 12 nt, Human
acaacacucaca

SEQ ID NO: 1672498 - RNA, 12 nt, Human
acaagccacccc

SEQ ID NO: 1672499 - RNA, 13 nt, Human
acaagcugcaccc

SEQ ID NO: 1672500 - RNA, 20 nt, Human
acaagcgugagccacugcac

SEQ ID NO: 1672501 - RNA, 21 nt, Human
acaagcgugagccacugcacc

SEQ ID NO: 1672502 - RNA, 17 nt, Human
acaagagcccaggccuc

SEQ ID NO: 1672503 - RNA, 18 nt, Human
acaagagcccaggccucc

SEQ ID NO: 1672504 - RNA, 18 nt, Human
acaagcacuaaacaaaga

SEQ ID NO: 1672505 - RNA, 22 nt, Human
uagauuuuagacccuauugcug

SEQ ID NO: 1672506 - RNA, 16 nt, Human
uagcacagacccugcc

SEQ ID NO: 1672507 - RNA, 17 nt, Human
uagcacagacccugccc

SEQ ID NO: 1672508 - RNA, 18 nt, Human
uagcacagacccugcccu

SEQ ID NO: 1672509 - RNA, 19 nt, Human
uagcacagacccugcccug

SEQ ID NO: 1672510 - RNA, 13 nt, Human
uagcaccagggaa

SEQ ID NO: 1672511 - RNA, 14 nt, Human
uagcaccagggaag

SEQ ID NO: 1672512 - RNA, 16 nt, Human
uagcaccagggaaggg

SEQ ID NO: 1672513 - RNA, 21 nt, Human
uagcaugucgucaaagcugaa

SEQ ID NO: 1672514 - RNA, 15 nt, Human
uagagcuucuggcac

SEQ ID NO: 1672515 - RNA, 16 nt, Human
acaaaaagcauaaaaa

SEQ ID NO: 1672516 - RNA, 17 nt, Human
uagaugcaguucugaag

SEQ ID NO: 1672517 - RNA, 19 nt, Human
uagaugcaguucugaagaa

SEQ ID NO: 1672518 - RNA, 16 nt, Human
uagaugcaguucugaa

SEQ ID NO: 1672519 - RNA, 21 nt, Human
uagaggaagccugauuaaaga

SEQ ID NO: 1672520 - RNA, 19 nt, Human
uagaggagaaacuggaacu

SEQ ID NO: 1672521 - RNA, 23 nt, Human
uagaagucacauuccugaacagg

SEQ ID NO: 1672522 - RNA, 16 nt, Human
uagaagucacacagua

SEQ ID NO: 1672523 - RNA, 16 nt, Human
uagaagucuuagaugu

SEQ ID NO: 1672524 - RNA, 17 nt, Human
uagaagucuuagaugua

SEQ ID NO: 1672525 - RNA, 20 nt, Human
uagaagucuuagauguauau

SEQ ID NO: 1672526 - RNA, 18 nt, Human
uagaagucuuagauguau

SEQ ID NO: 1672527 - RNA, 19 nt, Human
uagaagucuuagauguaua

SEQ ID NO: 1672528 - RNA, 16 nt, Human
uagacaauuuauuaug

SEQ ID NO: 1672529 - RNA, 15 nt, Human
uagaagucacacagu

SEQ ID NO: 1672530 - RNA, 21 nt, Human
uacuucaaauccuugaagauu

SEQ ID NO: 1672531 - RNA, 16 nt, Human
uacuucaugcugucua

SEQ ID NO: 1672532 - RNA, 14 nt, Human
uagaaccucuuugu

SEQ ID NO: 1672533 - RNA, 15 nt, Human
uagaacucccuuuca

SEQ ID NO: 1672534 - RNA, 12 nt, Human
uagacagucccu

SEQ ID NO: 1672535 - RNA, 14 nt, Human
uagacagucccugc

SEQ ID NO: 1672536 - RNA, 17 nt, Human
aauuuuuauuaaauuau

SEQ ID NO: 1672537 - RNA, 18 nt, Human
aauuuuuauuaaauuaug

SEQ ID NO: 1672538 - RNA, 19 nt, Human
aauuuuuauauuugaaaua

SEQ ID NO: 1672539 - RNA, 14 nt, Human
aauuuuuguauuuu

SEQ ID NO: 1672540 - RNA, 19 nt, Human
aauuuuuucucuaggaaau

SEQ ID NO: 1672541 - RNA, 13 nt, Human
acaaaaacauggc

SEQ ID NO: 1672542 - RNA, 17 nt, Human
aauuuuuuugagacaga

SEQ ID NO: 1672543 - RNA, 21 nt, Human
uaauuauaugcuauuucuaua

SEQ ID NO: 1672544 - RNA, 13 nt, Human
uaauuauaucuga

SEQ ID NO: 1672545 - RNA, 17 nt, Human
uaauuauaucugaggaa

SEQ ID NO: 1672546 - RNA, 20 nt, Human
uaauuauacccccugcaaag

SEQ ID NO: 1672547 - RNA, 23 nt, Human
uaauuaguuccucauuagcauuu

SEQ ID NO: 1672548 - RNA, 19 nt, Human
aaugcacuuuguucuggcu

SEQ ID NO: 1672549 - RNA, 20 nt, Human
aaugcacuuuguucuggcuc

SEQ ID NO: 1672550 - RNA, 19 nt, Human
aaugcacaaacagaggccg

SEQ ID NO: 1672551 - RNA, 20 nt, Human
aaugcacaaacagaggccgc

SEQ ID NO: 1672552 - RNA, 13 nt, Human
aaugcacuuuguu

SEQ ID NO: 1672553 - RNA, 16 nt, Human
aaugcacuuuguucug

SEQ ID NO: 1672554 - RNA, 22 nt, Human
aaugcaaaccaucauugaaauc

SEQ ID NO: 1672555 - RNA, 23 nt, Human
aaugcaaaccaucauugaaaucu

SEQ ID NO: 1672556 - RNA, 18 nt, Human
aaugcacaaacagaggcc

SEQ ID NO: 1672557 - RNA, 20 nt, Human
aaugaaugucagugugacug

SEQ ID NO: 1672558 - RNA, 21 nt, Human
aaugaaugucagugugacuga

SEQ ID NO: 1672559 - RNA, 13 nt, Human
aaugaccuuucaa

SEQ ID NO: 1672560 - RNA, 14 nt, Human
aaugaccuuucaau

SEQ ID NO: 1672561 - RNA, 15 nt, Human
aaugaccuuucaaua

SEQ ID NO: 1672562 - RNA, 16 nt, Human
aaugcaaaccaucauu

SEQ ID NO: 1672563 - RNA, 13 nt, Human
uaauucauguugc

SEQ ID NO: 1672564 - RNA, 17 nt, Human
uaauuuaccugaagucu

SEQ ID NO: 1672565 - RNA, 18 nt, Human
uaauuuaccugaagucuu

SEQ ID NO: 1672566 - RNA, 21 nt, Human
uaauuuuuguauuuuuaguag

SEQ ID NO: 1672567 - RNA, 20 nt, Human
uacaauaaaaucuugaaaau

SEQ ID NO: 1672568 - RNA, 21 nt, Human
uacaagcgugagccacugcac

SEQ ID NO: 1672569 - RNA, 16 nt, Human
uacaagcgugagccac

SEQ ID NO: 1672570 - RNA, 18 nt, Human
uacaagcgugagccacug

SEQ ID NO: 1672571 - RNA, 19 nt, Human
uacaagcgugagccacugc

SEQ ID NO: 1672572 - RNA, 20 nt, Human
uacaagcgugagccacugca

SEQ ID NO: 1672573 - RNA, 15 nt, Human
uacaaaaagcauaaa

SEQ ID NO: 1672574 - RNA, 16 nt, Human
uacaaaaacauggccu

SEQ ID NO: 1672575 - RNA, 17 nt, Human
uacaaaaacacagcaag

SEQ ID NO: 1672576 - RNA, 18 nt, Human
uacaaaaacacagcaagg

SEQ ID NO: 1672577 - RNA, 13 nt, Human
uaauaccucccuu

SEQ ID NO: 1672578 - RNA, 18 nt, Human
uaauacuugcuuuggaaa

SEQ ID NO: 1672579 - RNA, 23 nt, Human
uaauacaccacuacauucuguua

SEQ ID NO: 1672580 - RNA, 22 nt, Human
uaauacaccacuacauucuguu

SEQ ID NO: 1672581 - RNA, 20 nt, Human
aauacaguaucucagggccu

SEQ ID NO: 1672582 - RNA, 19 nt, Human
uaacaaugcuguauuuuaa

SEQ ID NO: 1672583 - RNA, 21 nt, Human
uaauauugauaugcuuauaca

SEQ ID NO: 1672584 - RNA, 22 nt, Human
uaauccaagcaaaugugaauca

SEQ ID NO: 1672585 - RNA, 17 nt, Human
uaaucuuuaauuuuaca

SEQ ID NO: 1672586 - RNA, 13 nt, Human
uaaucuuucacag

SEQ ID NO: 1672587 - RNA, 13 nt, Human
aaucuugaaaaug

SEQ ID NO: 1672588 - RNA, 23 nt, Human
aaucuucugaacuuggcgcugcc

SEQ ID NO: 1672589 - RNA, 15 nt, Human
aaugaaugucagugu

SEQ ID NO: 1672590 - RNA, 14 nt, Human
aaugaaugucagug

SEQ ID NO: 1672591 - RNA, 14 nt, Human
aaugaaugaaacau

SEQ ID NO: 1672592 - RNA, 15 nt, Human
aaugaaugaaugaau

SEQ ID NO: 1672593 - RNA, 15 nt, Human
uaauguaagacaaau

SEQ ID NO: 1672594 - RNA, 16 nt, Human
uaauguaagcucuacu

SEQ ID NO: 1672595 - RNA, 17 nt, Human
uaauguaagcucuacug

SEQ ID NO: 1672596 - RNA, 23 nt, Human
uaaugugaaacuggauuaaacuu

SEQ ID NO: 1672597 - RNA, 22 nt, Human
uaaugugaaacuggauuaaacu

SEQ ID NO: 1672598 - RNA, 20 nt, Human
uaaugugaaacuggauuaaa

SEQ ID NO: 1672599 - RNA, 12 nt, Human
uaaugugaaacu

SEQ ID NO: 1672600 - RNA, 16 nt, Human
uaaugucacaggcagg

SEQ ID NO: 1672601 - RNA, 17 nt, Human
uaaugucacaggcaggu

SEQ ID NO: 1672602 - RNA, 15 nt, Human
uaaugucacaggcag

SEQ ID NO: 1672603 - RNA, 23 nt, Human
aauguacagcaaggagauuuaca

SEQ ID NO: 1672604 - RNA, 21 nt, Human
aauguacagcaaggagauuua

SEQ ID NO: 1672605 - RNA, 22 nt, Human
uacagcaaggagauuuacaacu

SEQ ID NO: 1672606 - RNA, 13 nt, Human
aauguaagacaaa

SEQ ID NO: 1672607 - RNA, 13 nt, Human
aauguaagcucua

SEQ ID NO: 1672608 - RNA, 15 nt, Human
aauguaagcucuacu

SEQ ID NO: 1672609 - RNA, 17 nt, Human
aaugguuuucuugugug

SEQ ID NO: 1672610 - RNA, 18 nt, Human
aaugguuuucuugugugu

SEQ ID NO: 1672611 - RNA, 22 nt, Human
aaugguuuucuuguguguuuau

SEQ ID NO: 1672612 - RNA, 16 nt, Human
aaugguuuaaaugguc

SEQ ID NO: 1672613 - RNA, 22 nt, Human
aaugugaaacuggauuaaacuu

SEQ ID NO: 1672614 - RNA, 14 nt, Human
aaugucacaggcag

SEQ ID NO: 1672615 - RNA, 13 nt, Human
aaugucacaggca

SEQ ID NO: 1672616 - RNA, 18 nt, Human
uacaguaucucagggccu

SEQ ID NO: 1672617 - RNA, 12 nt, Human
uacaguccuccc

SEQ ID NO: 1672618 - RNA, 15 nt, Human
uacaguccucccauc

SEQ ID NO: 1672619 - RNA, 17 nt, Human
uacaguccucccaucuc

SEQ ID NO: 1672620 - RNA, 18 nt, Human
uacaguccucccaucuca

SEQ ID NO: 1672621 - RNA, 15 nt, Human
uacauaaugcgugca

SEQ ID NO: 1672622 - RNA, 20 nt, Human
uacaguggggaaugaagaua

SEQ ID NO: 1672623 - RNA, 20 nt, Human
uacccgggaagggggcuggg

SEQ ID NO: 1672624 - RNA, 16 nt, Human
uacccucauguucuua

SEQ ID NO: 1672625 - RNA, 20 nt, Human
uacccuggcacuauaaugua

SEQ ID NO: 1672626 - RNA, 22 nt, Human
uacccuggcacuauaauguaag

SEQ ID NO: 1672627 - RNA, 17 nt, Human
uaccacuuuuguucuug

SEQ ID NO: 1672628 - RNA, 17 nt, Human
uaccauccccuguagag

SEQ ID NO: 1672629 - RNA, 13 nt, Human
aauuaacauguua

SEQ ID NO: 1672630 - RNA, 14 nt, Human
aauuaacauguuaa

SEQ ID NO: 1672631 - RNA, 19 nt, Human
aauuaacaugaauauuuag

SEQ ID NO: 1672632 - RNA, 20 nt, Human
aauuaagaaaggauaaaguu

SEQ ID NO: 1672633 - RNA, 22 nt, Human
aauuaacuuuuauaaacuuuac

SEQ ID NO: 1672634 - RNA, 20 nt, Human
aauuaacuuuuauaaacuuu

SEQ ID NO: 1672635 - RNA, 18 nt, Human
aauuaacuuuuauaaacu

SEQ ID NO: 1672636 - RNA, 15 nt, Human
aaugucacaggcagg

SEQ ID NO: 1672637 - RNA, 18 nt, Human
aauguugacaugggacau

SEQ ID NO: 1672638 - RNA, 17 nt, Human
uacauguacugauuacu

SEQ ID NO: 1672639 - RNA, 23 nt, Human
uacauggcuggagcuagaauuug

SEQ ID NO: 1672640 - RNA, 18 nt, Human
aauuaacauguuaaacca

SEQ ID NO: 1672641 - RNA, 16 nt, Human
aauuaaggauuuuaug

SEQ ID NO: 1672642 - RNA, 20 nt, Human
aauuaaggauuuuaugcuuu

SEQ ID NO: 1672643 - RNA, 22 nt, Human
aauuaaggauuuuaugcuuuaa

SEQ ID NO: 1672644 - RNA, 13 nt, Human
aauuaaguacuau

SEQ ID NO: 1672645 - RNA, 19 nt, Human
uacauuagcaguuugcuuu

SEQ ID NO: 1672646 - RNA, 20 nt, Human
uacauuagcaguuugcuuug

SEQ ID NO: 1672647 - RNA, 15 nt, Human
aaggcuaccuuugua

SEQ ID NO: 1672648 - RNA, 14 nt, Human
guugcccaggcugg

SEQ ID NO: 1672649 - RNA, 13 nt, Human
aaggcuaccuuug

SEQ ID NO: 1672650 - RNA, 19 nt, Human
aaggccccgcccaggcuua

SEQ ID NO: 1672651 - RNA, 14 nt, Human
aaggccccgcccag

SEQ ID NO: 1672652 - RNA, 16 nt, Human
aaggccccgcccaggc

SEQ ID NO: 1672653 - RNA, 24 nt, Human
aaggaugcacagaguuguuacauu

SEQ ID NO: 1672654 - RNA, 14 nt, Human
aaggaugcccaaag

SEQ ID NO: 1672655 - RNA, 19 nt, Human
aaggaugcccaaagaugca

SEQ ID NO: 1672656 - RNA, 12 nt, Human
guugcugccuca

SEQ ID NO: 1672657 - RNA, 15 nt, Human
guugcccaggcuggc

SEQ ID NO: 1672658 - RNA, 16 nt, Human
guugcccaggcuggcg

SEQ ID NO: 1672659 - RNA, 17 nt, Human
guugcccaggcuggcgu

SEQ ID NO: 1672660 - RNA, 17 nt, Human
guugggcuggugucacc

SEQ ID NO: 1672661 - RNA, 20 nt, Human
aaggaggaagagaaaaaaua

SEQ ID NO: 1672662 - RNA, 21 nt, Human
aaggauaaaguugguaaaccu

SEQ ID NO: 1672663 - RNA, 23 nt, Human
aaggauaaaguugguaaaccuuu

SEQ ID NO: 1672664 - RNA, 13 nt, Human
aaggauaaugaau

SEQ ID NO: 1672665 - RNA, 11 nt, Human
aaggauccuga

SEQ ID NO: 1672666 - RNA, 12 nt, Human
aaggauccugag

SEQ ID NO: 1672667 - RNA, 13 nt, Human
aaggauccugagc

SEQ ID NO: 1672668 - RNA, 22 nt, Human
aaggauccugagccagauuuca

SEQ ID NO: 1672669 - RNA, 22 nt, Human
aaggagcaagucagaauagaaa

SEQ ID NO: 1672670 - RNA, 18 nt, Human
aaggagauuuacaacugg

SEQ ID NO: 1672671 - RNA, 16 nt, Human
aaggaagguucuggug

SEQ ID NO: 1672672 - RNA, 16 nt, Human
aaggaaacccagcucu

SEQ ID NO: 1672673 - RNA, 15 nt, Human
aaggaaacccagcuc

SEQ ID NO: 1672674 - RNA, 16 nt, Human
guucucugaggacacu

SEQ ID NO: 1672675 - RNA, 11 nt, Human
guucucugccc

SEQ ID NO: 1672676 - RNA, 13 nt, Human
guucucugcccuc

SEQ ID NO: 1672677 - RNA, 12 nt, Human
guucucugcccu

SEQ ID NO: 1672678 - RNA, 18 nt, Human
guuccccuguucacucua

SEQ ID NO: 1672679 - RNA, 13 nt, Human
guugaauuuuaca

SEQ ID NO: 1672680 - RNA, 23 nt, Human
guugauagcacagacccugcccu

SEQ ID NO: 1672681 - RNA, 17 nt, Human
aagcucugcuccucucc

SEQ ID NO: 1672682 - RNA, 13 nt, Human
aagcucugcuccu

SEQ ID NO: 1672683 - RNA, 18 nt, Human
aagcuguuacugucuuca

SEQ ID NO: 1672684 - RNA, 16 nt, Human
aagcuuuuaugugaaa

SEQ ID NO: 1672685 - RNA, 15 nt, Human
guuccccuguucacu

SEQ ID NO: 1672686 - RNA, 17 nt, Human
guuccccuguucacucu

SEQ ID NO: 1672687 - RNA, 19 nt, Human
aaggaaaaaauaacaauga

SEQ ID NO: 1672688 - RNA, 16 nt, Human
aaggaaaaaauaacaa

SEQ ID NO: 1672689 - RNA, 23 nt, Human
aagcucccaggcauuccccagga

SEQ ID NO: 1672690 - RNA, 12 nt, Human
aagcucccaggc

SEQ ID NO: 1672691 - RNA, 22 nt, Human
aagcucccaggcauuccccagg

SEQ ID NO: 1672692 - RNA, 22 nt, Human
guguuuaagacauuuuuggaag

SEQ ID NO: 1672693 - RNA, 11 nt, Human
aagcucccagg

SEQ ID NO: 1672694 - RNA, 13 nt, Human
guguuuauuguca

SEQ ID NO: 1672695 - RNA, 18 nt, Human
guuuuucuaggccugggg

SEQ ID NO: 1672696 - RNA, 18 nt, Human
aagucuuagauguauaua

SEQ ID NO: 1672697 - RNA, 19 nt, Human
aagucuuagauguauauau

SEQ ID NO: 1672698 - RNA, 22 nt, Human
aagucuuauauauuguagauaa

SEQ ID NO: 1672699 - RNA, 16 nt, Human
guuuuugucuuaaaaa

SEQ ID NO: 1672700 - RNA, 15 nt, Human
guuuuuuuuuaaaga

SEQ ID NO: 1672701 - RNA, 23 nt, Human
guuuuuuuuuaaaaaagaaacau

SEQ ID NO: 1672702 - RNA, 14 nt, Human
aagucacugcacag

SEQ ID NO: 1672703 - RNA, 12 nt, Human
aagucacugcac

SEQ ID NO: 1672704 - RNA, 20 nt, Human
aagucacauuccugaacagg

SEQ ID NO: 1672705 - RNA, 13 nt, Human
aagucacacagug

SEQ ID NO: 1672706 - RNA, 19 nt, Human
aagucaaggguaggguggg

SEQ ID NO: 1672707 - RNA, 24 nt, Human
aagucacacaguauuacuucugcu

SEQ ID NO: 1672708 - RNA, 21 nt, Human
aagucaagugaaaaaggagga

SEQ ID NO: 1672709 - RNA, 18 nt, Human
aaguauucuuauuuaaug

SEQ ID NO: 1672710 - RNA, 19 nt, Human
aaguauucuuauuuaauga

SEQ ID NO: 1672711 - RNA, 16 nt, Human
aaguacuauguaucaa

SEQ ID NO: 1672712 - RNA, 15 nt, Human
aaguacuggagaaaa

SEQ ID NO: 1672713 - RNA, 21 nt, Human
aaguacuucuccacccugcuc

SEQ ID NO: 1672714 - RNA, 16 nt, Human
guuuucugagaaagac

SEQ ID NO: 1672715 - RNA, 17 nt, Human
guuuucugagaaagacu

SEQ ID NO: 1672716 - RNA, 22 nt, Human
guuuucugagaaagacuauuca

SEQ ID NO: 1672717 - RNA, 22 nt, Human
aaguacuucuccacccugcucu

SEQ ID NO: 1672718 - RNA, 23 nt, Human
aaguacuucuccacccugcucuc

SEQ ID NO: 1672719 - RNA, 23 nt, Human
aaguauguuagugcaaauuguca

SEQ ID NO: 1672720 - RNA, 21 nt, Human
aaguauguuagugcaaauugu

SEQ ID NO: 1672721 - RNA, 13 nt, Human
aaguauuaagcau

SEQ ID NO: 1672722 - RNA, 14 nt, Human
aaguauuaagcaua

SEQ ID NO: 1672723 - RNA, 15 nt, Human
guuucuguacuuuuu

SEQ ID NO: 1672724 - RNA, 14 nt, Human
guuugcauagguga

SEQ ID NO: 1672725 - RNA, 19 nt, Human
guuugcaucugaaaauuga

SEQ ID NO: 1672726 - RNA, 17 nt, Human
guuugccucugccucug

SEQ ID NO: 1672727 - RNA, 13 nt, Human
guuugcuaaguga

SEQ ID NO: 1672728 - RNA, 10 nt, Human
guuucuguac

SEQ ID NO: 1672729 - RNA, 22 nt, Human
guuucugccgcagcccugcaga

SEQ ID NO: 1672730 - RNA, 14 nt, Human
guuucucagcuccc

SEQ ID NO: 1672731 - RNA, 22 nt, Human
guuucuaugacacaugcaaggu

SEQ ID NO: 1672732 - RNA, 14 nt, Human
guuuuaagaggcag

SEQ ID NO: 1672733 - RNA, 18 nt, Human
guuuuaaggaugcuugua

SEQ ID NO: 1672734 - RNA, 16 nt, Human
guuuuaagaggcaggg

SEQ ID NO: 1672735 - RNA, 16 nt, Human
guuuuacugcagcuuu

SEQ ID NO: 1672736 - RNA, 18 nt, Human
guuuuacugcagcuuugu

SEQ ID NO: 1672737 - RNA, 15 nt, Human
guuuuauaauuuugu

SEQ ID NO: 1672738 - RNA, 22 nt, Human
guuuuauaauuuugugaagcaa

SEQ ID NO: 1672739 - RNA, 15 nt, Human
guuuucugagaaaga

SEQ ID NO: 1672740 - RNA, 19 nt, Human
aaggcugagaggagagaga

SEQ ID NO: 1672741 - RNA, 15 nt, Human
aagggcccagagagg

SEQ ID NO: 1672742 - RNA, 13 nt, Human
aagggcccagaga

SEQ ID NO: 1672743 - RNA, 23 nt, Human
aaggcugaugccaaguuguuuga

SEQ ID NO: 1672744 - RNA, 17 nt, Human
aaggggcaguggugguu

SEQ ID NO: 1672745 - RNA, 14 nt, Human
aaggggcaguggug

SEQ ID NO: 1672746 - RNA, 19 nt, Human
aaggguaucaggugcugcc

SEQ ID NO: 1672747 - RNA, 16 nt, Human
aaggguaucuggugac

SEQ ID NO: 1672748 - RNA, 14 nt, Human
aaggcugggggaag

SEQ ID NO: 1672749 - RNA, 13 nt, Human
aagggccuggccu

SEQ ID NO: 1672750 - RNA, 14 nt, Human
aaguaaaaccacag

SEQ ID NO: 1672751 - RNA, 15 nt, Human
aaguaaaaccacagc

SEQ ID NO: 1672752 - RNA, 16 nt, Human
aaguaaaaccacagca

SEQ ID NO: 1672753 - RNA, 21 nt, Human
aagggugaugggaaagcauug

SEQ ID NO: 1672754 - RNA, 17 nt, Human
aaguaaaaccacagcag

SEQ ID NO: 1672755 - RNA, 18 nt, Human
aaguaaaaccacagcagu

SEQ ID NO: 1672756 - RNA, 16 nt, Human
uaaaauuaaagcugaa

SEQ ID NO: 1672757 - RNA, 18 nt, Human
uaaaauuaaagcugaaaa

SEQ ID NO: 1672758 - RNA, 19 nt, Human
uaaaauuaaagcugaaaac

SEQ ID NO: 1672759 - RNA, 17 nt, Human
uaaaauuuuuaaucuuu

SEQ ID NO: 1672760 - RNA, 19 nt, Human
uaaaccaaggcuagaacca

SEQ ID NO: 1672761 - RNA, 19 nt, Human
uaaaauuuuuaaucuuuaa

SEQ ID NO: 1672762 - RNA, 17 nt, Human
guuuuuuuuuaaagacu

SEQ ID NO: 1672763 - RNA, 12 nt, Human
aaguuaaauaaa

SEQ ID NO: 1672764 - RNA, 14 nt, Human
aaguuaaauaaauc

SEQ ID NO: 1672765 - RNA, 19 nt, Human
aaguuuaauauuaaagcca

SEQ ID NO: 1672766 - RNA, 20 nt, Human
aaguuuaauauuaaagccau

SEQ ID NO: 1672767 - RNA, 21 nt, Human
aaguuuaauauuaaagccaug

SEQ ID NO: 1672768 - RNA, 17 nt, Human
aaguucugcagauaaac

SEQ ID NO: 1672769 - RNA, 17 nt, Human
aaguucaugcuuuguuc

SEQ ID NO: 1672770 - RNA, 14 nt, Human
uaaagaagguuuca

SEQ ID NO: 1672771 - RNA, 15 nt, Human
uaaagacaccuacug

SEQ ID NO: 1672772 - RNA, 16 nt, Human
uaaagacuuuuaugau

SEQ ID NO: 1672773 - RNA, 18 nt, Human
uaaagaguuaguuugagu

SEQ ID NO: 1672774 - RNA, 14 nt, Human
uaaagaguguggca

SEQ ID NO: 1672775 - RNA, 19 nt, Human
uaaaggcuaccuuuguauu

SEQ ID NO: 1672776 - RNA, 21 nt, Human
uaaaggcuaccuuuguauucu

SEQ ID NO: 1672777 - RNA, 12 nt, Human
uaaacugccccc

SEQ ID NO: 1672778 - RNA, 13 nt, Human
uaaacgucuuaaa

SEQ ID NO: 1672779 - RNA, 17 nt, Human
uaaacgucuuaaauauu

SEQ ID NO: 1672780 - RNA, 18 nt, Human
uaaaccaugggauaaaug

SEQ ID NO: 1672781 - RNA, 20 nt, Human
uaaaccaugggauaaaugcc

SEQ ID NO: 1672782 - RNA, 21 nt, Human
uaaaccaugggauaaaugcca

SEQ ID NO: 1672783 - RNA, 22 nt, Human
uaaaccaugggauaaaugccau

SEQ ID NO: 1672784 - RNA, 16 nt, Human
uaaaccgccaaggcug

SEQ ID NO: 1672785 - RNA, 18 nt, Human
uaaaccgccaaggcuggg

SEQ ID NO: 1672786 - RNA, 20 nt, Human
uaaauguuuuuuuuuaaaga

SEQ ID NO: 1672787 - RNA, 23 nt, Human
uaaauguuuuuuuuuaaagacuu

SEQ ID NO: 1672788 - RNA, 21 nt, Human
uaaaucuccaaaauaaaacuu

SEQ ID NO: 1672789 - RNA, 20 nt, Human
uaaaucuccaaaauaaaacu

SEQ ID NO: 1672790 - RNA, 22 nt, Human
uaaaucuccaaaauaaaacuuu

SEQ ID NO: 1672791 - RNA, 17 nt, Human
uaaaugauuucauucaa

SEQ ID NO: 1672792 - RNA, 15 nt, Human
uaaauguugacaugg

SEQ ID NO: 1672793 - RNA, 16 nt, Human
uaacaacuaugauuug

SEQ ID NO: 1672794 - RNA, 21 nt, Human
uaacaacuaugauuuggaaaa

SEQ ID NO: 1672795 - RNA, 22 nt, Human
uaacaacuaugauuuggaaaau

SEQ ID NO: 1672796 - RNA, 13 nt, Human
uaacaagccaccc

SEQ ID NO: 1672797 - RNA, 15 nt, Human
uaacaaugcuguauu

SEQ ID NO: 1672798 - RNA, 17 nt, Human
uaacaaugcuguauuuu

SEQ ID NO: 1672799 - RNA, 16 nt, Human
uaacaacagcuggugc

SEQ ID NO: 1672800 - RNA, 21 nt, Human
aauacaccacuacauucuguu

SEQ ID NO: 1672801 - RNA, 20 nt, Human
aauacaccacuacauucugu

SEQ ID NO: 1672802 - RNA, 18 nt, Human
aauacaccacuacauucu

SEQ ID NO: 1672803 - RNA, 16 nt, Human
aauacaccacuacauu

SEQ ID NO: 1672804 - RNA, 15 nt, Human
aauacaauuuuguuu

SEQ ID NO: 1672805 - RNA, 17 nt, Human
aauacaauuuuguuucu

SEQ ID NO: 1672806 - RNA, 18 nt, Human
aauacaauuuuguuucug

SEQ ID NO: 1672807 - RNA, 20 nt, Human
aauacaauuuuguuucugua

SEQ ID NO: 1672808 - RNA, 12 nt, Human
aauacaauuuug

SEQ ID NO: 1672809 - RNA, 13 nt, Human
aauacaauuuugu

SEQ ID NO: 1672810 - RNA, 15 nt, Human
aauacaccacuacau

SEQ ID NO: 1672811 - RNA, 22 nt, Human
aauacaauuuuguuucuguacu

SEQ ID NO: 1672812 - RNA, 23 nt, Human
aauacaauuuuguuucuguacuu

SEQ ID NO: 1672813 - RNA, 14 nt, Human
aauacacacucaaa

SEQ ID NO: 1672814 - RNA, 13 nt, Human
uaaauacaauuuu

SEQ ID NO: 1672815 - RNA, 15 nt, Human
uaaauacaauuuugu

SEQ ID NO: 1672816 - RNA, 22 nt, Human
uaaauacaauuuuguuucugua

SEQ ID NO: 1672817 - RNA, 23 nt, Human
uaaauacaauuuuguuucuguac

SEQ ID NO: 1672818 - RNA, 19 nt, Human
uaaauagcuagacugguga

SEQ ID NO: 1672819 - RNA, 19 nt, Human
uaaauaguaaaaauaaaau

SEQ ID NO: 1672820 - RNA, 20 nt, Human
uaaauaguaaaaauaaaauu

SEQ ID NO: 1672821 - RNA, 23 nt, Human
uaaauagcuagacuggugacuga

SEQ ID NO: 1672822 - RNA, 12 nt, Human
uaaauagcuuuu

SEQ ID NO: 1672823 - RNA, 19 nt, Human
uaaaucuccaaaauaaaac

SEQ ID NO: 1672824 - RNA, 18 nt, Human
uaaaucgcuuuugauaau

SEQ ID NO: 1672825 - RNA, 19 nt, Human
uaaaucgcuuuugauaauc

SEQ ID NO: 1672826 - RNA, 23 nt, Human
uaaaucccauuauucaaaguugc

SEQ ID NO: 1672827 - RNA, 14 nt, Human
aauaauuauaugcu

SEQ ID NO: 1672828 - RNA, 15 nt, Human
aauaauuauaugcua

SEQ ID NO: 1672829 - RNA, 20 nt, Human
aauaauuauaugcuauuucu

SEQ ID NO: 1672830 - RNA, 21 nt, Human
aauaauuauaugcuauuucua

SEQ ID NO: 1672831 - RNA, 22 nt, Human
aauaauuauaugcuauuucuau

SEQ ID NO: 1672832 - RNA, 23 nt, Human
aauaauuauaugcuauuucuaua

SEQ ID NO: 1672833 - RNA, 16 nt, Human
aauaaggaaaaguuua

SEQ ID NO: 1672834 - RNA, 19 nt, Human
aauaaggaaaaguuuaaua

SEQ ID NO: 1672835 - RNA, 22 nt, Human
aauaaggaaaaguuuaauauua

SEQ ID NO: 1672836 - RNA, 13 nt, Human
aauaaggaaaagu

SEQ ID NO: 1672837 - RNA, 15 nt, Human
aauaaggaaaaguuu

SEQ ID NO: 1672838 - RNA, 15 nt, Human
aauaacuaaaaggua

SEQ ID NO: 1672839 - RNA, 12 nt, Human
aauaacauguaa

SEQ ID NO: 1672840 - RNA, 19 nt, Human
aauaacauguaauuaagua

SEQ ID NO: 1672841 - RNA, 22 nt, Human
aauaacauguaauuaaguacua

SEQ ID NO: 1672842 - RNA, 15 nt, Human
aauaacaauaaaaga

SEQ ID NO: 1672843 - RNA, 21 nt, Human
aauaaauagcuagacugguga

SEQ ID NO: 1672844 - RNA, 12 nt, Human
aauaaauuauuu

SEQ ID NO: 1672845 - RNA, 12 nt, Human
aauaaaugugcc

SEQ ID NO: 1672846 - RNA, 21 nt, Human
aauaaaugugccuucauuuuu

SEQ ID NO: 1672847 - RNA, 13 nt, Human
uaaagucaggggu

SEQ ID NO: 1672848 - RNA, 15 nt, Human
aauaaaaaauuauga

SEQ ID NO: 1672849 - RNA, 16 nt, Human
aauaaaaaauuaugac

SEQ ID NO: 1672850 - RNA, 14 nt, Human
aauaaaaaauuaug

SEQ ID NO: 1672851 - RNA, 20 nt, Human
uaaaguguauuuuuuuacua

SEQ ID NO: 1672852 - RNA, 19 nt, Human
uaaaguguauuuuuuuacu

SEQ ID NO: 1672853 - RNA, 15 nt, Human
uaaaguguauuuuuu

SEQ ID NO: 1672854 - RNA, 14 nt, Human
uaaaguguauuuuu

SEQ ID NO: 1672855 - RNA, 16 nt, Human
aauaaaguacaagagc

SEQ ID NO: 1672856 - RNA, 14 nt, Human
aauaaaguaauuau

SEQ ID NO: 1672857 - RNA, 16 nt, Human
aauaaaaucuugaaaa

SEQ ID NO: 1672858 - RNA, 22 nt, Human
aauaaaauccauacauuugugu

SEQ ID NO: 1672859 - RNA, 12 nt, Human
aauaaaaauaau

SEQ ID NO: 1672860 - RNA, 14 nt, Human
guggacacagcucu

SEQ ID NO: 1672861 - RNA, 15 nt, Human
guggacacagcucuu

SEQ ID NO: 1672862 - RNA, 17 nt, Human
guggacacagcucuucu

SEQ ID NO: 1672863 - RNA, 24 nt, Human
guggacacagcucuucuccaggcu

SEQ ID NO: 1672864 - RNA, 16 nt, Human
gugcugggccccugcc

SEQ ID NO: 1672865 - RNA, 19 nt, Human
gugcugguguaugugugaa

SEQ ID NO: 1672866 - RNA, 22 nt, Human
gugcugggguuaucugaaguca

SEQ ID NO: 1672867 - RNA, 19 nt, Human
gugcugggccccugccucu

SEQ ID NO: 1672868 - RNA, 23 nt, Human
aagaagguuucagaaagaagugg

SEQ ID NO: 1672869 - RNA, 18 nt, Human
gugcugcccugcccaccu

SEQ ID NO: 1672870 - RNA, 21 nt, Human
gugcugcccugcccaccuggc

SEQ ID NO: 1672871 - RNA, 19 nt, Human
gugcugcccugcccaccug

SEQ ID NO: 1672872 - RNA, 20 nt, Human
gugcugcccugcccaccugg

SEQ ID NO: 1672873 - RNA, 18 nt, Human
guggcaccagcagccugg

SEQ ID NO: 1672874 - RNA, 13 nt, Human
guggcaccagcag

SEQ ID NO: 1672875 - RNA, 14 nt, Human
guggcaccagcagc

SEQ ID NO: 1672876 - RNA, 22 nt, Human
guggcagcucaccucucccuug

SEQ ID NO: 1672877 - RNA, 14 nt, Human
guggcagcugcggu

SEQ ID NO: 1672878 - RNA, 23 nt, Human
guggauuuaacagaaauguacag

SEQ ID NO: 1672879 - RNA, 21 nt, Human
guggauuuaacagaaauguac

SEQ ID NO: 1672880 - RNA, 24 nt, Human
aagaauuucuaggacugaauuaug

SEQ ID NO: 1672881 - RNA, 16 nt, Human
aagacaaaaagcuacu

SEQ ID NO: 1672882 - RNA, 13 nt, Human
aagacccaaaagg

SEQ ID NO: 1672883 - RNA, 19 nt, Human
guggcagcugcgguccacc

SEQ ID NO: 1672884 - RNA, 17 nt, Human
guggcagcugcggucca

SEQ ID NO: 1672885 - RNA, 13 nt, Human
aagaauauuuuaa

SEQ ID NO: 1672886 - RNA, 20 nt, Human
gugcacuaauguguaagaca

SEQ ID NO: 1672887 - RNA, 22 nt, Human
gugcauuugaggucuguucuuu

SEQ ID NO: 1672888 - RNA, 21 nt, Human
gugcauuugaggucuguucuu

SEQ ID NO: 1672889 - RNA, 15 nt, Human
gugcauuuggugguu

SEQ ID NO: 1672890 - RNA, 14 nt, Human
gugccaagcagagg

SEQ ID NO: 1672891 - RNA, 12 nt, Human
gugcacacacca

SEQ ID NO: 1672892 - RNA, 14 nt, Human
gugcacacaccaga

SEQ ID NO: 1672893 - RNA, 18 nt, Human
gugcacguacacacacau

SEQ ID NO: 1672894 - RNA, 17 nt, Human
gugcacacaccagagcc

SEQ ID NO: 1672895 - RNA, 14 nt, Human
aacuuggcgcugcc

SEQ ID NO: 1672896 - RNA, 15 nt, Human
aacuuguaaaugugg

SEQ ID NO: 1672897 - RNA, 17 nt, Human
aacuuggcgcugccccu

SEQ ID NO: 1672898 - RNA, 23 nt, Human
aacuugguucccauuugcuccuu

SEQ ID NO: 1672899 - RNA, 16 nt, Human
gugccuggccacgccc

SEQ ID NO: 1672900 - RNA, 15 nt, Human
gugccucugggacug

SEQ ID NO: 1672901 - RNA, 14 nt, Human
aacuuguguaaaua

SEQ ID NO: 1672902 - RNA, 15 nt, Human
aacuuguguaaauac

SEQ ID NO: 1672903 - RNA, 20 nt, Human
aacuuguguaaauacaauuu

SEQ ID NO: 1672904 - RNA, 13 nt, Human
aacuuguuuucug

SEQ ID NO: 1672905 - RNA, 20 nt, Human
aagaaaaaggaugcacagag

SEQ ID NO: 1672906 - RNA, 19 nt, Human
aagaaaaaggaugcacaga

SEQ ID NO: 1672907 - RNA, 22 nt, Human
aagaaaaaggaugcacagaguu

SEQ ID NO: 1672908 - RNA, 16 nt, Human
aagaaaauaccaagga

SEQ ID NO: 1672909 - RNA, 13 nt, Human
aagaaaauaucac

SEQ ID NO: 1672910 - RNA, 15 nt, Human
aagaagcucucuccu

SEQ ID NO: 1672911 - RNA, 14 nt, Human
aagaagcucucucc

SEQ ID NO: 1672912 - RNA, 16 nt, Human
aagaagcccaggaaag

SEQ ID NO: 1672913 - RNA, 17 nt, Human
aagaagcccaggaaagg

SEQ ID NO: 1672914 - RNA, 22 nt, Human
aagaagcaccaaucaugaauua

SEQ ID NO: 1672915 - RNA, 18 nt, Human
guggggggggugcugggc

SEQ ID NO: 1672916 - RNA, 15 nt, Human
gugguguuuccuggc

SEQ ID NO: 1672917 - RNA, 16 nt, Human
gugguguuuccuggca

SEQ ID NO: 1672918 - RNA, 12 nt, Human
gugggagcugag

SEQ ID NO: 1672919 - RNA, 15 nt, Human
gugggauccuccagg

SEQ ID NO: 1672920 - RNA, 18 nt, Human
gugggauccuccaggugc

SEQ ID NO: 1672921 - RNA, 21 nt, Human
guggcuucccgcucagcccuc

SEQ ID NO: 1672922 - RNA, 15 nt, Human
guggccucccaacuc

SEQ ID NO: 1672923 - RNA, 17 nt, Human
guggcccgacagccugg

SEQ ID NO: 1672924 - RNA, 13 nt, Human
guggccucccaac

SEQ ID NO: 1672925 - RNA, 14 nt, Human
guggccucccaacu

SEQ ID NO: 1672926 - RNA, 16 nt, Human
aagagcccaggccucc

SEQ ID NO: 1672927 - RNA, 12 nt, Human
aagagcccaggc

SEQ ID NO: 1672928 - RNA, 14 nt, Human
aagagcccaggccu

SEQ ID NO: 1672929 - RNA, 16 nt, Human
aagacuguacaaagua

SEQ ID NO: 1672930 - RNA, 16 nt, Human
aagagauugugguuuc

SEQ ID NO: 1672931 - RNA, 19 nt, Human
aagagauugugguuucauu

SEQ ID NO: 1672932 - RNA, 18 nt, Human
aagagcuguucacagcca

SEQ ID NO: 1672933 - RNA, 16 nt, Human
guggcccgacagccug

SEQ ID NO: 1672934 - RNA, 19 nt, Human
aagagcuguucacagccag

SEQ ID NO: 1672935 - RNA, 17 nt, Human
aagacucauucuucugu

SEQ ID NO: 1672936 - RNA, 14 nt, Human
aagacuccaaagaa

SEQ ID NO: 1672937 - RNA, 16 nt, Human
aagacuccaaagaaau

SEQ ID NO: 1672938 - RNA, 17 nt, Human
aagacuccaaagaaaug

SEQ ID NO: 1672939 - RNA, 23 nt, Human
aagaccccuuaccacugcucuga

SEQ ID NO: 1672940 - RNA, 12 nt, Human
aagaccagucca

SEQ ID NO: 1672941 - RNA, 21 nt, Human
aagacgcugugcugcccugcc

SEQ ID NO: 1672942 - RNA, 22 nt, Human
aagacgcugugcugcccugccc

SEQ ID NO: 1672943 - RNA, 23 nt, Human
aagacgcugugcugcccugccca

SEQ ID NO: 1672944 - RNA, 14 nt, Human
aagacuauucaaac

SEQ ID NO: 1672945 - RNA, 22 nt, Human
aagauauuuugcuuugugauuu

SEQ ID NO: 1672946 - RNA, 20 nt, Human
aagaguaggaagacuuugga

SEQ ID NO: 1672947 - RNA, 20 nt, Human
aagauauuuugcuuugugau

SEQ ID NO: 1672948 - RNA, 17 nt, Human
aagauauuuugcuuugu

SEQ ID NO: 1672949 - RNA, 16 nt, Human
aagaguaggaagacuu

SEQ ID NO: 1672950 - RNA, 18 nt, Human
aagaguaggaagacuuug

SEQ ID NO: 1672951 - RNA, 19 nt, Human
aagaguaggaagacuuugg

SEQ ID NO: 1672952 - RNA, 15 nt, Human
aagauauuuugcuuu

SEQ ID NO: 1672953 - RNA, 19 nt, Human
gugguguuuccuggcacug

SEQ ID NO: 1672954 - RNA, 18 nt, Human
gugguuauggagagggug

SEQ ID NO: 1672955 - RNA, 22 nt, Human
aagauguagaggagaaacugga

SEQ ID NO: 1672956 - RNA, 12 nt, Human
aagcaaaugucu

SEQ ID NO: 1672957 - RNA, 13 nt, Human
aagcaaaugugaa

SEQ ID NO: 1672958 - RNA, 14 nt, Human
aagcaaaugugaau

SEQ ID NO: 1672959 - RNA, 20 nt, Human
aagcaaaugugaaucauuuu

SEQ ID NO: 1672960 - RNA, 19 nt, Human
aagcaaaauuuuuucucua

SEQ ID NO: 1672961 - RNA, 21 nt, Human
guguugaaacggaugauuucu

SEQ ID NO: 1672962 - RNA, 23 nt, Human
guguugaaacggaugauuucuau

SEQ ID NO: 1672963 - RNA, 13 nt, Human
guguuuaagacau

SEQ ID NO: 1672964 - RNA, 14 nt, Human
guguuuaagacauu

SEQ ID NO: 1672965 - RNA, 19 nt, Human
guguguguaugcgugugug

SEQ ID NO: 1672966 - RNA, 19 nt, Human
gugugguguuuccuggcac

SEQ ID NO: 1672967 - RNA, 20 nt, Human
gugugagucaccaagcccag

SEQ ID NO: 1672968 - RNA, 15 nt, Human
gugugguguuuccug

SEQ ID NO: 1672969 - RNA, 13 nt, Human
gugugagucacca

SEQ ID NO: 1672970 - RNA, 18 nt, Human
gugugagucaccaagccc

SEQ ID NO: 1672971 - RNA, 21 nt, Human
gugucuugcaauggcagccuu

SEQ ID NO: 1672972 - RNA, 18 nt, Human
gugucuuuaaaugcugcu

SEQ ID NO: 1672973 - RNA, 19 nt, Human
gugucuuuaaaugcugcuu

SEQ ID NO: 1672974 - RNA, 19 nt, Human
gugucuugcaauggcagcc

SEQ ID NO: 1672975 - RNA, 20 nt, Human
gugucccaaaaagaaaggag

SEQ ID NO: 1672976 - RNA, 16 nt, Human
aagcaaguauuagaau

SEQ ID NO: 1672977 - RNA, 18 nt, Human
gucgcccuggacugugug

SEQ ID NO: 1672978 - RNA, 20 nt, Human
gucuaccugaggggccucuu

SEQ ID NO: 1672979 - RNA, 14 nt, Human
gucgcccuggacug

SEQ ID NO: 1672980 - RNA, 23 nt, Human
gucgcccagucuggaaugcagug

SEQ ID NO: 1672981 - RNA, 15 nt, Human
gucgcccaggcugga

SEQ ID NO: 1672982 - RNA, 20 nt, Human
gucgcccaggcuggagugca

SEQ ID NO: 1672983 - RNA, 14 nt, Human
gucgcccaggcugg

SEQ ID NO: 1672984 - RNA, 13 nt, Human
gucgcccagucug

SEQ ID NO: 1672985 - RNA, 14 nt, Human
gucgcccagucugg

SEQ ID NO: 1672986 - RNA, 14 nt, Human
gucgaggacaggga

SEQ ID NO: 1672987 - RNA, 17 nt, Human
guccugcugcaguugcc

SEQ ID NO: 1672988 - RNA, 13 nt, Human
guccugcugcagu

SEQ ID NO: 1672989 - RNA, 16 nt, Human
guccugcugcaguugc

SEQ ID NO: 1672990 - RNA, 18 nt, Human
aaccaaaugcaaugugaa

SEQ ID NO: 1672991 - RNA, 13 nt, Human
aaccacaucuugc

SEQ ID NO: 1672992 - RNA, 18 nt, Human
aaccacaucuugcucugc

SEQ ID NO: 1672993 - RNA, 13 nt, Human
gucuccauguuug

SEQ ID NO: 1672994 - RNA, 16 nt, Human
aacauuuugucauaua

SEQ ID NO: 1672995 - RNA, 20 nt, Human
gucucaagagggcacuggug

SEQ ID NO: 1672996 - RNA, 22 nt, Human
gucucaagagggcacugguggc

SEQ ID NO: 1672997 - RNA, 15 nt, Human
gucucaagagggcac

SEQ ID NO: 1672998 - RNA, 17 nt, Human
gucucaagagggcacug

SEQ ID NO: 1672999 - RNA, 22 nt, Human
gucucaaacucuugaccucagg

SEQ ID NO: 1673000 - RNA, 14 nt, Human
gucuaugggacuca

SEQ ID NO: 1673001 - RNA, 15 nt, Human
gucuaugggacucaa

SEQ ID NO: 1673002 - RNA, 15 nt, Human
gucucaggucccugc

SEQ ID NO: 1673003 - RNA, 16 nt, Human
gucucaggucccugca

SEQ ID NO: 1673004 - RNA, 23 nt, Human
gucucaguccaugaagauguaga

SEQ ID NO: 1673005 - RNA, 22 nt, Human
guagcucuaggagggcuggcaa

SEQ ID NO: 1673006 - RNA, 12 nt, Human
gucccccucugg

SEQ ID NO: 1673007 - RNA, 14 nt, Human
gucccccucuggcu

SEQ ID NO: 1673008 - RNA, 19 nt, Human
gucccaccuuggcugcagg

SEQ ID NO: 1673009 - RNA, 20 nt, Human
gucccaccuuggcugcaggg

SEQ ID NO: 1673010 - RNA, 17 nt, Human
gucccaccuuggcugca

SEQ ID NO: 1673011 - RNA, 18 nt, Human
gucccaccuuggcugcag

SEQ ID NO: 1673012 - RNA, 22 nt, Human
guccgaaagggacuuggaagcu

SEQ ID NO: 1673013 - RNA, 13 nt, Human
gucccuuuuccuu

SEQ ID NO: 1673014 - RNA, 21 nt, Human
guccgaaagggacuuggaagc

SEQ ID NO: 1673015 - RNA, 18 nt, Human
gucccccugacaacacuc

SEQ ID NO: 1673016 - RNA, 13 nt, Human
gucccccugacaa

SEQ ID NO: 1673017 - RNA, 15 nt, Human
guccccgcacugggc

SEQ ID NO: 1673018 - RNA, 16 nt, Human
guccccgcacugggcu

SEQ ID NO: 1673019 - RNA, 23 nt, Human
guccccuguuuguuucugaaagg

SEQ ID NO: 1673020 - RNA, 19 nt, Human
aacagucucaggaaaucaa

SEQ ID NO: 1673021 - RNA, 19 nt, Human
aacagguuuuccugaagaa

SEQ ID NO: 1673022 - RNA, 17 nt, Human
aacagucucaggaaauc

SEQ ID NO: 1673023 - RNA, 13 nt, Human
guccuacccaccc

SEQ ID NO: 1673024 - RNA, 15 nt, Human
guccuacccacccuc

SEQ ID NO: 1673025 - RNA, 19 nt, Human
aacagauuauuaccuuaca

SEQ ID NO: 1673026 - RNA, 23 nt, Human
aacauguuaaaccaugggauaaa

SEQ ID NO: 1673027 - RNA, 22 nt, Human
aacauguuuuucuucucccuca

SEQ ID NO: 1673028 - RNA, 14 nt, Human
aacaucaacaucuu

SEQ ID NO: 1673029 - RNA, 16 nt, Human
aacauauauaacaaug

SEQ ID NO: 1673030 - RNA, 15 nt, Human
aacauaaaucuguga

SEQ ID NO: 1673031 - RNA, 12 nt, Human
aacauaaaucug

SEQ ID NO: 1673032 - RNA, 14 nt, Human
aacauaaaucugug

SEQ ID NO: 1673033 - RNA, 18 nt, Human
aacauacucccaucugug

SEQ ID NO: 1673034 - RNA, 16 nt, Human
aacauacucccaucug

SEQ ID NO: 1673035 - RNA, 20 nt, Human
aacauacucccaucugugaa

SEQ ID NO: 1673036 - RNA, 23 nt, Human
aacguggcugcuucaaggauccu

SEQ ID NO: 1673037 - RNA, 13 nt, Human
aaccuguucugcu

SEQ ID NO: 1673038 - RNA, 17 nt, Human
aaccuguucugcuuucc

SEQ ID NO: 1673039 - RNA, 19 nt, Human
aaccugauugugucucuug

SEQ ID NO: 1673040 - RNA, 18 nt, Human
aaccugauugugucucuu

SEQ ID NO: 1673041 - RNA, 15 nt, Human
gucuuuguacagaca

SEQ ID NO: 1673042 - RNA, 16 nt, Human
gucuuuguacagacaa

SEQ ID NO: 1673043 - RNA, 16 nt, Human
gucuucaguaagccgu

SEQ ID NO: 1673044 - RNA, 23 nt, Human
gucuucauaccuacauguauuug

SEQ ID NO: 1673045 - RNA, 18 nt, Human
gucucuuuaaugucacag

SEQ ID NO: 1673046 - RNA, 19 nt, Human
gucucuuuaaugucacagg

SEQ ID NO: 1673047 - RNA, 20 nt, Human
gucucuuuaaugucacaggc

SEQ ID NO: 1673048 - RNA, 16 nt, Human
gucugaagucacugca

SEQ ID NO: 1673049 - RNA, 19 nt, Human
gucugaaggcuggguucug

SEQ ID NO: 1673050 - RNA, 22 nt, Human
gucucuuuaaugucacaggcag

SEQ ID NO: 1673051 - RNA, 23 nt, Human
gucucuuuaaugucacaggcagg

SEQ ID NO: 1673052 - RNA, 17 nt, Human
gucucuugguccugcug

SEQ ID NO: 1673053 - RNA, 20 nt, Human
gucucuugguccugcugcag

SEQ ID NO: 1673054 - RNA, 18 nt, Human
gucucuugguccugcugc

SEQ ID NO: 1673055 - RNA, 19 nt, Human
gucucuugguccugcugca

SEQ ID NO: 1673056 - RNA, 17 nt, Human
gucugaagucacugcac

SEQ ID NO: 1673057 - RNA, 19 nt, Human
gucugaagucacugcacag

SEQ ID NO: 1673058 - RNA, 21 nt, Human
gucugacaggcaaugcuggcu

SEQ ID NO: 1673059 - RNA, 22 nt, Human
gucugacaggcaaugcuggcug

SEQ ID NO: 1673060 - RNA, 23 nt, Human
gucugacaggcaaugcuggcugu

SEQ ID NO: 1673061 - RNA, 12 nt, Human
gugagagcuggg

SEQ ID NO: 1673062 - RNA, 12 nt, Human
gugaccccaggu

SEQ ID NO: 1673063 - RNA, 21 nt, Human
gugagcacuaaggugugcucu

SEQ ID NO: 1673064 - RNA, 15 nt, Human
gugagcaggcuguga

SEQ ID NO: 1673065 - RNA, 17 nt, Human
gugaguacuacaguccu

SEQ ID NO: 1673066 - RNA, 13 nt, Human
gugagagcugggu

SEQ ID NO: 1673067 - RNA, 16 nt, Human
gugagaggggaacaga

SEQ ID NO: 1673068 - RNA, 20 nt, Human
gugaguccuggcaugggaau

SEQ ID NO: 1673069 - RNA, 15 nt, Human
gugagucgaggacag

SEQ ID NO: 1673070 - RNA, 17 nt, Human
gugaguccuggcauggg

SEQ ID NO: 1673071 - RNA, 19 nt, Human
gugaguacuacaguccucc

SEQ ID NO: 1673072 - RNA, 21 nt, Human
gugaguacuacaguccuccca

SEQ ID NO: 1673073 - RNA, 14 nt, Human
aacugaacucugac

SEQ ID NO: 1673074 - RNA, 20 nt, Human
aacugaaaucauacuucuua

SEQ ID NO: 1673075 - RNA, 17 nt, Human
gugaccaaugaugguca

SEQ ID NO: 1673076 - RNA, 18 nt, Human
gugaccauguuuuguuua

SEQ ID NO: 1673077 - RNA, 18 nt, Human
gugaccagcaccaucucu

SEQ ID NO: 1673078 - RNA, 21 nt, Human
gugaccagcaccaucucuccu

SEQ ID NO: 1673079 - RNA, 23 nt, Human
gugacagaggcagccccauucug

SEQ ID NO: 1673080 - RNA, 14 nt, Human
gugacaugucuuuu

SEQ ID NO: 1673081 - RNA, 16 nt, Human
gugacagaggcagccc

SEQ ID NO: 1673082 - RNA, 18 nt, Human
gugacagaggcagcccca

SEQ ID NO: 1673083 - RNA, 19 nt, Human
gugacagaggcagccccau

SEQ ID NO: 1673084 - RNA, 23 nt, Human
gugaagacaaugacuuacuguac

SEQ ID NO: 1673085 - RNA, 13 nt, Human
aacuauauuguuu

SEQ ID NO: 1673086 - RNA, 20 nt, Human
aacuaucucauuuccaagca

SEQ ID NO: 1673087 - RNA, 23 nt, Human
aacuaucucauuuccaagcaagu

SEQ ID NO: 1673088 - RNA, 14 nt, Human
gugaagugaagaca

SEQ ID NO: 1673089 - RNA, 21 nt, Human
agugucuuaauuaaaagaaua

SEQ ID NO: 1673090 - RNA, 17 nt, Human
agugucuuaauuaaaag

SEQ ID NO: 1673091 - RNA, 18 nt, Human
agugucuuaauuaaaaga

SEQ ID NO: 1673092 - RNA, 13 nt, Human
aguggcuccuccc

SEQ ID NO: 1673093 - RNA, 17 nt, Human
aguggcuccucccggug

SEQ ID NO: 1673094 - RNA, 21 nt, Human
aguggcuccucccggugccca

SEQ ID NO: 1673095 - RNA, 23 nt, Human
aguggcuuaaaacaacacucaca

SEQ ID NO: 1673096 - RNA, 16 nt, Human
agugggagcugccugu

SEQ ID NO: 1673097 - RNA, 15 nt, Human
agugggagcugccug

SEQ ID NO: 1673098 - RNA, 14 nt, Human
agugggagcugccu

SEQ ID NO: 1673099 - RNA, 18 nt, Human
aguguauuuuuuuacuaa

SEQ ID NO: 1673100 - RNA, 17 nt, Human
aguguauuuuuuuacua

SEQ ID NO: 1673101 - RNA, 15 nt, Human
agugucuuaauuaaa

SEQ ID NO: 1673102 - RNA, 20 nt, Human
aguuguuugauucagacagc

SEQ ID NO: 1673103 - RNA, 16 nt, Human
aguuguguuugaagca

SEQ ID NO: 1673104 - RNA, 14 nt, Human
aguugaagacagag

SEQ ID NO: 1673105 - RNA, 23 nt, Human
aguugaaaaucuuauaauuuaaa

SEQ ID NO: 1673106 - RNA, 22 nt, Human
aguugaaaagacuccaaagaaa

SEQ ID NO: 1673107 - RNA, 14 nt, Human
aguuacagacaaag

SEQ ID NO: 1673108 - RNA, 16 nt, Human
aguuacagacaaagcg

SEQ ID NO: 1673109 - RNA, 14 nt, Human
aguuaagccuuugg

SEQ ID NO: 1673110 - RNA, 13 nt, Human
aguuaagccuuug

SEQ ID NO: 1673111 - RNA, 12 nt, Human
aguuaaauaaau

SEQ ID NO: 1673112 - RNA, 20 nt, Human
aguucagguaacaggcagau

SEQ ID NO: 1673113 - RNA, 17 nt, Human
aguuacagacaaagcgu

SEQ ID NO: 1673114 - RNA, 19 nt, Human
aguucagguaacaggcaga

SEQ ID NO: 1673115 - RNA, 22 nt, Human
aguugaaaaucuuauaauuuaa

SEQ ID NO: 1673116 - RNA, 18 nt, Human
agugaccauacuaauuau

SEQ ID NO: 1673117 - RNA, 16 nt, Human
agugaagacaaugacu

SEQ ID NO: 1673118 - RNA, 14 nt, Human
agugaagacaauga

SEQ ID NO: 1673119 - RNA, 20 nt, Human
agucugauucccaagcucug

SEQ ID NO: 1673120 - RNA, 16 nt, Human
agucugauucccaagc

SEQ ID NO: 1673121 - RNA, 18 nt, Human
agucugauucccaagcuc

SEQ ID NO: 1673122 - RNA, 17 nt, Human
agucuggaaugcagugg

SEQ ID NO: 1673123 - RNA, 18 nt, Human
agucuggaaugcaguggu

SEQ ID NO: 1673124 - RNA, 22 nt, Human
aguccuggcaugggaaugaaug

SEQ ID NO: 1673125 - RNA, 20 nt, Human
aguccuggcaugggaaugaa

SEQ ID NO: 1673126 - RNA, 21 nt, Human
aguccuggcaugggaaugaau

SEQ ID NO: 1673127 - RNA, 17 nt, Human
agucugaaggcuggguu

SEQ ID NO: 1673128 - RNA, 16 nt, Human
agucugaaggcugggu

SEQ ID NO: 1673129 - RNA, 13 nt, Human
agucugaaggcug

SEQ ID NO: 1673130 - RNA, 15 nt, Human
agucugaaggcuggg

SEQ ID NO: 1673131 - RNA, 12 nt, Human
aguccuguaaug

SEQ ID NO: 1673132 - RNA, 17 nt, Human
aguaugggacuggccuc

SEQ ID NO: 1673133 - RNA, 20 nt, Human
aguaugggacuggccucugc

SEQ ID NO: 1673134 - RNA, 14 nt, Human
aguaugguggcugg

SEQ ID NO: 1673135 - RNA, 23 nt, Human
agucaaauugugugaaagguacu

SEQ ID NO: 1673136 - RNA, 19 nt, Human
agucaaauugugugaaagg

SEQ ID NO: 1673137 - RNA, 11 nt, Human
aguaucuugaa

SEQ ID NO: 1673138 - RNA, 12 nt, Human
aguaucuugaag

SEQ ID NO: 1673139 - RNA, 15 nt, Human
aguaucuugaagacu

SEQ ID NO: 1673140 - RNA, 17 nt, Human
aguaugaggcauuuguu

SEQ ID NO: 1673141 - RNA, 16 nt, Human
aguaugaggcauuugu

SEQ ID NO: 1673142 - RNA, 15 nt, Human
aguaugaggcauuug

SEQ ID NO: 1673143 - RNA, 16 nt, Human
aguaugaauaaagaca

SEQ ID NO: 1673144 - RNA, 16 nt, Human
aguaucuuuuuauuca

SEQ ID NO: 1673145 - RNA, 17 nt, Human
auaacauaaaucuguga

SEQ ID NO: 1673146 - RNA, 18 nt, Human
auaacauaaaucugugaa

SEQ ID NO: 1673147 - RNA, 19 nt, Human
auaacauaaaucugugaac

SEQ ID NO: 1673148 - RNA, 14 nt, Human
auaacauaaaucug

SEQ ID NO: 1673149 - RNA, 15 nt, Human
auaacauaaaucugu

SEQ ID NO: 1673150 - RNA, 18 nt, Human
auaaaggauuaaugucaa

SEQ ID NO: 1673151 - RNA, 15 nt, Human
auaaagcaggcagaa

SEQ ID NO: 1673152 - RNA, 18 nt, Human
auaaagcuguguggcagu

SEQ ID NO: 1673153 - RNA, 12 nt, Human
auaaagacaccu

SEQ ID NO: 1673154 - RNA, 13 nt, Human
auaaagcagcguu

SEQ ID NO: 1673155 - RNA, 20 nt, Human
auaaagcagcguuucuauga

SEQ ID NO: 1673156 - RNA, 19 nt, Human
auaaagcagcguuucuaug

SEQ ID NO: 1673157 - RNA, 18 nt, Human
auaaagcagcguuucuau

SEQ ID NO: 1673158 - RNA, 14 nt, Human
auaaagcagcguuu

SEQ ID NO: 1673159 - RNA, 11 nt, Human
auaaaacuuuu

SEQ ID NO: 1673160 - RNA, 15 nt, Human
auaaaacuuuuuaaa

SEQ ID NO: 1673161 - RNA, 20 nt, Human
auaaacuuuuuucuuacugu

SEQ ID NO: 1673162 - RNA, 24 nt, Human
auaaacuuuaccuuuuuuauacau

SEQ ID NO: 1673163 - RNA, 21 nt, Human
auaaacuuuaccuuuuuuaua

SEQ ID NO: 1673164 - RNA, 17 nt, Human
auaaaacuuuuuaaaau

SEQ ID NO: 1673165 - RNA, 12 nt, Human
auacccaccccc

SEQ ID NO: 1673166 - RNA, 21 nt, Human
auaccuacauguauuuguuug

SEQ ID NO: 1673167 - RNA, 11 nt, Human
auacccacccc

SEQ ID NO: 1673168 - RNA, 18 nt, Human
auaccugucccccugaca

SEQ ID NO: 1673169 - RNA, 16 nt, Human
auaaggaaaaguuuaa

SEQ ID NO: 1673170 - RNA, 15 nt, Human
auaaggaaaaguuua

SEQ ID NO: 1673171 - RNA, 21 nt, Human
auaaugcgugcauaccacuuu

SEQ ID NO: 1673172 - RNA, 20 nt, Human
auacaccacuacauucuguu

SEQ ID NO: 1673173 - RNA, 19 nt, Human
auacaccacuacauucugu

SEQ ID NO: 1673174 - RNA, 21 nt, Human
auacaccacuacauucuguua

SEQ ID NO: 1673175 - RNA, 17 nt, Human
auacacacucaaaucaa

SEQ ID NO: 1673176 - RNA, 18 nt, Human
auacacacucaaaucaag

SEQ ID NO: 1673177 - RNA, 20 nt, Human
auacacacucaaaucaagaa

SEQ ID NO: 1673178 - RNA, 18 nt, Human
auacaccacuacauucug

SEQ ID NO: 1673179 - RNA, 15 nt, Human
auaauguaagcucua

SEQ ID NO: 1673180 - RNA, 23 nt, Human
auaauguuucaaacauauauaac

SEQ ID NO: 1673181 - RNA, 15 nt, Human
auaauuaacauguua

SEQ ID NO: 1673182 - RNA, 17 nt, Human
auaauuaacauguuaaa

SEQ ID NO: 1673183 - RNA, 16 nt, Human
auaucaaauauauuca

SEQ ID NO: 1673184 - RNA, 19 nt, Human
auauauuuuuuucugaaau

SEQ ID NO: 1673185 - RNA, 15 nt, Human
auaucaauuuaaaaa

SEQ ID NO: 1673186 - RNA, 22 nt, Human
auaucaucaguauugaagcauu

SEQ ID NO: 1673187 - RNA, 16 nt, Human
auaugcuauuucuaua

SEQ ID NO: 1673188 - RNA, 18 nt, Human
auaugcuauuucuauauu

SEQ ID NO: 1673189 - RNA, 19 nt, Human
auaugcuauuucuauauuu

SEQ ID NO: 1673190 - RNA, 21 nt, Human
auaugcuauuucuauauuuuc

SEQ ID NO: 1673191 - RNA, 15 nt, Human
auaugcuauuucuau

SEQ ID NO: 1673192 - RNA, 22 nt, Human
auauuaccacagacauacuaac

SEQ ID NO: 1673193 - RNA, 22 nt, Human
auaugcuauuucuauauuuuca

SEQ ID NO: 1673194 - RNA, 23 nt, Human
auaugcuauuucuauauuuucau

SEQ ID NO: 1673195 - RNA, 20 nt, Human
auaugcuucuguuuuauaau

SEQ ID NO: 1673196 - RNA, 22 nt, Human
auaugcuucuguuuuauaauuu

SEQ ID NO: 1673197 - RNA, 14 nt, Human
auauuauuuuaugu

SEQ ID NO: 1673198 - RNA, 18 nt, Human
auauuuacuaaaauggac

SEQ ID NO: 1673199 - RNA, 20 nt, Human
auauuuacuaaaauggacug

SEQ ID NO: 1673200 - RNA, 19 nt, Human
auauuuacuucuuauacau

SEQ ID NO: 1673201 - RNA, 13 nt, Human
auauuuauuuuaa

SEQ ID NO: 1673202 - RNA, 23 nt, Human
auauuaugaagcuuuuaugugaa

SEQ ID NO: 1673203 - RNA, 15 nt, Human
auagccaaggccaaa

SEQ ID NO: 1673204 - RNA, 21 nt, Human
auagccaaggccaaaggaagc

SEQ ID NO: 1673205 - RNA, 21 nt, Human
auagguauaaguggugugugu

SEQ ID NO: 1673206 - RNA, 14 nt, Human
auaggugcuacaaa

SEQ ID NO: 1673207 - RNA, 23 nt, Human
auaggugcuacaaaaacacagca

SEQ ID NO: 1673208 - RNA, 15 nt, Human
auaggugcuacaaaa

SEQ ID NO: 1673209 - RNA, 21 nt, Human
auaggugcuacaaaaacacag

SEQ ID NO: 1673210 - RNA, 14 nt, Human
auagguuuggacaa

SEQ ID NO: 1673211 - RNA, 18 nt, Human
auagguuuggacaaaaug

SEQ ID NO: 1673212 - RNA, 15 nt, Human
auagguuuaauaauu

SEQ ID NO: 1673213 - RNA, 17 nt, Human
auaguaugguggcuggg

SEQ ID NO: 1673214 - RNA, 18 nt, Human
auaguaugguggcugggu

SEQ ID NO: 1673215 - RNA, 14 nt, Human
auagucaaauugug

SEQ ID NO: 1673216 - RNA, 23 nt, Human
augaaguuuuuuuuauacaggau

SEQ ID NO: 1673217 - RNA, 21 nt, Human
augaccuuucaauaggaaaaa

SEQ ID NO: 1673218 - RNA, 22 nt, Human
augaccuuucaauaggaaaaac

SEQ ID NO: 1673219 - RNA, 23 nt, Human
augaccuuucaauaggaaaaacu

SEQ ID NO: 1673220 - RNA, 19 nt, Human
augaaguuuuuuuuauaca

SEQ ID NO: 1673221 - RNA, 22 nt, Human
augaagcuuuuaugugaaacau

SEQ ID NO: 1673222 - RNA, 13 nt, Human
augaaagacugua

SEQ ID NO: 1673223 - RNA, 16 nt, Human
augaaagacuguacaa

SEQ ID NO: 1673224 - RNA, 17 nt, Human
augaaagacuguacaaa

SEQ ID NO: 1673225 - RNA, 19 nt, Human
augaaagacuguacaaagu

SEQ ID NO: 1673226 - RNA, 14 nt, Human
aucuauauuuuaca

SEQ ID NO: 1673227 - RNA, 17 nt, Human
aucuauauuuuacauaa

SEQ ID NO: 1673228 - RNA, 21 nt, Human
aucuauauuuuacauaaauuu

SEQ ID NO: 1673229 - RNA, 14 nt, Human
aucucggcucacug

SEQ ID NO: 1673230 - RNA, 15 nt, Human
aucucggcucacugc

SEQ ID NO: 1673231 - RNA, 16 nt, Human
aucucggcucacugca

SEQ ID NO: 1673232 - RNA, 17 nt, Human
aucucugcuuuggaaau

SEQ ID NO: 1673233 - RNA, 15 nt, Human
aucuggacuccucug

SEQ ID NO: 1673234 - RNA, 16 nt, Human
aucuggacuccucugu

SEQ ID NO: 1673235 - RNA, 17 nt, Human
aucuggacuccucuguc

SEQ ID NO: 1673236 - RNA, 18 nt, Human
aucuggacuccucugucc

SEQ ID NO: 1673237 - RNA, 19 nt, Human
aucuggacuccucugucca

SEQ ID NO: 1673238 - RNA, 22 nt, Human
aucuggacuccucuguccaggc

SEQ ID NO: 1673239 - RNA, 22 nt, Human
aucugcuuuuuaaagaaugcuc

SEQ ID NO: 1673240 - RNA, 18 nt, Human
aucuugaauaauguaaga

SEQ ID NO: 1673241 - RNA, 17 nt, Human
aucuugaauuguaagga

SEQ ID NO: 1673242 - RNA, 18 nt, Human
aucuugaagacuuuucuu

SEQ ID NO: 1673243 - RNA, 14 nt, Human
aucuucuuuauaau

SEQ ID NO: 1673244 - RNA, 16 nt, Human
auccagaaagaaaacu

SEQ ID NO: 1673245 - RNA, 18 nt, Human
auccagaaagaaaacuug

SEQ ID NO: 1673246 - RNA, 15 nt, Human
auccagacccggcug

SEQ ID NO: 1673247 - RNA, 14 nt, Human
aucccauuuaaaaa

SEQ ID NO: 1673248 - RNA, 13 nt, Human
auccccaagccug

SEQ ID NO: 1673249 - RNA, 15 nt, Human
aucccauuuaaaaaa

SEQ ID NO: 1673250 - RNA, 16 nt, Human
auccccaagccuggca

SEQ ID NO: 1673251 - RNA, 15 nt, Human
auccccuguagagug

SEQ ID NO: 1673252 - RNA, 11 nt, Human
auccuccaggu

SEQ ID NO: 1673253 - RNA, 23 nt, Human
auccuccaggugcacaagcucca

SEQ ID NO: 1673254 - RNA, 13 nt, Human
auccuccaggugc

SEQ ID NO: 1673255 - RNA, 15 nt, Human
auccucccaccucag

SEQ ID NO: 1673256 - RNA, 12 nt, Human
auccucccaggc

SEQ ID NO: 1673257 - RNA, 20 nt, Human
auccucccaccucagccucc

SEQ ID NO: 1673258 - RNA, 18 nt, Human
auccucccaccucagccu

SEQ ID NO: 1673259 - RNA, 19 nt, Human
auccucccaccucagccuc

SEQ ID NO: 1673260 - RNA, 21 nt, Human
aucacagccucugaaaaccaa

SEQ ID NO: 1673261 - RNA, 15 nt, Human
aucacauguggacuu

SEQ ID NO: 1673262 - RNA, 18 nt, Human
aucaccaacgucugugcc

SEQ ID NO: 1673263 - RNA, 19 nt, Human
aucaccaacgucugugcca

SEQ ID NO: 1673264 - RNA, 20 nt, Human
aucaccaacgucugugccau

SEQ ID NO: 1673265 - RNA, 17 nt, Human
auauuuauuuuaauaau

SEQ ID NO: 1673266 - RNA, 14 nt, Human
auauuuauuuuaau

SEQ ID NO: 1673267 - RNA, 15 nt, Human
auauuuauuuuaaua

SEQ ID NO: 1673268 - RNA, 23 nt, Human
aucagcacgauuucuguuuagau

SEQ ID NO: 1673269 - RNA, 20 nt, Human
aucagcacgauuucuguuua

SEQ ID NO: 1673270 - RNA, 19 nt, Human
aucagcacgauuucuguuu

SEQ ID NO: 1673271 - RNA, 14 nt, Human
aucaccgaaaacgu

SEQ ID NO: 1673272 - RNA, 19 nt, Human
aucaccgaaaacguggcug

SEQ ID NO: 1673273 - RNA, 21 nt, Human
aucaccgaaaacguggcugcu

SEQ ID NO: 1673274 - RNA, 20 nt, Human
aucagccugcuccagcuguu

SEQ ID NO: 1673275 - RNA, 19 nt, Human
aucagccugcuccagcugu

SEQ ID NO: 1673276 - RNA, 17 nt, Human
aucagccugcuccagcu

SEQ ID NO: 1673277 - RNA, 18 nt, Human
aucagccugcuccagcug

SEQ ID NO: 1673278 - RNA, 21 nt, Human
aucagcugcugaaacaacaaa

SEQ ID NO: 1673279 - RNA, 16 nt, Human
aucaugugaaaucauu

SEQ ID NO: 1673280 - RNA, 15 nt, Human
aucaugugaaaucau

SEQ ID NO: 1673281 - RNA, 22 nt, Human
aucagcugcugaaacaacaaau

SEQ ID NO: 1673282 - RNA, 23 nt, Human
aucagcugcugaaacaacaaaua

SEQ ID NO: 1673283 - RNA, 19 nt, Human
auggcugugccucugccug

SEQ ID NO: 1673284 - RNA, 20 nt, Human
auggcugugccucugccugu

SEQ ID NO: 1673285 - RNA, 14 nt, Human
augcuuguacauaa

SEQ ID NO: 1673286 - RNA, 13 nt, Human
augcuuguacaua

SEQ ID NO: 1673287 - RNA, 12 nt, Human
augcuuguacau

SEQ ID NO: 1673288 - RNA, 12 nt, Human
augcugcccugu

SEQ ID NO: 1673289 - RNA, 22 nt, Human
auggaggaaaaccaagccgugg

SEQ ID NO: 1673290 - RNA, 16 nt, Human
auggaggaaaaccaag

SEQ ID NO: 1673291 - RNA, 15 nt, Human
auggauuuccagcca

SEQ ID NO: 1673292 - RNA, 16 nt, Human
augcucuuuacuucau

SEQ ID NO: 1673293 - RNA, 11 nt, Human
augcugcccug

SEQ ID NO: 1673294 - RNA, 15 nt, Human
augcacaaacagagg

SEQ ID NO: 1673295 - RNA, 24 nt, Human
augauguuuuccaugaguccccug

SEQ ID NO: 1673296 - RNA, 16 nt, Human
augaugccaugaggaa

SEQ ID NO: 1673297 - RNA, 17 nt, Human
augaugccaugaggaac

SEQ ID NO: 1673298 - RNA, 16 nt, Human
augcauauuauuuuau

SEQ ID NO: 1673299 - RNA, 20 nt, Human
augcauauuauuuuauguug

SEQ ID NO: 1673300 - RNA, 20 nt, Human
augcaugaaguaauaugcac

SEQ ID NO: 1673301 - RNA, 16 nt, Human
augcaugaaguaauau

SEQ ID NO: 1673302 - RNA, 19 nt, Human
augccucucucaggccaaa

SEQ ID NO: 1673303 - RNA, 16 nt, Human
augcacagaguuguua

SEQ ID NO: 1673304 - RNA, 16 nt, Human
augcacaaacagaggc

SEQ ID NO: 1673305 - RNA, 17 nt, Human
augcacaaacagaggcc

SEQ ID NO: 1673306 - RNA, 18 nt, Human
augcacagaguuguuaca

SEQ ID NO: 1673307 - RNA, 17 nt, Human
augcacagaguuguuac

SEQ ID NO: 1673308 - RNA, 16 nt, Human
auguucucucuucucc

SEQ ID NO: 1673309 - RNA, 11 nt, Human
auguucuggga

SEQ ID NO: 1673310 - RNA, 12 nt, Human
auguucugggac

SEQ ID NO: 1673311 - RNA, 13 nt, Human
augugugaaguga

SEQ ID NO: 1673312 - RNA, 20 nt, Human
augugggcuaguugggcuuc

SEQ ID NO: 1673313 - RNA, 18 nt, Human
augugggcagugauguca

SEQ ID NO: 1673314 - RNA, 17 nt, Human
auguucuaagaagugaa

SEQ ID NO: 1673315 - RNA, 22 nt, Human
auguuugccucugccucugaca

SEQ ID NO: 1673316 - RNA, 19 nt, Human
auguuugccucugccucug

SEQ ID NO: 1673317 - RNA, 13 nt, Human
auguucugggaca

SEQ ID NO: 1673318 - RNA, 11 nt, Human
augugaacagu

SEQ ID NO: 1673319 - RNA, 21 nt, Human
augugaacaguuguguuugaa

SEQ ID NO: 1673320 - RNA, 23 nt, Human
augugaacaguuguguuugaagc

SEQ ID NO: 1673321 - RNA, 15 nt, Human
augugaaacauguuu

SEQ ID NO: 1673322 - RNA, 14 nt, Human
augugaaaucauuc

SEQ ID NO: 1673323 - RNA, 22 nt, Human
augugaaacuggauuaaacuua

SEQ ID NO: 1673324 - RNA, 13 nt, Human
augucuuccugga

SEQ ID NO: 1673325 - RNA, 21 nt, Human
augucuucauaccuacaugua

SEQ ID NO: 1673326 - RNA, 22 nt, Human
augucuucauaccuacauguau

SEQ ID NO: 1673327 - RNA, 14 nt, Human
augucuuuucuugc

SEQ ID NO: 1673328 - RNA, 20 nt, Human
augguccgugcuaaggacuu

SEQ ID NO: 1673329 - RNA, 21 nt, Human
augguccgugcuaaggacuug

SEQ ID NO: 1673330 - RNA, 19 nt, Human
auggucaccaaaucagcug

SEQ ID NO: 1673331 - RNA, 15 nt, Human
auggucggaaaacau

SEQ ID NO: 1673332 - RNA, 14 nt, Human
auguaagggaaacu

SEQ ID NO: 1673333 - RNA, 16 nt, Human
auguaagggaaacugc

SEQ ID NO: 1673334 - RNA, 15 nt, Human
auguaauuaaguacu

SEQ ID NO: 1673335 - RNA, 17 nt, Human
auguaauuaaguacuau

SEQ ID NO: 1673336 - RNA, 19 nt, Human
auguaagggaaacugccag

SEQ ID NO: 1673337 - RNA, 23 nt, Human
auguaauuaaguacuauguauca

SEQ ID NO: 1673338 - RNA, 14 nt, Human
auguauuuguuugc

SEQ ID NO: 1673339 - RNA, 20 nt, Human
agcuucuguugcugccucau

SEQ ID NO: 1673340 - RNA, 21 nt, Human
agcuuuucccuuuuuuuaagu

SEQ ID NO: 1673341 - RNA, 20 nt, Human
aggaauccagacccggcugc

SEQ ID NO: 1673342 - RNA, 21 nt, Human
aggaaucaugugccaagcaga

SEQ ID NO: 1673343 - RNA, 17 nt, Human
aggaauccagacccggc

SEQ ID NO: 1673344 - RNA, 23 nt, Human
aggaugcuuguacauaaugcgug

SEQ ID NO: 1673345 - RNA, 21 nt, Human
aggaugcuuguacauaaugcg

SEQ ID NO: 1673346 - RNA, 13 nt, Human
aggaccucaggug

SEQ ID NO: 1673347 - RNA, 20 nt, Human
aggauuaaauaauguaaaua

SEQ ID NO: 1673348 - RNA, 14 nt, Human
aggauuauuggaaa

SEQ ID NO: 1673349 - RNA, 14 nt, Human
aggauuaaauaaug

SEQ ID NO: 1673350 - RNA, 18 nt, Human
aggauguucugggacaca

SEQ ID NO: 1673351 - RNA, 22 nt, Human
aggauguacaaggacagccccu

SEQ ID NO: 1673352 - RNA, 22 nt, Human
aggauguucuagcauggcugcc

SEQ ID NO: 1673353 - RNA, 15 nt, Human
aggauguucugggac

SEQ ID NO: 1673354 - RNA, 16 nt, Human
aggauguucugggaca

SEQ ID NO: 1673355 - RNA, 23 nt, Human
aggaugguucccuugaugaagaa

SEQ ID NO: 1673356 - RNA, 19 nt, Human
agcuucuguugcugccuca

SEQ ID NO: 1673357 - RNA, 23 nt, Human
agcugcgguccacccaggagccc

SEQ ID NO: 1673358 - RNA, 23 nt, Human
agcugagauuauaggcaccuacc

SEQ ID NO: 1673359 - RNA, 12 nt, Human
agcuccuucugu

SEQ ID NO: 1673360 - RNA, 13 nt, Human
agcuccuucuguc

SEQ ID NO: 1673361 - RNA, 20 nt, Human
agcuccgcuuucuacccagc

SEQ ID NO: 1673362 - RNA, 21 nt, Human
agcuccgcuuucuacccagcg

SEQ ID NO: 1673363 - RNA, 23 nt, Human
agcuccgcuuucuacccagcgag

SEQ ID NO: 1673364 - RNA, 22 nt, Human
agcuccccucggagaagagcug

SEQ ID NO: 1673365 - RNA, 19 nt, Human
aggguaucaggugcugcca

SEQ ID NO: 1673366 - RNA, 21 nt, Human
aggguaucaggugcugccauc

SEQ ID NO: 1673367 - RNA, 15 nt, Human
aggguaucuggugac

SEQ ID NO: 1673368 - RNA, 19 nt, Human
aggggccucuuaugggcug

SEQ ID NO: 1673369 - RNA, 20 nt, Human
aggggccucuuaugggcugg

SEQ ID NO: 1673370 - RNA, 21 nt, Human
aggggccucuuaugggcuggg

SEQ ID NO: 1673371 - RNA, 12 nt, Human
aggguccugggg

SEQ ID NO: 1673372 - RNA, 15 nt, Human
aggguccuggggaac

SEQ ID NO: 1673373 - RNA, 21 nt, Human
aggguccuggggaaccugacc

SEQ ID NO: 1673374 - RNA, 23 nt, Human
aggguccuggggaaccugacccc

SEQ ID NO: 1673375 - RNA, 11 nt, Human
agggucccugg

SEQ ID NO: 1673376 - RNA, 21 nt, Human
agguaaucgaccugccucggc

SEQ ID NO: 1673377 - RNA, 23 nt, Human
agguaaaucagacuaugaaguuu

SEQ ID NO: 1673378 - RNA, 17 nt, Human
agguacaaccuguucug

SEQ ID NO: 1673379 - RNA, 12 nt, Human
aggucccuaaua

SEQ ID NO: 1673380 - RNA, 11 nt, Human
aggucccuaau

SEQ ID NO: 1673381 - RNA, 18 nt, Human
agguaaaucagacuauga

SEQ ID NO: 1673382 - RNA, 20 nt, Human
agguaaaagcaucacaugaa

SEQ ID NO: 1673383 - RNA, 13 nt, Human
aggucccuaauaa

SEQ ID NO: 1673384 - RNA, 15 nt, Human
aggucccuaauaaag

SEQ ID NO: 1673385 - RNA, 16 nt, Human
aggucccuaauaaagc

SEQ ID NO: 1673386 - RNA, 18 nt, Human
aggucuguucuuuccaaa

SEQ ID NO: 1673387 - RNA, 23 nt, Human
aggucuguucuuuccaaaguaca

SEQ ID NO: 1673388 - RNA, 22 nt, Human
aggucuguucuuuccaaaguac

SEQ ID NO: 1673389 - RNA, 18 nt, Human
aggugcuacaaaaacaca

SEQ ID NO: 1673390 - RNA, 19 nt, Human
aggugcuacaaaaacacag

SEQ ID NO: 1673391 - RNA, 20 nt, Human
aggugcuacaaaaacacagc

SEQ ID NO: 1673392 - RNA, 21 nt, Human
aggugcuacaaaaacacagca

SEQ ID NO: 1673393 - RNA, 22 nt, Human
aggugcuacaaaaacacagcaa

SEQ ID NO: 1673394 - RNA, 15 nt, Human
agguucaaagauauu

SEQ ID NO: 1673395 - RNA, 14 nt, Human
agguucaaagauau

SEQ ID NO: 1673396 - RNA, 22 nt, Human
agguucccuuugacgccauccc

SEQ ID NO: 1673397 - RNA, 13 nt, Human
agguucccuuuga

SEQ ID NO: 1673398 - RNA, 23 nt, Human
agguucccuuugacgccauccca

SEQ ID NO: 1673399 - RNA, 23 nt, Human
aggugcuaggaacacuccuucac

SEQ ID NO: 1673400 - RNA, 19 nt, Human
aggugcuaggaacacuccu

SEQ ID NO: 1673401 - RNA, 22 nt, Human
aggugcuaggaacacuccuuca

SEQ ID NO: 1673402 - RNA, 23 nt, Human
aggugcuacaaaaacacagcaag

SEQ ID NO: 1673403 - RNA, 24 nt, Human
aggugcuacaaaaacacagcaagg

SEQ ID NO: 1673404 - RNA, 13 nt, Human
aggcccuuccucu

SEQ ID NO: 1673405 - RNA, 15 nt, Human
aggcccuuccucucc

SEQ ID NO: 1673406 - RNA, 17 nt, Human
aggcccuuccucuccac

SEQ ID NO: 1673407 - RNA, 18 nt, Human
aggcccuuccucuccacu

SEQ ID NO: 1673408 - RNA, 20 nt, Human
aggcccuucucuccagcccc

SEQ ID NO: 1673409 - RNA, 21 nt, Human
aggcccuucucuccagccccu

SEQ ID NO: 1673410 - RNA, 19 nt, Human
aggcccuuccucuccacug

SEQ ID NO: 1673411 - RNA, 22 nt, Human
aggcccuucucuccagccccug

SEQ ID NO: 1673412 - RNA, 23 nt, Human
aggcccuucucuccagccccugg

SEQ ID NO: 1673413 - RNA, 21 nt, Human
aggcgugagccaccgugccug

SEQ ID NO: 1673414 - RNA, 23 nt, Human
aggcuacuguaaggcaaucaugg

SEQ ID NO: 1673415 - RNA, 17 nt, Human
aggcuacugucagcucc

SEQ ID NO: 1673416 - RNA, 21 nt, Human
aggcuagaaccaccugccuau

SEQ ID NO: 1673417 - RNA, 17 nt, Human
agggacgcuacccggga

SEQ ID NO: 1673418 - RNA, 21 nt, Human
aggcugucaauuacaggaagu

SEQ ID NO: 1673419 - RNA, 22 nt, Human
agggacagaggggguggccucc

SEQ ID NO: 1673420 - RNA, 23 nt, Human
agggacagaggggguggccuccc

SEQ ID NO: 1673421 - RNA, 20 nt, Human
aggcugucaauuacaggaag

SEQ ID NO: 1673422 - RNA, 13 nt, Human
aggcuguauccca

SEQ ID NO: 1673423 - RNA, 18 nt, Human
aggcuguaucccaugagc

SEQ ID NO: 1673424 - RNA, 15 nt, Human
aggcuagauguaugu

SEQ ID NO: 1673425 - RNA, 16 nt, Human
aggcuagauguaugua

SEQ ID NO: 1673426 - RNA, 17 nt, Human
aggcuagauguauguac

SEQ ID NO: 1673427 - RNA, 14 nt, Human
agauggcugugccu

SEQ ID NO: 1673428 - RNA, 19 nt, Human
agauauaugcucugcaugu

SEQ ID NO: 1673429 - RNA, 23 nt, Human
agaguggcuccucccggugccca

SEQ ID NO: 1673430 - RNA, 19 nt, Human
agaguggggauaugauuua

SEQ ID NO: 1673431 - RNA, 19 nt, Human
agaguggcuccucccggug

SEQ ID NO: 1673432 - RNA, 23 nt, Human
agaggguggugaccucugccuga

SEQ ID NO: 1673433 - RNA, 11 nt, Human
agagugggagc

SEQ ID NO: 1673434 - RNA, 13 nt, Human
agaguguugaaac

SEQ ID NO: 1673435 - RNA, 17 nt, Human
agaguguggcaaaauaa

SEQ ID NO: 1673436 - RNA, 14 nt, Human
agagugugccugaa

SEQ ID NO: 1673437 - RNA, 12 nt, Human
agagggcacaga

SEQ ID NO: 1673438 - RNA, 20 nt, Human
agaggguggugaccucugcc

SEQ ID NO: 1673439 - RNA, 22 nt, Human
agaggguggugaccucugccug

SEQ ID NO: 1673440 - RNA, 19 nt, Human
agaggguggugaccucugc

SEQ ID NO: 1673441 - RNA, 14 nt, Human
agaggacuuuucuu

SEQ ID NO: 1673442 - RNA, 15 nt, Human
agaggagagaggacc

SEQ ID NO: 1673443 - RNA, 16 nt, Human
agaggagagaggaccc

SEQ ID NO: 1673444 - RNA, 16 nt, Human
agaggaaggagaggag

SEQ ID NO: 1673445 - RNA, 15 nt, Human
agagcccaggccucc

SEQ ID NO: 1673446 - RNA, 13 nt, Human
agagcccaggccu

SEQ ID NO: 1673447 - RNA, 14 nt, Human
agagcccaggccuc

SEQ ID NO: 1673448 - RNA, 15 nt, Human
agacagauacuccuc

SEQ ID NO: 1673449 - RNA, 22 nt, Human
agacagauacuccuccaagguu

SEQ ID NO: 1673450 - RNA, 21 nt, Human
agacagauacuccuccaaggu

SEQ ID NO: 1673451 - RNA, 16 nt, Human
agacagcccgggcucu

SEQ ID NO: 1673452 - RNA, 14 nt, Human
agacagcccgggcu

SEQ ID NO: 1673453 - RNA, 15 nt, Human
agacagcccgggcuc

SEQ ID NO: 1673454 - RNA, 22 nt, Human
agacgcugugcugcccugccca

SEQ ID NO: 1673455 - RNA, 18 nt, Human
agacggagucccaccuug

SEQ ID NO: 1673456 - RNA, 12 nt, Human
agacagcugccu

SEQ ID NO: 1673457 - RNA, 11 nt, Human
agacagcucuu

SEQ ID NO: 1673458 - RNA, 12 nt, Human
agacagcucuua

SEQ ID NO: 1673459 - RNA, 21 nt, Human
agacgcugugcugcccugccc

SEQ ID NO: 1673460 - RNA, 17 nt, Human
agagcccacgcccccac

SEQ ID NO: 1673461 - RNA, 16 nt, Human
agagcccacgccccca

SEQ ID NO: 1673462 - RNA, 19 nt, Human
agagcccaccuuggcucaa

SEQ ID NO: 1673463 - RNA, 13 nt, Human
agagcccacgccc

SEQ ID NO: 1673464 - RNA, 22 nt, Human
agagaggguggugaccucugcc

SEQ ID NO: 1673465 - RNA, 20 nt, Human
agagaggguggugaccucug

SEQ ID NO: 1673466 - RNA, 21 nt, Human
agagaggguggugaccucugc

SEQ ID NO: 1673467 - RNA, 17 nt, Human
agagaacuuccagaucc

SEQ ID NO: 1673468 - RNA, 19 nt, Human
agacuggaagcacagcuuc

SEQ ID NO: 1673469 - RNA, 17 nt, Human
agacuggaagcacagcu

SEQ ID NO: 1673470 - RNA, 21 nt, Human
agacugcauuauauuuauuac

SEQ ID NO: 1673471 - RNA, 13 nt, Human
agccccagugccc

SEQ ID NO: 1673472 - RNA, 14 nt, Human
agccccagugccca

SEQ ID NO: 1673473 - RNA, 15 nt, Human
agccccagugcccac

SEQ ID NO: 1673474 - RNA, 17 nt, Human
agcccucacccuggggc

SEQ ID NO: 1673475 - RNA, 13 nt, Human
agccccauucugc

SEQ ID NO: 1673476 - RNA, 16 nt, Human
agccccauucugccug

SEQ ID NO: 1673477 - RNA, 18 nt, Human
agccagcaggcucucagg

SEQ ID NO: 1673478 - RNA, 19 nt, Human
agccagcaggcucucaggc

SEQ ID NO: 1673479 - RNA, 20 nt, Human
agccagcaggcucucaggcc

SEQ ID NO: 1673480 - RNA, 13 nt, Human
agccgcuggggcc

SEQ ID NO: 1673481 - RNA, 21 nt, Human
agccgccaugcuccuggccca

SEQ ID NO: 1673482 - RNA, 22 nt, Human
agccucccgaguagcugggacu

SEQ ID NO: 1673483 - RNA, 20 nt, Human
agccucccgaguagcuggga

SEQ ID NO: 1673484 - RNA, 18 nt, Human
agccucccgaguagcugg

SEQ ID NO: 1673485 - RNA, 19 nt, Human
agccucccgaguagcuggg

SEQ ID NO: 1673486 - RNA, 14 nt, Human
agccuccuccagcc

SEQ ID NO: 1673487 - RNA, 22 nt, Human
agccucccacgacugcccggca

SEQ ID NO: 1673488 - RNA, 17 nt, Human
agccgugccuucagcuc

SEQ ID NO: 1673489 - RNA, 21 nt, Human
agccucccaaagugcugggau

SEQ ID NO: 1673490 - RNA, 15 nt, Human
agccgugccuucagc

SEQ ID NO: 1673491 - RNA, 16 nt, Human
agccgugccuucagcu

SEQ ID NO: 1673492 - RNA, 21 nt, Human
agccgggcgugguggugagug

SEQ ID NO: 1673493 - RNA, 23 nt, Human
agccaagugugguagagugugcc

SEQ ID NO: 1673494 - RNA, 23 nt, Human
agcaugccuggauggggcugcac

SEQ ID NO: 1673495 - RNA, 22 nt, Human
agcauccuggcacccggccccu

SEQ ID NO: 1673496 - RNA, 23 nt, Human
agcauccuggcacccggccccug

SEQ ID NO: 1673497 - RNA, 16 nt, Human
agcaguugaaaagacu

SEQ ID NO: 1673498 - RNA, 23 nt, Human
agcaguucagagcugcccucucc

SEQ ID NO: 1673499 - RNA, 13 nt, Human
agcaguugaaaag

SEQ ID NO: 1673500 - RNA, 18 nt, Human
agcagcguuucuaugaca

SEQ ID NO: 1673501 - RNA, 13 nt, Human
agcagcguuucua

SEQ ID NO: 1673502 - RNA, 19 nt, Human
agcagugcaugcugucccu

SEQ ID NO: 1673503 - RNA, 20 nt, Human
agcagugcaugcugucccuu

SEQ ID NO: 1673504 - RNA, 23 nt, Human
agcacacuugacaucaacugcau

SEQ ID NO: 1673505 - RNA, 17 nt, Human
agcacagacccugcccu

SEQ ID NO: 1673506 - RNA, 20 nt, Human
agcacagacccugcccugug

SEQ ID NO: 1673507 - RNA, 18 nt, Human
agcacagacccugcccug

SEQ ID NO: 1673508 - RNA, 19 nt, Human
agcacagacccugcccugu

SEQ ID NO: 1673509 - RNA, 16 nt, Human
agcacugacuucuaag

SEQ ID NO: 1673510 - RNA, 17 nt, Human
aauccaagcaaauguga

SEQ ID NO: 1673511 - RNA, 18 nt, Human
aauccaagcaaaugugaa

SEQ ID NO: 1673512 - RNA, 21 nt, Human
aaugauuaugaauuacauuug

SEQ ID NO: 1673513 - RNA, 23 nt, Human
aaugauuaugaauuacauuugua

SEQ ID NO: 1673514 - RNA, 15 nt, Human
aaugauuaugaauua

SEQ ID NO: 1673515 - RNA, 23 nt, Human
aaugaagucucugaagugaaacu

SEQ ID NO: 1673516 - RNA, 14 nt, Human
aaugaagucucuga

SEQ ID NO: 1673517 - RNA, 16 nt, Human
aaugaagucucugaag

SEQ ID NO: 1673518 - RNA, 13 nt, Human
aaugaaauacugu

SEQ ID NO: 1673519 - RNA, 18 nt, Human
aaucucaaauuucuaaau

SEQ ID NO: 1673520 - RNA, 17 nt, Human
aaucucaaauuucuaaa

SEQ ID NO: 1673521 - RNA, 13 nt, Human
aauccagccugcu

SEQ ID NO: 1673522 - RNA, 16 nt, Human
aaucucaaauuucuaa

SEQ ID NO: 1673523 - RNA, 19 nt, Human
aauccagacccggcugcgu

SEQ ID NO: 1673524 - RNA, 15 nt, Human
aauccaaugaaauga

SEQ ID NO: 1673525 - RNA, 15 nt, Human
aaguugccuaaaucc

SEQ ID NO: 1673526 - RNA, 16 nt, Human
aaguugccuaaaucca

SEQ ID NO: 1673527 - RNA, 17 nt, Human
aaguugccuaaauccau

SEQ ID NO: 1673528 - RNA, 18 nt, Human
aaguugccuaaauccauu

SEQ ID NO: 1673529 - RNA, 19 nt, Human
aaguugccuaaauccauuu

SEQ ID NO: 1673530 - RNA, 13 nt, Human
aauacucuuauau

SEQ ID NO: 1673531 - RNA, 20 nt, Human
aauacucuacccucuuagaa

SEQ ID NO: 1673532 - RNA, 22 nt, Human
aauacucuacccucuuagaaaa

SEQ ID NO: 1673533 - RNA, 21 nt, Human
aauauuagugaccucagcuuu

SEQ ID NO: 1673534 - RNA, 12 nt, Human
aauauuaaagcc

SEQ ID NO: 1673535 - RNA, 15 nt, Human
aaucaccgaaaacgu

SEQ ID NO: 1673536 - RNA, 19 nt, Human
aaucacauucgaguguuuc

SEQ ID NO: 1673537 - RNA, 23 nt, Human
aaucaaguuggcuucuaaucaaa

SEQ ID NO: 1673538 - RNA, 14 nt, Human
aaucaccgaaaacg

SEQ ID NO: 1673539 - RNA, 13 nt, Human
aauagacaauuua

SEQ ID NO: 1673540 - RNA, 22 nt, Human
aauguuuuuuuuuaaagacuuu

SEQ ID NO: 1673541 - RNA, 15 nt, Human
aauguuuuuuuuuaa

SEQ ID NO: 1673542 - RNA, 20 nt, Human
aauguuuuuuuuuaaagacu

SEQ ID NO: 1673543 - RNA, 23 nt, Human
aaugccuuacccucauguucuua

SEQ ID NO: 1673544 - RNA, 22 nt, Human
aaugcgcaggcuggcccugccc

SEQ ID NO: 1673545 - RNA, 18 nt, Human
aaugcgugcauaccacuu

SEQ ID NO: 1673546 - RNA, 19 nt, Human
aaugcgugcauaccacuuu

SEQ ID NO: 1673547 - RNA, 17 nt, Human
aaugugaaaagaaaaau

SEQ ID NO: 1673548 - RNA, 15 nt, Human
aaugugaaaagaaaa

SEQ ID NO: 1673549 - RNA, 15 nt, Human
aauguuugccucugc

SEQ ID NO: 1673550 - RNA, 16 nt, Human
aauguuugccucugcc

SEQ ID NO: 1673551 - RNA, 22 nt, Human
aauguuuacagauccccaagcc

SEQ ID NO: 1673552 - RNA, 23 nt, Human
aauguuucaaacauauauaacaa

SEQ ID NO: 1673553 - RNA, 23 nt, Human
aaugcuauaacuauguugauaaa

SEQ ID NO: 1673554 - RNA, 13 nt, Human
aaugguuaaaaga

SEQ ID NO: 1673555 - RNA, 15 nt, Human
aagucuccaaagucu

SEQ ID NO: 1673556 - RNA, 12 nt, Human
aagucuguuuua

SEQ ID NO: 1673557 - RNA, 15 nt, Human
aagucuguuuuauga

SEQ ID NO: 1673558 - RNA, 13 nt, Human
aagucuguuuuau

SEQ ID NO: 1673559 - RNA, 14 nt, Human
aagucuguuuuaug

SEQ ID NO: 1673560 - RNA, 12 nt, Human
aaguugccuaaa

SEQ ID NO: 1673561 - RNA, 12 nt, Human
aaguugaauuuu

SEQ ID NO: 1673562 - RNA, 21 nt, Human
aaguggaaaaauagccugccu

SEQ ID NO: 1673563 - RNA, 19 nt, Human
aaguggaaaaauagccugc

SEQ ID NO: 1673564 - RNA, 20 nt, Human
aaggugaggagcuugaaacc

SEQ ID NO: 1673565 - RNA, 19 nt, Human
aaguagaagucuuagaugu

SEQ ID NO: 1673566 - RNA, 20 nt, Human
aaguagaagucuuagaugua

SEQ ID NO: 1673567 - RNA, 17 nt, Human
aaguaucccuacuguaa

SEQ ID NO: 1673568 - RNA, 23 nt, Human
aaguaucccuacuguaauuugug

SEQ ID NO: 1673569 - RNA, 18 nt, Human
aaguaucccuacuguaau

SEQ ID NO: 1673570 - RNA, 21 nt, Human
aaguagaagucuuagauguau

SEQ ID NO: 1673571 - RNA, 21 nt, Human
aaguagggacuucugucuuca

SEQ ID NO: 1673572 - RNA, 14 nt, Human
aagucuccaaaguc

SEQ ID NO: 1673573 - RNA, 22 nt, Human
aaguccucuuuucugagaggac

SEQ ID NO: 1673574 - RNA, 18 nt, Human
aaguccucuuuucugaga

SEQ ID NO: 1673575 - RNA, 18 nt, Human
aaguccaagcauuuagau

SEQ ID NO: 1673576 - RNA, 15 nt, Human
aaguaucugacaucu

SEQ ID NO: 1673577 - RNA, 17 nt, Human
aaguccaagcauaccaa

SEQ ID NO: 1673578 - RNA, 19 nt, Human
aaggucauuuuuuuuaaga

SEQ ID NO: 1673579 - RNA, 18 nt, Human
aaggucauuuuuuuuaag

SEQ ID NO: 1673580 - RNA, 18 nt, Human
aagggacgcuacccggga

SEQ ID NO: 1673581 - RNA, 23 nt, Human
aagggaaacugccagcaacgcag

SEQ ID NO: 1673582 - RNA, 16 nt, Human
aagggaaacugccagc

SEQ ID NO: 1673583 - RNA, 17 nt, Human
aagggaaacugccagca

SEQ ID NO: 1673584 - RNA, 21 nt, Human
aagcgauucuucugcuucagc

SEQ ID NO: 1673585 - RNA, 13 nt, Human
aaggacagccccu

SEQ ID NO: 1673586 - RNA, 19 nt, Human
aaggacagccccuccucca

SEQ ID NO: 1673587 - RNA, 14 nt, Human
aaggacuucuuuaa

SEQ ID NO: 1673588 - RNA, 15 nt, Human
aaggacuucuuuaau

SEQ ID NO: 1673589 - RNA, 20 nt, Human
aaggacuucuuuaauuuugg

SEQ ID NO: 1673590 - RNA, 21 nt, Human
aaggacuucuuuaauuuugga

SEQ ID NO: 1673591 - RNA, 18 nt, Human
aagcuguguggcagucug

SEQ ID NO: 1673592 - RNA, 18 nt, Human
aagcuggucccacucagu

SEQ ID NO: 1673593 - RNA, 21 nt, Human
aagcuggucccacucagucca

SEQ ID NO: 1673594 - RNA, 15 nt, Human
aaggauguucuagca

SEQ ID NO: 1673595 - RNA, 15 nt, Human
aaggauugcuacugu

SEQ ID NO: 1673596 - RNA, 12 nt, Human
aaggcagggagg

SEQ ID NO: 1673597 - RNA, 20 nt, Human
aaggcagcucuaaaugucaa

SEQ ID NO: 1673598 - RNA, 13 nt, Human
aagauacugaaau

SEQ ID NO: 1673599 - RNA, 12 nt, Human
aagauaaaugug

SEQ ID NO: 1673600 - RNA, 13 nt, Human
aagauaaaugugc

SEQ ID NO: 1673601 - RNA, 14 nt, Human
aagauaaaugugcu

SEQ ID NO: 1673602 - RNA, 20 nt, Human
aagccagcaggcucucaggc

SEQ ID NO: 1673603 - RNA, 23 nt, Human
aagccagcaggcucucaggccag

SEQ ID NO: 1673604 - RNA, 22 nt, Human
aagcagcguuucuaugacacau

SEQ ID NO: 1673605 - RNA, 21 nt, Human
aagcagcguuucuaugacaca

SEQ ID NO: 1673606 - RNA, 20 nt, Human
aagcagcguuucuaugacac

SEQ ID NO: 1673607 - RNA, 17 nt, Human
aagcagcguuucuauga

SEQ ID NO: 1673608 - RNA, 14 nt, Human
aagcagcguuucua

SEQ ID NO: 1673609 - RNA, 19 nt, Human
aacagcuggugcccugcuu

SEQ ID NO: 1673610 - RNA, 20 nt, Human
aacagcuggugcccugcuuu

SEQ ID NO: 1673611 - RNA, 21 nt, Human
aacagcuggugcccugcuuuc

SEQ ID NO: 1673612 - RNA, 15 nt, Human
aacaucccuccuggg

SEQ ID NO: 1673613 - RNA, 13 nt, Human
aaccacgcuggac

SEQ ID NO: 1673614 - RNA, 15 nt, Human
aaccacuucagcuga

SEQ ID NO: 1673615 - RNA, 12 nt, Human
aaccagaucauu

SEQ ID NO: 1673616 - RNA, 15 nt, Human
aacccuauugguaaa

SEQ ID NO: 1673617 - RNA, 21 nt, Human
aacccuuggagccaauggaga

SEQ ID NO: 1673618 - RNA, 21 nt, Human
aaccgaacugauguaaguaaa

SEQ ID NO: 1673619 - RNA, 17 nt, Human
aaccuagggugauauua

SEQ ID NO: 1673620 - RNA, 16 nt, Human
aacacaucagcuugcc

SEQ ID NO: 1673621 - RNA, 18 nt, Human
aacaaauuuacagagaca

SEQ ID NO: 1673622 - RNA, 15 nt, Human
aaaugccuuuguacu

SEQ ID NO: 1673623 - RNA, 17 nt, Human
aaaucuuauaauuuaaa

SEQ ID NO: 1673624 - RNA, 22 nt, Human
aaauguuguucucuucuuuaaa

SEQ ID NO: 1673625 - RNA, 13 nt, Human
aaauuaaagcuga

SEQ ID NO: 1673626 - RNA, 17 nt, Human
aaauuaaagcugaaaac

SEQ ID NO: 1673627 - RNA, 13 nt, Human
aaauucuuucauu

SEQ ID NO: 1673628 - RNA, 21 nt, Human
aaauucuugcaaaguaucccu

SEQ ID NO: 1673629 - RNA, 13 nt, Human
aaauugcuccuug

SEQ ID NO: 1673630 - RNA, 14 nt, Human
aaauugcuccuuga

SEQ ID NO: 1673631 - RNA, 22 nt, Human
aaauugacacuuaaaaaugguu

SEQ ID NO: 1673632 - RNA, 19 nt, Human
aaauugacacuuaaaaaug

SEQ ID NO: 1673633 - RNA, 11 nt, Human
aacgcagcccu

SEQ ID NO: 1673634 - RNA, 14 nt, Human
aacggaugauuucu

SEQ ID NO: 1673635 - RNA, 15 nt, Human
aacggaugauuucua

SEQ ID NO: 1673636 - RNA, 16 nt, Human
aacggaugauuucuau

SEQ ID NO: 1673637 - RNA, 17 nt, Human
aacggaugauuucuaug

SEQ ID NO: 1673638 - RNA, 17 nt, Human
aacgaucagacagaucu

SEQ ID NO: 1673639 - RNA, 16 nt, Human
aacuuaaucuaaaugg

SEQ ID NO: 1673640 - RNA, 15 nt, Human
aacuuaaucuaaaug

SEQ ID NO: 1673641 - RNA, 18 nt, Human
aacuuaaucuaaauggaa

SEQ ID NO: 1673642 - RNA, 14 nt, Human
aacugauaaagaug

SEQ ID NO: 1673643 - RNA, 16 nt, Human
aacugagugccuuuug

SEQ ID NO: 1673644 - RNA, 15 nt, Human
aacugacucuuaaga

SEQ ID NO: 1673645 - RNA, 18 nt, Human
aacugacucuuaagaaga

SEQ ID NO: 1673646 - RNA, 19 nt, Human
aacugacucuuaagaagac

SEQ ID NO: 1673647 - RNA, 20 nt, Human
aacugacucuuaagaagacu

SEQ ID NO: 1673648 - RNA, 20 nt, Human
aacugagaugugaacacauc

SEQ ID NO: 1673649 - RNA, 21 nt, Human
aacuuuaugcuaagugaaaua

SEQ ID NO: 1673650 - RNA, 20 nt, Human
aacuuuaugcuaagugaaau

SEQ ID NO: 1673651 - RNA, 19 nt, Human
aaauaguggugugauuugg

SEQ ID NO: 1673652 - RNA, 17 nt, Human
aaauagcuuuuuucucu

SEQ ID NO: 1673653 - RNA, 20 nt, Human
aaauagcuuuuuucucugau

SEQ ID NO: 1673654 - RNA, 18 nt, Human
aaauagcuagacugguga

SEQ ID NO: 1673655 - RNA, 24 nt, Human
aaauagcucaggugucccugcacu

SEQ ID NO: 1673656 - RNA, 15 nt, Human
aaaucugugaacuug

SEQ ID NO: 1673657 - RNA, 16 nt, Human
aaaucugugaacuuga

SEQ ID NO: 1673658 - RNA, 18 nt, Human
aaaucugugaacuugaaa

SEQ ID NO: 1673659 - RNA, 19 nt, Human
aaaucaaugcuauaacuau

SEQ ID NO: 1673660 - RNA, 15 nt, Human
aaauauuuauuuuaa

SEQ ID NO: 1673661 - RNA, 13 nt, Human
aaauauuuauuuu

SEQ ID NO: 1673662 - RNA, 20 nt, Human
aaauauuuauuuuaauaaug

SEQ ID NO: 1673663 - RNA, 12 nt, Human
aaaucaaauaug

SEQ ID NO: 1673664 - RNA, 14 nt, Human
aaaucaaauaugca

SEQ ID NO: 1673665 - RNA, 15 nt, Human
aaaucaaauaugcaa

SEQ ID NO: 1673666 - RNA, 16 nt, Human
aaaucaaauaugcaaa

SEQ ID NO: 1673667 - RNA, 10 nt, Human
aaauaaauaa

SEQ ID NO: 1673668 - RNA, 19 nt, Human
aaauaaaacuuuuuaaaau

SEQ ID NO: 1673669 - RNA, 16 nt, Human
aaauaaaacuuuuuaa

SEQ ID NO: 1673670 - RNA, 13 nt, Human
aaauaaaacuuuu

SEQ ID NO: 1673671 - RNA, 19 nt, Human
aaaggcuccaggagcagcc

SEQ ID NO: 1673672 - RNA, 20 nt, Human
aaaggcuccaggagcagcca

SEQ ID NO: 1673673 - RNA, 13 nt, Human
aaaguggaaaaau

SEQ ID NO: 1673674 - RNA, 13 nt, Human
aaagcccugugcu

SEQ ID NO: 1673675 - RNA, 14 nt, Human
aaagcccugugcuc

SEQ ID NO: 1673676 - RNA, 22 nt, Human
aaagcccuuccaugucgccucu

SEQ ID NO: 1673677 - RNA, 23 nt, Human
aaagcccuuccaugucgccucug

SEQ ID NO: 1673678 - RNA, 16 nt, Human
aaagccuccuccagcc

SEQ ID NO: 1673679 - RNA, 15 nt, Human
aaaggcuccaggagc

SEQ ID NO: 1673680 - RNA, 16 nt, Human
aaaggcuccaggagca

SEQ ID NO: 1673681 - RNA, 14 nt, Human
aaaggcagaagcaa

SEQ ID NO: 1673682 - RNA, 16 nt, Human
aaacccuauugguaaa

SEQ ID NO: 1673683 - RNA, 20 nt, Human
aaaccaugggauaaaugcca

SEQ ID NO: 1673684 - RNA, 18 nt, Human
aaacucuccucugcugcu

SEQ ID NO: 1673685 - RNA, 15 nt, Human
aaaccaugggauaaa

SEQ ID NO: 1673686 - RNA, 18 nt, Human
aaaccaucauugaaaucu

SEQ ID NO: 1673687 - RNA, 16 nt, Human
aaagauauuuugcuuu

SEQ ID NO: 1673688 - RNA, 12 nt, Human
aaagauauuuug

SEQ ID NO: 1673689 - RNA, 20 nt, Human
aaagauauuuugcuuuguga

SEQ ID NO: 1673690 - RNA, 17 nt, Human
aaagauauuuugcuuug

SEQ ID NO: 1673691 - RNA, 15 nt, Human
aaagaaauauaccua

SEQ ID NO: 1673692 - RNA, 17 nt, Human
aaagaaauauaccuaaa

SEQ ID NO: 1673693 - RNA, 21 nt, Human
aaacugagaugugaacacauc

SEQ ID NO: 1673694 - RNA, 23 nt, Human
aaacugagaugugaacacaucag

SEQ ID NO: 1673695 - RNA, 19 nt, Human
aaagaguguggcaaaauaa

SEQ ID NO: 1673696 - RNA, 20 nt, Human
aaagaagguuucagaaagaa

SEQ ID NO: 1673697 - RNA, 14 nt, Human
aaagaguaggaaga

SEQ ID NO: 1673698 - RNA, 15 nt, Human
aaagaaauguaaggg

SEQ ID NO: 1673699 - RNA, 22 nt, Human
aaaaucucaaauuucuaaaucu

SEQ ID NO: 1673700 - RNA, 19 nt, Human
aaaaucucaaauuucuaaa

SEQ ID NO: 1673701 - RNA, 16 nt, Human
aaaaucucaauauuuc

SEQ ID NO: 1673702 - RNA, 17 nt, Human
aaaaucucaauauuuca

SEQ ID NO: 1673703 - RNA, 21 nt, Human
aaaauugaugggauuugguca

SEQ ID NO: 1673704 - RNA, 22 nt, Human
aaacacugggagaaaugaaaaa

SEQ ID NO: 1673705 - RNA, 16 nt, Human
aaacacuguucucugc

SEQ ID NO: 1673706 - RNA, 21 nt, Human
aaacacugggagaaaugaaaa

SEQ ID NO: 1673707 - RNA, 15 nt, Human
aaaaagaaaggaggg

SEQ ID NO: 1673708 - RNA, 16 nt, Human
aaaaagaaacauuugg

SEQ ID NO: 1673709 - RNA, 19 nt, Human
aaaauaaaauuaaagcuga

SEQ ID NO: 1673710 - RNA, 13 nt, Human
aaaaguugaauuu

SEQ ID NO: 1673711 - RNA, 17 nt, Human
aaaauaaaacuuuuuaa

SEQ ID NO: 1673712 - RNA, 18 nt, Human
aaaaguucugcagauaaa

SEQ ID NO: 1673713 - RNA, 21 nt, Human
aaaaucuacacuccagugaga

SEQ ID NO: 1673714 - RNA, 13 nt, Human
accagaucauugu

SEQ ID NO: 1673715 - RNA, 13 nt, Human
accagcagaaaug

SEQ ID NO: 1673716 - RNA, 17 nt, Human
accagccaguaaauggg

SEQ ID NO: 1673717 - RNA, 12 nt, Human
accaagcccagu

SEQ ID NO: 1673718 - RNA, 19 nt, Human
acauuuguucuauagcuuu

SEQ ID NO: 1673719 - RNA, 15 nt, Human
acauuuauucugcuc

SEQ ID NO: 1673720 - RNA, 19 nt, Human
acaggcaaugcuggcuguu

SEQ ID NO: 1673721 - RNA, 23 nt, Human
acaggcaaugcuggcuguuggcu

SEQ ID NO: 1673722 - RNA, 19 nt, Human
acaggguuuugccauguug

SEQ ID NO: 1673723 - RNA, 22 nt, Human
acauaaugcgugcauaccacuu

SEQ ID NO: 1673724 - RNA, 23 nt, Human
acauaaugcgugcauaccacuuu

SEQ ID NO: 1673725 - RNA, 23 nt, Human
acauguuucuuuguaaugaaaac

SEQ ID NO: 1673726 - RNA, 19 nt, Human
acauguuucuuuguaauga

SEQ ID NO: 1673727 - RNA, 22 nt, Human
acauguuucuuuguaaugaaaa

SEQ ID NO: 1673728 - RNA, 19 nt, Human
acaucagcacgauuucugu

SEQ ID NO: 1673729 - RNA, 18 nt, Human
acaucagcacgauuucug

SEQ ID NO: 1673730 - RNA, 17 nt, Human
acaucagcacgauuucu

SEQ ID NO: 1673731 - RNA, 15 nt, Human
acaucagcacgauuu

SEQ ID NO: 1673732 - RNA, 16 nt, Human
acaugugcacaugcac

SEQ ID NO: 1673733 - RNA, 18 nt, Human
acaugugcacaugcacgu

SEQ ID NO: 1673734 - RNA, 17 nt, Human
accccucauagcccuca

SEQ ID NO: 1673735 - RNA, 16 nt, Human
accccuccaugugggc

SEQ ID NO: 1673736 - RNA, 19 nt, Human
accccuccaugugggcuag

SEQ ID NO: 1673737 - RNA, 16 nt, Human
accauauuaccacaga

SEQ ID NO: 1673738 - RNA, 14 nt, Human
accauauuaccaca

SEQ ID NO: 1673739 - RNA, 16 nt, Human
acccaccucagccucc

SEQ ID NO: 1673740 - RNA, 18 nt, Human
acccccugcaaagcccag

SEQ ID NO: 1673741 - RNA, 20 nt, Human
acccccugcaaagcccagcu

SEQ ID NO: 1673742 - RNA, 22 nt, Human
acccccugcaaagcccagcuug

SEQ ID NO: 1673743 - RNA, 14 nt, Human
acccccugcaaagc

SEQ ID NO: 1673744 - RNA, 17 nt, Human
acccccugcaaagccca

SEQ ID NO: 1673745 - RNA, 11 nt, Human
acccccugaau

SEQ ID NO: 1673746 - RNA, 18 nt, Human
acccaagggccuggccug

SEQ ID NO: 1673747 - RNA, 19 nt, Human
acccaagggccuggccuga

SEQ ID NO: 1673748 - RNA, 22 nt, Human
acccaagggccuggccugagcu

SEQ ID NO: 1673749 - RNA, 20 nt, Human
accauauuaccacagacaua

SEQ ID NO: 1673750 - RNA, 13 nt, Human
acccaccucagcc

SEQ ID NO: 1673751 - RNA, 14 nt, Human
acccaccucagccu

SEQ ID NO: 1673752 - RNA, 15 nt, Human
acccaccucagccuc

SEQ ID NO: 1673753 - RNA, 21 nt, Human
acccacaagaaaugaaagcag

SEQ ID NO: 1673754 - RNA, 23 nt, Human
acccaagggccuggccugagcug

SEQ ID NO: 1673755 - RNA, 17 nt, Human
acccacaagaaaugaaa

SEQ ID NO: 1673756 - RNA, 21 nt, Human
acaggaugaugacuauggaaa

SEQ ID NO: 1673757 - RNA, 12 nt, Human
acaggcaagcac

SEQ ID NO: 1673758 - RNA, 16 nt, Human
acagcucuucuccagg

SEQ ID NO: 1673759 - RNA, 17 nt, Human
acagcucuucuccaggc

SEQ ID NO: 1673760 - RNA, 18 nt, Human
acagcucuucuccaggcu

SEQ ID NO: 1673761 - RNA, 19 nt, Human
acagccacggccaggccag

SEQ ID NO: 1673762 - RNA, 18 nt, Human
acagccacggccaggcca

SEQ ID NO: 1673763 - RNA, 15 nt, Human
acagccacggccagg

SEQ ID NO: 1673764 - RNA, 16 nt, Human
acagccacggccaggc

SEQ ID NO: 1673765 - RNA, 17 nt, Human
acagccacggccaggcc

SEQ ID NO: 1673766 - RNA, 15 nt, Human
acacugcauguuugu

SEQ ID NO: 1673767 - RNA, 14 nt, Human
acacugcauguuug

SEQ ID NO: 1673768 - RNA, 11 nt, Human
acagacacagg

SEQ ID NO: 1673769 - RNA, 13 nt, Human
acagacaaagcgu

SEQ ID NO: 1673770 - RNA, 15 nt, Human
acacuguacugcaau

SEQ ID NO: 1673771 - RNA, 15 nt, Human
acagacacaggcccg

SEQ ID NO: 1673772 - RNA, 19 nt, Human
acagaggcagccccauucu

SEQ ID NO: 1673773 - RNA, 23 nt, Human
acagaggcagccccauucugccu

SEQ ID NO: 1673774 - RNA, 13 nt, Human
acagacacaggcc

SEQ ID NO: 1673775 - RNA, 14 nt, Human
acagacacaggccc

SEQ ID NO: 1673776 - RNA, 15 nt, Human
acagaggcagcccca

SEQ ID NO: 1673777 - RNA, 19 nt, Human
acagccaacuauggccugu

SEQ ID NO: 1673778 - RNA, 17 nt, Human
acagccaacuauggccu

SEQ ID NO: 1673779 - RNA, 14 nt, Human
acagaggggguggc

SEQ ID NO: 1673780 - RNA, 15 nt, Human
acagagugagacucu

SEQ ID NO: 1673781 - RNA, 19 nt, Human
acagagugagacucugucu

SEQ ID NO: 1673782 - RNA, 21 nt, Human
acagcaguugaaaagacucca

SEQ ID NO: 1673783 - RNA, 22 nt, Human
acagcaguugaaaagacuccaa

SEQ ID NO: 1673784 - RNA, 23 nt, Human
acagcaguugaaaagacuccaaa

SEQ ID NO: 1673785 - RNA, 13 nt, Human
aauuuuguuucug

SEQ ID NO: 1673786 - RNA, 13 nt, Human
aauuuugugaagc

SEQ ID NO: 1673787 - RNA, 15 nt, Human
acaaggcaaggcugu

SEQ ID NO: 1673788 - RNA, 14 nt, Human
aauuuuguuucugu

SEQ ID NO: 1673789 - RNA, 15 nt, Human
aauuuuguuucugua

SEQ ID NO: 1673790 - RNA, 22 nt, Human
acaaaauguaggguuauaauaa

SEQ ID NO: 1673791 - RNA, 12 nt, Human
acaaggcaaggc

SEQ ID NO: 1673792 - RNA, 14 nt, Human
acaaggcaaggcug

SEQ ID NO: 1673793 - RNA, 17 nt, Human
acaaggauugcuacugu

SEQ ID NO: 1673794 - RNA, 13 nt, Human
acaagaaaugaaa

SEQ ID NO: 1673795 - RNA, 17 nt, Human
acacagauuugagcuca

SEQ ID NO: 1673796 - RNA, 20 nt, Human
acacagcucuguccugggag

SEQ ID NO: 1673797 - RNA, 19 nt, Human
acacagaggcugccucucc

SEQ ID NO: 1673798 - RNA, 22 nt, Human
acacauuuuuuaaaugcaccug

SEQ ID NO: 1673799 - RNA, 20 nt, Human
acacauuuuuuaaaugcacc

SEQ ID NO: 1673800 - RNA, 12 nt, Human
acacauuuuucu

SEQ ID NO: 1673801 - RNA, 22 nt, Human
acacauuuuauuuuauuaugca

SEQ ID NO: 1673802 - RNA, 11 nt, Human
acacagcucuu

SEQ ID NO: 1673803 - RNA, 13 nt, Human
acacagcucuucu

SEQ ID NO: 1673804 - RNA, 16 nt, Human
acacgcuccuuccucu

SEQ ID NO: 1673805 - RNA, 14 nt, Human
acacgcuccuuccu

SEQ ID NO: 1673806 - RNA, 14 nt, Human
acacgagcaggcua

SEQ ID NO: 1673807 - RNA, 19 nt, Human
acacgagcaggcuacuguc

SEQ ID NO: 1673808 - RNA, 15 nt, Human
acacgcgugcacaca

SEQ ID NO: 1673809 - RNA, 17 nt, Human
acacgcgugcacacacc

SEQ ID NO: 1673810 - RNA, 21 nt, Human
acacgagcaggcuacugucag

SEQ ID NO: 1673811 - RNA, 23 nt, Human
agaaaguacuucuccacccugcu

SEQ ID NO: 1673812 - RNA, 22 nt, Human
agaaaguacuucuccacccugc

SEQ ID NO: 1673813 - RNA, 14 nt, Human
agaaaguucaugcu

SEQ ID NO: 1673814 - RNA, 23 nt, Human
acuuuuaugauacuugaaaauua

SEQ ID NO: 1673815 - RNA, 23 nt, Human
acuuuuauuuccagugaaaucag

SEQ ID NO: 1673816 - RNA, 20 nt, Human
acuuuucauaaccuagccuu

SEQ ID NO: 1673817 - RNA, 16 nt, Human
acuuuucuuucagcca

SEQ ID NO: 1673818 - RNA, 14 nt, Human
acuuuucuuugugg

SEQ ID NO: 1673819 - RNA, 19 nt, Human
agaaaauaguggugugauu

SEQ ID NO: 1673820 - RNA, 15 nt, Human
agaaaauaccaagga

SEQ ID NO: 1673821 - RNA, 16 nt, Human
agaaaaucaggcuggc

SEQ ID NO: 1673822 - RNA, 12 nt, Human
acuuuuaugaua

SEQ ID NO: 1673823 - RNA, 16 nt, Human
acuuuuaugauacuug

SEQ ID NO: 1673824 - RNA, 13 nt, Human
acuuuuauaaacu

SEQ ID NO: 1673825 - RNA, 20 nt, Human
acuuuguucuggcucuucca

SEQ ID NO: 1673826 - RNA, 19 nt, Human
acuuuguucuggcucuucc

SEQ ID NO: 1673827 - RNA, 22 nt, Human
acuuuaucuugaauaauguaag

SEQ ID NO: 1673828 - RNA, 16 nt, Human
acuuuguucuggcucu

SEQ ID NO: 1673829 - RNA, 17 nt, Human
acuuuguucuggcucuu

SEQ ID NO: 1673830 - RNA, 22 nt, Human
acuuuauuuucuauaauuuaaa

SEQ ID NO: 1673831 - RNA, 22 nt, Human
acugugcugagucugaaggcug

SEQ ID NO: 1673832 - RNA, 20 nt, Human
acugugcugagucugaaggc

SEQ ID NO: 1673833 - RNA, 16 nt, Human
acuugguuuuuaaaaa

SEQ ID NO: 1673834 - RNA, 18 nt, Human
acuuguaaaggaauuuaa

SEQ ID NO: 1673835 - RNA, 14 nt, Human
acuugggccacugu

SEQ ID NO: 1673836 - RNA, 15 nt, Human
acuugggccacugug

SEQ ID NO: 1673837 - RNA, 22 nt, Human
acuucugucuucacaacagauu

SEQ ID NO: 1673838 - RNA, 12 nt, Human
acuucagacaua

SEQ ID NO: 1673839 - RNA, 21 nt, Human
acuucugucuucacaacagau

SEQ ID NO: 1673840 - RNA, 23 nt, Human
acuguuugagguuuuuaagccuu

SEQ ID NO: 1673841 - RNA, 18 nt, Human
acuguuugagguuuuuaa

SEQ ID NO: 1673842 - RNA, 13 nt, Human
acugccagcaacg

SEQ ID NO: 1673843 - RNA, 20 nt, Human
acucugucucaguccaugaa

SEQ ID NO: 1673844 - RNA, 18 nt, Human
acucugucucaguccaug

SEQ ID NO: 1673845 - RNA, 18 nt, Human
acugguaggaaacuaggu

SEQ ID NO: 1673846 - RNA, 15 nt, Human
acuggagaaaaugga

SEQ ID NO: 1673847 - RNA, 14 nt, Human
acugcccccucugc

SEQ ID NO: 1673848 - RNA, 15 nt, Human
acugcccccucugcc

SEQ ID NO: 1673849 - RNA, 19 nt, Human
acuggaagcacagcuucau

SEQ ID NO: 1673850 - RNA, 16 nt, Human
acugcccccucugccc

SEQ ID NO: 1673851 - RNA, 17 nt, Human
acugcccccucugcccu

SEQ ID NO: 1673852 - RNA, 17 nt, Human
acuggaagcacagcuuc

SEQ ID NO: 1673853 - RNA, 14 nt, Human
acuggugacugauu

SEQ ID NO: 1673854 - RNA, 16 nt, Human
acuggugacugauucu

SEQ ID NO: 1673855 - RNA, 18 nt, Human
acugguuccauggccucu

SEQ ID NO: 1673856 - RNA, 19 nt, Human
acuguaagaaaauaucacu

SEQ ID NO: 1673857 - RNA, 13 nt, Human
acuguaagaaaau

SEQ ID NO: 1673858 - RNA, 22 nt, Human
acuguaagaaaauaucacuugu

SEQ ID NO: 1673859 - RNA, 20 nt, Human
acugucucaagagggcacug

SEQ ID NO: 1673860 - RNA, 21 nt, Human
acugucucaagagggcacugg

SEQ ID NO: 1673861 - RNA, 23 nt, Human
acugucucaagagggcacuggug

SEQ ID NO: 1673862 - RNA, 20 nt, Human
accugcccugcugaguccca

SEQ ID NO: 1673863 - RNA, 16 nt, Human
accugucccccugaca

SEQ ID NO: 1673864 - RNA, 12 nt, Human
accugucccccu

SEQ ID NO: 1673865 - RNA, 15 nt, Human
accugucccccugac

SEQ ID NO: 1673866 - RNA, 17 nt, Human
accuuggcugcagggag

SEQ ID NO: 1673867 - RNA, 18 nt, Human
accuuggcugcagggagu

SEQ ID NO: 1673868 - RNA, 13 nt, Human
accuuucccaucu

SEQ ID NO: 1673869 - RNA, 18 nt, Human
accuuucccaucuuccaa

SEQ ID NO: 1673870 - RNA, 15 nt, Human
accuuuaagagaaau

SEQ ID NO: 1673871 - RNA, 20 nt, Human
accucugcagcaauaaagca

SEQ ID NO: 1673872 - RNA, 18 nt, Human
accucugcagcaauaaag

SEQ ID NO: 1673873 - RNA, 21 nt, Human
accucugcagcaauaaagcag

SEQ ID NO: 1673874 - RNA, 14 nt, Human
acggaacucaaaua

SEQ ID NO: 1673875 - RNA, 13 nt, Human
acgucugacaggc

SEQ ID NO: 1673876 - RNA, 14 nt, Human
acgucugacaggca

SEQ ID NO: 1673877 - RNA, 15 nt, Human
acgucugacaggcaa

SEQ ID NO: 1673878 - RNA, 15 nt, Human
acgcugugcugcccu

SEQ ID NO: 1673879 - RNA, 11 nt, Human
acgcugugcug

SEQ ID NO: 1673880 - RNA, 12 nt, Human
acgcugugcugc

SEQ ID NO: 1673881 - RNA, 14 nt, Human
acgcugugcugccc

SEQ ID NO: 1673882 - RNA, 22 nt, Human
acgcaggcccccaggugccagu

SEQ ID NO: 1673883 - RNA, 11 nt, Human
acgugaguccu

SEQ ID NO: 1673884 - RNA, 13 nt, Human
acuaagagagaau

SEQ ID NO: 1673885 - RNA, 15 nt, Human
acuaagagagaauga

SEQ ID NO: 1673886 - RNA, 15 nt, Human
acucauauuuucaug

SEQ ID NO: 1673887 - RNA, 15 nt, Human
acucuagggaaaaac

SEQ ID NO: 1673888 - RNA, 17 nt, Human
acucuagggaaaaacca

SEQ ID NO: 1673889 - RNA, 19 nt, Human
acucugucgcccagucugg

SEQ ID NO: 1673890 - RNA, 23 nt, Human
acucuaucaaguauuauaccuuu

SEQ ID NO: 1673891 - RNA, 17 nt, Human
acucuauguucuaagaa

SEQ ID NO: 1673892 - RNA, 19 nt, Human
acucaguccauagcagaga

SEQ ID NO: 1673893 - RNA, 13 nt, Human
acucaaaagcugg

SEQ ID NO: 1673894 - RNA, 18 nt, Human
acucaaaagcugggcagg

SEQ ID NO: 1673895 - RNA, 20 nt, Human
acuaguauuucuaugaaaua

SEQ ID NO: 1673896 - RNA, 21 nt, Human
acuauucaaacagucucagga

SEQ ID NO: 1673897 - RNA, 18 nt, Human
aaaaaauuggggauucuu

SEQ ID NO: 1673898 - RNA, 13 nt, Human
aaaaacacagcaa

SEQ ID NO: 1673899 - RNA, 18 nt, Human
aaaaacacagcaagggug

SEQ ID NO: 1673900 - RNA, 20 nt, Human
aaaaaccaguauuguacaaa

SEQ ID NO: 1673901 - RNA, 19 nt, Human
aaaaaccaucuguaaaaga

SEQ ID NO: 1673902 - RNA, 15 nt, Human
aaaaaauauuuuccu

SEQ ID NO: 1673903 - RNA, 15 nt, Human
caccccuaaagagau

SEQ ID NO: 1673904 - RNA, 19 nt, Human
cacccaagggccuggccug

SEQ ID NO: 1673905 - RNA, 20 nt, Human
cacccaagggccuggccuga

SEQ ID NO: 1673906 - RNA, 21 nt, Human
cacccaagggccuggccugag

SEQ ID NO: 1673907 - RNA, 23 nt, Human
cacccaagggccuggccugagcu

SEQ ID NO: 1673908 - RNA, 16 nt, Human
cacccaagggccuggc

SEQ ID NO: 1673909 - RNA, 17 nt, Human
cacccaagggccuggcc

SEQ ID NO: 1673910 - RNA, 18 nt, Human
cacccaagggccuggccu

SEQ ID NO: 1673911 - RNA, 15 nt, Human
cacccacccuuuuuu

SEQ ID NO: 1673912 - RNA, 20 nt, Human
cacccaccaucaugucuggc

SEQ ID NO: 1673913 - RNA, 22 nt, Human
cacccaccaucaugucuggcua

SEQ ID NO: 1673914 - RNA, 12 nt, Human
cacccaccucag

SEQ ID NO: 1673915 - RNA, 13 nt, Human
cacccaccucagc

SEQ ID NO: 1673916 - RNA, 14 nt, Human
cacccaccucagcc

SEQ ID NO: 1673917 - RNA, 16 nt, Human
cacccaccucagccuc

SEQ ID NO: 1673918 - RNA, 13 nt, Human
caccccagcccca

SEQ ID NO: 1673919 - RNA, 14 nt, Human
caccccuaaagaga

SEQ ID NO: 1673920 - RNA, 14 nt, Human
caccccggccaccu

SEQ ID NO: 1673921 - RNA, 15 nt, Human
caccccggccaccug

SEQ ID NO: 1673922 - RNA, 16 nt, Human
caccccggccaccugc

SEQ ID NO: 1673923 - RNA, 17 nt, Human
caccccggccaccugcg

SEQ ID NO: 1673924 - RNA, 22 nt, Human
cacccccacccaagggccuggc

SEQ ID NO: 1673925 - RNA, 12 nt, Human
caaauauauuca

SEQ ID NO: 1673926 - RNA, 19 nt, Human
caaaguugccuaaauccau

SEQ ID NO: 1673927 - RNA, 21 nt, Human
caaaggaugcccaaagaugca

SEQ ID NO: 1673928 - RNA, 13 nt, Human
caaaucagcugcu

SEQ ID NO: 1673929 - RNA, 15 nt, Human
caaaugucuuccugg

SEQ ID NO: 1673930 - RNA, 18 nt, Human
caaaugucuuccuggauu

SEQ ID NO: 1673931 - RNA, 16 nt, Human
caaaucagcugcuacu

SEQ ID NO: 1673932 - RNA, 18 nt, Human
caaauaugcaaagcacug

SEQ ID NO: 1673933 - RNA, 16 nt, Human
caaauaugcaaagcac

SEQ ID NO: 1673934 - RNA, 17 nt, Human
caaauaugcaaagcacu

SEQ ID NO: 1673935 - RNA, 22 nt, Human
caaauucugcuugcuugcuuuu

SEQ ID NO: 1673936 - RNA, 14 nt, Human
caaauguggcuccu

SEQ ID NO: 1673937 - RNA, 21 nt, Human
caaauguucaucaaugaauga

SEQ ID NO: 1673938 - RNA, 16 nt, Human
caaagcuuguuaagau

SEQ ID NO: 1673939 - RNA, 20 nt, Human
caaagccaaagcuaggccug

SEQ ID NO: 1673940 - RNA, 21 nt, Human
caaagccaaagcuaggccugg

SEQ ID NO: 1673941 - RNA, 22 nt, Human
caaagccaaagcuaggccuggc

SEQ ID NO: 1673942 - RNA, 16 nt, Human
caaagcuaggccuggc

SEQ ID NO: 1673943 - RNA, 17 nt, Human
caaagcuaggccuggcc

SEQ ID NO: 1673944 - RNA, 18 nt, Human
caaagcuaggccuggcca

SEQ ID NO: 1673945 - RNA, 18 nt, Human
auuuuuuuacuaauagac

SEQ ID NO: 1673946 - RNA, 22 nt, Human
caagugauucuccugccucagc

SEQ ID NO: 1673947 - RNA, 22 nt, Human
caagugugguagagugugccug

SEQ ID NO: 1673948 - RNA, 22 nt, Human
caagugauucucaugccucagc

SEQ ID NO: 1673949 - RNA, 19 nt, Human
caagugaaaaaggaggaag

SEQ ID NO: 1673950 - RNA, 16 nt, Human
caagugauucuccugc

SEQ ID NO: 1673951 - RNA, 17 nt, Human
caagugauucuccugcc

SEQ ID NO: 1673952 - RNA, 15 nt, Human
caaggauugcuacug

SEQ ID NO: 1673953 - RNA, 19 nt, Human
caaggauugcuacuguccu

SEQ ID NO: 1673954 - RNA, 19 nt, Human
caagggccuggccugagcu

SEQ ID NO: 1673955 - RNA, 12 nt, Human
caaggugggagg

SEQ ID NO: 1673956 - RNA, 23 nt, Human
caaggugggaggauugcuugagc

SEQ ID NO: 1673957 - RNA, 14 nt, Human
caaggacuaggguc

SEQ ID NO: 1673958 - RNA, 13 nt, Human
caaggauccugag

SEQ ID NO: 1673959 - RNA, 19 nt, Human
caaggaugccccguccccc

SEQ ID NO: 1673960 - RNA, 21 nt, Human
caaggaugaucuaggaagacu

SEQ ID NO: 1673961 - RNA, 17 nt, Human
caagcgugagccacugc

SEQ ID NO: 1673962 - RNA, 18 nt, Human
caagcgugagccacugca

SEQ ID NO: 1673963 - RNA, 21 nt, Human
caagccaccaacauacuccca

SEQ ID NO: 1673964 - RNA, 14 nt, Human
caagccguggcuuc

SEQ ID NO: 1673965 - RNA, 15 nt, Human
caagccguggcuucc

SEQ ID NO: 1673966 - RNA, 16 nt, Human
caagccguggcuuccc

SEQ ID NO: 1673967 - RNA, 17 nt, Human
caagccguggcuucccg

SEQ ID NO: 1673968 - RNA, 16 nt, Human
caagcgugagccacug

SEQ ID NO: 1673969 - RNA, 17 nt, Human
caagcacuaaacaaaga

SEQ ID NO: 1673970 - RNA, 18 nt, Human
caagcaccuccugccucg

SEQ ID NO: 1673971 - RNA, 22 nt, Human
caagccaccaacauacucccau

SEQ ID NO: 1673972 - RNA, 21 nt, Human
caacccucagagccaccccua

SEQ ID NO: 1673973 - RNA, 22 nt, Human
caaccccuucgcuccugugucu

SEQ ID NO: 1673974 - RNA, 21 nt, Human
caaccccuucgcuccuguguc

SEQ ID NO: 1673975 - RNA, 18 nt, Human
caaccccuucgcuccugu

SEQ ID NO: 1673976 - RNA, 19 nt, Human
caaccccuucgcuccugug

SEQ ID NO: 1673977 - RNA, 22 nt, Human
caacaucuuggucagauuugaa

SEQ ID NO: 1673978 - RNA, 19 nt, Human
caacagguuuuccugaaga

SEQ ID NO: 1673979 - RNA, 18 nt, Human
caacaggguuuuuuucca

SEQ ID NO: 1673980 - RNA, 15 nt, Human
caacagguuuuccug

SEQ ID NO: 1673981 - RNA, 15 nt, Human
caaauucugucucug

SEQ ID NO: 1673982 - RNA, 18 nt, Human
caaauucugucucuggau

SEQ ID NO: 1673983 - RNA, 14 nt, Human
caaauuuacagaga

SEQ ID NO: 1673984 - RNA, 24 nt, Human
caacaggcugggcuucaguggcag

SEQ ID NO: 1673985 - RNA, 16 nt, Human
caaauuuacagagaca

SEQ ID NO: 1673986 - RNA, 23 nt, Human
caacaggcugggcuucaguggca

SEQ ID NO: 1673987 - RNA, 15 nt, Human
caaauuuacagagac

SEQ ID NO: 1673988 - RNA, 12 nt, Human
caacgcagcccu

SEQ ID NO: 1673989 - RNA, 13 nt, Human
caacgcagcccug

SEQ ID NO: 1673990 - RNA, 15 nt, Human
caacgcagcccugcu

SEQ ID NO: 1673991 - RNA, 18 nt, Human
caacgcagcccugcuuug

SEQ ID NO: 1673992 - RNA, 19 nt, Human
caacucuccuccagaguca

SEQ ID NO: 1673993 - RNA, 16 nt, Human
caaccugauugugucu

SEQ ID NO: 1673994 - RNA, 12 nt, Human
caacccucauca

SEQ ID NO: 1673995 - RNA, 15 nt, Human
caacccucaucacca

SEQ ID NO: 1673996 - RNA, 21 nt, Human
caacucugaaggguaauuaua

SEQ ID NO: 1673997 - RNA, 20 nt, Human
caacucuccuccagagucag

SEQ ID NO: 1673998 - RNA, 11 nt, Human
caacuuuguau

SEQ ID NO: 1673999 - RNA, 12 nt, Human
caacuuuguaua

SEQ ID NO: 1674000 - RNA, 19 nt, Human
caaugugaaaagaaaaaug

SEQ ID NO: 1674001 - RNA, 21 nt, Human
caauaggaaaaacugauuuuu

SEQ ID NO: 1674002 - RNA, 20 nt, Human
caauaggaaaaacugauuuu

SEQ ID NO: 1674003 - RNA, 23 nt, Human
caaugcacuuuguucuggcucuu

SEQ ID NO: 1674004 - RNA, 19 nt, Human
caaugcaaaccaucauuga

SEQ ID NO: 1674005 - RNA, 20 nt, Human
caaugcaaaccaucauugaa

SEQ ID NO: 1674006 - RNA, 17 nt, Human
caaugcaaaccaucauu

SEQ ID NO: 1674007 - RNA, 18 nt, Human
caaugcaaaccaucauug

SEQ ID NO: 1674008 - RNA, 13 nt, Human
caaugaccuuuca

SEQ ID NO: 1674009 - RNA, 22 nt, Human
caaugaaugaaugaauggcuaa

SEQ ID NO: 1674010 - RNA, 16 nt, Human
cacaaaaguuucucuu

SEQ ID NO: 1674011 - RNA, 18 nt, Human
cacaaaaguuucucuuuu

SEQ ID NO: 1674012 - RNA, 17 nt, Human
cacaaccuucuguggcu

SEQ ID NO: 1674013 - RNA, 18 nt, Human
cacaaccuucuguggcuc

SEQ ID NO: 1674014 - RNA, 19 nt, Human
cacaaccuucuguggcuca

SEQ ID NO: 1674015 - RNA, 23 nt, Human
cacaaccuucuguggcucacaga

SEQ ID NO: 1674016 - RNA, 22 nt, Human
cacaacacacagauuugagcuc

SEQ ID NO: 1674017 - RNA, 21 nt, Human
cacaaauucugucucuggauu

SEQ ID NO: 1674018 - RNA, 11 nt, Human
cacaacagauu

SEQ ID NO: 1674019 - RNA, 13 nt, Human
caauuaaggauuu

SEQ ID NO: 1674020 - RNA, 15 nt, Human
caauuaaggauuuua

SEQ ID NO: 1674021 - RNA, 20 nt, Human
caauuaaggauuuuaugcuu

SEQ ID NO: 1674022 - RNA, 23 nt, Human
caauuaaggauuuuaugcuuuaa

SEQ ID NO: 1674023 - RNA, 21 nt, Human
caauuaaggauuuuaugcuuu

SEQ ID NO: 1674024 - RNA, 22 nt, Human
caauuaaggauuuuaugcuuua

SEQ ID NO: 1674025 - RNA, 21 nt, Human
cacacuugacaucaacugcau

SEQ ID NO: 1674026 - RNA, 12 nt, Human
cacagagaaagu

SEQ ID NO: 1674027 - RNA, 17 nt, Human
cacagaguuguuacauu

SEQ ID NO: 1674028 - RNA, 16 nt, Human
cacagaguuguuacau

SEQ ID NO: 1674029 - RNA, 18 nt, Human
cacacuucaggcucuucu

SEQ ID NO: 1674030 - RNA, 20 nt, Human
cacacuucaggcucuucucc

SEQ ID NO: 1674031 - RNA, 21 nt, Human
cacacuucaggcucuucuccu

SEQ ID NO: 1674032 - RNA, 22 nt, Human
cacacuucaggcucuucuccuu

SEQ ID NO: 1674033 - RNA, 14 nt, Human
cacacuucaggcuc

SEQ ID NO: 1674034 - RNA, 17 nt, Human
cacacuucaggcucuuc

SEQ ID NO: 1674035 - RNA, 19 nt, Human
cacacucaaaucaagaaac

SEQ ID NO: 1674036 - RNA, 13 nt, Human
cacacccagccca

SEQ ID NO: 1674037 - RNA, 15 nt, Human
cacaccagagcccac

SEQ ID NO: 1674038 - RNA, 12 nt, Human
cacaccagagcc

SEQ ID NO: 1674039 - RNA, 13 nt, Human
cacaccagagccc

SEQ ID NO: 1674040 - RNA, 14 nt, Human
cacacccuguuuua

SEQ ID NO: 1674041 - RNA, 17 nt, Human
cacaccgggcacucaga

SEQ ID NO: 1674042 - RNA, 19 nt, Human
cacacagaggcugccucuc

SEQ ID NO: 1674043 - RNA, 21 nt, Human
cacacagaggcugccucuccc

SEQ ID NO: 1674044 - RNA, 12 nt, Human
cacacagcucug

SEQ ID NO: 1674045 - RNA, 14 nt, Human
cacacaccagagcc

SEQ ID NO: 1674046 - RNA, 13 nt, Human
cacaacuauauug

SEQ ID NO: 1674047 - RNA, 16 nt, Human
cacauuccugaacagg

SEQ ID NO: 1674048 - RNA, 16 nt, Human
cacauuccugaugcuu

SEQ ID NO: 1674049 - RNA, 13 nt, Human
cacauguggacuu

SEQ ID NO: 1674050 - RNA, 17 nt, Human
cacaugugcacaugcac

SEQ ID NO: 1674051 - RNA, 14 nt, Human
cacaugugcacaug

SEQ ID NO: 1674052 - RNA, 15 nt, Human
cacaugugcacaugc

SEQ ID NO: 1674053 - RNA, 19 nt, Human
cacaugccucucucaggcc

SEQ ID NO: 1674054 - RNA, 18 nt, Human
cacaucagcacgauuucu

SEQ ID NO: 1674055 - RNA, 12 nt, Human
cacauaucuguc

SEQ ID NO: 1674056 - RNA, 14 nt, Human
cacauaucugucau

SEQ ID NO: 1674057 - RNA, 19 nt, Human
cacaucagcacgauuucug

SEQ ID NO: 1674058 - RNA, 13 nt, Human
cacaugccucucu

SEQ ID NO: 1674059 - RNA, 17 nt, Human
cacaugccucucucagg

SEQ ID NO: 1674060 - RNA, 18 nt, Human
cacaugccucucucaggc

SEQ ID NO: 1674061 - RNA, 20 nt, Human
cacauugguguuguacucaa

SEQ ID NO: 1674062 - RNA, 15 nt, Human
caccaagcccaguua

SEQ ID NO: 1674063 - RNA, 18 nt, Human
cacauuggagauguuuag

SEQ ID NO: 1674064 - RNA, 17 nt, Human
cacauuggaaacaaguc

SEQ ID NO: 1674065 - RNA, 13 nt, Human
caccacacccagc

SEQ ID NO: 1674066 - RNA, 15 nt, Human
caccacacccagccc

SEQ ID NO: 1674067 - RNA, 17 nt, Human
caccacacccagcccac

SEQ ID NO: 1674068 - RNA, 19 nt, Human
caccacaugugcacaugca

SEQ ID NO: 1674069 - RNA, 15 nt, Human
caccacaugugcaca

SEQ ID NO: 1674070 - RNA, 18 nt, Human
caccacaugugcacaugc

SEQ ID NO: 1674071 - RNA, 18 nt, Human
caccacuacauucuguua

SEQ ID NO: 1674072 - RNA, 17 nt, Human
caccacuacauucuguu

SEQ ID NO: 1674073 - RNA, 16 nt, Human
caccacuacauucugu

SEQ ID NO: 1674074 - RNA, 14 nt, Human
caccaccucuuugg

SEQ ID NO: 1674075 - RNA, 20 nt, Human
caccacuacauucuguuaau

SEQ ID NO: 1674076 - RNA, 19 nt, Human
caccacuacauucuguuaa

SEQ ID NO: 1674077 - RNA, 21 nt, Human
cacagugagucgaggacaggg

SEQ ID NO: 1674078 - RNA, 17 nt, Human
cacaggaucagucugau

SEQ ID NO: 1674079 - RNA, 10 nt, Human
cacaggcagg

SEQ ID NO: 1674080 - RNA, 16 nt, Human
cacaggcccggcucca

SEQ ID NO: 1674081 - RNA, 17 nt, Human
cacaggcccggcuccag

SEQ ID NO: 1674082 - RNA, 18 nt, Human
cacaggcccggcuccagg

SEQ ID NO: 1674083 - RNA, 19 nt, Human
cacaggcccggcuccaggc

SEQ ID NO: 1674084 - RNA, 12 nt, Human
cacaggaucagu

SEQ ID NO: 1674085 - RNA, 15 nt, Human
cacaggaucagucug

SEQ ID NO: 1674086 - RNA, 16 nt, Human
cacaggaucagucuga

SEQ ID NO: 1674087 - RNA, 19 nt, Human
cacaggaaccacaagacug

SEQ ID NO: 1674088 - RNA, 20 nt, Human
cacaggaaccacaagacugc

SEQ ID NO: 1674089 - RNA, 15 nt, Human
cacaggaaguagagg

SEQ ID NO: 1674090 - RNA, 19 nt, Human
cacagugagucgaggacag

SEQ ID NO: 1674091 - RNA, 20 nt, Human
cacagugagucgaggacagg

SEQ ID NO: 1674092 - RNA, 15 nt, Human
cacaggcccuuccuc

SEQ ID NO: 1674093 - RNA, 18 nt, Human
cacagugagucgaggaca

SEQ ID NO: 1674094 - RNA, 20 nt, Human
cacaggcccggcuccaggcu

SEQ ID NO: 1674095 - RNA, 23 nt, Human
cacaggcccggcuccaggcuccu

SEQ ID NO: 1674096 - RNA, 22 nt, Human
cacauaauucaggaagcagcuu

SEQ ID NO: 1674097 - RNA, 15 nt, Human
cacaguuuucugaga

SEQ ID NO: 1674098 - RNA, 14 nt, Human
cacaguuuucugag

SEQ ID NO: 1674099 - RNA, 17 nt, Human
cacauacacacacacgc

SEQ ID NO: 1674100 - RNA, 23 nt, Human
cacagaugggugcuuggaggaag

SEQ ID NO: 1674101 - RNA, 16 nt, Human
cacagcagccccugca

SEQ ID NO: 1674102 - RNA, 20 nt, Human
cacagcacgggggccaagga

SEQ ID NO: 1674103 - RNA, 20 nt, Human
cacagaugggugcuuggagg

SEQ ID NO: 1674104 - RNA, 21 nt, Human
cacagaguuguuacauuuuua

SEQ ID NO: 1674105 - RNA, 20 nt, Human
cacagaguuguuacauuuuu

SEQ ID NO: 1674106 - RNA, 14 nt, Human
cacagaugggugcu

SEQ ID NO: 1674107 - RNA, 18 nt, Human
cacagaugggugcuugga

SEQ ID NO: 1674108 - RNA, 22 nt, Human
cacagcaguugaaaagacucca

SEQ ID NO: 1674109 - RNA, 16 nt, Human
uugagccuugaacuuu

SEQ ID NO: 1674110 - RNA, 15 nt, Human
uugagccuugaacuu

SEQ ID NO: 1674111 - RNA, 14 nt, Human
uugagccuugaacu

SEQ ID NO: 1674112 - RNA, 14 nt, Human
uugaauuguaagga

SEQ ID NO: 1674113 - RNA, 13 nt, Human
uugagcucagccc

SEQ ID NO: 1674114 - RNA, 19 nt, Human
uugagccuugaacuuugac

SEQ ID NO: 1674115 - RNA, 17 nt, Human
uugauccagaaagaaaa

SEQ ID NO: 1674116 - RNA, 17 nt, Human
uugauucagacagcugc

SEQ ID NO: 1674117 - RNA, 21 nt, Human
uugauucagacagcugccugg

SEQ ID NO: 1674118 - RNA, 23 nt, Human
uugauucagacagcugccuggga

SEQ ID NO: 1674119 - RNA, 16 nt, Human
uugauucagcucugca

SEQ ID NO: 1674120 - RNA, 22 nt, Human
uugauauuuucaacgcagcccu

SEQ ID NO: 1674121 - RNA, 16 nt, Human
uugauaugugaacagu

SEQ ID NO: 1674122 - RNA, 16 nt, Human
uugauaugcuuauaca

SEQ ID NO: 1674123 - RNA, 20 nt, Human
uugauaugccuuuucccaac

SEQ ID NO: 1674124 - RNA, 23 nt, Human
uugcagacaggcaagcaccuccu

SEQ ID NO: 1674125 - RNA, 13 nt, Human
uugauucauaaug

SEQ ID NO: 1674126 - RNA, 17 nt, Human
uugauucauaaugacuu

SEQ ID NO: 1674127 - RNA, 16 nt, Human
uugcauaacguauaaa

SEQ ID NO: 1674128 - RNA, 13 nt, Human
uugccagucaccc

SEQ ID NO: 1674129 - RNA, 13 nt, Human
uugccaucccucc

SEQ ID NO: 1674130 - RNA, 16 nt, Human
uugccauguuggccag

SEQ ID NO: 1674131 - RNA, 17 nt, Human
uugccauguuggccagg

SEQ ID NO: 1674132 - RNA, 18 nt, Human
uugccauguuggccaggc

SEQ ID NO: 1674133 - RNA, 19 nt, Human
uugccauguuggccaggcu

SEQ ID NO: 1674134 - RNA, 18 nt, Human
uugccaucccucccucca

SEQ ID NO: 1674135 - RNA, 17 nt, Human
uugccaucccucccucc

SEQ ID NO: 1674136 - RNA, 16 nt, Human
uugccaucccucccuc

SEQ ID NO: 1674137 - RNA, 14 nt, Human
uugccaucccuccc

SEQ ID NO: 1674138 - RNA, 23 nt, Human
uugccaucccucccuccaccucc

SEQ ID NO: 1674139 - RNA, 22 nt, Human
uugccaucccucccuccaccuc

SEQ ID NO: 1674140 - RNA, 14 nt, Human
uucuuguguguuua

SEQ ID NO: 1674141 - RNA, 19 nt, Human
uucuuguauuaagaaugaa

SEQ ID NO: 1674142 - RNA, 17 nt, Human
uucuuauguugcccagu

SEQ ID NO: 1674143 - RNA, 13 nt, Human
uucuucagagacu

SEQ ID NO: 1674144 - RNA, 17 nt, Human
uucuuagggaaggauac

SEQ ID NO: 1674145 - RNA, 19 nt, Human
uucuuaggguuaugauuaa

SEQ ID NO: 1674146 - RNA, 14 nt, Human
uucuguauagauua

SEQ ID NO: 1674147 - RNA, 13 nt, Human
uucuguauagauu

SEQ ID NO: 1674148 - RNA, 11 nt, Human
uucuguauaga

SEQ ID NO: 1674149 - RNA, 16 nt, Human
uucuggcuaugcauuu

SEQ ID NO: 1674150 - RNA, 20 nt, Human
uucuggcagaguugaagaca

SEQ ID NO: 1674151 - RNA, 24 nt, Human
uucuaaguaaaaccacagcaguug

SEQ ID NO: 1674152 - RNA, 18 nt, Human
uugaaaauuaacaugaau

SEQ ID NO: 1674153 - RNA, 16 nt, Human
uugaaacggaugauuu

SEQ ID NO: 1674154 - RNA, 19 nt, Human
uugaaacggaugauuucua

SEQ ID NO: 1674155 - RNA, 15 nt, Human
uugaacuuugaccuc

SEQ ID NO: 1674156 - RNA, 17 nt, Human
uucuuuaauuuuggaau

SEQ ID NO: 1674157 - RNA, 18 nt, Human
uucuuuaauuuuggaauu

SEQ ID NO: 1674158 - RNA, 12 nt, Human
uucuuuaauuuu

SEQ ID NO: 1674159 - RNA, 18 nt, Human
uucuuuccacagaagcuc

SEQ ID NO: 1674160 - RNA, 21 nt, Human
uucuuuccugaggcugggcuc

SEQ ID NO: 1674161 - RNA, 21 nt, Human
uugaaaaucuuauaauuuaaa

SEQ ID NO: 1674162 - RNA, 21 nt, Human
uugaagagguuuuaaagcuuc

SEQ ID NO: 1674163 - RNA, 20 nt, Human
uugaagcacagugaucaagu

SEQ ID NO: 1674164 - RNA, 16 nt, Human
uugaagagguuuuaaa

SEQ ID NO: 1674165 - RNA, 20 nt, Human
uugaaacggaugauuucuau

SEQ ID NO: 1674166 - RNA, 20 nt, Human
uugaacuuugaccucugcag

SEQ ID NO: 1674167 - RNA, 18 nt, Human
uugaacuuugaccucugc

SEQ ID NO: 1674168 - RNA, 17 nt, Human
uugaacuuugaccucug

SEQ ID NO: 1674169 - RNA, 12 nt, Human
uugaaugaugcc

SEQ ID NO: 1674170 - RNA, 16 nt, Human
uugaaugaugccauga

SEQ ID NO: 1674171 - RNA, 13 nt, Human
uugaagcauuuua

SEQ ID NO: 1674172 - RNA, 14 nt, Human
uugaagcauuuuau

SEQ ID NO: 1674173 - RNA, 15 nt, Human
uugaagcauuuuaua

SEQ ID NO: 1674174 - RNA, 17 nt, Human
uugaagcauuuuauaaa

SEQ ID NO: 1674175 - RNA, 22 nt, Human
uugaagcauuuuauaaaucgcu

SEQ ID NO: 1674176 - RNA, 23 nt, Human
uugaagcauuuuauaaaucgcuu

SEQ ID NO: 1674177 - RNA, 18 nt, Human
uuggacaaaauggaauac

SEQ ID NO: 1674178 - RNA, 19 nt, Human
uuggaagcuccgcuuucua

SEQ ID NO: 1674179 - RNA, 15 nt, Human
uuggauuguccccga

SEQ ID NO: 1674180 - RNA, 15 nt, Human
uuggacccugaggcc

SEQ ID NO: 1674181 - RNA, 18 nt, Human
uuggacccugaggcccag

SEQ ID NO: 1674182 - RNA, 19 nt, Human
uuggacccugaggcccaga

SEQ ID NO: 1674183 - RNA, 21 nt, Human
uuggacccugaggcccagagg

SEQ ID NO: 1674184 - RNA, 12 nt, Human
uugccuuuuuca

SEQ ID NO: 1674185 - RNA, 13 nt, Human
uugccuuuuucau

SEQ ID NO: 1674186 - RNA, 14 nt, Human
uugccuuuuucauu

SEQ ID NO: 1674187 - RNA, 15 nt, Human
uugccuuuuucauua

SEQ ID NO: 1674188 - RNA, 16 nt, Human
uugccuuuuucauuau

SEQ ID NO: 1674189 - RNA, 17 nt, Human
uugccuuuuucauuauu

SEQ ID NO: 1674190 - RNA, 20 nt, Human
uugccauguuggccaggcug

SEQ ID NO: 1674191 - RNA, 21 nt, Human
uugccauguuggccaggcugg

SEQ ID NO: 1674192 - RNA, 16 nt, Human
uugcugucccuuuucc

SEQ ID NO: 1674193 - RNA, 18 nt, Human
uugcugucccuuuuccuu

SEQ ID NO: 1674194 - RNA, 14 nt, Human
uugcugcuugaggc

SEQ ID NO: 1674195 - RNA, 16 nt, Human
uugcugcuugaggcaa

SEQ ID NO: 1674196 - RNA, 16 nt, Human
uugcuaagcauuccaa

SEQ ID NO: 1674197 - RNA, 18 nt, Human
uugcuaagcauuccaacu

SEQ ID NO: 1674198 - RNA, 19 nt, Human
uuggcauaacauaaaucug

SEQ ID NO: 1674199 - RNA, 20 nt, Human
uuggcauaacauaaaucugu

SEQ ID NO: 1674200 - RNA, 22 nt, Human
uuggcauaacauaaaucuguga

SEQ ID NO: 1674201 - RNA, 23 nt, Human
uuggcauaacauaaaucugugaa

SEQ ID NO: 1674202 - RNA, 18 nt, Human
uuggcauaacauaaaucu

SEQ ID NO: 1674203 - RNA, 23 nt, Human
uuggcuucacggaagagccuugc

SEQ ID NO: 1674204 - RNA, 20 nt, Human
uugguaaggggaauugagga

SEQ ID NO: 1674205 - RNA, 20 nt, Human
uuggucugacccacugcuuu

SEQ ID NO: 1674206 - RNA, 15 nt, Human
uuggucugugagaug

SEQ ID NO: 1674207 - RNA, 12 nt, Human
uuguaaaauggu

SEQ ID NO: 1674208 - RNA, 13 nt, Human
uuguaaaauggug

SEQ ID NO: 1674209 - RNA, 17 nt, Human
uugucugaagucacugc

SEQ ID NO: 1674210 - RNA, 18 nt, Human
uugucugaagucacugca

SEQ ID NO: 1674211 - RNA, 20 nt, Human
uugucuaugggacucaaugc

SEQ ID NO: 1674212 - RNA, 22 nt, Human
uuguaugaaagauggcugugcc

SEQ ID NO: 1674213 - RNA, 20 nt, Human
uuguaugauccuaaugaaug

SEQ ID NO: 1674214 - RNA, 22 nt, Human
uugucaaaguggugagaggcau

SEQ ID NO: 1674215 - RNA, 14 nt, Human
uugucuaugggacu

SEQ ID NO: 1674216 - RNA, 20 nt, Human
uuguaaaauggugugaccac

SEQ ID NO: 1674217 - RNA, 16 nt, Human
uuguaccgcaauguga

SEQ ID NO: 1674218 - RNA, 18 nt, Human
uuguacuuuagggaagua

SEQ ID NO: 1674219 - RNA, 17 nt, Human
uuguagaagucacauuc

SEQ ID NO: 1674220 - RNA, 22 nt, Human
uuguagaagucacauuccugaa

SEQ ID NO: 1674221 - RNA, 15 nt, Human
uuguagcauccugga

SEQ ID NO: 1674222 - RNA, 13 nt, Human
uuuaacagaaaug

SEQ ID NO: 1674223 - RNA, 16 nt, Human
uuuaaaaugagaaauc

SEQ ID NO: 1674224 - RNA, 12 nt, Human
uuuaaaaugucu

SEQ ID NO: 1674225 - RNA, 19 nt, Human
uuuaaaauacacacucaaa

SEQ ID NO: 1674226 - RNA, 20 nt, Human
uuuaaaaguauauaauaaaa

SEQ ID NO: 1674227 - RNA, 16 nt, Human
uuuaaaaucauuucug

SEQ ID NO: 1674228 - RNA, 13 nt, Human
uuuaaaagauaca

SEQ ID NO: 1674229 - RNA, 14 nt, Human
uuuaaaagaaugau

SEQ ID NO: 1674230 - RNA, 17 nt, Human
uuuaaaagaaugauuau

SEQ ID NO: 1674231 - RNA, 12 nt, Human
uuguuucuguac

SEQ ID NO: 1674232 - RNA, 14 nt, Human
uuguuucuguacuu

SEQ ID NO: 1674233 - RNA, 20 nt, Human
uuguuuggggaugagaaagg

SEQ ID NO: 1674234 - RNA, 13 nt, Human
uuguuuguuuagu

SEQ ID NO: 1674235 - RNA, 14 nt, Human
uuguuuguuuaguc

SEQ ID NO: 1674236 - RNA, 20 nt, Human
uugucuuuggacccugaggc

SEQ ID NO: 1674237 - RNA, 24 nt, Human
uugucuuuggacccugaggcccag

SEQ ID NO: 1674238 - RNA, 15 nt, Human
uugucuuuggacccu

SEQ ID NO: 1674239 - RNA, 18 nt, Human
uuguuuaaaaucauuucu

SEQ ID NO: 1674240 - RNA, 17 nt, Human
uuguuuaaaaucauuuc

SEQ ID NO: 1674241 - RNA, 14 nt, Human
uuuaauaaacacuc

SEQ ID NO: 1674242 - RNA, 15 nt, Human
uuuaauaaacacucu

SEQ ID NO: 1674243 - RNA, 14 nt, Human
uuuaaccucuaaau

SEQ ID NO: 1674244 - RNA, 15 nt, Human
uuuaacagaaaugua

SEQ ID NO: 1674245 - RNA, 14 nt, Human
uuuaacagaaaugu

SEQ ID NO: 1674246 - RNA, 22 nt, Human
uuuaauaaacacucuugaaaaa

SEQ ID NO: 1674247 - RNA, 13 nt, Human
uuuaauaaaccau

SEQ ID NO: 1674248 - RNA, 14 nt, Human
uuuaauaauguuuc

SEQ ID NO: 1674249 - RNA, 15 nt, Human
uuuaauaauguuuca

SEQ ID NO: 1674250 - RNA, 14 nt, Human
uuuaauaauuauau

SEQ ID NO: 1674251 - RNA, 19 nt, Human
uuuaauaauguuucaaaca

SEQ ID NO: 1674252 - RNA, 13 nt, Human
uuuacagcugccu

SEQ ID NO: 1674253 - RNA, 16 nt, Human
uuuacauggcuggagc

SEQ ID NO: 1674254 - RNA, 15 nt, Human
uuuaauauuaaagcc

SEQ ID NO: 1674255 - RNA, 17 nt, Human
uuuaauauuaaagccau

SEQ ID NO: 1674256 - RNA, 20 nt, Human
uuuaauauuaaagccauguu

SEQ ID NO: 1674257 - RNA, 21 nt, Human
uuuaauauuaaagccauguuu

SEQ ID NO: 1674258 - RNA, 14 nt, Human
uuuaauauuaaagc

SEQ ID NO: 1674259 - RNA, 13 nt, Human
uuuacagagacag

SEQ ID NO: 1674260 - RNA, 17 nt, Human
uuuaguugcaacuuugu

SEQ ID NO: 1674261 - RNA, 18 nt, Human
uuuaguugcaacuuugua

SEQ ID NO: 1674262 - RNA, 22 nt, Human
uuuagacccuauugcugcuuga

SEQ ID NO: 1674263 - RNA, 19 nt, Human
uuuagacccuauugcugcu

SEQ ID NO: 1674264 - RNA, 18 nt, Human
uuuauaaacuuuaccuuu

SEQ ID NO: 1674265 - RNA, 15 nt, Human
uuuauaaaucgcuuu

SEQ ID NO: 1674266 - RNA, 18 nt, Human
uuuauaaaucgcuuuuga

SEQ ID NO: 1674267 - RNA, 22 nt, Human
uuuauaaaucgcuuuugauaau

SEQ ID NO: 1674268 - RNA, 19 nt, Human
uuuauaaaucgcuuuugau

SEQ ID NO: 1674269 - RNA, 20 nt, Human
uuuauacauaaacaagacca

SEQ ID NO: 1674270 - RNA, 12 nt, Human
uuuauacauaaa

SEQ ID NO: 1674271 - RNA, 20 nt, Human
uuuaugacuucauuaauaau

SEQ ID NO: 1674272 - RNA, 15 nt, Human
uuucugauccaguuu

SEQ ID NO: 1674273 - RNA, 16 nt, Human
uuucugauccaguuuu

SEQ ID NO: 1674274 - RNA, 20 nt, Human
uuucugauccaguuuuguuu

SEQ ID NO: 1674275 - RNA, 22 nt, Human
uuucugauccaguuuuguuugg

SEQ ID NO: 1674276 - RNA, 13 nt, Human
uuucugauccagu

SEQ ID NO: 1674277 - RNA, 12 nt, Human
uuucugaaauuu

SEQ ID NO: 1674278 - RNA, 14 nt, Human
uuucugaaauaaca

SEQ ID NO: 1674279 - RNA, 22 nt, Human
uuucuacccagcgagcccuggu

SEQ ID NO: 1674280 - RNA, 15 nt, Human
uuucuacccagcgag

SEQ ID NO: 1674281 - RNA, 18 nt, Human
uuucuacccagcgagccc

SEQ ID NO: 1674282 - RNA, 12 nt, Human
uuucucuaggaa

SEQ ID NO: 1674283 - RNA, 22 nt, Human
uuuccucuuagucgagccaagu

SEQ ID NO: 1674284 - RNA, 23 nt, Human
uuuccuggcacugcuuccaguga

SEQ ID NO: 1674285 - RNA, 19 nt, Human
uuuccuggcacugcuucca

SEQ ID NO: 1674286 - RNA, 17 nt, Human
uuucuaaaguaaaaaca

SEQ ID NO: 1674287 - RNA, 22 nt, Human
uuucuaaaguaaaaacaaagaa

SEQ ID NO: 1674288 - RNA, 19 nt, Human
uuucuaaaucuccaaaaua

SEQ ID NO: 1674289 - RNA, 20 nt, Human
uuuccuaaauauauuuuaag

SEQ ID NO: 1674290 - RNA, 22 nt, Human
uuuaugauacuugaaaauuaac

SEQ ID NO: 1674291 - RNA, 12 nt, Human
uuuaugcuuuaa

SEQ ID NO: 1674292 - RNA, 17 nt, Human
uuuauggcacuaguauu

SEQ ID NO: 1674293 - RNA, 15 nt, Human
uuuaugcuuuaaaca

SEQ ID NO: 1674294 - RNA, 16 nt, Human
uuuaugcuuuaaacau

SEQ ID NO: 1674295 - RNA, 17 nt, Human
uuucagccaagaauucu

SEQ ID NO: 1674296 - RNA, 14 nt, Human
uuugauaugugaac

SEQ ID NO: 1674297 - RNA, 18 nt, Human
uuugauaaucaacugggc

SEQ ID NO: 1674298 - RNA, 15 nt, Human
uuugauaugugaaca

SEQ ID NO: 1674299 - RNA, 17 nt, Human
uuugauaugugaacagu

SEQ ID NO: 1674300 - RNA, 14 nt, Human
uuugauccaagcug

SEQ ID NO: 1674301 - RNA, 15 nt, Human
uuuggacccugaggc

SEQ ID NO: 1674302 - RNA, 19 nt, Human
uuuggacccugaggcccag

SEQ ID NO: 1674303 - RNA, 16 nt, Human
uuugcuugaaagaaaa

SEQ ID NO: 1674304 - RNA, 14 nt, Human
uuugcuugaaagaa

SEQ ID NO: 1674305 - RNA, 16 nt, Human
uuuguaugcacuuugu

SEQ ID NO: 1674306 - RNA, 15 nt, Human
uuuguauucucuccu

SEQ ID NO: 1674307 - RNA, 18 nt, Human
uuugguaaggggaauuga

SEQ ID NO: 1674308 - RNA, 17 nt, Human
uuugguugcuuuaauau

SEQ ID NO: 1674309 - RNA, 23 nt, Human
uuucugaucugaugcaagcaaga

SEQ ID NO: 1674310 - RNA, 12 nt, Human
uuucuuaaauaa

SEQ ID NO: 1674311 - RNA, 18 nt, Human
uuucuuaaccagaucauu

SEQ ID NO: 1674312 - RNA, 13 nt, Human
uuucuuaaauaau

SEQ ID NO: 1674313 - RNA, 19 nt, Human
uuucuuguguguuuauugu

SEQ ID NO: 1674314 - RNA, 18 nt, Human
uuugaagcacagugauca

SEQ ID NO: 1674315 - RNA, 21 nt, Human
uuugaaauuguauuacaaauc

SEQ ID NO: 1674316 - RNA, 16 nt, Human
uuugagaucagccugg

SEQ ID NO: 1674317 - RNA, 17 nt, Human
uuugagaucagccuggg

SEQ ID NO: 1674318 - RNA, 20 nt, Human
uuugauaaucaacugggcug

SEQ ID NO: 1674319 - RNA, 15 nt, Human
uucacgugguccuaa

SEQ ID NO: 1674320 - RNA, 18 nt, Human
uucacggaagagccuugc

SEQ ID NO: 1674321 - RNA, 13 nt, Human
uucaauaggaaaa

SEQ ID NO: 1674322 - RNA, 15 nt, Human
uucaauaggaaaaac

SEQ ID NO: 1674323 - RNA, 18 nt, Human
uucaauaggaaaaacuga

SEQ ID NO: 1674324 - RNA, 20 nt, Human
uucaauaggaaaaacugauu

SEQ ID NO: 1674325 - RNA, 21 nt, Human
uucacucuccauuuaauaauu

SEQ ID NO: 1674326 - RNA, 14 nt, Human
uucagagcugcccu

SEQ ID NO: 1674327 - RNA, 13 nt, Human
uucagagcugccc

SEQ ID NO: 1674328 - RNA, 21 nt, Human
uucagaguugaugguuguaca

SEQ ID NO: 1674329 - RNA, 22 nt, Human
uucagaguugaugguuguacau

SEQ ID NO: 1674330 - RNA, 20 nt, Human
uucagauaaucacaauacau

SEQ ID NO: 1674331 - RNA, 17 nt, Human
uucagauaacuguuauu

SEQ ID NO: 1674332 - RNA, 18 nt, Human
uucagauaacuguuauuu

SEQ ID NO: 1674333 - RNA, 23 nt, Human
uucagauaacuguuauuuauaau

SEQ ID NO: 1674334 - RNA, 13 nt, Human
uucacucuccuug

SEQ ID NO: 1674335 - RNA, 21 nt, Human
uucagacagcugccugggauc

SEQ ID NO: 1674336 - RNA, 16 nt, Human
uucagacauagaauua

SEQ ID NO: 1674337 - RNA, 20 nt, Human
uucagacauagaauuaacac

SEQ ID NO: 1674338 - RNA, 19 nt, Human
uucagagacuccugcaggc

SEQ ID NO: 1674339 - RNA, 11 nt, Human
uucaaaguugc

SEQ ID NO: 1674340 - RNA, 15 nt, Human
uucaaaguugccuaa

SEQ ID NO: 1674341 - RNA, 16 nt, Human
uucaaaguugccuaaa

SEQ ID NO: 1674342 - RNA, 17 nt, Human
uucaaaguugccuaaau

SEQ ID NO: 1674343 - RNA, 23 nt, Human
uucaaaguugccuaaauccauuu

SEQ ID NO: 1674344 - RNA, 17 nt, Human
uucaacugaccagccuc

SEQ ID NO: 1674345 - RNA, 20 nt, Human
uucaacgcagcccugcuuug

SEQ ID NO: 1674346 - RNA, 16 nt, Human
uucaacgcagcccugc

SEQ ID NO: 1674347 - RNA, 19 nt, Human
uucaacgcagcccugcuuu

SEQ ID NO: 1674348 - RNA, 17 nt, Human
uucaaauccuugaagau

SEQ ID NO: 1674349 - RNA, 13 nt, Human
uuauuuuauuaug

SEQ ID NO: 1674350 - RNA, 20 nt, Human
uuauuuuauguugcauagaa

SEQ ID NO: 1674351 - RNA, 17 nt, Human
uuauuuuaauaauguuu

SEQ ID NO: 1674352 - RNA, 12 nt, Human
uuauuggcuuuu

SEQ ID NO: 1674353 - RNA, 16 nt, Human
uuauuggcuuuucuga

SEQ ID NO: 1674354 - RNA, 18 nt, Human
uuauuggcuuuucugauc

SEQ ID NO: 1674355 - RNA, 22 nt, Human
uuauuggcuuuucugauccagu

SEQ ID NO: 1674356 - RNA, 15 nt, Human
uuauuuuaauaaugu

SEQ ID NO: 1674357 - RNA, 16 nt, Human
uuauuuuaauaauguu

SEQ ID NO: 1674358 - RNA, 17 nt, Human
uuauugucaaaguggug

SEQ ID NO: 1674359 - RNA, 18 nt, Human
uuauugucaaagugguga

SEQ ID NO: 1674360 - RNA, 15 nt, Human
uuauugucuagugaa

SEQ ID NO: 1674361 - RNA, 20 nt, Human
uuaguugcaacuuuguauaa

SEQ ID NO: 1674362 - RNA, 16 nt, Human
uuaucuagauacugua

SEQ ID NO: 1674363 - RNA, 13 nt, Human
uuaguugcaacuu

SEQ ID NO: 1674364 - RNA, 16 nt, Human
uuaguuccucauuagc

SEQ ID NO: 1674365 - RNA, 14 nt, Human
uuaguuccuugagu

SEQ ID NO: 1674366 - RNA, 20 nt, Human
uuaucuugaauaauguaaga

SEQ ID NO: 1674367 - RNA, 17 nt, Human
uuaucugaagucagauc

SEQ ID NO: 1674368 - RNA, 17 nt, Human
uuaucuagauacuguau

SEQ ID NO: 1674369 - RNA, 22 nt, Human
uuaugcaugaaguaauaugcac

SEQ ID NO: 1674370 - RNA, 16 nt, Human
uuaugcaugaaguaau

SEQ ID NO: 1674371 - RNA, 16 nt, Human
uuauggaacacucuga

SEQ ID NO: 1674372 - RNA, 21 nt, Human
uuauggcacuaguauuucuau

SEQ ID NO: 1674373 - RNA, 13 nt, Human
uuaugcuuuaaac

SEQ ID NO: 1674374 - RNA, 14 nt, Human
uuaugcuuuaaaca

SEQ ID NO: 1674375 - RNA, 14 nt, Human
uuauuacaguauaa

SEQ ID NO: 1674376 - RNA, 16 nt, Human
uuauuacuguaagaaa

SEQ ID NO: 1674377 - RNA, 17 nt, Human
uuauuacuguaagaaaa

SEQ ID NO: 1674378 - RNA, 18 nt, Human
uuauuacuguaagaaaau

SEQ ID NO: 1674379 - RNA, 17 nt, Human
uuauggcuauaggugcu

SEQ ID NO: 1674380 - RNA, 11 nt, Human
uuauucugcuc

SEQ ID NO: 1674381 - RNA, 15 nt, Human
uuauugcccacgcug

SEQ ID NO: 1674382 - RNA, 19 nt, Human
uucccccuccaaucccacc

SEQ ID NO: 1674383 - RNA, 17 nt, Human
uucccuugaugaagaag

SEQ ID NO: 1674384 - RNA, 17 nt, Human
uucccuggccuuucaua

SEQ ID NO: 1674385 - RNA, 16 nt, Human
uucccuggccuuucau

SEQ ID NO: 1674386 - RNA, 12 nt, Human
uucccuggccuu

SEQ ID NO: 1674387 - RNA, 13 nt, Human
uuccucauuagca

SEQ ID NO: 1674388 - RNA, 21 nt, Human
uucccuuugacgccaucccag

SEQ ID NO: 1674389 - RNA, 22 nt, Human
uucccuuugacgccaucccagc

SEQ ID NO: 1674390 - RNA, 20 nt, Human
uucccuuugacgccauccca

SEQ ID NO: 1674391 - RNA, 18 nt, Human
uucccuugaugaagaagu

SEQ ID NO: 1674392 - RNA, 17 nt, Human
uuccugccaggcauggu

SEQ ID NO: 1674393 - RNA, 16 nt, Human
uuccugcauuugugaa

SEQ ID NO: 1674394 - RNA, 18 nt, Human
uuccugcauuugugaaau

SEQ ID NO: 1674395 - RNA, 23 nt, Human
uuccugaugcuucuucagagacu

SEQ ID NO: 1674396 - RNA, 15 nt, Human
uuccugaugcuucuu

SEQ ID NO: 1674397 - RNA, 18 nt, Human
uuccugaugcuucuucag

SEQ ID NO: 1674398 - RNA, 19 nt, Human
uuccugaugcuucuucaga

SEQ ID NO: 1674399 - RNA, 14 nt, Human
uuccuggcacugcu

SEQ ID NO: 1674400 - RNA, 20 nt, Human
uuccuugaguugauucagcu

SEQ ID NO: 1674401 - RNA, 13 nt, Human
uucuaaagcugcc

SEQ ID NO: 1674402 - RNA, 17 nt, Human
uucuaaagcugccagcc

SEQ ID NO: 1674403 - RNA, 20 nt, Human
uucgggaggucgaggcagga

SEQ ID NO: 1674404 - RNA, 20 nt, Human
uuccuuggacucauuuuaaa

SEQ ID NO: 1674405 - RNA, 20 nt, Human
uuccagcaauucuccugccu

SEQ ID NO: 1674406 - RNA, 21 nt, Human
uuccagcaauucuccugccuc

SEQ ID NO: 1674407 - RNA, 22 nt, Human
uuccagcaauucuccugccuca

SEQ ID NO: 1674408 - RNA, 23 nt, Human
uuccagcaauucuccugccucag

SEQ ID NO: 1674409 - RNA, 14 nt, Human
uucccauucuugca

SEQ ID NO: 1674410 - RNA, 16 nt, Human
uucccauuugcuccuu

SEQ ID NO: 1674411 - RNA, 15 nt, Human
uuccccaggaggcca

SEQ ID NO: 1674412 - RNA, 16 nt, Human
uuccccaggaggccag

SEQ ID NO: 1674413 - RNA, 11 nt, Human
uucccucccuu

SEQ ID NO: 1674414 - RNA, 17 nt, Human
uucccucccuuccucuu

SEQ ID NO: 1674415 - RNA, 20 nt, Human
uucccucccuuccucuuucc

SEQ ID NO: 1674416 - RNA, 19 nt, Human
uuccccaugucucgacuca

SEQ ID NO: 1674417 - RNA, 11 nt, Human
uuccccauggg

SEQ ID NO: 1674418 - RNA, 21 nt, Human
uuccccaggaggccagccuug

SEQ ID NO: 1674419 - RNA, 17 nt, Human
uuccccaggaggccagc

SEQ ID NO: 1674420 - RNA, 18 nt, Human
uuccccaggaggccagcc

SEQ ID NO: 1674421 - RNA, 19 nt, Human
uuccccaggaggccagccu

SEQ ID NO: 1674422 - RNA, 20 nt, Human
uuccccaggaggccagccuu

SEQ ID NO: 1674423 - RNA, 15 nt, Human
uucaugaaagauuca

SEQ ID NO: 1674424 - RNA, 17 nt, Human
uucaugaaagauucaau

SEQ ID NO: 1674425 - RNA, 21 nt, Human
uucaucuugaauuguaaggaa

SEQ ID NO: 1674426 - RNA, 11 nt, Human
uucaggaagcu

SEQ ID NO: 1674427 - RNA, 13 nt, Human
uucaggaagcuca

SEQ ID NO: 1674428 - RNA, 15 nt, Human
uucaggaagcucagg

SEQ ID NO: 1674429 - RNA, 15 nt, Human
uucauuuccuguguc

SEQ ID NO: 1674430 - RNA, 16 nt, Human
uucauuuccugugucu

SEQ ID NO: 1674431 - RNA, 17 nt, Human
uucaugcaaacuuuauu

SEQ ID NO: 1674432 - RNA, 15 nt, Human
uuccaaauucugcuu

SEQ ID NO: 1674433 - RNA, 17 nt, Human
uuccagagaguggcucc

SEQ ID NO: 1674434 - RNA, 18 nt, Human
uuccagagaguggcuccu

SEQ ID NO: 1674435 - RNA, 19 nt, Human
uuccagagaguggcuccuc

SEQ ID NO: 1674436 - RNA, 20 nt, Human
uuccagagaguggcuccucc

SEQ ID NO: 1674437 - RNA, 21 nt, Human
uuccagagaguggcuccuccc

SEQ ID NO: 1674438 - RNA, 19 nt, Human
uuccagauccuggaaauca

SEQ ID NO: 1674439 - RNA, 17 nt, Human
uuacugucuuuuuucua

SEQ ID NO: 1674440 - RNA, 19 nt, Human
uuacugucuuuuuucuaaa

SEQ ID NO: 1674441 - RNA, 19 nt, Human
uuacuauggcccuggccua

SEQ ID NO: 1674442 - RNA, 21 nt, Human
uuacuuaaaccgccaaggcug

SEQ ID NO: 1674443 - RNA, 11 nt, Human
uuacuucugcu

SEQ ID NO: 1674444 - RNA, 12 nt, Human
uuacuucugcua

SEQ ID NO: 1674445 - RNA, 23 nt, Human
uuacuucuuauacauuugauaaa

SEQ ID NO: 1674446 - RNA, 18 nt, Human
uuacuuagguguggggga

SEQ ID NO: 1674447 - RNA, 16 nt, Human
uuacuaauagacaauu

SEQ ID NO: 1674448 - RNA, 14 nt, Human
uuacuaaguuuuua

SEQ ID NO: 1674449 - RNA, 13 nt, Human
uuacuaaguuuuu

SEQ ID NO: 1674450 - RNA, 21 nt, Human
uuacuaucaugucaaacguga

SEQ ID NO: 1674451 - RNA, 19 nt, Human
uuacuaucaugucaaacgu

SEQ ID NO: 1674452 - RNA, 17 nt, Human
uuacuaguuucccuugc

SEQ ID NO: 1674453 - RNA, 14 nt, Human
uuagagaguguuga

SEQ ID NO: 1674454 - RNA, 16 nt, Human
uuagagaguguugaaa

SEQ ID NO: 1674455 - RNA, 17 nt, Human
uuagagaguguugaaac

SEQ ID NO: 1674456 - RNA, 16 nt, Human
uuagacagucccugcc

SEQ ID NO: 1674457 - RNA, 17 nt, Human
uuagacagucccugcca

SEQ ID NO: 1674458 - RNA, 18 nt, Human
uuagacagucccugccaa

SEQ ID NO: 1674459 - RNA, 17 nt, Human
uuacuuuaaaaggagcc

SEQ ID NO: 1674460 - RNA, 18 nt, Human
uuacuuuaaaaggagcca

SEQ ID NO: 1674461 - RNA, 14 nt, Human
uuacuuuguguuca

SEQ ID NO: 1674462 - RNA, 15 nt, Human
uuagacagucccugc

SEQ ID NO: 1674463 - RNA, 19 nt, Human
uuagaaacacaacuauauu

SEQ ID NO: 1674464 - RNA, 14 nt, Human
uuaguguucauaaa

SEQ ID NO: 1674465 - RNA, 18 nt, Human
uuaguaugaggcauuugu

SEQ ID NO: 1674466 - RNA, 16 nt, Human
uuaguaugaggcauuu

SEQ ID NO: 1674467 - RNA, 18 nt, Human
uuaggauguugaaaaagu

SEQ ID NO: 1674468 - RNA, 12 nt, Human
uuagcugggaga

SEQ ID NO: 1674469 - RNA, 12 nt, Human
uuagcuggaaaa

SEQ ID NO: 1674470 - RNA, 13 nt, Human
uuagcuggaaaag

SEQ ID NO: 1674471 - RNA, 18 nt, Human
uuagagaguguugaaacg

SEQ ID NO: 1674472 - RNA, 12 nt, Human
uuagagauuuuu

SEQ ID NO: 1674473 - RNA, 14 nt, Human
uuagaguugauacu

SEQ ID NO: 1674474 - RNA, 13 nt, Human
uuagagugucuua

SEQ ID NO: 1674475 - RNA, 13 nt, Human
uuagaucuaguuc

SEQ ID NO: 1674476 - RNA, 14 nt, Human
uuagaucuaguuca

SEQ ID NO: 1674477 - RNA, 22 nt, Human
uuagauaauacaccacuacauu

SEQ ID NO: 1674478 - RNA, 20 nt, Human
uuagaugcaguucugaagaa

SEQ ID NO: 1674479 - RNA, 21 nt, Human
uuagaugcaguucugaagaag

SEQ ID NO: 1674480 - RNA, 16 nt, Human
uuagcuacuauauaug

SEQ ID NO: 1674481 - RNA, 20 nt, Human
uguuuuaagaggcagggucu

SEQ ID NO: 1674482 - RNA, 13 nt, Human
uguuugugauuga

SEQ ID NO: 1674483 - RNA, 15 nt, Human
uguuucaaacuuuac

SEQ ID NO: 1674484 - RNA, 20 nt, Human
uguuuagauaauacaccacu

SEQ ID NO: 1674485 - RNA, 21 nt, Human
uguuucaaacauauauaacaa

SEQ ID NO: 1674486 - RNA, 22 nt, Human
uguuucaaacauauauaacaau

SEQ ID NO: 1674487 - RNA, 16 nt, Human
uguuuagauaauacac

SEQ ID NO: 1674488 - RNA, 19 nt, Human
uguuucaaacauauauaac

SEQ ID NO: 1674489 - RNA, 21 nt, Human
uuaaaauaccagccaguaaau

SEQ ID NO: 1674490 - RNA, 19 nt, Human
uuaaaauacacacucaaau

SEQ ID NO: 1674491 - RNA, 13 nt, Human
uuaaaagaaugau

SEQ ID NO: 1674492 - RNA, 15 nt, Human
uuaaaagaugaaaau

SEQ ID NO: 1674493 - RNA, 18 nt, Human
uuaaaagaugaaaauauu

SEQ ID NO: 1674494 - RNA, 17 nt, Human
uguuuuguuuggagaca

SEQ ID NO: 1674495 - RNA, 18 nt, Human
uguuuuaaggaugcuugu

SEQ ID NO: 1674496 - RNA, 22 nt, Human
uguuuuaagaggcagggucuca

SEQ ID NO: 1674497 - RNA, 19 nt, Human
uguuuuaaggaugcuugua

SEQ ID NO: 1674498 - RNA, 18 nt, Human
uguuuuuuuuuuccacuu

SEQ ID NO: 1674499 - RNA, 19 nt, Human
uguuuuuuuuuuccacuua

SEQ ID NO: 1674500 - RNA, 18 nt, Human
uguuuuuuuuuaaagacu

SEQ ID NO: 1674501 - RNA, 17 nt, Human
uuaaaagauacaguuac

SEQ ID NO: 1674502 - RNA, 14 nt, Human
uuaaaagauacagu

SEQ ID NO: 1674503 - RNA, 21 nt, Human
uuaaaagaauauuuuaacuuc

SEQ ID NO: 1674504 - RNA, 22 nt, Human
uuaaaagaauauuuuaacuucc

SEQ ID NO: 1674505 - RNA, 21 nt, Human
uuacaagcgugagccacugca

SEQ ID NO: 1674506 - RNA, 20 nt, Human
uuacaagcgugagccacugc

SEQ ID NO: 1674507 - RNA, 13 nt, Human
uuaagcauauauu

SEQ ID NO: 1674508 - RNA, 15 nt, Human
uuaagcauauauuuu

SEQ ID NO: 1674509 - RNA, 18 nt, Human
uuaagcauauauuuuuau

SEQ ID NO: 1674510 - RNA, 19 nt, Human
uuaagcauauauuuuuaua

SEQ ID NO: 1674511 - RNA, 23 nt, Human
uuaagcauauauuuuuauauuua

SEQ ID NO: 1674512 - RNA, 15 nt, Human
uuaagccuuuggaaa

SEQ ID NO: 1674513 - RNA, 16 nt, Human
uuaagccuuuggaaac

SEQ ID NO: 1674514 - RNA, 17 nt, Human
uuaagcuguuacugucu

SEQ ID NO: 1674515 - RNA, 18 nt, Human
uuaauauugauaugcuua

SEQ ID NO: 1674516 - RNA, 22 nt, Human
uuaauauugauaugcuuauaca

SEQ ID NO: 1674517 - RNA, 21 nt, Human
uuaauauuaaagccauguuua

SEQ ID NO: 1674518 - RNA, 22 nt, Human
uuaauauuaaagccauguuuau

SEQ ID NO: 1674519 - RNA, 15 nt, Human
uuaauaucaucagua

SEQ ID NO: 1674520 - RNA, 14 nt, Human
uuaaagacuuuuau

SEQ ID NO: 1674521 - RNA, 21 nt, Human
uuaaauguuuuuuuuuaaaga

SEQ ID NO: 1674522 - RNA, 23 nt, Human
uuaaauguuuuuuuuuaaagacu

SEQ ID NO: 1674523 - RNA, 17 nt, Human
uuaaccacuucagcuga

SEQ ID NO: 1674524 - RNA, 16 nt, Human
uuaacuucacauauug

SEQ ID NO: 1674525 - RNA, 15 nt, Human
uuaacuuuuauaaac

SEQ ID NO: 1674526 - RNA, 17 nt, Human
uuaacuuuuauaaacuu

SEQ ID NO: 1674527 - RNA, 16 nt, Human
uuaacuuuuauaaacu

SEQ ID NO: 1674528 - RNA, 18 nt, Human
uuaacuuuuauaaacuuu

SEQ ID NO: 1674529 - RNA, 14 nt, Human
uggcucccacaggc

SEQ ID NO: 1674530 - RNA, 17 nt, Human
uggcucccacaggcccu

SEQ ID NO: 1674531 - RNA, 20 nt, Human
uggcucccacaggcccuucc

SEQ ID NO: 1674532 - RNA, 15 nt, Human
uggcgggguggggug

SEQ ID NO: 1674533 - RNA, 18 nt, Human
uggcuccucccggugccc

SEQ ID NO: 1674534 - RNA, 19 nt, Human
uggcuccucccggugccca

SEQ ID NO: 1674535 - RNA, 14 nt, Human
uggcuccucccggu

SEQ ID NO: 1674536 - RNA, 16 nt, Human
uggcuccucccggugc

SEQ ID NO: 1674537 - RNA, 11 nt, Human
uggcugcuuca

SEQ ID NO: 1674538 - RNA, 15 nt, Human
uggcugcuucaagga

SEQ ID NO: 1674539 - RNA, 16 nt, Human
uggcugcuucaaggau

SEQ ID NO: 1674540 - RNA, 23 nt, Human
uggccucccaacucaccccagcc

SEQ ID NO: 1674541 - RNA, 22 nt, Human
uggcgcagcauauucaggaagc

SEQ ID NO: 1674542 - RNA, 23 nt, Human
uggcgcagcauauucaggaagcu

SEQ ID NO: 1674543 - RNA, 16 nt, Human
uggcgcugccccuggc

SEQ ID NO: 1674544 - RNA, 23 nt, Human
uggcgcugccccuggcagccccu

SEQ ID NO: 1674545 - RNA, 20 nt, Human
uggccccugcccggcugcgg

SEQ ID NO: 1674546 - RNA, 15 nt, Human
uggccccugcccggc

SEQ ID NO: 1674547 - RNA, 16 nt, Human
uggccccugcccggcu

SEQ ID NO: 1674548 - RNA, 20 nt, Human
uggccaggcugcucuugaac

SEQ ID NO: 1674549 - RNA, 15 nt, Human
uggccaggcuggucu

SEQ ID NO: 1674550 - RNA, 13 nt, Human
uggccaggcuggu

SEQ ID NO: 1674551 - RNA, 16 nt, Human
uggccaggcugcucuu

SEQ ID NO: 1674552 - RNA, 17 nt, Human
uggccaggcugcucuug

SEQ ID NO: 1674553 - RNA, 20 nt, Human
uggccagaugcaccagcccu

SEQ ID NO: 1674554 - RNA, 19 nt, Human
uggccagaugcaccagccc

SEQ ID NO: 1674555 - RNA, 12 nt, Human
uggcagaggagg

SEQ ID NO: 1674556 - RNA, 15 nt, Human
uggcagaguugaaga

SEQ ID NO: 1674557 - RNA, 21 nt, Human
uggcagaguggauucuugaac

SEQ ID NO: 1674558 - RNA, 17 nt, Human
uggcagaguugaagaca

SEQ ID NO: 1674559 - RNA, 19 nt, Human
uggcagaguugaagacaga

SEQ ID NO: 1674560 - RNA, 17 nt, Human
uggccagaugcaccagc

SEQ ID NO: 1674561 - RNA, 18 nt, Human
uggccagaugcaccagcc

SEQ ID NO: 1674562 - RNA, 22 nt, Human
uggaccaaaaaccaguauugua

SEQ ID NO: 1674563 - RNA, 21 nt, Human
uggagaagcucccugaaguaa

SEQ ID NO: 1674564 - RNA, 13 nt, Human
uggacuccucugu

SEQ ID NO: 1674565 - RNA, 14 nt, Human
uggacuccucuguc

SEQ ID NO: 1674566 - RNA, 20 nt, Human
uggauaauaaggaaaaguuu

SEQ ID NO: 1674567 - RNA, 14 nt, Human
uggagacugucuca

SEQ ID NO: 1674568 - RNA, 17 nt, Human
uggagacugucucaaga

SEQ ID NO: 1674569 - RNA, 21 nt, Human
uggaggaaggaaacccagcuc

SEQ ID NO: 1674570 - RNA, 23 nt, Human
uggaggaaggaaacccagcucug

SEQ ID NO: 1674571 - RNA, 16 nt, Human
uggcaaaaaggcagga

SEQ ID NO: 1674572 - RNA, 12 nt, Human
uggcaaaaaggc

SEQ ID NO: 1674573 - RNA, 15 nt, Human
uggcacuauaaugua

SEQ ID NO: 1674574 - RNA, 16 nt, Human
uggcacuauaauguaa

SEQ ID NO: 1674575 - RNA, 20 nt, Human
uggcaauagucaaauugugu

SEQ ID NO: 1674576 - RNA, 15 nt, Human
uggcacuaguauuuc

SEQ ID NO: 1674577 - RNA, 15 nt, Human
ugggccuucagggag

SEQ ID NO: 1674578 - RNA, 12 nt, Human
ugggccuucagg

SEQ ID NO: 1674579 - RNA, 21 nt, Human
uggggccaggcugggucgccc

SEQ ID NO: 1674580 - RNA, 22 nt, Human
uggggccaggcugggucgcccu

SEQ ID NO: 1674581 - RNA, 21 nt, Human
uggggccaguuggucccccuu

SEQ ID NO: 1674582 - RNA, 20 nt, Human
uggggccaguuggucccccu

SEQ ID NO: 1674583 - RNA, 15 nt, Human
uggggaugagaaagg

SEQ ID NO: 1674584 - RNA, 23 nt, Human
uggggaugagaaagguugaagca

SEQ ID NO: 1674585 - RNA, 20 nt, Human
uggggccaggcugggucgcc

SEQ ID NO: 1674586 - RNA, 13 nt, Human
uggggggggugcu

SEQ ID NO: 1674587 - RNA, 16 nt, Human
ugggggaguggccaca

SEQ ID NO: 1674588 - RNA, 15 nt, Human
uggggguucuuucuu

SEQ ID NO: 1674589 - RNA, 19 nt, Human
uggggguucuuucuuccuc

SEQ ID NO: 1674590 - RNA, 20 nt, Human
uggggguucuuucuuccucu

SEQ ID NO: 1674591 - RNA, 22 nt, Human
uggggguucuuucuuccucugc

SEQ ID NO: 1674592 - RNA, 17 nt, Human
uggguacuuguggacac

SEQ ID NO: 1674593 - RNA, 18 nt, Human
uggguacuuguggacaca

SEQ ID NO: 1674594 - RNA, 22 nt, Human
ugggauuacaagcgugagccac

SEQ ID NO: 1674595 - RNA, 17 nt, Human
ugggauuacaggcguga

SEQ ID NO: 1674596 - RNA, 22 nt, Human
ugggcagagcagagaccauccc

SEQ ID NO: 1674597 - RNA, 14 nt, Human
ugggauccuccagg

SEQ ID NO: 1674598 - RNA, 12 nt, Human
ugggauccucca

SEQ ID NO: 1674599 - RNA, 13 nt, Human
ugggauccuccag

SEQ ID NO: 1674600 - RNA, 19 nt, Human
ugggaucacauguggacuu

SEQ ID NO: 1674601 - RNA, 14 nt, Human
ugggagugggccca

SEQ ID NO: 1674602 - RNA, 16 nt, Human
ugggagugggcccaau

SEQ ID NO: 1674603 - RNA, 16 nt, Human
uggcugggggccucag

SEQ ID NO: 1674604 - RNA, 17 nt, Human
uggcugggggccucagu

SEQ ID NO: 1674605 - RNA, 20 nt, Human
uggcugggggccucagugcc

SEQ ID NO: 1674606 - RNA, 21 nt, Human
ugggccccugccucucugcag

SEQ ID NO: 1674607 - RNA, 23 nt, Human
ugggccccugccucucugcaggu

SEQ ID NO: 1674608 - RNA, 11 nt, Human
ugggccuucag

SEQ ID NO: 1674609 - RNA, 14 nt, Human
ugggccuggcuccc

SEQ ID NO: 1674610 - RNA, 19 nt, Human
ugggcagcugccuccccuc

SEQ ID NO: 1674611 - RNA, 17 nt, Human
ugggcagcugccucccc

SEQ ID NO: 1674612 - RNA, 23 nt, Human
ugggcagagcagagaccaucccu

SEQ ID NO: 1674613 - RNA, 15 nt, Human
ugggcagcugccucc

SEQ ID NO: 1674614 - RNA, 14 nt, Human
ugggcagcugccuc

SEQ ID NO: 1674615 - RNA, 13 nt, Human
ugggcagcugccu

SEQ ID NO: 1674616 - RNA, 17 nt, Human
uggucggaaaacaugcu

SEQ ID NO: 1674617 - RNA, 14 nt, Human
uggucggaaaacau

SEQ ID NO: 1674618 - RNA, 19 nt, Human
uggucuacacugugcugag

SEQ ID NO: 1674619 - RNA, 13 nt, Human
uggugaccucugc

SEQ ID NO: 1674620 - RNA, 14 nt, Human
uggugaccucugcc

SEQ ID NO: 1674621 - RNA, 15 nt, Human
uggucuacacugugc

SEQ ID NO: 1674622 - RNA, 16 nt, Human
uggucuacacugugcu

SEQ ID NO: 1674623 - RNA, 17 nt, Human
uggucuacacugugcug

SEQ ID NO: 1674624 - RNA, 18 nt, Human
uggucuacacugugcuga

SEQ ID NO: 1674625 - RNA, 21 nt, Human
uggugcaaugaccuuucaaua

SEQ ID NO: 1674626 - RNA, 15 nt, Human
uggugacugauucuu

SEQ ID NO: 1674627 - RNA, 16 nt, Human
uggugacugauucuuc

SEQ ID NO: 1674628 - RNA, 19 nt, Human
uggugacugauucuucagc

SEQ ID NO: 1674629 - RNA, 19 nt, Human
uggugacuuuccucuuugg

SEQ ID NO: 1674630 - RNA, 15 nt, Human
uggugaccucugccu

SEQ ID NO: 1674631 - RNA, 16 nt, Human
uggugaccucugccug

SEQ ID NO: 1674632 - RNA, 17 nt, Human
uggugaccucugccuga

SEQ ID NO: 1674633 - RNA, 22 nt, Human
uggugaccucugccugaaguca

SEQ ID NO: 1674634 - RNA, 17 nt, Human
ugguccgugcuaaggac

SEQ ID NO: 1674635 - RNA, 18 nt, Human
ugguccgugcuaaggacu

SEQ ID NO: 1674636 - RNA, 19 nt, Human
ugguccgugcuaaggacuu

SEQ ID NO: 1674637 - RNA, 20 nt, Human
ugguccgugcuaaggacuug

SEQ ID NO: 1674638 - RNA, 15 nt, Human
uggucccccuuccau

SEQ ID NO: 1674639 - RNA, 16 nt, Human
uggucccccuuccaug

SEQ ID NO: 1674640 - RNA, 18 nt, Human
uggucccccuuccaugga

SEQ ID NO: 1674641 - RNA, 23 nt, Human
uggucccccuuccauggacuuug

SEQ ID NO: 1674642 - RNA, 13 nt, Human
ugguccugcugca

SEQ ID NO: 1674643 - RNA, 15 nt, Human
ugguccugcugcagu

SEQ ID NO: 1674644 - RNA, 23 nt, Human
ugguccugcugcaguugccaguc

SEQ ID NO: 1674645 - RNA, 17 nt, Human
ugguccuaaucuucuga

SEQ ID NO: 1674646 - RNA, 19 nt, Human
ugguccuaaucuucugaac

SEQ ID NO: 1674647 - RNA, 14 nt, Human
uggucccccuucca

SEQ ID NO: 1674648 - RNA, 20 nt, Human
uggucacaggacucugccuc

SEQ ID NO: 1674649 - RNA, 19 nt, Human
uggucacaggacucugccu

SEQ ID NO: 1674650 - RNA, 16 nt, Human
uggucccagccagcag

SEQ ID NO: 1674651 - RNA, 18 nt, Human
uggucacaggacucugcc

SEQ ID NO: 1674652 - RNA, 22 nt, Human
uggucacaggaaguagaggagg

SEQ ID NO: 1674653 - RNA, 13 nt, Human
ugguauguuuuca

SEQ ID NO: 1674654 - RNA, 21 nt, Human
ugguauguuuucaggcuagau

SEQ ID NO: 1674655 - RNA, 18 nt, Human
ugcccaggcuggcgugca

SEQ ID NO: 1674656 - RNA, 19 nt, Human
ugcccaggcuggcgugcag

SEQ ID NO: 1674657 - RNA, 20 nt, Human
ugcccaggcuggcgugcagu

SEQ ID NO: 1674658 - RNA, 12 nt, Human
ugcccggcugcg

SEQ ID NO: 1674659 - RNA, 14 nt, Human
ugcccggcugcgga

SEQ ID NO: 1674660 - RNA, 15 nt, Human
ugccccucccuucaa

SEQ ID NO: 1674661 - RNA, 16 nt, Human
ugccccucccuucaac

SEQ ID NO: 1674662 - RNA, 17 nt, Human
ugccccuccucucugcc

SEQ ID NO: 1674663 - RNA, 18 nt, Human
ugccccuccucucugccc

SEQ ID NO: 1674664 - RNA, 19 nt, Human
ugccccuccucucugcccu

SEQ ID NO: 1674665 - RNA, 20 nt, Human
ugccccuccucucugcccua

SEQ ID NO: 1674666 - RNA, 16 nt, Human
ugccccuggcagcccc

SEQ ID NO: 1674667 - RNA, 15 nt, Human
ugcccugcccaccug

SEQ ID NO: 1674668 - RNA, 16 nt, Human
ugcccugcccaccugg

SEQ ID NO: 1674669 - RNA, 20 nt, Human
ugcccugcccaccuggccuc

SEQ ID NO: 1674670 - RNA, 15 nt, Human
ugcccugggaggcag

SEQ ID NO: 1674671 - RNA, 17 nt, Human
ugcccugggaggcagug

SEQ ID NO: 1674672 - RNA, 18 nt, Human
ugcccugggaggcaguga

SEQ ID NO: 1674673 - RNA, 13 nt, Human
ugcccugggaggc

SEQ ID NO: 1674674 - RNA, 21 nt, Human
ugcccugcccaccuggccucu

SEQ ID NO: 1674675 - RNA, 12 nt, Human
ugcccuggugcu

SEQ ID NO: 1674676 - RNA, 14 nt, Human
ugcccuggugcugc

SEQ ID NO: 1674677 - RNA, 16 nt, Human
ugcccuggugcugcca

SEQ ID NO: 1674678 - RNA, 17 nt, Human
ugcccuggugcugccac

SEQ ID NO: 1674679 - RNA, 17 nt, Human
ugcccugguuuccugcc

SEQ ID NO: 1674680 - RNA, 18 nt, Human
ugcccugguuuccugccc

SEQ ID NO: 1674681 - RNA, 13 nt, Human
ugccuaaauccau

SEQ ID NO: 1674682 - RNA, 15 nt, Human
ugccuaaauccauuu

SEQ ID NO: 1674683 - RNA, 19 nt, Human
ugccuaaauccauuuggaa

SEQ ID NO: 1674684 - RNA, 19 nt, Human
ugcccugguuuccugcccu

SEQ ID NO: 1674685 - RNA, 20 nt, Human
ugcccugguuuccugcccug

SEQ ID NO: 1674686 - RNA, 23 nt, Human
ugcccugguuuccugcccuggga

SEQ ID NO: 1674687 - RNA, 23 nt, Human
ugcccugugaguacuacaguccu

SEQ ID NO: 1674688 - RNA, 20 nt, Human
ugccuaaauccauuuggaaa

SEQ ID NO: 1674689 - RNA, 22 nt, Human
ugccuaaauccauuuggaaauc

SEQ ID NO: 1674690 - RNA, 23 nt, Human
ugccuaaauccauuuggaaaucu

SEQ ID NO: 1674691 - RNA, 15 nt, Human
ugccucaagagaagg

SEQ ID NO: 1674692 - RNA, 14 nt, Human
ugccucaagagaag

SEQ ID NO: 1674693 - RNA, 14 nt, Human
ugccuccucuucaa

SEQ ID NO: 1674694 - RNA, 16 nt, Human
ugccuccucuucaacu

SEQ ID NO: 1674695 - RNA, 20 nt, Human
ugccucacccacccuuuuuu

SEQ ID NO: 1674696 - RNA, 23 nt, Human
ugccucacccacccuuuuuuaaa

SEQ ID NO: 1674697 - RNA, 14 nt, Human
ugccaggcauggug

SEQ ID NO: 1674698 - RNA, 20 nt, Human
ugccaggaagccagcaggcu

SEQ ID NO: 1674699 - RNA, 22 nt, Human
ugccaggaagccagcaggcucu

SEQ ID NO: 1674700 - RNA, 16 nt, Human
ugccacuaaauugaca

SEQ ID NO: 1674701 - RNA, 23 nt, Human
ugcauuuggugguuucagaaaug

SEQ ID NO: 1674702 - RNA, 21 nt, Human
ugcauuuggugguuucagaaa

SEQ ID NO: 1674703 - RNA, 17 nt, Human
ugcaugguuuagaaagc

SEQ ID NO: 1674704 - RNA, 13 nt, Human
ugcaucagcugcu

SEQ ID NO: 1674705 - RNA, 19 nt, Human
ugcaucagcugcugaaaca

SEQ ID NO: 1674706 - RNA, 21 nt, Human
ugcaguuacacuaaaagguga

SEQ ID NO: 1674707 - RNA, 21 nt, Human
ugcaguggugcgaucuggguu

SEQ ID NO: 1674708 - RNA, 13 nt, Human
ugcagggaguccg

SEQ ID NO: 1674709 - RNA, 18 nt, Human
ugcauauuauuuuauguu

SEQ ID NO: 1674710 - RNA, 22 nt, Human
ugcaucaauuuuucuuauuuca

SEQ ID NO: 1674711 - RNA, 16 nt, Human
ugcaguugccagucac

SEQ ID NO: 1674712 - RNA, 12 nt, Human
ugcaguucugaa

SEQ ID NO: 1674713 - RNA, 14 nt, Human
ugcaguucugaaga

SEQ ID NO: 1674714 - RNA, 20 nt, Human
ugcauaggugaucucauuua

SEQ ID NO: 1674715 - RNA, 19 nt, Human
ugcgcuaaacuuuucugau

SEQ ID NO: 1674716 - RNA, 20 nt, Human
ugcgcuaaacuuuucugaua

SEQ ID NO: 1674717 - RNA, 21 nt, Human
ugcgcuaaacuuuucugauag

SEQ ID NO: 1674718 - RNA, 21 nt, Human
ugcgcaggcuggcccugcccu

SEQ ID NO: 1674719 - RNA, 22 nt, Human
ugcgcaggcuggcccugcccug

SEQ ID NO: 1674720 - RNA, 23 nt, Human
ugcgcaggcuggcccugcccugg

SEQ ID NO: 1674721 - RNA, 20 nt, Human
ugccuugcauaauggucaga

SEQ ID NO: 1674722 - RNA, 17 nt, Human
ugcggacagccacggcc

SEQ ID NO: 1674723 - RNA, 22 nt, Human
ugcuaagacucaguggggaggg

SEQ ID NO: 1674724 - RNA, 21 nt, Human
ugcuacuguccuacccacccu

SEQ ID NO: 1674725 - RNA, 22 nt, Human
ugcuacuguccuacccacccuc

SEQ ID NO: 1674726 - RNA, 14 nt, Human
ugcucuccucuugc

SEQ ID NO: 1674727 - RNA, 12 nt, Human
ugcucuccucuu

SEQ ID NO: 1674728 - RNA, 23 nt, Human
ugcucuccgaccagacaccuuga

SEQ ID NO: 1674729 - RNA, 17 nt, Human
ugcucacauaucuguca

SEQ ID NO: 1674730 - RNA, 15 nt, Human
ugcucaggagcccug

SEQ ID NO: 1674731 - RNA, 18 nt, Human
ugcucaggagcccuggga

SEQ ID NO: 1674732 - RNA, 19 nt, Human
ugcucaggagcccugggag

SEQ ID NO: 1674733 - RNA, 20 nt, Human
ugcucaggagcccugggagg

SEQ ID NO: 1674734 - RNA, 22 nt, Human
ugcuaggaacacuccuucacag

SEQ ID NO: 1674735 - RNA, 21 nt, Human
ugcuaggaacacuccuucaca

SEQ ID NO: 1674736 - RNA, 18 nt, Human
ugcuagaacucccuuuca

SEQ ID NO: 1674737 - RNA, 13 nt, Human
ugcuagaacuccc

SEQ ID NO: 1674738 - RNA, 14 nt, Human
ugcuagaacucccu

SEQ ID NO: 1674739 - RNA, 15 nt, Human
ugcuagaacucccuu

SEQ ID NO: 1674740 - RNA, 17 nt, Human
ugcuagaacucccuuuc

SEQ ID NO: 1674741 - RNA, 15 nt, Human
ugcugccugcuuuuu

SEQ ID NO: 1674742 - RNA, 17 nt, Human
ugcugccugcuuuuuau

SEQ ID NO: 1674743 - RNA, 23 nt, Human
ugcugcauuuaaaagauacaguu

SEQ ID NO: 1674744 - RNA, 19 nt, Human
ugcugcauuuaaaagauac

SEQ ID NO: 1674745 - RNA, 18 nt, Human
ugcugcauuuaaaagaua

SEQ ID NO: 1674746 - RNA, 17 nt, Human
ugcugcauuuaaaagau

SEQ ID NO: 1674747 - RNA, 16 nt, Human
ugcugggccccugccu

SEQ ID NO: 1674748 - RNA, 17 nt, Human
ugcugggccccugccuc

SEQ ID NO: 1674749 - RNA, 18 nt, Human
ugcugggccccugccucu

SEQ ID NO: 1674750 - RNA, 19 nt, Human
ugcugggccccugccucuc

SEQ ID NO: 1674751 - RNA, 21 nt, Human
ugcugggccccugccucucug

SEQ ID NO: 1674752 - RNA, 22 nt, Human
ugcugggccccugccucucugc

SEQ ID NO: 1674753 - RNA, 23 nt, Human
ugcugggccccugccucucugca

SEQ ID NO: 1674754 - RNA, 24 nt, Human
ugcugggccccugccucucugcag

SEQ ID NO: 1674755 - RNA, 14 nt, Human
ugcugggccccugc

SEQ ID NO: 1674756 - RNA, 20 nt, Human
ugcugggauuacagguguga

SEQ ID NO: 1674757 - RNA, 19 nt, Human
ugcugcuugaggcaacuca

SEQ ID NO: 1674758 - RNA, 12 nt, Human
ugcugcuugagg

SEQ ID NO: 1674759 - RNA, 22 nt, Human
ugcugguguaugugugaaguga

SEQ ID NO: 1674760 - RNA, 13 nt, Human
ugcugguguaugu

SEQ ID NO: 1674761 - RNA, 17 nt, Human
ugcugggguuaucugaa

SEQ ID NO: 1674762 - RNA, 20 nt, Human
ugcugggguuaucugaaguc

SEQ ID NO: 1674763 - RNA, 13 nt, Human
ugcuggguguggc

SEQ ID NO: 1674764 - RNA, 17 nt, Human
ugcugggcuugucugua

SEQ ID NO: 1674765 - RNA, 20 nt, Human
ugcugggggggauuguaaaa

SEQ ID NO: 1674766 - RNA, 13 nt, Human
ugcugguuuuagu

SEQ ID NO: 1674767 - RNA, 18 nt, Human
ugcuguaacuuucugaaa

SEQ ID NO: 1674768 - RNA, 16 nt, Human
ugcuguucaugaaaga

SEQ ID NO: 1674769 - RNA, 17 nt, Human
ugcuguucaugaaagau

SEQ ID NO: 1674770 - RNA, 16 nt, Human
ugauugugucucuugg

SEQ ID NO: 1674771 - RNA, 20 nt, Human
ugauuggcaggaguuggaag

SEQ ID NO: 1674772 - RNA, 13 nt, Human
ugauuggaggggg

SEQ ID NO: 1674773 - RNA, 21 nt, Human
ugauuggaggggggagguggg

SEQ ID NO: 1674774 - RNA, 21 nt, Human
ugauucuucagcaaaaauauu

SEQ ID NO: 1674775 - RNA, 18 nt, Human
ugauucagacagcugccu

SEQ ID NO: 1674776 - RNA, 19 nt, Human
ugauucagacagcugccug

SEQ ID NO: 1674777 - RNA, 20 nt, Human
ugauucagacagcugccugg

SEQ ID NO: 1674778 - RNA, 21 nt, Human
ugauucagacagcugccuggg

SEQ ID NO: 1674779 - RNA, 23 nt, Human
ugauucagacagcugccugggau

SEQ ID NO: 1674780 - RNA, 21 nt, Human
ugauucuccugccucagccuc

SEQ ID NO: 1674781 - RNA, 13 nt, Human
ugauuauauguca

SEQ ID NO: 1674782 - RNA, 17 nt, Human
ugauuaugaauuacauu

SEQ ID NO: 1674783 - RNA, 19 nt, Human
ugauuaugaauuacauuug

SEQ ID NO: 1674784 - RNA, 20 nt, Human
ugauguucuuucacccuuuu

SEQ ID NO: 1674785 - RNA, 22 nt, Human
ugauguuuagaaacacaacuau

SEQ ID NO: 1674786 - RNA, 12 nt, Human
ugauucacagug

SEQ ID NO: 1674787 - RNA, 13 nt, Human
ugauucagacagc

SEQ ID NO: 1674788 - RNA, 14 nt, Human
ugauucagacagcu

SEQ ID NO: 1674789 - RNA, 15 nt, Human
ugauucagacagcug

SEQ ID NO: 1674790 - RNA, 16 nt, Human
ugauucagacagcugc

SEQ ID NO: 1674791 - RNA, 20 nt, Human
ugauucaacagguuuuccug

SEQ ID NO: 1674792 - RNA, 21 nt, Human
ugauuaugaauuacauuugua

SEQ ID NO: 1674793 - RNA, 22 nt, Human
ugauuaugaauuacauuuguau

SEQ ID NO: 1674794 - RNA, 13 nt, Human
ugauccaagcugg

SEQ ID NO: 1674795 - RNA, 14 nt, Human
ugauccaagcuggu

SEQ ID NO: 1674796 - RNA, 15 nt, Human
ugauccaagcugguc

SEQ ID NO: 1674797 - RNA, 17 nt, Human
ugauccaagcugguccc

SEQ ID NO: 1674798 - RNA, 15 nt, Human
ugauagaggaagccu

SEQ ID NO: 1674799 - RNA, 13 nt, Human
ugauagcacagac

SEQ ID NO: 1674800 - RNA, 14 nt, Human
ugauagcacagacc

SEQ ID NO: 1674801 - RNA, 17 nt, Human
ugaucagcuuauugucu

SEQ ID NO: 1674802 - RNA, 24 nt, Human
ugaucagcuuauugucuagugaaa

SEQ ID NO: 1674803 - RNA, 17 nt, Human
ugaucucucgugauuga

SEQ ID NO: 1674804 - RNA, 22 nt, Human
ugaucucauuuaauccucucaa

SEQ ID NO: 1674805 - RNA, 17 nt, Human
ugauccacccaccucag

SEQ ID NO: 1674806 - RNA, 18 nt, Human
ugauccacccaccucagc

SEQ ID NO: 1674807 - RNA, 19 nt, Human
ugauccacccaccucagcc

SEQ ID NO: 1674808 - RNA, 15 nt, Human
ugaucucauuuaauc

SEQ ID NO: 1674809 - RNA, 15 nt, Human
ugaucugugggcaca

SEQ ID NO: 1674810 - RNA, 20 nt, Human
ugaucuucuuuauaauucua

SEQ ID NO: 1674811 - RNA, 14 nt, Human
ugaucuuuaaaaua

SEQ ID NO: 1674812 - RNA, 15 nt, Human
ugaugccugugaacu

SEQ ID NO: 1674813 - RNA, 20 nt, Human
ugaugccugugaacugaacu

SEQ ID NO: 1674814 - RNA, 11 nt, Human
ugaugccuggc

SEQ ID NO: 1674815 - RNA, 20 nt, Human
ugaugcuacaggauuugaaa

SEQ ID NO: 1674816 - RNA, 21 nt, Human
ugaugccugugaacugaacuc

SEQ ID NO: 1674817 - RNA, 23 nt, Human
ugaugcgggccagugcuccagcc

SEQ ID NO: 1674818 - RNA, 23 nt, Human
ugaugcuacaggauuugaaauug

SEQ ID NO: 1674819 - RNA, 18 nt, Human
ugaucuuugcagacaggc

SEQ ID NO: 1674820 - RNA, 16 nt, Human
ugaucuuugcagacag

SEQ ID NO: 1674821 - RNA, 17 nt, Human
ugaucuuuaaaauacac

SEQ ID NO: 1674822 - RNA, 14 nt, Human
ugaugguuccccug

SEQ ID NO: 1674823 - RNA, 13 nt, Human
ugaugguuguaca

SEQ ID NO: 1674824 - RNA, 14 nt, Human
ugaugguuguacau

SEQ ID NO: 1674825 - RNA, 21 nt, Human
ugaugguuguacauauaagug

SEQ ID NO: 1674826 - RNA, 16 nt, Human
ugaugcuucuucagag

SEQ ID NO: 1674827 - RNA, 17 nt, Human
ugaugcuucuucagaga

SEQ ID NO: 1674828 - RNA, 18 nt, Human
ugaugcuucuucagagac

SEQ ID NO: 1674829 - RNA, 19 nt, Human
ugaugucccaacuuguaaa

SEQ ID NO: 1674830 - RNA, 16 nt, Human
ugauguguuaucucuu

SEQ ID NO: 1674831 - RNA, 16 nt, Human
ugaggagcuugaaacc

SEQ ID NO: 1674832 - RNA, 13 nt, Human
ugagcugggauga

SEQ ID NO: 1674833 - RNA, 23 nt, Human
ugaggcauuuguuugaacugaua

SEQ ID NO: 1674834 - RNA, 23 nt, Human
ugaggcuagugugguguuuccug

SEQ ID NO: 1674835 - RNA, 21 nt, Human
ugaggcauuuguuugaacuga

SEQ ID NO: 1674836 - RNA, 17 nt, Human
ugaggcuaguguggugu

SEQ ID NO: 1674837 - RNA, 20 nt, Human
ugaggcauuuguuugaacug

SEQ ID NO: 1674838 - RNA, 19 nt, Human
ugaggcauuuguuugaacu

SEQ ID NO: 1674839 - RNA, 23 nt, Human
ugaggcaucgcaauguaagacuc

SEQ ID NO: 1674840 - RNA, 12 nt, Human
ugaggcauuugu

SEQ ID NO: 1674841 - RNA, 12 nt, Human
ugaggugggagg

SEQ ID NO: 1674842 - RNA, 13 nt, Human
ugaggugggagga

SEQ ID NO: 1674843 - RNA, 15 nt, Human
ugaggcucugcccuu

SEQ ID NO: 1674844 - RNA, 17 nt, Human
ugagggaacagagaggu

SEQ ID NO: 1674845 - RNA, 13 nt, Human
ugaggcucugccc

SEQ ID NO: 1674846 - RNA, 14 nt, Human
ugaggcucugcccu

SEQ ID NO: 1674847 - RNA, 18 nt, Human
ugaggcuccacuuggucu

SEQ ID NO: 1674848 - RNA, 20 nt, Human
ugaggcuccacuuggucugu

SEQ ID NO: 1674849 - RNA, 19 nt, Human
ugagucccaggcugagccu

SEQ ID NO: 1674850 - RNA, 19 nt, Human
ugagucgaggacagggagg

SEQ ID NO: 1674851 - RNA, 15 nt, Human
ugagucccaggcuga

SEQ ID NO: 1674852 - RNA, 21 nt, Human
ugaggugggaggaucucuuga

SEQ ID NO: 1674853 - RNA, 19 nt, Human
ugaguccagaaguuugaga

SEQ ID NO: 1674854 - RNA, 13 nt, Human
ugagucugaaggc

SEQ ID NO: 1674855 - RNA, 15 nt, Human
ugagucugaaggcug

SEQ ID NO: 1674856 - RNA, 17 nt, Human
ugagucugaaggcuggg

SEQ ID NO: 1674857 - RNA, 18 nt, Human
ugagucugaaggcugggu

SEQ ID NO: 1674858 - RNA, 14 nt, Human
ugagugagcaugcc

SEQ ID NO: 1674859 - RNA, 16 nt, Human
ugaguugauagcacag

SEQ ID NO: 1674860 - RNA, 20 nt, Human
ugaguugauagcacagaccc

SEQ ID NO: 1674861 - RNA, 22 nt, Human
ugaguuugggccccagaggcug

SEQ ID NO: 1674862 - RNA, 23 nt, Human
ugaguuugggccccagaggcugg

SEQ ID NO: 1674863 - RNA, 21 nt, Human
ugaguugauagcacagacccu

SEQ ID NO: 1674864 - RNA, 16 nt, Human
ugauaacuggaaacuu

SEQ ID NO: 1674865 - RNA, 18 nt, Human
ugagcccuguccugccua

SEQ ID NO: 1674866 - RNA, 19 nt, Human
ugagccgagaucacgccac

SEQ ID NO: 1674867 - RNA, 21 nt, Human
ugagccgagaucacgccacug

SEQ ID NO: 1674868 - RNA, 17 nt, Human
ugagccucagcauccug

SEQ ID NO: 1674869 - RNA, 14 nt, Human
ugagccucagucuc

SEQ ID NO: 1674870 - RNA, 22 nt, Human
ugagccucagcauccuggcacc

SEQ ID NO: 1674871 - RNA, 18 nt, Human
ugagccucagcauccugg

SEQ ID NO: 1674872 - RNA, 21 nt, Human
ugagccucagcauccuggcac

SEQ ID NO: 1674873 - RNA, 18 nt, Human
ugagcaucaggccaggcc

SEQ ID NO: 1674874 - RNA, 19 nt, Human
ugagcaucaggccaggccc

SEQ ID NO: 1674875 - RNA, 20 nt, Human
ugagcaucaggccaggcccu

SEQ ID NO: 1674876 - RNA, 15 nt, Human
ugagcaucacaguuu

SEQ ID NO: 1674877 - RNA, 19 nt, Human
ugagcagggcucagcgggg

SEQ ID NO: 1674878 - RNA, 16 nt, Human
ugagcagggcucagcg

SEQ ID NO: 1674879 - RNA, 17 nt, Human
ugagcagggcucagcgg

SEQ ID NO: 1674880 - RNA, 14 nt, Human
ugagcaucacaguu

SEQ ID NO: 1674881 - RNA, 16 nt, Human
ugagcaucacaguuuu

SEQ ID NO: 1674882 - RNA, 15 nt, Human
ugagaucaaaacggu

SEQ ID NO: 1674883 - RNA, 14 nt, Human
ugagaucagccugg

SEQ ID NO: 1674884 - RNA, 15 nt, Human
ugagaucagccuggg

SEQ ID NO: 1674885 - RNA, 12 nt, Human
ugagcagggcuc

SEQ ID NO: 1674886 - RNA, 13 nt, Human
ugagcagggcuca

SEQ ID NO: 1674887 - RNA, 14 nt, Human
ugagcagggcucag

SEQ ID NO: 1674888 - RNA, 15 nt, Human
ugagcagggcucagc

SEQ ID NO: 1674889 - RNA, 20 nt, Human
ugagacucgcgacaaugcaa

SEQ ID NO: 1674890 - RNA, 21 nt, Human
ugagacucgcgacaaugcaaa

SEQ ID NO: 1674891 - RNA, 22 nt, Human
ugagacucgcgacaaugcaaac

SEQ ID NO: 1674892 - RNA, 23 nt, Human
ugagacucgcgacaaugcaaacc

SEQ ID NO: 1674893 - RNA, 16 nt, Human
ugagagugaacaaauu

SEQ ID NO: 1674894 - RNA, 17 nt, Human
ugagaaauuuauaaacu

SEQ ID NO: 1674895 - RNA, 22 nt, Human
ugaccucagcuuugauauuuca

SEQ ID NO: 1674896 - RNA, 20 nt, Human
ugaccucaggugauccaccc

SEQ ID NO: 1674897 - RNA, 21 nt, Human
ugaccucaggugauccaccca

SEQ ID NO: 1674898 - RNA, 19 nt, Human
ugagacucgcgacaaugca

SEQ ID NO: 1674899 - RNA, 22 nt, Human
ucuccucuugccacugccucuu

SEQ ID NO: 1674900 - RNA, 17 nt, Human
ucuccucuugccacugc

SEQ ID NO: 1674901 - RNA, 13 nt, Human
ucuccucuugcca

SEQ ID NO: 1674902 - RNA, 16 nt, Human
ucuccucuugccacug

SEQ ID NO: 1674903 - RNA, 16 nt, Human
ucucccuucauccuuc

SEQ ID NO: 1674904 - RNA, 20 nt, Human
ucuccucugcugcuggcugg

SEQ ID NO: 1674905 - RNA, 19 nt, Human
ucuugccuuuuucauuauu

SEQ ID NO: 1674906 - RNA, 16 nt, Human
ucuugccuuuuucauu

SEQ ID NO: 1674907 - RNA, 17 nt, Human
ucuugccuuuuucauua

SEQ ID NO: 1674908 - RNA, 15 nt, Human
ucuugcaugaggcua

SEQ ID NO: 1674909 - RNA, 16 nt, Human
ucuuguguguuuauug

SEQ ID NO: 1674910 - RNA, 21 nt, Human
ucuuguguguuuauugucaaa

SEQ ID NO: 1674911 - RNA, 23 nt, Human
ucuuucacccuuuucuguuugcu

SEQ ID NO: 1674912 - RNA, 14 nt, Human
ucuuuccaaaguac

SEQ ID NO: 1674913 - RNA, 13 nt, Human
ucuuuccaaagua

SEQ ID NO: 1674914 - RNA, 16 nt, Human
ucuuucagccaagaau

SEQ ID NO: 1674915 - RNA, 19 nt, Human
ucuuucagccaagaauucu

SEQ ID NO: 1674916 - RNA, 20 nt, Human
ucuuucagccaagaauucuu

SEQ ID NO: 1674917 - RNA, 21 nt, Human
ucuuucagccaagaauucuua

SEQ ID NO: 1674918 - RNA, 17 nt, Human
ucuuuccaaaguacacu

SEQ ID NO: 1674919 - RNA, 19 nt, Human
ucuuuccacagaagcucca

SEQ ID NO: 1674920 - RNA, 17 nt, Human
ucuuuggacacucacac

SEQ ID NO: 1674921 - RNA, 12 nt, Human
ucuuugccaagu

SEQ ID NO: 1674922 - RNA, 19 nt, Human
ugaacaguuguguuugaag

SEQ ID NO: 1674923 - RNA, 22 nt, Human
ugaaccaagaacuuuccaggaa

SEQ ID NO: 1674924 - RNA, 19 nt, Human
ugaaccacaucuugcucug

SEQ ID NO: 1674925 - RNA, 23 nt, Human
ugaaccacaucuugcucugcuga

SEQ ID NO: 1674926 - RNA, 17 nt, Human
ugaaccaccacacccag

SEQ ID NO: 1674927 - RNA, 20 nt, Human
ugaaccaccacacccagccc

SEQ ID NO: 1674928 - RNA, 16 nt, Human
ugaacuccuggccuca

SEQ ID NO: 1674929 - RNA, 12 nt, Human
ugaaauuauuca

SEQ ID NO: 1674930 - RNA, 16 nt, Human
ugaaaucaguuacucu

SEQ ID NO: 1674931 - RNA, 17 nt, Human
ugaaaucaguuacucuu

SEQ ID NO: 1674932 - RNA, 15 nt, Human
ugaaaucauucauuu

SEQ ID NO: 1674933 - RNA, 16 nt, Human
ugaaauauugacuuuu

SEQ ID NO: 1674934 - RNA, 21 nt, Human
ugaaaauuuugauguuuuaag

SEQ ID NO: 1674935 - RNA, 19 nt, Human
ugaaaauuuugauguuuua

SEQ ID NO: 1674936 - RNA, 13 nt, Human
ugaaaauuuugau

SEQ ID NO: 1674937 - RNA, 20 nt, Human
ugaaaagcuccauuuuuagu

SEQ ID NO: 1674938 - RNA, 14 nt, Human
ugaaacauuuuguc

SEQ ID NO: 1674939 - RNA, 22 nt, Human
ugaaacaacaaauaggaauugu

SEQ ID NO: 1674940 - RNA, 23 nt, Human
ugaaagggaguauuacaaaaaca

SEQ ID NO: 1674941 - RNA, 13 nt, Human
ugaaagggcccag

SEQ ID NO: 1674942 - RNA, 16 nt, Human
ugaaagguacuucaaa

SEQ ID NO: 1674943 - RNA, 15 nt, Human
ugaaagggcccagag

SEQ ID NO: 1674944 - RNA, 15 nt, Human
ugaaagguacuucaa

SEQ ID NO: 1674945 - RNA, 19 nt, Human
ugaaagauggcugugccuc

SEQ ID NO: 1674946 - RNA, 18 nt, Human
ugaaagauggcugugccu

SEQ ID NO: 1674947 - RNA, 18 nt, Human
ugaaagcccugagcuuuc

SEQ ID NO: 1674948 - RNA, 18 nt, Human
ugaaagaggcagcuugaa

SEQ ID NO: 1674949 - RNA, 20 nt, Human
ugaaggaauaaauugcuccu

SEQ ID NO: 1674950 - RNA, 15 nt, Human
ugaagauacugaaau

SEQ ID NO: 1674951 - RNA, 16 nt, Human
ugaagauacugaaaua

SEQ ID NO: 1674952 - RNA, 18 nt, Human
ugaagauacugaaauaaa

SEQ ID NO: 1674953 - RNA, 14 nt, Human
ugaagauacugaaa

SEQ ID NO: 1674954 - RNA, 16 nt, Human
ugaacucugacaacag

SEQ ID NO: 1674955 - RNA, 17 nt, Human
ugaacuccuggccucaa

SEQ ID NO: 1674956 - RNA, 20 nt, Human
ugaaggagagcccuucauuu

SEQ ID NO: 1674957 - RNA, 16 nt, Human
ugaaggagagcccuuc

SEQ ID NO: 1674958 - RNA, 15 nt, Human
ugaaggccccgccca

SEQ ID NO: 1674959 - RNA, 16 nt, Human
ugaaggccccgcccag

SEQ ID NO: 1674960 - RNA, 22 nt, Human
ugaaggacauugcggacagcca

SEQ ID NO: 1674961 - RNA, 19 nt, Human
ugaaggacauugcggacag

SEQ ID NO: 1674962 - RNA, 20 nt, Human
ugaaggacauugcggacagc

SEQ ID NO: 1674963 - RNA, 13 nt, Human
ugaaguccaagca

SEQ ID NO: 1674964 - RNA, 14 nt, Human
ugaagugaaacugc

SEQ ID NO: 1674965 - RNA, 13 nt, Human
ugaagugaaacug

SEQ ID NO: 1674966 - RNA, 20 nt, Human
ugaagucagaucugccuaag

SEQ ID NO: 1674967 - RNA, 17 nt, Human
ugaaggccccgcccagg

SEQ ID NO: 1674968 - RNA, 23 nt, Human
ugaagucagaucugccuaaggac

SEQ ID NO: 1674969 - RNA, 11 nt, Human
ugaaguccaag

SEQ ID NO: 1674970 - RNA, 14 nt, Human
ugaauaaagacacc

SEQ ID NO: 1674971 - RNA, 15 nt, Human
ugaauaaagacaccu

SEQ ID NO: 1674972 - RNA, 22 nt, Human
ugaaucauuuuaccuuugacaa

SEQ ID NO: 1674973 - RNA, 23 nt, Human
ugaaucauuuuaccuuugacaaa

SEQ ID NO: 1674974 - RNA, 23 nt, Human
ugaaugaugauccuaggcauuug

SEQ ID NO: 1674975 - RNA, 16 nt, Human
ugaauuauuuucucuc

SEQ ID NO: 1674976 - RNA, 13 nt, Human
ugaauuaugaaac

SEQ ID NO: 1674977 - RNA, 15 nt, Human
ugaauuaugaaacuu

SEQ ID NO: 1674978 - RNA, 17 nt, Human
ugaauuaugaaacuuuu

SEQ ID NO: 1674979 - RNA, 15 nt, Human
ugaauuacauuugua

SEQ ID NO: 1674980 - RNA, 16 nt, Human
ugaauuacauuuguau

SEQ ID NO: 1674981 - RNA, 18 nt, Human
ugaauuacauuuguauaa

SEQ ID NO: 1674982 - RNA, 20 nt, Human
ugaccagcaccaucucuccu

SEQ ID NO: 1674983 - RNA, 16 nt, Human
ugaccauucuccaccu

SEQ ID NO: 1674984 - RNA, 17 nt, Human
ugaccauucuccaccug

SEQ ID NO: 1674985 - RNA, 18 nt, Human
ugaccauucuccaccugc

SEQ ID NO: 1674986 - RNA, 19 nt, Human
ugaccauucuccaccugcc

SEQ ID NO: 1674987 - RNA, 13 nt, Human
ugaccgugaggcc

SEQ ID NO: 1674988 - RNA, 14 nt, Human
ugaccgugaggcca

SEQ ID NO: 1674989 - RNA, 16 nt, Human
ugaccgugaggccaga

SEQ ID NO: 1674990 - RNA, 20 nt, Human
ugaccgugaggccagagaca

SEQ ID NO: 1674991 - RNA, 17 nt, Human
ugacauagucuggcugu

SEQ ID NO: 1674992 - RNA, 16 nt, Human
ugacauagucuggcug

SEQ ID NO: 1674993 - RNA, 16 nt, Human
ugacaugggacauuug

SEQ ID NO: 1674994 - RNA, 17 nt, Human
ugacaugggacauuugc

SEQ ID NO: 1674995 - RNA, 13 nt, Human
ugacaugucuuuu

SEQ ID NO: 1674996 - RNA, 18 nt, Human
ugacaugggacauuugcu

SEQ ID NO: 1674997 - RNA, 15 nt, Human
ugacaugucuuuucu

SEQ ID NO: 1674998 - RNA, 19 nt, Human
ugaccagcaccaucucucc

SEQ ID NO: 1674999 - RNA, 20 nt, Human
ugaccacugcagaagacagu

SEQ ID NO: 1675000 - RNA, 16 nt, Human
ugacagacagcccucc

SEQ ID NO: 1675001 - RNA, 20 nt, Human
ugacagacacaggcccggcu

SEQ ID NO: 1675002 - RNA, 23 nt, Human
ugacagacacaggcccggcucca

SEQ ID NO: 1675003 - RNA, 14 nt, Human
ugacagaggcagcc

SEQ ID NO: 1675004 - RNA, 15 nt, Human
ugacagaggcagccc

SEQ ID NO: 1675005 - RNA, 16 nt, Human
ugacagaggcagcccc

SEQ ID NO: 1675006 - RNA, 17 nt, Human
ugacagaggcagcccca

SEQ ID NO: 1675007 - RNA, 18 nt, Human
ugacagaggcagccccau

SEQ ID NO: 1675008 - RNA, 23 nt, Human
ugacagaggcagccccauucugc

SEQ ID NO: 1675009 - RNA, 14 nt, Human
ugacagagugagac

SEQ ID NO: 1675010 - RNA, 17 nt, Human
ugacagagugagacucu

SEQ ID NO: 1675011 - RNA, 23 nt, Human
ugacauaaguauuuaauucaugu

SEQ ID NO: 1675012 - RNA, 19 nt, Human
ugacagagugagacucugu

SEQ ID NO: 1675013 - RNA, 22 nt, Human
ugacagagugagacucugucuc

SEQ ID NO: 1675014 - RNA, 12 nt, Human
ugacaagcucac

SEQ ID NO: 1675015 - RNA, 18 nt, Human
ugacaaggauugcuacug

SEQ ID NO: 1675016 - RNA, 15 nt, Human
ugacaagcucacaga

SEQ ID NO: 1675017 - RNA, 20 nt, Human
ugacaagcucacagaccuuu

SEQ ID NO: 1675018 - RNA, 16 nt, Human
uccugccuaaggcuga

SEQ ID NO: 1675019 - RNA, 19 nt, Human
uccugccuaaggcugaacu

SEQ ID NO: 1675020 - RNA, 14 nt, Human
uccuggaguucugg

SEQ ID NO: 1675021 - RNA, 20 nt, Human
uccugcccuuaccugccagg

SEQ ID NO: 1675022 - RNA, 11 nt, Human
uccugcccugg

SEQ ID NO: 1675023 - RNA, 12 nt, Human
uccugcccuggg

SEQ ID NO: 1675024 - RNA, 14 nt, Human
uccugcccugggag

SEQ ID NO: 1675025 - RNA, 15 nt, Human
uccugcccugggagg

SEQ ID NO: 1675026 - RNA, 21 nt, Human
uccugcccugggaggcaguga

SEQ ID NO: 1675027 - RNA, 17 nt, Human
uccugcccuuaccugcc

SEQ ID NO: 1675028 - RNA, 11 nt, Human
uccuguagccc

SEQ ID NO: 1675029 - RNA, 13 nt, Human
uccuguagcccua

SEQ ID NO: 1675030 - RNA, 12 nt, Human
uccuggccucaa

SEQ ID NO: 1675031 - RNA, 13 nt, Human
uccuggcacugcu

SEQ ID NO: 1675032 - RNA, 16 nt, Human
uccuggcacugcuucc

SEQ ID NO: 1675033 - RNA, 23 nt, Human
uccuggcacccggccccugcugg

SEQ ID NO: 1675034 - RNA, 17 nt, Human
uccuggcaauagucaaa

SEQ ID NO: 1675035 - RNA, 11 nt, Human
uccugccacca

SEQ ID NO: 1675036 - RNA, 16 nt, Human
uccugccaccacgccc

SEQ ID NO: 1675037 - RNA, 13 nt, Human
uccugccaggcau

SEQ ID NO: 1675038 - RNA, 14 nt, Human
uccugccaggcaug

SEQ ID NO: 1675039 - RNA, 16 nt, Human
uccugcauuugugaaa

SEQ ID NO: 1675040 - RNA, 21 nt, Human
uccugaggcuccacuuggucu

SEQ ID NO: 1675041 - RNA, 19 nt, Human
uccugaggcuccacuuggu

SEQ ID NO: 1675042 - RNA, 20 nt, Human
uccugaggcuccacuugguc

SEQ ID NO: 1675043 - RNA, 17 nt, Human
uccugccccugagccca

SEQ ID NO: 1675044 - RNA, 10 nt, Human
uccugcccug

SEQ ID NO: 1675045 - RNA, 18 nt, Human
uccugccccugagcccau

SEQ ID NO: 1675046 - RNA, 15 nt, Human
ucccuuccucuuucc

SEQ ID NO: 1675047 - RNA, 16 nt, Human
ucccuuccucuuucca

SEQ ID NO: 1675048 - RNA, 15 nt, Human
ucccccuuccaugga

SEQ ID NO: 1675049 - RNA, 14 nt, Human
uccgccucuugggu

SEQ ID NO: 1675050 - RNA, 18 nt, Human
uccgcuuucuacccagcg

SEQ ID NO: 1675051 - RNA, 20 nt, Human
uccgcuuucuacccagcgag

SEQ ID NO: 1675052 - RNA, 20 nt, Human
uccuaagcuauucaguaaua

SEQ ID NO: 1675053 - RNA, 21 nt, Human
uccuaagcuauucaguaauaa

SEQ ID NO: 1675054 - RNA, 16 nt, Human
uccgcuuucuacccag

SEQ ID NO: 1675055 - RNA, 12 nt, Human
uccucccaccuc

SEQ ID NO: 1675056 - RNA, 13 nt, Human
uccucccaccuca

SEQ ID NO: 1675057 - RNA, 10 nt, Human
uccuccaggu

SEQ ID NO: 1675058 - RNA, 17 nt, Human
uccuaucagaaguuucu

SEQ ID NO: 1675059 - RNA, 18 nt, Human
uccucauuagcauuuugc

SEQ ID NO: 1675060 - RNA, 20 nt, Human
uccuaucaccugucuugccu

SEQ ID NO: 1675061 - RNA, 12 nt, Human
uccuaguuccac

SEQ ID NO: 1675062 - RNA, 23 nt, Human
uccuauauuguuuucaguguaca

SEQ ID NO: 1675063 - RNA, 14 nt, Human
uccuagugaaagag

SEQ ID NO: 1675064 - RNA, 23 nt, Human
uccuagugaaagaggcagcuuga

SEQ ID NO: 1675065 - RNA, 22 nt, Human
ucuccagccccuggaugcagcc

SEQ ID NO: 1675066 - RNA, 16 nt, Human
ucuccagccccuggau

SEQ ID NO: 1675067 - RNA, 18 nt, Human
ucuccagccccuggaugc

SEQ ID NO: 1675068 - RNA, 14 nt, Human
ucuccacugccuuc

SEQ ID NO: 1675069 - RNA, 12 nt, Human
ucuccagccccu

SEQ ID NO: 1675070 - RNA, 13 nt, Human
ucuccagccccug

SEQ ID NO: 1675071 - RNA, 14 nt, Human
ucuccagccccugg

SEQ ID NO: 1675072 - RNA, 15 nt, Human
ucuccagccccugga

SEQ ID NO: 1675073 - RNA, 14 nt, Human
ucucccucccuugg

SEQ ID NO: 1675074 - RNA, 18 nt, Human
ucucccucagucuggccc

SEQ ID NO: 1675075 - RNA, 23 nt, Human
ucucccucagucuggcccuuccu

SEQ ID NO: 1675076 - RNA, 11 nt, Human
ucuccaggcug

SEQ ID NO: 1675077 - RNA, 12 nt, Human
ucucccccagcc

SEQ ID NO: 1675078 - RNA, 13 nt, Human
ucucccccagccc

SEQ ID NO: 1675079 - RNA, 13 nt, Human
ucucaugccucag

SEQ ID NO: 1675080 - RNA, 16 nt, Human
ucucaugccucagccu

SEQ ID NO: 1675081 - RNA, 19 nt, Human
ucucaugccucagccuccu

SEQ ID NO: 1675082 - RNA, 13 nt, Human
ucuccacccugcu

SEQ ID NO: 1675083 - RNA, 17 nt, Human
ucuccacccugcucucc

SEQ ID NO: 1675084 - RNA, 14 nt, Human
ucuccacccugcuc

SEQ ID NO: 1675085 - RNA, 16 nt, Human
ucuccacccugcucuc

SEQ ID NO: 1675086 - RNA, 13 nt, Human
ucuccacuccaga

SEQ ID NO: 1675087 - RNA, 22 nt, Human
ucuccaccugccagggacagag

SEQ ID NO: 1675088 - RNA, 17 nt, Human
ucuccaccugccaggga

SEQ ID NO: 1675089 - RNA, 19 nt, Human
ucuccaccugccagggaca

SEQ ID NO: 1675090 - RNA, 14 nt, Human
ucuccaccugccag

SEQ ID NO: 1675091 - RNA, 15 nt, Human
ucuccaccugccagg

SEQ ID NO: 1675092 - RNA, 16 nt, Human
ucuccaccugccaggg

SEQ ID NO: 1675093 - RNA, 16 nt, Human
ucucauacucaccuca

SEQ ID NO: 1675094 - RNA, 18 nt, Human
ucucauacucaccucacc

SEQ ID NO: 1675095 - RNA, 23 nt, Human
ucuaugggacucaaugcacugac

SEQ ID NO: 1675096 - RNA, 19 nt, Human
ucuaugggacucaaugcac

SEQ ID NO: 1675097 - RNA, 12 nt, Human
ucuaugggacuc

SEQ ID NO: 1675098 - RNA, 13 nt, Human
ucuaugggacuca

SEQ ID NO: 1675099 - RNA, 23 nt, Human
ucucaguccaugaagauguagag

SEQ ID NO: 1675100 - RNA, 16 nt, Human
ucguguccccuauccu

SEQ ID NO: 1675101 - RNA, 20 nt, Human
ucuaaaggcuaccuuuguau

SEQ ID NO: 1675102 - RNA, 19 nt, Human
ucuaaaggcuaccuuugua

SEQ ID NO: 1675103 - RNA, 17 nt, Human
ucuaaaggcuaccuuug

SEQ ID NO: 1675104 - RNA, 18 nt, Human
ucuaaaggcuaccuuugu

SEQ ID NO: 1675105 - RNA, 13 nt, Human
ucgugacaacacu

SEQ ID NO: 1675106 - RNA, 12 nt, Human
ucggagaagagc

SEQ ID NO: 1675107 - RNA, 18 nt, Human
ucggacuuagcugggaga

SEQ ID NO: 1675108 - RNA, 14 nt, Human
ucggagaagagcug

SEQ ID NO: 1675109 - RNA, 16 nt, Human
ucggagaagagcuguu

SEQ ID NO: 1675110 - RNA, 15 nt, Human
ucuaggaagacuuug

SEQ ID NO: 1675111 - RNA, 16 nt, Human
ucuaggaagacuuugg

SEQ ID NO: 1675112 - RNA, 19 nt, Human
ucuaggaagacuuuggaaa

SEQ ID NO: 1675113 - RNA, 21 nt, Human
ucuaggaagacuuuggaaaga

SEQ ID NO: 1675114 - RNA, 17 nt, Human
ucuaugacacaugcaag

SEQ ID NO: 1675115 - RNA, 18 nt, Human
ucuaugaaauauuauguu

SEQ ID NO: 1675116 - RNA, 14 nt, Human
ucuaugacacaugc

SEQ ID NO: 1675117 - RNA, 14 nt, Human
ucuaucaccaagga

SEQ ID NO: 1675118 - RNA, 14 nt, Human
ucuaccuuccugca

SEQ ID NO: 1675119 - RNA, 15 nt, Human
ucuacagaggccaug

SEQ ID NO: 1675120 - RNA, 16 nt, Human
ucuacagaggccaugg

SEQ ID NO: 1675121 - RNA, 17 nt, Human
ucuacacuaagagagaa

SEQ ID NO: 1675122 - RNA, 23 nt, Human
ucccagcugugcucuggacaggc

SEQ ID NO: 1675123 - RNA, 21 nt, Human
ucccagcugugcucuggacag

SEQ ID NO: 1675124 - RNA, 22 nt, Human
ucccagcugugcucuggacagg

SEQ ID NO: 1675125 - RNA, 24 nt, Human
ucccaggcauuccccaggaggcca

SEQ ID NO: 1675126 - RNA, 16 nt, Human
ucccaggcgccccuuc

SEQ ID NO: 1675127 - RNA, 15 nt, Human
ucccaucuuccaagg

SEQ ID NO: 1675128 - RNA, 18 nt, Human
ucccaugagccucagcau

SEQ ID NO: 1675129 - RNA, 19 nt, Human
ucccaugagccucagcauc

SEQ ID NO: 1675130 - RNA, 20 nt, Human
uccaugugggcuaguugggc

SEQ ID NO: 1675131 - RNA, 22 nt, Human
ucccaccucucucacuccuuga

SEQ ID NO: 1675132 - RNA, 13 nt, Human
ucccaccuuggcu

SEQ ID NO: 1675133 - RNA, 16 nt, Human
ucccaccuuggcugca

SEQ ID NO: 1675134 - RNA, 17 nt, Human
ucccaccuuggcugcag

SEQ ID NO: 1675135 - RNA, 20 nt, Human
ucccagcugugcucuggaca

SEQ ID NO: 1675136 - RNA, 18 nt, Human
ucccaccuuggcugcagg

SEQ ID NO: 1675137 - RNA, 13 nt, Human
ucccauuauucaa

SEQ ID NO: 1675138 - RNA, 14 nt, Human
ucccauuauucaaa

SEQ ID NO: 1675139 - RNA, 20 nt, Human
ucccaugagccucagcaucc

SEQ ID NO: 1675140 - RNA, 16 nt, Human
ucccauuauucaaagu

SEQ ID NO: 1675141 - RNA, 18 nt, Human
ucccauuauucaaaguug

SEQ ID NO: 1675142 - RNA, 19 nt, Human
ucccauuauucaaaguugc

SEQ ID NO: 1675143 - RNA, 13 nt, Human
uccccagauugca

SEQ ID NO: 1675144 - RNA, 18 nt, Human
uccccagauugcaacagg

SEQ ID NO: 1675145 - RNA, 19 nt, Human
uccccagauugcaacaggc

SEQ ID NO: 1675146 - RNA, 20 nt, Human
uccccagauugcaacaggcu

SEQ ID NO: 1675147 - RNA, 22 nt, Human
uccccagauugcaacaggcugg

SEQ ID NO: 1675148 - RNA, 23 nt, Human
uccccagauugcaacaggcuggg

SEQ ID NO: 1675149 - RNA, 20 nt, Human
uccccagcaagugagagcug

SEQ ID NO: 1675150 - RNA, 21 nt, Human
uccccagcaagugagagcugg

SEQ ID NO: 1675151 - RNA, 22 nt, Human
uccccagcaagugagagcuggg

SEQ ID NO: 1675152 - RNA, 22 nt, Human
ucccccagccccauccucugua

SEQ ID NO: 1675153 - RNA, 20 nt, Human
ucccccagccccauccucug

SEQ ID NO: 1675154 - RNA, 21 nt, Human
ucccccagccccauccucugu

SEQ ID NO: 1675155 - RNA, 15 nt, Human
uccccaggaggccag

SEQ ID NO: 1675156 - RNA, 16 nt, Human
uccccaggaggccagc

SEQ ID NO: 1675157 - RNA, 17 nt, Human
ucccccagccccauccu

SEQ ID NO: 1675158 - RNA, 17 nt, Human
uccccaggaggccagcc

SEQ ID NO: 1675159 - RNA, 14 nt, Human
uccccaggaggcca

SEQ ID NO: 1675160 - RNA, 14 nt, Human
uccagcagauuauu

SEQ ID NO: 1675161 - RNA, 15 nt, Human
uccagcagauuauuc

SEQ ID NO: 1675162 - RNA, 16 nt, Human
uccagcagauuauuca

SEQ ID NO: 1675163 - RNA, 22 nt, Human
uccagcaauucuccugccucag

SEQ ID NO: 1675164 - RNA, 17 nt, Human
uccagcagauuauucac

SEQ ID NO: 1675165 - RNA, 19 nt, Human
uccaggggugggacacccu

SEQ ID NO: 1675166 - RNA, 20 nt, Human
uccaggggugggacacccug

SEQ ID NO: 1675167 - RNA, 12 nt, Human
uccaggagcagc

SEQ ID NO: 1675168 - RNA, 13 nt, Human
uccaggagcagcc

SEQ ID NO: 1675169 - RNA, 14 nt, Human
uccaggagcagcca

SEQ ID NO: 1675170 - RNA, 15 nt, Human
uccaggagcagccac

SEQ ID NO: 1675171 - RNA, 23 nt, Human
uccagaaagaaaacuuguauuau

SEQ ID NO: 1675172 - RNA, 16 nt, Human
uccaaaguacacuguu

SEQ ID NO: 1675173 - RNA, 14 nt, Human
uccaaaguacacug

SEQ ID NO: 1675174 - RNA, 21 nt, Human
uccacuuggucugugagaugc

SEQ ID NO: 1675175 - RNA, 20 nt, Human
uccacuuucuagccagagga

SEQ ID NO: 1675176 - RNA, 21 nt, Human
uccacuuucuagccagaggag

SEQ ID NO: 1675177 - RNA, 23 nt, Human
uccacuuggucugugagaugcua

SEQ ID NO: 1675178 - RNA, 14 nt, Human
uccaugcugccucc

SEQ ID NO: 1675179 - RNA, 15 nt, Human
uccaugcugccucca

SEQ ID NO: 1675180 - RNA, 13 nt, Human
uccauggacuuug

SEQ ID NO: 1675181 - RNA, 20 nt, Human
uccaugggccauaugaaaag

SEQ ID NO: 1675182 - RNA, 14 nt, Human
uccaucaggccacu

SEQ ID NO: 1675183 - RNA, 14 nt, Human
uccauagagagcaa

SEQ ID NO: 1675184 - RNA, 15 nt, Human
uccauagagagcaag

SEQ ID NO: 1675185 - RNA, 21 nt, Human
uccauaaucuggacuccucug

SEQ ID NO: 1675186 - RNA, 15 nt, Human
uccauacauuugugu

SEQ ID NO: 1675187 - RNA, 20 nt, Human
uccaguuuuguuuggaccaa

SEQ ID NO: 1675188 - RNA, 22 nt, Human
uccauaaucuggacuccucugu

SEQ ID NO: 1675189 - RNA, 15 nt, Human
uccaguuuuguuugg

SEQ ID NO: 1675190 - RNA, 17 nt, Human
uccaguuuuguuuggac

SEQ ID NO: 1675191 - RNA, 20 nt, Human
uccagguuuaagcuguuacu

SEQ ID NO: 1675192 - RNA, 22 nt, Human
uccaggggugggacacccugug

SEQ ID NO: 1675193 - RNA, 19 nt, Human
uccagguagagggugugua

SEQ ID NO: 1675194 - RNA, 21 nt, Human
ucagucugauucccaagcucu

SEQ ID NO: 1675195 - RNA, 22 nt, Human
ucagucugauucccaagcucug

SEQ ID NO: 1675196 - RNA, 23 nt, Human
ucagucugauucccaagcucugc

SEQ ID NO: 1675197 - RNA, 16 nt, Human
ucagucucccucccuu

SEQ ID NO: 1675198 - RNA, 20 nt, Human
ucagguggggcagcuugagg

SEQ ID NO: 1675199 - RNA, 23 nt, Human
ucaguauugaagcauuuuauaaa

SEQ ID NO: 1675200 - RNA, 16 nt, Human
ucaggcucuucuccuu

SEQ ID NO: 1675201 - RNA, 21 nt, Human
ucaggcucuucuccuuucaca

SEQ ID NO: 1675202 - RNA, 12 nt, Human
ucaggucccugc

SEQ ID NO: 1675203 - RNA, 23 nt, Human
ucaggugagaagcagaggaagga

SEQ ID NO: 1675204 - RNA, 16 nt, Human
ucaggugauccaccca

SEQ ID NO: 1675205 - RNA, 23 nt, Human
ucaggugccucaagagaaggcaa

SEQ ID NO: 1675206 - RNA, 23 nt, Human
ucaggugauccacccaccucagc

SEQ ID NO: 1675207 - RNA, 18 nt, Human
ucagguggggcagcuuga

SEQ ID NO: 1675208 - RNA, 19 nt, Human
ucagguggggcagcuugag

SEQ ID NO: 1675209 - RNA, 11 nt, Human
ucaggagcccu

SEQ ID NO: 1675210 - RNA, 12 nt, Human
ucaggagcccug

SEQ ID NO: 1675211 - RNA, 14 nt, Human
ucaggagcccuggg

SEQ ID NO: 1675212 - RNA, 15 nt, Human
ucaggagcccuggga

SEQ ID NO: 1675213 - RNA, 20 nt, Human
ucaggaucaaaccccgacca

SEQ ID NO: 1675214 - RNA, 15 nt, Human
ucaggcucuucuccu

SEQ ID NO: 1675215 - RNA, 21 nt, Human
ucaggccugggggcugggcag

SEQ ID NO: 1675216 - RNA, 23 nt, Human
ucagcucugcaagaauugaagca

SEQ ID NO: 1675217 - RNA, 23 nt, Human
ucaggaagcucagggccuggcuc

SEQ ID NO: 1675218 - RNA, 23 nt, Human
ucagcuccagcucaccagcccca

SEQ ID NO: 1675219 - RNA, 24 nt, Human
ucagcuccagcucaccagccccag

SEQ ID NO: 1675220 - RNA, 20 nt, Human
ucauggaacgcguugaaauu

SEQ ID NO: 1675221 - RNA, 21 nt, Human
ucauggaacgcguugaaauug

SEQ ID NO: 1675222 - RNA, 22 nt, Human
ucauggaacgcguugaaauugu

SEQ ID NO: 1675223 - RNA, 17 nt, Human
ucaugcuguucaugaaa

SEQ ID NO: 1675224 - RNA, 16 nt, Human
ucaucuccccaucauu

SEQ ID NO: 1675225 - RNA, 18 nt, Human
ucauccacugugccaugu

SEQ ID NO: 1675226 - RNA, 14 nt, Human
ucauccacugugcc

SEQ ID NO: 1675227 - RNA, 17 nt, Human
ucauccacugugccaug

SEQ ID NO: 1675228 - RNA, 17 nt, Human
ucaucaaugaaugaaug

SEQ ID NO: 1675229 - RNA, 16 nt, Human
ucagugccaaaaacaa

SEQ ID NO: 1675230 - RNA, 20 nt, Human
ucaguguacauggaauaaca

SEQ ID NO: 1675231 - RNA, 12 nt, Human
ucauagcagcuu

SEQ ID NO: 1675232 - RNA, 11 nt, Human
ucauagcagcu

SEQ ID NO: 1675233 - RNA, 14 nt, Human
ucauggugcucaga

SEQ ID NO: 1675234 - RNA, 16 nt, Human
ucauuaggauggcuag

SEQ ID NO: 1675235 - RNA, 13 nt, Human
uccaaaguacacu

SEQ ID NO: 1675236 - RNA, 14 nt, Human
uccaaagaaaugua

SEQ ID NO: 1675237 - RNA, 17 nt, Human
uccaaagaaauguaagg

SEQ ID NO: 1675238 - RNA, 14 nt, Human
uauggaggcaggag

SEQ ID NO: 1675239 - RNA, 13 nt, Human
uauguguguuuua

SEQ ID NO: 1675240 - RNA, 19 nt, Human
uauggaggcuuugcauaga

SEQ ID NO: 1675241 - RNA, 12 nt, Human
uauguuaaaacu

SEQ ID NO: 1675242 - RNA, 19 nt, Human
uauguuagugcaaauuguc

SEQ ID NO: 1675243 - RNA, 16 nt, Human
uauuaagaaagacuau

SEQ ID NO: 1675244 - RNA, 15 nt, Human
uauuaaaugcccagc

SEQ ID NO: 1675245 - RNA, 17 nt, Human
uauuaaaugcccagccc

SEQ ID NO: 1675246 - RNA, 19 nt, Human
uauuaaaugcccagccccu

SEQ ID NO: 1675247 - RNA, 17 nt, Human
uauguugaagccuuugu

SEQ ID NO: 1675248 - RNA, 21 nt, Human
uauguugcccaggcaggucuu

SEQ ID NO: 1675249 - RNA, 22 nt, Human
uauguucuuaguggauguucug

SEQ ID NO: 1675250 - RNA, 17 nt, Human
uauguucuaagaaguga

SEQ ID NO: 1675251 - RNA, 13 nt, Human
uauuauaccuuuu

SEQ ID NO: 1675252 - RNA, 12 nt, Human
uauuauaccuuu

SEQ ID NO: 1675253 - RNA, 14 nt, Human
uauuaaggaagaca

SEQ ID NO: 1675254 - RNA, 16 nt, Human
uauuaagcauauauuu

SEQ ID NO: 1675255 - RNA, 24 nt, Human
uauuaagaaagacuaucuaaaugu

SEQ ID NO: 1675256 - RNA, 14 nt, Human
uauuauaccuuuuu

SEQ ID NO: 1675257 - RNA, 17 nt, Human
uauuauauuuacaaaug

SEQ ID NO: 1675258 - RNA, 12 nt, Human
uauuaugaaacu

SEQ ID NO: 1675259 - RNA, 20 nt, Human
uauuaugaaacuuguguaaa

SEQ ID NO: 1675260 - RNA, 21 nt, Human
uauuaugaaacuuguguaaau

SEQ ID NO: 1675261 - RNA, 22 nt, Human
uauuaugaaacuuguguaaaua

SEQ ID NO: 1675262 - RNA, 12 nt, Human
uauuauguaaau

SEQ ID NO: 1675263 - RNA, 15 nt, Human
uauuauguaaauccc

SEQ ID NO: 1675264 - RNA, 20 nt, Human
uauuauggaggcaggaguuu

SEQ ID NO: 1675265 - RNA, 22 nt, Human
uauuauguaaaucccauuauuc

SEQ ID NO: 1675266 - RNA, 16 nt, Human
uauuauguuaaaacug

SEQ ID NO: 1675267 - RNA, 14 nt, Human
uauuucuaugaaau

SEQ ID NO: 1675268 - RNA, 15 nt, Human
uauuucuaugaaaua

SEQ ID NO: 1675269 - RNA, 13 nt, Human
uauuucuaugaaa

SEQ ID NO: 1675270 - RNA, 22 nt, Human
uauuuauuaaaugcccagcccc

SEQ ID NO: 1675271 - RNA, 14 nt, Human
uauuuauuacugua

SEQ ID NO: 1675272 - RNA, 17 nt, Human
uauuuaugggauccugg

SEQ ID NO: 1675273 - RNA, 20 nt, Human
uauuguuuaaaaucauuucu

SEQ ID NO: 1675274 - RNA, 23 nt, Human
uauugcugauggugcaaugaccu

SEQ ID NO: 1675275 - RNA, 13 nt, Human
uauugcccacgcu

SEQ ID NO: 1675276 - RNA, 14 nt, Human
uauugcccacgcug

SEQ ID NO: 1675277 - RNA, 15 nt, Human
uauugcccacgcugg

SEQ ID NO: 1675278 - RNA, 15 nt, Human
uauuguuuaaaauca

SEQ ID NO: 1675279 - RNA, 16 nt, Human
uauuguuuaaaaucau

SEQ ID NO: 1675280 - RNA, 17 nt, Human
uauuguuuaaaaucauu

SEQ ID NO: 1675281 - RNA, 19 nt, Human
uauugugcgcuaaacuuuu

SEQ ID NO: 1675282 - RNA, 22 nt, Human
uauugugcgcuaaacuuuucug

SEQ ID NO: 1675283 - RNA, 23 nt, Human
uauugugcgcuaaacuuuucuga

SEQ ID NO: 1675284 - RNA, 20 nt, Human
uauugauaugcuuauacacu

SEQ ID NO: 1675285 - RNA, 19 nt, Human
ucacaggacucugccuccu

SEQ ID NO: 1675286 - RNA, 23 nt, Human
ucacaggacucugccuccucuuc

SEQ ID NO: 1675287 - RNA, 19 nt, Human
ucacaggagggagggggaa

SEQ ID NO: 1675288 - RNA, 14 nt, Human
ucacauuggaaaca

SEQ ID NO: 1675289 - RNA, 17 nt, Human
ucacaggacucugccuc

SEQ ID NO: 1675290 - RNA, 18 nt, Human
ucacaggacucugccucc

SEQ ID NO: 1675291 - RNA, 16 nt, Human
ucacaggacucugccu

SEQ ID NO: 1675292 - RNA, 15 nt, Human
ucacacacuuuggcu

SEQ ID NO: 1675293 - RNA, 22 nt, Human
ucacacaugagcaucaggccag

SEQ ID NO: 1675294 - RNA, 23 nt, Human
ucacacaugagcaucaggccagg

SEQ ID NO: 1675295 - RNA, 19 nt, Human
ucaauaaaaaauuaugaca

SEQ ID NO: 1675296 - RNA, 14 nt, Human
ucaauaaaauccau

SEQ ID NO: 1675297 - RNA, 22 nt, Human
ucacaagacccaaaaggcagaa

SEQ ID NO: 1675298 - RNA, 22 nt, Human
ucaccgaaaacguggcugcuuc

SEQ ID NO: 1675299 - RNA, 23 nt, Human
ucaccgaaaacguggcugcuuca

SEQ ID NO: 1675300 - RNA, 15 nt, Human
ucaccgaaaacgugg

SEQ ID NO: 1675301 - RNA, 19 nt, Human
ucaccgaaaacguggcugc

SEQ ID NO: 1675302 - RNA, 20 nt, Human
ucaccgaaaacguggcugcu

SEQ ID NO: 1675303 - RNA, 21 nt, Human
ucaccgaaaacguggcugcuu

SEQ ID NO: 1675304 - RNA, 19 nt, Human
ucacccgcuaagagggagg

SEQ ID NO: 1675305 - RNA, 20 nt, Human
ucacccuggggcuaggaaau

SEQ ID NO: 1675306 - RNA, 12 nt, Human
ucacccuuuucu

SEQ ID NO: 1675307 - RNA, 14 nt, Human
ucaccgaaaacgug

SEQ ID NO: 1675308 - RNA, 13 nt, Human
ucaccaagcccag

SEQ ID NO: 1675309 - RNA, 18 nt, Human
ucacccgcuaagagggag

SEQ ID NO: 1675310 - RNA, 14 nt, Human
ucacauuuauucug

SEQ ID NO: 1675311 - RNA, 17 nt, Human
ucaccaacgucugugcc

SEQ ID NO: 1675312 - RNA, 18 nt, Human
ucaccaacgucugugcca

SEQ ID NO: 1675313 - RNA, 22 nt, Human
ucacauuguauucagaguugau

SEQ ID NO: 1675314 - RNA, 18 nt, Human
ucacauugguguuguacu

SEQ ID NO: 1675315 - RNA, 17 nt, Human
ucacauuggaaacaagu

SEQ ID NO: 1675316 - RNA, 12 nt, Human
ucacauuuaaau

SEQ ID NO: 1675317 - RNA, 13 nt, Human
ucaaggauccuga

SEQ ID NO: 1675318 - RNA, 14 nt, Human
ucaaggauccugag

SEQ ID NO: 1675319 - RNA, 14 nt, Human
ucaauaaaaaauua

SEQ ID NO: 1675320 - RNA, 16 nt, Human
ucaauaaaaaauuaug

SEQ ID NO: 1675321 - RNA, 13 nt, Human
ucaauaaaaaauu

SEQ ID NO: 1675322 - RNA, 17 nt, Human
ucaaggauccugagcca

SEQ ID NO: 1675323 - RNA, 15 nt, Human
ucaaggauccugagc

SEQ ID NO: 1675324 - RNA, 16 nt, Human
ucaaggauccugagcc

SEQ ID NO: 1675325 - RNA, 21 nt, Human
ucaagcgauucuucugcuuca

SEQ ID NO: 1675326 - RNA, 18 nt, Human
ucaagcgauucuucugcu

SEQ ID NO: 1675327 - RNA, 19 nt, Human
ucaagcgauucuucugcuu

SEQ ID NO: 1675328 - RNA, 12 nt, Human
ucaagccaccaa

SEQ ID NO: 1675329 - RNA, 20 nt, Human
ucaagccaccaacauacucc

SEQ ID NO: 1675330 - RNA, 16 nt, Human
ucaaccuccugggcua

SEQ ID NO: 1675331 - RNA, 20 nt, Human
ucaaccccuucgcuccugug

SEQ ID NO: 1675332 - RNA, 15 nt, Human
ucaaccuccugggcu

SEQ ID NO: 1675333 - RNA, 18 nt, Human
ucaaccccuucgcuccug

SEQ ID NO: 1675334 - RNA, 19 nt, Human
ucaaccccuucgcuccugu

SEQ ID NO: 1675335 - RNA, 24 nt, Human
ucaacugaccagccuccaugcugc

SEQ ID NO: 1675336 - RNA, 18 nt, Human
ucaacugaccagccucca

SEQ ID NO: 1675337 - RNA, 20 nt, Human
ucaacucuccuccagaguca

SEQ ID NO: 1675338 - RNA, 14 nt, Human
ucaacucccugccc

SEQ ID NO: 1675339 - RNA, 15 nt, Human
ucaacucccugcccc

SEQ ID NO: 1675340 - RNA, 21 nt, Human
ucaacucccugccccccagcc

SEQ ID NO: 1675341 - RNA, 22 nt, Human
ucaacucccugccccccagccc

SEQ ID NO: 1675342 - RNA, 22 nt, Human
ucaacuccaaacugacucuuaa

SEQ ID NO: 1675343 - RNA, 23 nt, Human
ucaaaccccgaccaccugcccaa

SEQ ID NO: 1675344 - RNA, 19 nt, Human
ucaaaccccgaccaccugc

SEQ ID NO: 1675345 - RNA, 20 nt, Human
ucaaaccccgaccaccugcc

SEQ ID NO: 1675346 - RNA, 22 nt, Human
ucaaacagucucaggaaaucaa

SEQ ID NO: 1675347 - RNA, 17 nt, Human
ucaaacauauauaacaa

SEQ ID NO: 1675348 - RNA, 16 nt, Human
ucaaauccuugaagau

SEQ ID NO: 1675349 - RNA, 18 nt, Human
ucaaauaugcaaagcacu

SEQ ID NO: 1675350 - RNA, 19 nt, Human
ucaaauaugcaaagcacug

SEQ ID NO: 1675351 - RNA, 12 nt, Human
ucaaagagguuu

SEQ ID NO: 1675352 - RNA, 23 nt, Human
ucaaagagguuuuaaaaaaaucc

SEQ ID NO: 1675353 - RNA, 17 nt, Human
ucaaauaugcaaagcac

SEQ ID NO: 1675354 - RNA, 15 nt, Human
uauaauuaacauguu

SEQ ID NO: 1675355 - RNA, 16 nt, Human
uauaauuaacauguua

SEQ ID NO: 1675356 - RNA, 18 nt, Human
uauaauuaacauguuaaa

SEQ ID NO: 1675357 - RNA, 19 nt, Human
uauaauuaacauguuaaac

SEQ ID NO: 1675358 - RNA, 13 nt, Human
uauaauuaacaug

SEQ ID NO: 1675359 - RNA, 14 nt, Human
uauaauuaacaugu

SEQ ID NO: 1675360 - RNA, 12 nt, Human
uauaauuaacau

SEQ ID NO: 1675361 - RNA, 20 nt, Human
uauaaucacuuuuuuccaca

SEQ ID NO: 1675362 - RNA, 22 nt, Human
uauaauuaacauguuaaaccau

SEQ ID NO: 1675363 - RNA, 15 nt, Human
uauaauucacauugu

SEQ ID NO: 1675364 - RNA, 20 nt, Human
uauaauucacauuguauuca

SEQ ID NO: 1675365 - RNA, 23 nt, Human
uauaaaucgcuuuugauaaucaa

SEQ ID NO: 1675366 - RNA, 18 nt, Human
uauaucugaggaauucug

SEQ ID NO: 1675367 - RNA, 19 nt, Human
uauaucugaggaauucugu

SEQ ID NO: 1675368 - RNA, 20 nt, Human
uauaucugaggaauucugua

SEQ ID NO: 1675369 - RNA, 21 nt, Human
uauaucugaggaauucuguau

SEQ ID NO: 1675370 - RNA, 22 nt, Human
uauaucugaggaauucuguaua

SEQ ID NO: 1675371 - RNA, 13 nt, Human
uauauaacaaugc

SEQ ID NO: 1675372 - RNA, 18 nt, Human
uauauaaaugguuaaaag

SEQ ID NO: 1675373 - RNA, 21 nt, Human
uauaugcucugcauguuacau

SEQ ID NO: 1675374 - RNA, 13 nt, Human
uauaugcuucugu

SEQ ID NO: 1675375 - RNA, 16 nt, Human
uauaugugaugaucua

SEQ ID NO: 1675376 - RNA, 19 nt, Human
uagggaaaaaccagcgugu

SEQ ID NO: 1675377 - RNA, 20 nt, Human
uagggaaaaaccagcgugug

SEQ ID NO: 1675378 - RNA, 21 nt, Human
uagggaaaaaccagcguguga

SEQ ID NO: 1675379 - RNA, 20 nt, Human
uagguauaaguggugugugu

SEQ ID NO: 1675380 - RNA, 16 nt, Human
uagguaaauuacaguu

SEQ ID NO: 1675381 - RNA, 15 nt, Human
uaggucucaauaccu

SEQ ID NO: 1675382 - RNA, 16 nt, Human
uaggucagugcaaaua

SEQ ID NO: 1675383 - RNA, 12 nt, Human
uaggaauugacc

SEQ ID NO: 1675384 - RNA, 15 nt, Human
uaggccuggccagau

SEQ ID NO: 1675385 - RNA, 17 nt, Human
uaggccguuccuucaaa

SEQ ID NO: 1675386 - RNA, 18 nt, Human
uaggccuggccagaugca

SEQ ID NO: 1675387 - RNA, 18 nt, Human
uaggccaugggacaggga

SEQ ID NO: 1675388 - RNA, 13 nt, Human
uaguguucauaaa

SEQ ID NO: 1675389 - RNA, 20 nt, Human
uaguugcaacuuuguauaaa

SEQ ID NO: 1675390 - RNA, 13 nt, Human
uagucaaauugug

SEQ ID NO: 1675391 - RNA, 14 nt, Human
uagucaaauugugu

SEQ ID NO: 1675392 - RNA, 14 nt, Human
uagugcaaauuguc

SEQ ID NO: 1675393 - RNA, 15 nt, Human
uagugcaaauuguca

SEQ ID NO: 1675394 - RNA, 13 nt, Human
uaguaucaaaaga

SEQ ID NO: 1675395 - RNA, 21 nt, Human
uaggugauccacucgccuuca

SEQ ID NO: 1675396 - RNA, 23 nt, Human
uaggugacagagugagacucugu

SEQ ID NO: 1675397 - RNA, 18 nt, Human
uaggugcuacaaaaacac

SEQ ID NO: 1675398 - RNA, 21 nt, Human
uaggugaucucauuuaauccu

SEQ ID NO: 1675399 - RNA, 15 nt, Human
uaguaugaggcauuu

SEQ ID NO: 1675400 - RNA, 18 nt, Human
uaguauuucuaugaaaua

SEQ ID NO: 1675401 - RNA, 19 nt, Human
uaguauuucuaugaaauau

SEQ ID NO: 1675402 - RNA, 16 nt, Human
uaguauuucuaugaaa

SEQ ID NO: 1675403 - RNA, 17 nt, Human
uaugacuccagaauuuc

SEQ ID NO: 1675404 - RNA, 23 nt, Human
uaugacuccagaauuucccaaag

SEQ ID NO: 1675405 - RNA, 16 nt, Human
uaugacuucauuaaua

SEQ ID NO: 1675406 - RNA, 20 nt, Human
uaugacuucauuaauaauaa

SEQ ID NO: 1675407 - RNA, 16 nt, Human
uaugacuccagaauuu

SEQ ID NO: 1675408 - RNA, 16 nt, Human
uaugauucaaaugucu

SEQ ID NO: 1675409 - RNA, 21 nt, Human
uaugauucaaaugucuauaaa

SEQ ID NO: 1675410 - RNA, 16 nt, Human
uaugauucccagccag

SEQ ID NO: 1675411 - RNA, 14 nt, Human
uaugcacacauuuu

SEQ ID NO: 1675412 - RNA, 13 nt, Human
uaugcacacauuu

SEQ ID NO: 1675413 - RNA, 18 nt, Human
uaugcaaucaaaucugcu

SEQ ID NO: 1675414 - RNA, 15 nt, Human
uaugcaaagcacuga

SEQ ID NO: 1675415 - RNA, 15 nt, Human
uaugauuuggaaaau

SEQ ID NO: 1675416 - RNA, 17 nt, Human
uaugauuuggaaaauaa

SEQ ID NO: 1675417 - RNA, 18 nt, Human
uaugauuuggaaaauaaa

SEQ ID NO: 1675418 - RNA, 12 nt, Human
uaugcaaagcac

SEQ ID NO: 1675419 - RNA, 13 nt, Human
uaugcaaagcacu

SEQ ID NO: 1675420 - RNA, 14 nt, Human
uaugcaaagcacug

SEQ ID NO: 1675421 - RNA, 13 nt, Human
uauggaacacucu

SEQ ID NO: 1675422 - RNA, 16 nt, Human
uauggaacacucugag

SEQ ID NO: 1675423 - RNA, 17 nt, Human
uauggaacacucugaga

SEQ ID NO: 1675424 - RNA, 18 nt, Human
uauggaacacucugagac

SEQ ID NO: 1675425 - RNA, 15 nt, Human
uaugcuuuaaacauu

SEQ ID NO: 1675426 - RNA, 19 nt, Human
uauggaacacucugagacu

SEQ ID NO: 1675427 - RNA, 17 nt, Human
uauggacaaugacccag

SEQ ID NO: 1675428 - RNA, 18 nt, Human
uaugcagagguccacaac

SEQ ID NO: 1675429 - RNA, 20 nt, Human
uaugcauauuauuuuauguu

SEQ ID NO: 1675430 - RNA, 18 nt, Human
uaugcaugaaguaauaug

SEQ ID NO: 1675431 - RNA, 13 nt, Human
uaugcaugaagua

SEQ ID NO: 1675432 - RNA, 22 nt, Human
uaugcuuauacacuuacacuuu

SEQ ID NO: 1675433 - RNA, 15 nt, Human
uaugcuucuguuuua

SEQ ID NO: 1675434 - RNA, 16 nt, Human
uaugcuucuguuuuau

SEQ ID NO: 1675435 - RNA, 18 nt, Human
uaucugaggaauucugua

SEQ ID NO: 1675436 - RNA, 19 nt, Human
uaucugaggaauucuguau

SEQ ID NO: 1675437 - RNA, 21 nt, Human
uaucugaggaauucuguauag

SEQ ID NO: 1675438 - RNA, 22 nt, Human
uaucugaggaauucuguauaga

SEQ ID NO: 1675439 - RNA, 17 nt, Human
uaucugaggaauucugu

SEQ ID NO: 1675440 - RNA, 21 nt, Human
uaucuaauauguaacaagcca

SEQ ID NO: 1675441 - RNA, 16 nt, Human
uaucgucacugcuuaa

SEQ ID NO: 1675442 - RNA, 19 nt, Human
uauauguuuuaagaggcag

SEQ ID NO: 1675443 - RNA, 15 nt, Human
uaucguaaaauuaag

SEQ ID NO: 1675444 - RNA, 18 nt, Human
uaucguaaaauuaagaaa

SEQ ID NO: 1675445 - RNA, 16 nt, Human
uaucuaaauguugaaa

SEQ ID NO: 1675446 - RNA, 15 nt, Human
uauccuucagccuga

SEQ ID NO: 1675447 - RNA, 14 nt, Human
uauccuucagccug

SEQ ID NO: 1675448 - RNA, 20 nt, Human
uaugaaguuuuuuuuauaca

SEQ ID NO: 1675449 - RNA, 18 nt, Human
uaugaauaaagacaccua

SEQ ID NO: 1675450 - RNA, 14 nt, Human
uaucuugaagacuu

SEQ ID NO: 1675451 - RNA, 20 nt, Human
uaucugucauuugagcaggg

SEQ ID NO: 1675452 - RNA, 21 nt, Human
uaucugucauuugagcagggc

SEQ ID NO: 1675453 - RNA, 23 nt, Human
uaucugucauuugagcagggcuc

SEQ ID NO: 1675454 - RNA, 17 nt, Human
uaugaauuacauuugua

SEQ ID NO: 1675455 - RNA, 23 nt, Human
uaugaauuacauuuguauaaaau

SEQ ID NO: 1675456 - RNA, 12 nt, Human
uaugacacaugc

SEQ ID NO: 1675457 - RNA, 22 nt, Human
uaugacacaugcaaggucauuu

SEQ ID NO: 1675458 - RNA, 14 nt, Human
uaugaccacacucc

SEQ ID NO: 1675459 - RNA, 19 nt, Human
uaugaccacacuccagcug

SEQ ID NO: 1675460 - RNA, 21 nt, Human
guggccacuccagaccccugg

SEQ ID NO: 1675461 - RNA, 19 nt, Human
guggcagugggagcugccu

SEQ ID NO: 1675462 - RNA, 21 nt, Human
guggcagugggagcugccugu

SEQ ID NO: 1675463 - RNA, 11 nt, Human
guggcagucug

SEQ ID NO: 1675464 - RNA, 15 nt, Human
guggcagugggagcu

SEQ ID NO: 1675465 - RNA, 16 nt, Human
guggcagugggagcug

SEQ ID NO: 1675466 - RNA, 17 nt, Human
guggcagugggagcugc

SEQ ID NO: 1675467 - RNA, 20 nt, Human
guggaugccugguggcagcu

SEQ ID NO: 1675468 - RNA, 21 nt, Human
guggcagcugcgguccaccca

SEQ ID NO: 1675469 - RNA, 22 nt, Human
guggcagcugcgguccacccag

SEQ ID NO: 1675470 - RNA, 23 nt, Human
guggcagcugcgguccacccagg

SEQ ID NO: 1675471 - RNA, 12 nt, Human
guggcagcugcu

SEQ ID NO: 1675472 - RNA, 13 nt, Human
guggcagcugcuu

SEQ ID NO: 1675473 - RNA, 19 nt, Human
guggcagcugcuuuugucu

SEQ ID NO: 1675474 - RNA, 18 nt, Human
guggagaggcccggccuc

SEQ ID NO: 1675475 - RNA, 13 nt, Human
guggacuuuuauu

SEQ ID NO: 1675476 - RNA, 20 nt, Human
guggagaagcggcuggcagc

SEQ ID NO: 1675477 - RNA, 16 nt, Human
guggaugccugguggc

SEQ ID NO: 1675478 - RNA, 18 nt, Human
guggaugccugguggcag

SEQ ID NO: 1675479 - RNA, 17 nt, Human
guggaguucaucuugaa

SEQ ID NO: 1675480 - RNA, 18 nt, Human
gugcuuauguaugaggua

SEQ ID NO: 1675481 - RNA, 12 nt, Human
gugcuuggagga

SEQ ID NO: 1675482 - RNA, 13 nt, Human
gugcuuggaggaa

SEQ ID NO: 1675483 - RNA, 15 nt, Human
gugcuuggaggaagg

SEQ ID NO: 1675484 - RNA, 21 nt, Human
gugcugccacacuucaggcuc

SEQ ID NO: 1675485 - RNA, 22 nt, Human
gugcugccauccagguucagcu

SEQ ID NO: 1675486 - RNA, 11 nt, Human
gugcugcccug

SEQ ID NO: 1675487 - RNA, 12 nt, Human
gugcugcccugc

SEQ ID NO: 1675488 - RNA, 18 nt, Human
guggaaaaauagccugcc

SEQ ID NO: 1675489 - RNA, 20 nt, Human
gugcugcauuuaaaagauac

SEQ ID NO: 1675490 - RNA, 19 nt, Human
gugcugcauuuaaaagaua

SEQ ID NO: 1675491 - RNA, 12 nt, Human
gugcugcauuua

SEQ ID NO: 1675492 - RNA, 12 nt, Human
gugcugccacac

SEQ ID NO: 1675493 - RNA, 15 nt, Human
gugcugccauccagg

SEQ ID NO: 1675494 - RNA, 18 nt, Human
gugcugccauccagguuc

SEQ ID NO: 1675495 - RNA, 19 nt, Human
gugcugccauccagguuca

SEQ ID NO: 1675496 - RNA, 12 nt, Human
gugcugagucug

SEQ ID NO: 1675497 - RNA, 16 nt, Human
gugcugagucugaagg

SEQ ID NO: 1675498 - RNA, 17 nt, Human
gugcugagucugaaggc

SEQ ID NO: 1675499 - RNA, 18 nt, Human
gugcugagucugaaggcu

SEQ ID NO: 1675500 - RNA, 19 nt, Human
gugcugagucugaaggcug

SEQ ID NO: 1675501 - RNA, 17 nt, Human
gugcucuggacaggcau

SEQ ID NO: 1675502 - RNA, 18 nt, Human
gugcucuggacaggcaug

SEQ ID NO: 1675503 - RNA, 23 nt, Human
gugcugaaugguuuucaaaauaa

SEQ ID NO: 1675504 - RNA, 19 nt, Human
gugcugaaugguuuucaaa

SEQ ID NO: 1675505 - RNA, 20 nt, Human
gugcugaaugguuuucaaaa

SEQ ID NO: 1675506 - RNA, 15 nt, Human
gugcucuggacaggc

SEQ ID NO: 1675507 - RNA, 16 nt, Human
gugcucuggacaggca

SEQ ID NO: 1675508 - RNA, 22 nt, Human
gugccgagaaggaagccuccca

SEQ ID NO: 1675509 - RNA, 21 nt, Human
gugccuuggggacaagagcag

SEQ ID NO: 1675510 - RNA, 20 nt, Human
gugauucucaugccucagcc

SEQ ID NO: 1675511 - RNA, 14 nt, Human
gugauucuccugcc

SEQ ID NO: 1675512 - RNA, 16 nt, Human
gugauucuccugccuc

SEQ ID NO: 1675513 - RNA, 17 nt, Human
gugauucuccugccuca

SEQ ID NO: 1675514 - RNA, 18 nt, Human
gugauucuccugccucag

SEQ ID NO: 1675515 - RNA, 19 nt, Human
gugauucuccugccucagc

SEQ ID NO: 1675516 - RNA, 20 nt, Human
gugauucuccugccucagcc

SEQ ID NO: 1675517 - RNA, 22 nt, Human
gugauucuccugccucagccuc

SEQ ID NO: 1675518 - RNA, 23 nt, Human
gugauucuccugccucagccucc

SEQ ID NO: 1675519 - RNA, 20 nt, Human
gugauucacagugugaaucu

SEQ ID NO: 1675520 - RNA, 23 nt, Human
gugauccucccaccucagccucc

SEQ ID NO: 1675521 - RNA, 20 nt, Human
gugauccucccaccucagcc

SEQ ID NO: 1675522 - RNA, 22 nt, Human
gugauccucccaccucagccuc

SEQ ID NO: 1675523 - RNA, 14 nt, Human
gugauccacucgcc

SEQ ID NO: 1675524 - RNA, 22 nt, Human
gugauccacccaccucagccuc

SEQ ID NO: 1675525 - RNA, 14 nt, Human
gugauccucccacc

SEQ ID NO: 1675526 - RNA, 15 nt, Human
gugauccucccaccu

SEQ ID NO: 1675527 - RNA, 18 nt, Human
gugauccucccaccucag

SEQ ID NO: 1675528 - RNA, 23 nt, Human
gugaggauuaaauaauguaaaua

SEQ ID NO: 1675529 - RNA, 11 nt, Human
gugaggccaga

SEQ ID NO: 1675530 - RNA, 13 nt, Human
gugaggccagaga

SEQ ID NO: 1675531 - RNA, 15 nt, Human
gugauccacccaccu

SEQ ID NO: 1675532 - RNA, 18 nt, Human
gugauccacccaccucag

SEQ ID NO: 1675533 - RNA, 20 nt, Human
gugauccacccaccucagcc

SEQ ID NO: 1675534 - RNA, 20 nt, Human
gugcccacaggaucagucug

SEQ ID NO: 1675535 - RNA, 15 nt, Human
gugcaucucagccca

SEQ ID NO: 1675536 - RNA, 21 nt, Human
gugcauaccacuuuuguucuu

SEQ ID NO: 1675537 - RNA, 14 nt, Human
gugcauaccacuuu

SEQ ID NO: 1675538 - RNA, 13 nt, Human
gugcauaccacuu

SEQ ID NO: 1675539 - RNA, 18 nt, Human
gugcaugcagcaucuaag

SEQ ID NO: 1675540 - RNA, 18 nt, Human
gugcaucucagcccacau

SEQ ID NO: 1675541 - RNA, 20 nt, Human
gugccagguuuuuggucuga

SEQ ID NO: 1675542 - RNA, 22 nt, Human
gugccagguuuuuggucugacc

SEQ ID NO: 1675543 - RNA, 19 nt, Human
gugcauaaguuaacuucca

SEQ ID NO: 1675544 - RNA, 22 nt, Human
gugcaaaguucccuacuuccug

SEQ ID NO: 1675545 - RNA, 18 nt, Human
gugcaaauugucacagga

SEQ ID NO: 1675546 - RNA, 15 nt, Human
gugacugaauuucuu

SEQ ID NO: 1675547 - RNA, 18 nt, Human
gugacugaauuucuuuug

SEQ ID NO: 1675548 - RNA, 16 nt, Human
gugacugaauuucuuu

SEQ ID NO: 1675549 - RNA, 16 nt, Human
gugaccucagcuuuga

SEQ ID NO: 1675550 - RNA, 12 nt, Human
gugaccucugcc

SEQ ID NO: 1675551 - RNA, 16 nt, Human
gugacaacacuugugu

SEQ ID NO: 1675552 - RNA, 16 nt, Human
gugacaagcucacaga

SEQ ID NO: 1675553 - RNA, 22 nt, Human
gugagccaccgugccuggccac

SEQ ID NO: 1675554 - RNA, 14 nt, Human
gugagccacugcac

SEQ ID NO: 1675555 - RNA, 11 nt, Human
gugaggaagcc

SEQ ID NO: 1675556 - RNA, 16 nt, Human
gugaggaagccgcugg

SEQ ID NO: 1675557 - RNA, 19 nt, Human
gugaggaagccgcuggggc

SEQ ID NO: 1675558 - RNA, 16 nt, Human
gugagccaccacgccc

SEQ ID NO: 1675559 - RNA, 15 nt, Human
gugagccaccgugcc

SEQ ID NO: 1675560 - RNA, 15 nt, Human
gugagccaccacgcc

SEQ ID NO: 1675561 - RNA, 17 nt, Human
gugagccaccgugccug

SEQ ID NO: 1675562 - RNA, 21 nt, Human
gugagccaccgugccuggcca

SEQ ID NO: 1675563 - RNA, 13 nt, Human
gugagccacugca

SEQ ID NO: 1675564 - RNA, 17 nt, Human
gugacugaucucucgug

SEQ ID NO: 1675565 - RNA, 17 nt, Human
gugagcaggcugugagu

SEQ ID NO: 1675566 - RNA, 16 nt, Human
gugagcagucaggaaa

SEQ ID NO: 1675567 - RNA, 19 nt, Human
gugaaagaaaauaacaaua

SEQ ID NO: 1675568 - RNA, 23 nt, Human
gugaaacugcuuguuuccuagca

SEQ ID NO: 1675569 - RNA, 12 nt, Human
gugaaacuggau

SEQ ID NO: 1675570 - RNA, 20 nt, Human
gugaaacugcuuguuuccua

SEQ ID NO: 1675571 - RNA, 21 nt, Human
gugaaacugcuuguuuccuag

SEQ ID NO: 1675572 - RNA, 20 nt, Human
gugaaacucguuaauuugua

SEQ ID NO: 1675573 - RNA, 14 nt, Human
gugaaaagaaaaau

SEQ ID NO: 1675574 - RNA, 23 nt, Human
gugaaaagaaaaaugagccuggc

SEQ ID NO: 1675575 - RNA, 16 nt, Human
gugaaaaugugugugu

SEQ ID NO: 1675576 - RNA, 17 nt, Human
gugaauggcuuuguaua

SEQ ID NO: 1675577 - RNA, 18 nt, Human
gugaauggcuuuguauag

SEQ ID NO: 1675578 - RNA, 19 nt, Human
gugaauggcuuuguauaga

SEQ ID NO: 1675579 - RNA, 13 nt, Human
gugaauggcuuug

SEQ ID NO: 1675580 - RNA, 14 nt, Human
gugaauggcuuugu

SEQ ID NO: 1675581 - RNA, 14 nt, Human
gugaaucagagcac

SEQ ID NO: 1675582 - RNA, 18 nt, Human
gugaaauuauucauaauu

SEQ ID NO: 1675583 - RNA, 20 nt, Human
gugaaauuauucauaauuau

SEQ ID NO: 1675584 - RNA, 13 nt, Human
gugaaaucauuca

SEQ ID NO: 1675585 - RNA, 19 nt, Human
gugaaaggaaagagggagg

SEQ ID NO: 1675586 - RNA, 12 nt, Human
guccucccaucu

SEQ ID NO: 1675587 - RNA, 13 nt, Human
guccucccaucuc

SEQ ID NO: 1675588 - RNA, 14 nt, Human
guccucccaucuca

SEQ ID NO: 1675589 - RNA, 23 nt, Human
guccucccaucucacacaugagc

SEQ ID NO: 1675590 - RNA, 15 nt, Human
guccugggagugagc

SEQ ID NO: 1675591 - RNA, 16 nt, Human
guccugggagugagcu

SEQ ID NO: 1675592 - RNA, 17 nt, Human
guccuggcaugggaaug

SEQ ID NO: 1675593 - RNA, 19 nt, Human
guccugggagugagcuggu

SEQ ID NO: 1675594 - RNA, 17 nt, Human
guccugggagugagcug

SEQ ID NO: 1675595 - RNA, 18 nt, Human
guccugggagugagcugg

SEQ ID NO: 1675596 - RNA, 19 nt, Human
guccuggggaaccugaccc

SEQ ID NO: 1675597 - RNA, 20 nt, Human
guccuggggaaccugacccc

SEQ ID NO: 1675598 - RNA, 23 nt, Human
guccuagaaauuccccacccuga

SEQ ID NO: 1675599 - RNA, 15 nt, Human
guccuacucuguguc

SEQ ID NO: 1675600 - RNA, 23 nt, Human
guccuacucugugucaggugggg

SEQ ID NO: 1675601 - RNA, 16 nt, Human
gucccugguggcagcu

SEQ ID NO: 1675602 - RNA, 17 nt, Human
gucccugguggcagcuc

SEQ ID NO: 1675603 - RNA, 12 nt, Human
gucccagugccg

SEQ ID NO: 1675604 - RNA, 13 nt, Human
gucucagauuuua

SEQ ID NO: 1675605 - RNA, 11 nt, Human
gucucacucug

SEQ ID NO: 1675606 - RNA, 20 nt, Human
gucucacuguugcccaggcu

SEQ ID NO: 1675607 - RNA, 21 nt, Human
gucucacuguugcccaggcug

SEQ ID NO: 1675608 - RNA, 22 nt, Human
gucucacuguugcccaggcugg

SEQ ID NO: 1675609 - RNA, 23 nt, Human
gucucacuguugcccaggcuggc

SEQ ID NO: 1675610 - RNA, 20 nt, Human
gucucacuauguugcccagg

SEQ ID NO: 1675611 - RNA, 21 nt, Human
gucucacuauguugcccaggc

SEQ ID NO: 1675612 - RNA, 13 nt, Human
gucucacuguugc

SEQ ID NO: 1675613 - RNA, 23 nt, Human
gucucacuauguugcccaggcag

SEQ ID NO: 1675614 - RNA, 16 nt, Human
gucucacuguugccca

SEQ ID NO: 1675615 - RNA, 17 nt, Human
gucucacuguugcccag

SEQ ID NO: 1675616 - RNA, 18 nt, Human
gucucacuguugcccagg

SEQ ID NO: 1675617 - RNA, 19 nt, Human
gucucacuguugcccaggc

SEQ ID NO: 1675618 - RNA, 18 nt, Human
guccuuaccagcagagca

SEQ ID NO: 1675619 - RNA, 15 nt, Human
guccuuaccagcaga

SEQ ID NO: 1675620 - RNA, 16 nt, Human
guccuuaccagcagag

SEQ ID NO: 1675621 - RNA, 17 nt, Human
guccuuaccagcagagc

SEQ ID NO: 1675622 - RNA, 17 nt, Human
gucuacacuaagagaga

SEQ ID NO: 1675623 - RNA, 15 nt, Human
gucuacacugugcug

SEQ ID NO: 1675624 - RNA, 23 nt, Human
gucuacacuaagagagaaugaga

SEQ ID NO: 1675625 - RNA, 15 nt, Human
gucucuucuccacug

SEQ ID NO: 1675626 - RNA, 16 nt, Human
gucucuucuccacugg

SEQ ID NO: 1675627 - RNA, 14 nt, Human
gucucuucuccacu

SEQ ID NO: 1675628 - RNA, 13 nt, Human
gucugacccacug

SEQ ID NO: 1675629 - RNA, 14 nt, Human
gucugacccacugc

SEQ ID NO: 1675630 - RNA, 17 nt, Human
gucucuucuccacugga

SEQ ID NO: 1675631 - RNA, 15 nt, Human
gucugacccacugcu

SEQ ID NO: 1675632 - RNA, 18 nt, Human
gucugaggaauccagacc

SEQ ID NO: 1675633 - RNA, 19 nt, Human
gucugaggaauccagaccc

SEQ ID NO: 1675634 - RNA, 20 nt, Human
gucugauucccaagcucugc

SEQ ID NO: 1675635 - RNA, 21 nt, Human
gucugauucccaagcucugcu

SEQ ID NO: 1675636 - RNA, 17 nt, Human
gucugauucccaagcuc

SEQ ID NO: 1675637 - RNA, 18 nt, Human
gucugauucccaagcucu

SEQ ID NO: 1675638 - RNA, 19 nt, Human
gucugauucccaagcucug

SEQ ID NO: 1675639 - RNA, 21 nt, Human
gucugaggaauccagacccgg

SEQ ID NO: 1675640 - RNA, 16 nt, Human
gucaucucagcuggau

SEQ ID NO: 1675641 - RNA, 21 nt, Human
gucauauaagauucauauuua

SEQ ID NO: 1675642 - RNA, 14 nt, Human
guccacccaggagc

SEQ ID NO: 1675643 - RNA, 15 nt, Human
guccacccaggagcc

SEQ ID NO: 1675644 - RNA, 16 nt, Human
guccacccaggagccc

SEQ ID NO: 1675645 - RNA, 14 nt, Human
gucccacucagucc

SEQ ID NO: 1675646 - RNA, 15 nt, Human
gucccacucagucca

SEQ ID NO: 1675647 - RNA, 17 nt, Human
gucccagauacuugggg

SEQ ID NO: 1675648 - RNA, 20 nt, Human
gucccagccagcaguucaga

SEQ ID NO: 1675649 - RNA, 13 nt, Human
gucaccccggcca

SEQ ID NO: 1675650 - RNA, 15 nt, Human
gucaccccggccacc

SEQ ID NO: 1675651 - RNA, 20 nt, Human
gucaccugaagacucauucu

SEQ ID NO: 1675652 - RNA, 14 nt, Human
gucaccucauggaa

SEQ ID NO: 1675653 - RNA, 16 nt, Human
gucaauuacaggaagu

SEQ ID NO: 1675654 - RNA, 13 nt, Human
gucaauuacagga

SEQ ID NO: 1675655 - RNA, 15 nt, Human
gucaauuacaggaag

SEQ ID NO: 1675656 - RNA, 15 nt, Human
gucaauaaaauccau

SEQ ID NO: 1675657 - RNA, 21 nt, Human
gucaauaaaauccauacauuu

SEQ ID NO: 1675658 - RNA, 19 nt, Human
gucaagugaaaaaggagga

SEQ ID NO: 1675659 - RNA, 16 nt, Human
gucaagugaaaaagga

SEQ ID NO: 1675660 - RNA, 18 nt, Human
gucaagugaaaaaggagg

SEQ ID NO: 1675661 - RNA, 16 nt, Human
guauuuuaaaagaaug

SEQ ID NO: 1675662 - RNA, 17 nt, Human
guauuuuaaaagaauga

SEQ ID NO: 1675663 - RNA, 18 nt, Human
gucaagagggucugagga

SEQ ID NO: 1675664 - RNA, 19 nt, Human
gucaagagggucugaggaa

SEQ ID NO: 1675665 - RNA, 18 nt, Human
guauuuuaaaagaaugau

SEQ ID NO: 1675666 - RNA, 12 nt, Human
guauuuguuugc

SEQ ID NO: 1675667 - RNA, 23 nt, Human
guauuuguuugcauaggugaucu

SEQ ID NO: 1675668 - RNA, 20 nt, Human
guauuacaguggggaaugaa

SEQ ID NO: 1675669 - RNA, 15 nt, Human
guagagugggagcug

SEQ ID NO: 1675670 - RNA, 13 nt, Human
guagagugggagc

SEQ ID NO: 1675671 - RNA, 22 nt, Human
guauuacaguggggaaugaaga

SEQ ID NO: 1675672 - RNA, 13 nt, Human
guauuacuucugc

SEQ ID NO: 1675673 - RNA, 14 nt, Human
guauuacuucugcu

SEQ ID NO: 1675674 - RNA, 15 nt, Human
guauuacuucugcua

SEQ ID NO: 1675675 - RNA, 15 nt, Human
guauuauguguguuu

SEQ ID NO: 1675676 - RNA, 14 nt, Human
guauuauaccuuuu

SEQ ID NO: 1675677 - RNA, 19 nt, Human
guauuuauuuaguauuuau

SEQ ID NO: 1675678 - RNA, 17 nt, Human
guauuucuaugaaauau

SEQ ID NO: 1675679 - RNA, 22 nt, Human
guauuucuaugaaauauuaugu

SEQ ID NO: 1675680 - RNA, 13 nt, Human
gggcucugccucc

SEQ ID NO: 1675681 - RNA, 15 nt, Human
gggcucugccuccca

SEQ ID NO: 1675682 - RNA, 16 nt, Human
gggcucugccucccau

SEQ ID NO: 1675683 - RNA, 17 nt, Human
gggcucugccucccauc

SEQ ID NO: 1675684 - RNA, 20 nt, Human
gggcucugccucccaucacc

SEQ ID NO: 1675685 - RNA, 14 nt, Human
gggcuucaguggca

SEQ ID NO: 1675686 - RNA, 17 nt, Human
gggcugcaccggcuggc

SEQ ID NO: 1675687 - RNA, 16 nt, Human
gggcugaggugggagg

SEQ ID NO: 1675688 - RNA, 14 nt, Human
gggcugcaccggcu

SEQ ID NO: 1675689 - RNA, 16 nt, Human
gggcgcgguggcucac

SEQ ID NO: 1675690 - RNA, 13 nt, Human
gggcucccuuccc

SEQ ID NO: 1675691 - RNA, 14 nt, Human
gggcucccuuccca

SEQ ID NO: 1675692 - RNA, 17 nt, Human
gggcucccuucccaccu

SEQ ID NO: 1675693 - RNA, 18 nt, Human
gggcucccuucccaccuc

SEQ ID NO: 1675694 - RNA, 23 nt, Human
gggcucccuucccaccucucuca

SEQ ID NO: 1675695 - RNA, 18 nt, Human
gggccuggucguuuucaa

SEQ ID NO: 1675696 - RNA, 14 nt, Human
gggccuggcucagg

SEQ ID NO: 1675697 - RNA, 16 nt, Human
gggccuggcucaggug

SEQ ID NO: 1675698 - RNA, 10 nt, Human
gggccuggca

SEQ ID NO: 1675699 - RNA, 22 nt, Human
gggccuggcagccgugccuuca

SEQ ID NO: 1675700 - RNA, 12 nt, Human
gggccuggccug

SEQ ID NO: 1675701 - RNA, 12 nt, Human
gggccuggcuca

SEQ ID NO: 1675702 - RNA, 20 nt, Human
ggcucccacaggcccuuccu

SEQ ID NO: 1675703 - RNA, 21 nt, Human
ggcucccacaggcccuuccuc

SEQ ID NO: 1675704 - RNA, 17 nt, Human
ggggaucacagccucug

SEQ ID NO: 1675705 - RNA, 13 nt, Human
ggggaguggccac

SEQ ID NO: 1675706 - RNA, 22 nt, Human
gggcuuggggaccagagcugcc

SEQ ID NO: 1675707 - RNA, 21 nt, Human
gggcuuggggaccagagcugc

SEQ ID NO: 1675708 - RNA, 20 nt, Human
gggcuucauccuccucagau

SEQ ID NO: 1675709 - RNA, 20 nt, Human
gggcuuggggaccagagcug

SEQ ID NO: 1675710 - RNA, 19 nt, Human
gggcuucauccuccucaga

SEQ ID NO: 1675711 - RNA, 19 nt, Human
gggcuucaguggcagcugc

SEQ ID NO: 1675712 - RNA, 20 nt, Human
gggcuucaguggcagcugcu

SEQ ID NO: 1675713 - RNA, 15 nt, Human
gggcuucaguggcag

SEQ ID NO: 1675714 - RNA, 16 nt, Human
gggcuucaguggcagc

SEQ ID NO: 1675715 - RNA, 17 nt, Human
gggcuucaguggcagcu

SEQ ID NO: 1675716 - RNA, 18 nt, Human
gggcuucaguggcagcug

SEQ ID NO: 1675717 - RNA, 13 nt, Human
ggggcugggacau

SEQ ID NO: 1675718 - RNA, 16 nt, Human
ggggcugggcagagga

SEQ ID NO: 1675719 - RNA, 17 nt, Human
ggggcugggcagaggaa

SEQ ID NO: 1675720 - RNA, 18 nt, Human
ggguacccacugcucugg

SEQ ID NO: 1675721 - RNA, 13 nt, Human
ggguacccacugc

SEQ ID NO: 1675722 - RNA, 15 nt, Human
ggguacccacugcuc

SEQ ID NO: 1675723 - RNA, 19 nt, Human
ggguacuuguggacacagc

SEQ ID NO: 1675724 - RNA, 22 nt, Human
ggguacuuguggacacagcucu

SEQ ID NO: 1675725 - RNA, 23 nt, Human
ggguacuuguggacacagcucuu

SEQ ID NO: 1675726 - RNA, 23 nt, Human
ggguagagcggagaaaggaaggg

SEQ ID NO: 1675727 - RNA, 20 nt, Human
gggguucuuucuuccucugc

SEQ ID NO: 1675728 - RNA, 22 nt, Human
gggguucuuucuuccucugcug

SEQ ID NO: 1675729 - RNA, 23 nt, Human
gggguucccuuuuuuggcugcug

SEQ ID NO: 1675730 - RNA, 12 nt, Human
ggucccuaauaa

SEQ ID NO: 1675731 - RNA, 13 nt, Human
ggucccuaauaaa

SEQ ID NO: 1675732 - RNA, 16 nt, Human
ggucccuaauaaagcu

SEQ ID NO: 1675733 - RNA, 17 nt, Human
ggucccuaauaaagcug

SEQ ID NO: 1675734 - RNA, 18 nt, Human
ggucccuaauaaagcugu

SEQ ID NO: 1675735 - RNA, 14 nt, Human
ggucccugguggca

SEQ ID NO: 1675736 - RNA, 16 nt, Human
gguccgugcuaaggac

SEQ ID NO: 1675737 - RNA, 22 nt, Human
ggucccugguggcagcucaccu

SEQ ID NO: 1675738 - RNA, 17 nt, Human
gguccgugcuaaggacu

SEQ ID NO: 1675739 - RNA, 18 nt, Human
gguccgugcuaaggacuu

SEQ ID NO: 1675740 - RNA, 23 nt, Human
gguccuagaaauuccccacccug

SEQ ID NO: 1675741 - RNA, 22 nt, Human
ggucucacuauguugcccaggc

SEQ ID NO: 1675742 - RNA, 12 nt, Human
ggucucacucug

SEQ ID NO: 1675743 - RNA, 16 nt, Human
ggucucacucugucgc

SEQ ID NO: 1675744 - RNA, 19 nt, Human
ggucucgaacuccugaccu

SEQ ID NO: 1675745 - RNA, 20 nt, Human
ggucucgaacuccugaccuu

SEQ ID NO: 1675746 - RNA, 15 nt, Human
ggucugacccacugc

SEQ ID NO: 1675747 - RNA, 16 nt, Human
ggucugacccacugcu

SEQ ID NO: 1675748 - RNA, 14 nt, Human
ggugaauggcuuug

SEQ ID NO: 1675749 - RNA, 17 nt, Human
ggugaauggcuuuguau

SEQ ID NO: 1675750 - RNA, 20 nt, Human
ggugaauggcuuuguauaga

SEQ ID NO: 1675751 - RNA, 18 nt, Human
ggugaagugaagacaaug

SEQ ID NO: 1675752 - RNA, 19 nt, Human
ggucugaggaauccagacc

SEQ ID NO: 1675753 - RNA, 16 nt, Human
ggugaacuugguuccc

SEQ ID NO: 1675754 - RNA, 21 nt, Human
ggugacagagugagacucugu

SEQ ID NO: 1675755 - RNA, 14 nt, Human
ggugaccucugccu

SEQ ID NO: 1675756 - RNA, 16 nt, Human
ggugaccucugccuga

SEQ ID NO: 1675757 - RNA, 21 nt, Human
ggugaccucugccugaaguca

SEQ ID NO: 1675758 - RNA, 22 nt, Human
ggugauagguauaaguggugug

SEQ ID NO: 1675759 - RNA, 19 nt, Human
ggugcccugcuuucagaua

SEQ ID NO: 1675760 - RNA, 16 nt, Human
gguggcagugggagcu

SEQ ID NO: 1675761 - RNA, 15 nt, Human
gguggcagcugcggu

SEQ ID NO: 1675762 - RNA, 23 nt, Human
gguggcagcugcgguccacccag

SEQ ID NO: 1675763 - RNA, 13 nt, Human
gguggcagcucac

SEQ ID NO: 1675764 - RNA, 11 nt, Human
gguggcagcug

SEQ ID NO: 1675765 - RNA, 12 nt, Human
gguggcagcugc

SEQ ID NO: 1675766 - RNA, 13 nt, Human
gguggcagcugcg

SEQ ID NO: 1675767 - RNA, 23 nt, Human
ggugcuaucucccccagccccau

SEQ ID NO: 1675768 - RNA, 22 nt, Human
ggugcuaucucccccagcccca

SEQ ID NO: 1675769 - RNA, 21 nt, Human
ggugcuacaaaaacacagcaa

SEQ ID NO: 1675770 - RNA, 19 nt, Human
ggugcuacaaaaacacagc

SEQ ID NO: 1675771 - RNA, 22 nt, Human
ggguuccagcaauucuccugcc

SEQ ID NO: 1675772 - RNA, 19 nt, Human
gggugcugggccccugccu

SEQ ID NO: 1675773 - RNA, 16 nt, Human
ggguucuuucuuccuc

SEQ ID NO: 1675774 - RNA, 14 nt, Human
ggguucuuucuucc

SEQ ID NO: 1675775 - RNA, 19 nt, Human
ggguuggccccugcccggc

SEQ ID NO: 1675776 - RNA, 23 nt, Human
ggguucccuuuuuuggcugcuga

SEQ ID NO: 1675777 - RNA, 22 nt, Human
ggguucuacccaggugcuagga

SEQ ID NO: 1675778 - RNA, 20 nt, Human
ggguuucaccauguuggcca

SEQ ID NO: 1675779 - RNA, 17 nt, Human
gguacccacugcucugg

SEQ ID NO: 1675780 - RNA, 15 nt, Human
ggguugggcuggugu

SEQ ID NO: 1675781 - RNA, 22 nt, Human
gguacuuguggacacagcucuu

SEQ ID NO: 1675782 - RNA, 21 nt, Human
gguacuuguggacacagcucu

SEQ ID NO: 1675783 - RNA, 22 nt, Human
gguacuucaaauccuugaagau

SEQ ID NO: 1675784 - RNA, 22 nt, Human
ggucccaccccacacacgccag

SEQ ID NO: 1675785 - RNA, 22 nt, Human
ggucccacucaguccauagcag

SEQ ID NO: 1675786 - RNA, 12 nt, Human
ggucccacucag

SEQ ID NO: 1675787 - RNA, 14 nt, Human
ggucccacucaguc

SEQ ID NO: 1675788 - RNA, 13 nt, Human
ggucccccuucca

SEQ ID NO: 1675789 - RNA, 18 nt, Human
ggucccccuuccauggac

SEQ ID NO: 1675790 - RNA, 23 nt, Human
ggucccccuuccauggacuuugu

SEQ ID NO: 1675791 - RNA, 16 nt, Human
ggucacucuggcagcu

SEQ ID NO: 1675792 - RNA, 20 nt, Human
ggucacucuggcagcucaga

SEQ ID NO: 1675793 - RNA, 22 nt, Human
ggucacucuggcagcucagaga

SEQ ID NO: 1675794 - RNA, 12 nt, Human
ggucagagccug

SEQ ID NO: 1675795 - RNA, 13 nt, Human
ggucagagccugc

SEQ ID NO: 1675796 - RNA, 14 nt, Human
ggucagagccugca

SEQ ID NO: 1675797 - RNA, 15 nt, Human
ggucagagccugcag

SEQ ID NO: 1675798 - RNA, 16 nt, Human
ggucagagccugcagu

SEQ ID NO: 1675799 - RNA, 15 nt, Human
gguagacacacauga

SEQ ID NO: 1675800 - RNA, 22 nt, Human
gguagacacacaugaaguccaa

SEQ ID NO: 1675801 - RNA, 14 nt, Human
gguugggcuggugu

SEQ ID NO: 1675802 - RNA, 18 nt, Human
gguuggcaaaaaggcagg

SEQ ID NO: 1675803 - RNA, 13 nt, Human
gguuggugggggc

SEQ ID NO: 1675804 - RNA, 13 nt, Human
gguuuaagcuguu

SEQ ID NO: 1675805 - RNA, 20 nt, Human
gguucacugcaaccuccgcc

SEQ ID NO: 1675806 - RNA, 22 nt, Human
gguucaagcgauucuucugcuu

SEQ ID NO: 1675807 - RNA, 23 nt, Human
gguucaagcgauucuucugcuuc

SEQ ID NO: 1675808 - RNA, 12 nt, Human
gguucagcuugu

SEQ ID NO: 1675809 - RNA, 17 nt, Human
gguucuuucuuccucug

SEQ ID NO: 1675810 - RNA, 18 nt, Human
gguucuuucuuccucugc

SEQ ID NO: 1675811 - RNA, 14 nt, Human
gguugaagcaccaa

SEQ ID NO: 1675812 - RNA, 16 nt, Human
gguggcccgacagccu

SEQ ID NO: 1675813 - RNA, 17 nt, Human
gguggcccgacagccug

SEQ ID NO: 1675814 - RNA, 18 nt, Human
gguggcccgacagccugg

SEQ ID NO: 1675815 - RNA, 19 nt, Human
gguggcccgacagccuggc

SEQ ID NO: 1675816 - RNA, 20 nt, Human
gguggcccgacagccuggca

SEQ ID NO: 1675817 - RNA, 13 nt, Human
gguggccucccaa

SEQ ID NO: 1675818 - RNA, 17 nt, Human
gguggccucccaacuca

SEQ ID NO: 1675819 - RNA, 21 nt, Human
gguucaagcgauucuucugcu

SEQ ID NO: 1675820 - RNA, 23 nt, Human
gguuuugccauguuggccaggcu

SEQ ID NO: 1675821 - RNA, 15 nt, Human
gguuuucuguucuuu

SEQ ID NO: 1675822 - RNA, 13 nt, Human
gguuuucuguucu

SEQ ID NO: 1675823 - RNA, 12 nt, Human
gguuuucuguuc

SEQ ID NO: 1675824 - RNA, 20 nt, Human
gguuuucacauuggaaacaa

SEQ ID NO: 1675825 - RNA, 13 nt, Human
guaaaaauaaaau

SEQ ID NO: 1675826 - RNA, 14 nt, Human
guaaaaauaaaauu

SEQ ID NO: 1675827 - RNA, 18 nt, Human
guaaaaacaaagaaauua

SEQ ID NO: 1675828 - RNA, 20 nt, Human
guaaaaacaaagaaauuaug

SEQ ID NO: 1675829 - RNA, 14 nt, Human
guaaaaccacagca

SEQ ID NO: 1675830 - RNA, 15 nt, Human
guaaaaccacagcag

SEQ ID NO: 1675831 - RNA, 16 nt, Human
guaaaaccacagcagu

SEQ ID NO: 1675832 - RNA, 18 nt, Human
guaaaaccacagcaguug

SEQ ID NO: 1675833 - RNA, 23 nt, Human
guaaaaccacagcaguugaaaag

SEQ ID NO: 1675834 - RNA, 23 nt, Human
guaaauuaacuuuuauaaacuuu

SEQ ID NO: 1675835 - RNA, 18 nt, Human
guaaggaauaccuguccc

SEQ ID NO: 1675836 - RNA, 20 nt, Human
guaaggaauaccuguccccc

SEQ ID NO: 1675837 - RNA, 21 nt, Human
guaaggaauaccugucccccu

SEQ ID NO: 1675838 - RNA, 23 nt, Human
guaaggaauaccugucccccuga

SEQ ID NO: 1675839 - RNA, 13 nt, Human
guaaggaaugauu

SEQ ID NO: 1675840 - RNA, 22 nt, Human
guaaguauucuuauuuaaugaa

SEQ ID NO: 1675841 - RNA, 17 nt, Human
guaagggaaacugccag

SEQ ID NO: 1675842 - RNA, 18 nt, Human
guaagggaaacugccagc

SEQ ID NO: 1675843 - RNA, 16 nt, Human
guaaaucccauuauuc

SEQ ID NO: 1675844 - RNA, 17 nt, Human
guaaaucccauuauuca

SEQ ID NO: 1675845 - RNA, 18 nt, Human
guaaaucccauuauucaa

SEQ ID NO: 1675846 - RNA, 19 nt, Human
guaaaucccauuauucaaa

SEQ ID NO: 1675847 - RNA, 20 nt, Human
guaaaucccauuauucaaag

SEQ ID NO: 1675848 - RNA, 21 nt, Human
guaaaucccauuauucaaagu

SEQ ID NO: 1675849 - RNA, 20 nt, Human
guaaaugggggugcauuuga

SEQ ID NO: 1675850 - RNA, 19 nt, Human
guaaaugggggugcauuug

SEQ ID NO: 1675851 - RNA, 18 nt, Human
guaaaugggggugcauuu

SEQ ID NO: 1675852 - RNA, 22 nt, Human
guaaauuaacuuuuauaaacuu

SEQ ID NO: 1675853 - RNA, 21 nt, Human
guaaauuaacuuuuauaaacu

SEQ ID NO: 1675854 - RNA, 17 nt, Human
guaaauuaacuuuuaua

SEQ ID NO: 1675855 - RNA, 16 nt, Human
guaaauuaacuuuuau

SEQ ID NO: 1675856 - RNA, 15 nt, Human
guaaauuaacuuuua

SEQ ID NO: 1675857 - RNA, 21 nt, Human
guaaauacaauuuuguuucug

SEQ ID NO: 1675858 - RNA, 15 nt, Human
guaaaucccauuauu

SEQ ID NO: 1675859 - RNA, 22 nt, Human
guaaauacaauuuuguuucugu

SEQ ID NO: 1675860 - RNA, 23 nt, Human
guaaauacaauuuuguuucugua

SEQ ID NO: 1675861 - RNA, 15 nt, Human
guacagacagaaaaa

SEQ ID NO: 1675862 - RNA, 16 nt, Human
guacagacaacaaacc

SEQ ID NO: 1675863 - RNA, 21 nt, Human
guacacuguuucaaacuuuac

SEQ ID NO: 1675864 - RNA, 20 nt, Human
guacacuguuucaaacuuua

SEQ ID NO: 1675865 - RNA, 19 nt, Human
guacacuguuucaaacuuu

SEQ ID NO: 1675866 - RNA, 12 nt, Human
guacagagccca

SEQ ID NO: 1675867 - RNA, 18 nt, Human
guacagagcccacgcccc

SEQ ID NO: 1675868 - RNA, 22 nt, Human
guacagagcccacgcccccacu

SEQ ID NO: 1675869 - RNA, 20 nt, Human
guacagcaaggagauuuaca

SEQ ID NO: 1675870 - RNA, 20 nt, Human
guacauaaugcgugcauacc

SEQ ID NO: 1675871 - RNA, 15 nt, Human
guacccacugcucug

SEQ ID NO: 1675872 - RNA, 15 nt, Human
guaaucguguccccu

SEQ ID NO: 1675873 - RNA, 11 nt, Human
guaaugaaaac

SEQ ID NO: 1675874 - RNA, 13 nt, Human
guaaugaaaacca

SEQ ID NO: 1675875 - RNA, 18 nt, Human
guaaugaugucguuugaa

SEQ ID NO: 1675876 - RNA, 19 nt, Human
guaaugauaacuggaaacu

SEQ ID NO: 1675877 - RNA, 13 nt, Human
guaauuauaucug

SEQ ID NO: 1675878 - RNA, 21 nt, Human
guaauuaaguacuauguauca

SEQ ID NO: 1675879 - RNA, 14 nt, Human
guaauuaaguacua

SEQ ID NO: 1675880 - RNA, 17 nt, Human
guaauuaaguacuaugu

SEQ ID NO: 1675881 - RNA, 20 nt, Human
guaauuaaguacuauguauc

SEQ ID NO: 1675882 - RNA, 18 nt, Human
guacacuguuucaaacuu

SEQ ID NO: 1675883 - RNA, 15 nt, Human
guaauuggaaaggca

SEQ ID NO: 1675884 - RNA, 15 nt, Human
guacuugcucuugau

SEQ ID NO: 1675885 - RNA, 16 nt, Human
guacuugcucuugaug

SEQ ID NO: 1675886 - RNA, 18 nt, Human
guacuugcucuugaugcc

SEQ ID NO: 1675887 - RNA, 19 nt, Human
guacuugcucuugaugccu

SEQ ID NO: 1675888 - RNA, 22 nt, Human
guacuugcucuugaugccuggc

SEQ ID NO: 1675889 - RNA, 16 nt, Human
guacuuguggacacag

SEQ ID NO: 1675890 - RNA, 20 nt, Human
guacuuguggacacagcucu

SEQ ID NO: 1675891 - RNA, 14 nt, Human
guacuugcucuuga

SEQ ID NO: 1675892 - RNA, 20 nt, Human
guacuucuccacccugcucu

SEQ ID NO: 1675893 - RNA, 21 nt, Human
guacuucuccacccugcucuc

SEQ ID NO: 1675894 - RNA, 16 nt, Human
guacuucuccacccug

SEQ ID NO: 1675895 - RNA, 17 nt, Human
guacuucuccacccugc

SEQ ID NO: 1675896 - RNA, 18 nt, Human
guacuucuccacccugcu

SEQ ID NO: 1675897 - RNA, 19 nt, Human
guacuucuccacccugcuc

SEQ ID NO: 1675898 - RNA, 21 nt, Human
guacuuguggacacagcucuu

SEQ ID NO: 1675899 - RNA, 23 nt, Human
guacuuuauuuucuauaauuuaa

SEQ ID NO: 1675900 - RNA, 12 nt, Human
guacuuuuuggc

SEQ ID NO: 1675901 - RNA, 21 nt, Human
guacuuuuuggcauaacauaa

SEQ ID NO: 1675902 - RNA, 16 nt, Human
guagagcggagaaagg

SEQ ID NO: 1675903 - RNA, 15 nt, Human
guagaggagaaacug

SEQ ID NO: 1675904 - RNA, 22 nt, Human
guaccucuugagccuugaacuu

SEQ ID NO: 1675905 - RNA, 21 nt, Human
guaccucuugagccuugaacu

SEQ ID NO: 1675906 - RNA, 13 nt, Human
guaccucuugagc

SEQ ID NO: 1675907 - RNA, 16 nt, Human
guacccacugcucugg

SEQ ID NO: 1675908 - RNA, 15 nt, Human
guaccgcaaugugac

SEQ ID NO: 1675909 - RNA, 17 nt, Human
guacuacaguccuccca

SEQ ID NO: 1675910 - RNA, 14 nt, Human
guacuucuccaccc

SEQ ID NO: 1675911 - RNA, 15 nt, Human
guacuucuccacccu

SEQ ID NO: 1675912 - RNA, 17 nt, Human
guacguugugcauuugg

SEQ ID NO: 1675913 - RNA, 15 nt, Human
guacuaaggaaucuu

SEQ ID NO: 1675914 - RNA, 23 nt, Human
guacuaaggaaucuuucugcuuu

SEQ ID NO: 1675915 - RNA, 16 nt, Human
guacguugugcauuug

SEQ ID NO: 1675916 - RNA, 15 nt, Human
guacguugugcauuu

SEQ ID NO: 1675917 - RNA, 14 nt, Human
guacguugugcauu

SEQ ID NO: 1675918 - RNA, 17 nt, Human
guacgucugacaggcaa

SEQ ID NO: 1675919 - RNA, 14 nt, Human
guacgucugacagg

SEQ ID NO: 1675920 - RNA, 15 nt, Human
guacgucugacaggc

SEQ ID NO: 1675921 - RNA, 12 nt, Human
gccucugccugu

SEQ ID NO: 1675922 - RNA, 23 nt, Human
gccucucugcaggucccuaauaa

SEQ ID NO: 1675923 - RNA, 20 nt, Human
gccucucugcaggucccuaa

SEQ ID NO: 1675924 - RNA, 21 nt, Human
gccucucugcaggucccuaau

SEQ ID NO: 1675925 - RNA, 18 nt, Human
gccucugcugauccuccc

SEQ ID NO: 1675926 - RNA, 13 nt, Human
gccucugccuguc

SEQ ID NO: 1675927 - RNA, 19 nt, Human
gccucugcugauccuccca

SEQ ID NO: 1675928 - RNA, 22 nt, Human
gccugaagucacacagugaguc

SEQ ID NO: 1675929 - RNA, 18 nt, Human
gccugcuuuuuauggccu

SEQ ID NO: 1675930 - RNA, 19 nt, Human
gccugcuuuuuauggccug

SEQ ID NO: 1675931 - RNA, 22 nt, Human
gccugcuuuuuauggccuguga

SEQ ID NO: 1675932 - RNA, 16 nt, Human
gccugcuccagcuguu

SEQ ID NO: 1675933 - RNA, 18 nt, Human
gccugcuccagcuguuca

SEQ ID NO: 1675934 - RNA, 13 nt, Human
gccugauuaaaga

SEQ ID NO: 1675935 - RNA, 16 nt, Human
gccugauuaaagaaug

SEQ ID NO: 1675936 - RNA, 23 nt, Human
gccugcacggugaauggcuuugu

SEQ ID NO: 1675937 - RNA, 15 nt, Human
gccugcuccagcugu

SEQ ID NO: 1675938 - RNA, 21 nt, Human
gccugggggcugggcagagga

SEQ ID NO: 1675939 - RNA, 20 nt, Human
gccugggggcugggcagagg

SEQ ID NO: 1675940 - RNA, 18 nt, Human
gccugggcagaaggaaga

SEQ ID NO: 1675941 - RNA, 16 nt, Human
gccugggcagaaggaa

SEQ ID NO: 1675942 - RNA, 17 nt, Human
gccugggcagaaggaag

SEQ ID NO: 1675943 - RNA, 13 nt, Human
gccuggccacgcc

SEQ ID NO: 1675944 - RNA, 14 nt, Human
gccuggauggggcu

SEQ ID NO: 1675945 - RNA, 15 nt, Human
gccuggauggggcug

SEQ ID NO: 1675946 - RNA, 15 nt, Human
gccugggcagaagga

SEQ ID NO: 1675947 - RNA, 16 nt, Human
gccuggccagaugcac

SEQ ID NO: 1675948 - RNA, 14 nt, Human
gccuggccagaugc

SEQ ID NO: 1675949 - RNA, 15 nt, Human
gccuggccagaugca

SEQ ID NO: 1675950 - RNA, 19 nt, Human
gccucucugcaggucccua

SEQ ID NO: 1675951 - RNA, 20 nt, Human
gccucggacuuagcugggag

SEQ ID NO: 1675952 - RNA, 21 nt, Human
gccucggacuuagcugggaga

SEQ ID NO: 1675953 - RNA, 17 nt, Human
gccucccgaguagcugg

SEQ ID NO: 1675954 - RNA, 23 nt, Human
gccucccgaauagcugggacuac

SEQ ID NO: 1675955 - RNA, 15 nt, Human
gccucccgaguagcu

SEQ ID NO: 1675956 - RNA, 21 nt, Human
gccucccaacucaccccagcc

SEQ ID NO: 1675957 - RNA, 15 nt, Human
gccucagugccacua

SEQ ID NO: 1675958 - RNA, 22 nt, Human
gccucccaacucaccccagccc

SEQ ID NO: 1675959 - RNA, 23 nt, Human
gccucccaacucaccccagcccc

SEQ ID NO: 1675960 - RNA, 21 nt, Human
gccucccacgacugcccggca

SEQ ID NO: 1675961 - RNA, 14 nt, Human
gccucccacgacug

SEQ ID NO: 1675962 - RNA, 14 nt, Human
gccucagccucccg

SEQ ID NO: 1675963 - RNA, 23 nt, Human
gccucagccucccaaagugcugg

SEQ ID NO: 1675964 - RNA, 15 nt, Human
gccucagucucccuc

SEQ ID NO: 1675965 - RNA, 18 nt, Human
gccucagucucccucccu

SEQ ID NO: 1675966 - RNA, 12 nt, Human
gccucagugcca

SEQ ID NO: 1675967 - RNA, 14 nt, Human
gccucagugccacu

SEQ ID NO: 1675968 - RNA, 14 nt, Human
gccucaaccuccug

SEQ ID NO: 1675969 - RNA, 16 nt, Human
gccucaaccuccuggg

SEQ ID NO: 1675970 - RNA, 17 nt, Human
gccucaaccuccugggc

SEQ ID NO: 1675971 - RNA, 19 nt, Human
gccucaagugauucuccug

SEQ ID NO: 1675972 - RNA, 20 nt, Human
gccucaagugauucuccugc

SEQ ID NO: 1675973 - RNA, 21 nt, Human
gccucaagugauucuccugcc

SEQ ID NO: 1675974 - RNA, 22 nt, Human
gccuauauuuuuuguuaaauga

SEQ ID NO: 1675975 - RNA, 16 nt, Human
gccuaaggcugaacuu

SEQ ID NO: 1675976 - RNA, 17 nt, Human
gccuaagugcagccccg

SEQ ID NO: 1675977 - RNA, 15 nt, Human
gcccuggcucccaca

SEQ ID NO: 1675978 - RNA, 19 nt, Human
gcccuggcucccacaggcc

SEQ ID NO: 1675979 - RNA, 20 nt, Human
gcccuggcucccacaggccc

SEQ ID NO: 1675980 - RNA, 11 nt, Human
gcccugggagg

SEQ ID NO: 1675981 - RNA, 14 nt, Human
gcccugggaggcag

SEQ ID NO: 1675982 - RNA, 13 nt, Human
gcccugggaggcu

SEQ ID NO: 1675983 - RNA, 14 nt, Human
gcccugggaggcuc

SEQ ID NO: 1675984 - RNA, 15 nt, Human
gcccugggaggcucu

SEQ ID NO: 1675985 - RNA, 16 nt, Human
gcccugggaggcucug

SEQ ID NO: 1675986 - RNA, 15 nt, Human
gcccuggugcugcca

SEQ ID NO: 1675987 - RNA, 16 nt, Human
gcccuggugcugccac

SEQ ID NO: 1675988 - RNA, 17 nt, Human
gcccuggugcugccaca

SEQ ID NO: 1675989 - RNA, 21 nt, Human
gcccuggugcugccacacuuc

SEQ ID NO: 1675990 - RNA, 16 nt, Human
gcccugggaggcagug

SEQ ID NO: 1675991 - RNA, 23 nt, Human
gcccugggaggcucuggagccca

SEQ ID NO: 1675992 - RNA, 17 nt, Human
gcccugggaggcucugg

SEQ ID NO: 1675993 - RNA, 18 nt, Human
gcccugggaggcucugga

SEQ ID NO: 1675994 - RNA, 19 nt, Human
gcccugggaggcucuggag

SEQ ID NO: 1675995 - RNA, 21 nt, Human
gcccugggaggcucuggagcc

SEQ ID NO: 1675996 - RNA, 17 nt, Human
gcccugguuuccugccc

SEQ ID NO: 1675997 - RNA, 18 nt, Human
gcccugguuuccugcccu

SEQ ID NO: 1675998 - RNA, 19 nt, Human
gcccugguuuccugcccug

SEQ ID NO: 1675999 - RNA, 20 nt, Human
gcccugguuuccugcccugg

SEQ ID NO: 1676000 - RNA, 21 nt, Human
gcccugguuuccugcccuggg

SEQ ID NO: 1676001 - RNA, 23 nt, Human
gcccugguuuccugcccugggag

SEQ ID NO: 1676002 - RNA, 14 nt, Human
gcccugguuuccug

SEQ ID NO: 1676003 - RNA, 15 nt, Human
gcccugguuuccugc

SEQ ID NO: 1676004 - RNA, 14 nt, Human
gcccugguggcagu

SEQ ID NO: 1676005 - RNA, 17 nt, Human
gcccugguggcaguggg

SEQ ID NO: 1676006 - RNA, 18 nt, Human
gcccugguggcaguggga

SEQ ID NO: 1676007 - RNA, 19 nt, Human
gcccugguggcagugggag

SEQ ID NO: 1676008 - RNA, 20 nt, Human
gcccugguggcagugggagc

SEQ ID NO: 1676009 - RNA, 21 nt, Human
gcccugguggcagugggagcu

SEQ ID NO: 1676010 - RNA, 22 nt, Human
gcccugguggcagugggagcug

SEQ ID NO: 1676011 - RNA, 23 nt, Human
gcccugguggcagugggagcugc

SEQ ID NO: 1676012 - RNA, 16 nt, Human
gccgagaucacgccac

SEQ ID NO: 1676013 - RNA, 18 nt, Human
gccgagaucacgccacug

SEQ ID NO: 1676014 - RNA, 19 nt, Human
gccgagaucacgccacugc

SEQ ID NO: 1676015 - RNA, 18 nt, Human
gccgagauugcaccacug

SEQ ID NO: 1676016 - RNA, 17 nt, Human
gccgagauugcaccacu

SEQ ID NO: 1676017 - RNA, 20 nt, Human
gcccuuccucuccacugccu

SEQ ID NO: 1676018 - RNA, 23 nt, Human
gcccuucucuccagccccuggau

SEQ ID NO: 1676019 - RNA, 21 nt, Human
gcccuucucuccagccccugg

SEQ ID NO: 1676020 - RNA, 22 nt, Human
gcccuucucuccagccccugga

SEQ ID NO: 1676021 - RNA, 17 nt, Human
gcccuuccucuccacug

SEQ ID NO: 1676022 - RNA, 16 nt, Human
gcccuuccucuccacu

SEQ ID NO: 1676023 - RNA, 18 nt, Human
gcccuuccucuccacugc

SEQ ID NO: 1676024 - RNA, 19 nt, Human
gcccuuccucuccacugcc

SEQ ID NO: 1676025 - RNA, 21 nt, Human
gcccuuccucuccacugccuu

SEQ ID NO: 1676026 - RNA, 19 nt, Human
gcccuucucuccagccccu

SEQ ID NO: 1676027 - RNA, 12 nt, Human
gccccucccuuc

SEQ ID NO: 1676028 - RNA, 14 nt, Human
gccccucccuucaa

SEQ ID NO: 1676029 - RNA, 15 nt, Human
gccccucccuucaac

SEQ ID NO: 1676030 - RNA, 18 nt, Human
gccccuccucucugcccu

SEQ ID NO: 1676031 - RNA, 19 nt, Human
gccccuccucucugcccua

SEQ ID NO: 1676032 - RNA, 15 nt, Human
gcagacucuacagag

SEQ ID NO: 1676033 - RNA, 13 nt, Human
gccccugccaccc

SEQ ID NO: 1676034 - RNA, 14 nt, Human
gccccugccacccu

SEQ ID NO: 1676035 - RNA, 15 nt, Human
gccccugccacccug

SEQ ID NO: 1676036 - RNA, 21 nt, Human
gccccuguucuggcagaguug

SEQ ID NO: 1676037 - RNA, 12 nt, Human
gccccuuccccc

SEQ ID NO: 1676038 - RNA, 16 nt, Human
gcccgacagccuggca

SEQ ID NO: 1676039 - RNA, 17 nt, Human
gcccgacagccuggcac

SEQ ID NO: 1676040 - RNA, 19 nt, Human
gcccgacagccuggcacag

SEQ ID NO: 1676041 - RNA, 12 nt, Human
gcccggcuccag

SEQ ID NO: 1676042 - RNA, 16 nt, Human
gcccggcuccaggcuc

SEQ ID NO: 1676043 - RNA, 20 nt, Human
gcccugcuuugggcugcccu

SEQ ID NO: 1676044 - RNA, 21 nt, Human
gcccugcuuugggcugcccug

SEQ ID NO: 1676045 - RNA, 19 nt, Human
gcccugcuuugggcugccc

SEQ ID NO: 1676046 - RNA, 22 nt, Human
gcccugcuuugggcugcccugg

SEQ ID NO: 1676047 - RNA, 23 nt, Human
gcccugcuuugggcugcccuggu

SEQ ID NO: 1676048 - RNA, 12 nt, Human
gcccuggacugu

SEQ ID NO: 1676049 - RNA, 16 nt, Human
gcccuggacugugugc

SEQ ID NO: 1676050 - RNA, 22 nt, Human
gcccuggacugugugcucagga

SEQ ID NO: 1676051 - RNA, 17 nt, Human
gcccggcuccaggcucc

SEQ ID NO: 1676052 - RNA, 18 nt, Human
gcccggcuccaggcuccu

SEQ ID NO: 1676053 - RNA, 12 nt, Human
gcccucugccca

SEQ ID NO: 1676054 - RNA, 16 nt, Human
gcccugagcuuucugc

SEQ ID NO: 1676055 - RNA, 23 nt, Human
gcccucuccugggcagcugccuc

SEQ ID NO: 1676056 - RNA, 22 nt, Human
gcccucuccugggcagcugccu

SEQ ID NO: 1676057 - RNA, 14 nt, Human
gcccucuccugggc

SEQ ID NO: 1676058 - RNA, 13 nt, Human
gcccucuccuggg

SEQ ID NO: 1676059 - RNA, 12 nt, Human
gcccucuccugg

SEQ ID NO: 1676060 - RNA, 14 nt, Human
gcucaccucucccu

SEQ ID NO: 1676061 - RNA, 20 nt, Human
gcucaccagccccagugccc

SEQ ID NO: 1676062 - RNA, 23 nt, Human
gcucaccagccccagugcccaca

SEQ ID NO: 1676063 - RNA, 19 nt, Human
gcucaccagccccagugcc

SEQ ID NO: 1676064 - RNA, 17 nt, Human
gcucagcaaaagaugcu

SEQ ID NO: 1676065 - RNA, 20 nt, Human
gcucagcaaaagaugcuucu

SEQ ID NO: 1676066 - RNA, 22 nt, Human
gcucagcaaaagaugcuucuca

SEQ ID NO: 1676067 - RNA, 23 nt, Human
gcucagcaaaagaugcuucucac

SEQ ID NO: 1676068 - RNA, 19 nt, Human
gcucaggugucccugcacu

SEQ ID NO: 1676069 - RNA, 15 nt, Human
gcucagcggggacag

SEQ ID NO: 1676070 - RNA, 16 nt, Human
gcucagcggggacagc

SEQ ID NO: 1676071 - RNA, 20 nt, Human
gcucagcggggacagcuccu

SEQ ID NO: 1676072 - RNA, 21 nt, Human
gcucagcggggacagcuccuu

SEQ ID NO: 1676073 - RNA, 22 nt, Human
gcucagcggggacagcuccuuc

SEQ ID NO: 1676074 - RNA, 18 nt, Human
gcucaggugucccugcac

SEQ ID NO: 1676075 - RNA, 16 nt, Human
gcuccaaaugcagcuu

SEQ ID NO: 1676076 - RNA, 14 nt, Human
gcuccaagaauuuc

SEQ ID NO: 1676077 - RNA, 13 nt, Human
gcuccaagcuccc

SEQ ID NO: 1676078 - RNA, 14 nt, Human
gcuccaagcuccca

SEQ ID NO: 1676079 - RNA, 15 nt, Human
gcuccaagcucccag

SEQ ID NO: 1676080 - RNA, 17 nt, Human
gcuccagcuggccggga

SEQ ID NO: 1676081 - RNA, 23 nt, Human
gcuccagcuggccgggagccuga

SEQ ID NO: 1676082 - RNA, 21 nt, Human
gcuccaagcucccaggcauuc

SEQ ID NO: 1676083 - RNA, 16 nt, Human
gcuccaagcucccagg

SEQ ID NO: 1676084 - RNA, 17 nt, Human
gcuccaagcucccaggc

SEQ ID NO: 1676085 - RNA, 18 nt, Human
gcuccaagcucccaggca

SEQ ID NO: 1676086 - RNA, 19 nt, Human
gcuccaagcucccaggcau

SEQ ID NO: 1676087 - RNA, 15 nt, Human
gcuccauggcugcca

SEQ ID NO: 1676088 - RNA, 14 nt, Human
gcuccaucuccacu

SEQ ID NO: 1676089 - RNA, 20 nt, Human
gcuccagcuguucagcuggu

SEQ ID NO: 1676090 - RNA, 24 nt, Human
gcuccaggcuccuuuagcgcccag

SEQ ID NO: 1676091 - RNA, 11 nt, Human
gcuccagcugu

SEQ ID NO: 1676092 - RNA, 13 nt, Human
gcuccaggcuccu

SEQ ID NO: 1676093 - RNA, 16 nt, Human
gcuccaggcuccuuua

SEQ ID NO: 1676094 - RNA, 23 nt, Human
gcuccaggcuccuuuagcgccca

SEQ ID NO: 1676095 - RNA, 20 nt, Human
gcuccauuuuuagugaaaua

SEQ ID NO: 1676096 - RNA, 17 nt, Human
gccugugaacugaacuc

SEQ ID NO: 1676097 - RNA, 23 nt, Human
gccugugagcuaggaauuguguu

SEQ ID NO: 1676098 - RNA, 15 nt, Human
gcgggcuuccuccug

SEQ ID NO: 1676099 - RNA, 12 nt, Human
gcggggacagcu

SEQ ID NO: 1676100 - RNA, 13 nt, Human
gcggggacagcuc

SEQ ID NO: 1676101 - RNA, 16 nt, Human
gcgguccacccaggag

SEQ ID NO: 1676102 - RNA, 20 nt, Human
gcgguccacccaggagcccc

SEQ ID NO: 1676103 - RNA, 18 nt, Human
gcgguccacccaggagcc

SEQ ID NO: 1676104 - RNA, 19 nt, Human
gcgguccacccaggagccc

SEQ ID NO: 1676105 - RNA, 15 nt, Human
gcgugagaccugccc

SEQ ID NO: 1676106 - RNA, 18 nt, Human
gcgugagccacugcaccg

SEQ ID NO: 1676107 - RNA, 23 nt, Human
gcgugagccacugcaccgggcca

SEQ ID NO: 1676108 - RNA, 13 nt, Human
gcuaaaugugaau

SEQ ID NO: 1676109 - RNA, 16 nt, Human
gcuaaaugugaaugau

SEQ ID NO: 1676110 - RNA, 14 nt, Human
gcuaacauggaagu

SEQ ID NO: 1676111 - RNA, 22 nt, Human
gcuaagagggagggagggcucc

SEQ ID NO: 1676112 - RNA, 23 nt, Human
gcuaucucccccagccccauccu

SEQ ID NO: 1676113 - RNA, 19 nt, Human
gcuaucucccccagcccca

SEQ ID NO: 1676114 - RNA, 20 nt, Human
gcuaucucccccagccccau

SEQ ID NO: 1676115 - RNA, 21 nt, Human
gcuaucucccccagccccauc

SEQ ID NO: 1676116 - RNA, 22 nt, Human
gcuaucucccccagccccaucc

SEQ ID NO: 1676117 - RNA, 16 nt, Human
gcuaucucccccagcc

SEQ ID NO: 1676118 - RNA, 17 nt, Human
gcuaucucccccagccc

SEQ ID NO: 1676119 - RNA, 18 nt, Human
gcuaucucccccagcccc

SEQ ID NO: 1676120 - RNA, 21 nt, Human
gcuacccgggaagggggcugg

SEQ ID NO: 1676121 - RNA, 21 nt, Human
gcuagagguucaaagauauuu

SEQ ID NO: 1676122 - RNA, 19 nt, Human
gcuagagguucaaagauau

SEQ ID NO: 1676123 - RNA, 18 nt, Human
gcuagagguucaaagaua

SEQ ID NO: 1676124 - RNA, 14 nt, Human
gcuacccgggaagg

SEQ ID NO: 1676125 - RNA, 15 nt, Human
gcuacccgggaaggg

SEQ ID NO: 1676126 - RNA, 14 nt, Human
gcuaagcauuccaa

SEQ ID NO: 1676127 - RNA, 23 nt, Human
gcuaagagggagggagggcucca

SEQ ID NO: 1676128 - RNA, 17 nt, Human
gcuaagcaaaaugugau

SEQ ID NO: 1676129 - RNA, 15 nt, Human
gcugauggugcaaug

SEQ ID NO: 1676130 - RNA, 16 nt, Human
gcugauggugcaauga

SEQ ID NO: 1676131 - RNA, 22 nt, Human
gcugagugggggaucacagccu

SEQ ID NO: 1676132 - RNA, 23 nt, Human
gcugagugggggaucacagccuc

SEQ ID NO: 1676133 - RNA, 21 nt, Human
gcugacuguacuccucccagg

SEQ ID NO: 1676134 - RNA, 17 nt, Human
gcugagucccaggcuga

SEQ ID NO: 1676135 - RNA, 21 nt, Human
gcugagucccaggcugagccu

SEQ ID NO: 1676136 - RNA, 22 nt, Human
gcugagucccaggcugagccuc

SEQ ID NO: 1676137 - RNA, 15 nt, Human
gcugagucugaaggc

SEQ ID NO: 1676138 - RNA, 16 nt, Human
gcugagucugaaggcu

SEQ ID NO: 1676139 - RNA, 18 nt, Human
gcugagucugaaggcugg

SEQ ID NO: 1676140 - RNA, 19 nt, Human
gcugagucugaaggcuggg

SEQ ID NO: 1676141 - RNA, 17 nt, Human
gcugcauuuaaaagaua

SEQ ID NO: 1676142 - RNA, 21 nt, Human
gcugcaguugccagucacccc

SEQ ID NO: 1676143 - RNA, 18 nt, Human
gcugcaguugccagucac

SEQ ID NO: 1676144 - RNA, 20 nt, Human
gcugcaguugccagucaccc

SEQ ID NO: 1676145 - RNA, 18 nt, Human
gcugauggugcaaugacc

SEQ ID NO: 1676146 - RNA, 21 nt, Human
gcugauggugcaaugaccuuu

SEQ ID NO: 1676147 - RNA, 18 nt, Human
gcugacuguacuccuccc

SEQ ID NO: 1676148 - RNA, 19 nt, Human
gcugacuguacuccuccca

SEQ ID NO: 1676149 - RNA, 17 nt, Human
gcucuugaugccuggcg

SEQ ID NO: 1676150 - RNA, 17 nt, Human
gcugacagacagcccuc

SEQ ID NO: 1676151 - RNA, 21 nt, Human
gcugacagacacaggcccggc

SEQ ID NO: 1676152 - RNA, 23 nt, Human
gcucuucuccuuucacaaccuuc

SEQ ID NO: 1676153 - RNA, 14 nt, Human
gcucuugaugccug

SEQ ID NO: 1676154 - RNA, 15 nt, Human
gcucuugaugccugg

SEQ ID NO: 1676155 - RNA, 16 nt, Human
gcucuugaugccuggc

SEQ ID NO: 1676156 - RNA, 17 nt, Human
gcucuucuccuuucaca

SEQ ID NO: 1676157 - RNA, 21 nt, Human
gcucuucuccuuucacaaccu

SEQ ID NO: 1676158 - RNA, 13 nt, Human
gcucuucuccuuu

SEQ ID NO: 1676159 - RNA, 14 nt, Human
gcucuucuccaggc

SEQ ID NO: 1676160 - RNA, 16 nt, Human
gcucuucuccaggcug

SEQ ID NO: 1676161 - RNA, 19 nt, Human
gcucuuccaggcugggaga

SEQ ID NO: 1676162 - RNA, 18 nt, Human
gcucuuccaggcugggag

SEQ ID NO: 1676163 - RNA, 22 nt, Human
gcucuuccaggcugggagagcc

SEQ ID NO: 1676164 - RNA, 12 nt, Human
gcucuucuccag

SEQ ID NO: 1676165 - RNA, 15 nt, Human
gcucccuucccaccu

SEQ ID NO: 1676166 - RNA, 16 nt, Human
gcucccuucccaccuc

SEQ ID NO: 1676167 - RNA, 18 nt, Human
gcucccuucccaccucuc

SEQ ID NO: 1676168 - RNA, 19 nt, Human
gcucccuucccaccucucu

SEQ ID NO: 1676169 - RNA, 21 nt, Human
gcuccuucuguccuacucugu

SEQ ID NO: 1676170 - RNA, 16 nt, Human
gcucgagcaugccugg

SEQ ID NO: 1676171 - RNA, 17 nt, Human
gcucgagcaugccugga

SEQ ID NO: 1676172 - RNA, 19 nt, Human
gcucuccucuugccacugc

SEQ ID NO: 1676173 - RNA, 22 nt, Human
gcucuccucuugccacugccuc

SEQ ID NO: 1676174 - RNA, 15 nt, Human
gcucuccucuugcca

SEQ ID NO: 1676175 - RNA, 19 nt, Human
gcucuccgaccagacaccu

SEQ ID NO: 1676176 - RNA, 13 nt, Human
gcucuccgaccag

SEQ ID NO: 1676177 - RNA, 17 nt, Human
gcucuccgaccagacac

SEQ ID NO: 1676178 - RNA, 11 nt, Human
gcucucuggcc

SEQ ID NO: 1676179 - RNA, 12 nt, Human
gcucucuggccu

SEQ ID NO: 1676180 - RNA, 13 nt, Human
gcucucuggccuu

SEQ ID NO: 1676181 - RNA, 14 nt, Human
gcucuggacaggca

SEQ ID NO: 1676182 - RNA, 15 nt, Human
gcucuggacaggcau

SEQ ID NO: 1676183 - RNA, 16 nt, Human
gcucuggacaggcaug

SEQ ID NO: 1676184 - RNA, 21 nt, Human
gcucuggacaggcauguucuc

SEQ ID NO: 1676185 - RNA, 22 nt, Human
gcucuggacaggcauguucucu

SEQ ID NO: 1676186 - RNA, 19 nt, Human
gcucugcuccucuccccag

SEQ ID NO: 1676187 - RNA, 21 nt, Human
gcucugcuccucuccccagca

SEQ ID NO: 1676188 - RNA, 13 nt, Human
gcucugcugacag

SEQ ID NO: 1676189 - RNA, 14 nt, Human
gcucugcugacaga

SEQ ID NO: 1676190 - RNA, 18 nt, Human
gcucugcugacagacaca

SEQ ID NO: 1676191 - RNA, 19 nt, Human
gcucugcugacagacacag

SEQ ID NO: 1676192 - RNA, 20 nt, Human
gcucugcugacagacacagg

SEQ ID NO: 1676193 - RNA, 23 nt, Human
gcucugcugacagacacaggccc

SEQ ID NO: 1676194 - RNA, 13 nt, Human
gcucugccuccca

SEQ ID NO: 1676195 - RNA, 14 nt, Human
gcucugccucccau

SEQ ID NO: 1676196 - RNA, 15 nt, Human
gcucugccucccauc

SEQ ID NO: 1676197 - RNA, 22 nt, Human
gcucugccucccaucacccgcu

SEQ ID NO: 1676198 - RNA, 13 nt, Human
gcucugcuccucu

SEQ ID NO: 1676199 - RNA, 14 nt, Human
gcucugcuccucuc

SEQ ID NO: 1676200 - RNA, 14 nt, Human
gcucugcccuuggu

SEQ ID NO: 1676201 - RNA, 23 nt, Human
gcucugcccuugguuaggcauug

SEQ ID NO: 1676202 - RNA, 11 nt, Human
gcucugccucc

SEQ ID NO: 1676203 - RNA, 14 nt, Human
gcucucuggccuuc

SEQ ID NO: 1676204 - RNA, 15 nt, Human
gcucucuggccuucg

SEQ ID NO: 1676205 - RNA, 19 nt, Human
gcucucuggccuucggccu

SEQ ID NO: 1676206 - RNA, 20 nt, Human
gcucucuggccuucggccuc

SEQ ID NO: 1676207 - RNA, 18 nt, Human
ggcgcugccccuggcagc

SEQ ID NO: 1676208 - RNA, 19 nt, Human
ggcgcugccccuggcagcc

SEQ ID NO: 1676209 - RNA, 21 nt, Human
ggcgcugccccuggcagcccc

SEQ ID NO: 1676210 - RNA, 23 nt, Human
ggcgcugccccuggcagccccug

SEQ ID NO: 1676211 - RNA, 15 nt, Human
ggcgcgguggcucac

SEQ ID NO: 1676212 - RNA, 11 nt, Human
ggccugugagc

SEQ ID NO: 1676213 - RNA, 14 nt, Human
ggccugggggcugg

SEQ ID NO: 1676214 - RNA, 20 nt, Human
ggccugggggcugggcagag

SEQ ID NO: 1676215 - RNA, 22 nt, Human
ggccugggggcugggcagagga

SEQ ID NO: 1676216 - RNA, 19 nt, Human
ggccuggccugagcuggga

SEQ ID NO: 1676217 - RNA, 22 nt, Human
ggcuaggaccccuccauguggg

SEQ ID NO: 1676218 - RNA, 16 nt, Human
ggcuaggaccccucca

SEQ ID NO: 1676219 - RNA, 22 nt, Human
ggcuagagguucaaagauauuu

SEQ ID NO: 1676220 - RNA, 17 nt, Human
ggcuagagguucaaaga

SEQ ID NO: 1676221 - RNA, 16 nt, Human
ggcuaguugggcuucc

SEQ ID NO: 1676222 - RNA, 23 nt, Human
ggcuagugugguguuuccuggca

SEQ ID NO: 1676223 - RNA, 15 nt, Human
ggcuaguugggcuuc

SEQ ID NO: 1676224 - RNA, 19 nt, Human
ggcuaugggggcacugagg

SEQ ID NO: 1676225 - RNA, 15 nt, Human
ggcuaugcauuugaa

SEQ ID NO: 1676226 - RNA, 12 nt, Human
ggcuccagcugg

SEQ ID NO: 1676227 - RNA, 12 nt, Human
ggcuccaggagc

SEQ ID NO: 1676228 - RNA, 13 nt, Human
ggcuccaggagca

SEQ ID NO: 1676229 - RNA, 19 nt, Human
ggcuccaggagcagccaca

SEQ ID NO: 1676230 - RNA, 15 nt, Human
ggcucaaguccucuu

SEQ ID NO: 1676231 - RNA, 21 nt, Human
ggcucaaguccucuuuucuga

SEQ ID NO: 1676232 - RNA, 11 nt, Human
ggcuccaggcu

SEQ ID NO: 1676233 - RNA, 17 nt, Human
ggcucccacaggcccuu

SEQ ID NO: 1676234 - RNA, 18 nt, Human
ggcucccacaggcccuuc

SEQ ID NO: 1676235 - RNA, 19 nt, Human
ggcucccacaggcccuucc

SEQ ID NO: 1676236 - RNA, 16 nt, Human
ggcuccaggcuccuuu

SEQ ID NO: 1676237 - RNA, 22 nt, Human
ggccucggacuuagcugggaga

SEQ ID NO: 1676238 - RNA, 20 nt, Human
ggccucggacuuagcuggga

SEQ ID NO: 1676239 - RNA, 18 nt, Human
ggccucuuaugggcuggg

SEQ ID NO: 1676240 - RNA, 20 nt, Human
ggccucgguguggagaagcg

SEQ ID NO: 1676241 - RNA, 17 nt, Human
ggccucuuaugggcugg

SEQ ID NO: 1676242 - RNA, 13 nt, Human
ggccucugcacuc

SEQ ID NO: 1676243 - RNA, 14 nt, Human
ggccucugcacucc

SEQ ID NO: 1676244 - RNA, 15 nt, Human
ggccucugcacuccc

SEQ ID NO: 1676245 - RNA, 16 nt, Human
ggccucugcacucccc

SEQ ID NO: 1676246 - RNA, 11 nt, Human
ggcccugcccu

SEQ ID NO: 1676247 - RNA, 12 nt, Human
ggcccugcccug

SEQ ID NO: 1676248 - RNA, 13 nt, Human
ggcccugcccugg

SEQ ID NO: 1676249 - RNA, 20 nt, Human
ggcccugcccugguuuccug

SEQ ID NO: 1676250 - RNA, 13 nt, Human
ggcccugccuccu

SEQ ID NO: 1676251 - RNA, 13 nt, Human
ggcccuggcuccc

SEQ ID NO: 1676252 - RNA, 22 nt, Human
ggcccuggcucccacaggcccu

SEQ ID NO: 1676253 - RNA, 22 nt, Human
ggcccugcccugguuuccugcc

SEQ ID NO: 1676254 - RNA, 14 nt, Human
ggcccugccuccuu

SEQ ID NO: 1676255 - RNA, 15 nt, Human
ggcccugccuccuuu

SEQ ID NO: 1676256 - RNA, 11 nt, Human
ggcccagagag

SEQ ID NO: 1676257 - RNA, 12 nt, Human
ggcccagagagg

SEQ ID NO: 1676258 - RNA, 21 nt, Human
ggcccucugcccacucccugc

SEQ ID NO: 1676259 - RNA, 19 nt, Human
ggcccucugcccacucccu

SEQ ID NO: 1676260 - RNA, 20 nt, Human
ggcccucugcccacucccug

SEQ ID NO: 1676261 - RNA, 13 nt, Human
ggcccucugccca

SEQ ID NO: 1676262 - RNA, 15 nt, Human
ggcccucugcccacu

SEQ ID NO: 1676263 - RNA, 16 nt, Human
ggcccucugcccacuc

SEQ ID NO: 1676264 - RNA, 17 nt, Human
ggcccucugcccacucc

SEQ ID NO: 1676265 - RNA, 12 nt, Human
ggagugcaguga

SEQ ID NO: 1676266 - RNA, 14 nt, Human
ggagugcagugagc

SEQ ID NO: 1676267 - RNA, 15 nt, Human
ggagugcagugagcc

SEQ ID NO: 1676268 - RNA, 18 nt, Human
ggauacaaaagcauguga

SEQ ID NO: 1676269 - RNA, 22 nt, Human
ggaucaaaccccgaccaccugc

SEQ ID NO: 1676270 - RNA, 22 nt, Human
ggaucccucauccucauaccca

SEQ ID NO: 1676271 - RNA, 13 nt, Human
ggaucccucaucc

SEQ ID NO: 1676272 - RNA, 17 nt, Human
ggaucccucauccucau

SEQ ID NO: 1676273 - RNA, 23 nt, Human
ggaugcacagaguuguuacauuu

SEQ ID NO: 1676274 - RNA, 21 nt, Human
ggaugauuggaggggggaggu

SEQ ID NO: 1676275 - RNA, 16 nt, Human
ggaugcagccucacag

SEQ ID NO: 1676276 - RNA, 17 nt, Human
ggaugcagccucacagu

SEQ ID NO: 1676277 - RNA, 12 nt, Human
ggauccuccagg

SEQ ID NO: 1676278 - RNA, 13 nt, Human
ggauccuccaggu

SEQ ID NO: 1676279 - RNA, 19 nt, Human
ggaugcagccucacagucc

SEQ ID NO: 1676280 - RNA, 15 nt, Human
ggaugcuuguacaua

SEQ ID NO: 1676281 - RNA, 19 nt, Human
ggauuacaagcgugagcca

SEQ ID NO: 1676282 - RNA, 19 nt, Human
ggcaaucauggugcucaga

SEQ ID NO: 1676283 - RNA, 18 nt, Human
ggcaacccccagccugcu

SEQ ID NO: 1676284 - RNA, 14 nt, Human
ggcaaugcuggcug

SEQ ID NO: 1676285 - RNA, 15 nt, Human
ggcaaugcuggcugu

SEQ ID NO: 1676286 - RNA, 23 nt, Human
ggcaaugcuggcuguuggcuggg

SEQ ID NO: 1676287 - RNA, 18 nt, Human
ggcaccggggccucggac

SEQ ID NO: 1676288 - RNA, 22 nt, Human
ggcacccggccccugcugguuc

SEQ ID NO: 1676289 - RNA, 23 nt, Human
ggcacccaccaucaugucuggcu

SEQ ID NO: 1676290 - RNA, 20 nt, Human
ggauucuuaaaguugaauuu

SEQ ID NO: 1676291 - RNA, 16 nt, Human
ggauucuuauggacaa

SEQ ID NO: 1676292 - RNA, 16 nt, Human
ggauucuuccucccuc

SEQ ID NO: 1676293 - RNA, 19 nt, Human
ggauuacaggcuccugcca

SEQ ID NO: 1676294 - RNA, 23 nt, Human
ggauuacaagcgugagccacugc

SEQ ID NO: 1676295 - RNA, 18 nt, Human
ggauucuuaaaguugaau

SEQ ID NO: 1676296 - RNA, 19 nt, Human
ggauucuuaaaguugaauu

SEQ ID NO: 1676297 - RNA, 16 nt, Human
ggauucuuaaaguuga

SEQ ID NO: 1676298 - RNA, 17 nt, Human
ggauuagggagagaaga

SEQ ID NO: 1676299 - RNA, 17 nt, Human
ggauugcuacuguccua

SEQ ID NO: 1676300 - RNA, 16 nt, Human
ggcaacccccagccug

SEQ ID NO: 1676301 - RNA, 17 nt, Human
ggcaacccccagccugc

SEQ ID NO: 1676302 - RNA, 15 nt, Human
ggauuguaaaauggu

SEQ ID NO: 1676303 - RNA, 17 nt, Human
ggcauggccagguggcc

SEQ ID NO: 1676304 - RNA, 18 nt, Human
ggcauggccagguggcca

SEQ ID NO: 1676305 - RNA, 15 nt, Human
ggcaugaagacagau

SEQ ID NO: 1676306 - RNA, 18 nt, Human
ggcaugacacgaauauug

SEQ ID NO: 1676307 - RNA, 19 nt, Human
ggcagggucucacucuguc

SEQ ID NO: 1676308 - RNA, 20 nt, Human
ggcagggucucacucugucg

SEQ ID NO: 1676309 - RNA, 13 nt, Human
ggcagugggagcu

SEQ ID NO: 1676310 - RNA, 14 nt, Human
ggcagugggagcug

SEQ ID NO: 1676311 - RNA, 21 nt, Human
ggcagugggacagggcauggc

SEQ ID NO: 1676312 - RNA, 16 nt, Human
ggcagugggagcugcc

SEQ ID NO: 1676313 - RNA, 12 nt, Human
ggcagcucaccu

SEQ ID NO: 1676314 - RNA, 14 nt, Human
ggcagcucaccucu

SEQ ID NO: 1676315 - RNA, 17 nt, Human
ggcagcuugaggguugg

SEQ ID NO: 1676316 - RNA, 16 nt, Human
ggcagcucaccucucc

SEQ ID NO: 1676317 - RNA, 21 nt, Human
ggcagcucagagaggguggga

SEQ ID NO: 1676318 - RNA, 14 nt, Human
ggccaggcugcucu

SEQ ID NO: 1676319 - RNA, 15 nt, Human
ggccaggcugcucuu

SEQ ID NO: 1676320 - RNA, 11 nt, Human
ggccaggcugc

SEQ ID NO: 1676321 - RNA, 16 nt, Human
ggccaggcugcucuug

SEQ ID NO: 1676322 - RNA, 16 nt, Human
ggccaugggccuccug

SEQ ID NO: 1676323 - RNA, 23 nt, Human
ggccagcugcuugggcuucaucc

SEQ ID NO: 1676324 - RNA, 18 nt, Human
ggccaggcccucugccca

SEQ ID NO: 1676325 - RNA, 20 nt, Human
ggccagccuugaccauucuc

SEQ ID NO: 1676326 - RNA, 22 nt, Human
ggccagccuugaccauucucca

SEQ ID NO: 1676327 - RNA, 17 nt, Human
ggccagcugcuugggcu

SEQ ID NO: 1676328 - RNA, 17 nt, Human
ggccacuccagaccccu

SEQ ID NO: 1676329 - RNA, 18 nt, Human
ggcauuccccaggaggcc

SEQ ID NO: 1676330 - RNA, 19 nt, Human
ggcauuccccaggaggcca

SEQ ID NO: 1676331 - RNA, 22 nt, Human
ggcaugggaaugaaugucagug

SEQ ID NO: 1676332 - RNA, 17 nt, Human
ggcauuccccaggaggc

SEQ ID NO: 1676333 - RNA, 18 nt, Human
ggcaugggaaugaauguc

SEQ ID NO: 1676334 - RNA, 14 nt, Human
ggcauggcugggaa

SEQ ID NO: 1676335 - RNA, 16 nt, Human
gcuucaguggcagcug

SEQ ID NO: 1676336 - RNA, 12 nt, Human
gcuuauacacuu

SEQ ID NO: 1676337 - RNA, 20 nt, Human
gcuuauacacuuacacuuua

SEQ ID NO: 1676338 - RNA, 19 nt, Human
gcuuaucucaggggugugc

SEQ ID NO: 1676339 - RNA, 17 nt, Human
gcuucaguggcagcugc

SEQ ID NO: 1676340 - RNA, 18 nt, Human
gcuucaguggcagcugcu

SEQ ID NO: 1676341 - RNA, 12 nt, Human
gcuucauccucc

SEQ ID NO: 1676342 - RNA, 15 nt, Human
gcuucauccuccuca

SEQ ID NO: 1676343 - RNA, 13 nt, Human
gcuucauuuccug

SEQ ID NO: 1676344 - RNA, 16 nt, Human
gcuucauuuccugugu

SEQ ID NO: 1676345 - RNA, 16 nt, Human
gcuuccagugaggcuc

SEQ ID NO: 1676346 - RNA, 18 nt, Human
gcuuccagugaggcucug

SEQ ID NO: 1676347 - RNA, 17 nt, Human
gcuucauuuccuguguc

SEQ ID NO: 1676348 - RNA, 21 nt, Human
gcuucauccuccucagaucuu

SEQ ID NO: 1676349 - RNA, 18 nt, Human
gcuucauuuccugugucu

SEQ ID NO: 1676350 - RNA, 15 nt, Human
gcuuccagugaggcu

SEQ ID NO: 1676351 - RNA, 16 nt, Human
gcuugaggguugggcu

SEQ ID NO: 1676352 - RNA, 21 nt, Human
gcuuagucacugagacagccc

SEQ ID NO: 1676353 - RNA, 19 nt, Human
gcuuagucacugagacagc

SEQ ID NO: 1676354 - RNA, 20 nt, Human
gcuuagucacugagacagcc

SEQ ID NO: 1676355 - RNA, 15 nt, Human
gcuuagucacugaga

SEQ ID NO: 1676356 - RNA, 17 nt, Human
gcuuagucacugagaca

SEQ ID NO: 1676357 - RNA, 21 nt, Human
gcuguucaugaaagauucaau

SEQ ID NO: 1676358 - RNA, 12 nt, Human
gcuguucaugaa

SEQ ID NO: 1676359 - RNA, 14 nt, Human
gcuguucagcuggu

SEQ ID NO: 1676360 - RNA, 21 nt, Human
gcugugggcgugagaccugcc

SEQ ID NO: 1676361 - RNA, 22 nt, Human
gcugugggcgugagaccugccc

SEQ ID NO: 1676362 - RNA, 20 nt, Human
gcugugggcgugagaccugc

SEQ ID NO: 1676363 - RNA, 17 nt, Human
gcugucuccauguuuga

SEQ ID NO: 1676364 - RNA, 15 nt, Human
gcugccaaugggagc

SEQ ID NO: 1676365 - RNA, 16 nt, Human
gcugccaaugggagcu

SEQ ID NO: 1676366 - RNA, 19 nt, Human
gcugccaaugggagcucau

SEQ ID NO: 1676367 - RNA, 20 nt, Human
gcugccaaugggagcucaug

SEQ ID NO: 1676368 - RNA, 20 nt, Human
gcugucuacacuaagagaga

SEQ ID NO: 1676369 - RNA, 12 nt, Human
ggaaaggcucca

SEQ ID NO: 1676370 - RNA, 13 nt, Human
ggaaaggcuccag

SEQ ID NO: 1676371 - RNA, 14 nt, Human
ggaaaggcuccagg

SEQ ID NO: 1676372 - RNA, 14 nt, Human
ggaaaaguuuaaua

SEQ ID NO: 1676373 - RNA, 18 nt, Human
ggaaaaguuuaauauuaa

SEQ ID NO: 1676374 - RNA, 19 nt, Human
ggaaaaucagccugcucca

SEQ ID NO: 1676375 - RNA, 23 nt, Human
ggaaaaucagccugcuccagcug

SEQ ID NO: 1676376 - RNA, 22 nt, Human
ggaaaggcuccaggagcagcca

SEQ ID NO: 1676377 - RNA, 17 nt, Human
ggaaaggcuccaggagc

SEQ ID NO: 1676378 - RNA, 19 nt, Human
ggaaaggcuccaggagcag

SEQ ID NO: 1676379 - RNA, 20 nt, Human
ggaaaggcuccaggagcagc

SEQ ID NO: 1676380 - RNA, 21 nt, Human
ggaaaggcuccaggagcagcc

SEQ ID NO: 1676381 - RNA, 16 nt, Human
ggaacaggaaacugau

SEQ ID NO: 1676382 - RNA, 21 nt, Human
ggaaaucaccgaaaacguggc

SEQ ID NO: 1676383 - RNA, 14 nt, Human
ggaaaucaccgaaa

SEQ ID NO: 1676384 - RNA, 17 nt, Human
ggaaaucaaauaugcaa

SEQ ID NO: 1676385 - RNA, 21 nt, Human
ggaaaaccaagccguggcuuc

SEQ ID NO: 1676386 - RNA, 14 nt, Human
ggaaaagcugcuga

SEQ ID NO: 1676387 - RNA, 18 nt, Human
ggaaaagcugcugacagu

SEQ ID NO: 1676388 - RNA, 20 nt, Human
ggaaaagcugcugacagugu

SEQ ID NO: 1676389 - RNA, 22 nt, Human
gcuuuucacugcuggcugccuu

SEQ ID NO: 1676390 - RNA, 23 nt, Human
gcuuuucacugcuggcugccuua

SEQ ID NO: 1676391 - RNA, 18 nt, Human
ggaaaacaugcuacacac

SEQ ID NO: 1676392 - RNA, 21 nt, Human
gcuuuguuuguugucagcuga

SEQ ID NO: 1676393 - RNA, 14 nt, Human
gcuuuucacugcug

SEQ ID NO: 1676394 - RNA, 18 nt, Human
gcuuuucacugcuggcug

SEQ ID NO: 1676395 - RNA, 13 nt, Human
gcuuuucacugcu

SEQ ID NO: 1676396 - RNA, 14 nt, Human
gcuuucagauacug

SEQ ID NO: 1676397 - RNA, 18 nt, Human
gcuuucagauacuggauu

SEQ ID NO: 1676398 - RNA, 15 nt, Human
gcuuuguaugcacuu

SEQ ID NO: 1676399 - RNA, 23 nt, Human
gcuuucagauacuggauuguacu

SEQ ID NO: 1676400 - RNA, 15 nt, Human
gcuuugugauuuuug

SEQ ID NO: 1676401 - RNA, 22 nt, Human
gcuugaggguugggcugguguc

SEQ ID NO: 1676402 - RNA, 18 nt, Human
gcuugaggguugggcugg

SEQ ID NO: 1676403 - RNA, 20 nt, Human
gcuugaggguugggcuggug

SEQ ID NO: 1676404 - RNA, 15 nt, Human
ggacuguggugacuu

SEQ ID NO: 1676405 - RNA, 17 nt, Human
ggacuguggugacuuug

SEQ ID NO: 1676406 - RNA, 21 nt, Human
ggacuguggugacuuuggaua

SEQ ID NO: 1676407 - RNA, 22 nt, Human
ggacuguggugacuuuggauaa

SEQ ID NO: 1676408 - RNA, 17 nt, Human
ggacugugugcucagga

SEQ ID NO: 1676409 - RNA, 17 nt, Human
ggagaagcggcuggcag

SEQ ID NO: 1676410 - RNA, 18 nt, Human
ggagaagcggcuggcagc

SEQ ID NO: 1676411 - RNA, 15 nt, Human
ggagaaucacuugaa

SEQ ID NO: 1676412 - RNA, 19 nt, Human
ggagaaucacuugaacccg

SEQ ID NO: 1676413 - RNA, 18 nt, Human
ggacuggccucugcugau

SEQ ID NO: 1676414 - RNA, 14 nt, Human
ggacuguggugacu

SEQ ID NO: 1676415 - RNA, 15 nt, Human
ggacgcucucuggcc

SEQ ID NO: 1676416 - RNA, 13 nt, Human
ggacgcucucugg

SEQ ID NO: 1676417 - RNA, 14 nt, Human
ggacgcucucuggc

SEQ ID NO: 1676418 - RNA, 13 nt, Human
ggaccagagcugc

SEQ ID NO: 1676419 - RNA, 14 nt, Human
ggaccagagcugcc

SEQ ID NO: 1676420 - RNA, 19 nt, Human
ggaccucaggugagaagca

SEQ ID NO: 1676421 - RNA, 23 nt, Human
ggaccucaggugagaagcagagg

SEQ ID NO: 1676422 - RNA, 17 nt, Human
ggacgcuacccgggaag

SEQ ID NO: 1676423 - RNA, 19 nt, Human
ggacgcuacccgggaaggg

SEQ ID NO: 1676424 - RNA, 20 nt, Human
ggacgcuacccgggaagggg

SEQ ID NO: 1676425 - RNA, 15 nt, Human
ggaccuugaacuggg

SEQ ID NO: 1676426 - RNA, 17 nt, Human
ggaccuugaacugggua

SEQ ID NO: 1676427 - RNA, 17 nt, Human
ggacacucaaaagcugg

SEQ ID NO: 1676428 - RNA, 22 nt, Human
ggacacucaaaagcugggcagg

SEQ ID NO: 1676429 - RNA, 15 nt, Human
ggacagccacggcca

SEQ ID NO: 1676430 - RNA, 19 nt, Human
ggacagccacggccaggcc

SEQ ID NO: 1676431 - RNA, 20 nt, Human
ggacagccacggccaggcca

SEQ ID NO: 1676432 - RNA, 21 nt, Human
ggacagccacggccaggccag

SEQ ID NO: 1676433 - RNA, 22 nt, Human
ggacagccacggccaggccaga

SEQ ID NO: 1676434 - RNA, 20 nt, Human
ggacauugcggacagccacg

SEQ ID NO: 1676435 - RNA, 16 nt, Human
ggaccaaaaaccagua

SEQ ID NO: 1676436 - RNA, 23 nt, Human
ggaccaaaaaccaguauuguaca

SEQ ID NO: 1676437 - RNA, 16 nt, Human
ggacauuugcucaugg

SEQ ID NO: 1676438 - RNA, 13 nt, Human
ggaaccugacccc

SEQ ID NO: 1676439 - RNA, 14 nt, Human
ggaaggcagggagg

SEQ ID NO: 1676440 - RNA, 16 nt, Human
ggaacgcguugaaauu

SEQ ID NO: 1676441 - RNA, 17 nt, Human
ggaaggcugagaggaga

SEQ ID NO: 1676442 - RNA, 23 nt, Human
ggaaggggagauaaggguaucug

SEQ ID NO: 1676443 - RNA, 18 nt, Human
ggaaguacuggagaaaau

SEQ ID NO: 1676444 - RNA, 12 nt, Human
ggaaguacugga

SEQ ID NO: 1676445 - RNA, 16 nt, Human
ggaaguacuggagaaa

SEQ ID NO: 1676446 - RNA, 18 nt, Human
ggaagugcuaauuuugaa

SEQ ID NO: 1676447 - RNA, 20 nt, Human
ggaagugacgguuuaauggg

SEQ ID NO: 1676448 - RNA, 19 nt, Human
ggaauuuucaucuaggauu

SEQ ID NO: 1676449 - RNA, 16 nt, Human
ggacaaaauggaauac

SEQ ID NO: 1676450 - RNA, 17 nt, Human
ggacaaaauggaauacu

SEQ ID NO: 1676451 - RNA, 12 nt, Human
ggaauuguguuu

SEQ ID NO: 1676452 - RNA, 16 nt, Human
ggaauuggagcucgug

SEQ ID NO: 1676453 - RNA, 22 nt, Human
ggaauuggagcucgugggacag

SEQ ID NO: 1676454 - RNA, 23 nt, Human
ggaauuucucccagucauuuaau

SEQ ID NO: 1676455 - RNA, 19 nt, Human
ggaauguuugccucugccu

SEQ ID NO: 1676456 - RNA, 12 nt, Human
ggaauucuguau

SEQ ID NO: 1676457 - RNA, 15 nt, Human
ggaauucuguauaga

SEQ ID NO: 1676458 - RNA, 17 nt, Human
ggaauucuguauagauu

SEQ ID NO: 1676459 - RNA, 24 nt, Human
ggaaugauuaauuaaaacacaaca

SEQ ID NO: 1676460 - RNA, 12 nt, Human
ggaaugcagugg

SEQ ID NO: 1676461 - RNA, 20 nt, Human
gaggcugggcucccuuccca

SEQ ID NO: 1676462 - RNA, 19 nt, Human
gagggagggcuccagacac

SEQ ID NO: 1676463 - RNA, 21 nt, Human
gagggagugacagaggcagcc

SEQ ID NO: 1676464 - RNA, 22 nt, Human
gagggagugacagaggcagccc

SEQ ID NO: 1676465 - RNA, 20 nt, Human
gagggagggggaaggcaggg

SEQ ID NO: 1676466 - RNA, 20 nt, Human
gagggagggcuccagacaca

SEQ ID NO: 1676467 - RNA, 14 nt, Human
gagggagguaagga

SEQ ID NO: 1676468 - RNA, 18 nt, Human
gagggagugacagaggca

SEQ ID NO: 1676469 - RNA, 17 nt, Human
gaggggcugugggcgug

SEQ ID NO: 1676470 - RNA, 17 nt, Human
gaggggguggccuccca

SEQ ID NO: 1676471 - RNA, 13 nt, Human
gaggguaaggcug

SEQ ID NO: 1676472 - RNA, 24 nt, Human
gagguaaggaauaccugucccccu

SEQ ID NO: 1676473 - RNA, 21 nt, Human
gagguaaggaauaccuguccc

SEQ ID NO: 1676474 - RNA, 14 nt, Human
gaggguugggcugg

SEQ ID NO: 1676475 - RNA, 15 nt, Human
gaggguugggcuggu

SEQ ID NO: 1676476 - RNA, 17 nt, Human
gaggucaaggcugcagu

SEQ ID NO: 1676477 - RNA, 12 nt, Human
gaggucagagcc

SEQ ID NO: 1676478 - RNA, 13 nt, Human
gaggucagagccu

SEQ ID NO: 1676479 - RNA, 15 nt, Human
gagggugggaguggg

SEQ ID NO: 1676480 - RNA, 14 nt, Human
gaggguggugaccu

SEQ ID NO: 1676481 - RNA, 21 nt, Human
gaggguggugaccucugccug

SEQ ID NO: 1676482 - RNA, 22 nt, Human
gagggugucccaaaaagaaagg

SEQ ID NO: 1676483 - RNA, 12 nt, Human
gaggguggaaua

SEQ ID NO: 1676484 - RNA, 21 nt, Human
gagggugaagugaagacaaug

SEQ ID NO: 1676485 - RNA, 13 nt, Human
gagggucugagga

SEQ ID NO: 1676486 - RNA, 14 nt, Human
gagggucugaggaa

SEQ ID NO: 1676487 - RNA, 21 nt, Human
gaggcgcaugaauuugugaag

SEQ ID NO: 1676488 - RNA, 16 nt, Human
gaggccuucucugaag

SEQ ID NO: 1676489 - RNA, 18 nt, Human
gaggccuucucugaagga

SEQ ID NO: 1676490 - RNA, 19 nt, Human
gaggccuucucugaaggac

SEQ ID NO: 1676491 - RNA, 11 nt, Human
gaggcccagag

SEQ ID NO: 1676492 - RNA, 13 nt, Human
gaggcccagaggg

SEQ ID NO: 1676493 - RNA, 14 nt, Human
gaggcccagagggc

SEQ ID NO: 1676494 - RNA, 19 nt, Human
gaggcccagagggccugca

SEQ ID NO: 1676495 - RNA, 15 nt, Human
gaggcccagagggcc

SEQ ID NO: 1676496 - RNA, 16 nt, Human
gaggcccagagggccu

SEQ ID NO: 1676497 - RNA, 22 nt, Human
gaggcccuucucuccagccccu

SEQ ID NO: 1676498 - RNA, 21 nt, Human
gaggcccuucucuccagcccc

SEQ ID NO: 1676499 - RNA, 15 nt, Human
gaggcccuucucucc

SEQ ID NO: 1676500 - RNA, 20 nt, Human
gaggcccuucucuccagccc

SEQ ID NO: 1676501 - RNA, 20 nt, Human
gaggauugcuugagcucagg

SEQ ID NO: 1676502 - RNA, 22 nt, Human
gagcccuguccugccuaaggcu

SEQ ID NO: 1676503 - RNA, 13 nt, Human
gaggaucucuuga

SEQ ID NO: 1676504 - RNA, 22 nt, Human
gaggaucucuugagccugggag

SEQ ID NO: 1676505 - RNA, 16 nt, Human
gaggaucucuugagcc

SEQ ID NO: 1676506 - RNA, 19 nt, Human
gaggaucucuugagccugg

SEQ ID NO: 1676507 - RNA, 14 nt, Human
gaggccaugggccu

SEQ ID NO: 1676508 - RNA, 17 nt, Human
gaggccaugggccuccu

SEQ ID NO: 1676509 - RNA, 18 nt, Human
gaggccaugggccuccug

SEQ ID NO: 1676510 - RNA, 20 nt, Human
gaggccaugggccuccugug

SEQ ID NO: 1676511 - RNA, 21 nt, Human
gaggccaugggccuccugugu

SEQ ID NO: 1676512 - RNA, 23 nt, Human
gaggccaugggccuccugugugu

SEQ ID NO: 1676513 - RNA, 21 nt, Human
gaggcagccccauucugccug

SEQ ID NO: 1676514 - RNA, 20 nt, Human
gaggcagccccauucugccu

SEQ ID NO: 1676515 - RNA, 9 nt, Human
gaggcaggg

SEQ ID NO: 1676516 - RNA, 19 nt, Human
gaggcagccccauucugcc

SEQ ID NO: 1676517 - RNA, 19 nt, Human
gaggcagagguugcaguga

SEQ ID NO: 1676518 - RNA, 21 nt, Human
gagucuauuuacggaacucaa

SEQ ID NO: 1676519 - RNA, 12 nt, Human
gagucugaaggc

SEQ ID NO: 1676520 - RNA, 13 nt, Human
gagucugaaggcu

SEQ ID NO: 1676521 - RNA, 15 nt, Human
gagucugaaggcugg

SEQ ID NO: 1676522 - RNA, 14 nt, Human
gagucugaaggcug

SEQ ID NO: 1676523 - RNA, 17 nt, Human
gagugaagcugggagaa

SEQ ID NO: 1676524 - RNA, 14 nt, Human
gagugacagaggca

SEQ ID NO: 1676525 - RNA, 15 nt, Human
gagugacagaggcag

SEQ ID NO: 1676526 - RNA, 16 nt, Human
gagugacagaggcagc

SEQ ID NO: 1676527 - RNA, 11 nt, Human
gaguauauguc

SEQ ID NO: 1676528 - RNA, 18 nt, Human
gaguaggaagacuuugga

SEQ ID NO: 1676529 - RNA, 19 nt, Human
gaguaggaagacuuuggaa

SEQ ID NO: 1676530 - RNA, 15 nt, Human
gagucgaggacaggg

SEQ ID NO: 1676531 - RNA, 16 nt, Human
gagucgaggacaggga

SEQ ID NO: 1676532 - RNA, 19 nt, Human
gaguccgaaagggacuugg

SEQ ID NO: 1676533 - RNA, 14 nt, Human
gagucgaggacagg

SEQ ID NO: 1676534 - RNA, 22 nt, Human
gaguaauccaagcaaaugugaa

SEQ ID NO: 1676535 - RNA, 20 nt, Human
gaguacuacaguccucccau

SEQ ID NO: 1676536 - RNA, 21 nt, Human
gaguacuacaguccucccauc

SEQ ID NO: 1676537 - RNA, 23 nt, Human
gaguacuacaguccucccaucuc

SEQ ID NO: 1676538 - RNA, 19 nt, Human
gaguagcugggacuacagg

SEQ ID NO: 1676539 - RNA, 22 nt, Human
gaguagcugggacuacaggcac

SEQ ID NO: 1676540 - RNA, 12 nt, Human
gaguaggaagac

SEQ ID NO: 1676541 - RNA, 13 nt, Human
gaguaggaagacu

SEQ ID NO: 1676542 - RNA, 17 nt, Human
gaguaggaagacuuugg

SEQ ID NO: 1676543 - RNA, 17 nt, Human
gaggucagagccugcag

SEQ ID NO: 1676544 - RNA, 20 nt, Human
gaggucagagccugcaguua

SEQ ID NO: 1676545 - RNA, 15 nt, Human
gagguugggaggcca

SEQ ID NO: 1676546 - RNA, 17 nt, Human
gagguugggaggccauu

SEQ ID NO: 1676547 - RNA, 16 nt, Human
gagguuucaaaccucc

SEQ ID NO: 1676548 - RNA, 15 nt, Human
gauauaagugugugu

SEQ ID NO: 1676549 - RNA, 14 nt, Human
gauaugauucaaau

SEQ ID NO: 1676550 - RNA, 22 nt, Human
gauaugauucaaaugucuauaa

SEQ ID NO: 1676551 - RNA, 24 nt, Human
gauaugauucaaaugucuauaaac

SEQ ID NO: 1676552 - RNA, 18 nt, Human
gaucacggcucacugcag

SEQ ID NO: 1676553 - RNA, 14 nt, Human
gaucacagccucug

SEQ ID NO: 1676554 - RNA, 20 nt, Human
gaucacggcucacugcagcc

SEQ ID NO: 1676555 - RNA, 15 nt, Human
gaucacggcucacug

SEQ ID NO: 1676556 - RNA, 16 nt, Human
gaucacggcucacugc

SEQ ID NO: 1676557 - RNA, 21 nt, Human
gauacaggaaaagcugcugac

SEQ ID NO: 1676558 - RNA, 23 nt, Human
gauacaggaaaagcugcugacag

SEQ ID NO: 1676559 - RNA, 22 nt, Human
gauaagaaccuuuugagugccu

SEQ ID NO: 1676560 - RNA, 17 nt, Human
gauaacuguuauuuaua

SEQ ID NO: 1676561 - RNA, 20 nt, Human
gauacaggaaaagcugcuga

SEQ ID NO: 1676562 - RNA, 18 nt, Human
gauaacuguuauuuauaa

SEQ ID NO: 1676563 - RNA, 16 nt, Human
gauagcacagacccug

SEQ ID NO: 1676564 - RNA, 15 nt, Human
gauagcacagacccu

SEQ ID NO: 1676565 - RNA, 22 nt, Human
gauagccaaggccaaaggaagc

SEQ ID NO: 1676566 - RNA, 13 nt, Human
gaguuacagacaa

SEQ ID NO: 1676567 - RNA, 15 nt, Human
gaguuacagacaaag

SEQ ID NO: 1676568 - RNA, 14 nt, Human
gaguucaucuugaa

SEQ ID NO: 1676569 - RNA, 20 nt, Human
gaguucauacccuguuacca

SEQ ID NO: 1676570 - RNA, 19 nt, Human
gaguucaucuugaauugua

SEQ ID NO: 1676571 - RNA, 20 nt, Human
gaguucaucuugaauuguaa

SEQ ID NO: 1676572 - RNA, 15 nt, Human
gaguugaagacagag

SEQ ID NO: 1676573 - RNA, 17 nt, Human
gaguugaagacagagcu

SEQ ID NO: 1676574 - RNA, 21 nt, Human
gaguugaagacagagcuacac

SEQ ID NO: 1676575 - RNA, 11 nt, Human
gauaaaugcca

SEQ ID NO: 1676576 - RNA, 15 nt, Human
gauaaaugccaucaa

SEQ ID NO: 1676577 - RNA, 20 nt, Human
gauaaaugccaucaauaaaa

SEQ ID NO: 1676578 - RNA, 22 nt, Human
gauaaauggcuuccuggcaaua

SEQ ID NO: 1676579 - RNA, 16 nt, Human
gaguguugaaacggau

SEQ ID NO: 1676580 - RNA, 12 nt, Human
gaguuacagaca

SEQ ID NO: 1676581 - RNA, 20 nt, Human
gagugugccugaagucccag

SEQ ID NO: 1676582 - RNA, 19 nt, Human
gagugucuuaauuaaaaga

SEQ ID NO: 1676583 - RNA, 13 nt, Human
gagugggugaaua

SEQ ID NO: 1676584 - RNA, 17 nt, Human
gagugacagaggcagcc

SEQ ID NO: 1676585 - RNA, 22 nt, Human
gcaccccagcuggggccaggcu

SEQ ID NO: 1676586 - RNA, 12 nt, Human
gcaccauaacuu

SEQ ID NO: 1676587 - RNA, 20 nt, Human
gcaccuuagacagucccugc

SEQ ID NO: 1676588 - RNA, 21 nt, Human
gcaccuuagacagucccugcc

SEQ ID NO: 1676589 - RNA, 15 nt, Human
gcacgauuucuguuu

SEQ ID NO: 1676590 - RNA, 13 nt, Human
gcacgauuucugu

SEQ ID NO: 1676591 - RNA, 15 nt, Human
gcacagugcaucuca

SEQ ID NO: 1676592 - RNA, 18 nt, Human
gcacagugcaucucagcc

SEQ ID NO: 1676593 - RNA, 13 nt, Human
gcacagugcaucu

SEQ ID NO: 1676594 - RNA, 21 nt, Human
gcacagaguuguuacauuuuu

SEQ ID NO: 1676595 - RNA, 19 nt, Human
gcacagaguuguuacauuu

SEQ ID NO: 1676596 - RNA, 18 nt, Human
gcacagaguuguuacauu

SEQ ID NO: 1676597 - RNA, 16 nt, Human
gcacagaguuguuaca

SEQ ID NO: 1676598 - RNA, 22 nt, Human
gcacagaguuguuacauuuuua

SEQ ID NO: 1676599 - RNA, 12 nt, Human
gcagacaggcaa

SEQ ID NO: 1676600 - RNA, 13 nt, Human
gcagacaggcaag

SEQ ID NO: 1676601 - RNA, 14 nt, Human
gcagacaggcaagc

SEQ ID NO: 1676602 - RNA, 19 nt, Human
gcacuguggguagacacac

SEQ ID NO: 1676603 - RNA, 14 nt, Human
gcacugguggcccg

SEQ ID NO: 1676604 - RNA, 19 nt, Human
gcacugguggcccgacagc

SEQ ID NO: 1676605 - RNA, 23 nt, Human
gcacugcuuccagugaggcucug

SEQ ID NO: 1676606 - RNA, 14 nt, Human
gcacugcugcccag

SEQ ID NO: 1676607 - RNA, 15 nt, Human
gcacugcugcccagc

SEQ ID NO: 1676608 - RNA, 18 nt, Human
gcacugcugcccagccuc

SEQ ID NO: 1676609 - RNA, 20 nt, Human
gcacugcugcccagccucca

SEQ ID NO: 1676610 - RNA, 16 nt, Human
gcacgauuucuguuua

SEQ ID NO: 1676611 - RNA, 15 nt, Human
gcacugacuucuaag

SEQ ID NO: 1676612 - RNA, 18 nt, Human
gcacugacuucuaaguaa

SEQ ID NO: 1676613 - RNA, 23 nt, Human
gcacaaauucugucucuggauua

SEQ ID NO: 1676614 - RNA, 21 nt, Human
gcacaagcuccaagcucccag

SEQ ID NO: 1676615 - RNA, 18 nt, Human
gcacaagcuccaagcucc

SEQ ID NO: 1676616 - RNA, 15 nt, Human
gcacaagcuccaagc

SEQ ID NO: 1676617 - RNA, 17 nt, Human
gcacaagcuccaagcuc

SEQ ID NO: 1676618 - RNA, 20 nt, Human
gcacagaaaauggaagacag

SEQ ID NO: 1676619 - RNA, 15 nt, Human
gcacagaguuguuac

SEQ ID NO: 1676620 - RNA, 22 nt, Human
gcacagacccugcccugugggc

SEQ ID NO: 1676621 - RNA, 18 nt, Human
gcacagacccugcccugu

SEQ ID NO: 1676622 - RNA, 19 nt, Human
gcacagacccugcccugug

SEQ ID NO: 1676623 - RNA, 20 nt, Human
gcacagacccugcccugugg

SEQ ID NO: 1676624 - RNA, 21 nt, Human
gcacagacccugcccuguggg

SEQ ID NO: 1676625 - RNA, 21 nt, Human
gcacagaaaauggaagacagc

SEQ ID NO: 1676626 - RNA, 22 nt, Human
gcacagaaaauggaagacagcu

SEQ ID NO: 1676627 - RNA, 23 nt, Human
gcacagaaaauggaagacagcuc

SEQ ID NO: 1676628 - RNA, 14 nt, Human
gcacagacccugcc

SEQ ID NO: 1676629 - RNA, 15 nt, Human
gcacagacccugccc

SEQ ID NO: 1676630 - RNA, 16 nt, Human
gcacagacccugcccu

SEQ ID NO: 1676631 - RNA, 17 nt, Human
gcacagacccugcccug

SEQ ID NO: 1676632 - RNA, 13 nt, Human
gcaacucugaagg

SEQ ID NO: 1676633 - RNA, 15 nt, Human
gcaauggcagccuug

SEQ ID NO: 1676634 - RNA, 14 nt, Human
gcaacucaucuuag

SEQ ID NO: 1676635 - RNA, 14 nt, Human
gcaaugugauaaaa

SEQ ID NO: 1676636 - RNA, 15 nt, Human
gcacaaacagaggcc

SEQ ID NO: 1676637 - RNA, 16 nt, Human
gcacaaacagaggccg

SEQ ID NO: 1676638 - RNA, 14 nt, Human
gcacaaacagaggc

SEQ ID NO: 1676639 - RNA, 14 nt, Human
gcaauucuccugcc

SEQ ID NO: 1676640 - RNA, 15 nt, Human
gcaauucuccugccu

SEQ ID NO: 1676641 - RNA, 16 nt, Human
gcaauucuccugccuc

SEQ ID NO: 1676642 - RNA, 17 nt, Human
gcaauucuccugccuca

SEQ ID NO: 1676643 - RNA, 18 nt, Human
gcaauucuccugccucag

SEQ ID NO: 1676644 - RNA, 19 nt, Human
gcaauucuccugccucagc

SEQ ID NO: 1676645 - RNA, 20 nt, Human
gcaauucuccugccucagcc

SEQ ID NO: 1676646 - RNA, 19 nt, Human
gaugggugcuuggaggaag

SEQ ID NO: 1676647 - RNA, 13 nt, Human
gauggggcugcac

SEQ ID NO: 1676648 - RNA, 19 nt, Human
gauggggcugcaccggcug

SEQ ID NO: 1676649 - RNA, 15 nt, Human
gauggggcugcaccg

SEQ ID NO: 1676650 - RNA, 22 nt, Human
gauggccgggcgcgguggcuca

SEQ ID NO: 1676651 - RNA, 20 nt, Human
gaugggcaacccccagccug

SEQ ID NO: 1676652 - RNA, 21 nt, Human
gaugggcaacccccagccugc

SEQ ID NO: 1676653 - RNA, 24 nt, Human
gauggggcccugccuccuuuguga

SEQ ID NO: 1676654 - RNA, 20 nt, Human
gaugcccaaagaugcagccg

SEQ ID NO: 1676655 - RNA, 19 nt, Human
gaugcccaaagaugcagcc

SEQ ID NO: 1676656 - RNA, 21 nt, Human
gaucagacagaucuggaaugu

SEQ ID NO: 1676657 - RNA, 17 nt, Human
gaugcugacuguacucc

SEQ ID NO: 1676658 - RNA, 20 nt, Human
gaugcugacuguacuccucc

SEQ ID NO: 1676659 - RNA, 21 nt, Human
gaugccccgucccccucuggc

SEQ ID NO: 1676660 - RNA, 16 nt, Human
gaugccccgucccccu

SEQ ID NO: 1676661 - RNA, 18 nt, Human
gaugcuagaacucccuuu

SEQ ID NO: 1676662 - RNA, 20 nt, Human
gaugcuagaacucccuuuca

SEQ ID NO: 1676663 - RNA, 22 nt, Human
gaugcuagaacucccuuucaac

SEQ ID NO: 1676664 - RNA, 16 nt, Human
gauguuuaguaaucau

SEQ ID NO: 1676665 - RNA, 20 nt, Human
gauuacaggcgugagccacc

SEQ ID NO: 1676666 - RNA, 17 nt, Human
gauuacaggcuccugcc

SEQ ID NO: 1676667 - RNA, 23 nt, Human
gauuacaagcgugagccacugca

SEQ ID NO: 1676668 - RNA, 15 nt, Human
gauuaaacuuaaucu

SEQ ID NO: 1676669 - RNA, 22 nt, Human
gauuacaagcgugagccacugc

SEQ ID NO: 1676670 - RNA, 12 nt, Human
gauggugcaaug

SEQ ID NO: 1676671 - RNA, 14 nt, Human
gauggugcaaugac

SEQ ID NO: 1676672 - RNA, 17 nt, Human
gauggugcaaugaccuu

SEQ ID NO: 1676673 - RNA, 15 nt, Human
gauggugcaaugacc

SEQ ID NO: 1676674 - RNA, 16 nt, Human
gauggugcaaugaccu

SEQ ID NO: 1676675 - RNA, 13 nt, Human
gaugguuccccug

SEQ ID NO: 1676676 - RNA, 18 nt, Human
gaugguuccccuguucac

SEQ ID NO: 1676677 - RNA, 21 nt, Human
gaugguuccccuguucacucu

SEQ ID NO: 1676678 - RNA, 22 nt, Human
gaugguucccuugaugaagaag

SEQ ID NO: 1676679 - RNA, 21 nt, Human
gauucaaugccccugaauuua

SEQ ID NO: 1676680 - RNA, 18 nt, Human
gauuacaggcuccugcca

SEQ ID NO: 1676681 - RNA, 21 nt, Human
gauuacaggcuccugccacca

SEQ ID NO: 1676682 - RNA, 19 nt, Human
gauucaaugccccugaauu

SEQ ID NO: 1676683 - RNA, 20 nt, Human
gauucaaugccccugaauuu

SEQ ID NO: 1676684 - RNA, 16 nt, Human
gauucucaugccucag

SEQ ID NO: 1676685 - RNA, 14 nt, Human
gauucuccugccuc

SEQ ID NO: 1676686 - RNA, 15 nt, Human
gauugcaacaggcug

SEQ ID NO: 1676687 - RNA, 14 nt, Human
gauuuaacagaaau

SEQ ID NO: 1676688 - RNA, 13 nt, Human
gauuuaacagaaa

SEQ ID NO: 1676689 - RNA, 16 nt, Human
gauuugagcucagccc

SEQ ID NO: 1676690 - RNA, 22 nt, Human
gauuuccguuaaaauaccagcc

SEQ ID NO: 1676691 - RNA, 15 nt, Human
gauuuaacagaaaug

SEQ ID NO: 1676692 - RNA, 12 nt, Human
gcaaaccaucau

SEQ ID NO: 1676693 - RNA, 21 nt, Human
gauuuugaaauuuuuauuaaa

SEQ ID NO: 1676694 - RNA, 19 nt, Human
gauuuugauccaagcuggu

SEQ ID NO: 1676695 - RNA, 13 nt, Human
gauuuuaugcuuu

SEQ ID NO: 1676696 - RNA, 15 nt, Human
gcaaauguggcuccu

SEQ ID NO: 1676697 - RNA, 16 nt, Human
gcaaauugucacagga

SEQ ID NO: 1676698 - RNA, 15 nt, Human
gcaaaccaucauuga

SEQ ID NO: 1676699 - RNA, 19 nt, Human
gaccauucuccaccugcca

SEQ ID NO: 1676700 - RNA, 20 nt, Human
gaccauucuccaccugccag

SEQ ID NO: 1676701 - RNA, 21 nt, Human
gaccauucuccaccugccagg

SEQ ID NO: 1676702 - RNA, 22 nt, Human
gaccauucuccaccugccaggg

SEQ ID NO: 1676703 - RNA, 21 nt, Human
gaccagccuccaugcugccuc

SEQ ID NO: 1676704 - RNA, 22 nt, Human
gaccagccuccaugcugccucc

SEQ ID NO: 1676705 - RNA, 20 nt, Human
gaccagccuccaugcugccu

SEQ ID NO: 1676706 - RNA, 18 nt, Human
gaccagagcugccaccug

SEQ ID NO: 1676707 - RNA, 19 nt, Human
gaccagagcugccaccugc

SEQ ID NO: 1676708 - RNA, 13 nt, Human
gaccagagcugcc

SEQ ID NO: 1676709 - RNA, 14 nt, Human
gaccagagcugcca

SEQ ID NO: 1676710 - RNA, 15 nt, Human
gaccagagcugccac

SEQ ID NO: 1676711 - RNA, 17 nt, Human
gaccagagcugccaccu

SEQ ID NO: 1676712 - RNA, 13 nt, Human
gaccaccugccca

SEQ ID NO: 1676713 - RNA, 14 nt, Human
gaccaccugcccaa

SEQ ID NO: 1676714 - RNA, 18 nt, Human
gacaugggaaaggggaag

SEQ ID NO: 1676715 - RNA, 16 nt, Human
gacaugggacauuugc

SEQ ID NO: 1676716 - RNA, 21 nt, Human
gaccagacaccuugacagggc

SEQ ID NO: 1676717 - RNA, 11 nt, Human
gaccagagcug

SEQ ID NO: 1676718 - RNA, 14 nt, Human
gaccacguuucuaa

SEQ ID NO: 1676719 - RNA, 16 nt, Human
gaccacguuucuaaag

SEQ ID NO: 1676720 - RNA, 21 nt, Human
gaccacugcagaagacaguau

SEQ ID NO: 1676721 - RNA, 12 nt, Human
gacccugucuca

SEQ ID NO: 1676722 - RNA, 19 nt, Human
gacccuuguggucccaccc

SEQ ID NO: 1676723 - RNA, 20 nt, Human
gacccuuguggucccacccc

SEQ ID NO: 1676724 - RNA, 21 nt, Human
gacccuuguggucccacccca

SEQ ID NO: 1676725 - RNA, 19 nt, Human
gaccgugaggccagagaca

SEQ ID NO: 1676726 - RNA, 18 nt, Human
gaccgugaggccagagac

SEQ ID NO: 1676727 - RNA, 16 nt, Human
gaccgugaggccagag

SEQ ID NO: 1676728 - RNA, 17 nt, Human
gaccgugaggccagaga

SEQ ID NO: 1676729 - RNA, 14 nt, Human
gaccccuccaugug

SEQ ID NO: 1676730 - RNA, 18 nt, Human
gaccccuccaugugggcu

SEQ ID NO: 1676731 - RNA, 21 nt, Human
gaccccuccaugugggcuagu

SEQ ID NO: 1676732 - RNA, 22 nt, Human
gacccugaggcccagagggccu

SEQ ID NO: 1676733 - RNA, 23 nt, Human
gacccugaggcccagagggccug

SEQ ID NO: 1676734 - RNA, 12 nt, Human
gacccugcccug

SEQ ID NO: 1676735 - RNA, 12 nt, Human
gacccccaacca

SEQ ID NO: 1676736 - RNA, 21 nt, Human
gacccccaaccaaguggcucc

SEQ ID NO: 1676737 - RNA, 16 nt, Human
gacccaaaaggcagaa

SEQ ID NO: 1676738 - RNA, 15 nt, Human
gacccacaagaaaug

SEQ ID NO: 1676739 - RNA, 22 nt, Human
gacccacaagaaaugaaagcag

SEQ ID NO: 1676740 - RNA, 18 nt, Human
gacagcugccugggaucc

SEQ ID NO: 1676741 - RNA, 21 nt, Human
gacagcugccugggaucccuc

SEQ ID NO: 1676742 - RNA, 20 nt, Human
gacagccacggccaggccag

SEQ ID NO: 1676743 - RNA, 21 nt, Human
gacagccacggccaggccaga

SEQ ID NO: 1676744 - RNA, 16 nt, Human
gacagcugccugggau

SEQ ID NO: 1676745 - RNA, 17 nt, Human
gacagcugccugggauc

SEQ ID NO: 1676746 - RNA, 20 nt, Human
gacagagugagacucugucu

SEQ ID NO: 1676747 - RNA, 22 nt, Human
gacagagugagacucugucuca

SEQ ID NO: 1676748 - RNA, 14 nt, Human
gacagccacggcca

SEQ ID NO: 1676749 - RNA, 17 nt, Human
gacagccacggccaggc

SEQ ID NO: 1676750 - RNA, 18 nt, Human
gacagccacggccaggcc

SEQ ID NO: 1676751 - RNA, 19 nt, Human
gacagccacggccaggcca

SEQ ID NO: 1676752 - RNA, 21 nt, Human
gacagagcaagugagacccug

SEQ ID NO: 1676753 - RNA, 14 nt, Human
gacagaggcagccc

SEQ ID NO: 1676754 - RNA, 16 nt, Human
gacagaggcagcccca

SEQ ID NO: 1676755 - RNA, 17 nt, Human
gacagaggcagccccau

SEQ ID NO: 1676756 - RNA, 15 nt, Human
gacagaggggguggc

SEQ ID NO: 1676757 - RNA, 18 nt, Human
gacagaggggguggccuc

SEQ ID NO: 1676758 - RNA, 19 nt, Human
gacagaggggguggccucc

SEQ ID NO: 1676759 - RNA, 21 nt, Human
gacagaggggguggccuccca

SEQ ID NO: 1676760 - RNA, 22 nt, Human
gacagaggggguggccucccaa

SEQ ID NO: 1676761 - RNA, 23 nt, Human
gacagaggggguggccucccaac

SEQ ID NO: 1676762 - RNA, 14 nt, Human
gacagagucucacu

SEQ ID NO: 1676763 - RNA, 14 nt, Human
gacaugaucuucuu

SEQ ID NO: 1676764 - RNA, 14 nt, Human
gacaugggaaaggg

SEQ ID NO: 1676765 - RNA, 22 nt, Human
gacaguuaagagaaaugagcuu

SEQ ID NO: 1676766 - RNA, 20 nt, Human
gacauagaauuaacacauga

SEQ ID NO: 1676767 - RNA, 14 nt, Human
gacaguuaagagaa

SEQ ID NO: 1676768 - RNA, 24 nt, Human
gacagggcacaccgggcacucaga

SEQ ID NO: 1676769 - RNA, 23 nt, Human
gacagggcacaccgggcacucag

SEQ ID NO: 1676770 - RNA, 16 nt, Human
gacagggaggugaccc

SEQ ID NO: 1676771 - RNA, 18 nt, Human
gacagggaggacgcucuc

SEQ ID NO: 1676772 - RNA, 14 nt, Human
gacaggaccaggga

SEQ ID NO: 1676773 - RNA, 15 nt, Human
gacaggaccagggau

SEQ ID NO: 1676774 - RNA, 23 nt, Human
gacaggaccagggauuuccauga

SEQ ID NO: 1676775 - RNA, 17 nt, Human
gacagggaggacgcucu

SEQ ID NO: 1676776 - RNA, 20 nt, Human
gaauuugugaagguggaaau

SEQ ID NO: 1676777 - RNA, 20 nt, Human
gaauuugauaugugaacagu

SEQ ID NO: 1676778 - RNA, 21 nt, Human
gaauuucuucaacucccugcc

SEQ ID NO: 1676779 - RNA, 22 nt, Human
gaauuucuuuugccguuauuaa

SEQ ID NO: 1676780 - RNA, 19 nt, Human
gaauuucuaggacugaauu

SEQ ID NO: 1676781 - RNA, 20 nt, Human
gaauuucuaggacugaauua

SEQ ID NO: 1676782 - RNA, 15 nt, Human
gaauuguaaggaaug

SEQ ID NO: 1676783 - RNA, 16 nt, Human
gacaacagacuucuga

SEQ ID NO: 1676784 - RNA, 22 nt, Human
gacaacacucauugaccugagg

SEQ ID NO: 1676785 - RNA, 23 nt, Human
gacaacacucauugaccugaggc

SEQ ID NO: 1676786 - RNA, 19 nt, Human
gacaaugugaaaagaaaaa

SEQ ID NO: 1676787 - RNA, 20 nt, Human
gacaaugugaaaagaaaaau

SEQ ID NO: 1676788 - RNA, 22 nt, Human
gacaaugcaaaccaucauugaa

SEQ ID NO: 1676789 - RNA, 12 nt, Human
gacaaugugaaa

SEQ ID NO: 1676790 - RNA, 18 nt, Human
gacaaugugaaaagaaaa

SEQ ID NO: 1676791 - RNA, 21 nt, Human
gacaaggaugaucuaggaaga

SEQ ID NO: 1676792 - RNA, 18 nt, Human
gacaaggauugcuacugu

SEQ ID NO: 1676793 - RNA, 19 nt, Human
gacaaggauugcuacuguc

SEQ ID NO: 1676794 - RNA, 21 nt, Human
gacaaggauugcuacuguccu

SEQ ID NO: 1676795 - RNA, 16 nt, Human
gacaaggaaaaaauaa

SEQ ID NO: 1676796 - RNA, 19 nt, Human
gacacaugcaaggucauuu

SEQ ID NO: 1676797 - RNA, 15 nt, Human
gacacauguccaaga

SEQ ID NO: 1676798 - RNA, 20 nt, Human
gacacauguccaagaagccc

SEQ ID NO: 1676799 - RNA, 23 nt, Human
gacacauguccaagaagcccagg

SEQ ID NO: 1676800 - RNA, 14 nt, Human
gacacaugcaaggu

SEQ ID NO: 1676801 - RNA, 20 nt, Human
gacacaggcccggcuccagg

SEQ ID NO: 1676802 - RNA, 21 nt, Human
gacacaggcccggcuccaggc

SEQ ID NO: 1676803 - RNA, 16 nt, Human
gacacaagccuucggc

SEQ ID NO: 1676804 - RNA, 19 nt, Human
gacacaggcccggcuccag

SEQ ID NO: 1676805 - RNA, 22 nt, Human
gacacaagccuucggcgccuua

SEQ ID NO: 1676806 - RNA, 12 nt, Human
gaaaggcuccag

SEQ ID NO: 1676807 - RNA, 20 nt, Human
gaauccagacccggcugcgu

SEQ ID NO: 1676808 - RNA, 11 nt, Human
gaaugcagugg

SEQ ID NO: 1676809 - RNA, 18 nt, Human
gaaugaaccacaucuugc

SEQ ID NO: 1676810 - RNA, 21 nt, Human
gaaugcacaaacagaggccgc

SEQ ID NO: 1676811 - RNA, 15 nt, Human
gaaugcuguauaugu

SEQ ID NO: 1676812 - RNA, 20 nt, Human
gaaugcacaaacagaggccg

SEQ ID NO: 1676813 - RNA, 19 nt, Human
gaaugaaauacuguuugag

SEQ ID NO: 1676814 - RNA, 15 nt, Human
gaaugaaauacuguu

SEQ ID NO: 1676815 - RNA, 18 nt, Human
gaaugaaauacuguuuga

SEQ ID NO: 1676816 - RNA, 17 nt, Human
gaauggcuuuguauaga

SEQ ID NO: 1676817 - RNA, 21 nt, Human
gaauggcuuuguauagaaccu

SEQ ID NO: 1676818 - RNA, 14 nt, Human
gaauggcuuuguau

SEQ ID NO: 1676819 - RNA, 16 nt, Human
gaauggcuuuguauag

SEQ ID NO: 1676820 - RNA, 13 nt, Human
gaaugucagugug

SEQ ID NO: 1676821 - RNA, 14 nt, Human
gaauucuguauaga

SEQ ID NO: 1676822 - RNA, 21 nt, Human
gaauucuguauagauuagaau

SEQ ID NO: 1676823 - RNA, 22 nt, Human
gaauucuguauagauuagaauu

SEQ ID NO: 1676824 - RNA, 13 nt, Human
gaauucuguauag

SEQ ID NO: 1676825 - RNA, 15 nt, Human
gaauguuugccucug

SEQ ID NO: 1676826 - RNA, 16 nt, Human
gaauuggagcucgugg

SEQ ID NO: 1676827 - RNA, 16 nt, Human
gaauugacccacaaga

SEQ ID NO: 1676828 - RNA, 21 nt, Human
gaauugacccacaagaaauga

SEQ ID NO: 1676829 - RNA, 17 nt, Human
gagaaugagagacacac

SEQ ID NO: 1676830 - RNA, 16 nt, Human
gagaagagaaugcaca

SEQ ID NO: 1676831 - RNA, 16 nt, Human
gagaagcagaggaagg

SEQ ID NO: 1676832 - RNA, 13 nt, Human
gagaagagcuguu

SEQ ID NO: 1676833 - RNA, 14 nt, Human
gagaagagaaugca

SEQ ID NO: 1676834 - RNA, 22 nt, Human
gagaacuuccagauccuggaaa

SEQ ID NO: 1676835 - RNA, 23 nt, Human
gagaacuuccagauccuggaaau

SEQ ID NO: 1676836 - RNA, 22 nt, Human
gagaaaguacuucuccacccug

SEQ ID NO: 1676837 - RNA, 16 nt, Human
gagaaagguugaagca

SEQ ID NO: 1676838 - RNA, 21 nt, Human
gagaaaugaaaaaauauauau

SEQ ID NO: 1676839 - RNA, 14 nt, Human
gagaaaugagcuug

SEQ ID NO: 1676840 - RNA, 21 nt, Human
gagaaccuagggugauauuaa

SEQ ID NO: 1676841 - RNA, 22 nt, Human
gagaaccuagggugauauuaac

SEQ ID NO: 1676842 - RNA, 13 nt, Human
gacuuggaagcuc

SEQ ID NO: 1676843 - RNA, 16 nt, Human
gacuucuuuaauuuug

SEQ ID NO: 1676844 - RNA, 17 nt, Human
gacuucuuuaauuuugg

SEQ ID NO: 1676845 - RNA, 18 nt, Human
gacuucuuuaauuuugga

SEQ ID NO: 1676846 - RNA, 19 nt, Human
gacuucuuuaauuuuggaa

SEQ ID NO: 1676847 - RNA, 20 nt, Human
gacuucuuuaauuuuggaau

SEQ ID NO: 1676848 - RNA, 21 nt, Human
gacuucuuuaauuuuggaauu

SEQ ID NO: 1676849 - RNA, 19 nt, Human
gacuuaaaauauuccugca

SEQ ID NO: 1676850 - RNA, 19 nt, Human
gacuuaagcacacuugaca

SEQ ID NO: 1676851 - RNA, 16 nt, Human
gacuucuaaguaaaac

SEQ ID NO: 1676852 - RNA, 17 nt, Human
gacuucuaaguaaaacc

SEQ ID NO: 1676853 - RNA, 18 nt, Human
gacuucuaaguaaaacca

SEQ ID NO: 1676854 - RNA, 24 nt, Human
gacuucuaaguaaaaccacagcag

SEQ ID NO: 1676855 - RNA, 19 nt, Human
gacuucuaaguaaaaccac

SEQ ID NO: 1676856 - RNA, 23 nt, Human
gacuucuaaguaaaaccacagca

SEQ ID NO: 1676857 - RNA, 20 nt, Human
gacuucugucuucacaacag

SEQ ID NO: 1676858 - RNA, 23 nt, Human
gacuucugucuucacaacagauu

SEQ ID NO: 1676859 - RNA, 14 nt, Human
gacuggaagcacag

SEQ ID NO: 1676860 - RNA, 15 nt, Human
gacuggaagcacagc

SEQ ID NO: 1676861 - RNA, 16 nt, Human
gacuggaagcacagcu

SEQ ID NO: 1676862 - RNA, 18 nt, Human
gacuggaagcacagcuuc

SEQ ID NO: 1676863 - RNA, 17 nt, Human
gacucgcgacaaugcaa

SEQ ID NO: 1676864 - RNA, 22 nt, Human
gacugaguacguugugcauuug

SEQ ID NO: 1676865 - RNA, 21 nt, Human
gacugaguacguugugcauuu

SEQ ID NO: 1676866 - RNA, 15 nt, Human
gacugcccggcaggg

SEQ ID NO: 1676867 - RNA, 13 nt, Human
gacugcccggcag

SEQ ID NO: 1676868 - RNA, 23 nt, Human
gacugaguacguugugcauuugg

SEQ ID NO: 1676869 - RNA, 14 nt, Human
gacugcauuauauu

SEQ ID NO: 1676870 - RNA, 16 nt, Human
gacugcauuauauuua

SEQ ID NO: 1676871 - RNA, 14 nt, Human
gacucauucuucug

SEQ ID NO: 1676872 - RNA, 15 nt, Human
gacucauucuucugu

SEQ ID NO: 1676873 - RNA, 18 nt, Human
gacuacaggugugaguca

SEQ ID NO: 1676874 - RNA, 21 nt, Human
gacuacaggugugagucacca

SEQ ID NO: 1676875 - RNA, 13 nt, Human
gacuacaggugug

SEQ ID NO: 1676876 - RNA, 11 nt, Human
gacuccucugu

SEQ ID NO: 1676877 - RNA, 14 nt, Human
gacuccucugucca

SEQ ID NO: 1676878 - RNA, 12 nt, Human
gacuccugcagg

SEQ ID NO: 1676879 - RNA, 23 nt, Human
gacuccugcacacgcuccuuccu

SEQ ID NO: 1676880 - RNA, 13 nt, Human
gacuccugcaggc

SEQ ID NO: 1676881 - RNA, 13 nt, Human
gacucgcgacaau

SEQ ID NO: 1676882 - RNA, 16 nt, Human
gacuccaaagaaaugu

SEQ ID NO: 1676883 - RNA, 18 nt, Human
gacuccaaagaaauguaa

SEQ ID NO: 1676884 - RNA, 21 nt, Human
gacucauuuuaaaaaauggaa

SEQ ID NO: 1676885 - RNA, 11 nt, Human
gacuccaaaga

SEQ ID NO: 1676886 - RNA, 12 nt, Human
gacuccaaagaa

SEQ ID NO: 1676887 - RNA, 15 nt, Human
gacuccaaagaaaug

SEQ ID NO: 1676888 - RNA, 17 nt, Human
gagaugaggccgccaug

SEQ ID NO: 1676889 - RNA, 19 nt, Human
gagauagccaaggccaaag

SEQ ID NO: 1676890 - RNA, 18 nt, Human
gagaucacgccacugcac

SEQ ID NO: 1676891 - RNA, 19 nt, Human
gagaucacgccacugcacu

SEQ ID NO: 1676892 - RNA, 14 nt, Human
gagauagccaaggc

SEQ ID NO: 1676893 - RNA, 16 nt, Human
gagauagccaaggcca

SEQ ID NO: 1676894 - RNA, 23 nt, Human
gagaucaaccccuucgcuccugu

SEQ ID NO: 1676895 - RNA, 20 nt, Human
gagcaccuuagacagucccu

SEQ ID NO: 1676896 - RNA, 21 nt, Human
gagcacuaaggugugcucuga

SEQ ID NO: 1676897 - RNA, 15 nt, Human
gagcacuaaggugug

SEQ ID NO: 1676898 - RNA, 21 nt, Human
gagcaccuuagacagucccug

SEQ ID NO: 1676899 - RNA, 22 nt, Human
gagcaccuuagacagucccugc

SEQ ID NO: 1676900 - RNA, 15 nt, Human
gagcauuagauuucu

SEQ ID NO: 1676901 - RNA, 21 nt, Human
gagcauuagauuucucauuug

SEQ ID NO: 1676902 - RNA, 19 nt, Human
gagccaauuuaaagaaaac

SEQ ID NO: 1676903 - RNA, 12 nt, Human
gagcagagacca

SEQ ID NO: 1676904 - RNA, 16 nt, Human
gagcagagaauucucu

SEQ ID NO: 1676905 - RNA, 14 nt, Human
gagccagggucuca

SEQ ID NO: 1676906 - RNA, 23 nt, Human
gagccagauuucacucuccuugg

SEQ ID NO: 1676907 - RNA, 23 nt, Human
gagcccacuguacuugcucuuga

SEQ ID NO: 1676908 - RNA, 19 nt, Human
gagccagggucucacuaug

SEQ ID NO: 1676909 - RNA, 19 nt, Human
gagacuccugcaggcagcc

SEQ ID NO: 1676910 - RNA, 20 nt, Human
gagacuccugcaggcagcca

SEQ ID NO: 1676911 - RNA, 21 nt, Human
gagacuccugcaggcagccag

SEQ ID NO: 1676912 - RNA, 20 nt, Human
gagacucgcgacaaugcaaa

SEQ ID NO: 1676913 - RNA, 21 nt, Human
gagacucgcgacaaugcaaac

SEQ ID NO: 1676914 - RNA, 22 nt, Human
gagacuccugcaggcagccagg

SEQ ID NO: 1676915 - RNA, 13 nt, Human
gagacucugucuc

SEQ ID NO: 1676916 - RNA, 14 nt, Human
gagaccaucccuga

SEQ ID NO: 1676917 - RNA, 18 nt, Human
gagaccaucccugaaggc

SEQ ID NO: 1676918 - RNA, 21 nt, Human
gagaccaucccugaaggcccc

SEQ ID NO: 1676919 - RNA, 22 nt, Human
gagacaggguuuugccauguug

SEQ ID NO: 1676920 - RNA, 23 nt, Human
gagaaugcacaaacagaggccgc

SEQ ID NO: 1676921 - RNA, 20 nt, Human
gagaaugagagacacacuga

SEQ ID NO: 1676922 - RNA, 21 nt, Human
gagaaugagagacacacugaa

SEQ ID NO: 1676923 - RNA, 20 nt, Human
gagacagcucugcauacuca

SEQ ID NO: 1676924 - RNA, 19 nt, Human
gagagagcuucuguugcug

SEQ ID NO: 1676925 - RNA, 22 nt, Human
gagagagcuucuguugcugccu

SEQ ID NO: 1676926 - RNA, 16 nt, Human
gagagcccuucauuug

SEQ ID NO: 1676927 - RNA, 13 nt, Human
gagaggggcacag

SEQ ID NO: 1676928 - RNA, 19 nt, Human
gagaggggaacagacugga

SEQ ID NO: 1676929 - RNA, 14 nt, Human
gagagggugggagu

SEQ ID NO: 1676930 - RNA, 20 nt, Human
gagagggugggagugggccc

SEQ ID NO: 1676931 - RNA, 16 nt, Human
gagagggugggagugg

SEQ ID NO: 1676932 - RNA, 13 nt, Human
gagaguguugaaa

SEQ ID NO: 1676933 - RNA, 16 nt, Human
gagaguggcuccuccc

SEQ ID NO: 1676934 - RNA, 21 nt, Human
gagaguggcuccucccggugc

SEQ ID NO: 1676935 - RNA, 13 nt, Human
gagaguggcuccu

SEQ ID NO: 1676936 - RNA, 14 nt, Human
cuggccagaugcac

SEQ ID NO: 1676937 - RNA, 15 nt, Human
cuggcauagagcagc

SEQ ID NO: 1676938 - RNA, 15 nt, Human
cuggcccacugcauc

SEQ ID NO: 1676939 - RNA, 14 nt, Human
cuggcacuuggaga

SEQ ID NO: 1676940 - RNA, 21 nt, Human
cuggcacuuggagacuuguau

SEQ ID NO: 1676941 - RNA, 22 nt, Human
cuggcacccggccccugcuggu

SEQ ID NO: 1676942 - RNA, 19 nt, Human
cuggcacugcuuccaguga

SEQ ID NO: 1676943 - RNA, 20 nt, Human
cuggcacugcuuccagugag

SEQ ID NO: 1676944 - RNA, 23 nt, Human
cuggcacugcuuccagugaggcu

SEQ ID NO: 1676945 - RNA, 20 nt, Human
cuggcacccggccccugcug

SEQ ID NO: 1676946 - RNA, 21 nt, Human
cuggcacccggccccugcugg

SEQ ID NO: 1676947 - RNA, 20 nt, Human
cuggagugcagugagccgag

SEQ ID NO: 1676948 - RNA, 20 nt, Human
cuggcacaguuuucugagaa

SEQ ID NO: 1676949 - RNA, 21 nt, Human
cuggcacaguuuucugagaaa

SEQ ID NO: 1676950 - RNA, 22 nt, Human
cuggcacaguuuucugagaaag

SEQ ID NO: 1676951 - RNA, 21 nt, Human
cuggccucugcacuccccugc

SEQ ID NO: 1676952 - RNA, 18 nt, Human
cuggccucugcacucccc

SEQ ID NO: 1676953 - RNA, 20 nt, Human
cuggccucugcacuccccug

SEQ ID NO: 1676954 - RNA, 13 nt, Human
cuggccuggcccc

SEQ ID NO: 1676955 - RNA, 24 nt, Human
cuggccuggccccucagggucccu

SEQ ID NO: 1676956 - RNA, 22 nt, Human
cuggccuucggccuccauccug

SEQ ID NO: 1676957 - RNA, 21 nt, Human
cuggcucuuccaggcugggag

SEQ ID NO: 1676958 - RNA, 22 nt, Human
cuggcucuuccaggcugggaga

SEQ ID NO: 1676959 - RNA, 24 nt, Human
cuggcucuuccaggcugggagagc

SEQ ID NO: 1676960 - RNA, 14 nt, Human
cuggcgugcagugg

SEQ ID NO: 1676961 - RNA, 15 nt, Human
cuggcgugcaguggu

SEQ ID NO: 1676962 - RNA, 14 nt, Human
cuggccugugucua

SEQ ID NO: 1676963 - RNA, 23 nt, Human
cuggccuucggccuccauccuga

SEQ ID NO: 1676964 - RNA, 13 nt, Human
cuggaauuugaaa

SEQ ID NO: 1676965 - RNA, 23 nt, Human
cuggacaggcauguucucugagg

SEQ ID NO: 1676966 - RNA, 14 nt, Human
cuggacaggcaugu

SEQ ID NO: 1676967 - RNA, 17 nt, Human
cuggacaggcauguucu

SEQ ID NO: 1676968 - RNA, 16 nt, Human
cuggaccuugaacugg

SEQ ID NO: 1676969 - RNA, 15 nt, Human
cuggacccuguggau

SEQ ID NO: 1676970 - RNA, 14 nt, Human
cuggacuccucugu

SEQ ID NO: 1676971 - RNA, 17 nt, Human
cuggacuccucugucca

SEQ ID NO: 1676972 - RNA, 18 nt, Human
cuggacuccucuguccag

SEQ ID NO: 1676973 - RNA, 19 nt, Human
cuggacuccucuguccagg

SEQ ID NO: 1676974 - RNA, 20 nt, Human
cuggacuccucuguccaggc

SEQ ID NO: 1676975 - RNA, 17 nt, Human
cuggaccuugaacuggg

SEQ ID NO: 1676976 - RNA, 20 nt, Human
cuggaccuugaacuggguac

SEQ ID NO: 1676977 - RNA, 21 nt, Human
cuggaccuugaacuggguacu

SEQ ID NO: 1676978 - RNA, 17 nt, Human
cuggagguacgaaaaga

SEQ ID NO: 1676979 - RNA, 22 nt, Human
cuggagguacgaaaagagggga

SEQ ID NO: 1676980 - RNA, 14 nt, Human
cuggagugcaguga

SEQ ID NO: 1676981 - RNA, 15 nt, Human
cuggagugcagugag

SEQ ID NO: 1676982 - RNA, 16 nt, Human
cuggagugcagugagc

SEQ ID NO: 1676983 - RNA, 17 nt, Human
cuggagugcagugagcc

SEQ ID NO: 1676984 - RNA, 16 nt, Human
cuggagcucugcccau

SEQ ID NO: 1676985 - RNA, 12 nt, Human
cuggagcucugc

SEQ ID NO: 1676986 - RNA, 13 nt, Human
cuggagcucugcc

SEQ ID NO: 1676987 - RNA, 15 nt, Human
cugcugcuggcuggu

SEQ ID NO: 1676988 - RNA, 12 nt, Human
cugcuggcugcc

SEQ ID NO: 1676989 - RNA, 13 nt, Human
cugcugguucagg

SEQ ID NO: 1676990 - RNA, 15 nt, Human
cugcugguucagggu

SEQ ID NO: 1676991 - RNA, 23 nt, Human
cugcugguucaggguuggccccu

SEQ ID NO: 1676992 - RNA, 15 nt, Human
cugcuuccagugagg

SEQ ID NO: 1676993 - RNA, 16 nt, Human
cugcuuccagugaggc

SEQ ID NO: 1676994 - RNA, 18 nt, Human
cugcuuccagugaggcuc

SEQ ID NO: 1676995 - RNA, 19 nt, Human
cugcuuccagugaggcucu

SEQ ID NO: 1676996 - RNA, 20 nt, Human
cugcuuccagugaggcucug

SEQ ID NO: 1676997 - RNA, 21 nt, Human
cugcuuccagugaggcucugc

SEQ ID NO: 1676998 - RNA, 23 nt, Human
cugcuuccagugaggcucugccc

SEQ ID NO: 1676999 - RNA, 12 nt, Human
cugcugcccagc

SEQ ID NO: 1677000 - RNA, 15 nt, Human
cugcugcccagccuc

SEQ ID NO: 1677001 - RNA, 22 nt, Human
cugcugcccagccuccaagcuc

SEQ ID NO: 1677002 - RNA, 17 nt, Human
cugcugaaggaauaaau

SEQ ID NO: 1677003 - RNA, 18 nt, Human
cugcugaaggaauaaauu

SEQ ID NO: 1677004 - RNA, 21 nt, Human
cugcucuccucuugccacugc

SEQ ID NO: 1677005 - RNA, 11 nt, Human
cugcugaaggc

SEQ ID NO: 1677006 - RNA, 12 nt, Human
cugcugaaggcu

SEQ ID NO: 1677007 - RNA, 14 nt, Human
cugcucuccucuug

SEQ ID NO: 1677008 - RNA, 20 nt, Human
cugcucuccucuugccacug

SEQ ID NO: 1677009 - RNA, 19 nt, Human
cugcgaccacaagaaggau

SEQ ID NO: 1677010 - RNA, 19 nt, Human
cugcuccagcuguucagcu

SEQ ID NO: 1677011 - RNA, 20 nt, Human
cugcuccagcuguucagcug

SEQ ID NO: 1677012 - RNA, 21 nt, Human
cugcccuuucugggcaccggg

SEQ ID NO: 1677013 - RNA, 15 nt, Human
cugccgcagcccugc

SEQ ID NO: 1677014 - RNA, 17 nt, Human
cugccgcagcccugcag

SEQ ID NO: 1677015 - RNA, 18 nt, Human
cugccgcagcccugcaga

SEQ ID NO: 1677016 - RNA, 12 nt, Human
cugcccuccaag

SEQ ID NO: 1677017 - RNA, 14 nt, Human
cucccuucccaccu

SEQ ID NO: 1677018 - RNA, 15 nt, Human
cucccuucccaccuc

SEQ ID NO: 1677019 - RNA, 16 nt, Human
cucccuucccaccucu

SEQ ID NO: 1677020 - RNA, 17 nt, Human
cucccuucccaccucuc

SEQ ID NO: 1677021 - RNA, 22 nt, Human
cugcccugcugagucccaggcu

SEQ ID NO: 1677022 - RNA, 20 nt, Human
cugcccugcgggucacagga

SEQ ID NO: 1677023 - RNA, 21 nt, Human
cugcccucuccugggcagcug

SEQ ID NO: 1677024 - RNA, 20 nt, Human
cugcccucuccugggcagcu

SEQ ID NO: 1677025 - RNA, 19 nt, Human
cugcccucuccugggcagc

SEQ ID NO: 1677026 - RNA, 18 nt, Human
cugcccucuccugggcag

SEQ ID NO: 1677027 - RNA, 19 nt, Human
cugcccuccaagaccuucu

SEQ ID NO: 1677028 - RNA, 16 nt, Human
cugcccucuccugggc

SEQ ID NO: 1677029 - RNA, 12 nt, Human
cugccuaaggac

SEQ ID NO: 1677030 - RNA, 13 nt, Human
cugccuaaggacu

SEQ ID NO: 1677031 - RNA, 14 nt, Human
cugccuaaggacuu

SEQ ID NO: 1677032 - RNA, 15 nt, Human
cugccuaaggacuuc

SEQ ID NO: 1677033 - RNA, 19 nt, Human
cugccuaaggacuucuuua

SEQ ID NO: 1677034 - RNA, 11 nt, Human
cugccucccau

SEQ ID NO: 1677035 - RNA, 12 nt, Human
cugccucccauc

SEQ ID NO: 1677036 - RNA, 14 nt, Human
cugccucccaucac

SEQ ID NO: 1677037 - RNA, 16 nt, Human
cugccucccaucaccc

SEQ ID NO: 1677038 - RNA, 19 nt, Human
cugccucccaucacccgcu

SEQ ID NO: 1677039 - RNA, 22 nt, Human
cugccucucugcaggucccuaa

SEQ ID NO: 1677040 - RNA, 15 nt, Human
cugccucugacacac

SEQ ID NO: 1677041 - RNA, 22 nt, Human
cugccucugacacacagcucug

SEQ ID NO: 1677042 - RNA, 23 nt, Human
cugccucugacacacagcucugu

SEQ ID NO: 1677043 - RNA, 20 nt, Human
cugccucucugcaggucccu

SEQ ID NO: 1677044 - RNA, 21 nt, Human
cugccucucugcaggucccua

SEQ ID NO: 1677045 - RNA, 13 nt, Human
cugccuccccucc

SEQ ID NO: 1677046 - RNA, 21 nt, Human
cugccugggaucccucauccu

SEQ ID NO: 1677047 - RNA, 22 nt, Human
cugccugggaucccucauccuc

SEQ ID NO: 1677048 - RNA, 20 nt, Human
cugccugcccaggccccugc

SEQ ID NO: 1677049 - RNA, 15 nt, Human
cugccugaagucaca

SEQ ID NO: 1677050 - RNA, 16 nt, Human
cugccugcccaggccc

SEQ ID NO: 1677051 - RNA, 17 nt, Human
cugccugcccaggcccc

SEQ ID NO: 1677052 - RNA, 15 nt, Human
cugccucuucucuac

SEQ ID NO: 1677053 - RNA, 14 nt, Human
cugccuccccuccu

SEQ ID NO: 1677054 - RNA, 22 nt, Human
cuggguaacuagggaagauaau

SEQ ID NO: 1677055 - RNA, 20 nt, Human
cuggguaacuagggaagaua

SEQ ID NO: 1677056 - RNA, 14 nt, Human
cuggguacuugugg

SEQ ID NO: 1677057 - RNA, 15 nt, Human
cuggguucuacccag

SEQ ID NO: 1677058 - RNA, 16 nt, Human
cuggguucuacccagg

SEQ ID NO: 1677059 - RNA, 17 nt, Human
cuggguucuacccaggu

SEQ ID NO: 1677060 - RNA, 24 nt, Human
cugggcuucaguggcagcugcuuu

SEQ ID NO: 1677061 - RNA, 13 nt, Human
cugggggaagaag

SEQ ID NO: 1677062 - RNA, 15 nt, Human
cugggggaagaagcu

SEQ ID NO: 1677063 - RNA, 19 nt, Human
cugggggcugggcagagga

SEQ ID NO: 1677064 - RNA, 22 nt, Human
cugggggggauuguaaaauggu

SEQ ID NO: 1677065 - RNA, 12 nt, Human
cuggugcugcca

SEQ ID NO: 1677066 - RNA, 13 nt, Human
cuggugcugccac

SEQ ID NO: 1677067 - RNA, 20 nt, Human
cuggugcugccacacuucag

SEQ ID NO: 1677068 - RNA, 22 nt, Human
cuggugcugccacacuucaggc

SEQ ID NO: 1677069 - RNA, 23 nt, Human
cugguggcagcucaccucucccu

SEQ ID NO: 1677070 - RNA, 21 nt, Human
cugguggcccgacagccuggc

SEQ ID NO: 1677071 - RNA, 22 nt, Human
cugguggcccgacagccuggca

SEQ ID NO: 1677072 - RNA, 23 nt, Human
cugguggcccgacagccuggcac

SEQ ID NO: 1677073 - RNA, 13 nt, Human
cugguggcagcug

SEQ ID NO: 1677074 - RNA, 14 nt, Human
cugguggcagcugc

SEQ ID NO: 1677075 - RNA, 18 nt, Human
cuggucacaggacucugc

SEQ ID NO: 1677076 - RNA, 19 nt, Human
cuggucacaggacucugcc

SEQ ID NO: 1677077 - RNA, 20 nt, Human
cuguaauccuagcacuuugg

SEQ ID NO: 1677078 - RNA, 13 nt, Human
cuguacaaaguag

SEQ ID NO: 1677079 - RNA, 15 nt, Human
cuguacaaaguagaa

SEQ ID NO: 1677080 - RNA, 12 nt, Human
cugguuccuccc

SEQ ID NO: 1677081 - RNA, 13 nt, Human
cugguuccucccc

SEQ ID NO: 1677082 - RNA, 23 nt, Human
cuguaaucacagcuacuugggag

SEQ ID NO: 1677083 - RNA, 20 nt, Human
cugucuacacuaagagagaa

SEQ ID NO: 1677084 - RNA, 14 nt, Human
cuguccuacccacc

SEQ ID NO: 1677085 - RNA, 22 nt, Human
cugucccuuacgugaguccugg

SEQ ID NO: 1677086 - RNA, 15 nt, Human
cuguccgagcuuuga

SEQ ID NO: 1677087 - RNA, 22 nt, Human
cugucucaagagggcacuggug

SEQ ID NO: 1677088 - RNA, 18 nt, Human
cugucucaaaaaaagaaa

SEQ ID NO: 1677089 - RNA, 23 nt, Human
cugucucaaaaaaacacaaaagu

SEQ ID NO: 1677090 - RNA, 16 nt, Human
cugucucaaaaaaaga

SEQ ID NO: 1677091 - RNA, 18 nt, Human
cuguccccgcacugggcu

SEQ ID NO: 1677092 - RNA, 19 nt, Human
cuguccccgcacugggcuu

SEQ ID NO: 1677093 - RNA, 22 nt, Human
cuguccccgcacugggcuuggg

SEQ ID NO: 1677094 - RNA, 17 nt, Human
cuguccccgcacugggc

SEQ ID NO: 1677095 - RNA, 20 nt, Human
cugucccuuacgugaguccu

SEQ ID NO: 1677096 - RNA, 13 nt, Human
cuguacagagccc

SEQ ID NO: 1677097 - RNA, 16 nt, Human
cuguauagauuagaau

SEQ ID NO: 1677098 - RNA, 17 nt, Human
cuguccaggcacugcug

SEQ ID NO: 1677099 - RNA, 13 nt, Human
cugucaauuacag

SEQ ID NO: 1677100 - RNA, 14 nt, Human
cuguaucccaugag

SEQ ID NO: 1677101 - RNA, 23 nt, Human
cuguaucccaugagccucagcau

SEQ ID NO: 1677102 - RNA, 22 nt, Human
cuguauuuuaaaagaaugauua

SEQ ID NO: 1677103 - RNA, 20 nt, Human
cuguauuuuaaaagaaugau

SEQ ID NO: 1677104 - RNA, 19 nt, Human
cuguauuuuaaaagaauga

SEQ ID NO: 1677105 - RNA, 17 nt, Human
cuguggaugauaaaaca

SEQ ID NO: 1677106 - RNA, 21 nt, Human
cugugggcgugagaccugccc

SEQ ID NO: 1677107 - RNA, 22 nt, Human
cugugggcgugagaccugcccc

SEQ ID NO: 1677108 - RNA, 14 nt, Human
cugugggcccccaa

SEQ ID NO: 1677109 - RNA, 11 nt, Human
cugugccucug

SEQ ID NO: 1677110 - RNA, 14 nt, Human
cugugccucuggga

SEQ ID NO: 1677111 - RNA, 16 nt, Human
cugugccucugggacu

SEQ ID NO: 1677112 - RNA, 22 nt, Human
cugugcugcccugcccaccugg

SEQ ID NO: 1677113 - RNA, 17 nt, Human
cugugccucugggacug

SEQ ID NO: 1677114 - RNA, 18 nt, Human
cugugccucugggacugg

SEQ ID NO: 1677115 - RNA, 18 nt, Human
cugucuccauguuugaug

SEQ ID NO: 1677116 - RNA, 23 nt, Human
cugucucaagagggcacuggugg

SEQ ID NO: 1677117 - RNA, 23 nt, Human
cugugaguacuacaguccuccca

SEQ ID NO: 1677118 - RNA, 20 nt, Human
cugugaguacuacaguccuc

SEQ ID NO: 1677119 - RNA, 21 nt, Human
cugugaguacuacaguccucc

SEQ ID NO: 1677120 - RNA, 18 nt, Human
cugugauggggcccugcc

SEQ ID NO: 1677121 - RNA, 17 nt, Human
cugugauggggcccugc

SEQ ID NO: 1677122 - RNA, 19 nt, Human
cugugauggggcccugccu

SEQ ID NO: 1677123 - RNA, 20 nt, Human
cugugauggggcccugccuc

SEQ ID NO: 1677124 - RNA, 22 nt, Human
cugugccauuuuguauuuuacu

SEQ ID NO: 1677125 - RNA, 14 nt, Human
cugugccauuuugu

SEQ ID NO: 1677126 - RNA, 16 nt, Human
cugugccaugugccag

SEQ ID NO: 1677127 - RNA, 18 nt, Human
cugugccaugugccaggu

SEQ ID NO: 1677128 - RNA, 18 nt, Human
cuguucccauucuugcau

SEQ ID NO: 1677129 - RNA, 17 nt, Human
cuguucaugaaagauuc

SEQ ID NO: 1677130 - RNA, 18 nt, Human
cuguucaugaaagauuca

SEQ ID NO: 1677131 - RNA, 23 nt, Human
cuguucaugaaagauucaaugcc

SEQ ID NO: 1677132 - RNA, 13 nt, Human
cuguuacugucuu

SEQ ID NO: 1677133 - RNA, 19 nt, Human
cuguucagcugguugaggu

SEQ ID NO: 1677134 - RNA, 21 nt, Human
cuguucagcugguugagguuu

SEQ ID NO: 1677135 - RNA, 20 nt, Human
cuguucucugcccuccaaga

SEQ ID NO: 1677136 - RNA, 18 nt, Human
cuguucucugcccuccaa

SEQ ID NO: 1677137 - RNA, 19 nt, Human
cuguucucugcccuccaag

SEQ ID NO: 1677138 - RNA, 14 nt, Human
cuguucucugcccu

SEQ ID NO: 1677139 - RNA, 15 nt, Human
cuguucucugcccuc

SEQ ID NO: 1677140 - RNA, 16 nt, Human
cuguucucugcccucc

SEQ ID NO: 1677141 - RNA, 17 nt, Human
cuguucucugcccucca

SEQ ID NO: 1677142 - RNA, 13 nt, Human
cuguucucugccc

SEQ ID NO: 1677143 - RNA, 19 nt, Human
cugugugcucaggagcccu

SEQ ID NO: 1677144 - RNA, 16 nt, Human
cugugugcucaggagc

SEQ ID NO: 1677145 - RNA, 20 nt, Human
cugugugcucaggagcccug

SEQ ID NO: 1677146 - RNA, 21 nt, Human
cugugugcucaggagcccugg

SEQ ID NO: 1677147 - RNA, 23 nt, Human
cugugugcucaggagcccuggga

SEQ ID NO: 1677148 - RNA, 15 nt, Human
cuguguggcagucug

SEQ ID NO: 1677149 - RNA, 23 nt, Human
cugugggcgugagaccugccccu

SEQ ID NO: 1677150 - RNA, 21 nt, Human
cugugucuugcaauggcagcc

SEQ ID NO: 1677151 - RNA, 22 nt, Human
cugugucuugcaauggcagccu

SEQ ID NO: 1677152 - RNA, 23 nt, Human
cugugucuugcaauggcagccuu

SEQ ID NO: 1677153 - RNA, 20 nt, Human
cugugugugcgccuacagga

SEQ ID NO: 1677154 - RNA, 21 nt, Human
cuguuaaaagaugaaaauauu

SEQ ID NO: 1677155 - RNA, 23 nt, Human
cuguuaaaagaugaaaauauuug

SEQ ID NO: 1677156 - RNA, 20 nt, Human
cuguuaaaagaugaaaauau

SEQ ID NO: 1677157 - RNA, 13 nt, Human
cuucucugaagga

SEQ ID NO: 1677158 - RNA, 19 nt, Human
cuucuccuucaccuuuguc

SEQ ID NO: 1677159 - RNA, 12 nt, Human
cuucucuccagc

SEQ ID NO: 1677160 - RNA, 13 nt, Human
cuucucuccagcc

SEQ ID NO: 1677161 - RNA, 15 nt, Human
cuucucuccagcccc

SEQ ID NO: 1677162 - RNA, 17 nt, Human
cuucucuccagccccug

SEQ ID NO: 1677163 - RNA, 19 nt, Human
cuucucuccagccccugga

SEQ ID NO: 1677164 - RNA, 17 nt, Human
cuucuccacuggaugga

SEQ ID NO: 1677165 - RNA, 12 nt, Human
cuucuccaggcu

SEQ ID NO: 1677166 - RNA, 13 nt, Human
cuucuccaggcug

SEQ ID NO: 1677167 - RNA, 14 nt, Human
cuucuccaggcugu

SEQ ID NO: 1677168 - RNA, 15 nt, Human
cuuccucccucauuc

SEQ ID NO: 1677169 - RNA, 14 nt, Human
cuucuccacuggau

SEQ ID NO: 1677170 - RNA, 15 nt, Human
cuucuccacuggaug

SEQ ID NO: 1677171 - RNA, 13 nt, Human
cuucuccacugga

SEQ ID NO: 1677172 - RNA, 11 nt, Human
cuucuccacuu

SEQ ID NO: 1677173 - RNA, 20 nt, Human
cuucuccacuuucuagccag

SEQ ID NO: 1677174 - RNA, 14 nt, Human
cuucugguugaugc

SEQ ID NO: 1677175 - RNA, 16 nt, Human
cuucuggguuccuucc

SEQ ID NO: 1677176 - RNA, 17 nt, Human
cuucuggguuccuuccu

SEQ ID NO: 1677177 - RNA, 23 nt, Human
cuucuggguuccuuccucugagc

SEQ ID NO: 1677178 - RNA, 13 nt, Human
cuucugcuucagc

SEQ ID NO: 1677179 - RNA, 21 nt, Human
cuucuguacgucugacaggca

SEQ ID NO: 1677180 - RNA, 14 nt, Human
cuucuguacgucug

SEQ ID NO: 1677181 - RNA, 15 nt, Human
cuucuguacgucuga

SEQ ID NO: 1677182 - RNA, 18 nt, Human
cuucuguacgucugacag

SEQ ID NO: 1677183 - RNA, 20 nt, Human
cuucuguacgucugacaggc

SEQ ID NO: 1677184 - RNA, 16 nt, Human
cuucuguccuacucug

SEQ ID NO: 1677185 - RNA, 17 nt, Human
cuucuguccuacucugu

SEQ ID NO: 1677186 - RNA, 18 nt, Human
cuucuguccuacucugug

SEQ ID NO: 1677187 - RNA, 19 nt, Human
cuucuguccuacucugugu

SEQ ID NO: 1677188 - RNA, 21 nt, Human
cuucuguccuacucuguguca

SEQ ID NO: 1677189 - RNA, 18 nt, Human
cuucugucuucacaacag

SEQ ID NO: 1677190 - RNA, 21 nt, Human
cuucugucuucacaacagauu

SEQ ID NO: 1677191 - RNA, 22 nt, Human
cuucugucuucacaacagauua

SEQ ID NO: 1677192 - RNA, 18 nt, Human
cuugagccuugaacuuug

SEQ ID NO: 1677193 - RNA, 17 nt, Human
cuugagccuugaacuuu

SEQ ID NO: 1677194 - RNA, 15 nt, Human
cuugagccuugaacu

SEQ ID NO: 1677195 - RNA, 21 nt, Human
cuugaggguugggcugguguc

SEQ ID NO: 1677196 - RNA, 19 nt, Human
cuugaggguugggcuggug

SEQ ID NO: 1677197 - RNA, 20 nt, Human
cuugaggguugggcuggugu

SEQ ID NO: 1677198 - RNA, 16 nt, Human
cuugaagacuuuucuu

SEQ ID NO: 1677199 - RNA, 17 nt, Human
cuugaccgugaggccag

SEQ ID NO: 1677200 - RNA, 22 nt, Human
cuugaccauucuccaccugcca

SEQ ID NO: 1677201 - RNA, 23 nt, Human
cuugaccauucuccaccugccag

SEQ ID NO: 1677202 - RNA, 18 nt, Human
cuugaccgugaggccaga

SEQ ID NO: 1677203 - RNA, 20 nt, Human
cuugaccgugaggccagaga

SEQ ID NO: 1677204 - RNA, 21 nt, Human
cuugaccgugaggccagagac

SEQ ID NO: 1677205 - RNA, 13 nt, Human
cuugaccucaggu

SEQ ID NO: 1677206 - RNA, 18 nt, Human
cuugaacuccugaccuca

SEQ ID NO: 1677207 - RNA, 21 nt, Human
cuugaacuuugaccucugcag

SEQ ID NO: 1677208 - RNA, 17 nt, Human
cuugaacuuugaccucu

SEQ ID NO: 1677209 - RNA, 13 nt, Human
cuugaacuccuga

SEQ ID NO: 1677210 - RNA, 16 nt, Human
cuugaacuccugaccu

SEQ ID NO: 1677211 - RNA, 13 nt, Human
cuugaacuccugg

SEQ ID NO: 1677212 - RNA, 12 nt, Human
cuugaaaauuaa

SEQ ID NO: 1677213 - RNA, 13 nt, Human
cuugaaaauuaac

SEQ ID NO: 1677214 - RNA, 18 nt, Human
cuugaaaauuaacaugaa

SEQ ID NO: 1677215 - RNA, 12 nt, Human
cuugaaaaaugc

SEQ ID NO: 1677216 - RNA, 18 nt, Human
cuugaaaaaugcauguug

SEQ ID NO: 1677217 - RNA, 19 nt, Human
cuucuuuaauuuuggaauu

SEQ ID NO: 1677218 - RNA, 22 nt, Human
cuucuuuauaauucuacuuuga

SEQ ID NO: 1677219 - RNA, 14 nt, Human
cuugaaaacacugu

SEQ ID NO: 1677220 - RNA, 23 nt, Human
cuugaaaacacuguucucugccc

SEQ ID NO: 1677221 - RNA, 15 nt, Human
cuucuuuaauuuugg

SEQ ID NO: 1677222 - RNA, 16 nt, Human
cuucuuuaauuuugga

SEQ ID NO: 1677223 - RNA, 17 nt, Human
cuucuuuaauuuuggaa

SEQ ID NO: 1677224 - RNA, 18 nt, Human
cuucuuuaauuuuggaau

SEQ ID NO: 1677225 - RNA, 15 nt, Human
cuucuguugcugccu

SEQ ID NO: 1677226 - RNA, 15 nt, Human
cuucuguggcucaca

SEQ ID NO: 1677227 - RNA, 22 nt, Human
cuucuguggcucacagaacccu

SEQ ID NO: 1677228 - RNA, 13 nt, Human
cuucuguggguuu

SEQ ID NO: 1677229 - RNA, 14 nt, Human
cuucuguggguuuc

SEQ ID NO: 1677230 - RNA, 21 nt, Human
cuucuguggguuucuaaagcu

SEQ ID NO: 1677231 - RNA, 13 nt, Human
cuucuguggcuca

SEQ ID NO: 1677232 - RNA, 13 nt, Human
cuuauauuaugga

SEQ ID NO: 1677233 - RNA, 19 nt, Human
cuuauaucuauauuuuaca

SEQ ID NO: 1677234 - RNA, 14 nt, Human
cuuauagacaacau

SEQ ID NO: 1677235 - RNA, 19 nt, Human
cuuauaggaauugacccac

SEQ ID NO: 1677236 - RNA, 18 nt, Human
cuuagucacugagacagc

SEQ ID NO: 1677237 - RNA, 19 nt, Human
cuuagucacugagacagcc

SEQ ID NO: 1677238 - RNA, 16 nt, Human
cuguucugcacacagc

SEQ ID NO: 1677239 - RNA, 16 nt, Human
cuguucuggcagaguu

SEQ ID NO: 1677240 - RNA, 19 nt, Human
cuuagauguauauauuucc

SEQ ID NO: 1677241 - RNA, 16 nt, Human
cuuagucacugagaca

SEQ ID NO: 1677242 - RNA, 13 nt, Human
cuuagauguauau

SEQ ID NO: 1677243 - RNA, 22 nt, Human
cuuagaugcaguucugaagaag

SEQ ID NO: 1677244 - RNA, 16 nt, Human
cuucaaccauucccca

SEQ ID NO: 1677245 - RNA, 20 nt, Human
cuucaaccauuccccauggg

SEQ ID NO: 1677246 - RNA, 16 nt, Human
cuucaacucccugccc

SEQ ID NO: 1677247 - RNA, 10 nt, Human
cuucaaggau

SEQ ID NO: 1677248 - RNA, 13 nt, Human
cuucaaggauccu

SEQ ID NO: 1677249 - RNA, 15 nt, Human
cuucaaggauccuga

SEQ ID NO: 1677250 - RNA, 16 nt, Human
cuucaaggauccugag

SEQ ID NO: 1677251 - RNA, 23 nt, Human
cuucacagaugggugcuuggagg

SEQ ID NO: 1677252 - RNA, 17 nt, Human
cuuauuuaaugaaagac

SEQ ID NO: 1677253 - RNA, 18 nt, Human
cuuauuuaaugaaagacu

SEQ ID NO: 1677254 - RNA, 14 nt, Human
cuuauuucauuucu

SEQ ID NO: 1677255 - RNA, 17 nt, Human
cuucaaagcaaaugucu

SEQ ID NO: 1677256 - RNA, 15 nt, Human
cuucaaauauuuccc

SEQ ID NO: 1677257 - RNA, 15 nt, Human
cuuauuucauuucuu

SEQ ID NO: 1677258 - RNA, 12 nt, Human
cuuccaggcugg

SEQ ID NO: 1677259 - RNA, 14 nt, Human
cuuccaggcuggga

SEQ ID NO: 1677260 - RNA, 17 nt, Human
cuucaguggcagcugcu

SEQ ID NO: 1677261 - RNA, 17 nt, Human
cuuccacaagagcccag

SEQ ID NO: 1677262 - RNA, 19 nt, Human
cuuccacaagagcccaggc

SEQ ID NO: 1677263 - RNA, 21 nt, Human
cuuccacaagagcccaggccu

SEQ ID NO: 1677264 - RNA, 19 nt, Human
cuucaggcucuucuccuuu

SEQ ID NO: 1677265 - RNA, 22 nt, Human
cuucaggcucuucuccuuucac

SEQ ID NO: 1677266 - RNA, 15 nt, Human
cuucagggagugagg

SEQ ID NO: 1677267 - RNA, 16 nt, Human
cuucaguaagccguga

SEQ ID NO: 1677268 - RNA, 23 nt, Human
cuucaguaagccgugauuuucau

SEQ ID NO: 1677269 - RNA, 18 nt, Human
cuucagugccuuauggaa

SEQ ID NO: 1677270 - RNA, 22 nt, Human
cuucagugccuuauggaacacu

SEQ ID NO: 1677271 - RNA, 13 nt, Human
cuucaguggcagc

SEQ ID NO: 1677272 - RNA, 14 nt, Human
cuucaguggcagcu

SEQ ID NO: 1677273 - RNA, 15 nt, Human
cuucaguggcagcug

SEQ ID NO: 1677274 - RNA, 16 nt, Human
cuucaguggcagcugc

SEQ ID NO: 1677275 - RNA, 15 nt, Human
cuuccaggcugggag

SEQ ID NO: 1677276 - RNA, 16 nt, Human
cuuccaggcugggaga

SEQ ID NO: 1677277 - RNA, 19 nt, Human
cuuccaggcugggagagcc

SEQ ID NO: 1677278 - RNA, 14 nt, Human
cuuccagggguggg

SEQ ID NO: 1677279 - RNA, 15 nt, Human
cuuccagggguggga

SEQ ID NO: 1677280 - RNA, 17 nt, Human
cuuccaggggugggaca

SEQ ID NO: 1677281 - RNA, 21 nt, Human
cuuccaggggugggacacccu

SEQ ID NO: 1677282 - RNA, 13 nt, Human
cuuccucccucau

SEQ ID NO: 1677283 - RNA, 13 nt, Human
cuuccuaauucca

SEQ ID NO: 1677284 - RNA, 17 nt, Human
cuuccuaauuccacagc

SEQ ID NO: 1677285 - RNA, 18 nt, Human
cuuccuaauuccacagcu

SEQ ID NO: 1677286 - RNA, 19 nt, Human
cuuccuaauuccacagcug

SEQ ID NO: 1677287 - RNA, 19 nt, Human
cuucccgcucagcccuccc

SEQ ID NO: 1677288 - RNA, 23 nt, Human
cuucccgcucagcccucccugcc

SEQ ID NO: 1677289 - RNA, 17 nt, Human
cuucccuacaguugaaa

SEQ ID NO: 1677290 - RNA, 14 nt, Human
cuuuguccccaccg

SEQ ID NO: 1677291 - RNA, 19 nt, Human
cuuuggcuauuagagauca

SEQ ID NO: 1677292 - RNA, 15 nt, Human
cuuugugcugggguu

SEQ ID NO: 1677293 - RNA, 20 nt, Human
cuuugugcugggguuaucug

SEQ ID NO: 1677294 - RNA, 22 nt, Human
cuuugugcugggguuaucugaa

SEQ ID NO: 1677295 - RNA, 19 nt, Human
cuuugugaggaagccgcug

SEQ ID NO: 1677296 - RNA, 15 nt, Human
cuuugugaggaagcc

SEQ ID NO: 1677297 - RNA, 23 nt, Human
cuuugucuacaccauuaugugcg

SEQ ID NO: 1677298 - RNA, 20 nt, Human
cuuugucuacaccauuaugu

SEQ ID NO: 1677299 - RNA, 15 nt, Human
cuuuguccccaccgc

SEQ ID NO: 1677300 - RNA, 22 nt, Human
cuuugcauaacguauaaaagcc

SEQ ID NO: 1677301 - RNA, 20 nt, Human
cuuugcagacaggcaagcac

SEQ ID NO: 1677302 - RNA, 24 nt, Human
cuuugaccucugcagcaauaaagc

SEQ ID NO: 1677303 - RNA, 20 nt, Human
cuuugaccucugcagcaaua

SEQ ID NO: 1677304 - RNA, 18 nt, Human
cuuugaccucugcagcaa

SEQ ID NO: 1677305 - RNA, 17 nt, Human
cuuugaccucugcagca

SEQ ID NO: 1677306 - RNA, 12 nt, Human
cuuucuuccucu

SEQ ID NO: 1677307 - RNA, 13 nt, Human
cuuucuuccucug

SEQ ID NO: 1677308 - RNA, 14 nt, Human
cuuucuuccucugc

SEQ ID NO: 1677309 - RNA, 15 nt, Human
cuuucuuccucugcu

SEQ ID NO: 1677310 - RNA, 15 nt, Human
cuuugaccucugcag

SEQ ID NO: 1677311 - RNA, 14 nt, Human
cuuugaccucugca

SEQ ID NO: 1677312 - RNA, 15 nt, Human
cuuuccaucuacccu

SEQ ID NO: 1677313 - RNA, 12 nt, Human
cuuuccugaggc

SEQ ID NO: 1677314 - RNA, 11 nt, Human
cuuucccuccc

SEQ ID NO: 1677315 - RNA, 13 nt, Human
cuuucccucccuu

SEQ ID NO: 1677316 - RNA, 14 nt, Human
cuuucccucccuuc

SEQ ID NO: 1677317 - RNA, 16 nt, Human
cuuucccucccuuccu

SEQ ID NO: 1677318 - RNA, 11 nt, Human
cuuucuuccuc

SEQ ID NO: 1677319 - RNA, 20 nt, Human
cuuucugggcaccggggccu

SEQ ID NO: 1677320 - RNA, 20 nt, Human
cuuucuggcuaugcauuuga

SEQ ID NO: 1677321 - RNA, 19 nt, Human
cuuucuggcuaugcauuug

SEQ ID NO: 1677322 - RNA, 18 nt, Human
cuuucuggcuaugcauuu

SEQ ID NO: 1677323 - RNA, 17 nt, Human
cuuucuggcuaugcauu

SEQ ID NO: 1677324 - RNA, 13 nt, Human
cuuuccugaggcu

SEQ ID NO: 1677325 - RNA, 15 nt, Human
cuuuccugaggcugg

SEQ ID NO: 1677326 - RNA, 16 nt, Human
cuuucucuuucguuac

SEQ ID NO: 1677327 - RNA, 14 nt, Human
cuuguguaaauaca

SEQ ID NO: 1677328 - RNA, 16 nt, Human
cuuguguaaauacaau

SEQ ID NO: 1677329 - RNA, 21 nt, Human
cuuguguaaauacaauuuugu

SEQ ID NO: 1677330 - RNA, 12 nt, Human
cuuguguaaaua

SEQ ID NO: 1677331 - RNA, 17 nt, Human
cuuguacuuuauuuucu

SEQ ID NO: 1677332 - RNA, 23 nt, Human
cuugucaauaaaauccauacauu

SEQ ID NO: 1677333 - RNA, 12 nt, Human
cuuguacauaau

SEQ ID NO: 1677334 - RNA, 15 nt, Human
cuuguacauaaugcg

SEQ ID NO: 1677335 - RNA, 17 nt, Human
cuuguaaauagcucagg

SEQ ID NO: 1677336 - RNA, 18 nt, Human
cuuguaaauagcucaggu

SEQ ID NO: 1677337 - RNA, 21 nt, Human
cuuguacauaaugcgugcaua

SEQ ID NO: 1677338 - RNA, 19 nt, Human
cuuguacauaaugcgugca

SEQ ID NO: 1677339 - RNA, 22 nt, Human
cuuguacauaaugcgugcauac

SEQ ID NO: 1677340 - RNA, 21 nt, Human
cuuguaaauagcucagguguc

SEQ ID NO: 1677341 - RNA, 16 nt, Human
cuuguaaauagcucag

SEQ ID NO: 1677342 - RNA, 23 nt, Human
cuuggggggcugaggugggagga

SEQ ID NO: 1677343 - RNA, 19 nt, Human
cuugaguuuaaauuguaau

SEQ ID NO: 1677344 - RNA, 22 nt, Human
cuuguuagaucuaguucacucu

SEQ ID NO: 1677345 - RNA, 22 nt, Human
cuuuaccuuuuuuauacauaaa

SEQ ID NO: 1677346 - RNA, 13 nt, Human
cuuuacuauggcc

SEQ ID NO: 1677347 - RNA, 21 nt, Human
cuuuaaacauugguucuugua

SEQ ID NO: 1677348 - RNA, 18 nt, Human
cuuuaucuugaauaaugu

SEQ ID NO: 1677349 - RNA, 21 nt, Human
cuuuaucuugaauaauguaag

SEQ ID NO: 1677350 - RNA, 23 nt, Human
cuuuaucuugaauaauguaagac

SEQ ID NO: 1677351 - RNA, 15 nt, Human
cuuuaugcacaaaau

SEQ ID NO: 1677352 - RNA, 14 nt, Human
cuuuagcgcccagu

SEQ ID NO: 1677353 - RNA, 15 nt, Human
cuuuagcgcccaguu

SEQ ID NO: 1677354 - RNA, 19 nt, Human
cuuuauaauucuacuuuga

SEQ ID NO: 1677355 - RNA, 17 nt, Human
gaaagcccugugcucca

SEQ ID NO: 1677356 - RNA, 21 nt, Human
gaaagcuugcccuggugccuc

SEQ ID NO: 1677357 - RNA, 17 nt, Human
gaaagcccugagcuuuc

SEQ ID NO: 1677358 - RNA, 21 nt, Human
gaaagcccugagcuuucugcu

SEQ ID NO: 1677359 - RNA, 22 nt, Human
gaaagcccugagcuuucugcua

SEQ ID NO: 1677360 - RNA, 14 nt, Human
gaaagcagggacuu

SEQ ID NO: 1677361 - RNA, 21 nt, Human
gaaagaguacucuuguuuccu

SEQ ID NO: 1677362 - RNA, 15 nt, Human
gaaagaguaggaaga

SEQ ID NO: 1677363 - RNA, 16 nt, Human
gaaagaguaggaagac

SEQ ID NO: 1677364 - RNA, 22 nt, Human
gaaagcagaacagugauuacca

SEQ ID NO: 1677365 - RNA, 17 nt, Human
gaaagcagaacagugau

SEQ ID NO: 1677366 - RNA, 20 nt, Human
gaaagaggcagcuugaaacu

SEQ ID NO: 1677367 - RNA, 21 nt, Human
gaaagaggaaugaaguacuca

SEQ ID NO: 1677368 - RNA, 19 nt, Human
gaaagacuuuuccaacccu

SEQ ID NO: 1677369 - RNA, 17 nt, Human
gaaagagaacuuccaga

SEQ ID NO: 1677370 - RNA, 17 nt, Human
gaaacggaugauuucua

SEQ ID NO: 1677371 - RNA, 18 nt, Human
gaaacggaugauuucuau

SEQ ID NO: 1677372 - RNA, 19 nt, Human
gaaacuaggugcauauuua

SEQ ID NO: 1677373 - RNA, 23 nt, Human
gaaacucguuaauuuguaguguu

SEQ ID NO: 1677374 - RNA, 23 nt, Human
gaaacccagcucugguccauaga

SEQ ID NO: 1677375 - RNA, 14 nt, Human
gaaacccugucucu

SEQ ID NO: 1677376 - RNA, 13 nt, Human
gaaacccagcucu

SEQ ID NO: 1677377 - RNA, 14 nt, Human
gaaacccagcucug

SEQ ID NO: 1677378 - RNA, 15 nt, Human
gaaacccagcucugg

SEQ ID NO: 1677379 - RNA, 16 nt, Human
gaaacccagcucuggu

SEQ ID NO: 1677380 - RNA, 18 nt, Human
gaaacccagcucuggucc

SEQ ID NO: 1677381 - RNA, 19 nt, Human
gaaacccagcucuggucca

SEQ ID NO: 1677382 - RNA, 16 nt, Human
gaaacacaacuauauu

SEQ ID NO: 1677383 - RNA, 17 nt, Human
cuuuuuauggccuguga

SEQ ID NO: 1677384 - RNA, 20 nt, Human
cuuuuguucuugguuuguaa

SEQ ID NO: 1677385 - RNA, 18 nt, Human
cuuuguuaguuucuccaa

SEQ ID NO: 1677386 - RNA, 15 nt, Human
cuuuguucagccugc

SEQ ID NO: 1677387 - RNA, 12 nt, Human
cuuuuguucuug

SEQ ID NO: 1677388 - RNA, 11 nt, Human
cuuuuguucuu

SEQ ID NO: 1677389 - RNA, 12 nt, Human
gaaaaaggagga

SEQ ID NO: 1677390 - RNA, 15 nt, Human
gaaaaaggaggaaga

SEQ ID NO: 1677391 - RNA, 18 nt, Human
gaaaacacauuuuucuua

SEQ ID NO: 1677392 - RNA, 19 nt, Human
gaaaacacauuuuucuuag

SEQ ID NO: 1677393 - RNA, 18 nt, Human
gaaaacacuguucucugc

SEQ ID NO: 1677394 - RNA, 16 nt, Human
cuuuuuggcauaacau

SEQ ID NO: 1677395 - RNA, 20 nt, Human
cuuuuuggcauaacauaaau

SEQ ID NO: 1677396 - RNA, 22 nt, Human
cuuuuuggcauaacauaaaucu

SEQ ID NO: 1677397 - RNA, 17 nt, Human
cuuuuuuggcugcugaa

SEQ ID NO: 1677398 - RNA, 20 nt, Human
cuuuuuuggcugcugaaggc

SEQ ID NO: 1677399 - RNA, 22 nt, Human
cuuuuuuggcugcugaaggcuc

SEQ ID NO: 1677400 - RNA, 19 nt, Human
gaaaaguuuaauauuaaag

SEQ ID NO: 1677401 - RNA, 20 nt, Human
gaaaaguuuaauauuaaagc

SEQ ID NO: 1677402 - RNA, 21 nt, Human
gaaaaguuuaauauuaaagcc

SEQ ID NO: 1677403 - RNA, 22 nt, Human
gaaaaguuuaauauuaaagcca

SEQ ID NO: 1677404 - RNA, 14 nt, Human
gaaaaguugaauuu

SEQ ID NO: 1677405 - RNA, 15 nt, Human
gaaaaguuuaauauu

SEQ ID NO: 1677406 - RNA, 15 nt, Human
gaaaaguugaauuuu

SEQ ID NO: 1677407 - RNA, 24 nt, Human
gaaaacacuguucucugcccucca

SEQ ID NO: 1677408 - RNA, 20 nt, Human
gaaaacguggcugcuucaag

SEQ ID NO: 1677409 - RNA, 22 nt, Human
gaaaacguggcugcuucaagga

SEQ ID NO: 1677410 - RNA, 18 nt, Human
gaaaaucuuauaauuuaa

SEQ ID NO: 1677411 - RNA, 20 nt, Human
gaaaaucagccugcuccagc

SEQ ID NO: 1677412 - RNA, 22 nt, Human
gaaaaucagccugcuccagcug

SEQ ID NO: 1677413 - RNA, 22 nt, Human
gaaaaucuacacuccagugaga

SEQ ID NO: 1677414 - RNA, 23 nt, Human
gaaaaguuuaauauuaaagccau

SEQ ID NO: 1677415 - RNA, 18 nt, Human
gaaaauauuuguaucaca

SEQ ID NO: 1677416 - RNA, 22 nt, Human
ccugccuguugggccaggagcc

SEQ ID NO: 1677417 - RNA, 10 nt, Human
ccugcccugg

SEQ ID NO: 1677418 - RNA, 12 nt, Human
ccugcccuggga

SEQ ID NO: 1677419 - RNA, 14 nt, Human
ccugcccugggagg

SEQ ID NO: 1677420 - RNA, 15 nt, Human
ccugcccugggaggc

SEQ ID NO: 1677421 - RNA, 20 nt, Human
ccugcccugggaggcaguga

SEQ ID NO: 1677422 - RNA, 22 nt, Human
ccugcccugggaggcagugaug

SEQ ID NO: 1677423 - RNA, 14 nt, Human
ccugcccugguuuc

SEQ ID NO: 1677424 - RNA, 19 nt, Human
ccugcccugguuuccugcc

SEQ ID NO: 1677425 - RNA, 20 nt, Human
ccugcccugguuuccugccc

SEQ ID NO: 1677426 - RNA, 21 nt, Human
ccugcccugguuuccugcccu

SEQ ID NO: 1677427 - RNA, 22 nt, Human
ccugcccugguuuccugcccug

SEQ ID NO: 1677428 - RNA, 23 nt, Human
ccugcccugguuuccugcccugg

SEQ ID NO: 1677429 - RNA, 11 nt, Human
ccugcccugug

SEQ ID NO: 1677430 - RNA, 12 nt, Human
ccugcccugugg

SEQ ID NO: 1677431 - RNA, 14 nt, Human
ccugcccugugggc

SEQ ID NO: 1677432 - RNA, 15 nt, Human
ccugcccugugggcc

SEQ ID NO: 1677433 - RNA, 19 nt, Human
ccugcccuuaccugccagg

SEQ ID NO: 1677434 - RNA, 21 nt, Human
ccugcccuuaccugccaggaa

SEQ ID NO: 1677435 - RNA, 22 nt, Human
ccugcccuuaccugccaggaag

SEQ ID NO: 1677436 - RNA, 12 nt, Human
ccugccucagcc

SEQ ID NO: 1677437 - RNA, 13 nt, Human
ccugccucagccu

SEQ ID NO: 1677438 - RNA, 14 nt, Human
ccugccucagccuc

SEQ ID NO: 1677439 - RNA, 22 nt, Human
ccugccuguucccauucuugca

SEQ ID NO: 1677440 - RNA, 14 nt, Human
ccugccuguugggc

SEQ ID NO: 1677441 - RNA, 12 nt, Human
ccugccaggcau

SEQ ID NO: 1677442 - RNA, 15 nt, Human
ccugccaggcauggu

SEQ ID NO: 1677443 - RNA, 14 nt, Human
ccugccccccagcc

SEQ ID NO: 1677444 - RNA, 14 nt, Human
ccugcccggcugcg

SEQ ID NO: 1677445 - RNA, 16 nt, Human
ccugcccggcugcgga

SEQ ID NO: 1677446 - RNA, 15 nt, Human
ccugccccucccuuc

SEQ ID NO: 1677447 - RNA, 16 nt, Human
ccugccccucccuuca

SEQ ID NO: 1677448 - RNA, 18 nt, Human
ccugccccucccuucaac

SEQ ID NO: 1677449 - RNA, 18 nt, Human
ccugccccuccucucugc

SEQ ID NO: 1677450 - RNA, 14 nt, Human
ccugccccucccuu

SEQ ID NO: 1677451 - RNA, 19 nt, Human
ccugccccuccucucugcc

SEQ ID NO: 1677452 - RNA, 20 nt, Human
ccugccccuccucucugccc

SEQ ID NO: 1677453 - RNA, 21 nt, Human
ccugccccuccucucugcccu

SEQ ID NO: 1677454 - RNA, 22 nt, Human
ccugccccuccucucugcccua

SEQ ID NO: 1677455 - RNA, 17 nt, Human
ccugccccugagcccau

SEQ ID NO: 1677456 - RNA, 15 nt, Human
ccugagcugggauga

SEQ ID NO: 1677457 - RNA, 11 nt, Human
ccucuuccuga

SEQ ID NO: 1677458 - RNA, 18 nt, Human
ccugaaggccccgcccag

SEQ ID NO: 1677459 - RNA, 19 nt, Human
ccugaaggccccgcccagg

SEQ ID NO: 1677460 - RNA, 22 nt, Human
ccugaaggccccgcccaggcuu

SEQ ID NO: 1677461 - RNA, 20 nt, Human
ccugaaggccccgcccaggc

SEQ ID NO: 1677462 - RNA, 21 nt, Human
ccugaaggccccgcccaggcu

SEQ ID NO: 1677463 - RNA, 18 nt, Human
ccugaaagcccugagcuu

SEQ ID NO: 1677464 - RNA, 13 nt, Human
ccugaaagcccug

SEQ ID NO: 1677465 - RNA, 14 nt, Human
ccugaaagcccuga

SEQ ID NO: 1677466 - RNA, 13 nt, Human
ccugaaagaggaa

SEQ ID NO: 1677467 - RNA, 17 nt, Human
ccugcaaagcccagcuu

SEQ ID NO: 1677468 - RNA, 18 nt, Human
ccugcaaagcccagcuug

SEQ ID NO: 1677469 - RNA, 22 nt, Human
ccugcacaaagcccuuccaugu

SEQ ID NO: 1677470 - RNA, 20 nt, Human
ccugcacaaagcccuuccau

SEQ ID NO: 1677471 - RNA, 15 nt, Human
ccugcaaagcccagc

SEQ ID NO: 1677472 - RNA, 16 nt, Human
ccugcaaagcccagcu

SEQ ID NO: 1677473 - RNA, 14 nt, Human
ccugcaaagcccag

SEQ ID NO: 1677474 - RNA, 23 nt, Human
ccugcacaaagcccuuccauguc

SEQ ID NO: 1677475 - RNA, 19 nt, Human
ccugcaaagcccagcuuga

SEQ ID NO: 1677476 - RNA, 21 nt, Human
ccugcacacgcuccuuccucu

SEQ ID NO: 1677477 - RNA, 16 nt, Human
ccugccacccugggga

SEQ ID NO: 1677478 - RNA, 22 nt, Human
ccugccacccuggggagaaagu

SEQ ID NO: 1677479 - RNA, 14 nt, Human
ccugccacccuggg

SEQ ID NO: 1677480 - RNA, 12 nt, Human
ccugccacccug

SEQ ID NO: 1677481 - RNA, 13 nt, Human
ccugccacccugg

SEQ ID NO: 1677482 - RNA, 23 nt, Human
ccugcauuugugaaaugauggug

SEQ ID NO: 1677483 - RNA, 15 nt, Human
ccugccaccacgccc

SEQ ID NO: 1677484 - RNA, 19 nt, Human
ccugccaccacgcccggcu

SEQ ID NO: 1677485 - RNA, 19 nt, Human
ccugccaauggacuaacuu

SEQ ID NO: 1677486 - RNA, 20 nt, Human
ccugagccagauuucacucu

SEQ ID NO: 1677487 - RNA, 19 nt, Human
ccugaaguaagcaaagacu

SEQ ID NO: 1677488 - RNA, 22 nt, Human
ccugaagucuuuguacagacaa

SEQ ID NO: 1677489 - RNA, 20 nt, Human
ccugaagucacacagugagu

SEQ ID NO: 1677490 - RNA, 15 nt, Human
ccugagccagauuuc

SEQ ID NO: 1677491 - RNA, 16 nt, Human
ccugagccagauuuca

SEQ ID NO: 1677492 - RNA, 18 nt, Human
ccugagccagauuucacu

SEQ ID NO: 1677493 - RNA, 12 nt, Human
ccugagcuggga

SEQ ID NO: 1677494 - RNA, 15 nt, Human
ccugaggcccagagg

SEQ ID NO: 1677495 - RNA, 16 nt, Human
ccugaggcccagaggg

SEQ ID NO: 1677496 - RNA, 17 nt, Human
ccugaggcccagagggc

SEQ ID NO: 1677497 - RNA, 18 nt, Human
ccugaggcccagagggcc

SEQ ID NO: 1677498 - RNA, 13 nt, Human
ccugaggcugggc

SEQ ID NO: 1677499 - RNA, 14 nt, Human
ccugaggcugggcu

SEQ ID NO: 1677500 - RNA, 15 nt, Human
ccugaggcugggcuc

SEQ ID NO: 1677501 - RNA, 16 nt, Human
ccugaggcugggcucc

SEQ ID NO: 1677502 - RNA, 17 nt, Human
ccugaggcuccacuugg

SEQ ID NO: 1677503 - RNA, 13 nt, Human
ccugaggcuccac

SEQ ID NO: 1677504 - RNA, 14 nt, Human
ccugaggcuccacu

SEQ ID NO: 1677505 - RNA, 12 nt, Human
ccuguaccucuu

SEQ ID NO: 1677506 - RNA, 10 nt, Human
ccuguaccuc

SEQ ID NO: 1677507 - RNA, 15 nt, Human
ccugguggcaguggg

SEQ ID NO: 1677508 - RNA, 13 nt, Human
ccugguggcagug

SEQ ID NO: 1677509 - RNA, 14 nt, Human
ccugguggcagugg

SEQ ID NO: 1677510 - RNA, 13 nt, Human
ccuguagcccuaa

SEQ ID NO: 1677511 - RNA, 19 nt, Human
ccuguagagugggagcuga

SEQ ID NO: 1677512 - RNA, 15 nt, Human
ccuguagagugggag

SEQ ID NO: 1677513 - RNA, 16 nt, Human
ccuguagagugggagc

SEQ ID NO: 1677514 - RNA, 12 nt, Human
ccugucccccug

SEQ ID NO: 1677515 - RNA, 13 nt, Human
ccugucccccuga

SEQ ID NO: 1677516 - RNA, 14 nt, Human
ccugucccccugac

SEQ ID NO: 1677517 - RNA, 15 nt, Human
ccugucccccugaca

SEQ ID NO: 1677518 - RNA, 16 nt, Human
ccugucccccugacaa

SEQ ID NO: 1677519 - RNA, 19 nt, Human
ccugguggcagcucaccuc

SEQ ID NO: 1677520 - RNA, 21 nt, Human
ccugguggcagcucaccucuc

SEQ ID NO: 1677521 - RNA, 22 nt, Human
ccugguggcagcucaccucucc

SEQ ID NO: 1677522 - RNA, 14 nt, Human
ccugguggcagcug

SEQ ID NO: 1677523 - RNA, 15 nt, Human
ccugguggcagcugc

SEQ ID NO: 1677524 - RNA, 16 nt, Human
ccugguggcagcugcg

SEQ ID NO: 1677525 - RNA, 17 nt, Human
ccugguggcagcugcgg

SEQ ID NO: 1677526 - RNA, 18 nt, Human
ccugguggcagcugcggu

SEQ ID NO: 1677527 - RNA, 14 nt, Human
ccuggcaugggaau

SEQ ID NO: 1677528 - RNA, 18 nt, Human
ccugccuguugggccagg

SEQ ID NO: 1677529 - RNA, 19 nt, Human
ccugccuguugggccagga

SEQ ID NO: 1677530 - RNA, 20 nt, Human
ccugccuguugggccaggag

SEQ ID NO: 1677531 - RNA, 21 nt, Human
ccugcuaauuccccagauugc

SEQ ID NO: 1677532 - RNA, 12 nt, Human
ccuggagaacua

SEQ ID NO: 1677533 - RNA, 13 nt, Human
ccuggagaacuag

SEQ ID NO: 1677534 - RNA, 16 nt, Human
ccuggagaacuagaga

SEQ ID NO: 1677535 - RNA, 19 nt, Human
ccuggcacccggccccugc

SEQ ID NO: 1677536 - RNA, 20 nt, Human
ccuggcacccggccccugcu

SEQ ID NO: 1677537 - RNA, 21 nt, Human
ccuggcacccggccccugcug

SEQ ID NO: 1677538 - RNA, 12 nt, Human
ccuggcacugcu

SEQ ID NO: 1677539 - RNA, 13 nt, Human
ccuggcacugcuu

SEQ ID NO: 1677540 - RNA, 16 nt, Human
ccuggcacugcuucca

SEQ ID NO: 1677541 - RNA, 13 nt, Human
ccuggcaugggaa

SEQ ID NO: 1677542 - RNA, 13 nt, Human
ccuggccacgccc

SEQ ID NO: 1677543 - RNA, 13 nt, Human
ccuggcccacugc

SEQ ID NO: 1677544 - RNA, 14 nt, Human
ccuggcccacugca

SEQ ID NO: 1677545 - RNA, 21 nt, Human
ccuggccagaugcaccagccc

SEQ ID NO: 1677546 - RNA, 23 nt, Human
ccuggccagaugcaccagcccuu

SEQ ID NO: 1677547 - RNA, 17 nt, Human
ccuggcuuuucacugcu

SEQ ID NO: 1677548 - RNA, 18 nt, Human
ccuggcuuuucacugcug

SEQ ID NO: 1677549 - RNA, 16 nt, Human
ccuggcuuuucacugc

SEQ ID NO: 1677550 - RNA, 16 nt, Human
ccuggcccacugcauc

SEQ ID NO: 1677551 - RNA, 22 nt, Human
ccugggaggucaaggcugcagu

SEQ ID NO: 1677552 - RNA, 16 nt, Human
ccugggagugagcugg

SEQ ID NO: 1677553 - RNA, 18 nt, Human
ccugggagugagcugguu

SEQ ID NO: 1677554 - RNA, 16 nt, Human
ccugggcagaaggaag

SEQ ID NO: 1677555 - RNA, 20 nt, Human
ccugggggcugggcagagga

SEQ ID NO: 1677556 - RNA, 21 nt, Human
ccugggggcugggcagaggaa

SEQ ID NO: 1677557 - RNA, 19 nt, Human
ccugggggcugggcagagg

SEQ ID NO: 1677558 - RNA, 14 nt, Human
ccugggcagcugcc

SEQ ID NO: 1677559 - RNA, 13 nt, Human
ccugggcagcugc

SEQ ID NO: 1677560 - RNA, 13 nt, Human
cgcacugggcuug

SEQ ID NO: 1677561 - RNA, 23 nt, Human
cgcacuucgggaggucgaggcag

SEQ ID NO: 1677562 - RNA, 17 nt, Human
cgcacugggcuugggga

SEQ ID NO: 1677563 - RNA, 19 nt, Human
cgcagcauauucaggaagc

SEQ ID NO: 1677564 - RNA, 20 nt, Human
cgcagcauauucaggaagcu

SEQ ID NO: 1677565 - RNA, 17 nt, Human
cgcagcccugcagaggg

SEQ ID NO: 1677566 - RNA, 19 nt, Human
cgagcccugguggcagugg

SEQ ID NO: 1677567 - RNA, 16 nt, Human
cgaggacagggaggug

SEQ ID NO: 1677568 - RNA, 20 nt, Human
cgggaauuuucaucuaggau

SEQ ID NO: 1677569 - RNA, 18 nt, Human
cgggaauuuucaucuagg

SEQ ID NO: 1677570 - RNA, 16 nt, Human
cgggaagggggcuggg

SEQ ID NO: 1677571 - RNA, 19 nt, Human
cgggaagggggcugggaca

SEQ ID NO: 1677572 - RNA, 20 nt, Human
cgggaagggggcugggacau

SEQ ID NO: 1677573 - RNA, 14 nt, Human
cggcuggccuggcc

SEQ ID NO: 1677574 - RNA, 23 nt, Human
cggcuggcagcccaccccucaac

SEQ ID NO: 1677575 - RNA, 13 nt, Human
cggcuggccuggc

SEQ ID NO: 1677576 - RNA, 14 nt, Human
cggcuggcagccca

SEQ ID NO: 1677577 - RNA, 11 nt, Human
cggccaggcca

SEQ ID NO: 1677578 - RNA, 12 nt, Human
cggccaggccag

SEQ ID NO: 1677579 - RNA, 20 nt, Human
cggccaggccagagggagug

SEQ ID NO: 1677580 - RNA, 19 nt, Human
cgcgguggcucacgccugu

SEQ ID NO: 1677581 - RNA, 15 nt, Human
cgcgacaaugcaaac

SEQ ID NO: 1677582 - RNA, 14 nt, Human
cgcgacaaugcaaa

SEQ ID NO: 1677583 - RNA, 17 nt, Human
cgcuaaacuuuucugau

SEQ ID NO: 1677584 - RNA, 18 nt, Human
cgcuaaacuuuucugaua

SEQ ID NO: 1677585 - RNA, 19 nt, Human
cgcuaaacuuuucugauag

SEQ ID NO: 1677586 - RNA, 24 nt, Human
cgcguugaaauuguaauuauaucu

SEQ ID NO: 1677587 - RNA, 18 nt, Human
cgcuacccgggaaggggg

SEQ ID NO: 1677588 - RNA, 21 nt, Human
cgcuacccgggaagggggcug

SEQ ID NO: 1677589 - RNA, 24 nt, Human
cgcuacccgggaagggggcuggga

SEQ ID NO: 1677590 - RNA, 13 nt, Human
cgcagcccugcuu

SEQ ID NO: 1677591 - RNA, 15 nt, Human
cgcagcccugcuuug

SEQ ID NO: 1677592 - RNA, 24 nt, Human
cgcagcccugcuuugggcugcccu

SEQ ID NO: 1677593 - RNA, 18 nt, Human
cgcagcccugcagagggc

SEQ ID NO: 1677594 - RNA, 19 nt, Human
cgcagcccugcagagggca

SEQ ID NO: 1677595 - RNA, 18 nt, Human
cgcccaacuaauuuuugu

SEQ ID NO: 1677596 - RNA, 13 nt, Human
cgcccagucugga

SEQ ID NO: 1677597 - RNA, 19 nt, Human
cgcccagucuggaaugcag

SEQ ID NO: 1677598 - RNA, 18 nt, Human
cgcccggcuaauuuuugu

SEQ ID NO: 1677599 - RNA, 21 nt, Human
cgcccagucuggaaugcagug

SEQ ID NO: 1677600 - RNA, 16 nt, Human
cggacuuagcugggag

SEQ ID NO: 1677601 - RNA, 21 nt, Human
cggacagccacggccaggcca

SEQ ID NO: 1677602 - RNA, 22 nt, Human
cggacagccacggccaggccag

SEQ ID NO: 1677603 - RNA, 17 nt, Human
cggacuuagcugggaga

SEQ ID NO: 1677604 - RNA, 15 nt, Human
cggagaaaggaaggg

SEQ ID NO: 1677605 - RNA, 17 nt, Human
cggagaaaggaagggcu

SEQ ID NO: 1677606 - RNA, 16 nt, Human
cgcuuucuacccagcg

SEQ ID NO: 1677607 - RNA, 14 nt, Human
cgcuuucuacccag

SEQ ID NO: 1677608 - RNA, 16 nt, Human
cggaauaguuggcuag

SEQ ID NO: 1677609 - RNA, 17 nt, Human
cggaauaguuggcuagg

SEQ ID NO: 1677610 - RNA, 11 nt, Human
cgcugugcugc

SEQ ID NO: 1677611 - RNA, 13 nt, Human
cgcugugcugccc

SEQ ID NO: 1677612 - RNA, 14 nt, Human
cgcugugcugcccu

SEQ ID NO: 1677613 - RNA, 21 nt, Human
cgcugugcugcccugcccacc

SEQ ID NO: 1677614 - RNA, 23 nt, Human
cgcugugcugcccugcccaccug

SEQ ID NO: 1677615 - RNA, 19 nt, Human
cgcugugcugcccugccca

SEQ ID NO: 1677616 - RNA, 21 nt, Human
ccuuuguaaauugucagaugc

SEQ ID NO: 1677617 - RNA, 23 nt, Human
ccuuuguauucucuccuguaccu

SEQ ID NO: 1677618 - RNA, 22 nt, Human
ccuuuguauucucuccuguacc

SEQ ID NO: 1677619 - RNA, 23 nt, Human
ccuuuguaaauugucagaugcug

SEQ ID NO: 1677620 - RNA, 24 nt, Human
ccuuuguauucucuccuguaccuc

SEQ ID NO: 1677621 - RNA, 16 nt, Human
ccuuuguccccaccgc

SEQ ID NO: 1677622 - RNA, 18 nt, Human
ccuuuguccccaccgcag

SEQ ID NO: 1677623 - RNA, 14 nt, Human
ccuuuguccccacc

SEQ ID NO: 1677624 - RNA, 15 nt, Human
ccuuuuuuggcugcu

SEQ ID NO: 1677625 - RNA, 14 nt, Human
ccuuugugaggaag

SEQ ID NO: 1677626 - RNA, 22 nt, Human
ccuuuguccccaccgcagacag

SEQ ID NO: 1677627 - RNA, 23 nt, Human
ccuuuguccccaccgcagacagg

SEQ ID NO: 1677628 - RNA, 15 nt, Human
ccuuugugaggaagc

SEQ ID NO: 1677629 - RNA, 16 nt, Human
ccuuugugaggaagcc

SEQ ID NO: 1677630 - RNA, 17 nt, Human
ccuuugugaggaagccg

SEQ ID NO: 1677631 - RNA, 23 nt, Human
ccuuugugaggaagccgcugggg

SEQ ID NO: 1677632 - RNA, 15 nt, Human
cgaauauugcugaug

SEQ ID NO: 1677633 - RNA, 17 nt, Human
cgaauauugcugauggu

SEQ ID NO: 1677634 - RNA, 16 nt, Human
cgaauagcugggacua

SEQ ID NO: 1677635 - RNA, 11 nt, Human
cgaauauugcu

SEQ ID NO: 1677636 - RNA, 12 nt, Human
cgaauauugcug

SEQ ID NO: 1677637 - RNA, 14 nt, Human
cgaauauugcugau

SEQ ID NO: 1677638 - RNA, 23 nt, Human
cgaaagggacuuggaagcuccgc

SEQ ID NO: 1677639 - RNA, 17 nt, Human
ccuuuuuuggcugcuga

SEQ ID NO: 1677640 - RNA, 18 nt, Human
ccuuuuuuggcugcugaa

SEQ ID NO: 1677641 - RNA, 20 nt, Human
ccuuuuuuggcugcugaagg

SEQ ID NO: 1677642 - RNA, 22 nt, Human
ccuuuuuuggcugcugaaggcu

SEQ ID NO: 1677643 - RNA, 21 nt, Human
cgaacauguuuuucuucuccc

SEQ ID NO: 1677644 - RNA, 23 nt, Human
cgaacauguuuuucuucucccuc

SEQ ID NO: 1677645 - RNA, 18 nt, Human
ccuguggaucaaauccag

SEQ ID NO: 1677646 - RNA, 20 nt, Human
ccuguggaugauaaaacaca

SEQ ID NO: 1677647 - RNA, 20 nt, Human
ccugugggcccccaaaugga

SEQ ID NO: 1677648 - RNA, 20 nt, Human
ccugugccucugggacugga

SEQ ID NO: 1677649 - RNA, 19 nt, Human
ccuucauuuggcauucccc

SEQ ID NO: 1677650 - RNA, 12 nt, Human
ccuucucuccag

SEQ ID NO: 1677651 - RNA, 13 nt, Human
ccuucucuccagc

SEQ ID NO: 1677652 - RNA, 15 nt, Human
ccuucucuccagccc

SEQ ID NO: 1677653 - RNA, 16 nt, Human
ccuucucuccagcccc

SEQ ID NO: 1677654 - RNA, 17 nt, Human
ccuuccauggacuuugu

SEQ ID NO: 1677655 - RNA, 18 nt, Human
ccuuccaugucgccucug

SEQ ID NO: 1677656 - RNA, 13 nt, Human
ccuuccaggggug

SEQ ID NO: 1677657 - RNA, 17 nt, Human
ccuucggccuccauccu

SEQ ID NO: 1677658 - RNA, 18 nt, Human
ccuucggccuccauccug

SEQ ID NO: 1677659 - RNA, 19 nt, Human
ccuucucuccagccccugg

SEQ ID NO: 1677660 - RNA, 21 nt, Human
ccuuggugucgggcaugacac

SEQ ID NO: 1677661 - RNA, 19 nt, Human
ccuuggugucgggcaugac

SEQ ID NO: 1677662 - RNA, 20 nt, Human
ccuuggugucgggcaugaca

SEQ ID NO: 1677663 - RNA, 14 nt, Human
ccuuggggagcagg

SEQ ID NO: 1677664 - RNA, 16 nt, Human
ccuuggcugcagggag

SEQ ID NO: 1677665 - RNA, 23 nt, Human
ccuugacauuguagagcuucugg

SEQ ID NO: 1677666 - RNA, 17 nt, Human
ccuucucuccagccccu

SEQ ID NO: 1677667 - RNA, 18 nt, Human
ccuucucuccagccccug

SEQ ID NO: 1677668 - RNA, 18 nt, Human
ccuugacagggcacaccg

SEQ ID NO: 1677669 - RNA, 21 nt, Human
ccuugacagggcacaccgggc

SEQ ID NO: 1677670 - RNA, 19 nt, Human
ccuuggauuguccccgacc

SEQ ID NO: 1677671 - RNA, 22 nt, Human
ccuuggcucaaguccucuuuuc

SEQ ID NO: 1677672 - RNA, 15 nt, Human
ccuuggauugucccc

SEQ ID NO: 1677673 - RNA, 15 nt, Human
ccuuggacucauuuu

SEQ ID NO: 1677674 - RNA, 19 nt, Human
cucagcucccaaggcucug

SEQ ID NO: 1677675 - RNA, 15 nt, Human
cucagcucccaaggc

SEQ ID NO: 1677676 - RNA, 23 nt, Human
cucagcggggacagcuccuucug

SEQ ID NO: 1677677 - RNA, 14 nt, Human
cucagcggggacag

SEQ ID NO: 1677678 - RNA, 15 nt, Human
cucagcggggacagc

SEQ ID NO: 1677679 - RNA, 16 nt, Human
cucagcggggacagcu

SEQ ID NO: 1677680 - RNA, 18 nt, Human
cucagcggggacagcucc

SEQ ID NO: 1677681 - RNA, 19 nt, Human
cucagcggggacagcuccu

SEQ ID NO: 1677682 - RNA, 20 nt, Human
cucagcggggacagcuccuu

SEQ ID NO: 1677683 - RNA, 21 nt, Human
cucagcggggacagcuccuuc

SEQ ID NO: 1677684 - RNA, 14 nt, Human
cucagcccucccug

SEQ ID NO: 1677685 - RNA, 19 nt, Human
cucagcccucccugccccu

SEQ ID NO: 1677686 - RNA, 20 nt, Human
cucagcccucccugccccuc

SEQ ID NO: 1677687 - RNA, 21 nt, Human
cucagcccucccugccccucc

SEQ ID NO: 1677688 - RNA, 15 nt, Human
cucagcauccuggca

SEQ ID NO: 1677689 - RNA, 23 nt, Human
cucagauuuuauuauguaaaucc

SEQ ID NO: 1677690 - RNA, 21 nt, Human
cucagcaaaagaugcuucuca

SEQ ID NO: 1677691 - RNA, 16 nt, Human
cucagcaggggagggu

SEQ ID NO: 1677692 - RNA, 19 nt, Human
cucagcaaaagaugcuucu

SEQ ID NO: 1677693 - RNA, 20 nt, Human
cucagcaaaagaugcuucuc

SEQ ID NO: 1677694 - RNA, 13 nt, Human
cucagcauccugg

SEQ ID NO: 1677695 - RNA, 21 nt, Human
cucagcauccuggcacccggc

SEQ ID NO: 1677696 - RNA, 22 nt, Human
cucagcauccuggcacccggcc

SEQ ID NO: 1677697 - RNA, 16 nt, Human
cucagaucuucugugg

SEQ ID NO: 1677698 - RNA, 15 nt, Human
cucagagccaccccu

SEQ ID NO: 1677699 - RNA, 23 nt, Human
cucagagagggugggagugggcc

SEQ ID NO: 1677700 - RNA, 19 nt, Human
cucagagagggugggagug

SEQ ID NO: 1677701 - RNA, 16 nt, Human
cucacuguugcccagg

SEQ ID NO: 1677702 - RNA, 17 nt, Human
cucacuguugcccaggc

SEQ ID NO: 1677703 - RNA, 18 nt, Human
cucacuguugcccaggcu

SEQ ID NO: 1677704 - RNA, 19 nt, Human
cucacuguugcccaggcug

SEQ ID NO: 1677705 - RNA, 14 nt, Human
cucacuguugccca

SEQ ID NO: 1677706 - RNA, 15 nt, Human
cucacuguugcccag

SEQ ID NO: 1677707 - RNA, 20 nt, Human
cucacugcauccuccgccuc

SEQ ID NO: 1677708 - RNA, 15 nt, Human
cucacugcagccuca

SEQ ID NO: 1677709 - RNA, 16 nt, Human
cucacugcagccucaa

SEQ ID NO: 1677710 - RNA, 23 nt, Human
cucaggugauccacccaccucag

SEQ ID NO: 1677711 - RNA, 19 nt, Human
cucagguggggucacucug

SEQ ID NO: 1677712 - RNA, 20 nt, Human
cucagguggggucacucugg

SEQ ID NO: 1677713 - RNA, 21 nt, Human
cucagguggggucacucuggc

SEQ ID NO: 1677714 - RNA, 20 nt, Human
cucagguaaucgaccugccu

SEQ ID NO: 1677715 - RNA, 22 nt, Human
cucagguaaucgaccugccucg

SEQ ID NO: 1677716 - RNA, 24 nt, Human
cucagguaaucgaccugccucggc

SEQ ID NO: 1677717 - RNA, 24 nt, Human
cucagggucccugguggcagcuca

SEQ ID NO: 1677718 - RNA, 14 nt, Human
cucagggccugguc

SEQ ID NO: 1677719 - RNA, 20 nt, Human
cucagggucccugguggcag

SEQ ID NO: 1677720 - RNA, 21 nt, Human
cucagggucccugguggcagc

SEQ ID NO: 1677721 - RNA, 22 nt, Human
cucagggucccugguggcagcu

SEQ ID NO: 1677722 - RNA, 18 nt, Human
cucagggccuggcucagg

SEQ ID NO: 1677723 - RNA, 19 nt, Human
cucagggccuggcucaggu

SEQ ID NO: 1677724 - RNA, 20 nt, Human
cucagggccuggcucaggug

SEQ ID NO: 1677725 - RNA, 15 nt, Human
cucaggcagguggga

SEQ ID NO: 1677726 - RNA, 18 nt, Human
cucaggcaggugggaugg

SEQ ID NO: 1677727 - RNA, 24 nt, Human
cucaggagcccugggaggcucugg

SEQ ID NO: 1677728 - RNA, 12 nt, Human
cucaggagcccu

SEQ ID NO: 1677729 - RNA, 13 nt, Human
cucaggagcccug

SEQ ID NO: 1677730 - RNA, 14 nt, Human
cucaggagcccugg

SEQ ID NO: 1677731 - RNA, 15 nt, Human
cucaggagcccuggg

SEQ ID NO: 1677732 - RNA, 16 nt, Human
cucaggagcccuggga

SEQ ID NO: 1677733 - RNA, 17 nt, Human
cucaggagcccugggag

SEQ ID NO: 1677734 - RNA, 20 nt, Human
cucaggagcccugggaggcu

SEQ ID NO: 1677735 - RNA, 21 nt, Human
cucaggagcccugggaggcuc

SEQ ID NO: 1677736 - RNA, 22 nt, Human
cucaggagcccugggaggcucu

SEQ ID NO: 1677737 - RNA, 23 nt, Human
cucaggagcccugggaggcucug

SEQ ID NO: 1677738 - RNA, 22 nt, Human
cucaggaaaucaaauaugcaaa

SEQ ID NO: 1677739 - RNA, 22 nt, Human
cuccagcuggccgggagccuga

SEQ ID NO: 1677740 - RNA, 23 nt, Human
cuccagcuggccgggagccugau

SEQ ID NO: 1677741 - RNA, 19 nt, Human
cuccagcuggguuggaaaa

SEQ ID NO: 1677742 - RNA, 14 nt, Human
cuccaugcugccuc

SEQ ID NO: 1677743 - RNA, 15 nt, Human
cuccaugcugccucc

SEQ ID NO: 1677744 - RNA, 16 nt, Human
cuccaugcugccucca

SEQ ID NO: 1677745 - RNA, 17 nt, Human
cuccaugcugccuccag

SEQ ID NO: 1677746 - RNA, 13 nt, Human
cuccauuuaauaa

SEQ ID NO: 1677747 - RNA, 20 nt, Human
cuccauuuaauaauuauaug

SEQ ID NO: 1677748 - RNA, 16 nt, Human
cucccaaagugcuggg

SEQ ID NO: 1677749 - RNA, 23 nt, Human
cucccaaagugcugggauuacag

SEQ ID NO: 1677750 - RNA, 16 nt, Human
cucccaacucacccca

SEQ ID NO: 1677751 - RNA, 15 nt, Human
cucccacaaaggaga

SEQ ID NO: 1677752 - RNA, 14 nt, Human
cucccaacucaccc

SEQ ID NO: 1677753 - RNA, 15 nt, Human
cucccaacucacccc

SEQ ID NO: 1677754 - RNA, 17 nt, Human
cucccaggcgccccuuc

SEQ ID NO: 1677755 - RNA, 19 nt, Human
cucccaggcgccccuuccc

SEQ ID NO: 1677756 - RNA, 20 nt, Human
cucccaggcgccccuucccc

SEQ ID NO: 1677757 - RNA, 22 nt, Human
cucccaggcgccccuucccccu

SEQ ID NO: 1677758 - RNA, 16 nt, Human
cucccaucacuucccu

SEQ ID NO: 1677759 - RNA, 15 nt, Human
cucccgaguagcugg

SEQ ID NO: 1677760 - RNA, 22 nt, Human
cucccuauuuuuuuucuguuau

SEQ ID NO: 1677761 - RNA, 20 nt, Human
cucccgaauagcugggacua

SEQ ID NO: 1677762 - RNA, 23 nt, Human
cucccgaauagcugggacuacag

SEQ ID NO: 1677763 - RNA, 21 nt, Human
cucccuucaaccauuccccau

SEQ ID NO: 1677764 - RNA, 22 nt, Human
cucccuucaaccauuccccaug

SEQ ID NO: 1677765 - RNA, 23 nt, Human
cucccuucaaccauuccccaugg

SEQ ID NO: 1677766 - RNA, 15 nt, Human
cucccuucauccuuc

SEQ ID NO: 1677767 - RNA, 18 nt, Human
cucccucagucuggcccu

SEQ ID NO: 1677768 - RNA, 21 nt, Human
cuccccugcuggguguggcgc

SEQ ID NO: 1677769 - RNA, 23 nt, Human
cuccccugcuggguguggcgcag

SEQ ID NO: 1677770 - RNA, 20 nt, Human
cuccccagccccaucccaaa

SEQ ID NO: 1677771 - RNA, 14 nt, Human
cuccccucggagaa

SEQ ID NO: 1677772 - RNA, 14 nt, Human
cuccacugccuucg

SEQ ID NO: 1677773 - RNA, 15 nt, Human
cuccacugccuucga

SEQ ID NO: 1677774 - RNA, 16 nt, Human
cuccacugccuucgau

SEQ ID NO: 1677775 - RNA, 13 nt, Human
cuccacuggaugg

SEQ ID NO: 1677776 - RNA, 13 nt, Human
cuccacugccuuc

SEQ ID NO: 1677777 - RNA, 11 nt, Human
cuccagccccu

SEQ ID NO: 1677778 - RNA, 13 nt, Human
cuccagccccugg

SEQ ID NO: 1677779 - RNA, 14 nt, Human
cuccagccccugga

SEQ ID NO: 1677780 - RNA, 15 nt, Human
cuccagcucaccagc

SEQ ID NO: 1677781 - RNA, 16 nt, Human
cuccagcucaccagcc

SEQ ID NO: 1677782 - RNA, 18 nt, Human
cuccagcucaccagcccc

SEQ ID NO: 1677783 - RNA, 14 nt, Human
cuccacuggaugga

SEQ ID NO: 1677784 - RNA, 16 nt, Human
cuccagagucagaagu

SEQ ID NO: 1677785 - RNA, 12 nt, Human
cucauuuccaag

SEQ ID NO: 1677786 - RNA, 13 nt, Human
cucauuuccaagc

SEQ ID NO: 1677787 - RNA, 14 nt, Human
cucauuuccaagca

SEQ ID NO: 1677788 - RNA, 21 nt, Human
cucauuugucacacacuuugg

SEQ ID NO: 1677789 - RNA, 17 nt, Human
cucauuuccaagcaagu

SEQ ID NO: 1677790 - RNA, 22 nt, Human
cucauucuccuuguguuacuaa

SEQ ID NO: 1677791 - RNA, 18 nt, Human
cucauucuccuuguguua

SEQ ID NO: 1677792 - RNA, 12 nt, Human
cucauucuucug

SEQ ID NO: 1677793 - RNA, 17 nt, Human
cucauugaccugaggcc

SEQ ID NO: 1677794 - RNA, 19 nt, Human
cucauugaccugaggcccu

SEQ ID NO: 1677795 - RNA, 21 nt, Human
cucauugaccugaggcccuuc

SEQ ID NO: 1677796 - RNA, 11 nt, Human
cuauugguaaa

SEQ ID NO: 1677797 - RNA, 16 nt, Human
cuauugcugcuugagg

SEQ ID NO: 1677798 - RNA, 17 nt, Human
cucacagaacccuugga

SEQ ID NO: 1677799 - RNA, 14 nt, Human
cucaaguccucuuu

SEQ ID NO: 1677800 - RNA, 23 nt, Human
cucacacggacacucaaaagcug

SEQ ID NO: 1677801 - RNA, 19 nt, Human
cucaacucuccuccagagu

SEQ ID NO: 1677802 - RNA, 16 nt, Human
cucaacucuccuccag

SEQ ID NO: 1677803 - RNA, 18 nt, Human
cucaacucuccuccagag

SEQ ID NO: 1677804 - RNA, 19 nt, Human
cuauuucuauauuuucauu

SEQ ID NO: 1677805 - RNA, 20 nt, Human
cuauuucuauauuuucauuc

SEQ ID NO: 1677806 - RNA, 14 nt, Human
cucaaauuucuaaa

SEQ ID NO: 1677807 - RNA, 14 nt, Human
cucaacucuccucc

SEQ ID NO: 1677808 - RNA, 18 nt, Human
cucaaccaccuuucagau

SEQ ID NO: 1677809 - RNA, 17 nt, Human
cucaaauuucuaaaucu

SEQ ID NO: 1677810 - RNA, 15 nt, Human
cucaaauuucuaaau

SEQ ID NO: 1677811 - RNA, 19 nt, Human
cuaugauuuggaaaauaaa

SEQ ID NO: 1677812 - RNA, 15 nt, Human
cuaugauuuggaaaa

SEQ ID NO: 1677813 - RNA, 22 nt, Human
cuaugaaguuuuuuuuauacag

SEQ ID NO: 1677814 - RNA, 19 nt, Human
cuaugaaauauuauguuaa

SEQ ID NO: 1677815 - RNA, 19 nt, Human
cuauagccuaggugacaga

SEQ ID NO: 1677816 - RNA, 18 nt, Human
cuauagccuaggugacag

SEQ ID NO: 1677817 - RNA, 20 nt, Human
cuauagccuaggugacagag

SEQ ID NO: 1677818 - RNA, 21 nt, Human
cuauagccuaggugacagagu

SEQ ID NO: 1677819 - RNA, 20 nt, Human
cuaggaacacuccuucacag

SEQ ID NO: 1677820 - RNA, 15 nt, Human
cuaggaagacuuugg

SEQ ID NO: 1677821 - RNA, 17 nt, Human
cuaggaagacuuuggaa

SEQ ID NO: 1677822 - RNA, 13 nt, Human
cuauaauuuaaau

SEQ ID NO: 1677823 - RNA, 12 nt, Human
cuauaauuuaaa

SEQ ID NO: 1677824 - RNA, 23 nt, Human
cuauucaguaauaacucuacccu

SEQ ID NO: 1677825 - RNA, 18 nt, Human
cuaugcugaguuugugcu

SEQ ID NO: 1677826 - RNA, 14 nt, Human
cuaugcugaguuug

SEQ ID NO: 1677827 - RNA, 15 nt, Human
cuaugcugaguuugu

SEQ ID NO: 1677828 - RNA, 13 nt, Human
cuaugcugaguuu

SEQ ID NO: 1677829 - RNA, 19 nt, Human
cuaugggggcacugaggac

SEQ ID NO: 1677830 - RNA, 13 nt, Human
cuauguaucaaug

SEQ ID NO: 1677831 - RNA, 16 nt, Human
cuauguaucaaugagu

SEQ ID NO: 1677832 - RNA, 17 nt, Human
cuauucaguaauaacuc

SEQ ID NO: 1677833 - RNA, 12 nt, Human
cuacucuguguc

SEQ ID NO: 1677834 - RNA, 13 nt, Human
cuacucuguguca

SEQ ID NO: 1677835 - RNA, 19 nt, Human
cuacuguccuacccacccu

SEQ ID NO: 1677836 - RNA, 21 nt, Human
cuaccgagucucuucuccacu

SEQ ID NO: 1677837 - RNA, 22 nt, Human
cuaccgagucucuucuccacug

SEQ ID NO: 1677838 - RNA, 23 nt, Human
cuaccgagucucuucuccacugg

SEQ ID NO: 1677839 - RNA, 17 nt, Human
cuaccgagucucuucuc

SEQ ID NO: 1677840 - RNA, 19 nt, Human
cuaccgagucucuucucca

SEQ ID NO: 1677841 - RNA, 15 nt, Human
cuacucgaguuacag

SEQ ID NO: 1677842 - RNA, 16 nt, Human
cuacucgaguuacaga

SEQ ID NO: 1677843 - RNA, 19 nt, Human
cuacucgaguuacagacaa

SEQ ID NO: 1677844 - RNA, 14 nt, Human
cuagacuggugacu

SEQ ID NO: 1677845 - RNA, 15 nt, Human
cuagacuggugacug

SEQ ID NO: 1677846 - RNA, 17 nt, Human
cuagacuggugacugau

SEQ ID NO: 1677847 - RNA, 18 nt, Human
cuagacuggugacugauu

SEQ ID NO: 1677848 - RNA, 19 nt, Human
cuagacuggugacugauuc

SEQ ID NO: 1677849 - RNA, 22 nt, Human
cuagacuggugacugauucuuc

SEQ ID NO: 1677850 - RNA, 23 nt, Human
cuagacuggugacugauucuuca

SEQ ID NO: 1677851 - RNA, 17 nt, Human
cuacuuagcaugucccu

SEQ ID NO: 1677852 - RNA, 22 nt, Human
cuacuuagcaugucccuaccga

SEQ ID NO: 1677853 - RNA, 20 nt, Human
cuacuguccuacccacccuc

SEQ ID NO: 1677854 - RNA, 21 nt, Human
cuagagguucaaagauauuuu

SEQ ID NO: 1677855 - RNA, 18 nt, Human
cuagagguucaaagauau

SEQ ID NO: 1677856 - RNA, 17 nt, Human
cuagagguucaaagaua

SEQ ID NO: 1677857 - RNA, 18 nt, Human
cuagaguuuagcuggaaa

SEQ ID NO: 1677858 - RNA, 19 nt, Human
cuagaguuuagcuggaaaa

SEQ ID NO: 1677859 - RNA, 15 nt, Human
cuauaggugcuacaa

SEQ ID NO: 1677860 - RNA, 14 nt, Human
cuaggaaauauuua

SEQ ID NO: 1677861 - RNA, 15 nt, Human
cuaggaaauauuuau

SEQ ID NO: 1677862 - RNA, 19 nt, Human
cuaggaaauauuuauuuua

SEQ ID NO: 1677863 - RNA, 20 nt, Human
cuaggaaauauuuauuuuaa

SEQ ID NO: 1677864 - RNA, 16 nt, Human
cuagauacuguaucau

SEQ ID NO: 1677865 - RNA, 13 nt, Human
cuagauacuguau

SEQ ID NO: 1677866 - RNA, 24 nt, Human
cuagauacuguaucaugacaaaga

SEQ ID NO: 1677867 - RNA, 21 nt, Human
cuagccugugccucugggacu

SEQ ID NO: 1677868 - RNA, 19 nt, Human
cuagccugugccucuggga

SEQ ID NO: 1677869 - RNA, 22 nt, Human
cuagccugugccucugggacug

SEQ ID NO: 1677870 - RNA, 21 nt, Human
cuagccuuagaagucacacag

SEQ ID NO: 1677871 - RNA, 22 nt, Human
cuagccuuagaagucacacagu

SEQ ID NO: 1677872 - RNA, 23 nt, Human
cuagccuuagaagucacacagua

SEQ ID NO: 1677873 - RNA, 14 nt, Human
cuacauucuguuaa

SEQ ID NO: 1677874 - RNA, 13 nt, Human
cuacauucuguua

SEQ ID NO: 1677875 - RNA, 22 nt, Human
cuacauuauaaaugucucuuua

SEQ ID NO: 1677876 - RNA, 17 nt, Human
cuacccucuuagaaaaa

SEQ ID NO: 1677877 - RNA, 18 nt, Human
cuacccagcgagcccugg

SEQ ID NO: 1677878 - RNA, 13 nt, Human
cuacccaggugcu

SEQ ID NO: 1677879 - RNA, 13 nt, Human
cuacccacccucc

SEQ ID NO: 1677880 - RNA, 15 nt, Human
cuacccagcgagccc

SEQ ID NO: 1677881 - RNA, 17 nt, Human
cuacccagcgagcccug

SEQ ID NO: 1677882 - RNA, 15 nt, Human
cuacaggcacccacc

SEQ ID NO: 1677883 - RNA, 17 nt, Human
cuacaggcacccaccau

SEQ ID NO: 1677884 - RNA, 14 nt, Human
cuacaggagugagc

SEQ ID NO: 1677885 - RNA, 15 nt, Human
cuacaggagugagca

SEQ ID NO: 1677886 - RNA, 16 nt, Human
cuacaggagugagcac

SEQ ID NO: 1677887 - RNA, 14 nt, Human
cuacaggugugagu

SEQ ID NO: 1677888 - RNA, 16 nt, Human
cuacaggugugaguca

SEQ ID NO: 1677889 - RNA, 13 nt, Human
cuacaguccuccc

SEQ ID NO: 1677890 - RNA, 18 nt, Human
cuacauggaguauauguc

SEQ ID NO: 1677891 - RNA, 20 nt, Human
cuacauggaguauaugucaa

SEQ ID NO: 1677892 - RNA, 21 nt, Human
cuacagcuaaucagcauucuc

SEQ ID NO: 1677893 - RNA, 22 nt, Human
cuacagcuaaucagcauucuca

SEQ ID NO: 1677894 - RNA, 18 nt, Human
cuacagcuaaucagcauu

SEQ ID NO: 1677895 - RNA, 19 nt, Human
cuacagcuaaucagcauuc

SEQ ID NO: 1677896 - RNA, 23 nt, Human
cuacagcuugaccgugaggccag

SEQ ID NO: 1677897 - RNA, 19 nt, Human
cuacagcuugaccgugagg

SEQ ID NO: 1677898 - RNA, 22 nt, Human
cuacagcuugaccgugaggcca

SEQ ID NO: 1677899 - RNA, 22 nt, Human
cuacagaggccaugggccuccu

SEQ ID NO: 1677900 - RNA, 18 nt, Human
cuacagaggccaugggcc

SEQ ID NO: 1677901 - RNA, 20 nt, Human
cuacagaggccaugggccuc

SEQ ID NO: 1677902 - RNA, 13 nt, Human
cuacacugugcug

SEQ ID NO: 1677903 - RNA, 14 nt, Human
cuacacugugcuga

SEQ ID NO: 1677904 - RNA, 17 nt, Human
cuacacugugcugaguc

SEQ ID NO: 1677905 - RNA, 18 nt, Human
cuacacugugcugagucu

SEQ ID NO: 1677906 - RNA, 22 nt, Human
cuaggaaauauuuauuuuaaua

SEQ ID NO: 1677907 - RNA, 23 nt, Human
cuaauagacaauuuauuauggca

SEQ ID NO: 1677908 - RNA, 19 nt, Human
cuaauagacaauuuauuau

SEQ ID NO: 1677909 - RNA, 17 nt, Human
cuaauagacaauuuauu

SEQ ID NO: 1677910 - RNA, 14 nt, Human
cuaauaaagcugug

SEQ ID NO: 1677911 - RNA, 19 nt, Human
cuaaguaaaaccacagcag

SEQ ID NO: 1677912 - RNA, 14 nt, Human
cuaaguaaaaccac

SEQ ID NO: 1677913 - RNA, 18 nt, Human
cuaaguaaaaccacagca

SEQ ID NO: 1677914 - RNA, 14 nt, Human
cuaaggacuucuuu

SEQ ID NO: 1677915 - RNA, 15 nt, Human
cuaaggacuucuuua

SEQ ID NO: 1677916 - RNA, 16 nt, Human
cuaaggacuucuuuaa

SEQ ID NO: 1677917 - RNA, 22 nt, Human
cuaaggacuucuuuaauuuugg

SEQ ID NO: 1677918 - RNA, 22 nt, Human
cuaagcuauucaguaauaacuc

SEQ ID NO: 1677919 - RNA, 21 nt, Human
cuaagcuucacuguaaaauaa

SEQ ID NO: 1677920 - RNA, 22 nt, Human
cuaauuauacccccugcaaagc

SEQ ID NO: 1677921 - RNA, 22 nt, Human
cuaaugcgcaggcuggcccugc

SEQ ID NO: 1677922 - RNA, 23 nt, Human
cuaaugcgcaggcuggcccugcc

SEQ ID NO: 1677923 - RNA, 12 nt, Human
cuaaugggacac

SEQ ID NO: 1677924 - RNA, 13 nt, Human
cuaaugggacacu

SEQ ID NO: 1677925 - RNA, 15 nt, Human
cuaaugcgcaggcug

SEQ ID NO: 1677926 - RNA, 16 nt, Human
cuaaugcgcaggcugg

SEQ ID NO: 1677927 - RNA, 19 nt, Human
cuaaugcgcaggcuggccc

SEQ ID NO: 1677928 - RNA, 20 nt, Human
cuaaugcgcaggcuggcccu

SEQ ID NO: 1677929 - RNA, 20 nt, Human
cuaaucagcauucucacucc

SEQ ID NO: 1677930 - RNA, 21 nt, Human
cuaaucagcauucucacuccu

SEQ ID NO: 1677931 - RNA, 18 nt, Human
cuaauauguaacaagcca

SEQ ID NO: 1677932 - RNA, 15 nt, Human
cuaauuccacagcug

SEQ ID NO: 1677933 - RNA, 16 nt, Human
cuaauuccacagcugc

SEQ ID NO: 1677934 - RNA, 14 nt, Human
cuaauuccacagcu

SEQ ID NO: 1677935 - RNA, 21 nt, Human
cuacacaggggaaaagaggag

SEQ ID NO: 1677936 - RNA, 23 nt, Human
cuacacgagauacagaauuuuau

SEQ ID NO: 1677937 - RNA, 14 nt, Human
cuacacuaagagag

SEQ ID NO: 1677938 - RNA, 13 nt, Human
cguuuucaaaauu

SEQ ID NO: 1677939 - RNA, 12 nt, Human
cuaaacugcccc

SEQ ID NO: 1677940 - RNA, 13 nt, Human
cuaaacugccccc

SEQ ID NO: 1677941 - RNA, 22 nt, Human
cuaaaauggacuguggugacuu

SEQ ID NO: 1677942 - RNA, 21 nt, Human
cuaaaauggacuguggugacu

SEQ ID NO: 1677943 - RNA, 21 nt, Human
cuaaacugcccccucugcccu

SEQ ID NO: 1677944 - RNA, 17 nt, Human
cuaaauauauuuuaaga

SEQ ID NO: 1677945 - RNA, 21 nt, Human
cuaaaucuccaaaauaaaacu

SEQ ID NO: 1677946 - RNA, 22 nt, Human
cuaaaugaaaaucgugacaaca

SEQ ID NO: 1677947 - RNA, 20 nt, Human
cguuuguuccccaagacauu

SEQ ID NO: 1677948 - RNA, 23 nt, Human
cgggaggauguucugggacacag

SEQ ID NO: 1677949 - RNA, 20 nt, Human
cgggaggcagagguugcagu

SEQ ID NO: 1677950 - RNA, 12 nt, Human
cuaaccacgcug

SEQ ID NO: 1677951 - RNA, 14 nt, Human
cuaaccacgcugga

SEQ ID NO: 1677952 - RNA, 19 nt, Human
cuaaauucuuucauuuuag

SEQ ID NO: 1677953 - RNA, 19 nt, Human
cuaaauugacacuuaaaaa

SEQ ID NO: 1677954 - RNA, 16 nt, Human
cuaaauucaugcugcu

SEQ ID NO: 1677955 - RNA, 14 nt, Human
cuaagagagaauga

SEQ ID NO: 1677956 - RNA, 15 nt, Human
cuaagagagaaugag

SEQ ID NO: 1677957 - RNA, 13 nt, Human
cuaagagggaggg

SEQ ID NO: 1677958 - RNA, 15 nt, Human
cuaagagggagggag

SEQ ID NO: 1677959 - RNA, 22 nt, Human
cuaagagggagggagggcucca

SEQ ID NO: 1677960 - RNA, 23 nt, Human
cuaagagggagggagggcuccag

SEQ ID NO: 1677961 - RNA, 14 nt, Human
cccaucucuucugg

SEQ ID NO: 1677962 - RNA, 13 nt, Human
cccaguuguauuu

SEQ ID NO: 1677963 - RNA, 14 nt, Human
cccaguugggugga

SEQ ID NO: 1677964 - RNA, 19 nt, Human
cccaucucuacaaaaagca

SEQ ID NO: 1677965 - RNA, 12 nt, Human
cccaucugugaa

SEQ ID NO: 1677966 - RNA, 14 nt, Human
cccaugagccucag

SEQ ID NO: 1677967 - RNA, 18 nt, Human
cccauuauucaaaguugc

SEQ ID NO: 1677968 - RNA, 23 nt, Human
cccauuauucaaaguugccuaaa

SEQ ID NO: 1677969 - RNA, 16 nt, Human
ccccacccugccucac

SEQ ID NO: 1677970 - RNA, 15 nt, Human
ccccaccgcagacag

SEQ ID NO: 1677971 - RNA, 19 nt, Human
ccccaccgcagacaggacc

SEQ ID NO: 1677972 - RNA, 20 nt, Human
ccccuggcuuuucacugcug

SEQ ID NO: 1677973 - RNA, 22 nt, Human
ccccuggcuuuucacugcuggc

SEQ ID NO: 1677974 - RNA, 18 nt, Human
ccccuggcuuuucacugc

SEQ ID NO: 1677975 - RNA, 15 nt, Human
ccccuguucacucua

SEQ ID NO: 1677976 - RNA, 14 nt, Human
cccgacagccuggc

SEQ ID NO: 1677977 - RNA, 13 nt, Human
ccccuuccaugga

SEQ ID NO: 1677978 - RNA, 20 nt, Human
ccccuuccauggacuuuguu

SEQ ID NO: 1677979 - RNA, 15 nt, Human
cccgacagccuggca

SEQ ID NO: 1677980 - RNA, 18 nt, Human
cccgacagccuggcacag

SEQ ID NO: 1677981 - RNA, 20 nt, Human
cccgcccaggcuuagucacu

SEQ ID NO: 1677982 - RNA, 22 nt, Human
cccgcccaggcuuagucacuga

SEQ ID NO: 1677983 - RNA, 23 nt, Human
cccgcuaagagggagggagggcu

SEQ ID NO: 1677984 - RNA, 14 nt, Human
ccccugccucucug

SEQ ID NO: 1677985 - RNA, 15 nt, Human
ccccugccucucugc

SEQ ID NO: 1677986 - RNA, 16 nt, Human
ccccugccucucugca

SEQ ID NO: 1677987 - RNA, 17 nt, Human
ccccugccucucugcag

SEQ ID NO: 1677988 - RNA, 19 nt, Human
ccccugccucucugcaggu

SEQ ID NO: 1677989 - RNA, 13 nt, Human
ccccucugcccug

SEQ ID NO: 1677990 - RNA, 14 nt, Human
ccccucugcccugc

SEQ ID NO: 1677991 - RNA, 12 nt, Human
ccccucugcccu

SEQ ID NO: 1677992 - RNA, 17 nt, Human
ccccugcccggcugcgg

SEQ ID NO: 1677993 - RNA, 19 nt, Human
ccccugcccggcugcggaa

SEQ ID NO: 1677994 - RNA, 14 nt, Human
ccccugcugggugu

SEQ ID NO: 1677995 - RNA, 17 nt, Human
ccccugcuggguguggc

SEQ ID NO: 1677996 - RNA, 11 nt, Human
ccccugcuggu

SEQ ID NO: 1677997 - RNA, 13 nt, Human
ccccugcugguuc

SEQ ID NO: 1677998 - RNA, 15 nt, Human
ccccugcugguucag

SEQ ID NO: 1677999 - RNA, 20 nt, Human
ccccugcugguucaggguug

SEQ ID NO: 1678000 - RNA, 15 nt, Human
ccccuggaugcagcc

SEQ ID NO: 1678001 - RNA, 18 nt, Human
ccccuggaugcagccuca

SEQ ID NO: 1678002 - RNA, 19 nt, Human
ccccuggaugcagccucac

SEQ ID NO: 1678003 - RNA, 15 nt, Human
cccccacuggugaca

SEQ ID NO: 1678004 - RNA, 11 nt, Human
cccccacuggu

SEQ ID NO: 1678005 - RNA, 13 nt, Human
cccccacugguga

SEQ ID NO: 1678006 - RNA, 17 nt, Human
ccccaucauugguaccc

SEQ ID NO: 1678007 - RNA, 14 nt, Human
ccccauccucugua

SEQ ID NO: 1678008 - RNA, 24 nt, Human
cccccacccaagggccuggccuga

SEQ ID NO: 1678009 - RNA, 17 nt, Human
ccccauccucuguacag

SEQ ID NO: 1678010 - RNA, 13 nt, Human
cccccacccaagg

SEQ ID NO: 1678011 - RNA, 22 nt, Human
ccccauaauuuuuuuuuuccuu

SEQ ID NO: 1678012 - RNA, 14 nt, Human
ccccagugcccaca

SEQ ID NO: 1678013 - RNA, 15 nt, Human
ccccagugcccacag

SEQ ID NO: 1678014 - RNA, 16 nt, Human
ccccagugcccacagg

SEQ ID NO: 1678015 - RNA, 20 nt, Human
ccccagugcccacaggauca

SEQ ID NO: 1678016 - RNA, 15 nt, Human
ccccucaacaccucu

SEQ ID NO: 1678017 - RNA, 16 nt, Human
ccccucaacaccucug

SEQ ID NO: 1678018 - RNA, 23 nt, Human
ccccucaacucuccuccagaguc

SEQ ID NO: 1678019 - RNA, 12 nt, Human
cccccagccugc

SEQ ID NO: 1678020 - RNA, 12 nt, Human
cccccucuggcu

SEQ ID NO: 1678021 - RNA, 19 nt, Human
cccccucuggcuccagcug

SEQ ID NO: 1678022 - RNA, 21 nt, Human
cccccucuggcuccagcuggc

SEQ ID NO: 1678023 - RNA, 17 nt, Human
cccccugacaacacuca

SEQ ID NO: 1678024 - RNA, 21 nt, Human
cccccugcaaagcccagcuug

SEQ ID NO: 1678025 - RNA, 18 nt, Human
cccccugcaaagcccagc

SEQ ID NO: 1678026 - RNA, 19 nt, Human
cccccugcaaagcccagcu

SEQ ID NO: 1678027 - RNA, 19 nt, Human
cccccugacaacacucauu

SEQ ID NO: 1678028 - RNA, 20 nt, Human
ccccucauagcccucacccu

SEQ ID NO: 1678029 - RNA, 23 nt, Human
ccccuccaaucccaccaacccuc

SEQ ID NO: 1678030 - RNA, 16 nt, Human
ccccucagggucccug

SEQ ID NO: 1678031 - RNA, 15 nt, Human
ccccucccuucaacc

SEQ ID NO: 1678032 - RNA, 12 nt, Human
ccccuccaugug

SEQ ID NO: 1678033 - RNA, 22 nt, Human
ccccuccuccuggacuccugca

SEQ ID NO: 1678034 - RNA, 18 nt, Human
ccccuccuccuggacucc

SEQ ID NO: 1678035 - RNA, 15 nt, Human
ccccuccucucugcc

SEQ ID NO: 1678036 - RNA, 17 nt, Human
ccccuccucucugcccu

SEQ ID NO: 1678037 - RNA, 17 nt, Human
ccccuccucugcuugcc

SEQ ID NO: 1678038 - RNA, 14 nt, Human
ccccuccucugcuu

SEQ ID NO: 1678039 - RNA, 13 nt, Human
ccccuccucugcu

SEQ ID NO: 1678040 - RNA, 15 nt, Human
ccccucggagaagag

SEQ ID NO: 1678041 - RNA, 16 nt, Human
cccuggugcugccaca

SEQ ID NO: 1678042 - RNA, 13 nt, Human
cccugccucucug

SEQ ID NO: 1678043 - RNA, 14 nt, Human
cccugccucucugc

SEQ ID NO: 1678044 - RNA, 14 nt, Human
cccugccuccuuug

SEQ ID NO: 1678045 - RNA, 11 nt, Human
cccugccuccu

SEQ ID NO: 1678046 - RNA, 12 nt, Human
cccugaggccca

SEQ ID NO: 1678047 - RNA, 19 nt, Human
cccugcgggucacaggagg

SEQ ID NO: 1678048 - RNA, 21 nt, Human
cccugcgggucacaggaggga

SEQ ID NO: 1678049 - RNA, 15 nt, Human
cccugccucucugca

SEQ ID NO: 1678050 - RNA, 16 nt, Human
cccugccucucugcag

SEQ ID NO: 1678051 - RNA, 23 nt, Human
cccugcugagucccaggcugagc

SEQ ID NO: 1678052 - RNA, 21 nt, Human
cccugcugagucccaggcuga

SEQ ID NO: 1678053 - RNA, 22 nt, Human
cccugcucuccgaccagacacc

SEQ ID NO: 1678054 - RNA, 21 nt, Human
cccugcucuccgaccagacac

SEQ ID NO: 1678055 - RNA, 15 nt, Human
cccuggugcugccac

SEQ ID NO: 1678056 - RNA, 13 nt, Human
cccuguucuggca

SEQ ID NO: 1678057 - RNA, 14 nt, Human
cccuguucuggcag

SEQ ID NO: 1678058 - RNA, 19 nt, Human
cccuguuuguuucugaaag

SEQ ID NO: 1678059 - RNA, 17 nt, Human
cccuuaccugccaggaa

SEQ ID NO: 1678060 - RNA, 20 nt, Human
cccuuaccugccaggaagcc

SEQ ID NO: 1678061 - RNA, 23 nt, Human
cccuuaccugccaggaagccagc

SEQ ID NO: 1678062 - RNA, 14 nt, Human
cccugcuuucagau

SEQ ID NO: 1678063 - RNA, 21 nt, Human
cccuggugaccagcaccaucu

SEQ ID NO: 1678064 - RNA, 13 nt, Human
cccuggugcugcc

SEQ ID NO: 1678065 - RNA, 14 nt, Human
cccuggugcugcca

SEQ ID NO: 1678066 - RNA, 21 nt, Human
cccugguggcagcucaccucu

SEQ ID NO: 1678067 - RNA, 13 nt, Human
cccugguggcagu

SEQ ID NO: 1678068 - RNA, 14 nt, Human
cccugguggcagug

SEQ ID NO: 1678069 - RNA, 15 nt, Human
cccugguggcagugg

SEQ ID NO: 1678070 - RNA, 14 nt, Human
cccuucaaccauuc

SEQ ID NO: 1678071 - RNA, 18 nt, Human
cccuucaaccauucccca

SEQ ID NO: 1678072 - RNA, 20 nt, Human
cccuuccaugucgccucugc

SEQ ID NO: 1678073 - RNA, 12 nt, Human
cccuuccaugga

SEQ ID NO: 1678074 - RNA, 23 nt, Human
cccuuagcagggaaacagcuaau

SEQ ID NO: 1678075 - RNA, 20 nt, Human
cccuuagaaguuuguuguga

SEQ ID NO: 1678076 - RNA, 14 nt, Human
cccuuagcagggaa

SEQ ID NO: 1678077 - RNA, 15 nt, Human
cccuuacgugagucc

SEQ ID NO: 1678078 - RNA, 17 nt, Human
cccuuacgugaguccug

SEQ ID NO: 1678079 - RNA, 15 nt, Human
cccuugaugaagaag

SEQ ID NO: 1678080 - RNA, 15 nt, Human
cccgcucagcccucc

SEQ ID NO: 1678081 - RNA, 12 nt, Human
cccgcucagccc

SEQ ID NO: 1678082 - RNA, 13 nt, Human
cccgcucagcccu

SEQ ID NO: 1678083 - RNA, 14 nt, Human
cccgcucagcccuc

SEQ ID NO: 1678084 - RNA, 23 nt, Human
cccucccucuuucccucccuucc

SEQ ID NO: 1678085 - RNA, 14 nt, Human
cccucccugccccu

SEQ ID NO: 1678086 - RNA, 12 nt, Human
cccucuuucccu

SEQ ID NO: 1678087 - RNA, 17 nt, Human
cccucuuucccucccuu

SEQ ID NO: 1678088 - RNA, 20 nt, Human
cccucuuucccucccuuccu

SEQ ID NO: 1678089 - RNA, 12 nt, Human
cccucuggcucc

SEQ ID NO: 1678090 - RNA, 16 nt, Human
cccucuggcuccagcu

SEQ ID NO: 1678091 - RNA, 17 nt, Human
cccucuggcuccagcug

SEQ ID NO: 1678092 - RNA, 22 nt, Human
cccucuggcuccagcuggccgg

SEQ ID NO: 1678093 - RNA, 20 nt, Human
cccucuguucugcacacagc

SEQ ID NO: 1678094 - RNA, 21 nt, Human
cccucuguucugcacacagca

SEQ ID NO: 1678095 - RNA, 12 nt, Human
cccucuggggcu

SEQ ID NO: 1678096 - RNA, 22 nt, Human
cccucuccugggcagcugccuc

SEQ ID NO: 1678097 - RNA, 21 nt, Human
cccucuccugggcagcugccu

SEQ ID NO: 1678098 - RNA, 20 nt, Human
cccucuccugggcagcugcc

SEQ ID NO: 1678099 - RNA, 12 nt, Human
cccucugcccug

SEQ ID NO: 1678100 - RNA, 13 nt, Human
cccucugcccugc

SEQ ID NO: 1678101 - RNA, 14 nt, Human
cccucugcccugcg

SEQ ID NO: 1678102 - RNA, 19 nt, Human
cccucugcccacucccugc

SEQ ID NO: 1678103 - RNA, 15 nt, Human
cccucugcccacucc

SEQ ID NO: 1678104 - RNA, 18 nt, Human
cccucugcccacucccug

SEQ ID NO: 1678105 - RNA, 11 nt, Human
cccucugccca

SEQ ID NO: 1678106 - RNA, 23 nt, Human
cccucuccugggcagcugccucc

SEQ ID NO: 1678107 - RNA, 18 nt, Human
ccgagauagccaaggcca

SEQ ID NO: 1678108 - RNA, 21 nt, Human
ccgagauugcaccacugcacu

SEQ ID NO: 1678109 - RNA, 15 nt, Human
ccgagauugcaccac

SEQ ID NO: 1678110 - RNA, 19 nt, Human
ccgagauugcaccacugca

SEQ ID NO: 1678111 - RNA, 15 nt, Human
ccgcagacaggacca

SEQ ID NO: 1678112 - RNA, 19 nt, Human
ccgagucucuucuccacug

SEQ ID NO: 1678113 - RNA, 20 nt, Human
ccgagucucuucuccacugg

SEQ ID NO: 1678114 - RNA, 21 nt, Human
ccgagucucuucuccacugga

SEQ ID NO: 1678115 - RNA, 23 nt, Human
ccgcacugggcuuggggaccaga

SEQ ID NO: 1678116 - RNA, 19 nt, Human
ccgagcuuugaaaauucag

SEQ ID NO: 1678117 - RNA, 20 nt, Human
ccgaguagcugagauuauag

SEQ ID NO: 1678118 - RNA, 14 nt, Human
ccgagucucuucuc

SEQ ID NO: 1678119 - RNA, 16 nt, Human
ccgagucucuucucca

SEQ ID NO: 1678120 - RNA, 18 nt, Human
ccgagucucuucuccacu

SEQ ID NO: 1678121 - RNA, 14 nt, Human
ccgaguagcuggga

SEQ ID NO: 1678122 - RNA, 16 nt, Human
ccgaguagcugggacu

SEQ ID NO: 1678123 - RNA, 15 nt, Human
ccggaggggccuggc

SEQ ID NO: 1678124 - RNA, 16 nt, Human
ccggaggggccuggca

SEQ ID NO: 1678125 - RNA, 14 nt, Human
ccggaggggccugg

SEQ ID NO: 1678126 - RNA, 14 nt, Human
ccgcuggggccagu

SEQ ID NO: 1678127 - RNA, 11 nt, Human
ccgcuggggcc

SEQ ID NO: 1678128 - RNA, 18 nt, Human
ccgugaggccagagacac

SEQ ID NO: 1678129 - RNA, 22 nt, Human
ccgggcucugccucccaucacc

SEQ ID NO: 1678130 - RNA, 18 nt, Human
ccgggcucugccucccau

SEQ ID NO: 1678131 - RNA, 14 nt, Human
ccgggcucugccuc

SEQ ID NO: 1678132 - RNA, 15 nt, Human
ccgggcucugccucc

SEQ ID NO: 1678133 - RNA, 16 nt, Human
ccggcuccaggcuccu

SEQ ID NO: 1678134 - RNA, 21 nt, Human
ccggcuccaggcuccuuuagc

SEQ ID NO: 1678135 - RNA, 22 nt, Human
ccgggcacucagaagacacuga

SEQ ID NO: 1678136 - RNA, 13 nt, Human
ccgggccacagag

SEQ ID NO: 1678137 - RNA, 14 nt, Human
ccguggcuucccgc

SEQ ID NO: 1678138 - RNA, 19 nt, Human
ccuaccgagucucuucucc

SEQ ID NO: 1678139 - RNA, 20 nt, Human
ccuaccgagucucuucucca

SEQ ID NO: 1678140 - RNA, 21 nt, Human
ccuaccgagucucuucuccac

SEQ ID NO: 1678141 - RNA, 16 nt, Human
ccuaccgagucucuuc

SEQ ID NO: 1678142 - RNA, 17 nt, Human
ccuaccgagucucuucu

SEQ ID NO: 1678143 - RNA, 21 nt, Human
ccuacaguugaaaaacagcug

SEQ ID NO: 1678144 - RNA, 11 nt, Human
ccguggcuucc

SEQ ID NO: 1678145 - RNA, 15 nt, Human
ccuaacgaaguaucc

SEQ ID NO: 1678146 - RNA, 19 nt, Human
ccagccugagcgacaguga

SEQ ID NO: 1678147 - RNA, 23 nt, Human
ccagccuugaccauucuccaccu

SEQ ID NO: 1678148 - RNA, 13 nt, Human
ccagcgagcccug

SEQ ID NO: 1678149 - RNA, 13 nt, Human
ccagccuggguga

SEQ ID NO: 1678150 - RNA, 19 nt, Human
ccagcaggcucucaggcca

SEQ ID NO: 1678151 - RNA, 20 nt, Human
ccagcaggcucucaggccag

SEQ ID NO: 1678152 - RNA, 21 nt, Human
ccagcaggcucucaggccagc

SEQ ID NO: 1678153 - RNA, 23 nt, Human
ccagcaggcucucaggccagcug

SEQ ID NO: 1678154 - RNA, 16 nt, Human
ccagcccacuucugcc

SEQ ID NO: 1678155 - RNA, 17 nt, Human
ccagcccacuucugcca

SEQ ID NO: 1678156 - RNA, 17 nt, Human
ccagccgagauagccaa

SEQ ID NO: 1678157 - RNA, 20 nt, Human
ccagccgagauagccaaggc

SEQ ID NO: 1678158 - RNA, 22 nt, Human
ccagccgagauagccaaggcca

SEQ ID NO: 1678159 - RNA, 23 nt, Human
ccagccgagauagccaaggccaa

SEQ ID NO: 1678160 - RNA, 19 nt, Human
ccagccccaaaacucuccu

SEQ ID NO: 1678161 - RNA, 24 nt, Human
ccagauuuuuuacagcugccugca

SEQ ID NO: 1678162 - RNA, 17 nt, Human
ccagcaccaucucuccu

SEQ ID NO: 1678163 - RNA, 18 nt, Human
ccagcaccaucucuccuc

SEQ ID NO: 1678164 - RNA, 16 nt, Human
ccagcaggcucucagg

SEQ ID NO: 1678165 - RNA, 17 nt, Human
ccagcaggcucucaggc

SEQ ID NO: 1678166 - RNA, 18 nt, Human
ccagcaggcucucaggcc

SEQ ID NO: 1678167 - RNA, 17 nt, Human
ccagcaagugagagcug

SEQ ID NO: 1678168 - RNA, 18 nt, Human
ccagcaagugagagcugg

SEQ ID NO: 1678169 - RNA, 19 nt, Human
ccagcaagugagagcuggg

SEQ ID NO: 1678170 - RNA, 14 nt, Human
ccagagcccaccuu

SEQ ID NO: 1678171 - RNA, 14 nt, Human
ccagauugcaacag

SEQ ID NO: 1678172 - RNA, 16 nt, Human
ccagauugcaacaggc

SEQ ID NO: 1678173 - RNA, 23 nt, Human
ccagauugcaacaggcugggcuu

SEQ ID NO: 1678174 - RNA, 18 nt, Human
ccagauugcaacaggcug

SEQ ID NO: 1678175 - RNA, 22 nt, Human
ccagauugcaacaggcugggcu

SEQ ID NO: 1678176 - RNA, 18 nt, Human
ccagauuucacucuccuu

SEQ ID NO: 1678177 - RNA, 19 nt, Human
ccagauuucacucuccuug

SEQ ID NO: 1678178 - RNA, 15 nt, Human
ccagauuucacucuc

SEQ ID NO: 1678179 - RNA, 18 nt, Human
ccagagaguggcuccucc

SEQ ID NO: 1678180 - RNA, 22 nt, Human
ccagagaguggcuccucccggu

SEQ ID NO: 1678181 - RNA, 15 nt, Human
ccagagaguggcucc

SEQ ID NO: 1678182 - RNA, 16 nt, Human
ccagagaguggcuccu

SEQ ID NO: 1678183 - RNA, 14 nt, Human
ccagagaguggcuc

SEQ ID NO: 1678184 - RNA, 16 nt, Human
ccagacccggcugcgu

SEQ ID NO: 1678185 - RNA, 14 nt, Human
ccagacccggcugc

SEQ ID NO: 1678186 - RNA, 15 nt, Human
ccagacccggcugcg

SEQ ID NO: 1678187 - RNA, 22 nt, Human
ccagacacauguccaagaagcc

SEQ ID NO: 1678188 - RNA, 17 nt, Human
ccagacacauguccaag

SEQ ID NO: 1678189 - RNA, 20 nt, Human
ccagacacauguccaagaag

SEQ ID NO: 1678190 - RNA, 24 nt, Human
ccagaccccuggcuuuucacugcu

SEQ ID NO: 1678191 - RNA, 14 nt, Human
ccagacaucaacag

SEQ ID NO: 1678192 - RNA, 18 nt, Human
ccagaaaccuuuguuugc

SEQ ID NO: 1678193 - RNA, 22 nt, Human
ccagaagaaaauagugguguga

SEQ ID NO: 1678194 - RNA, 19 nt, Human
ccacugugccaugugccag

SEQ ID NO: 1678195 - RNA, 15 nt, Human
ccacugugccaugug

SEQ ID NO: 1678196 - RNA, 16 nt, Human
ccacugugccaugugc

SEQ ID NO: 1678197 - RNA, 13 nt, Human
ccacugccucuuc

SEQ ID NO: 1678198 - RNA, 16 nt, Human
ccacugccucuuccuc

SEQ ID NO: 1678199 - RNA, 14 nt, Human
ccaccuucccaugc

SEQ ID NO: 1678200 - RNA, 21 nt, Human
ccacugcaucguuucaucuuc

SEQ ID NO: 1678201 - RNA, 23 nt, Human
ccacugcaucguuucaucuucca

SEQ ID NO: 1678202 - RNA, 22 nt, Human
ccacugcuuuuggucuguguga

SEQ ID NO: 1678203 - RNA, 21 nt, Human
ccacugccuucgauacaccgg

SEQ ID NO: 1678204 - RNA, 20 nt, Human
ccacugcuuuuggucugugu

SEQ ID NO: 1678205 - RNA, 12 nt, Human
ccacugcucugg

SEQ ID NO: 1678206 - RNA, 13 nt, Human
ccacugcucuggu

SEQ ID NO: 1678207 - RNA, 15 nt, Human
ccacugcucugguua

SEQ ID NO: 1678208 - RNA, 14 nt, Human
ccacugugaagaga

SEQ ID NO: 1678209 - RNA, 15 nt, Human
ccacugugaagagaa

SEQ ID NO: 1678210 - RNA, 23 nt, Human
ccacuggugacaugucuuuucuu

SEQ ID NO: 1678211 - RNA, 15 nt, Human
ccacugguucuucuu

SEQ ID NO: 1678212 - RNA, 13 nt, Human
ccaccuuggcuca

SEQ ID NO: 1678213 - RNA, 14 nt, Human
ccacccuccuuuca

SEQ ID NO: 1678214 - RNA, 19 nt, Human
ccacccccacccaagggcc

SEQ ID NO: 1678215 - RNA, 14 nt, Human
ccaccuggccucug

SEQ ID NO: 1678216 - RNA, 13 nt, Human
ccaccuggccucu

SEQ ID NO: 1678217 - RNA, 20 nt, Human
ccaccuggccucugcacucc

SEQ ID NO: 1678218 - RNA, 13 nt, Human
ccaccugccaggg

SEQ ID NO: 1678219 - RNA, 14 nt, Human
ccaccugccaggga

SEQ ID NO: 1678220 - RNA, 15 nt, Human
ccaccugccagggac

SEQ ID NO: 1678221 - RNA, 16 nt, Human
ccaccugccagggaca

SEQ ID NO: 1678222 - RNA, 14 nt, Human
ccaccucucucacu

SEQ ID NO: 1678223 - RNA, 16 nt, Human
ccaccucucucacucc

SEQ ID NO: 1678224 - RNA, 19 nt, Human
ccaccucucucacuccuug

SEQ ID NO: 1678225 - RNA, 20 nt, Human
ccaccucucucacuccuuga

SEQ ID NO: 1678226 - RNA, 21 nt, Human
ccaccucccugcaauaaaaug

SEQ ID NO: 1678227 - RNA, 19 nt, Human
ccaccucccugcaauaaaa

SEQ ID NO: 1678228 - RNA, 11 nt, Human
ccacccugcuc

SEQ ID NO: 1678229 - RNA, 12 nt, Human
ccacccugcucu

SEQ ID NO: 1678230 - RNA, 15 nt, Human
ccaccucccugcaau

SEQ ID NO: 1678231 - RNA, 14 nt, Human
cccacgcuggagug

SEQ ID NO: 1678232 - RNA, 16 nt, Human
cccaccuuggcugcag

SEQ ID NO: 1678233 - RNA, 17 nt, Human
cccacgcccccacuggu

SEQ ID NO: 1678234 - RNA, 19 nt, Human
cccacgcccccacugguga

SEQ ID NO: 1678235 - RNA, 15 nt, Human
cccaccuuggcucaa

SEQ ID NO: 1678236 - RNA, 22 nt, Human
cccaccuuggcucaaguccucu

SEQ ID NO: 1678237 - RNA, 14 nt, Human
cccaccuuggcugc

SEQ ID NO: 1678238 - RNA, 15 nt, Human
cccaccuuggcugca

SEQ ID NO: 1678239 - RNA, 12 nt, Human
cccaccucagcc

SEQ ID NO: 1678240 - RNA, 14 nt, Human
cccaccucagccuc

SEQ ID NO: 1678241 - RNA, 15 nt, Human
cccaccucagccucc

SEQ ID NO: 1678242 - RNA, 17 nt, Human
cccaccucagccucccg

SEQ ID NO: 1678243 - RNA, 19 nt, Human
cccaccucucucacuccuu

SEQ ID NO: 1678244 - RNA, 12 nt, Human
cccaccuuggcu

SEQ ID NO: 1678245 - RNA, 21 nt, Human
cccaccucagccucccaaagu

SEQ ID NO: 1678246 - RNA, 13 nt, Human
cccaccucucuca

SEQ ID NO: 1678247 - RNA, 14 nt, Human
cccaccucucucac

SEQ ID NO: 1678248 - RNA, 17 nt, Human
cccaccucucucacucc

SEQ ID NO: 1678249 - RNA, 20 nt, Human
ccauuuugcugucccuuuuc

SEQ ID NO: 1678250 - RNA, 21 nt, Human
ccauuuuguauuuuacuaaua

SEQ ID NO: 1678251 - RNA, 12 nt, Human
cccaagggccug

SEQ ID NO: 1678252 - RNA, 14 nt, Human
cccaagggccuggc

SEQ ID NO: 1678253 - RNA, 17 nt, Human
cccaagggccuggccug

SEQ ID NO: 1678254 - RNA, 16 nt, Human
cccaagggccuggccu

SEQ ID NO: 1678255 - RNA, 19 nt, Human
cccacauagugaugguucc

SEQ ID NO: 1678256 - RNA, 16 nt, Human
cccacaggcccuuccu

SEQ ID NO: 1678257 - RNA, 18 nt, Human
cccacaggcccuuccucu

SEQ ID NO: 1678258 - RNA, 17 nt, Human
cccacaggaucagucug

SEQ ID NO: 1678259 - RNA, 13 nt, Human
cccacaggaucag

SEQ ID NO: 1678260 - RNA, 11 nt, Human
ccauuauucaa

SEQ ID NO: 1678261 - RNA, 18 nt, Human
ccauguuuuguuuacggu

SEQ ID NO: 1678262 - RNA, 14 nt, Human
ccauucuccaccug

SEQ ID NO: 1678263 - RNA, 13 nt, Human
ccauuuggaaauc

SEQ ID NO: 1678264 - RNA, 13 nt, Human
ccauuugcuccuu

SEQ ID NO: 1678265 - RNA, 16 nt, Human
ccauucugccugccca

SEQ ID NO: 1678266 - RNA, 15 nt, Human
ccauucugccugccc

SEQ ID NO: 1678267 - RNA, 21 nt, Human
ccaggcugggucgcccuggac

SEQ ID NO: 1678268 - RNA, 22 nt, Human
ccaggcugggucgcccuggacu

SEQ ID NO: 1678269 - RNA, 23 nt, Human
ccaggcugggucgcccuggacug

SEQ ID NO: 1678270 - RNA, 24 nt, Human
ccaggcugggucgcccuggacugu

SEQ ID NO: 1678271 - RNA, 12 nt, Human
ccaggcuggguc

SEQ ID NO: 1678272 - RNA, 16 nt, Human
ccaggcugggucgccc

SEQ ID NO: 1678273 - RNA, 15 nt, Human
ccaggcccucugccc

SEQ ID NO: 1678274 - RNA, 16 nt, Human
ccaggcccucugccca

SEQ ID NO: 1678275 - RNA, 14 nt, Human
ccaggcuggucuca

SEQ ID NO: 1678276 - RNA, 21 nt, Human
ccaggcuuagucacugagaca

SEQ ID NO: 1678277 - RNA, 22 nt, Human
ccaggcuuagucacugagacag

SEQ ID NO: 1678278 - RNA, 23 nt, Human
ccaggcuuagucacugagacagc

SEQ ID NO: 1678279 - RNA, 19 nt, Human
ccaggccccugccacccug

SEQ ID NO: 1678280 - RNA, 13 nt, Human
ccaggcccucugc

SEQ ID NO: 1678281 - RNA, 14 nt, Human
ccaggcccucugcc

SEQ ID NO: 1678282 - RNA, 12 nt, Human
ccaggccagagg

SEQ ID NO: 1678283 - RNA, 14 nt, Human
ccaggccccugcca

SEQ ID NO: 1678284 - RNA, 15 nt, Human
ccaggccccugccac

SEQ ID NO: 1678285 - RNA, 16 nt, Human
ccaggccccugccacc

SEQ ID NO: 1678286 - RNA, 15 nt, Human
ccaggaggccagccu

SEQ ID NO: 1678287 - RNA, 18 nt, Human
ccaggaggccagccuuga

SEQ ID NO: 1678288 - RNA, 20 nt, Human
ccaggaggccagccuugacc

SEQ ID NO: 1678289 - RNA, 23 nt, Human
ccagugcccacaggaucagucug

SEQ ID NO: 1678290 - RNA, 20 nt, Human
ccagguagaggguguguaag

SEQ ID NO: 1678291 - RNA, 19 nt, Human
ccauauuaccacagacaua

SEQ ID NO: 1678292 - RNA, 16 nt, Human
ccaucaagccaccaac

SEQ ID NO: 1678293 - RNA, 13 nt, Human
ccaucaagccacc

SEQ ID NO: 1678294 - RNA, 14 nt, Human
ccaucaagccacca

SEQ ID NO: 1678295 - RNA, 12 nt, Human
ccaucaugucug

SEQ ID NO: 1678296 - RNA, 13 nt, Human
ccaucaugucugg

SEQ ID NO: 1678297 - RNA, 12 nt, Human
ccaucauugaaa

SEQ ID NO: 1678298 - RNA, 15 nt, Human
ccauaugccugggca

SEQ ID NO: 1678299 - RNA, 13 nt, Human
ccauaugccuggg

SEQ ID NO: 1678300 - RNA, 14 nt, Human
ccagugugacaagg

SEQ ID NO: 1678301 - RNA, 23 nt, Human
ccagugugacaaggauugcuacu

SEQ ID NO: 1678302 - RNA, 14 nt, Human
ccaucucacacaug

SEQ ID NO: 1678303 - RNA, 15 nt, Human
ccaucucacacauga

SEQ ID NO: 1678304 - RNA, 17 nt, Human
ccaucucacacaugagc

SEQ ID NO: 1678305 - RNA, 18 nt, Human
ccaucucacacaugagca

SEQ ID NO: 1678306 - RNA, 20 nt, Human
ccaucucacacaugagcauc

SEQ ID NO: 1678307 - RNA, 21 nt, Human
ccaucucacacaugagcauca

SEQ ID NO: 1678308 - RNA, 17 nt, Human
ccaucucaccuccugcu

SEQ ID NO: 1678309 - RNA, 15 nt, Human
ccaucucuccuccuu

SEQ ID NO: 1678310 - RNA, 20 nt, Human
ccauccugaggcuccacuug

SEQ ID NO: 1678311 - RNA, 14 nt, Human
ccaucauugaaauc

SEQ ID NO: 1678312 - RNA, 16 nt, Human
ccaucauugaaaucuu

SEQ ID NO: 1678313 - RNA, 17 nt, Human
ccaucauugaaaucuuu

SEQ ID NO: 1678314 - RNA, 18 nt, Human
ccauccugaggcuccacu

SEQ ID NO: 1678315 - RNA, 22 nt, Human
ccaguaaaugggggugcauuug

SEQ ID NO: 1678316 - RNA, 21 nt, Human
ccaguaaaugggggugcauuu

SEQ ID NO: 1678317 - RNA, 20 nt, Human
ccaguaaaugggggugcauu

SEQ ID NO: 1678318 - RNA, 13 nt, Human
ccagguuuaagcu

SEQ ID NO: 1678319 - RNA, 16 nt, Human
ccagguuucuaugugu

SEQ ID NO: 1678320 - RNA, 16 nt, Human
ccagguggccacucca

SEQ ID NO: 1678321 - RNA, 21 nt, Human
ccagguggccacuccagaccc

SEQ ID NO: 1678322 - RNA, 12 nt, Human
ccaggugccagu

SEQ ID NO: 1678323 - RNA, 13 nt, Human
ccaggugccaguu

SEQ ID NO: 1678324 - RNA, 13 nt, Human
ccagugaggcucu

SEQ ID NO: 1678325 - RNA, 23 nt, Human
ccaguaaaugggggugcauuuga

SEQ ID NO: 1678326 - RNA, 14 nt, Human
cacagugcaucuca

SEQ ID NO: 1678327 - RNA, 19 nt, Human
cacagugaucaaguuauuu

SEQ ID NO: 1678328 - RNA, 19 nt, Human
cacaggcagguccaggguu

SEQ ID NO: 1678329 - RNA, 22 nt, Human
cacagugagucgaggacaggga

SEQ ID NO: 1678330 - RNA, 13 nt, Human
cacaguccuuacc

SEQ ID NO: 1678331 - RNA, 15 nt, Human
cacaguccuuaccag

SEQ ID NO: 1678332 - RNA, 21 nt, Human
cacaguccuuaccagcagagc

SEQ ID NO: 1678333 - RNA, 22 nt, Human
cacaguccuuaccagcagagca

SEQ ID NO: 1678334 - RNA, 17 nt, Human
cacagugcaucucagcc

SEQ ID NO: 1678335 - RNA, 14 nt, Human
cacaguucucuccu

SEQ ID NO: 1678336 - RNA, 15 nt, Human
cacaguucucuccuu

SEQ ID NO: 1678337 - RNA, 19 nt, Human
cacaggagggagggggaag

SEQ ID NO: 1678338 - RNA, 21 nt, Human
cacaggagggagggggaaggc

SEQ ID NO: 1678339 - RNA, 14 nt, Human
cacaggagggaggg

SEQ ID NO: 1678340 - RNA, 11 nt, Human
cacaggcaggu

SEQ ID NO: 1678341 - RNA, 14 nt, Human
cacaggcaggucca

SEQ ID NO: 1678342 - RNA, 15 nt, Human
cacaggcagguccag

SEQ ID NO: 1678343 - RNA, 21 nt, Human
cacagcuucauuuccuguguc

SEQ ID NO: 1678344 - RNA, 22 nt, Human
cacagcuucauuuccugugucu

SEQ ID NO: 1678345 - RNA, 22 nt, Human
cacagcugggguggggaccuca

SEQ ID NO: 1678346 - RNA, 23 nt, Human
cacagcugggguggggaccucag

SEQ ID NO: 1678347 - RNA, 21 nt, Human
cacauagugaugguuccccug

SEQ ID NO: 1678348 - RNA, 16 nt, Human
cacaguuuucugagaa

SEQ ID NO: 1678349 - RNA, 17 nt, Human
cacaguuuucugagaaa

SEQ ID NO: 1678350 - RNA, 19 nt, Human
cacaguuuucugagaaaga

SEQ ID NO: 1678351 - RNA, 20 nt, Human
cacaguuuucugagaaagac

SEQ ID NO: 1678352 - RNA, 14 nt, Human
caaaaauauuuuau

SEQ ID NO: 1678353 - RNA, 15 nt, Human
caaaaauauuuuaug

SEQ ID NO: 1678354 - RNA, 17 nt, Human
caaaaauauuuuaugau

SEQ ID NO: 1678355 - RNA, 21 nt, Human
caaaaauauuuuaugauccag

SEQ ID NO: 1678356 - RNA, 22 nt, Human
caaaaauauuuuaugauccagc

SEQ ID NO: 1678357 - RNA, 23 nt, Human
caaaaauauuuuaugauccagca

SEQ ID NO: 1678358 - RNA, 19 nt, Human
caaaaaucucaauauuuca

SEQ ID NO: 1678359 - RNA, 23 nt, Human
caaaacucuccucugcugcuggc

SEQ ID NO: 1678360 - RNA, 22 nt, Human
caaaacucuccucugcugcugg

SEQ ID NO: 1678361 - RNA, 20 nt, Human
caaaacucuccucugcugcu

SEQ ID NO: 1678362 - RNA, 21 nt, Human
caaaacucuccucugcugcug

SEQ ID NO: 1678363 - RNA, 17 nt, Human
caaaauaaaaaugaggu

SEQ ID NO: 1678364 - RNA, 23 nt, Human
caaaacuucagacauagaauuaa

SEQ ID NO: 1678365 - RNA, 19 nt, Human
caaaaaccaguauuguaca

SEQ ID NO: 1678366 - RNA, 20 nt, Human
caaaaaccaguauuguacaa

SEQ ID NO: 1678367 - RNA, 18 nt, Human
caaaaaccaguauuguac

SEQ ID NO: 1678368 - RNA, 13 nt, Human
caaaaaggcagga

SEQ ID NO: 1678369 - RNA, 20 nt, Human
caaaaacauggccuuugcuu

SEQ ID NO: 1678370 - RNA, 15 nt, Human
caaaaacacagcaag

SEQ ID NO: 1678371 - RNA, 17 nt, Human
caaaaacacagcaaggg

SEQ ID NO: 1678372 - RNA, 13 nt, Human
caaaaacacagca

SEQ ID NO: 1678373 - RNA, 14 nt, Human
caaaaacacagcaa

SEQ ID NO: 1678374 - RNA, 22 nt, Human
auuuugggguacccacugcucu

SEQ ID NO: 1678375 - RNA, 23 nt, Human
auuuugggguacccacugcucug

SEQ ID NO: 1678376 - RNA, 16 nt, Human
caaaaaaugcuugcuu

SEQ ID NO: 1678377 - RNA, 21 nt, Human
auuuugggguacccacugcuc

SEQ ID NO: 1678378 - RNA, 13 nt, Human
auuuuccugaaaa

SEQ ID NO: 1678379 - RNA, 21 nt, Human
caaauacgugggcauucaaau

SEQ ID NO: 1678380 - RNA, 22 nt, Human
caaauacgugggcauucaaaug

SEQ ID NO: 1678381 - RNA, 20 nt, Human
caaauacgugggcauucaaa

SEQ ID NO: 1678382 - RNA, 23 nt, Human
caaagugcugggauuacaggugu

SEQ ID NO: 1678383 - RNA, 19 nt, Human
caaagugcugggauuacag

SEQ ID NO: 1678384 - RNA, 19 nt, Human
caaaggguaucaggugcug

SEQ ID NO: 1678385 - RNA, 19 nt, Human
caaauaugcaaagcacuga

SEQ ID NO: 1678386 - RNA, 21 nt, Human
caaauaugcaaagcacugacu

SEQ ID NO: 1678387 - RNA, 15 nt, Human
caaaugucuauaaac

SEQ ID NO: 1678388 - RNA, 14 nt, Human
caaaugucuauaaa

SEQ ID NO: 1678389 - RNA, 14 nt, Human
caaauuucuaaauc

SEQ ID NO: 1678390 - RNA, 12 nt, Human
caaauuucuaaa

SEQ ID NO: 1678391 - RNA, 11 nt, Human
caaauuucuaa

SEQ ID NO: 1678392 - RNA, 21 nt, Human
caaauuguaagcaugcacaaa

SEQ ID NO: 1678393 - RNA, 15 nt, Human
caaauugugugaaag

SEQ ID NO: 1678394 - RNA, 20 nt, Human
caaacccuucagugccaaaa

SEQ ID NO: 1678395 - RNA, 15 nt, Human
caaacacauacagga

SEQ ID NO: 1678396 - RNA, 16 nt, Human
caaaauuuuuucucua

SEQ ID NO: 1678397 - RNA, 21 nt, Human
caaaauuuuuucucuaggaaa

SEQ ID NO: 1678398 - RNA, 22 nt, Human
caaaauuuuuucucuaggaaau

SEQ ID NO: 1678399 - RNA, 14 nt, Human
caaaauaaaacuuu

SEQ ID NO: 1678400 - RNA, 12 nt, Human
caaaauaaaacu

SEQ ID NO: 1678401 - RNA, 15 nt, Human
caaaauguaggguua

SEQ ID NO: 1678402 - RNA, 16 nt, Human
caaaauuguuacaaau

SEQ ID NO: 1678403 - RNA, 17 nt, Human
caaagccuccuccagcc

SEQ ID NO: 1678404 - RNA, 18 nt, Human
caaagccuccuccagccg

SEQ ID NO: 1678405 - RNA, 17 nt, Human
caaacucaccugccccu

SEQ ID NO: 1678406 - RNA, 14 nt, Human
caaaggaagcacau

SEQ ID NO: 1678407 - RNA, 16 nt, Human
caaaggguaucaggug

SEQ ID NO: 1678408 - RNA, 18 nt, Human
caaaggguaucaggugcu

SEQ ID NO: 1678409 - RNA, 13 nt, Human
caaagcuaggccu

SEQ ID NO: 1678410 - RNA, 14 nt, Human
caaagcuaggccug

SEQ ID NO: 1678411 - RNA, 19 nt, Human
caaagcuaggccuggccag

SEQ ID NO: 1678412 - RNA, 15 nt, Human
caaagcuaggccugg

SEQ ID NO: 1678413 - RNA, 12 nt, Human
caaaggaagcac

SEQ ID NO: 1678414 - RNA, 13 nt, Human
caaaggaagcaca

SEQ ID NO: 1678415 - RNA, 14 nt, Human
caauaggaaaaacu

SEQ ID NO: 1678416 - RNA, 14 nt, Human
caauguucucucuu

SEQ ID NO: 1678417 - RNA, 15 nt, Human
caaugugauaaaacc

SEQ ID NO: 1678418 - RNA, 17 nt, Human
caaugugauaaaacccc

SEQ ID NO: 1678419 - RNA, 14 nt, Human
caauucuccugccu

SEQ ID NO: 1678420 - RNA, 15 nt, Human
caauucuccugccuc

SEQ ID NO: 1678421 - RNA, 16 nt, Human
caauucuccugccuca

SEQ ID NO: 1678422 - RNA, 16 nt, Human
caauuacaggaaguac

SEQ ID NO: 1678423 - RNA, 13 nt, Human
caauucuccugcc

SEQ ID NO: 1678424 - RNA, 17 nt, Human
caauuacaggaaguacu

SEQ ID NO: 1678425 - RNA, 23 nt, Human
caauucucauuugucacacacuu

SEQ ID NO: 1678426 - RNA, 17 nt, Human
caaugcacuuuguucug

SEQ ID NO: 1678427 - RNA, 22 nt, Human
caaugcacuuuguucuggcucu

SEQ ID NO: 1678428 - RNA, 20 nt, Human
caaugcacuuuguucuggcu

SEQ ID NO: 1678429 - RNA, 21 nt, Human
caaugcacuuuguucuggcuc

SEQ ID NO: 1678430 - RNA, 23 nt, Human
caaugaccuuucaauaggaaaaa

SEQ ID NO: 1678431 - RNA, 18 nt, Human
caaugacuuacuguacau

SEQ ID NO: 1678432 - RNA, 17 nt, Human
caaugacuuacuguaca

SEQ ID NO: 1678433 - RNA, 15 nt, Human
caaugacuuacugua

SEQ ID NO: 1678434 - RNA, 17 nt, Human
caauauucgcuguguca

SEQ ID NO: 1678435 - RNA, 12 nt, Human
caauaggaaaaa

SEQ ID NO: 1678436 - RNA, 13 nt, Human
caauaggaaaaac

SEQ ID NO: 1678437 - RNA, 23 nt, Human
caauacaucccuuaccugggaaa

SEQ ID NO: 1678438 - RNA, 14 nt, Human
caaguccucuuuuc

SEQ ID NO: 1678439 - RNA, 18 nt, Human
caaggguagggugggccu

SEQ ID NO: 1678440 - RNA, 19 nt, Human
caaggguagggugggccuu

SEQ ID NO: 1678441 - RNA, 20 nt, Human
caaggucauuuuuuuuaaga

SEQ ID NO: 1678442 - RNA, 14 nt, Human
caaggucauuuuuu

SEQ ID NO: 1678443 - RNA, 18 nt, Human
caaggggcccaaauucuu

SEQ ID NO: 1678444 - RNA, 17 nt, Human
caaggggcccaaauucu

SEQ ID NO: 1678445 - RNA, 12 nt, Human
caaggcugcagu

SEQ ID NO: 1678446 - RNA, 15 nt, Human
caaggcugcagugag

SEQ ID NO: 1678447 - RNA, 23 nt, Human
caaggcugucaauuacaggaagu

SEQ ID NO: 1678448 - RNA, 19 nt, Human
caaguggcucccacacccu

SEQ ID NO: 1678449 - RNA, 14 nt, Human
caaguuaaauaaau

SEQ ID NO: 1678450 - RNA, 17 nt, Human
caagugauucucaugcc

SEQ ID NO: 1678451 - RNA, 18 nt, Human
caagugauucucaugccu

SEQ ID NO: 1678452 - RNA, 20 nt, Human
caagugauucucaugccuca

SEQ ID NO: 1678453 - RNA, 21 nt, Human
caagugauucucaugccucag

SEQ ID NO: 1678454 - RNA, 18 nt, Human
caagugagagcugggugu

SEQ ID NO: 1678455 - RNA, 21 nt, Human
caaguccucuuuucugagagg

SEQ ID NO: 1678456 - RNA, 14 nt, Human
caagugagagcugg

SEQ ID NO: 1678457 - RNA, 15 nt, Human
caagugagagcuggg

SEQ ID NO: 1678458 - RNA, 17 nt, Human
caagugagagcugggug

SEQ ID NO: 1678459 - RNA, 18 nt, Human
caagccguggcuucccgc

SEQ ID NO: 1678460 - RNA, 19 nt, Human
caagcgauucuucugcuuc

SEQ ID NO: 1678461 - RNA, 14 nt, Human
caagccuggcaagg

SEQ ID NO: 1678462 - RNA, 20 nt, Human
caagcgauucuucugcuuca

SEQ ID NO: 1678463 - RNA, 22 nt, Human
caagcgauucuucugcuucagc

SEQ ID NO: 1678464 - RNA, 17 nt, Human
caagagggcacuggugg

SEQ ID NO: 1678465 - RNA, 14 nt, Human
caagcaggacaugg

SEQ ID NO: 1678466 - RNA, 18 nt, Human
caagcaggacauggacaa

SEQ ID NO: 1678467 - RNA, 21 nt, Human
caagccagauuuuccugaaaa

SEQ ID NO: 1678468 - RNA, 18 nt, Human
caaggacagccccuccuc

SEQ ID NO: 1678469 - RNA, 15 nt, Human
caaggacugcaggga

SEQ ID NO: 1678470 - RNA, 17 nt, Human
caagcuggucccacuca

SEQ ID NO: 1678471 - RNA, 19 nt, Human
caagcuggucccacucagu

SEQ ID NO: 1678472 - RNA, 22 nt, Human
caaggacugcagggacugccag

SEQ ID NO: 1678473 - RNA, 17 nt, Human
caaggcugauuaaacca

SEQ ID NO: 1678474 - RNA, 15 nt, Human
caaccuccugggcua

SEQ ID NO: 1678475 - RNA, 14 nt, Human
caaccuccugggcu

SEQ ID NO: 1678476 - RNA, 20 nt, Human
caaccuguucugcuuuccuc

SEQ ID NO: 1678477 - RNA, 19 nt, Human
caaccuucgccaccugggu

SEQ ID NO: 1678478 - RNA, 15 nt, Human
caacugaccagccuc

SEQ ID NO: 1678479 - RNA, 17 nt, Human
caacugaccagccucca

SEQ ID NO: 1678480 - RNA, 13 nt, Human
caacgucugugcc

SEQ ID NO: 1678481 - RNA, 14 nt, Human
caacgucugugcca

SEQ ID NO: 1678482 - RNA, 17 nt, Human
caacccuggcacccagg

SEQ ID NO: 1678483 - RNA, 13 nt, Human
caacccucagagc

SEQ ID NO: 1678484 - RNA, 18 nt, Human
caacccucagagccaccc

SEQ ID NO: 1678485 - RNA, 18 nt, Human
caacacucauugaccuga

SEQ ID NO: 1678486 - RNA, 20 nt, Human
caacacucauugaccugagg

SEQ ID NO: 1678487 - RNA, 22 nt, Human
caacacucauugaccugaggcc

SEQ ID NO: 1678488 - RNA, 13 nt, Human
caagagggcacug

SEQ ID NO: 1678489 - RNA, 16 nt, Human
caagagcccaggccuc

SEQ ID NO: 1678490 - RNA, 17 nt, Human
caagagcccaggccucc

SEQ ID NO: 1678491 - RNA, 14 nt, Human
caagagggcacugg

SEQ ID NO: 1678492 - RNA, 15 nt, Human
caagagggcacuggu

SEQ ID NO: 1678493 - RNA, 15 nt, Human
caagcaccuccugcc

SEQ ID NO: 1678494 - RNA, 16 nt, Human
caagcaccuccugccu

SEQ ID NO: 1678495 - RNA, 17 nt, Human
caagcaccuccugccuc

SEQ ID NO: 1678496 - RNA, 19 nt, Human
caagacgcugugcugcccu

SEQ ID NO: 1678497 - RNA, 18 nt, Human
caagacgcugugcugccc

SEQ ID NO: 1678498 - RNA, 14 nt, Human
caagagcccaggcc

SEQ ID NO: 1678499 - RNA, 15 nt, Human
caagagcccaggccu

SEQ ID NO: 1678500 - RNA, 18 nt, Human
caagacucuuuggacacu

SEQ ID NO: 1678501 - RNA, 19 nt, Human
caagacugcacaucaaaau

SEQ ID NO: 1678502 - RNA, 20 nt, Human
caagaacuuuccaggaaggc

SEQ ID NO: 1678503 - RNA, 14 nt, Human
caagaccuucuccu

SEQ ID NO: 1678504 - RNA, 16 nt, Human
caagaccuucuccuuc

SEQ ID NO: 1678505 - RNA, 17 nt, Human
caagaccuucuccuuca

SEQ ID NO: 1678506 - RNA, 18 nt, Human
caagaccuucuccuucac

SEQ ID NO: 1678507 - RNA, 16 nt, Human
caagacgcugugcugc

SEQ ID NO: 1678508 - RNA, 17 nt, Human
caagacgcugugcugcc

SEQ ID NO: 1678509 - RNA, 19 nt, Human
caacugaccagccuccaug

SEQ ID NO: 1678510 - RNA, 22 nt, Human
uuuuuagacagagucucacugu

SEQ ID NO: 1678511 - RNA, 23 nt, Human
uuuuguuuggaccaaaaaccagu

SEQ ID NO: 1678512 - RNA, 11 nt, Human
uuuuuacuaau

SEQ ID NO: 1678513 - RNA, 12 nt, Human
uuuuuaucaugu

SEQ ID NO: 1678514 - RNA, 20 nt, Human
uuuuuaucgucacugcuuaa

SEQ ID NO: 1678515 - RNA, 12 nt, Human
uuuuuauggcuu

SEQ ID NO: 1678516 - RNA, 23 nt, Human
uuuuuauacauaaacaagaccac

SEQ ID NO: 1678517 - RNA, 19 nt, Human
uuuuuauauuugaaauauu

SEQ ID NO: 1678518 - RNA, 13 nt, Human
uuuuguuucugua

SEQ ID NO: 1678519 - RNA, 12 nt, Human
uuuuguuuggac

SEQ ID NO: 1678520 - RNA, 22 nt, Human
uuuuguuuggaccaaaaaccag

SEQ ID NO: 1678521 - RNA, 12 nt, Human
uuuuguuucugu

SEQ ID NO: 1678522 - RNA, 18 nt, Human
uuuuguuguuuguuuagu

SEQ ID NO: 1678523 - RNA, 21 nt, Human
uuuuguuccacaaguuaaaua

SEQ ID NO: 1678524 - RNA, 15 nt, Human
uuuuguuccacaagu

SEQ ID NO: 1678525 - RNA, 21 nt, Human
uuuugugaugucccaacuugu

SEQ ID NO: 1678526 - RNA, 20 nt, Human
uuuugugcauuaucuagaua

SEQ ID NO: 1678527 - RNA, 17 nt, Human
uuuugugcauuaucuag

SEQ ID NO: 1678528 - RNA, 23 nt, Human
uuuugugcauuaucuagauacug

SEQ ID NO: 1678529 - RNA, 23 nt, Human
uuuugccauguuggccaggcugg

SEQ ID NO: 1678530 - RNA, 14 nt, Human
auuaagcauauauu

SEQ ID NO: 1678531 - RNA, 15 nt, Human
auuaagcauauauuu

SEQ ID NO: 1678532 - RNA, 21 nt, Human
auuaagcauauauuuuuauau

SEQ ID NO: 1678533 - RNA, 11 nt, Human
auuaaagccau

SEQ ID NO: 1678534 - RNA, 17 nt, Human
uuuugagugccuuacac

SEQ ID NO: 1678535 - RNA, 17 nt, Human
uuuugauccaagcuggu

SEQ ID NO: 1678536 - RNA, 21 nt, Human
auuagaauucuguauagauua

SEQ ID NO: 1678537 - RNA, 15 nt, Human
auuagaauucuguau

SEQ ID NO: 1678538 - RNA, 16 nt, Human
auuagaauucuguaua

SEQ ID NO: 1678539 - RNA, 17 nt, Human
auuagaauucuguauag

SEQ ID NO: 1678540 - RNA, 18 nt, Human
auuagaauucuguauaga

SEQ ID NO: 1678541 - RNA, 13 nt, Human
auuagaauucugu

SEQ ID NO: 1678542 - RNA, 14 nt, Human
auuagaauucugua

SEQ ID NO: 1678543 - RNA, 12 nt, Human
auuagaauucug

SEQ ID NO: 1678544 - RNA, 12 nt, Human
auuacuucugcu

SEQ ID NO: 1678545 - RNA, 21 nt, Human
auuacaguggggaaugaagau

SEQ ID NO: 1678546 - RNA, 15 nt, Human
auuaauaauaaauuc

SEQ ID NO: 1678547 - RNA, 14 nt, Human
auuaaguacuaugu

SEQ ID NO: 1678548 - RNA, 16 nt, Human
auuaaguacuauguau

SEQ ID NO: 1678549 - RNA, 17 nt, Human
auuacauuuguauaaaa

SEQ ID NO: 1678550 - RNA, 18 nt, Human
auuacauuuguauaaaau

SEQ ID NO: 1678551 - RNA, 20 nt, Human
auuacauuuguauaaaauaa

SEQ ID NO: 1678552 - RNA, 22 nt, Human
uuuuuauggcuuuugugcauua

SEQ ID NO: 1678553 - RNA, 21 nt, Human
uuuuuauggcuuuugugcauu

SEQ ID NO: 1678554 - RNA, 20 nt, Human
uuuuuauggcuuuugugcau

SEQ ID NO: 1678555 - RNA, 19 nt, Human
uuuuuguagagccaggguc

SEQ ID NO: 1678556 - RNA, 20 nt, Human
uuuuuguagagccagggucu

SEQ ID NO: 1678557 - RNA, 19 nt, Human
uuuuugugaaaagcuccau

SEQ ID NO: 1678558 - RNA, 21 nt, Human
auuaaguaaugauaacuggaa

SEQ ID NO: 1678559 - RNA, 23 nt, Human
auuaaguaaugauaacuggaaac

SEQ ID NO: 1678560 - RNA, 12 nt, Human
augugugugugc

SEQ ID NO: 1678561 - RNA, 23 nt, Human
auguguguuuuaaaaugagaaau

SEQ ID NO: 1678562 - RNA, 24 nt, Human
auguggaguucaucuugaauugua

SEQ ID NO: 1678563 - RNA, 20 nt, Human
auguggaguucaucuugaau

SEQ ID NO: 1678564 - RNA, 19 nt, Human
augugcuaguaauuggaaa

SEQ ID NO: 1678565 - RNA, 22 nt, Human
augugccagguuuuuggucuga

SEQ ID NO: 1678566 - RNA, 16 nt, Human
uuuuaauaauguuuca

SEQ ID NO: 1678567 - RNA, 14 nt, Human
uuuuaauaaacacu

SEQ ID NO: 1678568 - RNA, 20 nt, Human
auggggcccugccuccuuug

SEQ ID NO: 1678569 - RNA, 12 nt, Human
auggggcugcac

SEQ ID NO: 1678570 - RNA, 12 nt, Human
uuuuaauaaugu

SEQ ID NO: 1678571 - RNA, 13 nt, Human
uuuuaauaauguu

SEQ ID NO: 1678572 - RNA, 14 nt, Human
uuuuaauaauguuu

SEQ ID NO: 1678573 - RNA, 12 nt, Human
auguuaaaccau

SEQ ID NO: 1678574 - RNA, 13 nt, Human
auguuaaaccaug

SEQ ID NO: 1678575 - RNA, 20 nt, Human
auguuaaaccaugggauaaa

SEQ ID NO: 1678576 - RNA, 20 nt, Human
auguugcccuguugcugccu

SEQ ID NO: 1678577 - RNA, 20 nt, Human
auguugcccaggcaggucuu

SEQ ID NO: 1678578 - RNA, 17 nt, Human
auguugcccaggcaggu

SEQ ID NO: 1678579 - RNA, 12 nt, Human
auguugcccagg

SEQ ID NO: 1678580 - RNA, 17 nt, Human
auguugcauagaauaaa

SEQ ID NO: 1678581 - RNA, 18 nt, Human
auguugcauagaauaaaa

SEQ ID NO: 1678582 - RNA, 18 nt, Human
auguucaucaaugaauga

SEQ ID NO: 1678583 - RNA, 17 nt, Human
auguuuaguaaucauau

SEQ ID NO: 1678584 - RNA, 15 nt, Human
auguuuucaggcuag

SEQ ID NO: 1678585 - RNA, 17 nt, Human
auguuuucaggcuagau

SEQ ID NO: 1678586 - RNA, 21 nt, Human
auguuuucaggcuagauguau

SEQ ID NO: 1678587 - RNA, 23 nt, Human
auuaaaacacaacaucuuuuucu

SEQ ID NO: 1678588 - RNA, 22 nt, Human
auuaaaaaucucaaauuucuaa

SEQ ID NO: 1678589 - RNA, 20 nt, Human
auuaaaaaucucaaauuucu

SEQ ID NO: 1678590 - RNA, 19 nt, Human
auuaaaaaucucaaauuuc

SEQ ID NO: 1678591 - RNA, 15 nt, Human
auuaaaaaucucaaa

SEQ ID NO: 1678592 - RNA, 15 nt, Human
auuaaaagaauauuu

SEQ ID NO: 1678593 - RNA, 11 nt, Human
uuuuauuuuau

SEQ ID NO: 1678594 - RNA, 12 nt, Human
uuuuauuaugaa

SEQ ID NO: 1678595 - RNA, 21 nt, Human
uuuuauuaugaaacuugugua

SEQ ID NO: 1678596 - RNA, 22 nt, Human
uuuuauuaugaaacuuguguaa

SEQ ID NO: 1678597 - RNA, 13 nt, Human
uuuuauuaugcau

SEQ ID NO: 1678598 - RNA, 14 nt, Human
uuuucucuaggaaa

SEQ ID NO: 1678599 - RNA, 16 nt, Human
uuuucucuaggaaaua

SEQ ID NO: 1678600 - RNA, 15 nt, Human
uuuucugauccaguu

SEQ ID NO: 1678601 - RNA, 15 nt, Human
uuuucugagaaagac

SEQ ID NO: 1678602 - RNA, 18 nt, Human
uuuucugagaaagacuau

SEQ ID NO: 1678603 - RNA, 20 nt, Human
uuuucauuuaggugaggaag

SEQ ID NO: 1678604 - RNA, 20 nt, Human
auucagauaugauucaaaug

SEQ ID NO: 1678605 - RNA, 12 nt, Human
auugaaaucuuu

SEQ ID NO: 1678606 - RNA, 18 nt, Human
auucagauaugauucaaa

SEQ ID NO: 1678607 - RNA, 20 nt, Human
auucaggaagcucagggccu

SEQ ID NO: 1678608 - RNA, 17 nt, Human
auucaggaagcucaggg

SEQ ID NO: 1678609 - RNA, 19 nt, Human
auucaggaagcucagggcc

SEQ ID NO: 1678610 - RNA, 15 nt, Human
auucaguaauaacuc

SEQ ID NO: 1678611 - RNA, 19 nt, Human
auucaguaauaacucuacc

SEQ ID NO: 1678612 - RNA, 17 nt, Human
auucagaguugaugguu

SEQ ID NO: 1678613 - RNA, 14 nt, Human
auucaggaagcuca

SEQ ID NO: 1678614 - RNA, 17 nt, Human
auucccaagcucugcuc

SEQ ID NO: 1678615 - RNA, 16 nt, Human
auucccaagcucugcu

SEQ ID NO: 1678616 - RNA, 14 nt, Human
auucccaagcucug

SEQ ID NO: 1678617 - RNA, 15 nt, Human
auucccaagcucugc

SEQ ID NO: 1678618 - RNA, 21 nt, Human
auucccuggccuuucauauuu

SEQ ID NO: 1678619 - RNA, 13 nt, Human
auucccuggccuu

SEQ ID NO: 1678620 - RNA, 19 nt, Human
auucccuggccuuucauau

SEQ ID NO: 1678621 - RNA, 20 nt, Human
auucuccugccucagccucc

SEQ ID NO: 1678622 - RNA, 19 nt, Human
auucuccugccucagccuc

SEQ ID NO: 1678623 - RNA, 15 nt, Human
auucuccugccucag

SEQ ID NO: 1678624 - RNA, 17 nt, Human
auucuccugccucagcc

SEQ ID NO: 1678625 - RNA, 16 nt, Human
auucuccuuguguuac

SEQ ID NO: 1678626 - RNA, 12 nt, Human
auucuccugccu

SEQ ID NO: 1678627 - RNA, 11 nt, Human
auucuccugcc

SEQ ID NO: 1678628 - RNA, 14 nt, Human
auucuccugccuca

SEQ ID NO: 1678629 - RNA, 13 nt, Human
auucuccugccuc

SEQ ID NO: 1678630 - RNA, 21 nt, Human
auucuccuaucaccugucuug

SEQ ID NO: 1678631 - RNA, 21 nt, Human
auucucaugccucagccuccu

SEQ ID NO: 1678632 - RNA, 21 nt, Human
auucuccaccugccagggaca

SEQ ID NO: 1678633 - RNA, 14 nt, Human
auucucaugccuca

SEQ ID NO: 1678634 - RNA, 15 nt, Human
auucucaugccucag

SEQ ID NO: 1678635 - RNA, 19 nt, Human
auucuccaccugccaggga

SEQ ID NO: 1678636 - RNA, 20 nt, Human
auucuccaccugccagggac

SEQ ID NO: 1678637 - RNA, 14 nt, Human
auugguguuguacu

SEQ ID NO: 1678638 - RNA, 22 nt, Human
auugguguuguacucaauuuua

SEQ ID NO: 1678639 - RNA, 23 nt, Human
auugguguuguacucaauuuuaa

SEQ ID NO: 1678640 - RNA, 13 nt, Human
auuguauucagag

SEQ ID NO: 1678641 - RNA, 17 nt, Human
auuguccccgacccuug

SEQ ID NO: 1678642 - RNA, 19 nt, Human
auuguccccgacccuugcc

SEQ ID NO: 1678643 - RNA, 20 nt, Human
auuguccccgacccuugccg

SEQ ID NO: 1678644 - RNA, 18 nt, Human
auugugucucuugguccu

SEQ ID NO: 1678645 - RNA, 14 nt, Human
auugugucucuugg

SEQ ID NO: 1678646 - RNA, 13 nt, Human
auucuuaaaguug

SEQ ID NO: 1678647 - RNA, 14 nt, Human
auucuuaaaguuga

SEQ ID NO: 1678648 - RNA, 15 nt, Human
auucuuaaaguugaa

SEQ ID NO: 1678649 - RNA, 16 nt, Human
auucuuaaaguugaau

SEQ ID NO: 1678650 - RNA, 21 nt, Human
auucuguauagauuagaauuc

SEQ ID NO: 1678651 - RNA, 24 nt, Human
auucugucucuggauuauauuaug

SEQ ID NO: 1678652 - RNA, 17 nt, Human
auucuccuuguguuacu

SEQ ID NO: 1678653 - RNA, 15 nt, Human
auucuucagcaaaaa

SEQ ID NO: 1678654 - RNA, 23 nt, Human
auucuucagcaaaaauauuuuau

SEQ ID NO: 1678655 - RNA, 14 nt, Human
auucuuauuuaaug

SEQ ID NO: 1678656 - RNA, 18 nt, Human
auucuuauuuaaugaaag

SEQ ID NO: 1678657 - RNA, 18 nt, Human
auucuuaaaguugaauuu

SEQ ID NO: 1678658 - RNA, 13 nt, Human
auucuuauuuaau

SEQ ID NO: 1678659 - RNA, 22 nt, Human
auucuuccucccucccucuuuc

SEQ ID NO: 1678660 - RNA, 13 nt, Human
auucuucuccacu

SEQ ID NO: 1678661 - RNA, 18 nt, Human
auugacccacaagaaaug

SEQ ID NO: 1678662 - RNA, 16 nt, Human
auuuccguuaaaauac

SEQ ID NO: 1678663 - RNA, 15 nt, Human
auuuccguuaaaaua

SEQ ID NO: 1678664 - RNA, 14 nt, Human
auuugaaaauuuug

SEQ ID NO: 1678665 - RNA, 15 nt, Human
auuugaaaauuuuga

SEQ ID NO: 1678666 - RNA, 14 nt, Human
auuugaaauauuga

SEQ ID NO: 1678667 - RNA, 20 nt, Human
auuuccagugaaaucaguua

SEQ ID NO: 1678668 - RNA, 22 nt, Human
auuucauuugugccagaaugcu

SEQ ID NO: 1678669 - RNA, 17 nt, Human
auuuccagccaaagccu

SEQ ID NO: 1678670 - RNA, 19 nt, Human
auuuauuuuaauaauguuu

SEQ ID NO: 1678671 - RNA, 20 nt, Human
auuuauuuuaauaauguuuc

SEQ ID NO: 1678672 - RNA, 16 nt, Human
auuucaaacggccuca

SEQ ID NO: 1678673 - RNA, 12 nt, Human
auuucauuucuu

SEQ ID NO: 1678674 - RNA, 13 nt, Human
auuuauucugcuc

SEQ ID NO: 1678675 - RNA, 17 nt, Human
auuuauuuuaauaaugu

SEQ ID NO: 1678676 - RNA, 14 nt, Human
auuuauucugcuca

SEQ ID NO: 1678677 - RNA, 12 nt, Human
auuuaacagaaa

SEQ ID NO: 1678678 - RNA, 14 nt, Human
auuuaacagaaaug

SEQ ID NO: 1678679 - RNA, 17 nt, Human
auuuacuucuuauacau

SEQ ID NO: 1678680 - RNA, 14 nt, Human
auuuacuucuuaua

SEQ ID NO: 1678681 - RNA, 16 nt, Human
auuuacuucuuauaca

SEQ ID NO: 1678682 - RNA, 15 nt, Human
auuuagaaauauaau

SEQ ID NO: 1678683 - RNA, 17 nt, Human
auuuauaaaaauaaaaa

SEQ ID NO: 1678684 - RNA, 22 nt, Human
auuuauaaaaauaaaaaacacu

SEQ ID NO: 1678685 - RNA, 23 nt, Human
auuuauaaaaauaaaaaacacug

SEQ ID NO: 1678686 - RNA, 13 nt, Human
auuuaguguucau

SEQ ID NO: 1678687 - RNA, 20 nt, Human
auuuaguaucuuuuuauuca

SEQ ID NO: 1678688 - RNA, 18 nt, Human
auuuaguauuuuguuuca

SEQ ID NO: 1678689 - RNA, 13 nt, Human
auuuagauguaua

SEQ ID NO: 1678690 - RNA, 17 nt, Human
auuuuaccuuugacaaa

SEQ ID NO: 1678691 - RNA, 16 nt, Human
auuuuacauaaauuua

SEQ ID NO: 1678692 - RNA, 17 nt, Human
auuuuacauaaauuuag

SEQ ID NO: 1678693 - RNA, 15 nt, Human
auuuuaauucaguug

SEQ ID NO: 1678694 - RNA, 18 nt, Human
auuuuaaaagaaugauua

SEQ ID NO: 1678695 - RNA, 22 nt, Human
auuuuaaaagaaugauuaugaa

SEQ ID NO: 1678696 - RNA, 18 nt, Human
auuuguauaaaauaauuu

SEQ ID NO: 1678697 - RNA, 19 nt, Human
auuuguauaaaauaauuuu

SEQ ID NO: 1678698 - RNA, 21 nt, Human
auuuguauaaaauaauuuuua

SEQ ID NO: 1678699 - RNA, 15 nt, Human
auuugugauacaaug

SEQ ID NO: 1678700 - RNA, 14 nt, Human
auuugugauacaau

SEQ ID NO: 1678701 - RNA, 17 nt, Human
auuuuaaaagaaugauu

SEQ ID NO: 1678702 - RNA, 18 nt, Human
auuuucaacgcagcccug

SEQ ID NO: 1678703 - RNA, 20 nt, Human
auuuucaacgcagcccugcu

SEQ ID NO: 1678704 - RNA, 16 nt, Human
auuuuauuauguaaau

SEQ ID NO: 1678705 - RNA, 17 nt, Human
auuuuauuauguaaauc

SEQ ID NO: 1678706 - RNA, 18 nt, Human
auuuuauuauguaaaucc

SEQ ID NO: 1678707 - RNA, 19 nt, Human
auuuuauuauguaaauccc

SEQ ID NO: 1678708 - RNA, 20 nt, Human
auuuuauuauguaaauccca

SEQ ID NO: 1678709 - RNA, 21 nt, Human
auuuuauuauguaaaucccau

SEQ ID NO: 1678710 - RNA, 21 nt, Human
auuuuauuuuuuucugaauua

SEQ ID NO: 1678711 - RNA, 13 nt, Human
auuuuccuccuuu

SEQ ID NO: 1678712 - RNA, 17 nt, Human
auuuuccuccuuucucu

SEQ ID NO: 1678713 - RNA, 22 nt, Human
auuuucaguuauuauauuuaca

SEQ ID NO: 1678714 - RNA, 17 nt, Human
uugcugauggugcaaug

SEQ ID NO: 1678715 - RNA, 18 nt, Human
uugcugauggugcaauga

SEQ ID NO: 1678716 - RNA, 19 nt, Human
uugcugauggugcaaugac

SEQ ID NO: 1678717 - RNA, 17 nt, Human
uuggaaagaguaggaag

SEQ ID NO: 1678718 - RNA, 20 nt, Human
uugcuaagugaggaugaaaa

SEQ ID NO: 1678719 - RNA, 19 nt, Human
uugcugaauacagaggcaa

SEQ ID NO: 1678720 - RNA, 11 nt, Human
uugcucaugga

SEQ ID NO: 1678721 - RNA, 12 nt, Human
uugcucauggaa

SEQ ID NO: 1678722 - RNA, 18 nt, Human
uuggaaagaguaggaaga

SEQ ID NO: 1678723 - RNA, 23 nt, Human
uuggaaagaguaggaagacuuug

SEQ ID NO: 1678724 - RNA, 22 nt, Human
uuggcuagagguucaaagauau

SEQ ID NO: 1678725 - RNA, 22 nt, Human
uuggcuaggaccccuccaugug

SEQ ID NO: 1678726 - RNA, 21 nt, Human
uuggcuagagguucaaagaua

SEQ ID NO: 1678727 - RNA, 23 nt, Human
uuggcuauuagagaucaaccccu

SEQ ID NO: 1678728 - RNA, 14 nt, Human
uuggcugcagggag

SEQ ID NO: 1678729 - RNA, 11 nt, Human
uuggcugcuga

SEQ ID NO: 1678730 - RNA, 15 nt, Human
uuggcugcugaaggc

SEQ ID NO: 1678731 - RNA, 22 nt, Human
uuggcgcugccccuggcagccc

SEQ ID NO: 1678732 - RNA, 16 nt, Human
uuggcugcugaaggcu

SEQ ID NO: 1678733 - RNA, 19 nt, Human
augaaagauggcugugccu

SEQ ID NO: 1678734 - RNA, 20 nt, Human
augaaagauggcugugccuc

SEQ ID NO: 1678735 - RNA, 23 nt, Human
augaaagauggcugugccucugc

SEQ ID NO: 1678736 - RNA, 20 nt, Human
augaaagacuguacaaagua

SEQ ID NO: 1678737 - RNA, 14 nt, Human
augaaaugagguca

SEQ ID NO: 1678738 - RNA, 21 nt, Human
augaaauauuauguuaaaacu

SEQ ID NO: 1678739 - RNA, 20 nt, Human
augaaauauuauguuaaaac

SEQ ID NO: 1678740 - RNA, 15 nt, Human
uuguaauuauaucug

SEQ ID NO: 1678741 - RNA, 13 nt, Human
uuguaaugaaaac

SEQ ID NO: 1678742 - RNA, 20 nt, Human
uuguaaggaaugauuaauua

SEQ ID NO: 1678743 - RNA, 19 nt, Human
uuguauaaaauaauuuuua

SEQ ID NO: 1678744 - RNA, 13 nt, Human
uuguauaaaauaa

SEQ ID NO: 1678745 - RNA, 19 nt, Human
augacacgaauauugcuga

SEQ ID NO: 1678746 - RNA, 20 nt, Human
augacacgaauauugcugau

SEQ ID NO: 1678747 - RNA, 21 nt, Human
augaauuaguuuuauaugcuu

SEQ ID NO: 1678748 - RNA, 23 nt, Human
augaauuaguuuuauaugcuucu

SEQ ID NO: 1678749 - RNA, 19 nt, Human
uugguuaggcauuguggga

SEQ ID NO: 1678750 - RNA, 16 nt, Human
uugguuaagucuguuu

SEQ ID NO: 1678751 - RNA, 22 nt, Human
uugggguacccacugcucuggu

SEQ ID NO: 1678752 - RNA, 18 nt, Human
uugguuaagucuguuuua

SEQ ID NO: 1678753 - RNA, 22 nt, Human
uuguaaaaauuaaaaguuaugg

SEQ ID NO: 1678754 - RNA, 14 nt, Human
uuguaaggaaugau

SEQ ID NO: 1678755 - RNA, 19 nt, Human
uuggggaagaacgaagcca

SEQ ID NO: 1678756 - RNA, 17 nt, Human
uugggguacccacugcu

SEQ ID NO: 1678757 - RNA, 20 nt, Human
augaaccacaucuugcucug

SEQ ID NO: 1678758 - RNA, 22 nt, Human
augaaccacaucuugcucugcu

SEQ ID NO: 1678759 - RNA, 13 nt, Human
augaaccacaucu

SEQ ID NO: 1678760 - RNA, 18 nt, Human
augaauuacauuuguaua

SEQ ID NO: 1678761 - RNA, 19 nt, Human
augaauuacauuuguauaa

SEQ ID NO: 1678762 - RNA, 22 nt, Human
augaauuacauuuguauaaaau

SEQ ID NO: 1678763 - RNA, 22 nt, Human
augcaaacuuuauuuuguguuu

SEQ ID NO: 1678764 - RNA, 16 nt, Human
augcaaggucauuuuu

SEQ ID NO: 1678765 - RNA, 14 nt, Human
augcaaggucauuu

SEQ ID NO: 1678766 - RNA, 14 nt, Human
augcaccuggaaua

SEQ ID NO: 1678767 - RNA, 16 nt, Human
augcaccuggaauaua

SEQ ID NO: 1678768 - RNA, 22 nt, Human
augcaaggucauuuuuuuuaag

SEQ ID NO: 1678769 - RNA, 15 nt, Human
augaucuucuuuaua

SEQ ID NO: 1678770 - RNA, 18 nt, Human
augaucuucuuuauaauu

SEQ ID NO: 1678771 - RNA, 16 nt, Human
augcaaaccaucauug

SEQ ID NO: 1678772 - RNA, 18 nt, Human
augcaaaccaucauugaa

SEQ ID NO: 1678773 - RNA, 19 nt, Human
augcaaaccaucauugaaa

SEQ ID NO: 1678774 - RNA, 20 nt, Human
augcaaaccaucauugaaau

SEQ ID NO: 1678775 - RNA, 21 nt, Human
augcaaaccaucauugaaauc

SEQ ID NO: 1678776 - RNA, 22 nt, Human
augcaaaccaucauugaaaucu

SEQ ID NO: 1678777 - RNA, 17 nt, Human
uuuaaaaaaaaaauugg

SEQ ID NO: 1678778 - RNA, 19 nt, Human
uuguuuuuuuuuuccacuu

SEQ ID NO: 1678779 - RNA, 20 nt, Human
uuuaaaaaagaaacauuugg

SEQ ID NO: 1678780 - RNA, 17 nt, Human
uuuaaaaaauuaaucug

SEQ ID NO: 1678781 - RNA, 18 nt, Human
uuguuuuuuuuuuccacu

SEQ ID NO: 1678782 - RNA, 19 nt, Human
augcaccuggaauauauaa

SEQ ID NO: 1678783 - RNA, 23 nt, Human
augaucacggcucacugcagccu

SEQ ID NO: 1678784 - RNA, 16 nt, Human
augauccuaggcauuu

SEQ ID NO: 1678785 - RNA, 15 nt, Human
augauccuaaugaau

SEQ ID NO: 1678786 - RNA, 23 nt, Human
augaucuaccagccucccuauuu

SEQ ID NO: 1678787 - RNA, 15 nt, Human
augaucuaggaagac

SEQ ID NO: 1678788 - RNA, 14 nt, Human
augaucuucuuuau

SEQ ID NO: 1678789 - RNA, 15 nt, Human
augaucacggcucac

SEQ ID NO: 1678790 - RNA, 18 nt, Human
augaucacggcucacugc

SEQ ID NO: 1678791 - RNA, 19 nt, Human
augaucacggcucacugca

SEQ ID NO: 1678792 - RNA, 17 nt, Human
uugugaagguggaaaua

SEQ ID NO: 1678793 - RNA, 18 nt, Human
uugugaagguggaaauaa

SEQ ID NO: 1678794 - RNA, 18 nt, Human
uugugaagcaaaauuuuu

SEQ ID NO: 1678795 - RNA, 17 nt, Human
augagccucagcauccu

SEQ ID NO: 1678796 - RNA, 18 nt, Human
augagccucagcauccug

SEQ ID NO: 1678797 - RNA, 19 nt, Human
augagccucagcauccugg

SEQ ID NO: 1678798 - RNA, 15 nt, Human
augauaaaacacaaa

SEQ ID NO: 1678799 - RNA, 14 nt, Human
augauaacuggaaa

SEQ ID NO: 1678800 - RNA, 15 nt, Human
augagcaucaggcca

SEQ ID NO: 1678801 - RNA, 16 nt, Human
augagcaucaggccag

SEQ ID NO: 1678802 - RNA, 17 nt, Human
augagcaucaggccagg

SEQ ID NO: 1678803 - RNA, 18 nt, Human
augagcaucaggccaggc

SEQ ID NO: 1678804 - RNA, 19 nt, Human
augagcaucaggccaggcc

SEQ ID NO: 1678805 - RNA, 20 nt, Human
augagcaucaggccaggccc

SEQ ID NO: 1678806 - RNA, 21 nt, Human
augagcaucaggccaggcccu

SEQ ID NO: 1678807 - RNA, 22 nt, Human
augagcaucaggccaggcccuc

SEQ ID NO: 1678808 - RNA, 12 nt, Human
augagccucagc

SEQ ID NO: 1678809 - RNA, 15 nt, Human
augagccucagcauc

SEQ ID NO: 1678810 - RNA, 16 nt, Human
augagccucagcaucc

SEQ ID NO: 1678811 - RNA, 16 nt, Human
augagaggaaaucacc

SEQ ID NO: 1678812 - RNA, 14 nt, Human
augagaggaaauca

SEQ ID NO: 1678813 - RNA, 15 nt, Human
augagaggaaaucac

SEQ ID NO: 1678814 - RNA, 12 nt, Human
augagaggaaau

SEQ ID NO: 1678815 - RNA, 13 nt, Human
augagaggaaauc

SEQ ID NO: 1678816 - RNA, 11 nt, Human
uuuccuucagu

SEQ ID NO: 1678817 - RNA, 12 nt, Human
uuuccuucagug

SEQ ID NO: 1678818 - RNA, 15 nt, Human
uuuccuucagugccu

SEQ ID NO: 1678819 - RNA, 17 nt, Human
augggccuccugugugu

SEQ ID NO: 1678820 - RNA, 12 nt, Human
uuuccugugucu

SEQ ID NO: 1678821 - RNA, 23 nt, Human
uuuccuucauucaacccaccugc

SEQ ID NO: 1678822 - RNA, 18 nt, Human
uuuccuucagugccuuau

SEQ ID NO: 1678823 - RNA, 21 nt, Human
uuuccuucagugccuuaugga

SEQ ID NO: 1678824 - RNA, 22 nt, Human
uuuccuucagugccuuauggaa

SEQ ID NO: 1678825 - RNA, 21 nt, Human
uuuccuucauucaacccaccu

SEQ ID NO: 1678826 - RNA, 21 nt, Human
uuuccuuuuaaaacacuucca

SEQ ID NO: 1678827 - RNA, 22 nt, Human
uuucgcaggauucuuccucccu

SEQ ID NO: 1678828 - RNA, 18 nt, Human
uuucgcaggauucuuccu

SEQ ID NO: 1678829 - RNA, 15 nt, Human
augggacuggccucu

SEQ ID NO: 1678830 - RNA, 13 nt, Human
augggagcucaug

SEQ ID NO: 1678831 - RNA, 19 nt, Human
augggcaacccccagccug

SEQ ID NO: 1678832 - RNA, 21 nt, Human
augggcaacccccagccugcu

SEQ ID NO: 1678833 - RNA, 15 nt, Human
augggcagagcagag

SEQ ID NO: 1678834 - RNA, 13 nt, Human
augggcagagcag

SEQ ID NO: 1678835 - RNA, 14 nt, Human
augggcagagcaga

SEQ ID NO: 1678836 - RNA, 15 nt, Human
augggccuccugugu

SEQ ID NO: 1678837 - RNA, 22 nt, Human
augggacauuugcucauggaau

SEQ ID NO: 1678838 - RNA, 21 nt, Human
augggacauuugcucauggaa

SEQ ID NO: 1678839 - RNA, 21 nt, Human
auggcuauaggugcuacaaaa

SEQ ID NO: 1678840 - RNA, 23 nt, Human
auggcuauaggugcuacaaaaac

SEQ ID NO: 1678841 - RNA, 18 nt, Human
auggccucuucagaucuc

SEQ ID NO: 1678842 - RNA, 16 nt, Human
auggcuauaggugcua

SEQ ID NO: 1678843 - RNA, 19 nt, Human
auggcuauaggugcuacaa

SEQ ID NO: 1678844 - RNA, 21 nt, Human
auggacccaauauuuaccaga

SEQ ID NO: 1678845 - RNA, 17 nt, Human
auggaauuucucccagu

SEQ ID NO: 1678846 - RNA, 15 nt, Human
uuucuauauuuucau

SEQ ID NO: 1678847 - RNA, 18 nt, Human
uuucuauauuuucauucu

SEQ ID NO: 1678848 - RNA, 13 nt, Human
uuucuauauuuuc

SEQ ID NO: 1678849 - RNA, 21 nt, Human
uuucuaggacugaauuaugaa

SEQ ID NO: 1678850 - RNA, 17 nt, Human
uuucuaggacugaauua

SEQ ID NO: 1678851 - RNA, 22 nt, Human
uuucuaggacugaauuaugaaa

SEQ ID NO: 1678852 - RNA, 21 nt, Human
uuucuaugacacaugcaaggu

SEQ ID NO: 1678853 - RNA, 15 nt, Human
uuucuaugacacaug

SEQ ID NO: 1678854 - RNA, 21 nt, Human
uuucuaugcugaguuugugcu

SEQ ID NO: 1678855 - RNA, 13 nt, Human
uuucuaugaaaua

SEQ ID NO: 1678856 - RNA, 14 nt, Human
uuucuaugaaauau

SEQ ID NO: 1678857 - RNA, 20 nt, Human
uuucuaugaaauauuauguu

SEQ ID NO: 1678858 - RNA, 14 nt, Human
uuucugccgcagcc

SEQ ID NO: 1678859 - RNA, 16 nt, Human
uuucugccgcagcccu

SEQ ID NO: 1678860 - RNA, 22 nt, Human
uuucucauuugccaauaauaau

SEQ ID NO: 1678861 - RNA, 14 nt, Human
uuucugcaucagcu

SEQ ID NO: 1678862 - RNA, 13 nt, Human
uuucuuuguggcu

SEQ ID NO: 1678863 - RNA, 17 nt, Human
uuugaaacacuuugcau

SEQ ID NO: 1678864 - RNA, 19 nt, Human
uuugaaacacuuugcauaa

SEQ ID NO: 1678865 - RNA, 14 nt, Human
auggggcccugccu

SEQ ID NO: 1678866 - RNA, 13 nt, Human
auggggcccugcc

SEQ ID NO: 1678867 - RNA, 23 nt, Human
augggcuggguucuacccaggug

SEQ ID NO: 1678868 - RNA, 14 nt, Human
uuugaaauauugac

SEQ ID NO: 1678869 - RNA, 18 nt, Human
augcuacacacugcaugu

SEQ ID NO: 1678870 - RNA, 17 nt, Human
augcuacacacugcaug

SEQ ID NO: 1678871 - RNA, 20 nt, Human
uuuaccuuuuuuauacauaa

SEQ ID NO: 1678872 - RNA, 19 nt, Human
uuuaccuuuuuuauacaua

SEQ ID NO: 1678873 - RNA, 14 nt, Human
uuuaccuuuuuuau

SEQ ID NO: 1678874 - RNA, 18 nt, Human
uuuacuaauagacaauuu

SEQ ID NO: 1678875 - RNA, 17 nt, Human
uuuacuaauagacaauu

SEQ ID NO: 1678876 - RNA, 14 nt, Human
uuuacuaauagaca

SEQ ID NO: 1678877 - RNA, 15 nt, Human
uuuacuaaaauggac

SEQ ID NO: 1678878 - RNA, 17 nt, Human
uuuacuaaaauggacug

SEQ ID NO: 1678879 - RNA, 21 nt, Human
uuuaccuuuuuuauacauaaa

SEQ ID NO: 1678880 - RNA, 23 nt, Human
augcgcaggcuggcccugcccug

SEQ ID NO: 1678881 - RNA, 16 nt, Human
augcgggccagugcuc

SEQ ID NO: 1678882 - RNA, 16 nt, Human
uuuaaagcuuccauug

SEQ ID NO: 1678883 - RNA, 24 nt, Human
uuuaaagcuuauuaaaacucauuu

SEQ ID NO: 1678884 - RNA, 13 nt, Human
uuuagauaauaca

SEQ ID NO: 1678885 - RNA, 18 nt, Human
uuuagaguugauacuaca

SEQ ID NO: 1678886 - RNA, 15 nt, Human
uuuagauaauacacc

SEQ ID NO: 1678887 - RNA, 15 nt, Human
uuuaguagagacagg

SEQ ID NO: 1678888 - RNA, 23 nt, Human
uuuagcuacuauauaugugauga

SEQ ID NO: 1678889 - RNA, 14 nt, Human
uuuaugugaaacau

SEQ ID NO: 1678890 - RNA, 15 nt, Human
uuuaugugaaacaug

SEQ ID NO: 1678891 - RNA, 19 nt, Human
uuuauuaaaugcccagccc

SEQ ID NO: 1678892 - RNA, 17 nt, Human
uuuauaugcuucuguuu

SEQ ID NO: 1678893 - RNA, 19 nt, Human
uuuauaugcuucuguuuua

SEQ ID NO: 1678894 - RNA, 13 nt, Human
uuuauuuuuuggg

SEQ ID NO: 1678895 - RNA, 14 nt, Human
auggaauaacaugu

SEQ ID NO: 1678896 - RNA, 15 nt, Human
auggaauaacaugua

SEQ ID NO: 1678897 - RNA, 16 nt, Human
uuuauuuuaauaaugu

SEQ ID NO: 1678898 - RNA, 18 nt, Human
auggaacacucugagacu

SEQ ID NO: 1678899 - RNA, 17 nt, Human
auggaacacucugagac

SEQ ID NO: 1678900 - RNA, 21 nt, Human
auggaaguacuauaauuuacc

SEQ ID NO: 1678901 - RNA, 16 nt, Human
auggaacauaaaauac

SEQ ID NO: 1678902 - RNA, 19 nt, Human
augcugugcccuaaagugu

SEQ ID NO: 1678903 - RNA, 14 nt, Human
augcuguauauguu

SEQ ID NO: 1678904 - RNA, 14 nt, Human
augcuguauuuuaa

SEQ ID NO: 1678905 - RNA, 23 nt, Human
augcugucuacacuaagagagaa

SEQ ID NO: 1678906 - RNA, 21 nt, Human
uuuauuaugaaacuuguguaa

SEQ ID NO: 1678907 - RNA, 22 nt, Human
augcuggcuguuggcugggggc

SEQ ID NO: 1678908 - RNA, 13 nt, Human
uuuauuaugaaac

SEQ ID NO: 1678909 - RNA, 19 nt, Human
uuuauuacuguaagaaaau

SEQ ID NO: 1678910 - RNA, 16 nt, Human
uuuauuuuuugggaaa

SEQ ID NO: 1678911 - RNA, 17 nt, Human
uuuauuuuuuucugaau

SEQ ID NO: 1678912 - RNA, 14 nt, Human
uuucacucuccuug

SEQ ID NO: 1678913 - RNA, 24 nt, Human
uuucacugcuggcugccuuagaac

SEQ ID NO: 1678914 - RNA, 15 nt, Human
uuucacucuccuugg

SEQ ID NO: 1678915 - RNA, 24 nt, Human
uuucacucuuauugcccacgcugg

SEQ ID NO: 1678916 - RNA, 12 nt, Human
uuucauaaagca

SEQ ID NO: 1678917 - RNA, 23 nt, Human
auggaauuggagcucgugggaca

SEQ ID NO: 1678918 - RNA, 19 nt, Human
uuuccagguuuaagcuguu

SEQ ID NO: 1678919 - RNA, 16 nt, Human
uucagauaugauucaa

SEQ ID NO: 1678920 - RNA, 17 nt, Human
uucagauaugauucaaa

SEQ ID NO: 1678921 - RNA, 18 nt, Human
uucagauaugauucaaau

SEQ ID NO: 1678922 - RNA, 17 nt, Human
uucagcaaaaauauuuu

SEQ ID NO: 1678923 - RNA, 19 nt, Human
uucagauaugauucaaaug

SEQ ID NO: 1678924 - RNA, 16 nt, Human
uucagaaauguguuau

SEQ ID NO: 1678925 - RNA, 14 nt, Human
uucaggguuggccc

SEQ ID NO: 1678926 - RNA, 16 nt, Human
uucaggguuggccccu

SEQ ID NO: 1678927 - RNA, 17 nt, Human
uucaggguuggccccug

SEQ ID NO: 1678928 - RNA, 19 nt, Human
uucaggguuggccccugcc

SEQ ID NO: 1678929 - RNA, 22 nt, Human
uucaggguuggccccugcccgg

SEQ ID NO: 1678930 - RNA, 15 nt, Human
uucagguaacaggca

SEQ ID NO: 1678931 - RNA, 16 nt, Human
uucagguaacaggcag

SEQ ID NO: 1678932 - RNA, 19 nt, Human
uucagcaaaaauauuuuau

SEQ ID NO: 1678933 - RNA, 20 nt, Human
uucagccugccuucuuuucu

SEQ ID NO: 1678934 - RNA, 15 nt, Human
uucagccugccuucu

SEQ ID NO: 1678935 - RNA, 14 nt, Human
uucagccaagaauu

SEQ ID NO: 1678936 - RNA, 17 nt, Human
uucagcgguuuauauaa

SEQ ID NO: 1678937 - RNA, 17 nt, Human
uucagguaacaggcaga

SEQ ID NO: 1678938 - RNA, 14 nt, Human
uucaguaagccgug

SEQ ID NO: 1678939 - RNA, 16 nt, Human
uucagugccaaaaaca

SEQ ID NO: 1678940 - RNA, 13 nt, Human
auauaugcuaagu

SEQ ID NO: 1678941 - RNA, 15 nt, Human
uucaucaaugaauga

SEQ ID NO: 1678942 - RNA, 21 nt, Human
auauauguuuuaagaggcagg

SEQ ID NO: 1678943 - RNA, 22 nt, Human
auauauguuuuaagaggcaggg

SEQ ID NO: 1678944 - RNA, 15 nt, Human
uuccaggcugggaga

SEQ ID NO: 1678945 - RNA, 17 nt, Human
uuccaggcugggagagc

SEQ ID NO: 1678946 - RNA, 18 nt, Human
uuccagguuuaagcuguu

SEQ ID NO: 1678947 - RNA, 17 nt, Human
uuccagguuuaagcugu

SEQ ID NO: 1678948 - RNA, 15 nt, Human
uuccaccuucccaug

SEQ ID NO: 1678949 - RNA, 18 nt, Human
uuccaccaucaagccacc

SEQ ID NO: 1678950 - RNA, 21 nt, Human
uuccacaagagcccaggccuc

SEQ ID NO: 1678951 - RNA, 22 nt, Human
uuccaauuuacauacucugcuu

SEQ ID NO: 1678952 - RNA, 22 nt, Human
uucauuauuuuauuaugaaacu

SEQ ID NO: 1678953 - RNA, 14 nt, Human
uucauuaucucaaa

SEQ ID NO: 1678954 - RNA, 21 nt, Human
uucauggaacgcguugaaauu

SEQ ID NO: 1678955 - RNA, 22 nt, Human
uucauggaacgcguugaaauug

SEQ ID NO: 1678956 - RNA, 15 nt, Human
uucauuaauaauaaa

SEQ ID NO: 1678957 - RNA, 18 nt, Human
uucauuaauaauaaauuc

SEQ ID NO: 1678958 - RNA, 21 nt, Human
uucauuaauaauaaauucccu

SEQ ID NO: 1678959 - RNA, 19 nt, Human
uucauggaacgcguugaaa

SEQ ID NO: 1678960 - RNA, 20 nt, Human
uucauggaacgcguugaaau

SEQ ID NO: 1678961 - RNA, 22 nt, Human
uucaugcuguucaugaaagauu

SEQ ID NO: 1678962 - RNA, 20 nt, Human
auauguggaguucaucuuga

SEQ ID NO: 1678963 - RNA, 21 nt, Human
auauguggaguucaucuugaa

SEQ ID NO: 1678964 - RNA, 23 nt, Human
auauguaccuaacgaaguauccu

SEQ ID NO: 1678965 - RNA, 13 nt, Human
auauauuuuuaua

SEQ ID NO: 1678966 - RNA, 15 nt, Human
auaugcaaagcacug

SEQ ID NO: 1678967 - RNA, 13 nt, Human
auaugcaaagcac

SEQ ID NO: 1678968 - RNA, 14 nt, Human
auaugcaaagcacu

SEQ ID NO: 1678969 - RNA, 14 nt, Human
uucccgcucagccc

SEQ ID NO: 1678970 - RNA, 15 nt, Human
uucccgcucagcccu

SEQ ID NO: 1678971 - RNA, 12 nt, Human
uucccgcucagc

SEQ ID NO: 1678972 - RNA, 13 nt, Human
uucccuacuuccu

SEQ ID NO: 1678973 - RNA, 15 nt, Human
uucccuuuuuuuaag

SEQ ID NO: 1678974 - RNA, 13 nt, Human
uuccucugagccu

SEQ ID NO: 1678975 - RNA, 19 nt, Human
uuccucuccacugccuucg

SEQ ID NO: 1678976 - RNA, 18 nt, Human
uuccucuccacugccuuc

SEQ ID NO: 1678977 - RNA, 21 nt, Human
uuccuaaauauauuuuaagac

SEQ ID NO: 1678978 - RNA, 19 nt, Human
uuccuggcacugcuuccag

SEQ ID NO: 1678979 - RNA, 12 nt, Human
uuccugaacagg

SEQ ID NO: 1678980 - RNA, 22 nt, Human
uuccucuuuuuauuuaguuccu

SEQ ID NO: 1678981 - RNA, 20 nt, Human
uuccuggcacugcuuccagu

SEQ ID NO: 1678982 - RNA, 22 nt, Human
uuccuggcacugcuuccaguga

SEQ ID NO: 1678983 - RNA, 15 nt, Human
aucacgccacugcac

SEQ ID NO: 1678984 - RNA, 17 nt, Human
aucacgccacugcacua

SEQ ID NO: 1678985 - RNA, 14 nt, Human
aucaauuuuucuua

SEQ ID NO: 1678986 - RNA, 19 nt, Human
aucaauuuuucuuauuuca

SEQ ID NO: 1678987 - RNA, 21 nt, Human
aucaaggguacacugccuucu

SEQ ID NO: 1678988 - RNA, 13 nt, Human
aucaauuuaaaaa

SEQ ID NO: 1678989 - RNA, 21 nt, Human
aucaacugcaucaagauguga

SEQ ID NO: 1678990 - RNA, 16 nt, Human
aucaaggguacacugc

SEQ ID NO: 1678991 - RNA, 19 nt, Human
aucaacugggcugaacacu

SEQ ID NO: 1678992 - RNA, 16 nt, Human
aucaaauaugcaaagc

SEQ ID NO: 1678993 - RNA, 17 nt, Human
aucaaauaugcaaagca

SEQ ID NO: 1678994 - RNA, 18 nt, Human
aucaaauaugcaaagcac

SEQ ID NO: 1678995 - RNA, 15 nt, Human
aucaaauaugcaaag

SEQ ID NO: 1678996 - RNA, 22 nt, Human
uuccagugaaaucaguuacucu

SEQ ID NO: 1678997 - RNA, 15 nt, Human
uuccagugaggcucu

SEQ ID NO: 1678998 - RNA, 16 nt, Human
uuccagugaggcucug

SEQ ID NO: 1678999 - RNA, 16 nt, Human
auauguucugacauaa

SEQ ID NO: 1679000 - RNA, 12 nt, Human
auauuaaagcca

SEQ ID NO: 1679001 - RNA, 14 nt, Human
auauuaaagccaug

SEQ ID NO: 1679002 - RNA, 17 nt, Human
auauuaccacagacaua

SEQ ID NO: 1679003 - RNA, 16 nt, Human
auauuaagaaagacua

SEQ ID NO: 1679004 - RNA, 15 nt, Human
auauuaagaaagacu

SEQ ID NO: 1679005 - RNA, 17 nt, Human
auauuaagaaagacuau

SEQ ID NO: 1679006 - RNA, 22 nt, Human
auauuaagaaagacuaucuaaa

SEQ ID NO: 1679007 - RNA, 15 nt, Human
auauguuuaaaagua

SEQ ID NO: 1679008 - RNA, 18 nt, Human
auauucucacagcuccaa

SEQ ID NO: 1679009 - RNA, 21 nt, Human
auauuccugcauuugugaaau

SEQ ID NO: 1679010 - RNA, 19 nt, Human
auauuaccacagacauacu

SEQ ID NO: 1679011 - RNA, 21 nt, Human
auauucucacagcuccaagaa

SEQ ID NO: 1679012 - RNA, 15 nt, Human
auauugauaugcuua

SEQ ID NO: 1679013 - RNA, 22 nt, Human
auauugcugauggugcaaugac

SEQ ID NO: 1679014 - RNA, 13 nt, Human
auauuguuuucag

SEQ ID NO: 1679015 - RNA, 17 nt, Human
auauuguuuucagugua

SEQ ID NO: 1679016 - RNA, 14 nt, Human
auauuguuugcuaa

SEQ ID NO: 1679017 - RNA, 13 nt, Human
auauuuacaaaug

SEQ ID NO: 1679018 - RNA, 12 nt, Human
aucguaaaauua

SEQ ID NO: 1679019 - RNA, 13 nt, Human
aucguaaaauuaa

SEQ ID NO: 1679020 - RNA, 14 nt, Human
aucguaaaauuaag

SEQ ID NO: 1679021 - RNA, 17 nt, Human
aucguaaaauuaagaaa

SEQ ID NO: 1679022 - RNA, 15 nt, Human
auccuggaguucugg

SEQ ID NO: 1679023 - RNA, 17 nt, Human
auccuggcacccggccc

SEQ ID NO: 1679024 - RNA, 19 nt, Human
auccuggcacccggccccu

SEQ ID NO: 1679025 - RNA, 20 nt, Human
auccuggcacccggccccug

SEQ ID NO: 1679026 - RNA, 21 nt, Human
auccuggcacccggccccugc

SEQ ID NO: 1679027 - RNA, 20 nt, Human
auccuggcugucgagaaaca

SEQ ID NO: 1679028 - RNA, 22 nt, Human
auccuggcacccggccccugcu

SEQ ID NO: 1679029 - RNA, 23 nt, Human
auccuggcacccggccccugcug

SEQ ID NO: 1679030 - RNA, 17 nt, Human
auccucuuugagugaag

SEQ ID NO: 1679031 - RNA, 11 nt, Human
auccugagcca

SEQ ID NO: 1679032 - RNA, 12 nt, Human
auccugagccag

SEQ ID NO: 1679033 - RNA, 13 nt, Human
auccugagccaga

SEQ ID NO: 1679034 - RNA, 18 nt, Human
auccucuguacagagccc

SEQ ID NO: 1679035 - RNA, 20 nt, Human
auccucuguacagagcccac

SEQ ID NO: 1679036 - RNA, 20 nt, Human
uucuuuugccguuauuaaaa

SEQ ID NO: 1679037 - RNA, 16 nt, Human
auccugcaauuccacu

SEQ ID NO: 1679038 - RNA, 22 nt, Human
auccugaggcuccacuuggucu

SEQ ID NO: 1679039 - RNA, 13 nt, Human
auccugccccuga

SEQ ID NO: 1679040 - RNA, 14 nt, Human
auccugagccagau

SEQ ID NO: 1679041 - RNA, 15 nt, Human
auccugagccagauu

SEQ ID NO: 1679042 - RNA, 17 nt, Human
auccugagccagauuuc

SEQ ID NO: 1679043 - RNA, 21 nt, Human
auccugagccagauuucacuc

SEQ ID NO: 1679044 - RNA, 11 nt, Human
auccugaggcu

SEQ ID NO: 1679045 - RNA, 13 nt, Human
auccugaggcucc

SEQ ID NO: 1679046 - RNA, 16 nt, Human
auccugaggcuccacu

SEQ ID NO: 1679047 - RNA, 18 nt, Human
auccugaggcuccacuug

SEQ ID NO: 1679048 - RNA, 17 nt, Human
uugacauagucuggcug

SEQ ID NO: 1679049 - RNA, 13 nt, Human
uugacaucaacug

SEQ ID NO: 1679050 - RNA, 18 nt, Human
uugaccauucuccaccug

SEQ ID NO: 1679051 - RNA, 19 nt, Human
uugaccauucuccaccugc

SEQ ID NO: 1679052 - RNA, 14 nt, Human
uugacauagucugg

SEQ ID NO: 1679053 - RNA, 19 nt, Human
uugacacuuaaaaaugguu

SEQ ID NO: 1679054 - RNA, 24 nt, Human
uugaccauucuccaccugccaggg

SEQ ID NO: 1679055 - RNA, 14 nt, Human
uugacccacaagaa

SEQ ID NO: 1679056 - RNA, 12 nt, Human
uugauaaaguaa

SEQ ID NO: 1679057 - RNA, 15 nt, Human
uugagaucagccugg

SEQ ID NO: 1679058 - RNA, 16 nt, Human
uugaggucuguucuuu

SEQ ID NO: 1679059 - RNA, 19 nt, Human
uugauaaucaacugggcug

SEQ ID NO: 1679060 - RNA, 17 nt, Human
uugacacuuaaaaaugg

SEQ ID NO: 1679061 - RNA, 14 nt, Human
aucgucacugcuua

SEQ ID NO: 1679062 - RNA, 18 nt, Human
aucgucacugcuuaacuu

SEQ ID NO: 1679063 - RNA, 14 nt, Human
aucgugacaacacu

SEQ ID NO: 1679064 - RNA, 15 nt, Human
aucgugacaacacuu

SEQ ID NO: 1679065 - RNA, 15 nt, Human
aucuaaacugccccc

SEQ ID NO: 1679066 - RNA, 15 nt, Human
aucuaaauguugaaa

SEQ ID NO: 1679067 - RNA, 18 nt, Human
auccaagcaaaugugaau

SEQ ID NO: 1679068 - RNA, 16 nt, Human
auccaagcaaauguga

SEQ ID NO: 1679069 - RNA, 15 nt, Human
uucugccugcccagg

SEQ ID NO: 1679070 - RNA, 16 nt, Human
uucugccugcccaggc

SEQ ID NO: 1679071 - RNA, 14 nt, Human
auccaguaucuuga

SEQ ID NO: 1679072 - RNA, 15 nt, Human
auccaguaucuugaa

SEQ ID NO: 1679073 - RNA, 17 nt, Human
auccagguucagcuugu

SEQ ID NO: 1679074 - RNA, 11 nt, Human
aucccagcccc

SEQ ID NO: 1679075 - RNA, 12 nt, Human
aucccagcccca

SEQ ID NO: 1679076 - RNA, 16 nt, Human
aucccaugagccucag

SEQ ID NO: 1679077 - RNA, 22 nt, Human
aucccugaaggccccgcccagg

SEQ ID NO: 1679078 - RNA, 17 nt, Human
aucccugaaggccccgc

SEQ ID NO: 1679079 - RNA, 21 nt, Human
aucccucccuccaccucccug

SEQ ID NO: 1679080 - RNA, 20 nt, Human
aucccucccuccaccucccu

SEQ ID NO: 1679081 - RNA, 17 nt, Human
aucccaugagccucagc

SEQ ID NO: 1679082 - RNA, 18 nt, Human
aucccaugagccucagca

SEQ ID NO: 1679083 - RNA, 18 nt, Human
aucccucccuccaccucc

SEQ ID NO: 1679084 - RNA, 17 nt, Human
aucccucccuccaccuc

SEQ ID NO: 1679085 - RNA, 16 nt, Human
aucccucccuccaccu

SEQ ID NO: 1679086 - RNA, 12 nt, Human
uucuuucuggcu

SEQ ID NO: 1679087 - RNA, 20 nt, Human
uucuuucuggcuaugcauuu

SEQ ID NO: 1679088 - RNA, 17 nt, Human
uucuuucuggcuaugca

SEQ ID NO: 1679089 - RNA, 22 nt, Human
uucuucuccacuuucuagccag

SEQ ID NO: 1679090 - RNA, 11 nt, Human
uucuucucccu

SEQ ID NO: 1679091 - RNA, 13 nt, Human
uucuuaaaguuga

SEQ ID NO: 1679092 - RNA, 15 nt, Human
uucuuaaauaauaaa

SEQ ID NO: 1679093 - RNA, 19 nt, Human
uucuuaaauaauaaagauc

SEQ ID NO: 1679094 - RNA, 22 nt, Human
uucuuaaccagaucauugugaa

SEQ ID NO: 1679095 - RNA, 23 nt, Human
uucuuaaccagaucauugugaaa

SEQ ID NO: 1679096 - RNA, 18 nt, Human
uucuguuuagauaauaca

SEQ ID NO: 1679097 - RNA, 13 nt, Human
uucuguuuagaua

SEQ ID NO: 1679098 - RNA, 16 nt, Human
uucuguuuuauaauuu

SEQ ID NO: 1679099 - RNA, 17 nt, Human
uucuguuuuauaauuuu

SEQ ID NO: 1679100 - RNA, 13 nt, Human
aucauugugaaau

SEQ ID NO: 1679101 - RNA, 15 nt, Human
aucauugugaaauua

SEQ ID NO: 1679102 - RNA, 19 nt, Human
aucauugugaaauuauuca

SEQ ID NO: 1679103 - RNA, 13 nt, Human
aucauugaaaucu

SEQ ID NO: 1679104 - RNA, 12 nt, Human
aucauugaaauc

SEQ ID NO: 1679105 - RNA, 18 nt, Human
uucuccuuucacaaccuu

SEQ ID NO: 1679106 - RNA, 22 nt, Human
uucuccuuucacaaccuucugu

SEQ ID NO: 1679107 - RNA, 21 nt, Human
uucucuaguuugauuaaauuc

SEQ ID NO: 1679108 - RNA, 16 nt, Human
uucugcaucagcugcu

SEQ ID NO: 1679109 - RNA, 16 nt, Human
aucauuaggugugacu

SEQ ID NO: 1679110 - RNA, 21 nt, Human
aucauccacugugccaugugc

SEQ ID NO: 1679111 - RNA, 23 nt, Human
aucauccacugugccaugugcca

SEQ ID NO: 1679112 - RNA, 15 nt, Human
aucauaaaacuugau

SEQ ID NO: 1679113 - RNA, 17 nt, Human
aucaggugcugccaucc

SEQ ID NO: 1679114 - RNA, 19 nt, Human
aucaggugcugccauccag

SEQ ID NO: 1679115 - RNA, 15 nt, Human
aucaggugcugccau

SEQ ID NO: 1679116 - RNA, 23 nt, Human
aucacuugaacccgggaggcaga

SEQ ID NO: 1679117 - RNA, 13 nt, Human
aucagugcccucc

SEQ ID NO: 1679118 - RNA, 15 nt, Human
aucagugcccuccag

SEQ ID NO: 1679119 - RNA, 17 nt, Human
aucagugcccuccagga

SEQ ID NO: 1679120 - RNA, 19 nt, Human
aucagucugauucccaagc

SEQ ID NO: 1679121 - RNA, 15 nt, Human
ugcuggcugccuuag

SEQ ID NO: 1679122 - RNA, 14 nt, Human
ugcuggcugccuua

SEQ ID NO: 1679123 - RNA, 21 nt, Human
ugcuggcugccuuagaaccuu

SEQ ID NO: 1679124 - RNA, 16 nt, Human
ugcuggcugguuagag

SEQ ID NO: 1679125 - RNA, 18 nt, Human
ugcuggcuguuggcuggg

SEQ ID NO: 1679126 - RNA, 13 nt, Human
ugcugcccuguga

SEQ ID NO: 1679127 - RNA, 14 nt, Human
ugcugcccugugag

SEQ ID NO: 1679128 - RNA, 20 nt, Human
aggaauuuuauuuuuuucug

SEQ ID NO: 1679129 - RNA, 15 nt, Human
ugcugcccugugagu

SEQ ID NO: 1679130 - RNA, 13 nt, Human
ugcuggagcucug

SEQ ID NO: 1679131 - RNA, 14 nt, Human
ugcuggagcucugc

SEQ ID NO: 1679132 - RNA, 16 nt, Human
ugcuucaaggauccug

SEQ ID NO: 1679133 - RNA, 18 nt, Human
ugcuucaaggauccugag

SEQ ID NO: 1679134 - RNA, 19 nt, Human
ugcuucaaggauccugagc

SEQ ID NO: 1679135 - RNA, 13 nt, Human
ugcuucagccucc

SEQ ID NO: 1679136 - RNA, 14 nt, Human
ugcuucagccuccc

SEQ ID NO: 1679137 - RNA, 13 nt, Human
ugcuuauacacuu

SEQ ID NO: 1679138 - RNA, 23 nt, Human
aggacacuaaccacgcuggaccu

SEQ ID NO: 1679139 - RNA, 14 nt, Human
ugcuucaucccuuu

SEQ ID NO: 1679140 - RNA, 14 nt, Human
aggacacugauaug

SEQ ID NO: 1679141 - RNA, 22 nt, Human
aggacagggaggugaccccagg

SEQ ID NO: 1679142 - RNA, 14 nt, Human
ugcuauuucuauau

SEQ ID NO: 1679143 - RNA, 20 nt, Human
ugcuauuucuauauuuucau

SEQ ID NO: 1679144 - RNA, 21 nt, Human
ugcuauuucuauauuuucauu

SEQ ID NO: 1679145 - RNA, 12 nt, Human
ugcuauuucuau

SEQ ID NO: 1679146 - RNA, 13 nt, Human
ugcuauuucuaua

SEQ ID NO: 1679147 - RNA, 19 nt, Human
agcugggacuacaggcacc

SEQ ID NO: 1679148 - RNA, 16 nt, Human
agcugggacuacaggc

SEQ ID NO: 1679149 - RNA, 18 nt, Human
agcugggacuacaggcac

SEQ ID NO: 1679150 - RNA, 16 nt, Human
ugcuccagcuguucag

SEQ ID NO: 1679151 - RNA, 19 nt, Human
ugcuccagcuguucagcug

SEQ ID NO: 1679152 - RNA, 20 nt, Human
ugcuccagcuguucagcugg

SEQ ID NO: 1679153 - RNA, 21 nt, Human
ugcucugcugacagacacagg

SEQ ID NO: 1679154 - RNA, 22 nt, Human
ugcucugcugacagacacaggc

SEQ ID NO: 1679155 - RNA, 14 nt, Human
ugcugacuguacuc

SEQ ID NO: 1679156 - RNA, 15 nt, Human
ugcugagucugaagg

SEQ ID NO: 1679157 - RNA, 14 nt, Human
ugcugagucugaag

SEQ ID NO: 1679158 - RNA, 14 nt, Human
aggaagccagcagg

SEQ ID NO: 1679159 - RNA, 15 nt, Human
aggaagccagcaggc

SEQ ID NO: 1679160 - RNA, 13 nt, Human
aggaagacuuugg

SEQ ID NO: 1679161 - RNA, 14 nt, Human
aggaagacuuugga

SEQ ID NO: 1679162 - RNA, 23 nt, Human
aggaagcacaugccucucucagg

SEQ ID NO: 1679163 - RNA, 24 nt, Human
aggaagcacaugccucucucaggc

SEQ ID NO: 1679164 - RNA, 16 nt, Human
ugcugagucugaaggc

SEQ ID NO: 1679165 - RNA, 17 nt, Human
ugcugagucugaaggcu

SEQ ID NO: 1679166 - RNA, 18 nt, Human
ugcugagucugaaggcug

SEQ ID NO: 1679167 - RNA, 21 nt, Human
ugcugagucugaaggcugggu

SEQ ID NO: 1679168 - RNA, 22 nt, Human
ugcugagucugaaggcuggguu

SEQ ID NO: 1679169 - RNA, 23 nt, Human
ugcugagucugaaggcuggguuc

SEQ ID NO: 1679170 - RNA, 13 nt, Human
aggaagacuucau

SEQ ID NO: 1679171 - RNA, 19 nt, Human
aggaagacuucaucccucu

SEQ ID NO: 1679172 - RNA, 19 nt, Human
aggaaggaaacccagcucu

SEQ ID NO: 1679173 - RNA, 15 nt, Human
aggaaggagaggaga

SEQ ID NO: 1679174 - RNA, 18 nt, Human
aggaaggaaacccagcuc

SEQ ID NO: 1679175 - RNA, 17 nt, Human
aggaagccagcaggcuc

SEQ ID NO: 1679176 - RNA, 18 nt, Human
aggaagccagcaggcucu

SEQ ID NO: 1679177 - RNA, 23 nt, Human
aggaauuguguuuauaauuuuaa

SEQ ID NO: 1679178 - RNA, 23 nt, Human
aggaauugacccacaagaaauga

SEQ ID NO: 1679179 - RNA, 11 nt, Human
aggaauuuaaa

SEQ ID NO: 1679180 - RNA, 14 nt, Human
aggacuuguuagau

SEQ ID NO: 1679181 - RNA, 16 nt, Human
aggacuuguuagaucu

SEQ ID NO: 1679182 - RNA, 19 nt, Human
aggacugaauuaugaaacu

SEQ ID NO: 1679183 - RNA, 20 nt, Human
aggacugaauuaugaaacuu

SEQ ID NO: 1679184 - RNA, 19 nt, Human
aggacauugcggacagcca

SEQ ID NO: 1679185 - RNA, 23 nt, Human
aggacauugcggacagccacggc

SEQ ID NO: 1679186 - RNA, 15 nt, Human
aggacauugcggaca

SEQ ID NO: 1679187 - RNA, 17 nt, Human
aggacauugcggacagc

SEQ ID NO: 1679188 - RNA, 18 nt, Human
aggacauugcggacagcc

SEQ ID NO: 1679189 - RNA, 18 nt, Human
aggagcccugggaggcuc

SEQ ID NO: 1679190 - RNA, 22 nt, Human
aggagccccgaggccuucucug

SEQ ID NO: 1679191 - RNA, 17 nt, Human
aggacuuguuagaucua

SEQ ID NO: 1679192 - RNA, 11 nt, Human
aggagaaacug

SEQ ID NO: 1679193 - RNA, 17 nt, Human
aggagauuggaaggaac

SEQ ID NO: 1679194 - RNA, 17 nt, Human
aggagaaacuggaacuc

SEQ ID NO: 1679195 - RNA, 21 nt, Human
ugcuuggaggaaggaaaccca

SEQ ID NO: 1679196 - RNA, 12 nt, Human
ugcuugggcuuc

SEQ ID NO: 1679197 - RNA, 16 nt, Human
ugcuugggcuucaucc

SEQ ID NO: 1679198 - RNA, 19 nt, Human
aggagcccugggaggcucu

SEQ ID NO: 1679199 - RNA, 23 nt, Human
aggagcccugggaggcucuggag

SEQ ID NO: 1679200 - RNA, 16 nt, Human
ugcuugccaucccucc

SEQ ID NO: 1679201 - RNA, 15 nt, Human
ugcuugccaucccuc

SEQ ID NO: 1679202 - RNA, 18 nt, Human
ugcuuugggcugcccugg

SEQ ID NO: 1679203 - RNA, 19 nt, Human
ugcuuugggcugcccuggu

SEQ ID NO: 1679204 - RNA, 20 nt, Human
ugcuuugggcugcccuggug

SEQ ID NO: 1679205 - RNA, 21 nt, Human
ugcuuugggcugcccuggugc

SEQ ID NO: 1679206 - RNA, 19 nt, Human
ugcuugggcuucauccucc

SEQ ID NO: 1679207 - RNA, 15 nt, Human
uggaaauauuaagaa

SEQ ID NO: 1679208 - RNA, 13 nt, Human
uggaaaggcagcu

SEQ ID NO: 1679209 - RNA, 20 nt, Human
uggaaauauuaagaaagacu

SEQ ID NO: 1679210 - RNA, 23 nt, Human
uggaaaugggcagagcagagacc

SEQ ID NO: 1679211 - RNA, 17 nt, Human
aggauccugagccagau

SEQ ID NO: 1679212 - RNA, 18 nt, Human
aggauccugagccagauu

SEQ ID NO: 1679213 - RNA, 21 nt, Human
aggaucucuugagccugggag

SEQ ID NO: 1679214 - RNA, 22 nt, Human
aggaucucuugagccugggagg

SEQ ID NO: 1679215 - RNA, 16 nt, Human
aggaugaucuaggaag

SEQ ID NO: 1679216 - RNA, 17 nt, Human
aggaugaucuaggaaga

SEQ ID NO: 1679217 - RNA, 21 nt, Human
aggauacaaaagcaugugaga

SEQ ID NO: 1679218 - RNA, 15 nt, Human
aggauccugagccag

SEQ ID NO: 1679219 - RNA, 16 nt, Human
aggauccugagccaga

SEQ ID NO: 1679220 - RNA, 14 nt, Human
aggagggaggggga

SEQ ID NO: 1679221 - RNA, 21 nt, Human
aggagggagcaucagugcccu

SEQ ID NO: 1679222 - RNA, 15 nt, Human
uggacacagcucuuc

SEQ ID NO: 1679223 - RNA, 16 nt, Human
uggacacagcucuucu

SEQ ID NO: 1679224 - RNA, 18 nt, Human
uggacacagcucuucucc

SEQ ID NO: 1679225 - RNA, 21 nt, Human
uggacacagcucuucuccagg

SEQ ID NO: 1679226 - RNA, 15 nt, Human
uggacccugaggccc

SEQ ID NO: 1679227 - RNA, 14 nt, Human
uggacccugaggcc

SEQ ID NO: 1679228 - RNA, 12 nt, Human
uggacccugagg

SEQ ID NO: 1679229 - RNA, 13 nt, Human
uggacccugaggc

SEQ ID NO: 1679230 - RNA, 19 nt, Human
aggaugcccaaagaugcag

SEQ ID NO: 1679231 - RNA, 20 nt, Human
aggaugaucuaggaagacuu

SEQ ID NO: 1679232 - RNA, 14 nt, Human
aggaugcccaaaga

SEQ ID NO: 1679233 - RNA, 17 nt, Human
aggaugccccguccccc

SEQ ID NO: 1679234 - RNA, 19 nt, Human
aggauuuugauccaagcug

SEQ ID NO: 1679235 - RNA, 20 nt, Human
aggauuuuaugcuuuaaaca

SEQ ID NO: 1679236 - RNA, 17 nt, Human
aggcaacucaucuuagg

SEQ ID NO: 1679237 - RNA, 19 nt, Human
aggcaacugcauuggcuuu

SEQ ID NO: 1679238 - RNA, 18 nt, Human
uggaauuggagcucgugg

SEQ ID NO: 1679239 - RNA, 22 nt, Human
uggaauuucucccagucauuua

SEQ ID NO: 1679240 - RNA, 18 nt, Human
uggcugccaaugggagcu

SEQ ID NO: 1679241 - RNA, 20 nt, Human
uggcugccaaugggagcuca

SEQ ID NO: 1679242 - RNA, 15 nt, Human
uggcugcagggaguc

SEQ ID NO: 1679243 - RNA, 13 nt, Human
uggcugcagggag

SEQ ID NO: 1679244 - RNA, 14 nt, Human
uggcugcagggagu

SEQ ID NO: 1679245 - RNA, 12 nt, Human
uggcugcaaagg

SEQ ID NO: 1679246 - RNA, 18 nt, Human
uggcucaaguccucuuuu

SEQ ID NO: 1679247 - RNA, 20 nt, Human
uggcucuuccaggcugggag

SEQ ID NO: 1679248 - RNA, 21 nt, Human
uggcucuuccaggcugggaga

SEQ ID NO: 1679249 - RNA, 18 nt, Human
aggcuggcgugcaguggu

SEQ ID NO: 1679250 - RNA, 20 nt, Human
aggcuggcgugcaguggugc

SEQ ID NO: 1679251 - RNA, 22 nt, Human
uggcuagagguucaaagauauu

SEQ ID NO: 1679252 - RNA, 14 nt, Human
aggcugggagagcc

SEQ ID NO: 1679253 - RNA, 22 nt, Human
uggcuauuagagaucaaccccu

SEQ ID NO: 1679254 - RNA, 19 nt, Human
uggcuaugcauuugaaaau

SEQ ID NO: 1679255 - RNA, 14 nt, Human
uggcuaugcauuug

SEQ ID NO: 1679256 - RNA, 17 nt, Human
uggcuaugcauuugaaa

SEQ ID NO: 1679257 - RNA, 15 nt, Human
uggcuaugcauuuga

SEQ ID NO: 1679258 - RNA, 13 nt, Human
ugggaacuagacu

SEQ ID NO: 1679259 - RNA, 18 nt, Human
uggcuucccgcucagccc

SEQ ID NO: 1679260 - RNA, 17 nt, Human
uggcuucccgcucagcc

SEQ ID NO: 1679261 - RNA, 15 nt, Human
uggcuucccgcucag

SEQ ID NO: 1679262 - RNA, 16 nt, Human
uggcuucccgcucagc

SEQ ID NO: 1679263 - RNA, 16 nt, Human
ugggaaaggggaaguu

SEQ ID NO: 1679264 - RNA, 23 nt, Human
uggcuucacggaagagccuugcg

SEQ ID NO: 1679265 - RNA, 14 nt, Human
uggcugugucuccc

SEQ ID NO: 1679266 - RNA, 13 nt, Human
uggcuguuggcug

SEQ ID NO: 1679267 - RNA, 15 nt, Human
uggcuguuggcuggg

SEQ ID NO: 1679268 - RNA, 17 nt, Human
uggcuuaaaacaacacu

SEQ ID NO: 1679269 - RNA, 11 nt, Human
uggcugcugaa

SEQ ID NO: 1679270 - RNA, 23 nt, Human
aggcugcucuugaacuccugacc

SEQ ID NO: 1679271 - RNA, 18 nt, Human
aggcucuggagcccacug

SEQ ID NO: 1679272 - RNA, 19 nt, Human
aggcucuggagcccacugu

SEQ ID NO: 1679273 - RNA, 14 nt, Human
aggcucuggagccc

SEQ ID NO: 1679274 - RNA, 15 nt, Human
aggcucuggagccca

SEQ ID NO: 1679275 - RNA, 13 nt, Human
aggcucuggagcc

SEQ ID NO: 1679276 - RNA, 16 nt, Human
aggcucugcccuuggu

SEQ ID NO: 1679277 - RNA, 15 nt, Human
aggcuggcccugccc

SEQ ID NO: 1679278 - RNA, 16 nt, Human
aggcuggcccugcccu

SEQ ID NO: 1679279 - RNA, 17 nt, Human
aggcuggcccugcccug

SEQ ID NO: 1679280 - RNA, 18 nt, Human
aggcuggcccugcccugg

SEQ ID NO: 1679281 - RNA, 12 nt, Human
aggcuggcccug

SEQ ID NO: 1679282 - RNA, 14 nt, Human
aggcuggcccugcc

SEQ ID NO: 1679283 - RNA, 19 nt, Human
aggcuggcccugcccuggu

SEQ ID NO: 1679284 - RNA, 13 nt, Human
aggcuggcgugca

SEQ ID NO: 1679285 - RNA, 17 nt, Human
aggcuggcgugcagugg

SEQ ID NO: 1679286 - RNA, 14 nt, Human
aggcuccugccacc

SEQ ID NO: 1679287 - RNA, 20 nt, Human
aggcuccugccaccacgccc

SEQ ID NO: 1679288 - RNA, 19 nt, Human
aggcuccuuuagcgcccag

SEQ ID NO: 1679289 - RNA, 12 nt, Human
aggcucgagcau

SEQ ID NO: 1679290 - RNA, 21 nt, Human
aggcucgagcaugccuggaug

SEQ ID NO: 1679291 - RNA, 15 nt, Human
aggcucgagcaugcc

SEQ ID NO: 1679292 - RNA, 17 nt, Human
aggcucgagcaugccug

SEQ ID NO: 1679293 - RNA, 18 nt, Human
aggcucgagcaugccugg

SEQ ID NO: 1679294 - RNA, 19 nt, Human
aggcucgagcaugccugga

SEQ ID NO: 1679295 - RNA, 21 nt, Human
aggcucucaggccagcugcuu

SEQ ID NO: 1679296 - RNA, 11 nt, Human
aggcucugccc

SEQ ID NO: 1679297 - RNA, 12 nt, Human
aggcucugcccu

SEQ ID NO: 1679298 - RNA, 13 nt, Human
aggcucugcccuu

SEQ ID NO: 1679299 - RNA, 14 nt, Human
aggcucugcccuug

SEQ ID NO: 1679300 - RNA, 15 nt, Human
aggcucugcccuugg

SEQ ID NO: 1679301 - RNA, 11 nt, Human
aggcucucagg

SEQ ID NO: 1679302 - RNA, 12 nt, Human
aggcucucaggc

SEQ ID NO: 1679303 - RNA, 14 nt, Human
aggcucucaggcca

SEQ ID NO: 1679304 - RNA, 15 nt, Human
aggcucucaggccag

SEQ ID NO: 1679305 - RNA, 16 nt, Human
aggcucucaggccagc

SEQ ID NO: 1679306 - RNA, 18 nt, Human
aggcucucaggccagcug

SEQ ID NO: 1679307 - RNA, 19 nt, Human
aggcucucaggccagcugc

SEQ ID NO: 1679308 - RNA, 20 nt, Human
aggcucucaggccagcugcu

SEQ ID NO: 1679309 - RNA, 20 nt, Human
uggccaggcuggucucgaac

SEQ ID NO: 1679310 - RNA, 17 nt, Human
uggccaggcuggucuca

SEQ ID NO: 1679311 - RNA, 22 nt, Human
uggcaugggaaugaaugucagu

SEQ ID NO: 1679312 - RNA, 12 nt, Human
uggcaugggaau

SEQ ID NO: 1679313 - RNA, 15 nt, Human
uggcaugggaaugaa

SEQ ID NO: 1679314 - RNA, 13 nt, Human
aggccugccuguu

SEQ ID NO: 1679315 - RNA, 13 nt, Human
aggcccucugccc

SEQ ID NO: 1679316 - RNA, 14 nt, Human
aggcccucugccca

SEQ ID NO: 1679317 - RNA, 15 nt, Human
aggcccucugcccac

SEQ ID NO: 1679318 - RNA, 14 nt, Human
uggccucugcacuc

SEQ ID NO: 1679319 - RNA, 15 nt, Human
uggccucugcacucc

SEQ ID NO: 1679320 - RNA, 17 nt, Human
uggccucugcacucccc

SEQ ID NO: 1679321 - RNA, 23 nt, Human
uggccgggcgcgguggcucacgc

SEQ ID NO: 1679322 - RNA, 18 nt, Human
uggccucugcacuccccu

SEQ ID NO: 1679323 - RNA, 12 nt, Human
uggccuggcccc

SEQ ID NO: 1679324 - RNA, 23 nt, Human
aggccugggggcugggcagagga

SEQ ID NO: 1679325 - RNA, 22 nt, Human
aggccuggccagaugcaccagc

SEQ ID NO: 1679326 - RNA, 23 nt, Human
aggccuggccagaugcaccagcc

SEQ ID NO: 1679327 - RNA, 15 nt, Human
aggccuggccagaug

SEQ ID NO: 1679328 - RNA, 16 nt, Human
aggccuggccagaugc

SEQ ID NO: 1679329 - RNA, 17 nt, Human
aggccuggccagaugca

SEQ ID NO: 1679330 - RNA, 21 nt, Human
aggccuggccagaugcaccag

SEQ ID NO: 1679331 - RNA, 14 nt, Human
uggcccgacagccu

SEQ ID NO: 1679332 - RNA, 15 nt, Human
uggcccgacagccug

SEQ ID NO: 1679333 - RNA, 16 nt, Human
uggcccgacagccugg

SEQ ID NO: 1679334 - RNA, 17 nt, Human
uggcccgacagccuggc

SEQ ID NO: 1679335 - RNA, 18 nt, Human
uggcccgacagccuggca

SEQ ID NO: 1679336 - RNA, 19 nt, Human
uggcccgacagccuggcac

SEQ ID NO: 1679337 - RNA, 21 nt, Human
uggccccugcccggcugcgga

SEQ ID NO: 1679338 - RNA, 15 nt, Human
uggccgggagccuga

SEQ ID NO: 1679339 - RNA, 19 nt, Human
uggagucagacagaugugg

SEQ ID NO: 1679340 - RNA, 15 nt, Human
aggccacaagacccu

SEQ ID NO: 1679341 - RNA, 16 nt, Human
aggccacaagacccuu

SEQ ID NO: 1679342 - RNA, 20 nt, Human
uggaugccugguggcagcug

SEQ ID NO: 1679343 - RNA, 18 nt, Human
uggaugccugguggcagc

SEQ ID NO: 1679344 - RNA, 19 nt, Human
uggaugccugguggcagcu

SEQ ID NO: 1679345 - RNA, 16 nt, Human
uggaguucaucuugaa

SEQ ID NO: 1679346 - RNA, 17 nt, Human
uggaguucaucuugaau

SEQ ID NO: 1679347 - RNA, 20 nt, Human
uggaguucaucuugaauugu

SEQ ID NO: 1679348 - RNA, 23 nt, Human
aggccaaaggaagcacaugccuc

SEQ ID NO: 1679349 - RNA, 18 nt, Human
aggccaaggugggaggau

SEQ ID NO: 1679350 - RNA, 20 nt, Human
aggccaaacucaccugcccc

SEQ ID NO: 1679351 - RNA, 14 nt, Human
aggccaaaggaagc

SEQ ID NO: 1679352 - RNA, 15 nt, Human
aggccaaaggaagca

SEQ ID NO: 1679353 - RNA, 16 nt, Human
aggccaaacucaccug

SEQ ID NO: 1679354 - RNA, 18 nt, Human
aggcauuuguuugaacug

SEQ ID NO: 1679355 - RNA, 18 nt, Human
uggacgagaaaacaauaa

SEQ ID NO: 1679356 - RNA, 12 nt, Human
aggccagagaca

SEQ ID NO: 1679357 - RNA, 13 nt, Human
uggcagccuuggc

SEQ ID NO: 1679358 - RNA, 23 nt, Human
uggcagccgugccuucagcucua

SEQ ID NO: 1679359 - RNA, 15 nt, Human
uggcagccucuucaa

SEQ ID NO: 1679360 - RNA, 16 nt, Human
uggcagccucuucaaa

SEQ ID NO: 1679361 - RNA, 20 nt, Human
aggccacaagacccuugugg

SEQ ID NO: 1679362 - RNA, 16 nt, Human
uggcagccgugccuuc

SEQ ID NO: 1679363 - RNA, 12 nt, Human
uggcagccccug

SEQ ID NO: 1679364 - RNA, 21 nt, Human
uggcacaucagcacgauuucu

SEQ ID NO: 1679365 - RNA, 15 nt, Human
uggcacccggccccu

SEQ ID NO: 1679366 - RNA, 16 nt, Human
uggcacccggccccug

SEQ ID NO: 1679367 - RNA, 21 nt, Human
uggcagaguugaagacagagc

SEQ ID NO: 1679368 - RNA, 22 nt, Human
uggcagaguugaagacagagcu

SEQ ID NO: 1679369 - RNA, 22 nt, Human
uggauuaaacuuaaucuaaaug

SEQ ID NO: 1679370 - RNA, 12 nt, Human
uggauguucuga

SEQ ID NO: 1679371 - RNA, 20 nt, Human
uggcacaucagcacgauuuc

SEQ ID NO: 1679372 - RNA, 22 nt, Human
uggcacaguuuucugagaaaga

SEQ ID NO: 1679373 - RNA, 15 nt, Human
ugccucucugcaggu

SEQ ID NO: 1679374 - RNA, 23 nt, Human
ugccucucugcaggucccuaaua

SEQ ID NO: 1679375 - RNA, 14 nt, Human
ugccucugacacac

SEQ ID NO: 1679376 - RNA, 16 nt, Human
ugccucugacacacag

SEQ ID NO: 1679377 - RNA, 11 nt, Human
ugccucugccu

SEQ ID NO: 1679378 - RNA, 20 nt, Human
ugccugcccaggccccugcc

SEQ ID NO: 1679379 - RNA, 12 nt, Human
ugccucugccuc

SEQ ID NO: 1679380 - RNA, 17 nt, Human
ugccugcccaggccccu

SEQ ID NO: 1679381 - RNA, 18 nt, Human
ugccugcccaggccccug

SEQ ID NO: 1679382 - RNA, 19 nt, Human
ugccugcccaggccccugc

SEQ ID NO: 1679383 - RNA, 23 nt, Human
agcugcuuuugucuaugggacuc

SEQ ID NO: 1679384 - RNA, 24 nt, Human
agcugcuuuugucuaugggacuca

SEQ ID NO: 1679385 - RNA, 13 nt, Human
agcugccuguuca

SEQ ID NO: 1679386 - RNA, 21 nt, Human
agcugcccucuccugggcagc

SEQ ID NO: 1679387 - RNA, 20 nt, Human
agcugcccucuccugggcag

SEQ ID NO: 1679388 - RNA, 19 nt, Human
agcugcccucuccugggca

SEQ ID NO: 1679389 - RNA, 18 nt, Human
agcugcccucuccugggc

SEQ ID NO: 1679390 - RNA, 17 nt, Human
agcugcccucuccuggg

SEQ ID NO: 1679391 - RNA, 15 nt, Human
ugccuccccuccucu

SEQ ID NO: 1679392 - RNA, 14 nt, Human
ugccuccccuccuc

SEQ ID NO: 1679393 - RNA, 13 nt, Human
ugccuccccuccu

SEQ ID NO: 1679394 - RNA, 12 nt, Human
ugccuccccucc

SEQ ID NO: 1679395 - RNA, 11 nt, Human
ugccuccccuc

SEQ ID NO: 1679396 - RNA, 11 nt, Human
ugccucucugc

SEQ ID NO: 1679397 - RNA, 12 nt, Human
ugccucucugca

SEQ ID NO: 1679398 - RNA, 17 nt, Human
ugccucucucaggccaa

SEQ ID NO: 1679399 - RNA, 16 nt, Human
ugccuccccuccucug

SEQ ID NO: 1679400 - RNA, 22 nt, Human
ugccucccaucacccgcuaaga

SEQ ID NO: 1679401 - RNA, 15 nt, Human
ugccucagccuccug

SEQ ID NO: 1679402 - RNA, 15 nt, Human
ugccucagccucccg

SEQ ID NO: 1679403 - RNA, 18 nt, Human
ugccucagaaaacaagga

SEQ ID NO: 1679404 - RNA, 20 nt, Human
ugccgcagcccugcagaggg

SEQ ID NO: 1679405 - RNA, 15 nt, Human
ugccucaccccuugc

SEQ ID NO: 1679406 - RNA, 15 nt, Human
agcucuucuccaggc

SEQ ID NO: 1679407 - RNA, 16 nt, Human
agcucuucuccaggcu

SEQ ID NO: 1679408 - RNA, 17 nt, Human
agcucuucuccaggcug

SEQ ID NO: 1679409 - RNA, 15 nt, Human
ugcccugugggcccc

SEQ ID NO: 1679410 - RNA, 18 nt, Human
ugcccugugggcccccaa

SEQ ID NO: 1679411 - RNA, 22 nt, Human
ugcccuuaccugccaggaagcc

SEQ ID NO: 1679412 - RNA, 19 nt, Human
ugcccuguuaaaagaugaa

SEQ ID NO: 1679413 - RNA, 13 nt, Human
agcuccagcucac

SEQ ID NO: 1679414 - RNA, 17 nt, Human
agcuccagcucaccagc

SEQ ID NO: 1679415 - RNA, 14 nt, Human
ugcccugcccaccu

SEQ ID NO: 1679416 - RNA, 17 nt, Human
agcuccaagcucccagg

SEQ ID NO: 1679417 - RNA, 18 nt, Human
agcuccaagcucccaggc

SEQ ID NO: 1679418 - RNA, 19 nt, Human
agcuccaagcucccaggca

SEQ ID NO: 1679419 - RNA, 23 nt, Human
ugcccuaaugcgcaggcuggccc

SEQ ID NO: 1679420 - RNA, 20 nt, Human
ugcccuaaugcgcaggcugg

SEQ ID NO: 1679421 - RNA, 20 nt, Human
ugcccucuccugggcagcug

SEQ ID NO: 1679422 - RNA, 18 nt, Human
ugcccucuccugggcagc

SEQ ID NO: 1679423 - RNA, 17 nt, Human
ugcccucuccugggcag

SEQ ID NO: 1679424 - RNA, 16 nt, Human
ugcccucuccugggca

SEQ ID NO: 1679425 - RNA, 23 nt, Human
ugcccucuccugggcagcugccu

SEQ ID NO: 1679426 - RNA, 22 nt, Human
ugcccucuccugggcagcugcc

SEQ ID NO: 1679427 - RNA, 15 nt, Human
ugcccucuccugggc

SEQ ID NO: 1679428 - RNA, 14 nt, Human
ugcccucuccuggg

SEQ ID NO: 1679429 - RNA, 13 nt, Human
ugcccucuccugg

SEQ ID NO: 1679430 - RNA, 12 nt, Human
ugcccucuccug

SEQ ID NO: 1679431 - RNA, 23 nt, Human
agcuccuucuguccuacucugug

SEQ ID NO: 1679432 - RNA, 21 nt, Human
agcuccaucuccacuccagau

SEQ ID NO: 1679433 - RNA, 21 nt, Human
agcuccagcucaccagcccca

SEQ ID NO: 1679434 - RNA, 18 nt, Human
agcuccagcucaccagcc

SEQ ID NO: 1679435 - RNA, 19 nt, Human
agcuccagcucaccagccc

SEQ ID NO: 1679436 - RNA, 21 nt, Human
agcucugcagagcaggaaaca

SEQ ID NO: 1679437 - RNA, 23 nt, Human
agcucugcccauccugccccuga

SEQ ID NO: 1679438 - RNA, 19 nt, Human
ugcauuugaggucuguucu

SEQ ID NO: 1679439 - RNA, 20 nt, Human
ugcauuuaaaagauacaguu

SEQ ID NO: 1679440 - RNA, 23 nt, Human
agccuugaccauucuccaccugc

SEQ ID NO: 1679441 - RNA, 22 nt, Human
agcgauucuucugcuucagccu

SEQ ID NO: 1679442 - RNA, 22 nt, Human
agccuugaacuuugaccucugc

SEQ ID NO: 1679443 - RNA, 16 nt, Human
agccuugaacuuugac

SEQ ID NO: 1679444 - RNA, 23 nt, Human
agccuugaacuuugaccucugca

SEQ ID NO: 1679445 - RNA, 22 nt, Human
agccuugaccauucuccaccug

SEQ ID NO: 1679446 - RNA, 15 nt, Human
agccuugaacuuuga

SEQ ID NO: 1679447 - RNA, 18 nt, Human
agccuuccagggguggga

SEQ ID NO: 1679448 - RNA, 18 nt, Human
ugccacugccucuuccuc

SEQ ID NO: 1679449 - RNA, 19 nt, Human
ugccacugccucuuccucc

SEQ ID NO: 1679450 - RNA, 20 nt, Human
ugccacugccucuuccuccc

SEQ ID NO: 1679451 - RNA, 13 nt, Human
ugccacugccucu

SEQ ID NO: 1679452 - RNA, 17 nt, Human
ugccacugccucuuccu

SEQ ID NO: 1679453 - RNA, 21 nt, Human
ugcauuugaggucuguucuuu

SEQ ID NO: 1679454 - RNA, 20 nt, Human
ugcauuugaggucuguucuu

SEQ ID NO: 1679455 - RNA, 18 nt, Human
ugccagcuuaucucaggg

SEQ ID NO: 1679456 - RNA, 13 nt, Human
agcggcuggcagc

SEQ ID NO: 1679457 - RNA, 22 nt, Human
agcggggacagcuccuucuguc

SEQ ID NO: 1679458 - RNA, 23 nt, Human
agcggcuggcagcccaccccuca

SEQ ID NO: 1679459 - RNA, 19 nt, Human
agcggggacagcuccuucu

SEQ ID NO: 1679460 - RNA, 20 nt, Human
agcggggacagcuccuucug

SEQ ID NO: 1679461 - RNA, 17 nt, Human
agcuaucguaaaauuaa

SEQ ID NO: 1679462 - RNA, 21 nt, Human
agcuaggccuggccagaugca

SEQ ID NO: 1679463 - RNA, 13 nt, Human
agcgugagccacu

SEQ ID NO: 1679464 - RNA, 20 nt, Human
agcucagggccuggcucagg

SEQ ID NO: 1679465 - RNA, 14 nt, Human
agcucagggccugg

SEQ ID NO: 1679466 - RNA, 19 nt, Human
agcucagggccuggcucag

SEQ ID NO: 1679467 - RNA, 19 nt, Human
agcuauucaguaauaacuc

SEQ ID NO: 1679468 - RNA, 12 nt, Human
agcucagggccu

SEQ ID NO: 1679469 - RNA, 13 nt, Human
agcucagggccug

SEQ ID NO: 1679470 - RNA, 15 nt, Human
agcuccaagaauuuc

SEQ ID NO: 1679471 - RNA, 17 nt, Human
agcucaggugucccugc

SEQ ID NO: 1679472 - RNA, 18 nt, Human
agcuccaagaauuucuag

SEQ ID NO: 1679473 - RNA, 15 nt, Human
agcuccaagcuccca

SEQ ID NO: 1679474 - RNA, 16 nt, Human
agcuccaagcucccag

SEQ ID NO: 1679475 - RNA, 22 nt, Human
ugccauuuaaagcuuauuaaaa

SEQ ID NO: 1679476 - RNA, 17 nt, Human
ugcccaaagaugcagcc

SEQ ID NO: 1679477 - RNA, 20 nt, Human
ugcccaaagaugcagccggu

SEQ ID NO: 1679478 - RNA, 13 nt, Human
ugcccagccccuu

SEQ ID NO: 1679479 - RNA, 16 nt, Human
ugcccagccccuucug

SEQ ID NO: 1679480 - RNA, 17 nt, Human
ugcccagccccuucuga

SEQ ID NO: 1679481 - RNA, 15 nt, Human
ugcccaggccccugc

SEQ ID NO: 1679482 - RNA, 17 nt, Human
ugcccaggccccugcca

SEQ ID NO: 1679483 - RNA, 18 nt, Human
ugcccaggccccugccac

SEQ ID NO: 1679484 - RNA, 14 nt, Human
ugcccccucugccc

SEQ ID NO: 1679485 - RNA, 15 nt, Human
ugcccccucugcccu

SEQ ID NO: 1679486 - RNA, 16 nt, Human
ugcccccucugcccug

SEQ ID NO: 1679487 - RNA, 17 nt, Human
ugcccccucugcccugc

SEQ ID NO: 1679488 - RNA, 18 nt, Human
ugcccccucugcccugcg

SEQ ID NO: 1679489 - RNA, 20 nt, Human
ugcccuaaaguguauuuuuu

SEQ ID NO: 1679490 - RNA, 23 nt, Human
ugccccgaacauguuuuucuucu

SEQ ID NO: 1679491 - RNA, 16 nt, Human
ugccccauucaacauc

SEQ ID NO: 1679492 - RNA, 14 nt, Human
agcccacuguacuu

SEQ ID NO: 1679493 - RNA, 16 nt, Human
agcccacuguacuugc

SEQ ID NO: 1679494 - RNA, 13 nt, Human
agcccacuucugc

SEQ ID NO: 1679495 - RNA, 14 nt, Human
agcccacuucugcc

SEQ ID NO: 1679496 - RNA, 15 nt, Human
agcccacuucugcca

SEQ ID NO: 1679497 - RNA, 22 nt, Human
agcccacuucugccauauucug

SEQ ID NO: 1679498 - RNA, 21 nt, Human
agccaguaaaugggggugcau

SEQ ID NO: 1679499 - RNA, 22 nt, Human
agccaguaaaugggggugcauu

SEQ ID NO: 1679500 - RNA, 13 nt, Human
agccaguaaaugg

SEQ ID NO: 1679501 - RNA, 22 nt, Human
ugauucccaagcucugcuccuc

SEQ ID NO: 1679502 - RNA, 23 nt, Human
ugauucccaagcucugcuccucu

SEQ ID NO: 1679503 - RNA, 13 nt, Human
ugauucucaugcc

SEQ ID NO: 1679504 - RNA, 14 nt, Human
ugauucucaugccu

SEQ ID NO: 1679505 - RNA, 15 nt, Human
ugauucucaugccuc

SEQ ID NO: 1679506 - RNA, 16 nt, Human
ugauucucaugccuca

SEQ ID NO: 1679507 - RNA, 13 nt, Human
ugauucuccugcc

SEQ ID NO: 1679508 - RNA, 23 nt, Human
agcccagcuugaaaccuucacuu

SEQ ID NO: 1679509 - RNA, 14 nt, Human
agcccaggaaaggc

SEQ ID NO: 1679510 - RNA, 21 nt, Human
ugauucauaaugacuuaagca

SEQ ID NO: 1679511 - RNA, 18 nt, Human
agcccaggaaaggcucca

SEQ ID NO: 1679512 - RNA, 16 nt, Human
ugauucauaaugacuu

SEQ ID NO: 1679513 - RNA, 17 nt, Human
ugauuucagcucacugc

SEQ ID NO: 1679514 - RNA, 22 nt, Human
ugauuuccguuaaaauaccagc

SEQ ID NO: 1679515 - RNA, 12 nt, Human
ugauuucuaugc

SEQ ID NO: 1679516 - RNA, 15 nt, Human
ugauuucuaugcuga

SEQ ID NO: 1679517 - RNA, 16 nt, Human
ugauuucuaugcugag

SEQ ID NO: 1679518 - RNA, 17 nt, Human
ugauuuggggauauuuu

SEQ ID NO: 1679519 - RNA, 13 nt, Human
ugaugagaggaaa

SEQ ID NO: 1679520 - RNA, 14 nt, Human
ugaugagaggaaau

SEQ ID NO: 1679521 - RNA, 15 nt, Human
ugaugagaggaaauc

SEQ ID NO: 1679522 - RNA, 16 nt, Human
ugaugagaggaaauca

SEQ ID NO: 1679523 - RNA, 14 nt, Human
ugaugggaaagcau

SEQ ID NO: 1679524 - RNA, 14 nt, Human
ugauggggcccugc

SEQ ID NO: 1679525 - RNA, 15 nt, Human
ugauggggcccugcc

SEQ ID NO: 1679526 - RNA, 16 nt, Human
ugauggggcccugccu

SEQ ID NO: 1679527 - RNA, 19 nt, Human
ugauggggcccugccuccu

SEQ ID NO: 1679528 - RNA, 14 nt, Human
ugaugggauuuggu

SEQ ID NO: 1679529 - RNA, 21 nt, Human
ugaugggcaacccccagccug

SEQ ID NO: 1679530 - RNA, 19 nt, Human
ugaugggaaagcauuguaa

SEQ ID NO: 1679531 - RNA, 16 nt, Human
ugauccuaguuccacc

SEQ ID NO: 1679532 - RNA, 15 nt, Human
ugauccucccaccuc

SEQ ID NO: 1679533 - RNA, 22 nt, Human
ugauccuaaugaaugcauaaaa

SEQ ID NO: 1679534 - RNA, 22 nt, Human
ugauccucccaccucagccucc

SEQ ID NO: 1679535 - RNA, 16 nt, Human
ugauccucccaccuca

SEQ ID NO: 1679536 - RNA, 21 nt, Human
ugauccucccaccucagccuc

SEQ ID NO: 1679537 - RNA, 11 nt, Human
ugaugaagaag

SEQ ID NO: 1679538 - RNA, 12 nt, Human
ugaugaagaagu

SEQ ID NO: 1679539 - RNA, 17 nt, Human
ugauuaauggaaauguu

SEQ ID NO: 1679540 - RNA, 15 nt, Human
agccacgguguucug

SEQ ID NO: 1679541 - RNA, 20 nt, Human
ugauuaaccacuucagcuga

SEQ ID NO: 1679542 - RNA, 23 nt, Human
ugauuaaguaaugauaacuggaa

SEQ ID NO: 1679543 - RNA, 19 nt, Human
ugauuaaauucuugcaaag

SEQ ID NO: 1679544 - RNA, 15 nt, Human
ugauggugcaaugac

SEQ ID NO: 1679545 - RNA, 15 nt, Human
ugauggugaugaaau

SEQ ID NO: 1679546 - RNA, 16 nt, Human
ugauggugaugaaaug

SEQ ID NO: 1679547 - RNA, 13 nt, Human
ugauggugcaaug

SEQ ID NO: 1679548 - RNA, 17 nt, Human
ugauggugaugaaaugu

SEQ ID NO: 1679549 - RNA, 20 nt, Human
ugauuaaauucuugcaaagu

SEQ ID NO: 1679550 - RNA, 19 nt, Human
ugauuaaccacuucagcug

SEQ ID NO: 1679551 - RNA, 18 nt, Human
ugauuaaguaaugauaac

SEQ ID NO: 1679552 - RNA, 21 nt, Human
agccagcaguucagagcugcc

SEQ ID NO: 1679553 - RNA, 20 nt, Human
agccagcaguucagagcugc

SEQ ID NO: 1679554 - RNA, 22 nt, Human
agccagcaguucagagcugccc

SEQ ID NO: 1679555 - RNA, 20 nt, Human
agccacugcaccgggccaca

SEQ ID NO: 1679556 - RNA, 18 nt, Human
agccacugcaccgggcca

SEQ ID NO: 1679557 - RNA, 19 nt, Human
agccacugcaccgggccac

SEQ ID NO: 1679558 - RNA, 10 nt, Human
agccagagga

SEQ ID NO: 1679559 - RNA, 11 nt, Human
agccagaggag

SEQ ID NO: 1679560 - RNA, 15 nt, Human
agccagcaguucaga

SEQ ID NO: 1679561 - RNA, 19 nt, Human
agccagcaguucagagcug

SEQ ID NO: 1679562 - RNA, 17 nt, Human
agccagcaguucagagc

SEQ ID NO: 1679563 - RNA, 19 nt, Human
agcccugcuuugggcugcc

SEQ ID NO: 1679564 - RNA, 20 nt, Human
agcccugcuuugggcugccc

SEQ ID NO: 1679565 - RNA, 17 nt, Human
agcccugcuuugggcug

SEQ ID NO: 1679566 - RNA, 22 nt, Human
ugcacacaccagagcccaccuu

SEQ ID NO: 1679567 - RNA, 21 nt, Human
ugcacacaccagagcccaccu

SEQ ID NO: 1679568 - RNA, 17 nt, Human
ugcacacaccagagccc

SEQ ID NO: 1679569 - RNA, 18 nt, Human
ugcacacaccagagccca

SEQ ID NO: 1679570 - RNA, 14 nt, Human
agcccugguggcag

SEQ ID NO: 1679571 - RNA, 15 nt, Human
agcccugguggcagu

SEQ ID NO: 1679572 - RNA, 16 nt, Human
agcccugguggcagug

SEQ ID NO: 1679573 - RNA, 23 nt, Human
agccccauucugccugcccaggc

SEQ ID NO: 1679574 - RNA, 21 nt, Human
ugcaaaccaucauugaaaucu

SEQ ID NO: 1679575 - RNA, 16 nt, Human
agccccaaaacucucc

SEQ ID NO: 1679576 - RNA, 17 nt, Human
agccccaaaacucuccu

SEQ ID NO: 1679577 - RNA, 18 nt, Human
agccccaaaacucuccuc

SEQ ID NO: 1679578 - RNA, 21 nt, Human
agccccauucugccugcccag

SEQ ID NO: 1679579 - RNA, 22 nt, Human
agccccauucugccugcccagg

SEQ ID NO: 1679580 - RNA, 13 nt, Human
agccucagucucc

SEQ ID NO: 1679581 - RNA, 16 nt, Human
agccucagucucccuc

SEQ ID NO: 1679582 - RNA, 19 nt, Human
agccucagucucccucccu

SEQ ID NO: 1679583 - RNA, 20 nt, Human
agccucagucucccucccuu

SEQ ID NO: 1679584 - RNA, 22 nt, Human
agccucagucucccucccuugg

SEQ ID NO: 1679585 - RNA, 17 nt, Human
agccucacaguccuuac

SEQ ID NO: 1679586 - RNA, 18 nt, Human
agccucacaguccuuacc

SEQ ID NO: 1679587 - RNA, 20 nt, Human
agccucaaccuccugggcua

SEQ ID NO: 1679588 - RNA, 18 nt, Human
agccgagaucacgccacu

SEQ ID NO: 1679589 - RNA, 21 nt, Human
ugcagccucaaccuccugggc

SEQ ID NO: 1679590 - RNA, 22 nt, Human
ugcagccucaaccuccugggcu

SEQ ID NO: 1679591 - RNA, 23 nt, Human
ugcagccucaaccuccugggcua

SEQ ID NO: 1679592 - RNA, 17 nt, Human
agccuccaugcugccuc

SEQ ID NO: 1679593 - RNA, 21 nt, Human
agccuccaagcuccaucucca

SEQ ID NO: 1679594 - RNA, 23 nt, Human
agccucugaaaaccaauguucuc

SEQ ID NO: 1679595 - RNA, 18 nt, Human
ugcagacucuacagaggc

SEQ ID NO: 1679596 - RNA, 16 nt, Human
ugcagacucuacagag

SEQ ID NO: 1679597 - RNA, 17 nt, Human
ugcagacucuacagagg

SEQ ID NO: 1679598 - RNA, 16 nt, Human
agcccuuagcagggaa

SEQ ID NO: 1679599 - RNA, 21 nt, Human
agcccuuagcagggaaacagc

SEQ ID NO: 1679600 - RNA, 21 nt, Human
agccgagauagccaaggccaa

SEQ ID NO: 1679601 - RNA, 17 nt, Human
agccgagaucacgccac

SEQ ID NO: 1679602 - RNA, 21 nt, Human
agcccugguggcagugggagc

SEQ ID NO: 1679603 - RNA, 19 nt, Human
ugcacuccccugcugggug

SEQ ID NO: 1679604 - RNA, 16 nt, Human
ugcacuccccugcugg

SEQ ID NO: 1679605 - RNA, 17 nt, Human
ugcacuccccugcuggg

SEQ ID NO: 1679606 - RNA, 15 nt, Human
ugcacacauuuuuua

SEQ ID NO: 1679607 - RNA, 13 nt, Human
ugcacacauuuuu

SEQ ID NO: 1679608 - RNA, 12 nt, Human
ugcacacauuuu

SEQ ID NO: 1679609 - RNA, 11 nt, Human
ugcacacauuu

SEQ ID NO: 1679610 - RNA, 14 nt, Human
ugcagaagacagua

SEQ ID NO: 1679611 - RNA, 22 nt, Human
ugcagacaggcaagcaccuccu

SEQ ID NO: 1679612 - RNA, 15 nt, Human
ugcagaagacaguau

SEQ ID NO: 1679613 - RNA, 13 nt, Human
aguucucuccuuc

SEQ ID NO: 1679614 - RNA, 16 nt, Human
aguucucuccuucuuc

SEQ ID NO: 1679615 - RNA, 15 nt, Human
uguuuucucuugaga

SEQ ID NO: 1679616 - RNA, 17 nt, Human
uguuuucaguguacaug

SEQ ID NO: 1679617 - RNA, 15 nt, Human
uguuuucaguguaca

SEQ ID NO: 1679618 - RNA, 13 nt, Human
uguuuuauaauuu

SEQ ID NO: 1679619 - RNA, 20 nt, Human
uguuuuauaauuuugugaag

SEQ ID NO: 1679620 - RNA, 19 nt, Human
uguuuggggaugagaaagg

SEQ ID NO: 1679621 - RNA, 15 nt, Human
uguuuggggaugaga

SEQ ID NO: 1679622 - RNA, 19 nt, Human
uguuugcuaagcauuccaa

SEQ ID NO: 1679623 - RNA, 14 nt, Human
uguugucagcugaa

SEQ ID NO: 1679624 - RNA, 15 nt, Human
uguuugcaucugaaa

SEQ ID NO: 1679625 - RNA, 14 nt, Human
uguuugccucugcc

SEQ ID NO: 1679626 - RNA, 16 nt, Human
uguuugccucugccuc

SEQ ID NO: 1679627 - RNA, 15 nt, Human
uguuugcuaagcauu

SEQ ID NO: 1679628 - RNA, 19 nt, Human
aguugcaacuuuguauaaa

SEQ ID NO: 1679629 - RNA, 23 nt, Human
aguugauucagcucugcaagaau

SEQ ID NO: 1679630 - RNA, 14 nt, Human
aguugauucagcuc

SEQ ID NO: 1679631 - RNA, 15 nt, Human
aguugauucagcucu

SEQ ID NO: 1679632 - RNA, 17 nt, Human
aguugauucagcucugc

SEQ ID NO: 1679633 - RNA, 18 nt, Human
aguugauucagcucugca

SEQ ID NO: 1679634 - RNA, 13 nt, Human
aguugauucagcu

SEQ ID NO: 1679635 - RNA, 22 nt, Human
aguugauagcacagacccugcc

SEQ ID NO: 1679636 - RNA, 23 nt, Human
aguugauagcacagacccugccc

SEQ ID NO: 1679637 - RNA, 21 nt, Human
aguugauaugccuuuucccaa

SEQ ID NO: 1679638 - RNA, 15 nt, Human
aguugauagcacaga

SEQ ID NO: 1679639 - RNA, 19 nt, Human
aguugauagcacagacccu

SEQ ID NO: 1679640 - RNA, 20 nt, Human
aguugauagcacagacccug

SEQ ID NO: 1679641 - RNA, 21 nt, Human
aguugauagcacagacccugc

SEQ ID NO: 1679642 - RNA, 13 nt, Human
aguucugaagaag

SEQ ID NO: 1679643 - RNA, 14 nt, Human
aguucugaagaaga

SEQ ID NO: 1679644 - RNA, 15 nt, Human
aguucugaagaagau

SEQ ID NO: 1679645 - RNA, 16 nt, Human
aguucugaagaagaug

SEQ ID NO: 1679646 - RNA, 15 nt, Human
aguuucguuuucaaa

SEQ ID NO: 1679647 - RNA, 16 nt, Human
aguuucguuuucaaaa

SEQ ID NO: 1679648 - RNA, 16 nt, Human
aguuucucagcuccca

SEQ ID NO: 1679649 - RNA, 21 nt, Human
aguuucuccaagcaggacaug

SEQ ID NO: 1679650 - RNA, 13 nt, Human
aguuucuccaagc

SEQ ID NO: 1679651 - RNA, 15 nt, Human
aguuucuccaagcag

SEQ ID NO: 1679652 - RNA, 20 nt, Human
uuaaauucuugcaaaguauc

SEQ ID NO: 1679653 - RNA, 16 nt, Human
uuaaauucuugcaaag

SEQ ID NO: 1679654 - RNA, 13 nt, Human
uuaaauucuugca

SEQ ID NO: 1679655 - RNA, 22 nt, Human
aguuuucacucuuauugcccac

SEQ ID NO: 1679656 - RNA, 19 nt, Human
aguuugugcugguguaugu

SEQ ID NO: 1679657 - RNA, 17 nt, Human
uuaaaacaacacucaca

SEQ ID NO: 1679658 - RNA, 18 nt, Human
uuaaaaaguggaaaaaua

SEQ ID NO: 1679659 - RNA, 20 nt, Human
aguugccagucaccccggcc

SEQ ID NO: 1679660 - RNA, 15 nt, Human
uuaaaaaagaaacau

SEQ ID NO: 1679661 - RNA, 18 nt, Human
uuaaaaaagaaacauuug

SEQ ID NO: 1679662 - RNA, 22 nt, Human
uuaaauaaugugaaacuggauu

SEQ ID NO: 1679663 - RNA, 21 nt, Human
uuaaauaaugugaaacuggau

SEQ ID NO: 1679664 - RNA, 20 nt, Human
uuaaauaaugugaaacugga

SEQ ID NO: 1679665 - RNA, 13 nt, Human
uuaaauaaaucau

SEQ ID NO: 1679666 - RNA, 15 nt, Human
uuaaauaaaucauaa

SEQ ID NO: 1679667 - RNA, 16 nt, Human
uuaaaauauuccugca

SEQ ID NO: 1679668 - RNA, 19 nt, Human
uuaaaauauuccugcauuu

SEQ ID NO: 1679669 - RNA, 17 nt, Human
uuaaaccgccaaggcug

SEQ ID NO: 1679670 - RNA, 14 nt, Human
uuaaaaucauuucu

SEQ ID NO: 1679671 - RNA, 16 nt, Human
uguucccauucuugca

SEQ ID NO: 1679672 - RNA, 23 nt, Human
aguguacauggaauaacauguaa

SEQ ID NO: 1679673 - RNA, 18 nt, Human
uguucuugguuuguaaau

SEQ ID NO: 1679674 - RNA, 17 nt, Human
uguucuugguuuguaaa

SEQ ID NO: 1679675 - RNA, 14 nt, Human
uguucuuuccaaag

SEQ ID NO: 1679676 - RNA, 13 nt, Human
uguucuuuccaaa

SEQ ID NO: 1679677 - RNA, 19 nt, Human
uguucuugguuuguaaauu

SEQ ID NO: 1679678 - RNA, 16 nt, Human
uguucuuaauucuuag

SEQ ID NO: 1679679 - RNA, 14 nt, Human
uguucuuaauucuu

SEQ ID NO: 1679680 - RNA, 14 nt, Human
uguucugggacaca

SEQ ID NO: 1679681 - RNA, 15 nt, Human
uguucugggacacag

SEQ ID NO: 1679682 - RNA, 13 nt, Human
uguucugggacac

SEQ ID NO: 1679683 - RNA, 19 nt, Human
agugggggaguggccacag

SEQ ID NO: 1679684 - RNA, 20 nt, Human
agugggggaguggccacaga

SEQ ID NO: 1679685 - RNA, 18 nt, Human
agugggggaucacagccu

SEQ ID NO: 1679686 - RNA, 13 nt, Human
agugggugaauaa

SEQ ID NO: 1679687 - RNA, 18 nt, Human
agugggugaauaauacag

SEQ ID NO: 1679688 - RNA, 14 nt, Human
aguggcagcugcuu

SEQ ID NO: 1679689 - RNA, 20 nt, Human
aguggcagcugcuuuugucu

SEQ ID NO: 1679690 - RNA, 12 nt, Human
aguggcagcugc

SEQ ID NO: 1679691 - RNA, 13 nt, Human
aguggcagcugcu

SEQ ID NO: 1679692 - RNA, 16 nt, Human
aguggugcgaucuggg

SEQ ID NO: 1679693 - RNA, 21 nt, Human
agugguuccuaauccucuagg

SEQ ID NO: 1679694 - RNA, 19 nt, Human
agugggugaauaauacagu

SEQ ID NO: 1679695 - RNA, 21 nt, Human
aguguacauggaauaacaugu

SEQ ID NO: 1679696 - RNA, 22 nt, Human
aguguacauggaauaacaugua

SEQ ID NO: 1679697 - RNA, 17 nt, Human
aguucccuacuuccugu

SEQ ID NO: 1679698 - RNA, 21 nt, Human
aguuauuuuuauuuauuuaaa

SEQ ID NO: 1679699 - RNA, 19 nt, Human
aguucagagcugcccucuc

SEQ ID NO: 1679700 - RNA, 18 nt, Human
aguucagagcugcccucu

SEQ ID NO: 1679701 - RNA, 17 nt, Human
aguucagagcugcccuc

SEQ ID NO: 1679702 - RNA, 16 nt, Human
aguucagagcugcccu

SEQ ID NO: 1679703 - RNA, 15 nt, Human
aguucagagcugccc

SEQ ID NO: 1679704 - RNA, 14 nt, Human
aguucagagcugcc

SEQ ID NO: 1679705 - RNA, 21 nt, Human
uguuguacucaauuuuaacaa

SEQ ID NO: 1679706 - RNA, 13 nt, Human
uguugucagcuga

SEQ ID NO: 1679707 - RNA, 13 nt, Human
uguugggccagga

SEQ ID NO: 1679708 - RNA, 16 nt, Human
uguugggccaggagcc

SEQ ID NO: 1679709 - RNA, 17 nt, Human
aguuacccaaauuaaga

SEQ ID NO: 1679710 - RNA, 18 nt, Human
aguuacccaaauuaagag

SEQ ID NO: 1679711 - RNA, 20 nt, Human
uguucuuuccaaaguacacu

SEQ ID NO: 1679712 - RNA, 18 nt, Human
uguucuuuccaaaguaca

SEQ ID NO: 1679713 - RNA, 20 nt, Human
aguuauuauauuuacaaaug

SEQ ID NO: 1679714 - RNA, 19 nt, Human
aguuauggcuauaggugcu

SEQ ID NO: 1679715 - RNA, 16 nt, Human
auacauuugauaaagu

SEQ ID NO: 1679716 - RNA, 20 nt, Human
auacauaaacaagaccacgu

SEQ ID NO: 1679717 - RNA, 20 nt, Human
auacaucccuuaccugggaa

SEQ ID NO: 1679718 - RNA, 14 nt, Human
auacaggaaaagcu

SEQ ID NO: 1679719 - RNA, 19 nt, Human
auacaggaaaagcugcuga

SEQ ID NO: 1679720 - RNA, 20 nt, Human
auacaggaaaagcugcugac

SEQ ID NO: 1679721 - RNA, 22 nt, Human
auacaggaaaagcugcugacag

SEQ ID NO: 1679722 - RNA, 21 nt, Human
auacaguucggugagcuacaa

SEQ ID NO: 1679723 - RNA, 20 nt, Human
auacuacaguuuguuaguau

SEQ ID NO: 1679724 - RNA, 16 nt, Human
auacuacaguuuguua

SEQ ID NO: 1679725 - RNA, 15 nt, Human
auacuacaguuuguu

SEQ ID NO: 1679726 - RNA, 13 nt, Human
auacuacaguuug

SEQ ID NO: 1679727 - RNA, 21 nt, Human
auacuaaccagcagaaaugcc

SEQ ID NO: 1679728 - RNA, 19 nt, Human
auaccagccaguaaauggg

SEQ ID NO: 1679729 - RNA, 22 nt, Human
auaccacaggaaccacaagacu

SEQ ID NO: 1679730 - RNA, 17 nt, Human
uuaucaugugaaaucau

SEQ ID NO: 1679731 - RNA, 18 nt, Human
uuaucaugugaaaucauu

SEQ ID NO: 1679732 - RNA, 20 nt, Human
uuaucaugugaaaucauuca

SEQ ID NO: 1679733 - RNA, 22 nt, Human
uuaucaugugaaaucauucauu

SEQ ID NO: 1679734 - RNA, 13 nt, Human
auaauuuugugaa

SEQ ID NO: 1679735 - RNA, 14 nt, Human
auaauuuugugaag

SEQ ID NO: 1679736 - RNA, 15 nt, Human
auaauuuugugaagc

SEQ ID NO: 1679737 - RNA, 20 nt, Human
auaauuuugugaagcaaaau

SEQ ID NO: 1679738 - RNA, 14 nt, Human
auaauuuuuauauu

SEQ ID NO: 1679739 - RNA, 16 nt, Human
auaauuuuuauauuug

SEQ ID NO: 1679740 - RNA, 19 nt, Human
auaauuuuuauauuugaaa

SEQ ID NO: 1679741 - RNA, 21 nt, Human
auaauuuuuauauuugaaaua

SEQ ID NO: 1679742 - RNA, 22 nt, Human
auaauuuuuauauuugaaauau

SEQ ID NO: 1679743 - RNA, 15 nt, Human
auacaaaagcaugug

SEQ ID NO: 1679744 - RNA, 13 nt, Human
auacaaaagcaug

SEQ ID NO: 1679745 - RNA, 12 nt, Human
auacaaaagcau

SEQ ID NO: 1679746 - RNA, 22 nt, Human
auacaaaaaaaaaaaaaaauua

SEQ ID NO: 1679747 - RNA, 22 nt, Human
uuauauauauuuuuuucugaaa

SEQ ID NO: 1679748 - RNA, 18 nt, Human
uuauauaagcuuguauuc

SEQ ID NO: 1679749 - RNA, 16 nt, Human
uuagcaguuugcuuug

SEQ ID NO: 1679750 - RNA, 14 nt, Human
uuagccccauaauu

SEQ ID NO: 1679751 - RNA, 14 nt, Human
uuauaaaucgcuuu

SEQ ID NO: 1679752 - RNA, 17 nt, Human
uuauaaaucgcuuuuga

SEQ ID NO: 1679753 - RNA, 18 nt, Human
uuauaaaucgcuuuugau

SEQ ID NO: 1679754 - RNA, 18 nt, Human
uuauacccccugcaaagc

SEQ ID NO: 1679755 - RNA, 15 nt, Human
auaaacgucuuaaau

SEQ ID NO: 1679756 - RNA, 16 nt, Human
auaaacgucuuaaaua

SEQ ID NO: 1679757 - RNA, 18 nt, Human
auaaacgucuuaaauauu

SEQ ID NO: 1679758 - RNA, 16 nt, Human
auaaacuuuaccuuuu

SEQ ID NO: 1679759 - RNA, 15 nt, Human
auaaacuuuaccuuu

SEQ ID NO: 1679760 - RNA, 13 nt, Human
auaaacuuuaccu

SEQ ID NO: 1679761 - RNA, 23 nt, Human
auaaacacucuugaaaaaugcau

SEQ ID NO: 1679762 - RNA, 18 nt, Human
aguuuucugagaaagacu

SEQ ID NO: 1679763 - RNA, 14 nt, Human
aguuuucugagaaa

SEQ ID NO: 1679764 - RNA, 17 nt, Human
aguuuucugagaaagac

SEQ ID NO: 1679765 - RNA, 12 nt, Human
aguuuucugaga

SEQ ID NO: 1679766 - RNA, 13 nt, Human
aguuuucugagaa

SEQ ID NO: 1679767 - RNA, 16 nt, Human
auaaaccgaacugaug

SEQ ID NO: 1679768 - RNA, 13 nt, Human
auaaauaaaguuu

SEQ ID NO: 1679769 - RNA, 19 nt, Human
auaaauaaaguuuguugaa

SEQ ID NO: 1679770 - RNA, 19 nt, Human
auaaaugugccuucauuuu

SEQ ID NO: 1679771 - RNA, 20 nt, Human
auaaccaguguuguggauuu

SEQ ID NO: 1679772 - RNA, 12 nt, Human
auaacuggaaac

SEQ ID NO: 1679773 - RNA, 23 nt, Human
uuaccauuuugggguacccacug

SEQ ID NO: 1679774 - RNA, 18 nt, Human
uuacaggaaguacuggag

SEQ ID NO: 1679775 - RNA, 22 nt, Human
uuacaggaaguacuggagaaaa

SEQ ID NO: 1679776 - RNA, 15 nt, Human
uuacaggaaguacug

SEQ ID NO: 1679777 - RNA, 16 nt, Human
uuacaggaaguacugg

SEQ ID NO: 1679778 - RNA, 23 nt, Human
uuagaugcaguucugaagaagau

SEQ ID NO: 1679779 - RNA, 22 nt, Human
uuagaugcaguucugaagaaga

SEQ ID NO: 1679780 - RNA, 21 nt, Human
auaauuauaugcuauuucuau

SEQ ID NO: 1679781 - RNA, 23 nt, Human
auaauuauaugcuauuucuauau

SEQ ID NO: 1679782 - RNA, 14 nt, Human
auaauucuacuuug

SEQ ID NO: 1679783 - RNA, 17 nt, Human
auaauuauaugcuauuu

SEQ ID NO: 1679784 - RNA, 19 nt, Human
auaauuauaugcuauuucu

SEQ ID NO: 1679785 - RNA, 14 nt, Human
auaaugaauacuuu

SEQ ID NO: 1679786 - RNA, 19 nt, Human
auaauacaguaucucaggg

SEQ ID NO: 1679787 - RNA, 19 nt, Human
auaaucacuuuuuuccaca

SEQ ID NO: 1679788 - RNA, 21 nt, Human
auaaucuuucacaggggacag

SEQ ID NO: 1679789 - RNA, 23 nt, Human
auaagaaccuuuugagugccuua

SEQ ID NO: 1679790 - RNA, 17 nt, Human
auaaguuaacuuccaau

SEQ ID NO: 1679791 - RNA, 22 nt, Human
auaagaaccuuuugagugccuu

SEQ ID NO: 1679792 - RNA, 16 nt, Human
auaauaaggaaaaguu

SEQ ID NO: 1679793 - RNA, 17 nt, Human
auaauaaggaaaaguuu

SEQ ID NO: 1679794 - RNA, 18 nt, Human
auaauaaggaaaaguuua

SEQ ID NO: 1679795 - RNA, 19 nt, Human
auaauaaggaaaaguuuaa

SEQ ID NO: 1679796 - RNA, 22 nt, Human
auaauaaggaaaaguuuaauau

SEQ ID NO: 1679797 - RNA, 23 nt, Human
auaauacaccacuacauucuguu

SEQ ID NO: 1679798 - RNA, 22 nt, Human
auaaguuaacuuccaauuuaca

SEQ ID NO: 1679799 - RNA, 15 nt, Human
agggggaaggcaggg

SEQ ID NO: 1679800 - RNA, 13 nt, Human
agggggcugggac

SEQ ID NO: 1679801 - RNA, 16 nt, Human
aggggauagagagaga

SEQ ID NO: 1679802 - RNA, 18 nt, Human
aggguaucaggugcugcc

SEQ ID NO: 1679803 - RNA, 12 nt, Human
aggguagggugg

SEQ ID NO: 1679804 - RNA, 16 nt, Human
aggguaucaggugcug

SEQ ID NO: 1679805 - RNA, 19 nt, Human
aggguacuaaggaaucuuu

SEQ ID NO: 1679806 - RNA, 15 nt, Human
ugguccauagagagc

SEQ ID NO: 1679807 - RNA, 16 nt, Human
ugguccauagagagca

SEQ ID NO: 1679808 - RNA, 22 nt, Human
ugguaauuuaagauuccagaga

SEQ ID NO: 1679809 - RNA, 23 nt, Human
uggucaccaaaucagcugcuacu

SEQ ID NO: 1679810 - RNA, 21 nt, Human
uggucaccaaaucagcugcua

SEQ ID NO: 1679811 - RNA, 23 nt, Human
uggguggaugccugguggcagcu

SEQ ID NO: 1679812 - RNA, 22 nt, Human
ugggucuuguuuuuuuuuucca

SEQ ID NO: 1679813 - RNA, 14 nt, Human
uggguggaugccug

SEQ ID NO: 1679814 - RNA, 21 nt, Human
agggugaugggaaagcauugu

SEQ ID NO: 1679815 - RNA, 22 nt, Human
agggugaugggaaagcauugua

SEQ ID NO: 1679816 - RNA, 19 nt, Human
uggugaacagaacaaaagg

SEQ ID NO: 1679817 - RNA, 17 nt, Human
aggguggugaccucugc

SEQ ID NO: 1679818 - RNA, 18 nt, Human
aggguggugaccucugcc

SEQ ID NO: 1679819 - RNA, 19 nt, Human
aggguggugaccucugccu

SEQ ID NO: 1679820 - RNA, 21 nt, Human
aggguggugaccucugccuga

SEQ ID NO: 1679821 - RNA, 13 nt, Human
aggguuggccccu

SEQ ID NO: 1679822 - RNA, 14 nt, Human
aggguuggccccug

SEQ ID NO: 1679823 - RNA, 17 nt, Human
aggguuggccccugccc

SEQ ID NO: 1679824 - RNA, 15 nt, Human
aggguugggcuggug

SEQ ID NO: 1679825 - RNA, 20 nt, Human
uggucucgaacuccugaccu

SEQ ID NO: 1679826 - RNA, 21 nt, Human
uggucucgaacuccugaccuu

SEQ ID NO: 1679827 - RNA, 19 nt, Human
uggucucgaacuccugacc

SEQ ID NO: 1679828 - RNA, 13 nt, Human
uggucccacccca

SEQ ID NO: 1679829 - RNA, 19 nt, Human
ugguccauagagagcaaga

SEQ ID NO: 1679830 - RNA, 22 nt, Human
ugguccaugggccauaugaaaa

SEQ ID NO: 1679831 - RNA, 16 nt, Human
uggucuuauuuguaaa

SEQ ID NO: 1679832 - RNA, 12 nt, Human
uggucuguguga

SEQ ID NO: 1679833 - RNA, 22 nt, Human
uggucugugagaugcuagaacu

SEQ ID NO: 1679834 - RNA, 17 nt, Human
agguaugcaaucaaauc

SEQ ID NO: 1679835 - RNA, 17 nt, Human
aggguugggcugguguc

SEQ ID NO: 1679836 - RNA, 20 nt, Human
aggguuuauguuuaggaugu

SEQ ID NO: 1679837 - RNA, 23 nt, Human
aggucauuuuuuuuaagaaaaag

SEQ ID NO: 1679838 - RNA, 22 nt, Human
aggucauuuuuuuuaagaaaaa

SEQ ID NO: 1679839 - RNA, 21 nt, Human
aggucaaggcugcagugagcc

SEQ ID NO: 1679840 - RNA, 15 nt, Human
aggucagugcaaaua

SEQ ID NO: 1679841 - RNA, 22 nt, Human
aggucuugaacuccuggccuca

SEQ ID NO: 1679842 - RNA, 20 nt, Human
aggucuugaacuccuggccu

SEQ ID NO: 1679843 - RNA, 21 nt, Human
aggucuugaacuccuggccuc

SEQ ID NO: 1679844 - RNA, 17 nt, Human
agguccacaacacacag

SEQ ID NO: 1679845 - RNA, 15 nt, Human
ugguggcagagugga

SEQ ID NO: 1679846 - RNA, 12 nt, Human
ugguggcagcuc

SEQ ID NO: 1679847 - RNA, 16 nt, Human
ugguggcagcucaccu

SEQ ID NO: 1679848 - RNA, 19 nt, Human
ugguggcagcucaccucuc

SEQ ID NO: 1679849 - RNA, 20 nt, Human
ugguggcagcucaccucucc

SEQ ID NO: 1679850 - RNA, 23 nt, Human
ugguggcagcucaccucucccuu

SEQ ID NO: 1679851 - RNA, 15 nt, Human
ugguguguguaugcg

SEQ ID NO: 1679852 - RNA, 12 nt, Human
ugguggcagcug

SEQ ID NO: 1679853 - RNA, 15 nt, Human
ugguguuuccuggca

SEQ ID NO: 1679854 - RNA, 17 nt, Human
ugguguuuccuggcacu

SEQ ID NO: 1679855 - RNA, 18 nt, Human
ugguuaagucuguuuuau

SEQ ID NO: 1679856 - RNA, 15 nt, Human
ugguuaagucuguuu

SEQ ID NO: 1679857 - RNA, 20 nt, Human
ugguucaggguuggccccug

SEQ ID NO: 1679858 - RNA, 22 nt, Human
ugguucaggguuggccccugcc

SEQ ID NO: 1679859 - RNA, 23 nt, Human
ugguucaggguuggccccugccc

SEQ ID NO: 1679860 - RNA, 18 nt, Human
ugguuuuaguugcaacuu

SEQ ID NO: 1679861 - RNA, 12 nt, Human
ugguuuucuguu

SEQ ID NO: 1679862 - RNA, 21 nt, Human
ugguuuguaaauuaacuuuua

SEQ ID NO: 1679863 - RNA, 15 nt, Human
ugguuucagaaaugu

SEQ ID NO: 1679864 - RNA, 14 nt, Human
ugguuucagaaaug

SEQ ID NO: 1679865 - RNA, 21 nt, Human
uguaaauacaauuuuguuucu

SEQ ID NO: 1679866 - RNA, 10 nt, Human
uguaaauccc

SEQ ID NO: 1679867 - RNA, 23 nt, Human
aggugauccacccaccucagccu

SEQ ID NO: 1679868 - RNA, 15 nt, Human
ugguuuucuguucuu

SEQ ID NO: 1679869 - RNA, 13 nt, Human
ugguuuucuguuc

SEQ ID NO: 1679870 - RNA, 16 nt, Human
uguaaauacaauuuug

SEQ ID NO: 1679871 - RNA, 17 nt, Human
uguaaauacaauuuugu

SEQ ID NO: 1679872 - RNA, 18 nt, Human
uguaaauacaauuuuguu

SEQ ID NO: 1679873 - RNA, 19 nt, Human
uguaaauacaauuuuguuu

SEQ ID NO: 1679874 - RNA, 16 nt, Human
uguaaaggaauuuaaa

SEQ ID NO: 1679875 - RNA, 16 nt, Human
agguggggcagcuuga

SEQ ID NO: 1679876 - RNA, 14 nt, Human
agguggggcagcuu

SEQ ID NO: 1679877 - RNA, 23 nt, Human
agguggggucacucuggcagcuc

SEQ ID NO: 1679878 - RNA, 22 nt, Human
aggugauccacucgccuucauc

SEQ ID NO: 1679879 - RNA, 13 nt, Human
agguggggcagcu

SEQ ID NO: 1679880 - RNA, 18 nt, Human
aggugugacugaauuucu

SEQ ID NO: 1679881 - RNA, 23 nt, Human
aggugugaaccaccacacccagc

SEQ ID NO: 1679882 - RNA, 22 nt, Human
aggugugaaccaccacacccag

SEQ ID NO: 1679883 - RNA, 20 nt, Human
aggugugagccaccacgccc

SEQ ID NO: 1679884 - RNA, 20 nt, Human
aggugugacugaauuucuuu

SEQ ID NO: 1679885 - RNA, 14 nt, Human
aggugugagucacc

SEQ ID NO: 1679886 - RNA, 20 nt, Human
aggugugagucaccaagccc

SEQ ID NO: 1679887 - RNA, 16 nt, Human
agguugucugaaguca

SEQ ID NO: 1679888 - RNA, 20 nt, Human
agguugucugaagucacugc

SEQ ID NO: 1679889 - RNA, 13 nt, Human
uguaaggaaugau

SEQ ID NO: 1679890 - RNA, 14 nt, Human
uguaaggaaugauu

SEQ ID NO: 1679891 - RNA, 15 nt, Human
uguaaggaaugauua

SEQ ID NO: 1679892 - RNA, 22 nt, Human
uguaagcucuacugaggugcua

SEQ ID NO: 1679893 - RNA, 18 nt, Human
uguaagaaaauaucacuu

SEQ ID NO: 1679894 - RNA, 15 nt, Human
uguaaggcaaucaug

SEQ ID NO: 1679895 - RNA, 16 nt, Human
uguaauuugugauaca

SEQ ID NO: 1679896 - RNA, 18 nt, Human
uguaaggaaugauuaauu

SEQ ID NO: 1679897 - RNA, 21 nt, Human
uguaauuugugauacaaugcu

SEQ ID NO: 1679898 - RNA, 17 nt, Human
uguaauuugugauacaa

SEQ ID NO: 1679899 - RNA, 13 nt, Human
uguacaaaguauu

SEQ ID NO: 1679900 - RNA, 14 nt, Human
uguacaaaguauua

SEQ ID NO: 1679901 - RNA, 19 nt, Human
uguacaaaguagaagucuu

SEQ ID NO: 1679902 - RNA, 23 nt, Human
uguacaaaguagaagucuuagau

SEQ ID NO: 1679903 - RNA, 15 nt, Human
uguacuugcucuuga

SEQ ID NO: 1679904 - RNA, 19 nt, Human
uguacuugcucuugaugcc

SEQ ID NO: 1679905 - RNA, 21 nt, Human
uguagaagucacauuccugaa

SEQ ID NO: 1679906 - RNA, 20 nt, Human
uguacaugaaaacacauuuu

SEQ ID NO: 1679907 - RNA, 19 nt, Human
uguacaugaaaacacauuu

SEQ ID NO: 1679908 - RNA, 18 nt, Human
uguacaugaaaacacauu

SEQ ID NO: 1679909 - RNA, 17 nt, Human
uguacaugaaaacacau

SEQ ID NO: 1679910 - RNA, 23 nt, Human
aguccccuguuuguuucugaaag

SEQ ID NO: 1679911 - RNA, 13 nt, Human
agucccugccaau

SEQ ID NO: 1679912 - RNA, 14 nt, Human
agucccugccaaug

SEQ ID NO: 1679913 - RNA, 16 nt, Human
agucccugccaaugga

SEQ ID NO: 1679914 - RNA, 22 nt, Human
ugucucuggauuauauuaugaa

SEQ ID NO: 1679915 - RNA, 13 nt, Human
ugucucugagagu

SEQ ID NO: 1679916 - RNA, 17 nt, Human
ugucucuacuaaaaaua

SEQ ID NO: 1679917 - RNA, 18 nt, Human
ugucucuugguccugcug

SEQ ID NO: 1679918 - RNA, 19 nt, Human
ugucucuugguccugcugc

SEQ ID NO: 1679919 - RNA, 20 nt, Human
ugucucuugguccugcugca

SEQ ID NO: 1679920 - RNA, 21 nt, Human
ugucucuugguccugcugcag

SEQ ID NO: 1679921 - RNA, 22 nt, Human
ugucucuuuaaugucacaggca

SEQ ID NO: 1679922 - RNA, 22 nt, Human
ugucucuugguccugcugcagu

SEQ ID NO: 1679923 - RNA, 21 nt, Human
ugucucuuuaaugucacaggc

SEQ ID NO: 1679924 - RNA, 14 nt, Human
ugucuuaauuaaaa

SEQ ID NO: 1679925 - RNA, 15 nt, Human
ugucuugccuuuuuc

SEQ ID NO: 1679926 - RNA, 16 nt, Human
ugucuugccuuuuuca

SEQ ID NO: 1679927 - RNA, 17 nt, Human
ugucuugccuuuuucau

SEQ ID NO: 1679928 - RNA, 21 nt, Human
ugucuugccuuuuucauuauu

SEQ ID NO: 1679929 - RNA, 17 nt, Human
ugucuuuaaaugcugcu

SEQ ID NO: 1679930 - RNA, 22 nt, Human
ugugaacaguuguguuugaagc

SEQ ID NO: 1679931 - RNA, 15 nt, Human
ugugaaccaccacac

SEQ ID NO: 1679932 - RNA, 16 nt, Human
ugugaaccaccacacc

SEQ ID NO: 1679933 - RNA, 17 nt, Human
ugugaaccaccacaccc

SEQ ID NO: 1679934 - RNA, 22 nt, Human
ugugaaccaccacacccagccc

SEQ ID NO: 1679935 - RNA, 23 nt, Human
ugugaaccaccacacccagccca

SEQ ID NO: 1679936 - RNA, 14 nt, Human
ugugaacuaaacuu

SEQ ID NO: 1679937 - RNA, 19 nt, Human
ugugaacuaaacuuucaca

SEQ ID NO: 1679938 - RNA, 20 nt, Human
ugugaacuaaacuuucacac

SEQ ID NO: 1679939 - RNA, 15 nt, Human
ugucuugcaauggca

SEQ ID NO: 1679940 - RNA, 17 nt, Human
ugucuugcaauggcagc

SEQ ID NO: 1679941 - RNA, 18 nt, Human
ugucuugcaauggcagcc

SEQ ID NO: 1679942 - RNA, 20 nt, Human
ugucuugcaauggcagccuu

SEQ ID NO: 1679943 - RNA, 21 nt, Human
ugucuugcaauggcagccuug

SEQ ID NO: 1679944 - RNA, 14 nt, Human
ugucuucacaacag

SEQ ID NO: 1679945 - RNA, 22 nt, Human
ugucuucauaccuacauguauu

SEQ ID NO: 1679946 - RNA, 17 nt, Human
ugugauggggcccugcc

SEQ ID NO: 1679947 - RNA, 18 nt, Human
ugugauggggcccugccu

SEQ ID NO: 1679948 - RNA, 14 nt, Human
agugagagcugggu

SEQ ID NO: 1679949 - RNA, 21 nt, Human
agugagcagucaggaaagaga

SEQ ID NO: 1679950 - RNA, 15 nt, Human
ugugauggggcccug

SEQ ID NO: 1679951 - RNA, 16 nt, Human
ugugauggggcccugc

SEQ ID NO: 1679952 - RNA, 16 nt, Human
agugagccgagauugu

SEQ ID NO: 1679953 - RNA, 22 nt, Human
agugagacucugucucaaaaaa

SEQ ID NO: 1679954 - RNA, 16 nt, Human
agugagacucugucuc

SEQ ID NO: 1679955 - RNA, 17 nt, Human
agugagacucugucuca

SEQ ID NO: 1679956 - RNA, 17 nt, Human
agugagacccugucuca

SEQ ID NO: 1679957 - RNA, 21 nt, Human
agugagacccugucucaaaaa

SEQ ID NO: 1679958 - RNA, 13 nt, Human
agugagacucugu

SEQ ID NO: 1679959 - RNA, 20 nt, Human
agugaaacucguuaauuugu

SEQ ID NO: 1679960 - RNA, 14 nt, Human
agugagacagcucu

SEQ ID NO: 1679961 - RNA, 22 nt, Human
agugaaagaggcagcuugaaac

SEQ ID NO: 1679962 - RNA, 16 nt, Human
agugaaagaggcagcu

SEQ ID NO: 1679963 - RNA, 17 nt, Human
agugaaagaaaauaaca

SEQ ID NO: 1679964 - RNA, 11 nt, Human
agugaaaaagg

SEQ ID NO: 1679965 - RNA, 17 nt, Human
agugaaaaaggaggaag

SEQ ID NO: 1679966 - RNA, 20 nt, Human
agugaaaaaggaggaagaga

SEQ ID NO: 1679967 - RNA, 23 nt, Human
agugaaaaaggaggaagagaaaa

SEQ ID NO: 1679968 - RNA, 14 nt, Human
agucuguuuuauga

SEQ ID NO: 1679969 - RNA, 17 nt, Human
agucuguuuuaugacuu

SEQ ID NO: 1679970 - RNA, 18 nt, Human
agucuguuuuaugacuuc

SEQ ID NO: 1679971 - RNA, 14 nt, Human
agucucccucccuu

SEQ ID NO: 1679972 - RNA, 18 nt, Human
agucucccucccuugggg

SEQ ID NO: 1679973 - RNA, 18 nt, Human
agucucugaagugaaacu

SEQ ID NO: 1679974 - RNA, 19 nt, Human
agucucugaagugaaacug

SEQ ID NO: 1679975 - RNA, 19 nt, Human
agucuccaaagucucugga

SEQ ID NO: 1679976 - RNA, 18 nt, Human
ugugagcaucacaguuuu

SEQ ID NO: 1679977 - RNA, 19 nt, Human
ugugagcacaaagguagcu

SEQ ID NO: 1679978 - RNA, 14 nt, Human
ugugaacugaacuc

SEQ ID NO: 1679979 - RNA, 23 nt, Human
ugugaacugaacucugacaacag

SEQ ID NO: 1679980 - RNA, 14 nt, Human
ugugaagcaaaauu

SEQ ID NO: 1679981 - RNA, 23 nt, Human
agguuuggacaaaauggaauacu

SEQ ID NO: 1679982 - RNA, 12 nt, Human
uguagagccagg

SEQ ID NO: 1679983 - RNA, 15 nt, Human
uguagagccaggguc

SEQ ID NO: 1679984 - RNA, 12 nt, Human
uguaugugugaa

SEQ ID NO: 1679985 - RNA, 13 nt, Human
uguaugugugaag

SEQ ID NO: 1679986 - RNA, 12 nt, Human
uguauuaagaau

SEQ ID NO: 1679987 - RNA, 16 nt, Human
uguauuaagaaugaaa

SEQ ID NO: 1679988 - RNA, 15 nt, Human
uguaucccaugagcc

SEQ ID NO: 1679989 - RNA, 16 nt, Human
uguaucccaugagccu

SEQ ID NO: 1679990 - RNA, 14 nt, Human
uguauguguaagua

SEQ ID NO: 1679991 - RNA, 13 nt, Human
aguagcugggacu

SEQ ID NO: 1679992 - RNA, 14 nt, Human
aguagcugggacua

SEQ ID NO: 1679993 - RNA, 16 nt, Human
ugucaaaguggugaga

SEQ ID NO: 1679994 - RNA, 19 nt, Human
ugucaaaguggugagaggc

SEQ ID NO: 1679995 - RNA, 15 nt, Human
uguauuagucacaga

SEQ ID NO: 1679996 - RNA, 11 nt, Human
uguauuaugug

SEQ ID NO: 1679997 - RNA, 14 nt, Human
ugucaaagugguga

SEQ ID NO: 1679998 - RNA, 15 nt, Human
ugucaaaguggugag

SEQ ID NO: 1679999 - RNA, 22 nt, Human
agucacagagauaauucuagcu

SEQ ID NO: 1680000 - RNA, 21 nt, Human
aguauuuaauucauguugccu

SEQ ID NO: 1680001 - RNA, 15 nt, Human
aguauuguccagguc

SEQ ID NO: 1680002 - RNA, 16 nt, Human
aguauuguccaggucu

SEQ ID NO: 1680003 - RNA, 15 nt, Human
agucacugagacagc

SEQ ID NO: 1680004 - RNA, 16 nt, Human
agucacugagacagcc

SEQ ID NO: 1680005 - RNA, 17 nt, Human
agucacugagacagccc

SEQ ID NO: 1680006 - RNA, 15 nt, Human
ugucagcauagaagu

SEQ ID NO: 1680007 - RNA, 20 nt, Human
agucacauuccaagccucau

SEQ ID NO: 1680008 - RNA, 15 nt, Human
aguauuguacaaagu

SEQ ID NO: 1680009 - RNA, 20 nt, Human
aguauuguacaaaguauuaa

SEQ ID NO: 1680010 - RNA, 22 nt, Human
aguauuguacaaaguauuaagc

SEQ ID NO: 1680011 - RNA, 23 nt, Human
aguauuguacaaaguauuaagca

SEQ ID NO: 1680012 - RNA, 11 nt, Human
aguauuguaca

SEQ ID NO: 1680013 - RNA, 15 nt, Human
aguauuauaccuuuu

SEQ ID NO: 1680014 - RNA, 14 nt, Human
aguauuauaccuuu

SEQ ID NO: 1680015 - RNA, 22 nt, Human
aguagcugggacuacaggcacc

SEQ ID NO: 1680016 - RNA, 19 nt, Human
aguagcugggacuacaggc

SEQ ID NO: 1680017 - RNA, 21 nt, Human
aguagcugggacuacaggcac

SEQ ID NO: 1680018 - RNA, 21 nt, Human
aguauuagaauaccacaggaa

SEQ ID NO: 1680019 - RNA, 18 nt, Human
aguauguuagugcaaauu

SEQ ID NO: 1680020 - RNA, 21 nt, Human
aguauguuagugcaaauuguc

SEQ ID NO: 1680021 - RNA, 17 nt, Human
ugucccuuuuccuuuuu

SEQ ID NO: 1680022 - RNA, 12 nt, Human
ugucccuuuucc

SEQ ID NO: 1680023 - RNA, 14 nt, Human
ugucccugcacuug

SEQ ID NO: 1680024 - RNA, 20 nt, Human
ugucccuaccgagucucuuc

SEQ ID NO: 1680025 - RNA, 21 nt, Human
ugucccuaccgagucucuucu

SEQ ID NO: 1680026 - RNA, 22 nt, Human
ugucccuaccgagucucuucuc

SEQ ID NO: 1680027 - RNA, 20 nt, Human
uguccaggcacugcugccca

SEQ ID NO: 1680028 - RNA, 21 nt, Human
uguccaggcacugcugcccag

SEQ ID NO: 1680029 - RNA, 19 nt, Human
uguccaggcacugcugccc

SEQ ID NO: 1680030 - RNA, 18 nt, Human
agucacugagacagcccg

SEQ ID NO: 1680031 - RNA, 16 nt, Human
ugucagccauuccugu

SEQ ID NO: 1680032 - RNA, 23 nt, Human
ugucagcuccccucggagaagag

SEQ ID NO: 1680033 - RNA, 20 nt, Human
ugucagcuccccucggagaa

SEQ ID NO: 1680034 - RNA, 21 nt, Human
ugucagcuccccucggagaag

SEQ ID NO: 1680035 - RNA, 14 nt, Human
aguccccuguuugu

SEQ ID NO: 1680036 - RNA, 19 nt, Human
aguccccuguuuguuucug

SEQ ID NO: 1680037 - RNA, 20 nt, Human
agucccaggcugagccucag

SEQ ID NO: 1680038 - RNA, 21 nt, Human
agucccaccuuggcugcaggg

SEQ ID NO: 1680039 - RNA, 23 nt, Human
agucccaccuuggcugcagggag

SEQ ID NO: 1680040 - RNA, 23 nt, Human
agucagaucugccuaaggacuuc

SEQ ID NO: 1680041 - RNA, 15 nt, Human
agucagucauucaga

SEQ ID NO: 1680042 - RNA, 21 nt, Human
agucagucauucagauaugau

SEQ ID NO: 1680043 - RNA, 21 nt, Human
agucagaucugccuaaggacu

SEQ ID NO: 1680044 - RNA, 22 nt, Human
agucagaucugccuaaggacuu

SEQ ID NO: 1680045 - RNA, 20 nt, Human
agucagaucugccuaaggac

SEQ ID NO: 1680046 - RNA, 17 nt, Human
agucagaucugccuaag

SEQ ID NO: 1680047 - RNA, 15 nt, Human
agacuuuuaugauac

SEQ ID NO: 1680048 - RNA, 15 nt, Human
agacuuuuccaaccc

SEQ ID NO: 1680049 - RNA, 12 nt, Human
agacuuuuauga

SEQ ID NO: 1680050 - RNA, 19 nt, Human
agacuuuggaaagaguagg

SEQ ID NO: 1680051 - RNA, 19 nt, Human
agacuuuucuuucagccaa

SEQ ID NO: 1680052 - RNA, 16 nt, Human
agagacacaagccuuc

SEQ ID NO: 1680053 - RNA, 19 nt, Human
agagacacaagccuucggc

SEQ ID NO: 1680054 - RNA, 20 nt, Human
agacuggugacugauucuuc

SEQ ID NO: 1680055 - RNA, 21 nt, Human
agacuggugacugauucuuca

SEQ ID NO: 1680056 - RNA, 20 nt, Human
agacugguuccauggccucu

SEQ ID NO: 1680057 - RNA, 14 nt, Human
agacuguacaaagu

SEQ ID NO: 1680058 - RNA, 17 nt, Human
agacuuuggaaagacuu

SEQ ID NO: 1680059 - RNA, 15 nt, Human
agacuuuggaaagag

SEQ ID NO: 1680060 - RNA, 21 nt, Human
ucuuuuuucuaaaguaaaaac

SEQ ID NO: 1680061 - RNA, 22 nt, Human
ucuuuuuucuaaaguaaaaaca

SEQ ID NO: 1680062 - RNA, 17 nt, Human
ucuuugucuacaccauu

SEQ ID NO: 1680063 - RNA, 14 nt, Human
ucuuuguggcuucc

SEQ ID NO: 1680064 - RNA, 16 nt, Human
ucuuuguaaugaaaac

SEQ ID NO: 1680065 - RNA, 14 nt, Human
ucuuuguacagaca

SEQ ID NO: 1680066 - RNA, 15 nt, Human
ucuuuguacagacaa

SEQ ID NO: 1680067 - RNA, 20 nt, Human
ucuuuguacagacaacaaac

SEQ ID NO: 1680068 - RNA, 16 nt, Human
agagacacacugaaga

SEQ ID NO: 1680069 - RNA, 14 nt, Human
agagacagaaagca

SEQ ID NO: 1680070 - RNA, 15 nt, Human
agagacagaaagcag

SEQ ID NO: 1680071 - RNA, 22 nt, Human
agacuccaaagaaauguaaggg

SEQ ID NO: 1680072 - RNA, 12 nt, Human
ucuuuccugagg

SEQ ID NO: 1680073 - RNA, 18 nt, Human
ucuuuaaugucacaggca

SEQ ID NO: 1680074 - RNA, 19 nt, Human
ucuuuaaugucacaggcag

SEQ ID NO: 1680075 - RNA, 20 nt, Human
agacaggcaagcaccuccug

SEQ ID NO: 1680076 - RNA, 22 nt, Human
agacaggcaagcaccuccugcc

SEQ ID NO: 1680077 - RNA, 15 nt, Human
ucuuuaaugucacag

SEQ ID NO: 1680078 - RNA, 16 nt, Human
agacucccaagcugga

SEQ ID NO: 1680079 - RNA, 21 nt, Human
agacuccagcuggguuggaaa

SEQ ID NO: 1680080 - RNA, 13 nt, Human
agacuccugcagg

SEQ ID NO: 1680081 - RNA, 23 nt, Human
agacuggcacaguuuucugagaa

SEQ ID NO: 1680082 - RNA, 13 nt, Human
agacucugucuca

SEQ ID NO: 1680083 - RNA, 20 nt, Human
agacuggcacaguuuucuga

SEQ ID NO: 1680084 - RNA, 21 nt, Human
agacuggcacaguuuucugag

SEQ ID NO: 1680085 - RNA, 14 nt, Human
ugaaaauuaacaug

SEQ ID NO: 1680086 - RNA, 18 nt, Human
ugaaacugcuuguuuccu

SEQ ID NO: 1680087 - RNA, 19 nt, Human
ugaaacugcuuguuuccua

SEQ ID NO: 1680088 - RNA, 18 nt, Human
ugaaacuggauuaaacuu

SEQ ID NO: 1680089 - RNA, 17 nt, Human
ugaaacuggauuaaacu

SEQ ID NO: 1680090 - RNA, 13 nt, Human
ugaaagaaaauaa

SEQ ID NO: 1680091 - RNA, 21 nt, Human
ugaaaauauuuguaucacaaa

SEQ ID NO: 1680092 - RNA, 22 nt, Human
ugaaaauauuuguaucacaaau

SEQ ID NO: 1680093 - RNA, 14 nt, Human
ucuuuuuuugugau

SEQ ID NO: 1680094 - RNA, 16 nt, Human
ucuuuuuuugugaugu

SEQ ID NO: 1680095 - RNA, 13 nt, Human
ugaaaacacauuu

SEQ ID NO: 1680096 - RNA, 12 nt, Human
ugaaaacacauu

SEQ ID NO: 1680097 - RNA, 14 nt, Human
ugaaaacacauuuu

SEQ ID NO: 1680098 - RNA, 20 nt, Human
ugaaaacacauuuuucuuag

SEQ ID NO: 1680099 - RNA, 19 nt, Human
ugaaaacacauuuuucuua

SEQ ID NO: 1680100 - RNA, 17 nt, Human
ugaaaacacauuuuucu

SEQ ID NO: 1680101 - RNA, 15 nt, Human
ugaaaacacauuuuu

SEQ ID NO: 1680102 - RNA, 17 nt, Human
ugaaaauauuuguauca

SEQ ID NO: 1680103 - RNA, 16 nt, Human
agagaguguugaaacg

SEQ ID NO: 1680104 - RNA, 17 nt, Human
agagaguggcuccuccc

SEQ ID NO: 1680105 - RNA, 15 nt, Human
agagaguguugaaac

SEQ ID NO: 1680106 - RNA, 15 nt, Human
agagacuccugcagg

SEQ ID NO: 1680107 - RNA, 12 nt, Human
agagacuccugc

SEQ ID NO: 1680108 - RNA, 13 nt, Human
agagacuccugca

SEQ ID NO: 1680109 - RNA, 14 nt, Human
agagacuccugcag

SEQ ID NO: 1680110 - RNA, 22 nt, Human
agagaccaucccugaaggcccc

SEQ ID NO: 1680111 - RNA, 23 nt, Human
agagaccaucccugaaggccccg

SEQ ID NO: 1680112 - RNA, 19 nt, Human
agagaccaucccugaaggc

SEQ ID NO: 1680113 - RNA, 21 nt, Human
agagaccaucccugaaggccc

SEQ ID NO: 1680114 - RNA, 18 nt, Human
ugaaagaggaaugaagua

SEQ ID NO: 1680115 - RNA, 22 nt, Human
ugaaagaaaauaccaaggaaca

SEQ ID NO: 1680116 - RNA, 20 nt, Human
ugaaacugcuuguuuccuag

SEQ ID NO: 1680117 - RNA, 22 nt, Human
ugaaacugcuuguuuccuagca

SEQ ID NO: 1680118 - RNA, 16 nt, Human
ugaaagacuguacaaa

SEQ ID NO: 1680119 - RNA, 18 nt, Human
ugaaagacuguacaaagu

SEQ ID NO: 1680120 - RNA, 19 nt, Human
ugaaagacuguacaaagua

SEQ ID NO: 1680121 - RNA, 22 nt, Human
ugaaagacuguacaaaguagaa

SEQ ID NO: 1680122 - RNA, 17 nt, Human
ugaaagaggaaugaagu

SEQ ID NO: 1680123 - RNA, 18 nt, Human
agaguaauccaagcaaau

SEQ ID NO: 1680124 - RNA, 12 nt, Human
agagguuuuucu

SEQ ID NO: 1680125 - RNA, 22 nt, Human
agagguuuuucuuaaauaauaa

SEQ ID NO: 1680126 - RNA, 20 nt, Human
agaguaauccaagcaaaugu

SEQ ID NO: 1680127 - RNA, 22 nt, Human
agaguaauccaagcaaauguga

SEQ ID NO: 1680128 - RNA, 20 nt, Human
agagguucaaagauauuuug

SEQ ID NO: 1680129 - RNA, 19 nt, Human
agagguucaaagauauuuu

SEQ ID NO: 1680130 - RNA, 16 nt, Human
agagguucaaagauau

SEQ ID NO: 1680131 - RNA, 13 nt, Human
agagguucaaaga

SEQ ID NO: 1680132 - RNA, 20 nt, Human
agagggagugacagaggcag

SEQ ID NO: 1680133 - RNA, 15 nt, Human
agagggagugacaga

SEQ ID NO: 1680134 - RNA, 22 nt, Human
agaggcugccucucccaucacu

SEQ ID NO: 1680135 - RNA, 24 nt, Human
agaggcagccccauucugccugcc

SEQ ID NO: 1680136 - RNA, 21 nt, Human
agaggcagccccauucugccu

SEQ ID NO: 1680137 - RNA, 22 nt, Human
agaggcagccccauucugccug

SEQ ID NO: 1680138 - RNA, 23 nt, Human
agaggcagccccauucugccugc

SEQ ID NO: 1680139 - RNA, 18 nt, Human
agagcuguucacagccag

SEQ ID NO: 1680140 - RNA, 19 nt, Human
agagcuguucacagccaga

SEQ ID NO: 1680141 - RNA, 23 nt, Human
ugaauaauguaagacaaauaugu

SEQ ID NO: 1680142 - RNA, 13 nt, Human
ugaauaauacagu

SEQ ID NO: 1680143 - RNA, 13 nt, Human
ugaagucacacag

SEQ ID NO: 1680144 - RNA, 12 nt, Human
ugaauaauacag

SEQ ID NO: 1680145 - RNA, 15 nt, Human
ugaaguaagcaaaga

SEQ ID NO: 1680146 - RNA, 17 nt, Human
ugaaguacucauacaug

SEQ ID NO: 1680147 - RNA, 22 nt, Human
ugaaguaauaugcacacauuuu

SEQ ID NO: 1680148 - RNA, 21 nt, Human
ugaaguaauaugcacacauuu

SEQ ID NO: 1680149 - RNA, 20 nt, Human
ugaaguaauaugcacacauu

SEQ ID NO: 1680150 - RNA, 16 nt, Human
ugaaguaauaugcaca

SEQ ID NO: 1680151 - RNA, 13 nt, Human
ugaaguaagcaaa

SEQ ID NO: 1680152 - RNA, 14 nt, Human
ugaaguaagcaaag

SEQ ID NO: 1680153 - RNA, 15 nt, Human
ugaaguaauaugcac

SEQ ID NO: 1680154 - RNA, 17 nt, Human
ugaagauuuaccacuug

SEQ ID NO: 1680155 - RNA, 20 nt, Human
ugaagauuuaccacuugugu

SEQ ID NO: 1680156 - RNA, 13 nt, Human
ugaagacagagcu

SEQ ID NO: 1680157 - RNA, 23 nt, Human
ugaagacaaugacuuacuguaca

SEQ ID NO: 1680158 - RNA, 22 nt, Human
ugaagacaaugacuuacuguac

SEQ ID NO: 1680159 - RNA, 15 nt, Human
ugaacuccugaccuc

SEQ ID NO: 1680160 - RNA, 11 nt, Human
ugaacuccugg

SEQ ID NO: 1680161 - RNA, 22 nt, Human
ugaaccgaugagaaauaaaguu

SEQ ID NO: 1680162 - RNA, 23 nt, Human
ugaacuagaguuuagcuggaaaa

SEQ ID NO: 1680163 - RNA, 17 nt, Human
ugaacuaaacuuucaca

SEQ ID NO: 1680164 - RNA, 19 nt, Human
ugaacuaaacuuucacacc

SEQ ID NO: 1680165 - RNA, 22 nt, Human
ugaacccauauuuguacaccaa

SEQ ID NO: 1680166 - RNA, 18 nt, Human
ugaacccgggaggcagag

SEQ ID NO: 1680167 - RNA, 22 nt, Human
ugaaccaccacacccagcccac

SEQ ID NO: 1680168 - RNA, 18 nt, Human
ugaacaaauuuacagaga

SEQ ID NO: 1680169 - RNA, 21 nt, Human
ugaaccaccacacccagccca

SEQ ID NO: 1680170 - RNA, 13 nt, Human
ugaacaaauuuac

SEQ ID NO: 1680171 - RNA, 23 nt, Human
ugaaauagacccacaagaggcag

SEQ ID NO: 1680172 - RNA, 13 nt, Human
ugaaauuguaauu

SEQ ID NO: 1680173 - RNA, 14 nt, Human
ugaaauuguaauua

SEQ ID NO: 1680174 - RNA, 15 nt, Human
ugaaauuguaauuau

SEQ ID NO: 1680175 - RNA, 16 nt, Human
ugaaauuguaauuaua

SEQ ID NO: 1680176 - RNA, 19 nt, Human
ugaaauuguaauuauaucu

SEQ ID NO: 1680177 - RNA, 20 nt, Human
ugaaauuguaauuauaucug

SEQ ID NO: 1680178 - RNA, 21 nt, Human
ugaaauuuccugggagcuuuu

SEQ ID NO: 1680179 - RNA, 20 nt, Human
ugaaauuuuuauuaaauuau

SEQ ID NO: 1680180 - RNA, 19 nt, Human
ugaaauuuuuauuaaauua

SEQ ID NO: 1680181 - RNA, 15 nt, Human
ugaaauuuccuggga

SEQ ID NO: 1680182 - RNA, 13 nt, Human
ugaaauaaacguc

SEQ ID NO: 1680183 - RNA, 18 nt, Human
ugaaauaaacgucuuaaa

SEQ ID NO: 1680184 - RNA, 22 nt, Human
ugaaauaaacgucuuaaauauu

SEQ ID NO: 1680185 - RNA, 23 nt, Human
ugaaauaaacgucuuaaauauuc

SEQ ID NO: 1680186 - RNA, 17 nt, Human
ugaaauaacauggccuu

SEQ ID NO: 1680187 - RNA, 16 nt, Human
ugaaauaacauggccu

SEQ ID NO: 1680188 - RNA, 14 nt, Human
ugaaauaagccaga

SEQ ID NO: 1680189 - RNA, 14 nt, Human
ugaaauacuguuug

SEQ ID NO: 1680190 - RNA, 16 nt, Human
ugaaauacuguuugag

SEQ ID NO: 1680191 - RNA, 16 nt, Human
agagauugugguuuca

SEQ ID NO: 1680192 - RNA, 18 nt, Human
agagcugcccucuccugg

SEQ ID NO: 1680193 - RNA, 17 nt, Human
agagcugcccucuccug

SEQ ID NO: 1680194 - RNA, 16 nt, Human
agagcugcccucuccu

SEQ ID NO: 1680195 - RNA, 20 nt, Human
agagcugcccucuccugggc

SEQ ID NO: 1680196 - RNA, 19 nt, Human
agagcugcccucuccuggg

SEQ ID NO: 1680197 - RNA, 14 nt, Human
ugagagcugggugu

SEQ ID NO: 1680198 - RNA, 10 nt, Human
ugagaggaaa

SEQ ID NO: 1680199 - RNA, 11 nt, Human
ugagaggaaau

SEQ ID NO: 1680200 - RNA, 12 nt, Human
ugagaggaaauc

SEQ ID NO: 1680201 - RNA, 13 nt, Human
ugagaggaaauca

SEQ ID NO: 1680202 - RNA, 14 nt, Human
ugagaggaaaucac

SEQ ID NO: 1680203 - RNA, 21 nt, Human
ugagagacacacugaagaagc

SEQ ID NO: 1680204 - RNA, 22 nt, Human
ugagagacacacugaagaagca

SEQ ID NO: 1680205 - RNA, 14 nt, Human
ugagauguguucac

SEQ ID NO: 1680206 - RNA, 24 nt, Human
ugagaugugaacacaucagcuugc

SEQ ID NO: 1680207 - RNA, 18 nt, Human
ugagaugugaacacauca

SEQ ID NO: 1680208 - RNA, 19 nt, Human
ugagaugugaacacaucag

SEQ ID NO: 1680209 - RNA, 17 nt, Human
ugagaggaaaucaccga

SEQ ID NO: 1680210 - RNA, 23 nt, Human
ugagaggacuuuucuuuguggcu

SEQ ID NO: 1680211 - RNA, 23 nt, Human
ugagauguagccccucuccugga

SEQ ID NO: 1680212 - RNA, 13 nt, Human
ugagaugugaaca

SEQ ID NO: 1680213 - RNA, 16 nt, Human
ugagagacacacugaa

SEQ ID NO: 1680214 - RNA, 17 nt, Human
ugagagacacacugaag

SEQ ID NO: 1680215 - RNA, 19 nt, Human
ugagagacacacugaagaa

SEQ ID NO: 1680216 - RNA, 20 nt, Human
ugagagacacacugaagaag

SEQ ID NO: 1680217 - RNA, 17 nt, Human
ugagacagcccgggcuc

SEQ ID NO: 1680218 - RNA, 18 nt, Human
ugagacagcccgggcucu

SEQ ID NO: 1680219 - RNA, 19 nt, Human
ugagacagcccgggcucug

SEQ ID NO: 1680220 - RNA, 20 nt, Human
ugagacagcccgggcucugc

SEQ ID NO: 1680221 - RNA, 20 nt, Human
ugagacucugucucaaaaaa

SEQ ID NO: 1680222 - RNA, 20 nt, Human
ugagacucugucucagucca

SEQ ID NO: 1680223 - RNA, 22 nt, Human
ugagacagcccgggcucugccu

SEQ ID NO: 1680224 - RNA, 12 nt, Human
ugagacagcucu

SEQ ID NO: 1680225 - RNA, 20 nt, Human
ugagacagaaucucgcucug

SEQ ID NO: 1680226 - RNA, 11 nt, Human
ugagacagagu

SEQ ID NO: 1680227 - RNA, 21 nt, Human
ugagacagaguuuucacucuu

SEQ ID NO: 1680228 - RNA, 13 nt, Human
ugagacagcccgg

SEQ ID NO: 1680229 - RNA, 15 nt, Human
agauuuuccugaaaa

SEQ ID NO: 1680230 - RNA, 16 nt, Human
agauuuuccugaaaac

SEQ ID NO: 1680231 - RNA, 17 nt, Human
agcaccuagccucgcuc

SEQ ID NO: 1680232 - RNA, 13 nt, Human
agcaccuccugcc

SEQ ID NO: 1680233 - RNA, 14 nt, Human
agcaccuccugccu

SEQ ID NO: 1680234 - RNA, 16 nt, Human
agcaccuccugccucg

SEQ ID NO: 1680235 - RNA, 22 nt, Human
agcaccaaaagcuuaccaaggg

SEQ ID NO: 1680236 - RNA, 23 nt, Human
agcacaugccucucucaggccaa

SEQ ID NO: 1680237 - RNA, 16 nt, Human
agcaccaucucuccuc

SEQ ID NO: 1680238 - RNA, 18 nt, Human
agcacaugccucucucag

SEQ ID NO: 1680239 - RNA, 19 nt, Human
agcacaugccucucucagg

SEQ ID NO: 1680240 - RNA, 20 nt, Human
agcacaugccucucucaggc

SEQ ID NO: 1680241 - RNA, 21 nt, Human
agcacaugccucucucaggcc

SEQ ID NO: 1680242 - RNA, 22 nt, Human
agcacaugccucucucaggcca

SEQ ID NO: 1680243 - RNA, 21 nt, Human
agcacagcuucauuuccugug

SEQ ID NO: 1680244 - RNA, 17 nt, Human
agcaagugagagcuggg

SEQ ID NO: 1680245 - RNA, 18 nt, Human
agcaagugagagcugggu

SEQ ID NO: 1680246 - RNA, 20 nt, Human
ugagccagauuucacucucc

SEQ ID NO: 1680247 - RNA, 21 nt, Human
ugagccagauuucacucuccu

SEQ ID NO: 1680248 - RNA, 14 nt, Human
ugagccacugcacc

SEQ ID NO: 1680249 - RNA, 18 nt, Human
ugagccagauuucacucu

SEQ ID NO: 1680250 - RNA, 19 nt, Human
ugagccagauuucacucuc

SEQ ID NO: 1680251 - RNA, 15 nt, Human
ugagcaaauguggcu

SEQ ID NO: 1680252 - RNA, 16 nt, Human
ugagcauuagauuucu

SEQ ID NO: 1680253 - RNA, 14 nt, Human
ugagcauuagauuu

SEQ ID NO: 1680254 - RNA, 12 nt, Human
ugagccacugca

SEQ ID NO: 1680255 - RNA, 13 nt, Human
ugagccacugcac

SEQ ID NO: 1680256 - RNA, 16 nt, Human
agcaagugagacccug

SEQ ID NO: 1680257 - RNA, 15 nt, Human
agcaagugagagcug

SEQ ID NO: 1680258 - RNA, 16 nt, Human
agcaagugagagcugg

SEQ ID NO: 1680259 - RNA, 15 nt, Human
agcaagucagaauag

SEQ ID NO: 1680260 - RNA, 20 nt, Human
agcaagggugaugggaaagc

SEQ ID NO: 1680261 - RNA, 22 nt, Human
agcaagggugaugggaaagcau

SEQ ID NO: 1680262 - RNA, 14 nt, Human
agcaaggagauuua

SEQ ID NO: 1680263 - RNA, 19 nt, Human
agcaaggagauuuacaacu

SEQ ID NO: 1680264 - RNA, 17 nt, Human
agcaaggagauuuacaa

SEQ ID NO: 1680265 - RNA, 16 nt, Human
agcaagggugauggga

SEQ ID NO: 1680266 - RNA, 21 nt, Human
agaugcaguucugaagaagau

SEQ ID NO: 1680267 - RNA, 19 nt, Human
agaugcuagaacucccuuu

SEQ ID NO: 1680268 - RNA, 22 nt, Human
agauguagccccucuccuggaa

SEQ ID NO: 1680269 - RNA, 21 nt, Human
agaugcuagaacucccuuuca

SEQ ID NO: 1680270 - RNA, 22 nt, Human
agaugcuagaacucccuuucaa

SEQ ID NO: 1680271 - RNA, 18 nt, Human
agauccccaagccuggca

SEQ ID NO: 1680272 - RNA, 18 nt, Human
agaucucuaacuucacca

SEQ ID NO: 1680273 - RNA, 13 nt, Human
agauccuggaaau

SEQ ID NO: 1680274 - RNA, 14 nt, Human
agauccuggaaauc

SEQ ID NO: 1680275 - RNA, 17 nt, Human
ugacaggcaaugcuggc

SEQ ID NO: 1680276 - RNA, 19 nt, Human
ugacaggcaaugcuggcug

SEQ ID NO: 1680277 - RNA, 22 nt, Human
ugacagggcacaccgggcacuc

SEQ ID NO: 1680278 - RNA, 16 nt, Human
ugacacgaauauugcu

SEQ ID NO: 1680279 - RNA, 19 nt, Human
ugacacgaauauugcugau

SEQ ID NO: 1680280 - RNA, 15 nt, Human
ugacacuuaaaaaug

SEQ ID NO: 1680281 - RNA, 15 nt, Human
agauuagaauucugu

SEQ ID NO: 1680282 - RNA, 16 nt, Human
agauuagaauucugua

SEQ ID NO: 1680283 - RNA, 20 nt, Human
ugacuuacuguacaugaaaa

SEQ ID NO: 1680284 - RNA, 12 nt, Human
ugacuuacugua

SEQ ID NO: 1680285 - RNA, 22 nt, Human
agauuagaauucuguauagauu

SEQ ID NO: 1680286 - RNA, 23 nt, Human
agauuagaauucuguauagauua

SEQ ID NO: 1680287 - RNA, 21 nt, Human
agauuagagaguguugaaacg

SEQ ID NO: 1680288 - RNA, 13 nt, Human
agauucauauuua

SEQ ID NO: 1680289 - RNA, 16 nt, Human
agauucauauuuacuu

SEQ ID NO: 1680290 - RNA, 19 nt, Human
agauuucacucuccuuggu

SEQ ID NO: 1680291 - RNA, 22 nt, Human
agauuccagagaguggcuccuc

SEQ ID NO: 1680292 - RNA, 21 nt, Human
agauuccagagaguggcuccu

SEQ ID NO: 1680293 - RNA, 19 nt, Human
agauucauauuuacuucuu

SEQ ID NO: 1680294 - RNA, 15 nt, Human
ugaccuuuaagagaa

SEQ ID NO: 1680295 - RNA, 22 nt, Human
agaugugaacacaucagcuugc

SEQ ID NO: 1680296 - RNA, 22 nt, Human
agauguauguacuucaugcugu

SEQ ID NO: 1680297 - RNA, 17 nt, Human
agaugugaacacaucag

SEQ ID NO: 1680298 - RNA, 21 nt, Human
ugacucguauaugucucaggu

SEQ ID NO: 1680299 - RNA, 21 nt, Human
ugacuguuuucucuugagagg

SEQ ID NO: 1680300 - RNA, 12 nt, Human
ugaccuuucaau

SEQ ID NO: 1680301 - RNA, 13 nt, Human
ugaccuuucaaua

SEQ ID NO: 1680302 - RNA, 12 nt, Human
acuuuaccuuuu

SEQ ID NO: 1680303 - RNA, 20 nt, Human
acuuucugaaauaacauggc

SEQ ID NO: 1680304 - RNA, 17 nt, Human
ucuccucugcugcuggc

SEQ ID NO: 1680305 - RNA, 18 nt, Human
ucuccucugcugcuggcu

SEQ ID NO: 1680306 - RNA, 15 nt, Human
ucuccuccagaguca

SEQ ID NO: 1680307 - RNA, 16 nt, Human
ucuccucugcugcugg

SEQ ID NO: 1680308 - RNA, 23 nt, Human
ucuccccagcaagugagagcugg

SEQ ID NO: 1680309 - RNA, 12 nt, Human
ucuccacccugc

SEQ ID NO: 1680310 - RNA, 18 nt, Human
ucuccaagcaggacaugg

SEQ ID NO: 1680311 - RNA, 19 nt, Human
ucuccaagcaggacaugga

SEQ ID NO: 1680312 - RNA, 17 nt, Human
ucuccgaccagacaccu

SEQ ID NO: 1680313 - RNA, 23 nt, Human
ucuccgaccagacaccuugacag

SEQ ID NO: 1680314 - RNA, 21 nt, Human
ucuccuuguguuacuaaguuu

SEQ ID NO: 1680315 - RNA, 13 nt, Human
ucuccuuguguua

SEQ ID NO: 1680316 - RNA, 16 nt, Human
ucuccuucaccuuugu

SEQ ID NO: 1680317 - RNA, 18 nt, Human
ucuccuucaccuuugucc

SEQ ID NO: 1680318 - RNA, 17 nt, Human
agaaaaaauauuuuccc

SEQ ID NO: 1680319 - RNA, 14 nt, Human
ucuccuucaccuuu

SEQ ID NO: 1680320 - RNA, 15 nt, Human
ucuccuucaccuuug

SEQ ID NO: 1680321 - RNA, 23 nt, Human
acuuuuguucuugguuuguaaau

SEQ ID NO: 1680322 - RNA, 15 nt, Human
acuuuuguucuuggu

SEQ ID NO: 1680323 - RNA, 13 nt, Human
acuuuuguucuug

SEQ ID NO: 1680324 - RNA, 12 nt, Human
acuuuuguucuu

SEQ ID NO: 1680325 - RNA, 21 nt, Human
acuuuguuaguuucuccaagc

SEQ ID NO: 1680326 - RNA, 14 nt, Human
acuuuguucuggcu

SEQ ID NO: 1680327 - RNA, 20 nt, Human
acuuuguuaguuucuccaag

SEQ ID NO: 1680328 - RNA, 17 nt, Human
acuuuggauaauaagga

SEQ ID NO: 1680329 - RNA, 19 nt, Human
acuuuggauaauaaggaaa

SEQ ID NO: 1680330 - RNA, 12 nt, Human
acuuuggauaau

SEQ ID NO: 1680331 - RNA, 13 nt, Human
acuuugaccucug

SEQ ID NO: 1680332 - RNA, 12 nt, Human
acuuugaccucu

SEQ ID NO: 1680333 - RNA, 21 nt, Human
ucucaugccucagccuccuga

SEQ ID NO: 1680334 - RNA, 20 nt, Human
ucucaugccucagccuccug

SEQ ID NO: 1680335 - RNA, 21 nt, Human
ucucaggccagcugcuugggc

SEQ ID NO: 1680336 - RNA, 17 nt, Human
ucucaggccagcugcuu

SEQ ID NO: 1680337 - RNA, 18 nt, Human
ucucaggccagcugcuug

SEQ ID NO: 1680338 - RNA, 16 nt, Human
ucucauuugucacaca

SEQ ID NO: 1680339 - RNA, 13 nt, Human
ucuccaaaauaaa

SEQ ID NO: 1680340 - RNA, 16 nt, Human
ucuccaagcaggacau

SEQ ID NO: 1680341 - RNA, 19 nt, Human
ucucauuugccaauaauaa

SEQ ID NO: 1680342 - RNA, 14 nt, Human
ucucauuugucaca

SEQ ID NO: 1680343 - RNA, 15 nt, Human
ucucauuuccaagca

SEQ ID NO: 1680344 - RNA, 16 nt, Human
ucucauuuaauccucu

SEQ ID NO: 1680345 - RNA, 10 nt, Human
ucucaggcca

SEQ ID NO: 1680346 - RNA, 12 nt, Human
ucucaggccaaa

SEQ ID NO: 1680347 - RNA, 12 nt, Human
ucucaggccagc

SEQ ID NO: 1680348 - RNA, 13 nt, Human
ucucaggccagcu

SEQ ID NO: 1680349 - RNA, 22 nt, Human
ucucagauuuuauuauguaaau

SEQ ID NO: 1680350 - RNA, 23 nt, Human
ucucagauuuuauuauguaaauc

SEQ ID NO: 1680351 - RNA, 23 nt, Human
ucucaggaaaucaaauaugcaaa

SEQ ID NO: 1680352 - RNA, 14 nt, Human
ucucaggaaaucaa

SEQ ID NO: 1680353 - RNA, 21 nt, Human
ucucaggaaaucaaauaugca

SEQ ID NO: 1680354 - RNA, 17 nt, Human
acuugcucuugaugccu

SEQ ID NO: 1680355 - RNA, 18 nt, Human
acuugcucuugaugccug

SEQ ID NO: 1680356 - RNA, 20 nt, Human
acuugcucuugaugccuggc

SEQ ID NO: 1680357 - RNA, 16 nt, Human
acuugcucuugaugcc

SEQ ID NO: 1680358 - RNA, 23 nt, Human
acuugcagacucuacagaggcca

SEQ ID NO: 1680359 - RNA, 19 nt, Human
acuugcagacucuacagag

SEQ ID NO: 1680360 - RNA, 22 nt, Human
acuugcagacucuacagaggcc

SEQ ID NO: 1680361 - RNA, 20 nt, Human
ucucacuauguugcccaggc

SEQ ID NO: 1680362 - RNA, 21 nt, Human
ucucacuauguugcccaggca

SEQ ID NO: 1680363 - RNA, 22 nt, Human
ucucacuauguugcccaggcag

SEQ ID NO: 1680364 - RNA, 23 nt, Human
ucucacuauguugcccaggcagg

SEQ ID NO: 1680365 - RNA, 18 nt, Human
ucucaccuccugcugggc

SEQ ID NO: 1680366 - RNA, 13 nt, Human
acuuguguaaaua

SEQ ID NO: 1680367 - RNA, 19 nt, Human
acuuguggacacagcucuu

SEQ ID NO: 1680368 - RNA, 22 nt, Human
acuuguggacacagcucuucuc

SEQ ID NO: 1680369 - RNA, 20 nt, Human
acuugucuuuggacccugag

SEQ ID NO: 1680370 - RNA, 21 nt, Human
acuugucuuuggacccugagg

SEQ ID NO: 1680371 - RNA, 14 nt, Human
acuugcuuuuaaaa

SEQ ID NO: 1680372 - RNA, 18 nt, Human
acuuguauuauguguguu

SEQ ID NO: 1680373 - RNA, 19 nt, Human
acuuguauuauguguguuu

SEQ ID NO: 1680374 - RNA, 15 nt, Human
acuugucaauaaaau

SEQ ID NO: 1680375 - RNA, 21 nt, Human
ucuacccuggcacuauaaugu

SEQ ID NO: 1680376 - RNA, 15 nt, Human
acuguuauuuauaau

SEQ ID NO: 1680377 - RNA, 17 nt, Human
acuguuauuuauaauca

SEQ ID NO: 1680378 - RNA, 20 nt, Human
acuguuauuuauaaucacuu

SEQ ID NO: 1680379 - RNA, 20 nt, Human
ucuacccagcgagcccuggu

SEQ ID NO: 1680380 - RNA, 14 nt, Human
ucuacccaggugcu

SEQ ID NO: 1680381 - RNA, 19 nt, Human
ucuacccuggcacuauaau

SEQ ID NO: 1680382 - RNA, 14 nt, Human
ucuacccuggcacu

SEQ ID NO: 1680383 - RNA, 16 nt, Human
acuguucucugcccuc

SEQ ID NO: 1680384 - RNA, 17 nt, Human
acuguucucugcccucc

SEQ ID NO: 1680385 - RNA, 21 nt, Human
acuguuauuuauaaucacuuu

SEQ ID NO: 1680386 - RNA, 19 nt, Human
acuguucucugcccuccaa

SEQ ID NO: 1680387 - RNA, 18 nt, Human
acuguucucugcccucca

SEQ ID NO: 1680388 - RNA, 20 nt, Human
ucuacagcuaaucagcauuc

SEQ ID NO: 1680389 - RNA, 23 nt, Human
ucuacagcuaaucagcauucuca

SEQ ID NO: 1680390 - RNA, 19 nt, Human
ucuacccagcgagcccugg

SEQ ID NO: 1680391 - RNA, 21 nt, Human
ucuacagaggccaugggccuc

SEQ ID NO: 1680392 - RNA, 18 nt, Human
uccugggagugagcuggu

SEQ ID NO: 1680393 - RNA, 14 nt, Human
uccugggcagcugc

SEQ ID NO: 1680394 - RNA, 13 nt, Human
uccugggcagcug

SEQ ID NO: 1680395 - RNA, 12 nt, Human
uccugggcagcu

SEQ ID NO: 1680396 - RNA, 20 nt, Human
ucuaaguaaaaccacagcag

SEQ ID NO: 1680397 - RNA, 19 nt, Human
ucuaaguaaaaccacagca

SEQ ID NO: 1680398 - RNA, 14 nt, Human
ucuaaguaaaacca

SEQ ID NO: 1680399 - RNA, 15 nt, Human
ucuaaguaaaaccac

SEQ ID NO: 1680400 - RNA, 15 nt, Human
acuuagguguggggg

SEQ ID NO: 1680401 - RNA, 21 nt, Human
acuuacuguacaugaaaacac

SEQ ID NO: 1680402 - RNA, 17 nt, Human
acuuacacuuuaugcac

SEQ ID NO: 1680403 - RNA, 14 nt, Human
acuuagcugggaga

SEQ ID NO: 1680404 - RNA, 22 nt, Human
acuuacuguacaugaaaacaca

SEQ ID NO: 1680405 - RNA, 16 nt, Human
acuuacacuuuaugca

SEQ ID NO: 1680406 - RNA, 22 nt, Human
acuuaaucuaaauggaaccacu

SEQ ID NO: 1680407 - RNA, 19 nt, Human
acuuaaucuaaauggaacc

SEQ ID NO: 1680408 - RNA, 17 nt, Human
acuuaaucuaaauggaa

SEQ ID NO: 1680409 - RNA, 13 nt, Human
acuuaagcacacu

SEQ ID NO: 1680410 - RNA, 20 nt, Human
acuuaaauaaugugaaacug

SEQ ID NO: 1680411 - RNA, 14 nt, Human
ucucaccuccugcu

SEQ ID NO: 1680412 - RNA, 15 nt, Human
ucucaccuccugcug

SEQ ID NO: 1680413 - RNA, 16 nt, Human
ucucaccuccugcugg

SEQ ID NO: 1680414 - RNA, 17 nt, Human
ucucaccuccugcuggg

SEQ ID NO: 1680415 - RNA, 19 nt, Human
ucucaccuccugcugggca

SEQ ID NO: 1680416 - RNA, 17 nt, Human
ucucacuauguugccca

SEQ ID NO: 1680417 - RNA, 19 nt, Human
ucucacuauguugcccagg

SEQ ID NO: 1680418 - RNA, 13 nt, Human
ucuauaaaccgaa

SEQ ID NO: 1680419 - RNA, 23 nt, Human
ucuaguuguuugauucagacagc

SEQ ID NO: 1680420 - RNA, 21 nt, Human
ucuaguuugauuaaauucuug

SEQ ID NO: 1680421 - RNA, 22 nt, Human
ucuaguuugauuaaauucuugc

SEQ ID NO: 1680422 - RNA, 22 nt, Human
ucuaguuguuugauucagacag

SEQ ID NO: 1680423 - RNA, 12 nt, Human
ucuaggaagacu

SEQ ID NO: 1680424 - RNA, 17 nt, Human
ucuaggaaauauuuauu

SEQ ID NO: 1680425 - RNA, 13 nt, Human
ucuagccagagga

SEQ ID NO: 1680426 - RNA, 16 nt, Human
ucuaggaaauauuuau

SEQ ID NO: 1680427 - RNA, 13 nt, Human
acuuccccuuccu

SEQ ID NO: 1680428 - RNA, 19 nt, Human
acuuccccuuccuaauucc

SEQ ID NO: 1680429 - RNA, 16 nt, Human
acuucaucccucuggg

SEQ ID NO: 1680430 - RNA, 18 nt, Human
ucuagcauggcugccaau

SEQ ID NO: 1680431 - RNA, 13 nt, Human
ucuagauacugua

SEQ ID NO: 1680432 - RNA, 16 nt, Human
ucuccuuucacaaccu

SEQ ID NO: 1680433 - RNA, 15 nt, Human
ucugaauuauuuucu

SEQ ID NO: 1680434 - RNA, 13 nt, Human
ucugacacacagc

SEQ ID NO: 1680435 - RNA, 14 nt, Human
ucugacacacagcu

SEQ ID NO: 1680436 - RNA, 15 nt, Human
ucugacacacagcuc

SEQ ID NO: 1680437 - RNA, 10 nt, Human
ucugaauuau

SEQ ID NO: 1680438 - RNA, 22 nt, Human
ucugaaggacauugcggacagc

SEQ ID NO: 1680439 - RNA, 21 nt, Human
ucugaaggacauugcggacag

SEQ ID NO: 1680440 - RNA, 22 nt, Human
ucugagacucgcgacaaugcaa

SEQ ID NO: 1680441 - RNA, 21 nt, Human
ucugagacucgcgacaaugca

SEQ ID NO: 1680442 - RNA, 16 nt, Human
ucugaugcaagcaaga

SEQ ID NO: 1680443 - RNA, 14 nt, Human
ucugauccaguuuu

SEQ ID NO: 1680444 - RNA, 21 nt, Human
ucugauccaguuuuguuugga

SEQ ID NO: 1680445 - RNA, 17 nt, Human
ucugaucauccacugug

SEQ ID NO: 1680446 - RNA, 11 nt, Human
ucugauccagu

SEQ ID NO: 1680447 - RNA, 21 nt, Human
ucugaucauccacugugccau

SEQ ID NO: 1680448 - RNA, 11 nt, Human
ucugcaggucc

SEQ ID NO: 1680449 - RNA, 12 nt, Human
ucugcagguccc

SEQ ID NO: 1680450 - RNA, 13 nt, Human
ucugcaggucccu

SEQ ID NO: 1680451 - RNA, 14 nt, Human
ucugcaggucccua

SEQ ID NO: 1680452 - RNA, 15 nt, Human
agaaauguacagcaa

SEQ ID NO: 1680453 - RNA, 14 nt, Human
agaaauguacagca

SEQ ID NO: 1680454 - RNA, 21 nt, Human
ucugaugcaagcaagaaacac

SEQ ID NO: 1680455 - RNA, 17 nt, Human
ucugcacuccccugcug

SEQ ID NO: 1680456 - RNA, 16 nt, Human
ucugcacuccccugcu

SEQ ID NO: 1680457 - RNA, 14 nt, Human
ucugcacuccccug

SEQ ID NO: 1680458 - RNA, 15 nt, Human
ucugcacuccccugc

SEQ ID NO: 1680459 - RNA, 17 nt, Human
ucugcagcaauaaagca

SEQ ID NO: 1680460 - RNA, 18 nt, Human
ucugcagcaauaaagcag

SEQ ID NO: 1680461 - RNA, 18 nt, Human
ucugcagauaaacaguag

SEQ ID NO: 1680462 - RNA, 15 nt, Human
ucugcagauaaacag

SEQ ID NO: 1680463 - RNA, 17 nt, Human
agaaauugcauuuccug

SEQ ID NO: 1680464 - RNA, 20 nt, Human
agaaauugcauuuccugaca

SEQ ID NO: 1680465 - RNA, 18 nt, Human
agaagaugguaccaccag

SEQ ID NO: 1680466 - RNA, 13 nt, Human
agaagaacugaaa

SEQ ID NO: 1680467 - RNA, 14 nt, Human
agaagaacugaaau

SEQ ID NO: 1680468 - RNA, 12 nt, Human
agaagcccagga

SEQ ID NO: 1680469 - RNA, 16 nt, Human
agaagcccaggaaagg

SEQ ID NO: 1680470 - RNA, 18 nt, Human
agaagcccaggaaaggcu

SEQ ID NO: 1680471 - RNA, 20 nt, Human
agaagcccaggaaaggcucc

SEQ ID NO: 1680472 - RNA, 21 nt, Human
agaagcccaggaaaggcucca

SEQ ID NO: 1680473 - RNA, 22 nt, Human
agaagcccaggaaaggcuccag

SEQ ID NO: 1680474 - RNA, 17 nt, Human
ucugcccacucccugca

SEQ ID NO: 1680475 - RNA, 18 nt, Human
agaagauuuugaaauuuu

SEQ ID NO: 1680476 - RNA, 19 nt, Human
agaagcaacccaaauguuc

SEQ ID NO: 1680477 - RNA, 11 nt, Human
ucugcccugcg

SEQ ID NO: 1680478 - RNA, 12 nt, Human
ucugcccugcgg

SEQ ID NO: 1680479 - RNA, 10 nt, Human
ucugcccugc

SEQ ID NO: 1680480 - RNA, 14 nt, Human
ucugccgcagcccu

SEQ ID NO: 1680481 - RNA, 15 nt, Human
ucugccgcagcccug

SEQ ID NO: 1680482 - RNA, 18 nt, Human
ucugcccacucccugcaa

SEQ ID NO: 1680483 - RNA, 21 nt, Human
ucugcccacucccugcaaccu

SEQ ID NO: 1680484 - RNA, 19 nt, Human
ucugcccuccaagaccuuc

SEQ ID NO: 1680485 - RNA, 23 nt, Human
ucugccgcagcccugcagagggc

SEQ ID NO: 1680486 - RNA, 22 nt, Human
ucugccgcagcccugcagaggg

SEQ ID NO: 1680487 - RNA, 21 nt, Human
ucugccugcccaggccccugc

SEQ ID NO: 1680488 - RNA, 22 nt, Human
ucugccugcccaggccccugcc

SEQ ID NO: 1680489 - RNA, 19 nt, Human
ucugcucacauaucuguca

SEQ ID NO: 1680490 - RNA, 20 nt, Human
ucugcucacauaucugucau

SEQ ID NO: 1680491 - RNA, 14 nt, Human
ucugcuucagccuc

SEQ ID NO: 1680492 - RNA, 15 nt, Human
ucugcuucagccucc

SEQ ID NO: 1680493 - RNA, 13 nt, Human
ucugcuucagccu

SEQ ID NO: 1680494 - RNA, 23 nt, Human
ucugcuugccaucccucccucca

SEQ ID NO: 1680495 - RNA, 20 nt, Human
ucugcuugccaucccucccu

SEQ ID NO: 1680496 - RNA, 17 nt, Human
ucugcuugccaucccuc

SEQ ID NO: 1680497 - RNA, 16 nt, Human
ucugcuugccaucccu

SEQ ID NO: 1680498 - RNA, 13 nt, Human
agacagagcuaca

SEQ ID NO: 1680499 - RNA, 19 nt, Human
agacaccuugacagggcac

SEQ ID NO: 1680500 - RNA, 18 nt, Human
agacaccuugacagggca

SEQ ID NO: 1680501 - RNA, 17 nt, Human
agacaccuugacagggc

SEQ ID NO: 1680502 - RNA, 16 nt, Human
agacacauguccaaga

SEQ ID NO: 1680503 - RNA, 20 nt, Human
agacacauguccaagaagcc

SEQ ID NO: 1680504 - RNA, 22 nt, Human
agaauuugauaugugaacaguu

SEQ ID NO: 1680505 - RNA, 21 nt, Human
agaauuugauaugugaacagu

SEQ ID NO: 1680506 - RNA, 12 nt, Human
agacacaggccc

SEQ ID NO: 1680507 - RNA, 13 nt, Human
agacacaggcccg

SEQ ID NO: 1680508 - RNA, 16 nt, Human
agacacaggcccggcu

SEQ ID NO: 1680509 - RNA, 12 nt, Human
agacacacauga

SEQ ID NO: 1680510 - RNA, 15 nt, Human
agacacacaugaagu

SEQ ID NO: 1680511 - RNA, 13 nt, Human
ucuguucuuucca

SEQ ID NO: 1680512 - RNA, 20 nt, Human
ucugugagcaucacaguuuu

SEQ ID NO: 1680513 - RNA, 22 nt, Human
ucuguucuuuccaaaguacacu

SEQ ID NO: 1680514 - RNA, 15 nt, Human
ucuguugcugccuca

SEQ ID NO: 1680515 - RNA, 12 nt, Human
ucuguuggccag

SEQ ID NO: 1680516 - RNA, 17 nt, Human
ucuguuggccaguguga

SEQ ID NO: 1680517 - RNA, 14 nt, Human
agaauucuguauag

SEQ ID NO: 1680518 - RNA, 13 nt, Human
ucuguuuagauaa

SEQ ID NO: 1680519 - RNA, 12 nt, Human
agaauucuguau

SEQ ID NO: 1680520 - RNA, 23 nt, Human
ucugugagaugcuagaacucccu

SEQ ID NO: 1680521 - RNA, 17 nt, Human
ucugugagaugcuagaa

SEQ ID NO: 1680522 - RNA, 22 nt, Human
ucugugagaugcuagaacuccc

SEQ ID NO: 1680523 - RNA, 14 nt, Human
ucugugaacuugaa

SEQ ID NO: 1680524 - RNA, 17 nt, Human
ucugugaacuugaaauu

SEQ ID NO: 1680525 - RNA, 18 nt, Human
ucugugaacuugaaauuu

SEQ ID NO: 1680526 - RNA, 14 nt, Human
ucugugagaugcua

SEQ ID NO: 1680527 - RNA, 14 nt, Human
ucugggccagaauu

SEQ ID NO: 1680528 - RNA, 15 nt, Human
ucugggccagaauuu

SEQ ID NO: 1680529 - RNA, 21 nt, Human
agaaugguccgugcuaaggac

SEQ ID NO: 1680530 - RNA, 23 nt, Human
agaaugguccgugcuaaggacuu

SEQ ID NO: 1680531 - RNA, 23 nt, Human
agaauuaacacaugauccugcaa

SEQ ID NO: 1680532 - RNA, 15 nt, Human
agaauuaacacauga

SEQ ID NO: 1680533 - RNA, 20 nt, Human
agaaguggggacagagcaga

SEQ ID NO: 1680534 - RNA, 21 nt, Human
agaaguuucugccgcagcccu

SEQ ID NO: 1680535 - RNA, 22 nt, Human
agaaguuucugccgcagcccug

SEQ ID NO: 1680536 - RNA, 23 nt, Human
agaaguuucugccgcagcccugc

SEQ ID NO: 1680537 - RNA, 12 nt, Human
ucugcuuuccuc

SEQ ID NO: 1680538 - RNA, 13 nt, Human
ucugcuuuccucu

SEQ ID NO: 1680539 - RNA, 18 nt, Human
ucugcuuuccucuuccug

SEQ ID NO: 1680540 - RNA, 14 nt, Human
agaaggcaaaugac

SEQ ID NO: 1680541 - RNA, 15 nt, Human
agaaggcaaaugacu

SEQ ID NO: 1680542 - RNA, 20 nt, Human
agaaggcaaaugacuuugga

SEQ ID NO: 1680543 - RNA, 12 nt, Human
agaauaaaauuu

SEQ ID NO: 1680544 - RNA, 14 nt, Human
agaauaaaauuuuu

SEQ ID NO: 1680545 - RNA, 17 nt, Human
agaauaaaauuuuuaau

SEQ ID NO: 1680546 - RNA, 16 nt, Human
agaauagaugcugacu

SEQ ID NO: 1680547 - RNA, 13 nt, Human
ucccuuuuuuuaa

SEQ ID NO: 1680548 - RNA, 23 nt, Human
ucccuuuuuuggcugcugaaggc

SEQ ID NO: 1680549 - RNA, 20 nt, Human
ucccuuuuuuggcugcugaa

SEQ ID NO: 1680550 - RNA, 22 nt, Human
ucccuuuuuuggcugcugaagg

SEQ ID NO: 1680551 - RNA, 21 nt, Human
ucccuuugacgccaucccagc

SEQ ID NO: 1680552 - RNA, 19 nt, Human
ucccuuugacgccauccca

SEQ ID NO: 1680553 - RNA, 17 nt, Human
ucccuuuuuuggcugcu

SEQ ID NO: 1680554 - RNA, 19 nt, Human
ucccuuuuuuggcugcuga

SEQ ID NO: 1680555 - RNA, 12 nt, Human
acuccuggccuc

SEQ ID NO: 1680556 - RNA, 16 nt, Human
ucccuuugacgccauc

SEQ ID NO: 1680557 - RNA, 18 nt, Human
ucccuuugacgccauccc

SEQ ID NO: 1680558 - RNA, 22 nt, Human
ucccugguggcagcucaccucu

SEQ ID NO: 1680559 - RNA, 23 nt, Human
ucccugguggcagcucaccucuc

SEQ ID NO: 1680560 - RNA, 19 nt, Human
ucccuuggauuguccccga

SEQ ID NO: 1680561 - RNA, 20 nt, Human
ucccuuggauuguccccgac

SEQ ID NO: 1680562 - RNA, 18 nt, Human
uccgguguuuaagacauu

SEQ ID NO: 1680563 - RNA, 16 nt, Human
ucccuuuuuuuaagua

SEQ ID NO: 1680564 - RNA, 21 nt, Human
ucccuuuuuuuaaguaaggaa

SEQ ID NO: 1680565 - RNA, 13 nt, Human
uccuacucugugu

SEQ ID NO: 1680566 - RNA, 14 nt, Human
uccuacucuguguc

SEQ ID NO: 1680567 - RNA, 15 nt, Human
uccuacucuguguca

SEQ ID NO: 1680568 - RNA, 13 nt, Human
uccuaggcauuug

SEQ ID NO: 1680569 - RNA, 13 nt, Human
acuccuggccuca

SEQ ID NO: 1680570 - RNA, 14 nt, Human
acuccuggccucaa

SEQ ID NO: 1680571 - RNA, 18 nt, Human
acuccagaccccuggcuu

SEQ ID NO: 1680572 - RNA, 19 nt, Human
acuccagaccccuggcuuu

SEQ ID NO: 1680573 - RNA, 21 nt, Human
acuccagaccccuggcuuuuc

SEQ ID NO: 1680574 - RNA, 19 nt, Human
acuccagugagacagcucu

SEQ ID NO: 1680575 - RNA, 13 nt, Human
acucaccccagcc

SEQ ID NO: 1680576 - RNA, 15 nt, Human
acuccagaccccugg

SEQ ID NO: 1680577 - RNA, 16 nt, Human
acucaccccagcccca

SEQ ID NO: 1680578 - RNA, 14 nt, Human
acucaccccagccc

SEQ ID NO: 1680579 - RNA, 15 nt, Human
acucaccccagcccc

SEQ ID NO: 1680580 - RNA, 12 nt, Human
acuccucccagg

SEQ ID NO: 1680581 - RNA, 14 nt, Human
acuccugcaggcag

SEQ ID NO: 1680582 - RNA, 22 nt, Human
acuccugcaggcagccaggcca

SEQ ID NO: 1680583 - RNA, 15 nt, Human
acuccugcaggcagc

SEQ ID NO: 1680584 - RNA, 16 nt, Human
acuccugcaggcagcc

SEQ ID NO: 1680585 - RNA, 18 nt, Human
ucccugguggcagcucac

SEQ ID NO: 1680586 - RNA, 19 nt, Human
ucccugguggcagcucacc

SEQ ID NO: 1680587 - RNA, 20 nt, Human
ucccugguggcagcucaccu

SEQ ID NO: 1680588 - RNA, 21 nt, Human
ucccugguggcagcucaccuc

SEQ ID NO: 1680589 - RNA, 16 nt, Human
ucccugguggcagcuc

SEQ ID NO: 1680590 - RNA, 17 nt, Human
ucccugguggcagcuca

SEQ ID NO: 1680591 - RNA, 11 nt, Human
acuccuggccu

SEQ ID NO: 1680592 - RNA, 11 nt, Human
acucugagacu

SEQ ID NO: 1680593 - RNA, 22 nt, Human
acucugagacucgcgacaaugc

SEQ ID NO: 1680594 - RNA, 16 nt, Human
acucuccuuggugucg

SEQ ID NO: 1680595 - RNA, 23 nt, Human
acucuccuuggugucgggcauga

SEQ ID NO: 1680596 - RNA, 12 nt, Human
acucugccuccu

SEQ ID NO: 1680597 - RNA, 16 nt, Human
acucugccuccucuuc

SEQ ID NO: 1680598 - RNA, 13 nt, Human
acucuggcagcuc

SEQ ID NO: 1680599 - RNA, 15 nt, Human
acucuggcagcucag

SEQ ID NO: 1680600 - RNA, 23 nt, Human
acuccuugaaaacacuguucucu

SEQ ID NO: 1680601 - RNA, 24 nt, Human
acuccuugaaaacacuguucucug

SEQ ID NO: 1680602 - RNA, 14 nt, Human
acucuccuccagag

SEQ ID NO: 1680603 - RNA, 17 nt, Human
acucuccuccagaguca

SEQ ID NO: 1680604 - RNA, 12 nt, Human
acucuccucugc

SEQ ID NO: 1680605 - RNA, 13 nt, Human
acucuccucugcu

SEQ ID NO: 1680606 - RNA, 14 nt, Human
acucuccucugcug

SEQ ID NO: 1680607 - RNA, 16 nt, Human
acucuccucugcugcu

SEQ ID NO: 1680608 - RNA, 18 nt, Human
acucuccuggaaauauua

SEQ ID NO: 1680609 - RNA, 15 nt, Human
acucuccuugguguc

SEQ ID NO: 1680610 - RNA, 19 nt, Human
uccucccaggcgccccuuc

SEQ ID NO: 1680611 - RNA, 21 nt, Human
uccucccaggcgccccuuccc

SEQ ID NO: 1680612 - RNA, 13 nt, Human
uccucccaggcgc

SEQ ID NO: 1680613 - RNA, 22 nt, Human
uccucauaguaugguggcuggg

SEQ ID NO: 1680614 - RNA, 23 nt, Human
uccucauacccacccccacccaa

SEQ ID NO: 1680615 - RNA, 19 nt, Human
acucuuauaucuauauuuu

SEQ ID NO: 1680616 - RNA, 15 nt, Human
acucuugaccucagg

SEQ ID NO: 1680617 - RNA, 16 nt, Human
acucuugaccucaggu

SEQ ID NO: 1680618 - RNA, 16 nt, Human
acucuuauaucuauau

SEQ ID NO: 1680619 - RNA, 17 nt, Human
acucuuauaucuauauu

SEQ ID NO: 1680620 - RNA, 18 nt, Human
acucuuauaucuauauuu

SEQ ID NO: 1680621 - RNA, 22 nt, Human
acucuuauaucuauauuuuaca

SEQ ID NO: 1680622 - RNA, 14 nt, Human
acucuugaccucag

SEQ ID NO: 1680623 - RNA, 21 nt, Human
acucuuaagaagacugcauua

SEQ ID NO: 1680624 - RNA, 20 nt, Human
acugaacucugacaacagac

SEQ ID NO: 1680625 - RNA, 15 nt, Human
acucuuguuuccuua

SEQ ID NO: 1680626 - RNA, 19 nt, Human
acucuuucuauuguuucuu

SEQ ID NO: 1680627 - RNA, 21 nt, Human
uccugaauuuuauuuuuuggg

SEQ ID NO: 1680628 - RNA, 22 nt, Human
uccucuuuggucuacacugugc

SEQ ID NO: 1680629 - RNA, 23 nt, Human
uccucuuuggucuacacugugcu

SEQ ID NO: 1680630 - RNA, 19 nt, Human
uccucuuuccaucuacccu

SEQ ID NO: 1680631 - RNA, 19 nt, Human
uccucuuuggucuacacug

SEQ ID NO: 1680632 - RNA, 21 nt, Human
uccucuuuggucuacacugug

SEQ ID NO: 1680633 - RNA, 11 nt, Human
uccucccuccc

SEQ ID NO: 1680634 - RNA, 14 nt, Human
uccucccucccucu

SEQ ID NO: 1680635 - RNA, 11 nt, Human
uccucuuucca

SEQ ID NO: 1680636 - RNA, 12 nt, Human
uccucuuuccau

SEQ ID NO: 1680637 - RNA, 12 nt, Human
acugaagaagca

SEQ ID NO: 1680638 - RNA, 13 nt, Human
acugacucuuaag

SEQ ID NO: 1680639 - RNA, 14 nt, Human
acugacucuuaaga

SEQ ID NO: 1680640 - RNA, 15 nt, Human
acugacucuuaagaa

SEQ ID NO: 1680641 - RNA, 16 nt, Human
acugacucuuaagaag

SEQ ID NO: 1680642 - RNA, 17 nt, Human
acugacucuuaagaaga

SEQ ID NO: 1680643 - RNA, 18 nt, Human
acugacucuuaagaagac

SEQ ID NO: 1680644 - RNA, 20 nt, Human
acugacucuuaagaagacug

SEQ ID NO: 1680645 - RNA, 13 nt, Human
acugacuucuaag

SEQ ID NO: 1680646 - RNA, 15 nt, Human
acugacuucuaagua

SEQ ID NO: 1680647 - RNA, 16 nt, Human
acugacuucuaaguaa

SEQ ID NO: 1680648 - RNA, 22 nt, Human
acugacuucuaaguaaaaccac

SEQ ID NO: 1680649 - RNA, 12 nt, Human
acugagaaauuu

SEQ ID NO: 1680650 - RNA, 17 nt, Human
acugagaaauuuauaaa

SEQ ID NO: 1680651 - RNA, 21 nt, Human
acugagaaauuuauaaacuuu

SEQ ID NO: 1680652 - RNA, 15 nt, Human
acugagacagcccgg

SEQ ID NO: 1680653 - RNA, 18 nt, Human
acugagacagcccgggcu

SEQ ID NO: 1680654 - RNA, 21 nt, Human
acugagacagcccgggcucug

SEQ ID NO: 1680655 - RNA, 22 nt, Human
acugagacagcccgggcucugc

SEQ ID NO: 1680656 - RNA, 23 nt, Human
acugagacagcccgggcucugcc

SEQ ID NO: 1680657 - RNA, 18 nt, Human
acugagagugaacaaauu

SEQ ID NO: 1680658 - RNA, 22 nt, Human
acugagaugugaacacaucagc

SEQ ID NO: 1680659 - RNA, 17 nt, Human
acugagaugugaacaca

SEQ ID NO: 1680660 - RNA, 14 nt, Human
uccugcacacgcuc

SEQ ID NO: 1680661 - RNA, 21 nt, Human
uccugcacacgcuccuuccuc

SEQ ID NO: 1680662 - RNA, 22 nt, Human
uccugcaaugaagucucugaag

SEQ ID NO: 1680663 - RNA, 22 nt, Human
uccugcacacgcuccuuccucu

SEQ ID NO: 1680664 - RNA, 13 nt, Human
acugcacuguuuu

SEQ ID NO: 1680665 - RNA, 19 nt, Human
uccugaugcuucuucagag

SEQ ID NO: 1680666 - RNA, 20 nt, Human
uccugaugcuucuucagaga

SEQ ID NO: 1680667 - RNA, 21 nt, Human
uccugaugcuucuucagagac

SEQ ID NO: 1680668 - RNA, 21 nt, Human
acugcacuauagccuagguga

SEQ ID NO: 1680669 - RNA, 14 nt, Human
acugcacuccagcc

SEQ ID NO: 1680670 - RNA, 17 nt, Human
acugcacuccagccugg

SEQ ID NO: 1680671 - RNA, 18 nt, Human
acugcacuccagccuggg

SEQ ID NO: 1680672 - RNA, 19 nt, Human
acugcacuccagccugggu

SEQ ID NO: 1680673 - RNA, 20 nt, Human
acugcacuccagccugggug

SEQ ID NO: 1680674 - RNA, 20 nt, Human
acugcaacuuguaaaugugg

SEQ ID NO: 1680675 - RNA, 21 nt, Human
acugauaaagaugagugagca

SEQ ID NO: 1680676 - RNA, 13 nt, Human
acugauaaagaug

SEQ ID NO: 1680677 - RNA, 23 nt, Human
acugcacagugcaucucagccca

SEQ ID NO: 1680678 - RNA, 14 nt, Human
acugcaccgggcca

SEQ ID NO: 1680679 - RNA, 16 nt, Human
acugcaccgggccaca

SEQ ID NO: 1680680 - RNA, 20 nt, Human
acugcacuauagccuaggug

SEQ ID NO: 1680681 - RNA, 13 nt, Human
uccugcugggcag

SEQ ID NO: 1680682 - RNA, 12 nt, Human
uccugcaggcag

SEQ ID NO: 1680683 - RNA, 13 nt, Human
uccugcaggcagc

SEQ ID NO: 1680684 - RNA, 14 nt, Human
uccugcaggcagcc

SEQ ID NO: 1680685 - RNA, 15 nt, Human
uccugcaggcagcca

SEQ ID NO: 1680686 - RNA, 15 nt, Human
uccugggagcuuuug

SEQ ID NO: 1680687 - RNA, 12 nt, Human
uccugggaguga

SEQ ID NO: 1680688 - RNA, 14 nt, Human
uccugggagugagc

SEQ ID NO: 1680689 - RNA, 17 nt, Human
uccugggagugagcugg

SEQ ID NO: 1680690 - RNA, 23 nt, Human
uccuggaagugcuaauuuugaaa

SEQ ID NO: 1680691 - RNA, 22 nt, Human
uccuggaauaucuccgucaacu

SEQ ID NO: 1680692 - RNA, 15 nt, Human
uccuggaaauauuaa

SEQ ID NO: 1680693 - RNA, 16 nt, Human
uccuggaaaucagggu

SEQ ID NO: 1680694 - RNA, 19 nt, Human
acuagacucccaagcugga

SEQ ID NO: 1680695 - RNA, 16 nt, Human
ucccccagccccaucc

SEQ ID NO: 1680696 - RNA, 13 nt, Human
ucccccagcccca

SEQ ID NO: 1680697 - RNA, 15 nt, Human
ucccccagccccauc

SEQ ID NO: 1680698 - RNA, 11 nt, Human
ucccccagccc

SEQ ID NO: 1680699 - RNA, 23 nt, Human
uccccaggaggccagccuugacc

SEQ ID NO: 1680700 - RNA, 20 nt, Human
uccccaggaggccagccuug

SEQ ID NO: 1680701 - RNA, 21 nt, Human
uccccaggaggccagccuuga

SEQ ID NO: 1680702 - RNA, 23 nt, Human
uccccacccugaaagcccugagc

SEQ ID NO: 1680703 - RNA, 15 nt, Human
uccccaccgcagaca

SEQ ID NO: 1680704 - RNA, 16 nt, Human
uccccaccgcagacag

SEQ ID NO: 1680705 - RNA, 18 nt, Human
uccccaggaggccagccu

SEQ ID NO: 1680706 - RNA, 17 nt, Human
acuauguugcccaggca

SEQ ID NO: 1680707 - RNA, 15 nt, Human
acuauguugcccagg

SEQ ID NO: 1680708 - RNA, 16 nt, Human
acuauguugcccaggc

SEQ ID NO: 1680709 - RNA, 22 nt, Human
acuauggcccuggccuagcaua

SEQ ID NO: 1680710 - RNA, 14 nt, Human
acuauguugcccag

SEQ ID NO: 1680711 - RNA, 12 nt, Human
acucaauuuuaa

SEQ ID NO: 1680712 - RNA, 15 nt, Human
acucaauuuuaacaa

SEQ ID NO: 1680713 - RNA, 16 nt, Human
acucaaugcacugaca

SEQ ID NO: 1680714 - RNA, 16 nt, Human
acuaucucauuuccaa

SEQ ID NO: 1680715 - RNA, 17 nt, Human
acuaucucauuuccaag

SEQ ID NO: 1680716 - RNA, 16 nt, Human
acuaucuaaauguuga

SEQ ID NO: 1680717 - RNA, 21 nt, Human
acuaucuaaauguugaaagau

SEQ ID NO: 1680718 - RNA, 15 nt, Human
acuaucucauuucca

SEQ ID NO: 1680719 - RNA, 20 nt, Human
acuauagccuaggugacaga

SEQ ID NO: 1680720 - RNA, 22 nt, Human
acuauagccuaggugacagagu

SEQ ID NO: 1680721 - RNA, 17 nt, Human
acuauauuguuugcuaa

SEQ ID NO: 1680722 - RNA, 22 nt, Human
acuauauuguuugcuaagcauu

SEQ ID NO: 1680723 - RNA, 18 nt, Human
acguggcugcuucaagga

SEQ ID NO: 1680724 - RNA, 19 nt, Human
acguggcugcuucaaggau

SEQ ID NO: 1680725 - RNA, 21 nt, Human
acguggcugcuucaaggaucc

SEQ ID NO: 1680726 - RNA, 15 nt, Human
acguuaccaggcagg

SEQ ID NO: 1680727 - RNA, 13 nt, Human
acguugugcauuu

SEQ ID NO: 1680728 - RNA, 15 nt, Human
acguugugcauuugg

SEQ ID NO: 1680729 - RNA, 14 nt, Human
acguugugcauuug

SEQ ID NO: 1680730 - RNA, 16 nt, Human
acguuucuaaaggcua

SEQ ID NO: 1680731 - RNA, 19 nt, Human
acggugaauggcuuuguau

SEQ ID NO: 1680732 - RNA, 20 nt, Human
acggugaauggcuuuguaua

SEQ ID NO: 1680733 - RNA, 16 nt, Human
acggugaauggcuuug

SEQ ID NO: 1680734 - RNA, 19 nt, Human
uccauccugaggcuccacu

SEQ ID NO: 1680735 - RNA, 12 nt, Human
uccauccugagg

SEQ ID NO: 1680736 - RNA, 15 nt, Human
uccauccugaggcuc

SEQ ID NO: 1680737 - RNA, 16 nt, Human
ucccagauacuugggg

SEQ ID NO: 1680738 - RNA, 18 nt, Human
ucccagauacuugggggg

SEQ ID NO: 1680739 - RNA, 22 nt, Human
acguuucuaaaggcuaccuuug

SEQ ID NO: 1680740 - RNA, 15 nt, Human
acuaaacuuucacac

SEQ ID NO: 1680741 - RNA, 16 nt, Human
acuaaacuuucacacc

SEQ ID NO: 1680742 - RNA, 15 nt, Human
acuaauuuuaaaaug

SEQ ID NO: 1680743 - RNA, 13 nt, Human
acggaugauuucu

SEQ ID NO: 1680744 - RNA, 14 nt, Human
acggaugauuucua

SEQ ID NO: 1680745 - RNA, 12 nt, Human
acggccaggcca

SEQ ID NO: 1680746 - RNA, 13 nt, Human
acggccaggccag

SEQ ID NO: 1680747 - RNA, 16 nt, Human
acggcucacugcagcc

SEQ ID NO: 1680748 - RNA, 17 nt, Human
acggcucacugcagccu

SEQ ID NO: 1680749 - RNA, 18 nt, Human
acggcucacugcagccuc

SEQ ID NO: 1680750 - RNA, 18 nt, Human
acggcuuuuacuuaaacc

SEQ ID NO: 1680751 - RNA, 14 nt, Human
uccaguaucuugaa

SEQ ID NO: 1680752 - RNA, 15 nt, Human
uccaguaucuugaag

SEQ ID NO: 1680753 - RNA, 16 nt, Human
uccaguaucuugaaga

SEQ ID NO: 1680754 - RNA, 18 nt, Human
uccaguaucuugaagacu

SEQ ID NO: 1680755 - RNA, 22 nt, Human
uccagugaggcucugcccuugg

SEQ ID NO: 1680756 - RNA, 23 nt, Human
uccagugaggcucugcccuuggu

SEQ ID NO: 1680757 - RNA, 16 nt, Human
uccagugaggcucugc

SEQ ID NO: 1680758 - RNA, 17 nt, Human
uccagugaggcucugcc

SEQ ID NO: 1680759 - RNA, 15 nt, Human
uccagugaggcucug

SEQ ID NO: 1680760 - RNA, 18 nt, Human
uccagugagacagcucug

SEQ ID NO: 1680761 - RNA, 20 nt, Human
acgcgugcacacaccagagc

SEQ ID NO: 1680762 - RNA, 21 nt, Human
acgcuacccgggaagggggcu

SEQ ID NO: 1680763 - RNA, 21 nt, Human
acgaauauugcugauggugca

SEQ ID NO: 1680764 - RNA, 23 nt, Human
acggagucccaccuuggcugcag

SEQ ID NO: 1680765 - RNA, 17 nt, Human
acgcuggagugcaguga

SEQ ID NO: 1680766 - RNA, 18 nt, Human
acgcuggagugcagugag

SEQ ID NO: 1680767 - RNA, 20 nt, Human
acgcuggaccuugaacuggg

SEQ ID NO: 1680768 - RNA, 23 nt, Human
acgcuggaccuugaacuggguac

SEQ ID NO: 1680769 - RNA, 15 nt, Human
acgcuggagugcagu

SEQ ID NO: 1680770 - RNA, 16 nt, Human
acgcuggagugcagug

SEQ ID NO: 1680771 - RNA, 14 nt, Human
acgcuccuuccucu

SEQ ID NO: 1680772 - RNA, 15 nt, Human
acgcuccuuccucug

SEQ ID NO: 1680773 - RNA, 13 nt, Human
acgcuggaccuug

SEQ ID NO: 1680774 - RNA, 11 nt, Human
acgcucucugg

SEQ ID NO: 1680775 - RNA, 14 nt, Human
acgcucucuggccu

SEQ ID NO: 1680776 - RNA, 20 nt, Human
uccagccugcugccugcuuu

SEQ ID NO: 1680777 - RNA, 11 nt, Human
uccagccuggg

SEQ ID NO: 1680778 - RNA, 13 nt, Human
uccagaccccugg

SEQ ID NO: 1680779 - RNA, 16 nt, Human
uccagaauuucccaaa

SEQ ID NO: 1680780 - RNA, 14 nt, Human
uccagaauuuccca

SEQ ID NO: 1680781 - RNA, 15 nt, Human
uccagaauuucccaa

SEQ ID NO: 1680782 - RNA, 14 nt, Human
uccaggcuguaucc

SEQ ID NO: 1680783 - RNA, 23 nt, Human
uccaggcugggagagccuuccag

SEQ ID NO: 1680784 - RNA, 15 nt, Human
acgaauauugcugau

SEQ ID NO: 1680785 - RNA, 18 nt, Human
acgaauauugcugauggu

SEQ ID NO: 1680786 - RNA, 10 nt, Human
uccaggcucc

SEQ ID NO: 1680787 - RNA, 12 nt, Human
uccaggcuccuu

SEQ ID NO: 1680788 - RNA, 22 nt, Human
uccaggcuccuuuagcgcccag

SEQ ID NO: 1680789 - RNA, 20 nt, Human
uccaggcugggagagccuuc

SEQ ID NO: 1680790 - RNA, 21 nt, Human
uccaggcugggagagccuucc

SEQ ID NO: 1680791 - RNA, 13 nt, Human
accuuuuuuauac

SEQ ID NO: 1680792 - RNA, 20 nt, Human
accuuuuggucuggagggaa

SEQ ID NO: 1680793 - RNA, 18 nt, Human
uccagaauggucuuucua

SEQ ID NO: 1680794 - RNA, 21 nt, Human
uccacugugccaugugccagg

SEQ ID NO: 1680795 - RNA, 22 nt, Human
uccacugguucuucuuggucuc

SEQ ID NO: 1680796 - RNA, 20 nt, Human
accuugaacuggguacuugu

SEQ ID NO: 1680797 - RNA, 19 nt, Human
accuugaaaacuuuaugcu

SEQ ID NO: 1680798 - RNA, 17 nt, Human
accuuugacaaagguaa

SEQ ID NO: 1680799 - RNA, 18 nt, Human
accuuugacaaagguaaa

SEQ ID NO: 1680800 - RNA, 17 nt, Human
accuuuguccccaccgc

SEQ ID NO: 1680801 - RNA, 22 nt, Human
accuuuguuugcaucugaaaau

SEQ ID NO: 1680802 - RNA, 18 nt, Human
accuuuguccccaccgca

SEQ ID NO: 1680803 - RNA, 16 nt, Human
accgagucucuucucc

SEQ ID NO: 1680804 - RNA, 17 nt, Human
accgagucucuucucca

SEQ ID NO: 1680805 - RNA, 15 nt, Human
ucauauuuucaugcu

SEQ ID NO: 1680806 - RNA, 16 nt, Human
ucauauuuacuucuua

SEQ ID NO: 1680807 - RNA, 15 nt, Human
ucauauuuacuucuu

SEQ ID NO: 1680808 - RNA, 23 nt, Human
ucauauuuacuucuuauacauuu

SEQ ID NO: 1680809 - RNA, 21 nt, Human
ucauaguaugguggcuggguu

SEQ ID NO: 1680810 - RNA, 18 nt, Human
ucauauaagauucauauu

SEQ ID NO: 1680811 - RNA, 14 nt, Human
ucauaaccuagccu

SEQ ID NO: 1680812 - RNA, 15 nt, Human
ucauaguaugguggc

SEQ ID NO: 1680813 - RNA, 18 nt, Human
ucauaguaugguggcugg

SEQ ID NO: 1680814 - RNA, 19 nt, Human
ucauaguaugguggcuggg

SEQ ID NO: 1680815 - RNA, 12 nt, Human
ucagugccacua

SEQ ID NO: 1680816 - RNA, 17 nt, Human
accgaaaacguggcugc

SEQ ID NO: 1680817 - RNA, 19 nt, Human
accgaaaacguggcugcuu

SEQ ID NO: 1680818 - RNA, 20 nt, Human
ucagugcccuccaggauaga

SEQ ID NO: 1680819 - RNA, 9 nt, Human
ucagugccu

SEQ ID NO: 1680820 - RNA, 10 nt, Human
ucagugccuu

SEQ ID NO: 1680821 - RNA, 11 nt, Human
ucagugccuua

SEQ ID NO: 1680822 - RNA, 12 nt, Human
ucagugccuuau

SEQ ID NO: 1680823 - RNA, 14 nt, Human
ucagugccuuaugg

SEQ ID NO: 1680824 - RNA, 15 nt, Human
ucagugccuuaugga

SEQ ID NO: 1680825 - RNA, 16 nt, Human
ucaguggggaggggcu

SEQ ID NO: 1680826 - RNA, 12 nt, Human
ucaguggcagcu

SEQ ID NO: 1680827 - RNA, 13 nt, Human
ucaguggcagcug

SEQ ID NO: 1680828 - RNA, 16 nt, Human
ucagugccuuauggaa

SEQ ID NO: 1680829 - RNA, 18 nt, Human
ucagugccuuauggaaca

SEQ ID NO: 1680830 - RNA, 11 nt, Human
ucaguggcagc

SEQ ID NO: 1680831 - RNA, 20 nt, Human
ucaguggggcccauggaugu

SEQ ID NO: 1680832 - RNA, 15 nt, Human
ucaguuuuugugaaa

SEQ ID NO: 1680833 - RNA, 17 nt, Human
ucaguuuuugugaaaag

SEQ ID NO: 1680834 - RNA, 17 nt, Human
ucaugugaaaucauuca

SEQ ID NO: 1680835 - RNA, 16 nt, Human
ucaugugaaaucauuc

SEQ ID NO: 1680836 - RNA, 23 nt, Human
ucaugcaaacuuuauuuuguguu

SEQ ID NO: 1680837 - RNA, 13 nt, Human
ucauccauccagg

SEQ ID NO: 1680838 - RNA, 13 nt, Human
ucaucuaggauuu

SEQ ID NO: 1680839 - RNA, 11 nt, Human
ucaugauuuuu

SEQ ID NO: 1680840 - RNA, 14 nt, Human
ucaugcaaacuuua

SEQ ID NO: 1680841 - RNA, 16 nt, Human
ucaugaaagauucaau

SEQ ID NO: 1680842 - RNA, 17 nt, Human
ucaugaaagauucaaug

SEQ ID NO: 1680843 - RNA, 20 nt, Human
accucccacaaaggagagcu

SEQ ID NO: 1680844 - RNA, 17 nt, Human
accgcagacaggaccag

SEQ ID NO: 1680845 - RNA, 12 nt, Human
accgcagacagg

SEQ ID NO: 1680846 - RNA, 16 nt, Human
accgcagacaggacca

SEQ ID NO: 1680847 - RNA, 16 nt, Human
accuagggugauauua

SEQ ID NO: 1680848 - RNA, 16 nt, Human
acccugaaagcccuga

SEQ ID NO: 1680849 - RNA, 18 nt, Human
acccugaaagcccugagc

SEQ ID NO: 1680850 - RNA, 14 nt, Human
acccugaggcccag

SEQ ID NO: 1680851 - RNA, 15 nt, Human
accgaaaacguggcu

SEQ ID NO: 1680852 - RNA, 17 nt, Human
acccuugccgucuaccu

SEQ ID NO: 1680853 - RNA, 23 nt, Human
acccuuguggucccaccccacac

SEQ ID NO: 1680854 - RNA, 17 nt, Human
acccugcccugugggcc

SEQ ID NO: 1680855 - RNA, 22 nt, Human
acccugcccugugggcccccaa

SEQ ID NO: 1680856 - RNA, 15 nt, Human
acccugaggcccaga

SEQ ID NO: 1680857 - RNA, 16 nt, Human
acccugaggcccagag

SEQ ID NO: 1680858 - RNA, 17 nt, Human
acccugaggcccagagg

SEQ ID NO: 1680859 - RNA, 15 nt, Human
acccugcccuguggg

SEQ ID NO: 1680860 - RNA, 21 nt, Human
ucaggccaggcccucugccca

SEQ ID NO: 1680861 - RNA, 22 nt, Human
ucaggccaggcccucugcccac

SEQ ID NO: 1680862 - RNA, 14 nt, Human
ucagcuccagcuca

SEQ ID NO: 1680863 - RNA, 15 nt, Human
ucagcuccagcucac

SEQ ID NO: 1680864 - RNA, 21 nt, Human
ucagcuuguaaauagcucagg

SEQ ID NO: 1680865 - RNA, 22 nt, Human
ucagcuuguaaauagcucaggu

SEQ ID NO: 1680866 - RNA, 23 nt, Human
ucaggccaggcccucugcccacu

SEQ ID NO: 1680867 - RNA, 19 nt, Human
ucagggucccugguggcag

SEQ ID NO: 1680868 - RNA, 16 nt, Human
ucaggguuggccccug

SEQ ID NO: 1680869 - RNA, 17 nt, Human
ucaggguuggccccugc

SEQ ID NO: 1680870 - RNA, 23 nt, Human
ucagguaacaggcagauacagga

SEQ ID NO: 1680871 - RNA, 21 nt, Human
ucagguaacaggcagauacag

SEQ ID NO: 1680872 - RNA, 22 nt, Human
ucagguaacaggcagauacagg

SEQ ID NO: 1680873 - RNA, 18 nt, Human
acccggaggggccuggca

SEQ ID NO: 1680874 - RNA, 21 nt, Human
acccggaggggccuggcagcc

SEQ ID NO: 1680875 - RNA, 14 nt, Human
acccggccccugcu

SEQ ID NO: 1680876 - RNA, 15 nt, Human
acccggccccugcug

SEQ ID NO: 1680877 - RNA, 16 nt, Human
acccggccccugcugg

SEQ ID NO: 1680878 - RNA, 22 nt, Human
acccggccccugcugguucagg

SEQ ID NO: 1680879 - RNA, 17 nt, Human
acccggccccugcuggu

SEQ ID NO: 1680880 - RNA, 20 nt, Human
acccggccccugcugguuca

SEQ ID NO: 1680881 - RNA, 12 nt, Human
acccgggaaggg

SEQ ID NO: 1680882 - RNA, 13 nt, Human
acccgggaagggg

SEQ ID NO: 1680883 - RNA, 17 nt, Human
acccgggaggcagaggu

SEQ ID NO: 1680884 - RNA, 21 nt, Human
ucagauuugaacucuucaauc

SEQ ID NO: 1680885 - RNA, 12 nt, Human
ucagauuugaac

SEQ ID NO: 1680886 - RNA, 18 nt, Human
accaguguuguggauuua

SEQ ID NO: 1680887 - RNA, 19 nt, Human
accauaaccccggaagcca

SEQ ID NO: 1680888 - RNA, 23 nt, Human
ucagauuuuauuauguaaauccc

SEQ ID NO: 1680889 - RNA, 19 nt, Human
ucagcaaaaauauuuuaug

SEQ ID NO: 1680890 - RNA, 20 nt, Human
ucagcaaaaauauuuuauga

SEQ ID NO: 1680891 - RNA, 15 nt, Human
ucagcaaaagaugcu

SEQ ID NO: 1680892 - RNA, 13 nt, Human
ucagcccucccug

SEQ ID NO: 1680893 - RNA, 14 nt, Human
ucagcccucccugc

SEQ ID NO: 1680894 - RNA, 15 nt, Human
ucagcccucccugcc

SEQ ID NO: 1680895 - RNA, 16 nt, Human
ucagcccucccugccc

SEQ ID NO: 1680896 - RNA, 17 nt, Human
ucagcccucccugcccc

SEQ ID NO: 1680897 - RNA, 19 nt, Human
acccaggagccccgaggcc

SEQ ID NO: 1680898 - RNA, 23 nt, Human
acccaggagccccgaggccuucu

SEQ ID NO: 1680899 - RNA, 17 nt, Human
accccacacacgccaga

SEQ ID NO: 1680900 - RNA, 13 nt, Human
accccagccccaa

SEQ ID NO: 1680901 - RNA, 22 nt, Human
accccagccccaaaacucuccu

SEQ ID NO: 1680902 - RNA, 18 nt, Human
accccuggcuuuucacug

SEQ ID NO: 1680903 - RNA, 19 nt, Human
accccuggcuuuucacugc

SEQ ID NO: 1680904 - RNA, 20 nt, Human
accccuggcuuuucacugcu

SEQ ID NO: 1680905 - RNA, 21 nt, Human
accccuggcuuuucacugcug

SEQ ID NO: 1680906 - RNA, 12 nt, Human
ucagcuccagcu

SEQ ID NO: 1680907 - RNA, 19 nt, Human
ucagcggggacagcuccuu

SEQ ID NO: 1680908 - RNA, 20 nt, Human
ucagcggggacagcuccuuc

SEQ ID NO: 1680909 - RNA, 21 nt, Human
ucagcggggacagcuccuucu

SEQ ID NO: 1680910 - RNA, 23 nt, Human
ucagcggggacagcuccuucugu

SEQ ID NO: 1680911 - RNA, 18 nt, Human
accccaucucuacaaaaa

SEQ ID NO: 1680912 - RNA, 15 nt, Human
accccugagcuugca

SEQ ID NO: 1680913 - RNA, 13 nt, Human
ucaaauuucuaaa

SEQ ID NO: 1680914 - RNA, 14 nt, Human
ucaaauuucuaaau

SEQ ID NO: 1680915 - RNA, 20 nt, Human
ucaacugcaucaagauguga

SEQ ID NO: 1680916 - RNA, 18 nt, Human
ucaacugggcugaacacu

SEQ ID NO: 1680917 - RNA, 15 nt, Human
ucaaccauuccccau

SEQ ID NO: 1680918 - RNA, 18 nt, Human
ucaaccauuccccauggg

SEQ ID NO: 1680919 - RNA, 14 nt, Human
ucaaccagcagaug

SEQ ID NO: 1680920 - RNA, 17 nt, Human
ucaaccaccuuucagau

SEQ ID NO: 1680921 - RNA, 19 nt, Human
acauguccaagaagcccag

SEQ ID NO: 1680922 - RNA, 15 nt, Human
acauguccaagaagc

SEQ ID NO: 1680923 - RNA, 23 nt, Human
acauguaauuaaguacuauguau

SEQ ID NO: 1680924 - RNA, 19 nt, Human
acauguauuuguuugcaua

SEQ ID NO: 1680925 - RNA, 17 nt, Human
acauguauuuguuugca

SEQ ID NO: 1680926 - RNA, 18 nt, Human
acauguauuuguuugcau

SEQ ID NO: 1680927 - RNA, 14 nt, Human
acauuccugaacag

SEQ ID NO: 1680928 - RNA, 15 nt, Human
acauuccugaacagg

SEQ ID NO: 1680929 - RNA, 14 nt, Human
acauuccugaugcu

SEQ ID NO: 1680930 - RNA, 18 nt, Human
ucaaauugugugaaaggu

SEQ ID NO: 1680931 - RNA, 15 nt, Human
acauguaauuaagua

SEQ ID NO: 1680932 - RNA, 17 nt, Human
acauguaauuaaguacu

SEQ ID NO: 1680933 - RNA, 19 nt, Human
acauguaauuaaguacuau

SEQ ID NO: 1680934 - RNA, 21 nt, Human
acauguaauuaaguacuaugu

SEQ ID NO: 1680935 - RNA, 22 nt, Human
acauguaauuaaguacuaugua

SEQ ID NO: 1680936 - RNA, 15 nt, Human
acaugggacauuugc

SEQ ID NO: 1680937 - RNA, 20 nt, Human
acaugggacauuugcucaug

SEQ ID NO: 1680938 - RNA, 21 nt, Human
acaugggacauuugcucaugg

SEQ ID NO: 1680939 - RNA, 14 nt, Human
acauggaaguacua

SEQ ID NO: 1680940 - RNA, 11 nt, Human
acaugggacau

SEQ ID NO: 1680941 - RNA, 14 nt, Human
acaugggacauuug

SEQ ID NO: 1680942 - RNA, 22 nt, Human
acaugcuacacacugcauguuu

SEQ ID NO: 1680943 - RNA, 21 nt, Human
acaugcuacacacugcauguu

SEQ ID NO: 1680944 - RNA, 15 nt, Human
acaugcuacacacug

SEQ ID NO: 1680945 - RNA, 23 nt, Human
acaugagguacugagagugaaca

SEQ ID NO: 1680946 - RNA, 20 nt, Human
acaugaauauuuaguguuca

SEQ ID NO: 1680947 - RNA, 12 nt, Human
acagucccugcc

SEQ ID NO: 1680948 - RNA, 20 nt, Human
acaugagguacugagaguga

SEQ ID NO: 1680949 - RNA, 21 nt, Human
acauuuuuuaaaugcaccugg

SEQ ID NO: 1680950 - RNA, 17 nt, Human
acauuuuuuaaaugcac

SEQ ID NO: 1680951 - RNA, 16 nt, Human
acauuuuuuaaaugca

SEQ ID NO: 1680952 - RNA, 14 nt, Human
acauuuuuuaaaug

SEQ ID NO: 1680953 - RNA, 23 nt, Human
acauuuuuaagugcugcauuuaa

SEQ ID NO: 1680954 - RNA, 22 nt, Human
acauuuuuaagugcugcauuua

SEQ ID NO: 1680955 - RNA, 21 nt, Human
acauuuuuaagugcugcauuu

SEQ ID NO: 1680956 - RNA, 20 nt, Human
acauuuuauuuuauuaugca

SEQ ID NO: 1680957 - RNA, 19 nt, Human
acauuuuauuuuauuaugc

SEQ ID NO: 1680958 - RNA, 14 nt, Human
acauuuuauuuuau

SEQ ID NO: 1680959 - RNA, 18 nt, Human
acauuuuauuuuauuaug

SEQ ID NO: 1680960 - RNA, 22 nt, Human
ucaauaucuuuuuuuuaauaaa

SEQ ID NO: 1680961 - RNA, 12 nt, Human
ucaacugggcug

SEQ ID NO: 1680962 - RNA, 15 nt, Human
ucaauauuucagaua

SEQ ID NO: 1680963 - RNA, 19 nt, Human
ucaauauuucagauaauca

SEQ ID NO: 1680964 - RNA, 23 nt, Human
ucaaugaaugaaugaauggcuaa

SEQ ID NO: 1680965 - RNA, 22 nt, Human
accagcgugugacuacuccccc

SEQ ID NO: 1680966 - RNA, 16 nt, Human
accacuacauucuguu

SEQ ID NO: 1680967 - RNA, 17 nt, Human
accacuacauucuguua

SEQ ID NO: 1680968 - RNA, 16 nt, Human
ucacuaggcuucuggu

SEQ ID NO: 1680969 - RNA, 19 nt, Human
ucaccugucuugccuuuuu

SEQ ID NO: 1680970 - RNA, 20 nt, Human
ucaccugucuugccuuuuuc

SEQ ID NO: 1680971 - RNA, 12 nt, Human
ucaccucaugga

SEQ ID NO: 1680972 - RNA, 13 nt, Human
ucaccucauggaa

SEQ ID NO: 1680973 - RNA, 14 nt, Human
ucaccucauggaau

SEQ ID NO: 1680974 - RNA, 23 nt, Human
ucacuguugcccaggcuggcgug

SEQ ID NO: 1680975 - RNA, 13 nt, Human
ucacugcauccuc

SEQ ID NO: 1680976 - RNA, 15 nt, Human
ucacugcagccucaa

SEQ ID NO: 1680977 - RNA, 19 nt, Human
ucacuaucccggcugcccu

SEQ ID NO: 1680978 - RNA, 20 nt, Human
ucacuaucccggcugcccuu

SEQ ID NO: 1680979 - RNA, 17 nt, Human
ucacuauguugcccagg

SEQ ID NO: 1680980 - RNA, 16 nt, Human
ucacugagacagcccg

SEQ ID NO: 1680981 - RNA, 17 nt, Human
ucacugagacagcccgg

SEQ ID NO: 1680982 - RNA, 21 nt, Human
ucacugagacagcccgggcuc

SEQ ID NO: 1680983 - RNA, 22 nt, Human
ucacugagacagcccgggcucu

SEQ ID NO: 1680984 - RNA, 14 nt, Human
ucacugcagccuca

SEQ ID NO: 1680985 - RNA, 17 nt, Human
accaguguuguggauuu

SEQ ID NO: 1680986 - RNA, 15 nt, Human
accaguguuguggau

SEQ ID NO: 1680987 - RNA, 23 nt, Human
accaguauuguacaaaguauuaa

SEQ ID NO: 1680988 - RNA, 14 nt, Human
accagucugacugu

SEQ ID NO: 1680989 - RNA, 14 nt, Human
accaguauuguaca

SEQ ID NO: 1680990 - RNA, 15 nt, Human
accaguauuguacaa

SEQ ID NO: 1680991 - RNA, 20 nt, Human
accaguauuguacaaaguau

SEQ ID NO: 1680992 - RNA, 22 nt, Human
accaguauuguacaaaguauua

SEQ ID NO: 1680993 - RNA, 10 nt, Human
ucacuugagu

SEQ ID NO: 1680994 - RNA, 23 nt, Human
ucacuugaacccgggaggcagag

SEQ ID NO: 1680995 - RNA, 14 nt, Human
ucacaaccuucugu

SEQ ID NO: 1680996 - RNA, 20 nt, Human
ucacagaugggugcuuggag

SEQ ID NO: 1680997 - RNA, 23 nt, Human
ucacagaugugugauucacagug

SEQ ID NO: 1680998 - RNA, 21 nt, Human
ucacagaugugugauucacag

SEQ ID NO: 1680999 - RNA, 13 nt, Human
ucacagccucuga

SEQ ID NO: 1681000 - RNA, 16 nt, Human
ucacaguucucuccuu

SEQ ID NO: 1681001 - RNA, 20 nt, Human
ucacaguucucuccuucuuc

SEQ ID NO: 1681002 - RNA, 17 nt, Human
ucacaaaggaugcccaa

SEQ ID NO: 1681003 - RNA, 16 nt, Human
ucaauucuugccaaau

SEQ ID NO: 1681004 - RNA, 15 nt, Human
accaccacacccagc

SEQ ID NO: 1681005 - RNA, 20 nt, Human
accaccacacccagcccacu

SEQ ID NO: 1681006 - RNA, 24 nt, Human
accacauuggagauguuuaguaau

SEQ ID NO: 1681007 - RNA, 18 nt, Human
accacaugugcacaugca

SEQ ID NO: 1681008 - RNA, 17 nt, Human
accacaucuugcucugc

SEQ ID NO: 1681009 - RNA, 18 nt, Human
accacaucuugcucugcu

SEQ ID NO: 1681010 - RNA, 19 nt, Human
accacaucuugcucugcug

SEQ ID NO: 1681011 - RNA, 22 nt, Human
ucaccauguuggccaggcuggu

SEQ ID NO: 1681012 - RNA, 20 nt, Human
ucacaguuuugguugcuuua

SEQ ID NO: 1681013 - RNA, 21 nt, Human
ucacaguuuugguugcuuuaa

SEQ ID NO: 1681014 - RNA, 23 nt, Human
ucacaguuuugguugcuuuaaua

SEQ ID NO: 1681015 - RNA, 21 nt, Human
uaagauuccagagaguggcuc

SEQ ID NO: 1681016 - RNA, 14 nt, Human
uaagauuccagaga

SEQ ID NO: 1681017 - RNA, 22 nt, Human
aaucaggguuaguauuguccag

SEQ ID NO: 1681018 - RNA, 16 nt, Human
aaucaggguuaguauu

SEQ ID NO: 1681019 - RNA, 21 nt, Human
aaucaggguuaguauugucca

SEQ ID NO: 1681020 - RNA, 18 nt, Human
uaagcacacuugacauca

SEQ ID NO: 1681021 - RNA, 22 nt, Human
uaagcuguuacugucuucagua

SEQ ID NO: 1681022 - RNA, 15 nt, Human
uaagagaaaugagcu

SEQ ID NO: 1681023 - RNA, 17 nt, Human
aauaugcacacauuuuu

SEQ ID NO: 1681024 - RNA, 16 nt, Human
aauaugcacacauuuu

SEQ ID NO: 1681025 - RNA, 22 nt, Human
aauaugcacacauuuuuuaaau

SEQ ID NO: 1681026 - RNA, 15 nt, Human
aauauuccugcauuu

SEQ ID NO: 1681027 - RNA, 21 nt, Human
aauaugccccauucaacaucu

SEQ ID NO: 1681028 - RNA, 24 nt, Human
aauaugccccauucaacaucuagu

SEQ ID NO: 1681029 - RNA, 12 nt, Human
aauauuuagugu

SEQ ID NO: 1681030 - RNA, 18 nt, Human
aauauuuauuuuaauaau

SEQ ID NO: 1681031 - RNA, 19 nt, Human
aauauuuauuuuaauaaug

SEQ ID NO: 1681032 - RNA, 14 nt, Human
aauauuucagauaa

SEQ ID NO: 1681033 - RNA, 17 nt, Human
aauauugauaugcuuau

SEQ ID NO: 1681034 - RNA, 14 nt, Human
uaacuucaccauau

SEQ ID NO: 1681035 - RNA, 17 nt, Human
uaacuuccaauuuacau

SEQ ID NO: 1681036 - RNA, 21 nt, Human
uaacuucacauauugauuucc

SEQ ID NO: 1681037 - RNA, 20 nt, Human
uaacgauaaaagacagugaa

SEQ ID NO: 1681038 - RNA, 16 nt, Human
uaacuuucugaaauaa

SEQ ID NO: 1681039 - RNA, 18 nt, Human
uaagaagugaaaaucuac

SEQ ID NO: 1681040 - RNA, 12 nt, Human
uaacauaaaucu

SEQ ID NO: 1681041 - RNA, 14 nt, Human
uaacauaaaucugu

SEQ ID NO: 1681042 - RNA, 18 nt, Human
uaacauggacaugaucuu

SEQ ID NO: 1681043 - RNA, 23 nt, Human
uaacauggacaugaucuucuuua

SEQ ID NO: 1681044 - RNA, 17 nt, Human
uaacauguaauuaagua

SEQ ID NO: 1681045 - RNA, 22 nt, Human
aauaucacuugucaauaaaauc

SEQ ID NO: 1681046 - RNA, 18 nt, Human
aauauauuuuaagacgaa

SEQ ID NO: 1681047 - RNA, 20 nt, Human
aauaucacuugucaauaaaa

SEQ ID NO: 1681048 - RNA, 16 nt, Human
aauaucaucaguauug

SEQ ID NO: 1681049 - RNA, 14 nt, Human
aauaguuguugauu

SEQ ID NO: 1681050 - RNA, 14 nt, Human
aauauauuuuaaga

SEQ ID NO: 1681051 - RNA, 15 nt, Human
aauauauuuuaagac

SEQ ID NO: 1681052 - RNA, 13 nt, Human
aauaguuggcuag

SEQ ID NO: 1681053 - RNA, 22 nt, Human
aauaguggugugauuuggggau

SEQ ID NO: 1681054 - RNA, 16 nt, Human
aauaguggugugauuu

SEQ ID NO: 1681055 - RNA, 16 nt, Human
aauagucaaauugugu

SEQ ID NO: 1681056 - RNA, 11 nt, Human
aauccuggcug

SEQ ID NO: 1681057 - RNA, 15 nt, Human
aaucgaccugccucg

SEQ ID NO: 1681058 - RNA, 12 nt, Human
aauccgcccauc

SEQ ID NO: 1681059 - RNA, 23 nt, Human
aaucauuaggugugacugaauuu

SEQ ID NO: 1681060 - RNA, 17 nt, Human
aaucauuaggugugacu

SEQ ID NO: 1681061 - RNA, 15 nt, Human
aaucauuagguguga

SEQ ID NO: 1681062 - RNA, 19 nt, Human
aaucuuauaauuuaaaaua

SEQ ID NO: 1681063 - RNA, 20 nt, Human
aaucugugaacuugaaauuu

SEQ ID NO: 1681064 - RNA, 21 nt, Human
aaucugugaacuugaaauuug

SEQ ID NO: 1681065 - RNA, 22 nt, Human
aaucugugaacuugaaauuuga

SEQ ID NO: 1681066 - RNA, 16 nt, Human
aaucugggccagaauu

SEQ ID NO: 1681067 - RNA, 17 nt, Human
aaucugggccagaauuu

SEQ ID NO: 1681068 - RNA, 19 nt, Human
aaucuacacuccagugaga

SEQ ID NO: 1681069 - RNA, 12 nt, Human
uaauaaacacuc

SEQ ID NO: 1681070 - RNA, 18 nt, Human
uaauaaacacucuugaaa

SEQ ID NO: 1681071 - RNA, 12 nt, Human
aaucaugaauua

SEQ ID NO: 1681072 - RNA, 15 nt, Human
aaucaugaauuaguu

SEQ ID NO: 1681073 - RNA, 13 nt, Human
uaaguacuaugua

SEQ ID NO: 1681074 - RNA, 16 nt, Human
uaaguacuauguauca

SEQ ID NO: 1681075 - RNA, 17 nt, Human
uaaguacuauguaucaa

SEQ ID NO: 1681076 - RNA, 19 nt, Human
uaaguacuauguaucaaug

SEQ ID NO: 1681077 - RNA, 21 nt, Human
uaaguauucuuauuuaaugaa

SEQ ID NO: 1681078 - RNA, 20 nt, Human
uaaguauucuuauuuaauga

SEQ ID NO: 1681079 - RNA, 19 nt, Human
uaaguauucuuauuuaaug

SEQ ID NO: 1681080 - RNA, 16 nt, Human
uaagcuuguauuccuu

SEQ ID NO: 1681081 - RNA, 19 nt, Human
uaaguaaugauaacuggaa

SEQ ID NO: 1681082 - RNA, 16 nt, Human
uaaggaaaaguuuaau

SEQ ID NO: 1681083 - RNA, 17 nt, Human
uaaugaaugaaacauuu

SEQ ID NO: 1681084 - RNA, 16 nt, Human
uaaucacuuuuuucca

SEQ ID NO: 1681085 - RNA, 17 nt, Human
uaaucacuuuuuuccac

SEQ ID NO: 1681086 - RNA, 19 nt, Human
uaaucacuuuuuuccacau

SEQ ID NO: 1681087 - RNA, 18 nt, Human
uaaucacuuuuuuccaca

SEQ ID NO: 1681088 - RNA, 16 nt, Human
uaauagacaauuuauu

SEQ ID NO: 1681089 - RNA, 21 nt, Human
uaauacaccacuacauucugu

SEQ ID NO: 1681090 - RNA, 14 nt, Human
uaauagacaauuua

SEQ ID NO: 1681091 - RNA, 19 nt, Human
uaauacaccacuacauucu

SEQ ID NO: 1681092 - RNA, 18 nt, Human
uaauacaccacuacauuc

SEQ ID NO: 1681093 - RNA, 16 nt, Human
uaauacaccacuacau

SEQ ID NO: 1681094 - RNA, 22 nt, Human
uaauagacaauuuauuauggca

SEQ ID NO: 1681095 - RNA, 18 nt, Human
uaauagacaauuuauuau

SEQ ID NO: 1681096 - RNA, 15 nt, Human
aaucuuuaauuuuac

SEQ ID NO: 1681097 - RNA, 16 nt, Human
aaucuuuaauuuuaca

SEQ ID NO: 1681098 - RNA, 15 nt, Human
uaaugaaugcauaaa

SEQ ID NO: 1681099 - RNA, 13 nt, Human
uaauguacugcau

SEQ ID NO: 1681100 - RNA, 18 nt, Human
uaaugucacaggcagguc

SEQ ID NO: 1681101 - RNA, 22 nt, Human
aaugaaugucagugugacugau

SEQ ID NO: 1681102 - RNA, 13 nt, Human
aaugaaugucagu

SEQ ID NO: 1681103 - RNA, 17 nt, Human
aaugaaugcauaaaaug

SEQ ID NO: 1681104 - RNA, 22 nt, Human
aaugaauggcuaagcaaaaugu

SEQ ID NO: 1681105 - RNA, 16 nt, Human
aaugaaagacuguaca

SEQ ID NO: 1681106 - RNA, 17 nt, Human
aaugaaagacuguacaa

SEQ ID NO: 1681107 - RNA, 17 nt, Human
aaugaaaccugugucuc

SEQ ID NO: 1681108 - RNA, 17 nt, Human
aaugaaacauuuuguca

SEQ ID NO: 1681109 - RNA, 16 nt, Human
aauuauuauuuggccc

SEQ ID NO: 1681110 - RNA, 14 nt, Human
aauuccccacccug

SEQ ID NO: 1681111 - RNA, 12 nt, Human
aauuccccagau

SEQ ID NO: 1681112 - RNA, 22 nt, Human
aauuccacuuauaggaauugac

SEQ ID NO: 1681113 - RNA, 18 nt, Human
aauuccaagugauugaaa

SEQ ID NO: 1681114 - RNA, 11 nt, Human
aauuacaggaa

SEQ ID NO: 1681115 - RNA, 15 nt, Human
aauuagccaagugug

SEQ ID NO: 1681116 - RNA, 10 nt, Human
uaccuguccc

SEQ ID NO: 1681117 - RNA, 13 nt, Human
uaccugucccccu

SEQ ID NO: 1681118 - RNA, 14 nt, Human
uaccugucccccug

SEQ ID NO: 1681119 - RNA, 16 nt, Human
uaccugucccccugac

SEQ ID NO: 1681120 - RNA, 17 nt, Human
uaccugucccccugaca

SEQ ID NO: 1681121 - RNA, 23 nt, Human
uaccugccaggaagccagcaggc

SEQ ID NO: 1681122 - RNA, 18 nt, Human
uaccugccaggaagccag

SEQ ID NO: 1681123 - RNA, 20 nt, Human
uaccugccaggaagccagca

SEQ ID NO: 1681124 - RNA, 20 nt, Human
uacuaucaugucaaacguga

SEQ ID NO: 1681125 - RNA, 19 nt, Human
uacuauauaugugaugauc

SEQ ID NO: 1681126 - RNA, 17 nt, Human
uacuacuccuguaggaa

SEQ ID NO: 1681127 - RNA, 23 nt, Human
uacuauggcccuggccuagcaua

SEQ ID NO: 1681128 - RNA, 12 nt, Human
uacuauguauca

SEQ ID NO: 1681129 - RNA, 13 nt, Human
uacuauguaucaa

SEQ ID NO: 1681130 - RNA, 14 nt, Human
uacuauguaucaau

SEQ ID NO: 1681131 - RNA, 22 nt, Human
uacucuccuggaaauauuaaga

SEQ ID NO: 1681132 - RNA, 23 nt, Human
uacucuccuggaaauauuaagaa

SEQ ID NO: 1681133 - RNA, 16 nt, Human
uacguugugcauuugg

SEQ ID NO: 1681134 - RNA, 15 nt, Human
uacguugugcauuug

SEQ ID NO: 1681135 - RNA, 14 nt, Human
uacguacacauuuu

SEQ ID NO: 1681136 - RNA, 13 nt, Human
uacguacacauuu

SEQ ID NO: 1681137 - RNA, 12 nt, Human
uacguacacauu

SEQ ID NO: 1681138 - RNA, 18 nt, Human
uacgggaggguaaggcug

SEQ ID NO: 1681139 - RNA, 22 nt, Human
uacgccaggggaaaaucagccu

SEQ ID NO: 1681140 - RNA, 19 nt, Human
aauucccuggccuuucaua

SEQ ID NO: 1681141 - RNA, 20 nt, Human
aauucccuggccuuucauau

SEQ ID NO: 1681142 - RNA, 21 nt, Human
uacucugugucagguggggca

SEQ ID NO: 1681143 - RNA, 12 nt, Human
uacucuguguca

SEQ ID NO: 1681144 - RNA, 14 nt, Human
uacuggauuguacu

SEQ ID NO: 1681145 - RNA, 16 nt, Human
uacuggagaaaaugga

SEQ ID NO: 1681146 - RNA, 19 nt, Human
uacuguaaggcaaucaugg

SEQ ID NO: 1681147 - RNA, 18 nt, Human
uacuguaauuugugauac

SEQ ID NO: 1681148 - RNA, 20 nt, Human
uacuguaauuugugauacaa

SEQ ID NO: 1681149 - RNA, 19 nt, Human
uacuguaauuugugauaca

SEQ ID NO: 1681150 - RNA, 18 nt, Human
uacuguaaggcaaucaug

SEQ ID NO: 1681151 - RNA, 14 nt, Human
uacuguaagaaaau

SEQ ID NO: 1681152 - RNA, 22 nt, Human
uacuguacaugaaaacacauuu

SEQ ID NO: 1681153 - RNA, 21 nt, Human
uacuguacaugaaaacacauu

SEQ ID NO: 1681154 - RNA, 23 nt, Human
uacuguaauuugugauacaaugc

SEQ ID NO: 1681155 - RNA, 22 nt, Human
aauugacccacaagaaaugaaa

SEQ ID NO: 1681156 - RNA, 21 nt, Human
aauugacccacaagaaaugaa

SEQ ID NO: 1681157 - RNA, 19 nt, Human
aauugaugggauuugguca

SEQ ID NO: 1681158 - RNA, 12 nt, Human
aauugcauuucc

SEQ ID NO: 1681159 - RNA, 23 nt, Human
aauggcacaaucucggcucacug

SEQ ID NO: 1681160 - RNA, 16 nt, Human
aauggacuguggugac

SEQ ID NO: 1681161 - RNA, 16 nt, Human
aauggcagccuuggca

SEQ ID NO: 1681162 - RNA, 12 nt, Human
aauggcagccuu

SEQ ID NO: 1681163 - RNA, 20 nt, Human
uacagauccccaagccuggc

SEQ ID NO: 1681164 - RNA, 22 nt, Human
uacagacaacaaaccuguuucu

SEQ ID NO: 1681165 - RNA, 19 nt, Human
uacacauuuuauuuuauua

SEQ ID NO: 1681166 - RNA, 22 nt, Human
uacacauuuuauuuuauuaugc

SEQ ID NO: 1681167 - RNA, 21 nt, Human
uacacauuuuauuuuauuaug

SEQ ID NO: 1681168 - RNA, 23 nt, Human
uacacauuuuauuuuauuaugca

SEQ ID NO: 1681169 - RNA, 15 nt, Human
uacacuaaaagguga

SEQ ID NO: 1681170 - RNA, 14 nt, Human
uacacuaagagaga

SEQ ID NO: 1681171 - RNA, 18 nt, Human
uacacuaagagagaauga

SEQ ID NO: 1681172 - RNA, 16 nt, Human
aaugccaucaauaaaa

SEQ ID NO: 1681173 - RNA, 21 nt, Human
aaugccaucaauaaaaaauua

SEQ ID NO: 1681174 - RNA, 23 nt, Human
aaugccaucaauaaaaaauuaug

SEQ ID NO: 1681175 - RNA, 22 nt, Human
aaugcacuuuguucuggcucuu

SEQ ID NO: 1681176 - RNA, 21 nt, Human
uacaaugcugugcccuaaagu

SEQ ID NO: 1681177 - RNA, 18 nt, Human
aaugaccuuucaauagga

SEQ ID NO: 1681178 - RNA, 16 nt, Human
aaugaccuuucaauag

SEQ ID NO: 1681179 - RNA, 17 nt, Human
aaugaccuuucaauagg

SEQ ID NO: 1681180 - RNA, 20 nt, Human
aaugaccuuucaauaggaaa

SEQ ID NO: 1681181 - RNA, 21 nt, Human
aaugcacuuuguucuggcucu

SEQ ID NO: 1681182 - RNA, 16 nt, Human
aaugcuucaucccuuu

SEQ ID NO: 1681183 - RNA, 20 nt, Human
aauggaaaugggcagagcag

SEQ ID NO: 1681184 - RNA, 21 nt, Human
aauggaaaugggcagagcaga

SEQ ID NO: 1681185 - RNA, 14 nt, Human
aauggaaccacucu

SEQ ID NO: 1681186 - RNA, 23 nt, Human
aauggacguguuaugacuccaga

SEQ ID NO: 1681187 - RNA, 20 nt, Human
aauggacuaacuugucuuug

SEQ ID NO: 1681188 - RNA, 13 nt, Human
aaugcccagcccc

SEQ ID NO: 1681189 - RNA, 11 nt, Human
aaugcccagcc

SEQ ID NO: 1681190 - RNA, 12 nt, Human
aaugcccagccc

SEQ ID NO: 1681191 - RNA, 22 nt, Human
aaugcuguauuagucacagaga

SEQ ID NO: 1681192 - RNA, 16 nt, Human
aaugcuguauuuuaaa

SEQ ID NO: 1681193 - RNA, 20 nt, Human
aauuaacauguuaaaccaug

SEQ ID NO: 1681194 - RNA, 19 nt, Human
aauuaacauguuaaaccau

SEQ ID NO: 1681195 - RNA, 11 nt, Human
aauuaacuuuu

SEQ ID NO: 1681196 - RNA, 22 nt, Human
aauuaaucugggccagaauuuc

SEQ ID NO: 1681197 - RNA, 21 nt, Human
aauuaagaaaggauaaaguug

SEQ ID NO: 1681198 - RNA, 15 nt, Human
aauuaagagagucua

SEQ ID NO: 1681199 - RNA, 13 nt, Human
uacauucuguuaa

SEQ ID NO: 1681200 - RNA, 18 nt, Human
uaccaccagucugacugu

SEQ ID NO: 1681201 - RNA, 13 nt, Human
uacauguauuugu

SEQ ID NO: 1681202 - RNA, 19 nt, Human
aauguauguguaaguauuc

SEQ ID NO: 1681203 - RNA, 22 nt, Human
aauguauuacaguggggaauga

SEQ ID NO: 1681204 - RNA, 20 nt, Human
aauguauguguaaguauucu

SEQ ID NO: 1681205 - RNA, 11 nt, Human
aaugugugugu

SEQ ID NO: 1681206 - RNA, 14 nt, Human
aaugugaaacugga

SEQ ID NO: 1681207 - RNA, 19 nt, Human
aaugugaaaagaaaaauga

SEQ ID NO: 1681208 - RNA, 15 nt, Human
aaugugaaacuggau

SEQ ID NO: 1681209 - RNA, 20 nt, Human
uacaucccuuaccugggaaa

SEQ ID NO: 1681210 - RNA, 24 nt, Human
uacauaaugcgugcauaccacuuu

SEQ ID NO: 1681211 - RNA, 23 nt, Human
uacauaaugcgugcauaccacuu

SEQ ID NO: 1681212 - RNA, 16 nt, Human
uacaggugugagucac

SEQ ID NO: 1681213 - RNA, 12 nt, Human
uauucaaaguug

SEQ ID NO: 1681214 - RNA, 13 nt, Human
uauucaaaguugc

SEQ ID NO: 1681215 - RNA, 16 nt, Human
uauucaaaguugccua

SEQ ID NO: 1681216 - RNA, 21 nt, Human
uauucagcucauggacuucug

SEQ ID NO: 1681217 - RNA, 12 nt, Human
acaggcuccugc

SEQ ID NO: 1681218 - RNA, 22 nt, Human
acaggcgugagccaccgugccu

SEQ ID NO: 1681219 - RNA, 14 nt, Human
uauucauaauuauu

SEQ ID NO: 1681220 - RNA, 16 nt, Human
uauucaggaagcucag

SEQ ID NO: 1681221 - RNA, 14 nt, Human
uauucaggaagcuc

SEQ ID NO: 1681222 - RNA, 20 nt, Human
uauucaguaauaacucuacc

SEQ ID NO: 1681223 - RNA, 21 nt, Human
uauuagugaccucagcuuuga

SEQ ID NO: 1681224 - RNA, 23 nt, Human
uauucaaacagucucaggaaauc

SEQ ID NO: 1681225 - RNA, 19 nt, Human
uauuagugaccucagcuuu

SEQ ID NO: 1681226 - RNA, 15 nt, Human
uauucaaacagucuc

SEQ ID NO: 1681227 - RNA, 14 nt, Human
uauuacuucugcua

SEQ ID NO: 1681228 - RNA, 13 nt, Human
uauuacuucugcu

SEQ ID NO: 1681229 - RNA, 14 nt, Human
uauuacuguaagaa

SEQ ID NO: 1681230 - RNA, 12 nt, Human
acagggcacacc

SEQ ID NO: 1681231 - RNA, 20 nt, Human
acagggcacaccgggcacuc

SEQ ID NO: 1681232 - RNA, 13 nt, Human
acaguauaauuaa

SEQ ID NO: 1681233 - RNA, 15 nt, Human
acaguauaauuaaca

SEQ ID NO: 1681234 - RNA, 20 nt, Human
acaguauaauuaacauguua

SEQ ID NO: 1681235 - RNA, 16 nt, Human
acagucaccucaugga

SEQ ID NO: 1681236 - RNA, 17 nt, Human
acagucaccucauggaa

SEQ ID NO: 1681237 - RNA, 18 nt, Human
acagucaccucauggaau

SEQ ID NO: 1681238 - RNA, 13 nt, Human
acaggcuccugcc

SEQ ID NO: 1681239 - RNA, 15 nt, Human
acaggcuccugccac

SEQ ID NO: 1681240 - RNA, 21 nt, Human
acaggcuccugccaccacgcc

SEQ ID NO: 1681241 - RNA, 22 nt, Human
acaggcuccugccaccacgccc

SEQ ID NO: 1681242 - RNA, 12 nt, Human
acaggcugggcu

SEQ ID NO: 1681243 - RNA, 22 nt, Human
acaggcugggcuucaguggcag

SEQ ID NO: 1681244 - RNA, 23 nt, Human
acaggcugggcuucaguggcagc

SEQ ID NO: 1681245 - RNA, 20 nt, Human
acagggaggacgcucucugg

SEQ ID NO: 1681246 - RNA, 21 nt, Human
acagggaggacgcucucuggc

SEQ ID NO: 1681247 - RNA, 14 nt, Human
uaugugugaaguga

SEQ ID NO: 1681248 - RNA, 12 nt, Human
uaugugugaagu

SEQ ID NO: 1681249 - RNA, 16 nt, Human
uauuaaaacucauuuu

SEQ ID NO: 1681250 - RNA, 17 nt, Human
uaugugaaacauguuuc

SEQ ID NO: 1681251 - RNA, 12 nt, Human
uaugugaacagu

SEQ ID NO: 1681252 - RNA, 22 nt, Human
uaugugaacaguuguguuugaa

SEQ ID NO: 1681253 - RNA, 23 nt, Human
uaugugccagauuuaugcauauu

SEQ ID NO: 1681254 - RNA, 20 nt, Human
uauguggaguucaucuugaa

SEQ ID NO: 1681255 - RNA, 14 nt, Human
uaugugaaacaugu

SEQ ID NO: 1681256 - RNA, 22 nt, Human
acaggcauguucucugaggaca

SEQ ID NO: 1681257 - RNA, 15 nt, Human
acaggcauguucucu

SEQ ID NO: 1681258 - RNA, 18 nt, Human
acaggcauguucucugag

SEQ ID NO: 1681259 - RNA, 19 nt, Human
acaggcauguucucugagg

SEQ ID NO: 1681260 - RNA, 20 nt, Human
acaggcauguucucugagga

SEQ ID NO: 1681261 - RNA, 14 nt, Human
acaggcauguucuc

SEQ ID NO: 1681262 - RNA, 14 nt, Human
acaggcagguccag

SEQ ID NO: 1681263 - RNA, 16 nt, Human
acaggcagguccaggg

SEQ ID NO: 1681264 - RNA, 16 nt, Human
acaggagugagcacua

SEQ ID NO: 1681265 - RNA, 14 nt, Human
acaggaucagucug

SEQ ID NO: 1681266 - RNA, 15 nt, Human
acaggaucagucuga

SEQ ID NO: 1681267 - RNA, 14 nt, Human
acaggacucugccu

SEQ ID NO: 1681268 - RNA, 23 nt, Human
acaggaccagggauuuccaugau

SEQ ID NO: 1681269 - RNA, 11 nt, Human
acagccuggca

SEQ ID NO: 1681270 - RNA, 13 nt, Human
acagcuaacaugg

SEQ ID NO: 1681271 - RNA, 15 nt, Human
acaggaaaagcugcu

SEQ ID NO: 1681272 - RNA, 16 nt, Human
acaggaaaagcugcug

SEQ ID NO: 1681273 - RNA, 17 nt, Human
acaggaaaagcugcuga

SEQ ID NO: 1681274 - RNA, 18 nt, Human
acaggaaaagcugcugac

SEQ ID NO: 1681275 - RNA, 13 nt, Human
acaggaaguacug

SEQ ID NO: 1681276 - RNA, 17 nt, Human
acaggaaguagaggagg

SEQ ID NO: 1681277 - RNA, 17 nt, Human
uauaaguguguguuuuu

SEQ ID NO: 1681278 - RNA, 23 nt, Human
uauaaguguguguuuuucauaaa

SEQ ID NO: 1681279 - RNA, 17 nt, Human
acagaaauguacagcaa

SEQ ID NO: 1681280 - RNA, 16 nt, Human
acagaaauguacagca

SEQ ID NO: 1681281 - RNA, 14 nt, Human
acagaaauguacag

SEQ ID NO: 1681282 - RNA, 20 nt, Human
acagaaaauggaagacagcu

SEQ ID NO: 1681283 - RNA, 17 nt, Human
acagaaaauucuucucc

SEQ ID NO: 1681284 - RNA, 18 nt, Human
acagaaaauucuucucca

SEQ ID NO: 1681285 - RNA, 13 nt, Human
acagacccugccc

SEQ ID NO: 1681286 - RNA, 14 nt, Human
acagacccugcccu

SEQ ID NO: 1681287 - RNA, 15 nt, Human
acagacccugcccug

SEQ ID NO: 1681288 - RNA, 20 nt, Human
uauauuuacuaaaauggacu

SEQ ID NO: 1681289 - RNA, 21 nt, Human
uauauuuacuaaaauggacug

SEQ ID NO: 1681290 - RNA, 16 nt, Human
uauauuuaguaucuuu

SEQ ID NO: 1681291 - RNA, 15 nt, Human
uauauuguuugcuaa

SEQ ID NO: 1681292 - RNA, 11 nt, Human
acagagaaagu

SEQ ID NO: 1681293 - RNA, 18 nt, Human
acagagaaaguacuucuc

SEQ ID NO: 1681294 - RNA, 13 nt, Human
uaucucccccagc

SEQ ID NO: 1681295 - RNA, 16 nt, Human
uaucucccccagcccc

SEQ ID NO: 1681296 - RNA, 14 nt, Human
uaucucccccagcc

SEQ ID NO: 1681297 - RNA, 23 nt, Human
uaucuauauuuuacauaaauuua

SEQ ID NO: 1681298 - RNA, 17 nt, Human
uaucucaaaacugcacu

SEQ ID NO: 1681299 - RNA, 18 nt, Human
uaucaaguauuauaccuu

SEQ ID NO: 1681300 - RNA, 17 nt, Human
uauggcuuuugugcauu

SEQ ID NO: 1681301 - RNA, 21 nt, Human
uauggcuuuugugcauuaucu

SEQ ID NO: 1681302 - RNA, 18 nt, Human
uauggcuuuugugcauua

SEQ ID NO: 1681303 - RNA, 15 nt, Human
uaugcuuauacacuu

SEQ ID NO: 1681304 - RNA, 23 nt, Human
uauggcuuuugugcauuaucuag

SEQ ID NO: 1681305 - RNA, 12 nt, Human
acagccuggcac

SEQ ID NO: 1681306 - RNA, 16 nt, Human
acagccucuuagaugc

SEQ ID NO: 1681307 - RNA, 17 nt, Human
uaugccugggcagaagg

SEQ ID NO: 1681308 - RNA, 19 nt, Human
uaugccccauucaacaucu

SEQ ID NO: 1681309 - RNA, 16 nt, Human
uaugauuaaguaauga

SEQ ID NO: 1681310 - RNA, 20 nt, Human
uaugauuaaguaaugauaac

SEQ ID NO: 1681311 - RNA, 24 nt, Human
uaugcauuugaaaauuuugauguu

SEQ ID NO: 1681312 - RNA, 23 nt, Human
uaugcauuugaaaauuuugaugu

SEQ ID NO: 1681313 - RNA, 11 nt, Human
uaugcauuuga

SEQ ID NO: 1681314 - RNA, 21 nt, Human
uaugauuaaguaaugauaacu

SEQ ID NO: 1681315 - RNA, 22 nt, Human
acagaucucugcuuuggaaauc

SEQ ID NO: 1681316 - RNA, 18 nt, Human
acagauccccaagccugg

SEQ ID NO: 1681317 - RNA, 17 nt, Human
acagauccccaagccug

SEQ ID NO: 1681318 - RNA, 15 nt, Human
acagagcccacgccc

SEQ ID NO: 1681319 - RNA, 18 nt, Human
acagagcccacgccccca

SEQ ID NO: 1681320 - RNA, 19 nt, Human
acagagcccacgcccccac

SEQ ID NO: 1681321 - RNA, 14 nt, Human
acagauuugagcuc

SEQ ID NO: 1681322 - RNA, 15 nt, Human
acagauuugagcuca

SEQ ID NO: 1681323 - RNA, 17 nt, Human
acagcaaggagauuuac

SEQ ID NO: 1681324 - RNA, 18 nt, Human
acagcccgggcucugccu

SEQ ID NO: 1681325 - RNA, 19 nt, Human
acagcccgggcucugccuc

SEQ ID NO: 1681326 - RNA, 20 nt, Human
acagcccgggcucugccucc

SEQ ID NO: 1681327 - RNA, 21 nt, Human
acagcaaggagauuuacaacu

SEQ ID NO: 1681328 - RNA, 17 nt, Human
acagcccgggcucugcc

SEQ ID NO: 1681329 - RNA, 18 nt, Human
acagcaagggugauggga

SEQ ID NO: 1681330 - RNA, 18 nt, Human
acagccguuuguucccca

SEQ ID NO: 1681331 - RNA, 19 nt, Human
acacacagcucuguccugg

SEQ ID NO: 1681332 - RNA, 17 nt, Human
acacacagcucuguccu

SEQ ID NO: 1681333 - RNA, 13 nt, Human
acacacagcucug

SEQ ID NO: 1681334 - RNA, 14 nt, Human
acacacagcucugu

SEQ ID NO: 1681335 - RNA, 22 nt, Human
acacacacgcgugcacacacca

SEQ ID NO: 1681336 - RNA, 14 nt, Human
acacaccagagccc

SEQ ID NO: 1681337 - RNA, 15 nt, Human
acacaccagagccca

SEQ ID NO: 1681338 - RNA, 20 nt, Human
acacaccagagcccaccuug

SEQ ID NO: 1681339 - RNA, 21 nt, Human
acacacgcgugcacacaccag

SEQ ID NO: 1681340 - RNA, 21 nt, Human
acacacugcauguuugugauu

SEQ ID NO: 1681341 - RNA, 20 nt, Human
acacacucaaaucaagaaac

SEQ ID NO: 1681342 - RNA, 15 nt, Human
acacacucaaaucaa

SEQ ID NO: 1681343 - RNA, 19 nt, Human
acaaugugaaaagaaaaau

SEQ ID NO: 1681344 - RNA, 17 nt, Human
acaaugugaaaagaaaa

SEQ ID NO: 1681345 - RNA, 19 nt, Human
acaauggauaggcacagga

SEQ ID NO: 1681346 - RNA, 24 nt, Human
acaaugcugugcccuaaaguguau

SEQ ID NO: 1681347 - RNA, 23 nt, Human
acaaugcugugcccuaaagugua

SEQ ID NO: 1681348 - RNA, 22 nt, Human
acaaugcugugcccuaaagugu

SEQ ID NO: 1681349 - RNA, 21 nt, Human
acaaugcugugcccuaaagug

SEQ ID NO: 1681350 - RNA, 22 nt, Human
acaaugcuguauuuuaaaagaa

SEQ ID NO: 1681351 - RNA, 19 nt, Human
acacaguauuacuucugcu

SEQ ID NO: 1681352 - RNA, 22 nt, Human
acacaguauuacuucugcuaca

SEQ ID NO: 1681353 - RNA, 18 nt, Human
acacaguauuacuucugc

SEQ ID NO: 1681354 - RNA, 23 nt, Human
acacacuuuugguuaagucuguu

SEQ ID NO: 1681355 - RNA, 22 nt, Human
uagugaaacucguuaauuugua

SEQ ID NO: 1681356 - RNA, 23 nt, Human
uaguguuggagaagaacugaaau

SEQ ID NO: 1681357 - RNA, 21 nt, Human
acaccuuagccugcccuccuu

SEQ ID NO: 1681358 - RNA, 12 nt, Human
acacgaauauug

SEQ ID NO: 1681359 - RNA, 16 nt, Human
acaccgggccuggaga

SEQ ID NO: 1681360 - RNA, 21 nt, Human
acaccucugcacaagcugcac

SEQ ID NO: 1681361 - RNA, 14 nt, Human
acaccgggccugga

SEQ ID NO: 1681362 - RNA, 16 nt, Human
acaccgggcacucaga

SEQ ID NO: 1681363 - RNA, 15 nt, Human
uauaaguguguguuu

SEQ ID NO: 1681364 - RNA, 20 nt, Human
acacucacauuuauucugcu

SEQ ID NO: 1681365 - RNA, 22 nt, Human
acacucacauuuauucugcuca

SEQ ID NO: 1681366 - RNA, 13 nt, Human
acacuaagagaga

SEQ ID NO: 1681367 - RNA, 14 nt, Human
acacuaagagagaa

SEQ ID NO: 1681368 - RNA, 15 nt, Human
acacucaaaagcugg

SEQ ID NO: 1681369 - RNA, 19 nt, Human
acacucaaaucaagaaacu

SEQ ID NO: 1681370 - RNA, 19 nt, Human
uauaaaaauaaaaaacacu

SEQ ID NO: 1681371 - RNA, 20 nt, Human
uauaaaagccuguuuaagag

SEQ ID NO: 1681372 - RNA, 22 nt, Human
uauaaaagggacugagaaauuu

SEQ ID NO: 1681373 - RNA, 19 nt, Human
uauaaaagccuguuuaaga

SEQ ID NO: 1681374 - RNA, 20 nt, Human
uaguuccaccaucaagccac

SEQ ID NO: 1681375 - RNA, 17 nt, Human
acaccauuaugugcgcu

SEQ ID NO: 1681376 - RNA, 21 nt, Human
acaccauuaugugcgcugaua

SEQ ID NO: 1681377 - RNA, 21 nt, Human
acacauuuuauuuuauuaugc

SEQ ID NO: 1681378 - RNA, 20 nt, Human
acacauuuuauuuuauuaug

SEQ ID NO: 1681379 - RNA, 19 nt, Human
acacauuuuauuuuauuau

SEQ ID NO: 1681380 - RNA, 14 nt, Human
acacauuuuauuuu

SEQ ID NO: 1681381 - RNA, 18 nt, Human
acacaugcaaggucauuu

SEQ ID NO: 1681382 - RNA, 15 nt, Human
acacaugaaguccaa

SEQ ID NO: 1681383 - RNA, 15 nt, Human
acacaucagcuugcc

SEQ ID NO: 1681384 - RNA, 21 nt, Human
acacaugagcaucaggccagg

SEQ ID NO: 1681385 - RNA, 18 nt, Human
acacaugauccugcaauu

SEQ ID NO: 1681386 - RNA, 16 nt, Human
uaggaaauccagggug

SEQ ID NO: 1681387 - RNA, 19 nt, Human
uaggaaauauuuauuuuaa

SEQ ID NO: 1681388 - RNA, 18 nt, Human
uaggaaauauuuauuuua

SEQ ID NO: 1681389 - RNA, 14 nt, Human
uaggcauuguggga

SEQ ID NO: 1681390 - RNA, 16 nt, Human
uaggcauuugcugaau

SEQ ID NO: 1681391 - RNA, 20 nt, Human
uaggcauuugcugaauacag

SEQ ID NO: 1681392 - RNA, 14 nt, Human
uagggagagaagau

SEQ ID NO: 1681393 - RNA, 15 nt, Human
uagggagagaagaua

SEQ ID NO: 1681394 - RNA, 22 nt, Human
acaaggacagccccuccuccau

SEQ ID NO: 1681395 - RNA, 21 nt, Human
acaaggacagccccuccucca

SEQ ID NO: 1681396 - RNA, 18 nt, Human
acaaggacuaggguccug

SEQ ID NO: 1681397 - RNA, 19 nt, Human
acaaggacuaggguccugg

SEQ ID NO: 1681398 - RNA, 13 nt, Human
acaagacugcaca

SEQ ID NO: 1681399 - RNA, 14 nt, Human
acaagacugcacau

SEQ ID NO: 1681400 - RNA, 23 nt, Human
acaauacaucccuuaccugggaa

SEQ ID NO: 1681401 - RNA, 19 nt, Human
acaaugacuuacuguacau

SEQ ID NO: 1681402 - RNA, 18 nt, Human
acaaugacuuacuguaca

SEQ ID NO: 1681403 - RNA, 17 nt, Human
acaaugacuuacuguac

SEQ ID NO: 1681404 - RNA, 12 nt, Human
acaaugacuuac

SEQ ID NO: 1681405 - RNA, 21 nt, Human
uagcuagacuggugacugauu

SEQ ID NO: 1681406 - RNA, 22 nt, Human
uagcuagacuggugacugauuc

SEQ ID NO: 1681407 - RNA, 11 nt, Human
uagccagagga

SEQ ID NO: 1681408 - RNA, 15 nt, Human
uagccagaggagaga

SEQ ID NO: 1681409 - RNA, 19 nt, Human
acaaauuuacagagacaga

SEQ ID NO: 1681410 - RNA, 18 nt, Human
acaaauuuacagagacag

SEQ ID NO: 1681411 - RNA, 23 nt, Human
acaacacucauugaccugaggcc

SEQ ID NO: 1681412 - RNA, 21 nt, Human
acaacacucauugaccugagg

SEQ ID NO: 1681413 - RNA, 19 nt, Human
acaagaccacguuucuaaa

SEQ ID NO: 1681414 - RNA, 19 nt, Human
acaagacccuugugguccc

SEQ ID NO: 1681415 - RNA, 20 nt, Human
acaagacccaaaaggcagaa

SEQ ID NO: 1681416 - RNA, 21 nt, Human
uagccaaggccaaaggaagca

SEQ ID NO: 1681417 - RNA, 22 nt, Human
uagcauuuugcuaaaugugaau

SEQ ID NO: 1681418 - RNA, 16 nt, Human
uagcauuuugcuaaau

SEQ ID NO: 1681419 - RNA, 18 nt, Human
uagcaugucgucaaagcu

SEQ ID NO: 1681420 - RNA, 23 nt, Human
uagaugcugacuguacuccuccc

SEQ ID NO: 1681421 - RNA, 14 nt, Human
uagaugcugacugu

SEQ ID NO: 1681422 - RNA, 15 nt, Human
uagaugcaguucuga

SEQ ID NO: 1681423 - RNA, 19 nt, Human
uagcauggcugccaauggg

SEQ ID NO: 1681424 - RNA, 22 nt, Human
acaaaggaugcccaaagaugca

SEQ ID NO: 1681425 - RNA, 21 nt, Human
aauuguguuuauaauuuuaaa

SEQ ID NO: 1681426 - RNA, 16 nt, Human
aauuguuacaaauugu

SEQ ID NO: 1681427 - RNA, 22 nt, Human
acaaaagcaugugagacugguu

SEQ ID NO: 1681428 - RNA, 11 nt, Human
acaaaagcaug

SEQ ID NO: 1681429 - RNA, 18 nt, Human
acaaaaggauaaugaaua

SEQ ID NO: 1681430 - RNA, 19 nt, Human
uagauauaugcucugcaug

SEQ ID NO: 1681431 - RNA, 15 nt, Human
uagauauaugcucug

SEQ ID NO: 1681432 - RNA, 22 nt, Human
uagaggagaaacuggaacucuc

SEQ ID NO: 1681433 - RNA, 23 nt, Human
uagagauuuuuuuguuguuuguu

SEQ ID NO: 1681434 - RNA, 22 nt, Human
gugcuccauggcugccaucuca

SEQ ID NO: 1681435 - RNA, 18 nt, Human
gugcuccauggcugccau

SEQ ID NO: 1681436 - RNA, 19 nt, Human
gugcucaggagcccuggga

SEQ ID NO: 1681437 - RNA, 18 nt, Human
gugcucaggagcccuggg

SEQ ID NO: 1681438 - RNA, 19 nt, Human
gugcuaucucccccagccc

SEQ ID NO: 1681439 - RNA, 16 nt, Human
gugcucaggagcccug

SEQ ID NO: 1681440 - RNA, 16 nt, Human
gugcucugaucaucca

SEQ ID NO: 1681441 - RNA, 13 nt, Human
gugcucuggacag

SEQ ID NO: 1681442 - RNA, 14 nt, Human
gugcucuggacagg

SEQ ID NO: 1681443 - RNA, 13 nt, Human
gugcugcccugcc

SEQ ID NO: 1681444 - RNA, 14 nt, Human
gugcugcccugccc

SEQ ID NO: 1681445 - RNA, 15 nt, Human
gugcugcccugccca

SEQ ID NO: 1681446 - RNA, 17 nt, Human
gugcuaggaacacuccu

SEQ ID NO: 1681447 - RNA, 15 nt, Human
gugcuaucuccccca

SEQ ID NO: 1681448 - RNA, 18 nt, Human
gugcuaucucccccagcc

SEQ ID NO: 1681449 - RNA, 22 nt, Human
gugcuacaaaaacacagcaagg

SEQ ID NO: 1681450 - RNA, 14 nt, Human
aagaaagaaaauca

SEQ ID NO: 1681451 - RNA, 16 nt, Human
aagaaagaaaaucagg

SEQ ID NO: 1681452 - RNA, 22 nt, Human
aagaaaauaguggugugauuug

SEQ ID NO: 1681453 - RNA, 21 nt, Human
aagaaaauaguggugugauuu

SEQ ID NO: 1681454 - RNA, 15 nt, Human
aagaaaauaguggug

SEQ ID NO: 1681455 - RNA, 11 nt, Human
aagaaacauuu

SEQ ID NO: 1681456 - RNA, 19 nt, Human
gugccagauuuaugcauau

SEQ ID NO: 1681457 - RNA, 23 nt, Human
aacuuuaccuuuuuuauacauaa

SEQ ID NO: 1681458 - RNA, 22 nt, Human
aacuuuaccuuuuuuauacaua

SEQ ID NO: 1681459 - RNA, 21 nt, Human
aacuuuaccuuuuuuauacau

SEQ ID NO: 1681460 - RNA, 19 nt, Human
aagaaaaaauauuuucccu

SEQ ID NO: 1681461 - RNA, 13 nt, Human
aagaaaaagaaaa

SEQ ID NO: 1681462 - RNA, 18 nt, Human
aagaaaaagaaaaagaaa

SEQ ID NO: 1681463 - RNA, 17 nt, Human
aagaaaaaugagccugg

SEQ ID NO: 1681464 - RNA, 18 nt, Human
aagaaaaaugagccuggc

SEQ ID NO: 1681465 - RNA, 22 nt, Human
gugcaaugaccuuucaauagga

SEQ ID NO: 1681466 - RNA, 23 nt, Human
gugcacaagcuccaagcucccag

SEQ ID NO: 1681467 - RNA, 21 nt, Human
gugcacaugcacgugugugca

SEQ ID NO: 1681468 - RNA, 18 nt, Human
gugcaaugaccuuucaau

SEQ ID NO: 1681469 - RNA, 13 nt, Human
gugcacaagcucc

SEQ ID NO: 1681470 - RNA, 16 nt, Human
gugcacaagcuccaag

SEQ ID NO: 1681471 - RNA, 21 nt, Human
gugcacaagcuccaagcuccc

SEQ ID NO: 1681472 - RNA, 20 nt, Human
gugcauuugaggucuguucu

SEQ ID NO: 1681473 - RNA, 21 nt, Human
gugcauuuggugguuucagaa

SEQ ID NO: 1681474 - RNA, 23 nt, Human
gugccaaaaacaacaacaaaaug

SEQ ID NO: 1681475 - RNA, 19 nt, Human
gugcauuugaggucuguuc

SEQ ID NO: 1681476 - RNA, 17 nt, Human
gugcauuugaggucugu

SEQ ID NO: 1681477 - RNA, 23 nt, Human
gugaugguuccccuguucacucu

SEQ ID NO: 1681478 - RNA, 14 nt, Human
gugaucucauuuaa

SEQ ID NO: 1681479 - RNA, 11 nt, Human
gugauuaccag

SEQ ID NO: 1681480 - RNA, 16 nt, Human
gugauuaccagggacu

SEQ ID NO: 1681481 - RNA, 17 nt, Human
gugauuaccagggacug

SEQ ID NO: 1681482 - RNA, 13 nt, Human
aacuugaaauuug

SEQ ID NO: 1681483 - RNA, 18 nt, Human
aacuugaaauuugaauuu

SEQ ID NO: 1681484 - RNA, 19 nt, Human
aacuugaaauuugaauuuu

SEQ ID NO: 1681485 - RNA, 12 nt, Human
aacuugaaauuu

SEQ ID NO: 1681486 - RNA, 22 nt, Human
aacuuccuuggacucauuuuaa

SEQ ID NO: 1681487 - RNA, 18 nt, Human
aacuucagcgguuuauau

SEQ ID NO: 1681488 - RNA, 13 nt, Human
aacuucagacaua

SEQ ID NO: 1681489 - RNA, 21 nt, Human
aacuucagcgguuuauauaag

SEQ ID NO: 1681490 - RNA, 23 nt, Human
aacuuccuuggacucauuuuaaa

SEQ ID NO: 1681491 - RNA, 18 nt, Human
aacugcccccucugcccu

SEQ ID NO: 1681492 - RNA, 19 nt, Human
aacugcccccucugcccug

SEQ ID NO: 1681493 - RNA, 20 nt, Human
aacugcccccucugcccugc

SEQ ID NO: 1681494 - RNA, 21 nt, Human
aacugcccccucugcccugcg

SEQ ID NO: 1681495 - RNA, 16 nt, Human
aacugcccccucugcc

SEQ ID NO: 1681496 - RNA, 17 nt, Human
aacugcccccucugccc

SEQ ID NO: 1681497 - RNA, 22 nt, Human
aacuucaccauauuaccacaga

SEQ ID NO: 1681498 - RNA, 22 nt, Human
aacuucacauauugauuuccgu

SEQ ID NO: 1681499 - RNA, 14 nt, Human
aacuucacauauug

SEQ ID NO: 1681500 - RNA, 18 nt, Human
gugaggcucugcccuugg

SEQ ID NO: 1681501 - RNA, 23 nt, Human
gugaguacuacaguccucccauc

SEQ ID NO: 1681502 - RNA, 17 nt, Human
gugagucaccaagccca

SEQ ID NO: 1681503 - RNA, 19 nt, Human
gugagucaccaagcccagu

SEQ ID NO: 1681504 - RNA, 19 nt, Human
aacucuccucugcugcugg

SEQ ID NO: 1681505 - RNA, 21 nt, Human
aacucuccucugcugcuggcu

SEQ ID NO: 1681506 - RNA, 18 nt, Human
gugagacucugucucaaa

SEQ ID NO: 1681507 - RNA, 12 nt, Human
gugaggcucugc

SEQ ID NO: 1681508 - RNA, 13 nt, Human
gugaggcucugcc

SEQ ID NO: 1681509 - RNA, 14 nt, Human
gugaggcucugccc

SEQ ID NO: 1681510 - RNA, 15 nt, Human
gugaggcucugcccu

SEQ ID NO: 1681511 - RNA, 16 nt, Human
gugaggcucugcccuu

SEQ ID NO: 1681512 - RNA, 17 nt, Human
gugaggcucugcccuug

SEQ ID NO: 1681513 - RNA, 16 nt, Human
aacucugacaacagac

SEQ ID NO: 1681514 - RNA, 22 nt, Human
aacucuccucugcugcuggcug

SEQ ID NO: 1681515 - RNA, 23 nt, Human
aacucuccucugcugcuggcugg

SEQ ID NO: 1681516 - RNA, 21 nt, Human
aacugauuuuuuuuuccuuca

SEQ ID NO: 1681517 - RNA, 22 nt, Human
aacugauuuuuuuuuccuucag

SEQ ID NO: 1681518 - RNA, 23 nt, Human
aacugauuuuuuuuuccuucagu

SEQ ID NO: 1681519 - RNA, 16 nt, Human
aacugcauuggcuuug

SEQ ID NO: 1681520 - RNA, 13 nt, Human
gugagaccugccc

SEQ ID NO: 1681521 - RNA, 14 nt, Human
gugagaccugcccc

SEQ ID NO: 1681522 - RNA, 15 nt, Human
gugagaccugccccu

SEQ ID NO: 1681523 - RNA, 22 nt, Human
gugagacccugucucaaaaaaa

SEQ ID NO: 1681524 - RNA, 16 nt, Human
gugagaccugccccuc

SEQ ID NO: 1681525 - RNA, 23 nt, Human
gugagaccugccccuccucucug

SEQ ID NO: 1681526 - RNA, 14 nt, Human
gugagacucugucu

SEQ ID NO: 1681527 - RNA, 16 nt, Human
gugagacucugucuca

SEQ ID NO: 1681528 - RNA, 16 nt, Human
gugacuucagcucugu

SEQ ID NO: 1681529 - RNA, 12 nt, Human
gugacuuuggau

SEQ ID NO: 1681530 - RNA, 15 nt, Human
gugacuuuggauaau

SEQ ID NO: 1681531 - RNA, 22 nt, Human
gugacauguguuggcagccucu

SEQ ID NO: 1681532 - RNA, 19 nt, Human
gugacaugucuuuucuugc

SEQ ID NO: 1681533 - RNA, 20 nt, Human
gugacagagugagacucugu

SEQ ID NO: 1681534 - RNA, 22 nt, Human
gugacagagugagacucugucu

SEQ ID NO: 1681535 - RNA, 12 nt, Human
aacuccugaccu

SEQ ID NO: 1681536 - RNA, 14 nt, Human
aacuccugaccuca

SEQ ID NO: 1681537 - RNA, 12 nt, Human
aacuccuggccu

SEQ ID NO: 1681538 - RNA, 23 nt, Human
gugaauaauacaguaucucaggg

SEQ ID NO: 1681539 - RNA, 14 nt, Human
gucugaaggcuggg

SEQ ID NO: 1681540 - RNA, 14 nt, Human
gucucaaaaaaaca

SEQ ID NO: 1681541 - RNA, 17 nt, Human
gucucaaaaaaagaaaa

SEQ ID NO: 1681542 - RNA, 19 nt, Human
gucucaaaaaaagaaaaag

SEQ ID NO: 1681543 - RNA, 20 nt, Human
gucugacaggcaaugcuggc

SEQ ID NO: 1681544 - RNA, 15 nt, Human
gucugacaggcaaug

SEQ ID NO: 1681545 - RNA, 18 nt, Human
gucugacaggcaaugcug

SEQ ID NO: 1681546 - RNA, 12 nt, Human
gucugacaggca

SEQ ID NO: 1681547 - RNA, 13 nt, Human
gucugacaggcaa

SEQ ID NO: 1681548 - RNA, 14 nt, Human
gucugacaggcaau

SEQ ID NO: 1681549 - RNA, 22 nt, Human
gucuuguuuuuuuuuuccacuu

SEQ ID NO: 1681550 - RNA, 23 nt, Human
gucuugucucagauuuuauuaug

SEQ ID NO: 1681551 - RNA, 13 nt, Human
gucuucacaacag

SEQ ID NO: 1681552 - RNA, 18 nt, Human
gucuggaaugcaguggua

SEQ ID NO: 1681553 - RNA, 15 nt, Human
gucuggaaugcagug

SEQ ID NO: 1681554 - RNA, 16 nt, Human
gucuggaaugcagugg

SEQ ID NO: 1681555 - RNA, 14 nt, Human
gucuuaauuaaaag

SEQ ID NO: 1681556 - RNA, 21 nt, Human
aaccuucgccaccuggguucc

SEQ ID NO: 1681557 - RNA, 12 nt, Human
aacgucuuaaau

SEQ ID NO: 1681558 - RNA, 14 nt, Human
aacgucuuaaauau

SEQ ID NO: 1681559 - RNA, 12 nt, Human
aacgugaaaaug

SEQ ID NO: 1681560 - RNA, 15 nt, Human
aacgucuuaaauauu

SEQ ID NO: 1681561 - RNA, 23 nt, Human
aaccuggucacaggacucugccu

SEQ ID NO: 1681562 - RNA, 21 nt, Human
aacuaggugcauauuuauaaa

SEQ ID NO: 1681563 - RNA, 17 nt, Human
aacuagggaagauaaua

SEQ ID NO: 1681564 - RNA, 12 nt, Human
aacguggcugcu

SEQ ID NO: 1681565 - RNA, 13 nt, Human
aacguggcugcuu

SEQ ID NO: 1681566 - RNA, 12 nt, Human
aacuauggccug

SEQ ID NO: 1681567 - RNA, 15 nt, Human
aacuauguugauaaa

SEQ ID NO: 1681568 - RNA, 21 nt, Human
aacucauuuuuguuuucauua

SEQ ID NO: 1681569 - RNA, 24 nt, Human
aacucauuuuuguuuucauuaucu

SEQ ID NO: 1681570 - RNA, 16 nt, Human
gucgaggacagggagg

SEQ ID NO: 1681571 - RNA, 12 nt, Human
gucgaggcagga

SEQ ID NO: 1681572 - RNA, 14 nt, Human
guccucuuuucuga

SEQ ID NO: 1681573 - RNA, 19 nt, Human
guccugcugcaguugccag

SEQ ID NO: 1681574 - RNA, 16 nt, Human
guccuggcaugggaau

SEQ ID NO: 1681575 - RNA, 12 nt, Human
gucgccucugca

SEQ ID NO: 1681576 - RNA, 14 nt, Human
gucuaccugagggg

SEQ ID NO: 1681577 - RNA, 13 nt, Human
gucuaccugaggg

SEQ ID NO: 1681578 - RNA, 15 nt, Human
gucuaccugaggggc

SEQ ID NO: 1681579 - RNA, 16 nt, Human
gucuaccugaggggcc

SEQ ID NO: 1681580 - RNA, 20 nt, Human
gucuauuuacggaacucaaa

SEQ ID NO: 1681581 - RNA, 22 nt, Human
gucuaugggacucaaugcacug

SEQ ID NO: 1681582 - RNA, 16 nt, Human
aacauguuaaaccaug

SEQ ID NO: 1681583 - RNA, 14 nt, Human
aacauguuaaacca

SEQ ID NO: 1681584 - RNA, 15 nt, Human
aacauguuaaaccau

SEQ ID NO: 1681585 - RNA, 16 nt, Human
aacauugguucuugua

SEQ ID NO: 1681586 - RNA, 18 nt, Human
aacauugguucuuguauu

SEQ ID NO: 1681587 - RNA, 19 nt, Human
aacauugguucuuguauua

SEQ ID NO: 1681588 - RNA, 22 nt, Human
aacauugguucuuguauuaaga

SEQ ID NO: 1681589 - RNA, 23 nt, Human
aacauugguucuuguauuaagaa

SEQ ID NO: 1681590 - RNA, 14 nt, Human
aacauaaaauacaa

SEQ ID NO: 1681591 - RNA, 14 nt, Human
aacagucucaggaa

SEQ ID NO: 1681592 - RNA, 12 nt, Human
aacauauauaac

SEQ ID NO: 1681593 - RNA, 16 nt, Human
guccgugcuaaggacu

SEQ ID NO: 1681594 - RNA, 17 nt, Human
guccgugcuaaggacuu

SEQ ID NO: 1681595 - RNA, 15 nt, Human
guccgugcuaaggac

SEQ ID NO: 1681596 - RNA, 18 nt, Human
aacaguccauugaaaggg

SEQ ID NO: 1681597 - RNA, 13 nt, Human
aacagucucagga

SEQ ID NO: 1681598 - RNA, 21 nt, Human
aacacugggagaaaugaaaaa

SEQ ID NO: 1681599 - RNA, 17 nt, Human
aacacucauugaccuga

SEQ ID NO: 1681600 - RNA, 21 nt, Human
aacacucacauuuauucugcu

SEQ ID NO: 1681601 - RNA, 17 nt, Human
gucauuugagcagggcu

SEQ ID NO: 1681602 - RNA, 19 nt, Human
aacacuguucucugcccuc

SEQ ID NO: 1681603 - RNA, 16 nt, Human
aacacuguucucugcc

SEQ ID NO: 1681604 - RNA, 17 nt, Human
aacacuguucucugccc

SEQ ID NO: 1681605 - RNA, 18 nt, Human
aacacuguucucugcccu

SEQ ID NO: 1681606 - RNA, 15 nt, Human
aaauuugaauuuugu

SEQ ID NO: 1681607 - RNA, 22 nt, Human
aaauuugaauuuuguguuagag

SEQ ID NO: 1681608 - RNA, 19 nt, Human
aacacaaacgggcucagca

SEQ ID NO: 1681609 - RNA, 12 nt, Human
aaauuugaauuu

SEQ ID NO: 1681610 - RNA, 19 nt, Human
aaauuucuaaaucuccaaa

SEQ ID NO: 1681611 - RNA, 18 nt, Human
aacacagcaagggugaug

SEQ ID NO: 1681612 - RNA, 20 nt, Human
aacacagcaagggugauggg

SEQ ID NO: 1681613 - RNA, 15 nt, Human
gucccuaauaaagcu

SEQ ID NO: 1681614 - RNA, 18 nt, Human
gucccugguggcagcuca

SEQ ID NO: 1681615 - RNA, 19 nt, Human
gucccugguggcagcucac

SEQ ID NO: 1681616 - RNA, 18 nt, Human
gucccuuacgugaguccu

SEQ ID NO: 1681617 - RNA, 19 nt, Human
gucccuuacgugaguccug

SEQ ID NO: 1681618 - RNA, 12 nt, Human
gucccuaauaaa

SEQ ID NO: 1681619 - RNA, 22 nt, Human
guccccuguuuguuucugaaag

SEQ ID NO: 1681620 - RNA, 18 nt, Human
guccccuguuuguuucug

SEQ ID NO: 1681621 - RNA, 15 nt, Human
gucccaccccacaca

SEQ ID NO: 1681622 - RNA, 22 nt, Human
guccccaccgcagacaggacca

SEQ ID NO: 1681623 - RNA, 20 nt, Human
gucccaccccacacacgcca

SEQ ID NO: 1681624 - RNA, 18 nt, Human
guccccaccgcagacagg

SEQ ID NO: 1681625 - RNA, 19 nt, Human
gucauuugagcagggcuca

SEQ ID NO: 1681626 - RNA, 22 nt, Human
guccaugaagauguagaggaga

SEQ ID NO: 1681627 - RNA, 23 nt, Human
guccaugaagauguagaggagaa

SEQ ID NO: 1681628 - RNA, 20 nt, Human
gucacugcacagugcaucuc

SEQ ID NO: 1681629 - RNA, 23 nt, Human
gucacugcacagugcaucucagc

SEQ ID NO: 1681630 - RNA, 10 nt, Human
gucacugcuu

SEQ ID NO: 1681631 - RNA, 17 nt, Human
gucacugagacagcccg

SEQ ID NO: 1681632 - RNA, 18 nt, Human
gucacugagacagcccgg

SEQ ID NO: 1681633 - RNA, 21 nt, Human
gucacugagacagcccgggcu

SEQ ID NO: 1681634 - RNA, 23 nt, Human
gucacugagacagcccgggcucu

SEQ ID NO: 1681635 - RNA, 14 nt, Human
gucacugagacagc

SEQ ID NO: 1681636 - RNA, 15 nt, Human
gucacugagacagcc

SEQ ID NO: 1681637 - RNA, 16 nt, Human
gucacugagacagccc

SEQ ID NO: 1681638 - RNA, 12 nt, Human
gucaccaagccc

SEQ ID NO: 1681639 - RNA, 15 nt, Human
gucaccaagcccagu

SEQ ID NO: 1681640 - RNA, 23 nt, Human
gucacucuggcagcucagagagg

SEQ ID NO: 1681641 - RNA, 18 nt, Human
gucacauuccugaacagg

SEQ ID NO: 1681642 - RNA, 22 nt, Human
gucaccaaaucagcugcuacua

SEQ ID NO: 1681643 - RNA, 19 nt, Human
gucacaggacucugccucc

SEQ ID NO: 1681644 - RNA, 16 nt, Human
gucacaggagggaggg

SEQ ID NO: 1681645 - RNA, 12 nt, Human
gucacaggcagg

SEQ ID NO: 1681646 - RNA, 17 nt, Human
gucacaggacucugccu

SEQ ID NO: 1681647 - RNA, 18 nt, Human
gucacaggacucugccuc

SEQ ID NO: 1681648 - RNA, 20 nt, Human
gucacaggaaguagaggagg

SEQ ID NO: 1681649 - RNA, 22 nt, Human
gucaauuacaggaaguacugga

SEQ ID NO: 1681650 - RNA, 21 nt, Human
gucaauuuuguuauguauauu

SEQ ID NO: 1681651 - RNA, 13 nt, Human
gucacaggaagua

SEQ ID NO: 1681652 - RNA, 15 nt, Human
gucacaggaaguaga

SEQ ID NO: 1681653 - RNA, 15 nt, Human
aaauuucuaaaucuc

SEQ ID NO: 1681654 - RNA, 13 nt, Human
aaauuucuaaauc

SEQ ID NO: 1681655 - RNA, 15 nt, Human
gucagugugacugau

SEQ ID NO: 1681656 - RNA, 16 nt, Human
gucagguggggcagcu

SEQ ID NO: 1681657 - RNA, 17 nt, Human
gucagguggggcagcuu

SEQ ID NO: 1681658 - RNA, 18 nt, Human
gucagguggggcagcuug

SEQ ID NO: 1681659 - RNA, 22 nt, Human
gucagguggggcagcuugaggg

SEQ ID NO: 1681660 - RNA, 21 nt, Human
gucacugcuuaacuucacaua

SEQ ID NO: 1681661 - RNA, 15 nt, Human
gucacugcuuaacuu

SEQ ID NO: 1681662 - RNA, 17 nt, Human
gucacuuuguuuuacug

SEQ ID NO: 1681663 - RNA, 23 nt, Human
gucagaaguuucugccgcagccc

SEQ ID NO: 1681664 - RNA, 21 nt, Human
gucagaaguuucugccgcagc

SEQ ID NO: 1681665 - RNA, 14 nt, Human
gucaggaaagagaa

SEQ ID NO: 1681666 - RNA, 13 nt, Human
gucaggaaagaga

SEQ ID NO: 1681667 - RNA, 18 nt, Human
aaauuaggauuucaugau

SEQ ID NO: 1681668 - RNA, 19 nt, Human
aaauuaggauuucaugauu

SEQ ID NO: 1681669 - RNA, 23 nt, Human
aaauuaugugccagauuuaugca

SEQ ID NO: 1681670 - RNA, 15 nt, Human
aaauguggcuccugg

SEQ ID NO: 1681671 - RNA, 14 nt, Human
aaauuaaucugggc

SEQ ID NO: 1681672 - RNA, 18 nt, Human
aaaugugccuucauuuuu

SEQ ID NO: 1681673 - RNA, 15 nt, Human
aaaugugcuuuuaaa

SEQ ID NO: 1681674 - RNA, 18 nt, Human
aaauugucagaugcugug

SEQ ID NO: 1681675 - RNA, 17 nt, Human
aaauuguauuacaaauc

SEQ ID NO: 1681676 - RNA, 16 nt, Human
aaauuccccacccuga

SEQ ID NO: 1681677 - RNA, 17 nt, Human
aaauuccaagugauuga

SEQ ID NO: 1681678 - RNA, 11 nt, Human
guauuuauuca

SEQ ID NO: 1681679 - RNA, 14 nt, Human
aaaugucuuccugg

SEQ ID NO: 1681680 - RNA, 21 nt, Human
aaaugucucuuuaaugucaca

SEQ ID NO: 1681681 - RNA, 19 nt, Human
guauuguacaaaguauuaa

SEQ ID NO: 1681682 - RNA, 10 nt, Human
guauugaagc

SEQ ID NO: 1681683 - RNA, 13 nt, Human
guauugaagcauu

SEQ ID NO: 1681684 - RNA, 17 nt, Human
guauugaagcauuuuau

SEQ ID NO: 1681685 - RNA, 18 nt, Human
guauugaagcauuuuaua

SEQ ID NO: 1681686 - RNA, 22 nt, Human
guauugaagcauuuuauaaauc

SEQ ID NO: 1681687 - RNA, 21 nt, Human
guauuguacaaaguauuaagc

SEQ ID NO: 1681688 - RNA, 22 nt, Human
guauuguacaaaguauuaagca

SEQ ID NO: 1681689 - RNA, 23 nt, Human
guauuguacaaaguauuaagcau

SEQ ID NO: 1681690 - RNA, 16 nt, Human
aaaucauucauuuucu

SEQ ID NO: 1681691 - RNA, 11 nt, Human
aaaucauuucu

SEQ ID NO: 1681692 - RNA, 21 nt, Human
guauucucuccuguaccucuu

SEQ ID NO: 1681693 - RNA, 18 nt, Human
guauucucuccuguaccu

SEQ ID NO: 1681694 - RNA, 21 nt, Human
uaaaauaccagccaguaaaug

SEQ ID NO: 1681695 - RNA, 13 nt, Human
aagugauccuccc

SEQ ID NO: 1681696 - RNA, 19 nt, Human
aagugauccucccaccuca

SEQ ID NO: 1681697 - RNA, 20 nt, Human
aagugauccucccaccucag

SEQ ID NO: 1681698 - RNA, 17 nt, Human
aagugauucucaugccu

SEQ ID NO: 1681699 - RNA, 13 nt, Human
aagugauucucau

SEQ ID NO: 1681700 - RNA, 16 nt, Human
aagugauucucaugcc

SEQ ID NO: 1681701 - RNA, 19 nt, Human
aagugauucucaugccuca

SEQ ID NO: 1681702 - RNA, 23 nt, Human
aagugauccucccaccucagccu

SEQ ID NO: 1681703 - RNA, 22 nt, Human
uaaaauaauuuuuauauuugaa

SEQ ID NO: 1681704 - RNA, 21 nt, Human
uaaaauacacacucaaaucaa

SEQ ID NO: 1681705 - RNA, 13 nt, Human
uaaaagucuugug

SEQ ID NO: 1681706 - RNA, 13 nt, Human
uaaaagaauauuu

SEQ ID NO: 1681707 - RNA, 16 nt, Human
uaaaagaauauuuuaa

SEQ ID NO: 1681708 - RNA, 13 nt, Human
uaaaacccaagug

SEQ ID NO: 1681709 - RNA, 15 nt, Human
uaaaacuuuuuaaaa

SEQ ID NO: 1681710 - RNA, 12 nt, Human
uaaaacuuuuua

SEQ ID NO: 1681711 - RNA, 15 nt, Human
uaaaaccacagcagu

SEQ ID NO: 1681712 - RNA, 22 nt, Human
uaaaaaugagguacucuccugg

SEQ ID NO: 1681713 - RNA, 14 nt, Human
uaaaaccacagcag

SEQ ID NO: 1681714 - RNA, 15 nt, Human
uaaaaaugagguacu

SEQ ID NO: 1681715 - RNA, 23 nt, Human
uaaaaaucucaaauuucuaaauc

SEQ ID NO: 1681716 - RNA, 23 nt, Human
aagucagaucugccuaaggacuu

SEQ ID NO: 1681717 - RNA, 14 nt, Human
uaaaaaaaaaauug

SEQ ID NO: 1681718 - RNA, 18 nt, Human
uaaaaaaaaaauugggga

SEQ ID NO: 1681719 - RNA, 21 nt, Human
uaaaaaaaaaccugagcccca

SEQ ID NO: 1681720 - RNA, 22 nt, Human
uaaaaagcuccaaaugcagcuu

SEQ ID NO: 1681721 - RNA, 23 nt, Human
aaguuaagaauguucuuauguug

SEQ ID NO: 1681722 - RNA, 11 nt, Human
aaguuaagaau

SEQ ID NO: 1681723 - RNA, 16 nt, Human
aaguguguguuuuuca

SEQ ID NO: 1681724 - RNA, 21 nt, Human
aaguguguguuuuucauaaag

SEQ ID NO: 1681725 - RNA, 12 nt, Human
aaguguguguuu

SEQ ID NO: 1681726 - RNA, 13 nt, Human
aagugugguagag

SEQ ID NO: 1681727 - RNA, 23 nt, Human
aaguguauuuuuuuacuaauaga

SEQ ID NO: 1681728 - RNA, 14 nt, Human
aaguucccuacuuc

SEQ ID NO: 1681729 - RNA, 17 nt, Human
aaguucccuacuuccug

SEQ ID NO: 1681730 - RNA, 20 nt, Human
aaguucccuacuuccuguga

SEQ ID NO: 1681731 - RNA, 19 nt, Human
aaguuauuuuuaauuuggu

SEQ ID NO: 1681732 - RNA, 19 nt, Human
aaguuucugccgcagcccu

SEQ ID NO: 1681733 - RNA, 21 nt, Human
aaguuucugccgcagcccugc

SEQ ID NO: 1681734 - RNA, 20 nt, Human
aaguuugagaucagccuggg

SEQ ID NO: 1681735 - RNA, 9 nt, Human
uaaaauggu

SEQ ID NO: 1681736 - RNA, 16 nt, Human
aaggcugggggaagaa

SEQ ID NO: 1681737 - RNA, 13 nt, Human
guuucagaaaugu

SEQ ID NO: 1681738 - RNA, 11 nt, Human
guuucagaaau

SEQ ID NO: 1681739 - RNA, 19 nt, Human
aaggcugggggaagaagcu

SEQ ID NO: 1681740 - RNA, 22 nt, Human
aaggcugggggaagaagcucuc

SEQ ID NO: 1681741 - RNA, 20 nt, Human
aaggcugucaauuacaggaa

SEQ ID NO: 1681742 - RNA, 15 nt, Human
aagggcuguuauaau

SEQ ID NO: 1681743 - RNA, 17 nt, Human
aagggcuguuauaaucu

SEQ ID NO: 1681744 - RNA, 17 nt, Human
aaggggaauugaggaca

SEQ ID NO: 1681745 - RNA, 13 nt, Human
aaggggagaguaa

SEQ ID NO: 1681746 - RNA, 12 nt, Human
aagggggcuggg

SEQ ID NO: 1681747 - RNA, 23 nt, Human
aagggggcugggacaugggaaag

SEQ ID NO: 1681748 - RNA, 23 nt, Human
aagguuucagaaagaagugggga

SEQ ID NO: 1681749 - RNA, 12 nt, Human
guuguuuguuua

SEQ ID NO: 1681750 - RNA, 21 nt, Human
guuuaagugacugauggcuaa

SEQ ID NO: 1681751 - RNA, 12 nt, Human
aaggaaaaguuu

SEQ ID NO: 1681752 - RNA, 17 nt, Human
aaggaaacccagcucug

SEQ ID NO: 1681753 - RNA, 22 nt, Human
aaggaaacccagcucuggucca

SEQ ID NO: 1681754 - RNA, 23 nt, Human
guuguuugauucagacagcugcc

SEQ ID NO: 1681755 - RNA, 20 nt, Human
aaggaaacuggguuccugca

SEQ ID NO: 1681756 - RNA, 13 nt, Human
guuuauuacagua

SEQ ID NO: 1681757 - RNA, 17 nt, Human
guuuauuacaguauaau

SEQ ID NO: 1681758 - RNA, 13 nt, Human
guuuaauauuaaa

SEQ ID NO: 1681759 - RNA, 14 nt, Human
guuuaauauuaaag

SEQ ID NO: 1681760 - RNA, 15 nt, Human
guuuaauauuaaagc

SEQ ID NO: 1681761 - RNA, 18 nt, Human
guuuaauauuaaagccau

SEQ ID NO: 1681762 - RNA, 19 nt, Human
guuuaauauuaaagccaug

SEQ ID NO: 1681763 - RNA, 14 nt, Human
guuuaugauuccac

SEQ ID NO: 1681764 - RNA, 18 nt, Human
guuuggaccaaaaaccag

SEQ ID NO: 1681765 - RNA, 13 nt, Human
guuuggagacaga

SEQ ID NO: 1681766 - RNA, 20 nt, Human
guuugcuuuguaugcacuuu

SEQ ID NO: 1681767 - RNA, 19 nt, Human
guuuggacaaaauggaaua

SEQ ID NO: 1681768 - RNA, 15 nt, Human
guuuuaaagcuucca

SEQ ID NO: 1681769 - RNA, 20 nt, Human
aaguaauaugcacacauuuu

SEQ ID NO: 1681770 - RNA, 18 nt, Human
aaguaauaugcacacauu

SEQ ID NO: 1681771 - RNA, 17 nt, Human
aaguaauaugcacacau

SEQ ID NO: 1681772 - RNA, 21 nt, Human
aaguaauaugcacacauuuuu

SEQ ID NO: 1681773 - RNA, 19 nt, Human
guuuucuguucuuucuggc

SEQ ID NO: 1681774 - RNA, 16 nt, Human
guuuucuguucuuucu

SEQ ID NO: 1681775 - RNA, 15 nt, Human
guuuucuguucuuuc

SEQ ID NO: 1681776 - RNA, 14 nt, Human
guuuucuguucuuu

SEQ ID NO: 1681777 - RNA, 22 nt, Human
guuuuaaggaugcuuguacaua

SEQ ID NO: 1681778 - RNA, 13 nt, Human
guuuuaugacuuc

SEQ ID NO: 1681779 - RNA, 18 nt, Human
guuuuaugacuucauuaa

SEQ ID NO: 1681780 - RNA, 22 nt, Human
aagucacugcacagugcaucuc

SEQ ID NO: 1681781 - RNA, 18 nt, Human
aagucagaucugccuaag

SEQ ID NO: 1681782 - RNA, 21 nt, Human
aagucagaucugccuaaggac

SEQ ID NO: 1681783 - RNA, 22 nt, Human
aagucagaucugccuaaggacu

SEQ ID NO: 1681784 - RNA, 23 nt, Human
aaguauucuuauuuaaugaaaga

SEQ ID NO: 1681785 - RNA, 19 nt, Human
aaguauuauaccuuuuuua

SEQ ID NO: 1681786 - RNA, 16 nt, Human
aaguauuauaccuuuu

SEQ ID NO: 1681787 - RNA, 21 nt, Human
aaguauucuuauuuaaugaaa

SEQ ID NO: 1681788 - RNA, 14 nt, Human
aaguacuauaauuu

SEQ ID NO: 1681789 - RNA, 17 nt, Human
aaguacuauaauuuacc

SEQ ID NO: 1681790 - RNA, 13 nt, Human
aaguacuauguau

SEQ ID NO: 1681791 - RNA, 15 nt, Human
aaguacuauguauca

SEQ ID NO: 1681792 - RNA, 18 nt, Human
aaguacuucuccacccug

SEQ ID NO: 1681793 - RNA, 19 nt, Human
aaguacuucuccacccugc

SEQ ID NO: 1681794 - RNA, 20 nt, Human
aaguacuucuccacccugcu

SEQ ID NO: 1681795 - RNA, 18 nt, Human
aaguauguuagugcaaau

SEQ ID NO: 1681796 - RNA, 19 nt, Human
aaguauguuagugcaaauu

SEQ ID NO: 1681797 - RNA, 15 nt, Human
aaguauuauaccuuu

SEQ ID NO: 1681798 - RNA, 22 nt, Human
guugauagcacagacccugccc

SEQ ID NO: 1681799 - RNA, 14 nt, Human
guugauagcacaga

SEQ ID NO: 1681800 - RNA, 19 nt, Human
guugauagcacagacccug

SEQ ID NO: 1681801 - RNA, 18 nt, Human
guucuugguuuguaaauu

SEQ ID NO: 1681802 - RNA, 15 nt, Human
guucuugguuuguaa

SEQ ID NO: 1681803 - RNA, 14 nt, Human
guucuugguuugua

SEQ ID NO: 1681804 - RNA, 19 nt, Human
guucuagcauggcugccaa

SEQ ID NO: 1681805 - RNA, 15 nt, Human
guucucucuucucca

SEQ ID NO: 1681806 - RNA, 12 nt, Human
guucucugagga

SEQ ID NO: 1681807 - RNA, 14 nt, Human
guucucugaggaca

SEQ ID NO: 1681808 - RNA, 15 nt, Human
guucucugcccucca

SEQ ID NO: 1681809 - RNA, 13 nt, Human
guucuuaauucuu

SEQ ID NO: 1681810 - RNA, 17 nt, Human
guucucugcccuccaag

SEQ ID NO: 1681811 - RNA, 18 nt, Human
guucucugcccuccaaga

SEQ ID NO: 1681812 - RNA, 17 nt, Human
guucuuaauucuuagcu

SEQ ID NO: 1681813 - RNA, 14 nt, Human
guucuuaauucuua

SEQ ID NO: 1681814 - RNA, 23 nt, Human
aagcuuguauuccuuuuucucuc

SEQ ID NO: 1681815 - RNA, 18 nt, Human
aagcuuauuaaaacucau

SEQ ID NO: 1681816 - RNA, 15 nt, Human
guuccccaagacauu

SEQ ID NO: 1681817 - RNA, 19 nt, Human
aagcuuuuaugugaaacau

SEQ ID NO: 1681818 - RNA, 21 nt, Human
aagcuuuuaugugaaacaugu

SEQ ID NO: 1681819 - RNA, 18 nt, Human
guucccuugaugaagaag

SEQ ID NO: 1681820 - RNA, 21 nt, Human
guucccuuuuuuggcugcuga

SEQ ID NO: 1681821 - RNA, 22 nt, Human
guucccuuuuuuggcugcugaa

SEQ ID NO: 1681822 - RNA, 17 nt, Human
guucagguaacaggcag

SEQ ID NO: 1681823 - RNA, 18 nt, Human
guucagguaacaggcaga

SEQ ID NO: 1681824 - RNA, 13 nt, Human
aagccguggcuuc

SEQ ID NO: 1681825 - RNA, 14 nt, Human
aagccguggcuucc

SEQ ID NO: 1681826 - RNA, 15 nt, Human
aagccguggcuuccc

SEQ ID NO: 1681827 - RNA, 21 nt, Human
aagccgugauuuucauugcug

SEQ ID NO: 1681828 - RNA, 20 nt, Human
guucaggguuggccccugcc

SEQ ID NO: 1681829 - RNA, 21 nt, Human
guucaggguuggccccugccc

SEQ ID NO: 1681830 - RNA, 22 nt, Human
guucaggguuggccccugcccg

SEQ ID NO: 1681831 - RNA, 23 nt, Human
guucagcuuguaaauagcucagg

SEQ ID NO: 1681832 - RNA, 15 nt, Human
aagccuguuuaagag

SEQ ID NO: 1681833 - RNA, 18 nt, Human
aagccuguuuaagagaca

SEQ ID NO: 1681834 - RNA, 16 nt, Human
aagccucccacgacug

SEQ ID NO: 1681835 - RNA, 15 nt, Human
aagccuccuccagcc

SEQ ID NO: 1681836 - RNA, 19 nt, Human
aagccuccuccagccgcca

SEQ ID NO: 1681837 - RNA, 21 nt, Human
aagccuuggggcugaugcagu

SEQ ID NO: 1681838 - RNA, 13 nt, Human
aagcccagcuuga

SEQ ID NO: 1681839 - RNA, 20 nt, Human
aagccauguuuauuacagua

SEQ ID NO: 1681840 - RNA, 21 nt, Human
aagccauguuuauuacaguau

SEQ ID NO: 1681841 - RNA, 22 nt, Human
aagccauguuuauuacaguaua

SEQ ID NO: 1681842 - RNA, 23 nt, Human
aagccauguuuauuacaguauaa

SEQ ID NO: 1681843 - RNA, 23 nt, Human
guuacucuucaguuaagccuuug

SEQ ID NO: 1681844 - RNA, 19 nt, Human
guuaauauuuauaggucac

SEQ ID NO: 1681845 - RNA, 18 nt, Human
guuaaucauuagguguga

SEQ ID NO: 1681846 - RNA, 18 nt, Human
guuagagauuuuuuuguu

SEQ ID NO: 1681847 - RNA, 19 nt, Human
guuagagguucccuuugac

SEQ ID NO: 1681848 - RNA, 19 nt, Human
guuauuauauuuacaaaug

SEQ ID NO: 1681849 - RNA, 20 nt, Human
guuauuauauuuacaaaugg

SEQ ID NO: 1681850 - RNA, 12 nt, Human
guguuugaagca

SEQ ID NO: 1681851 - RNA, 16 nt, Human
aagcacacuugacauc

SEQ ID NO: 1681852 - RNA, 14 nt, Human
aagcacaugccucu

SEQ ID NO: 1681853 - RNA, 15 nt, Human
aagcacaugccucuc

SEQ ID NO: 1681854 - RNA, 16 nt, Human
aagcacaugccucucu

SEQ ID NO: 1681855 - RNA, 19 nt, Human
aagcacaugccucucucag

SEQ ID NO: 1681856 - RNA, 20 nt, Human
aagcacaugccucucucagg

SEQ ID NO: 1681857 - RNA, 21 nt, Human
aagcacaugccucucucaggc

SEQ ID NO: 1681858 - RNA, 13 nt, Human
aagcaccuccugc

SEQ ID NO: 1681859 - RNA, 14 nt, Human
aagcaccuccugcc

SEQ ID NO: 1681860 - RNA, 15 nt, Human
aagcaccuccugccu

SEQ ID NO: 1681861 - RNA, 16 nt, Human
aagcaccuccugccuc

SEQ ID NO: 1681862 - RNA, 17 nt, Human
aagcaccuccugccucg

SEQ ID NO: 1681863 - RNA, 16 nt, Human
aagcacuaaacaaaga

SEQ ID NO: 1681864 - RNA, 16 nt, Human
aagcacugacuucuaa

SEQ ID NO: 1681865 - RNA, 17 nt, Human
aagcacugacuucuaag

SEQ ID NO: 1681866 - RNA, 23 nt, Human
aagcaugcacaaauucugucucu

SEQ ID NO: 1681867 - RNA, 12 nt, Human
aagcaugugaga

SEQ ID NO: 1681868 - RNA, 23 nt, Human
aagcauauauuuuuauauuuacu

SEQ ID NO: 1681869 - RNA, 19 nt, Human
aagcacugacuucuaagua

SEQ ID NO: 1681870 - RNA, 20 nt, Human
aagcacugacuucuaaguaa

SEQ ID NO: 1681871 - RNA, 15 nt, Human
aagccauguuuauua

SEQ ID NO: 1681872 - RNA, 16 nt, Human
aagccauguuuauuac

SEQ ID NO: 1681873 - RNA, 17 nt, Human
aagccauguuuauuaca

SEQ ID NO: 1681874 - RNA, 17 nt, Human
aagccaaagcuaggccu

SEQ ID NO: 1681875 - RNA, 18 nt, Human
aagccaaagcuaggccug

SEQ ID NO: 1681876 - RNA, 20 nt, Human
aagccaaagcuaggccuggc

SEQ ID NO: 1681877 - RNA, 19 nt, Human
aagcauuguaaaugugcuu

SEQ ID NO: 1681878 - RNA, 21 nt, Human
aagcauuuuauaaaucgcuuu

SEQ ID NO: 1681879 - RNA, 17 nt, Human
aagcauuuuauaaaucg

SEQ ID NO: 1681880 - RNA, 19 nt, Human
aagcauuuuauaaaucgcu

SEQ ID NO: 1681881 - RNA, 12 nt, Human
aagcauuuuaua

SEQ ID NO: 1681882 - RNA, 14 nt, Human
aagcauuuuauaaa

SEQ ID NO: 1681883 - RNA, 15 nt, Human
aagcauuuuauaaau

SEQ ID NO: 1681884 - RNA, 16 nt, Human
aagauggcugugccuc

SEQ ID NO: 1681885 - RNA, 23 nt, Human
aagaucaaaagguuaauaaagua

SEQ ID NO: 1681886 - RNA, 20 nt, Human
aagaucaaaagguuaauaaa

SEQ ID NO: 1681887 - RNA, 13 nt, Human
aagcaaaauguga

SEQ ID NO: 1681888 - RNA, 17 nt, Human
aagcaacccaaauguuc

SEQ ID NO: 1681889 - RNA, 14 nt, Human
gugucaccugaaga

SEQ ID NO: 1681890 - RNA, 22 nt, Human
gugucaccugaagacucauucu

SEQ ID NO: 1681891 - RNA, 14 nt, Human
gugucagguggggc

SEQ ID NO: 1681892 - RNA, 18 nt, Human
gugucagguggggcagcu

SEQ ID NO: 1681893 - RNA, 23 nt, Human
gugugaaccaccacacccagccc

SEQ ID NO: 1681894 - RNA, 20 nt, Human
gugucagguggggcagcuug

SEQ ID NO: 1681895 - RNA, 19 nt, Human
gugucagguggggcagcuu

SEQ ID NO: 1681896 - RNA, 22 nt, Human
gugucuuaauuaaaagaauauu

SEQ ID NO: 1681897 - RNA, 11 nt, Human
aagaggcaggg

SEQ ID NO: 1681898 - RNA, 14 nt, Human
aagaggcagggucu

SEQ ID NO: 1681899 - RNA, 21 nt, Human
aagagggagggagggcuccag

SEQ ID NO: 1681900 - RNA, 22 nt, Human
aagagggagggagggcuccaga

SEQ ID NO: 1681901 - RNA, 15 nt, Human
aagauagcagggcau

SEQ ID NO: 1681902 - RNA, 23 nt, Human
gugcugcccugcccaccuggccu

SEQ ID NO: 1681903 - RNA, 15 nt, Human
gugguuucagaaaug

SEQ ID NO: 1681904 - RNA, 18 nt, Human
guguaaauacaauuuugu

SEQ ID NO: 1681905 - RNA, 21 nt, Human
guguaaauacaauuuuguuuc

SEQ ID NO: 1681906 - RNA, 22 nt, Human
guguaaauacaauuuuguuucu

SEQ ID NO: 1681907 - RNA, 23 nt, Human
cucuugagccuugaacuuugacc

SEQ ID NO: 1681908 - RNA, 18 nt, Human
cucuugagccuugaacuu

SEQ ID NO: 1681909 - RNA, 17 nt, Human
cucuugagccuugaacu

SEQ ID NO: 1681910 - RNA, 16 nt, Human
cucuugagccuugaac

SEQ ID NO: 1681911 - RNA, 21 nt, Human
cugaagcuaucguaaaauuaa

SEQ ID NO: 1681912 - RNA, 22 nt, Human
cugaagcuaucguaaaauuaag

SEQ ID NO: 1681913 - RNA, 23 nt, Human
cugaaggacauugcggacagcca

SEQ ID NO: 1681914 - RNA, 22 nt, Human
cugacaacacucauugaccuga

SEQ ID NO: 1681915 - RNA, 23 nt, Human
cugacaacacucauugaccugag

SEQ ID NO: 1681916 - RNA, 19 nt, Human
cugaaggccccgcccaggc

SEQ ID NO: 1681917 - RNA, 17 nt, Human
cugaaggcuggguucug

SEQ ID NO: 1681918 - RNA, 21 nt, Human
cugaaggccccgcccaggcuu

SEQ ID NO: 1681919 - RNA, 13 nt, Human
cucuugaugccug

SEQ ID NO: 1681920 - RNA, 15 nt, Human
cucuugaugccuggc

SEQ ID NO: 1681921 - RNA, 16 nt, Human
cucuugaugccuggcg

SEQ ID NO: 1681922 - RNA, 21 nt, Human
cucuugaugccuggcggggug

SEQ ID NO: 1681923 - RNA, 22 nt, Human
cugaaaauugaugggauuuggu

SEQ ID NO: 1681924 - RNA, 15 nt, Human
cugaaacaacaaaua

SEQ ID NO: 1681925 - RNA, 14 nt, Human
cucugcaggucccu

SEQ ID NO: 1681926 - RNA, 15 nt, Human
cucugcaggucccua

SEQ ID NO: 1681927 - RNA, 16 nt, Human
cucugcaggucccuaa

SEQ ID NO: 1681928 - RNA, 17 nt, Human
cucugcaggucccuaau

SEQ ID NO: 1681929 - RNA, 13 nt, Human
cucugcuccucuc

SEQ ID NO: 1681930 - RNA, 18 nt, Human
cucugcuccucuccccag

SEQ ID NO: 1681931 - RNA, 20 nt, Human
cucugcuccucuccccagca

SEQ ID NO: 1681932 - RNA, 13 nt, Human
cucugcagcaaua

SEQ ID NO: 1681933 - RNA, 21 nt, Human
cucugcacuccccugcugggu

SEQ ID NO: 1681934 - RNA, 20 nt, Human
cucugcacuccccugcuggg

SEQ ID NO: 1681935 - RNA, 14 nt, Human
cucugguccauaga

SEQ ID NO: 1681936 - RNA, 13 nt, Human
cucugcugacaga

SEQ ID NO: 1681937 - RNA, 14 nt, Human
cucugcugacagac

SEQ ID NO: 1681938 - RNA, 16 nt, Human
cucugcugacagacac

SEQ ID NO: 1681939 - RNA, 12 nt, Human
cucuguccaggc

SEQ ID NO: 1681940 - RNA, 15 nt, Human
cucugguuaucuaau

SEQ ID NO: 1681941 - RNA, 15 nt, Human
cucugguccauagag

SEQ ID NO: 1681942 - RNA, 16 nt, Human
cucuucaacugaccag

SEQ ID NO: 1681943 - RNA, 17 nt, Human
cucuucaacugaccagc

SEQ ID NO: 1681944 - RNA, 20 nt, Human
cucuucaacugaccagccuc

SEQ ID NO: 1681945 - RNA, 14 nt, Human
cucuucaaucucuu

SEQ ID NO: 1681946 - RNA, 19 nt, Human
cucuucagaucucuaacuu

SEQ ID NO: 1681947 - RNA, 18 nt, Human
cucuucagaucucuaacu

SEQ ID NO: 1681948 - RNA, 14 nt, Human
cucuuauugcccac

SEQ ID NO: 1681949 - RNA, 15 nt, Human
cucuuauugcccacg

SEQ ID NO: 1681950 - RNA, 19 nt, Human
cucuuauugcccacgcugg

SEQ ID NO: 1681951 - RNA, 20 nt, Human
cucuuauugcccacgcugga

SEQ ID NO: 1681952 - RNA, 13 nt, Human
cucuuauugccca

SEQ ID NO: 1681953 - RNA, 22 nt, Human
cucuuagaugcaguucugaaga

SEQ ID NO: 1681954 - RNA, 17 nt, Human
cugagaguagagucacu

SEQ ID NO: 1681955 - RNA, 21 nt, Human
cugagaggacuuuucuuugug

SEQ ID NO: 1681956 - RNA, 22 nt, Human
cugagaggacuuuucuuugugg

SEQ ID NO: 1681957 - RNA, 22 nt, Human
cugagacucgcgacaaugcaaa

SEQ ID NO: 1681958 - RNA, 21 nt, Human
cugagacucgcgacaaugcaa

SEQ ID NO: 1681959 - RNA, 23 nt, Human
cugagacagcccgggcucugccu

SEQ ID NO: 1681960 - RNA, 21 nt, Human
cugacccaugcugcccuguga

SEQ ID NO: 1681961 - RNA, 22 nt, Human
cugacccaugcugcccugugag

SEQ ID NO: 1681962 - RNA, 15 nt, Human
cugacaacagacuuc

SEQ ID NO: 1681963 - RNA, 18 nt, Human
cugacaacagacuucuga

SEQ ID NO: 1681964 - RNA, 19 nt, Human
cugacaacagacuucugaa

SEQ ID NO: 1681965 - RNA, 14 nt, Human
cugaguagcuggga

SEQ ID NO: 1681966 - RNA, 15 nt, Human
cugaguagcugggau

SEQ ID NO: 1681967 - RNA, 20 nt, Human
cugaguagcugggauuacag

SEQ ID NO: 1681968 - RNA, 22 nt, Human
cugaggacuuaaaauauuccug

SEQ ID NO: 1681969 - RNA, 14 nt, Human
cugaggaccagcca

SEQ ID NO: 1681970 - RNA, 20 nt, Human
cugaguacguugugcauuug

SEQ ID NO: 1681971 - RNA, 19 nt, Human
cugaguacguugugcauuu

SEQ ID NO: 1681972 - RNA, 17 nt, Human
cugaguacguugugcau

SEQ ID NO: 1681973 - RNA, 18 nt, Human
cugaguacguugugcauu

SEQ ID NO: 1681974 - RNA, 21 nt, Human
cugaguacguugugcauuugg

SEQ ID NO: 1681975 - RNA, 12 nt, Human
cugaggugggag

SEQ ID NO: 1681976 - RNA, 23 nt, Human
cugaggacacuaaccacgcugga

SEQ ID NO: 1681977 - RNA, 21 nt, Human
cugaggaauccagacccggcu

SEQ ID NO: 1681978 - RNA, 20 nt, Human
cugaggacacuaaccacgcu

SEQ ID NO: 1681979 - RNA, 17 nt, Human
cugaggaauccagaccc

SEQ ID NO: 1681980 - RNA, 20 nt, Human
cugaggaauccagacccggc

SEQ ID NO: 1681981 - RNA, 21 nt, Human
cugagaucaaaacgguuuuac

SEQ ID NO: 1681982 - RNA, 14 nt, Human
cugagcuuucugcu

SEQ ID NO: 1681983 - RNA, 15 nt, Human
cugagcuuucugcua

SEQ ID NO: 1681984 - RNA, 20 nt, Human
cuccuggggguucuuucuuc

SEQ ID NO: 1681985 - RNA, 22 nt, Human
cuccuggggguucuuucuuccu

SEQ ID NO: 1681986 - RNA, 18 nt, Human
cuccuggggguucuuucu

SEQ ID NO: 1681987 - RNA, 23 nt, Human
cuccuggggguucuuucuuccuc

SEQ ID NO: 1681988 - RNA, 13 nt, Human
cucgaacuggcug

SEQ ID NO: 1681989 - RNA, 14 nt, Human
cucgaacuggcugc

SEQ ID NO: 1681990 - RNA, 15 nt, Human
cucgaacuggcugca

SEQ ID NO: 1681991 - RNA, 16 nt, Human
cucgaacuggcugcaa

SEQ ID NO: 1681992 - RNA, 15 nt, Human
cucuaucaccaagga

SEQ ID NO: 1681993 - RNA, 14 nt, Human
cucguuaauuugua

SEQ ID NO: 1681994 - RNA, 13 nt, Human
cucccccaucucu

SEQ ID NO: 1681995 - RNA, 22 nt, Human
cucccccagccccauccucugu

SEQ ID NO: 1681996 - RNA, 15 nt, Human
cucccccagccccau

SEQ ID NO: 1681997 - RNA, 20 nt, Human
cucccccagccccauccucu

SEQ ID NO: 1681998 - RNA, 18 nt, Human
cuccucuucaacugacca

SEQ ID NO: 1681999 - RNA, 23 nt, Human
cuccucuucaacugaccagccuc

SEQ ID NO: 1682000 - RNA, 15 nt, Human
cuccuggacuccugc

SEQ ID NO: 1682001 - RNA, 20 nt, Human
cuccucugcuugccaucccu

SEQ ID NO: 1682002 - RNA, 17 nt, Human
cuccucugcuugccauc

SEQ ID NO: 1682003 - RNA, 16 nt, Human
cuccucugcuugccau

SEQ ID NO: 1682004 - RNA, 15 nt, Human
cuccucugcuugcca

SEQ ID NO: 1682005 - RNA, 22 nt, Human
cuccucugcuugccaucccucc

SEQ ID NO: 1682006 - RNA, 21 nt, Human
cuccucugcuugccaucccuc

SEQ ID NO: 1682007 - RNA, 22 nt, Human
cuccugggcagcugccuccccu

SEQ ID NO: 1682008 - RNA, 19 nt, Human
cuccugggcagcugccucc

SEQ ID NO: 1682009 - RNA, 18 nt, Human
cuccugggcagcugccuc

SEQ ID NO: 1682010 - RNA, 17 nt, Human
cuccugggcagcugccu

SEQ ID NO: 1682011 - RNA, 16 nt, Human
cuccugggcagcugcc

SEQ ID NO: 1682012 - RNA, 15 nt, Human
cuccugggcagcugc

SEQ ID NO: 1682013 - RNA, 14 nt, Human
cuccugggcagcug

SEQ ID NO: 1682014 - RNA, 16 nt, Human
cuccuggcccacugca

SEQ ID NO: 1682015 - RNA, 18 nt, Human
cuccuggcccacugcauc

SEQ ID NO: 1682016 - RNA, 12 nt, Human
cuccugggcagc

SEQ ID NO: 1682017 - RNA, 13 nt, Human
cuccucucugccc

SEQ ID NO: 1682018 - RNA, 14 nt, Human
cuccucucugcccu

SEQ ID NO: 1682019 - RNA, 15 nt, Human
cuccucucugcccua

SEQ ID NO: 1682020 - RNA, 19 nt, Human
cuccucucugcccuaaugc

SEQ ID NO: 1682021 - RNA, 16 nt, Human
cuccucugcugcuggc

SEQ ID NO: 1682022 - RNA, 18 nt, Human
cuccucugcugcuggcug

SEQ ID NO: 1682023 - RNA, 14 nt, Human
cuccucugcuugcc

SEQ ID NO: 1682024 - RNA, 12 nt, Human
cuccucugcuug

SEQ ID NO: 1682025 - RNA, 13 nt, Human
cucagucucccuc

SEQ ID NO: 1682026 - RNA, 15 nt, Human
cucagucucccuccc

SEQ ID NO: 1682027 - RNA, 16 nt, Human
cucagucucccucccu

SEQ ID NO: 1682028 - RNA, 17 nt, Human
cucagucucccucccuu

SEQ ID NO: 1682029 - RNA, 16 nt, Human
cucaugccucagccuc

SEQ ID NO: 1682030 - RNA, 12 nt, Human
cucaugccucag

SEQ ID NO: 1682031 - RNA, 13 nt, Human
cuccaagaauuuc

SEQ ID NO: 1682032 - RNA, 14 nt, Human
cuccaagaauuucu

SEQ ID NO: 1682033 - RNA, 15 nt, Human
cuccaagaccuucuc

SEQ ID NO: 1682034 - RNA, 22 nt, Human
cuccaagaccuucuccuucacc

SEQ ID NO: 1682035 - RNA, 13 nt, Human
cuccaagcaggac

SEQ ID NO: 1682036 - RNA, 14 nt, Human
cuccaagcaggaca

SEQ ID NO: 1682037 - RNA, 22 nt, Human
cuccaagcaggacauggacaag

SEQ ID NO: 1682038 - RNA, 24 nt, Human
cuccaagcaggacauggacaagga

SEQ ID NO: 1682039 - RNA, 18 nt, Human
cuccaagcuccaucucca

SEQ ID NO: 1682040 - RNA, 19 nt, Human
cuccaagcuccaucuccac

SEQ ID NO: 1682041 - RNA, 14 nt, Human
cuccaagcuccauc

SEQ ID NO: 1682042 - RNA, 13 nt, Human
cuccaagcuccca

SEQ ID NO: 1682043 - RNA, 14 nt, Human
cuccaagcucccag

SEQ ID NO: 1682044 - RNA, 15 nt, Human
cuccaagcucccagg

SEQ ID NO: 1682045 - RNA, 16 nt, Human
cuccaagcucccaggc

SEQ ID NO: 1682046 - RNA, 16 nt, Human
cuccacuggauggagg

SEQ ID NO: 1682047 - RNA, 17 nt, Human
cuccaagcucccaggca

SEQ ID NO: 1682048 - RNA, 13 nt, Human
cuccacuuggucu

SEQ ID NO: 1682049 - RNA, 15 nt, Human
cuccacuuggucugu

SEQ ID NO: 1682050 - RNA, 16 nt, Human
cuccacuuggucugug

SEQ ID NO: 1682051 - RNA, 17 nt, Human
cuccacuuggucuguga

SEQ ID NO: 1682052 - RNA, 21 nt, Human
cuccacuuggucugugagaug

SEQ ID NO: 1682053 - RNA, 22 nt, Human
cuccacuuggucugugagaugc

SEQ ID NO: 1682054 - RNA, 20 nt, Human
cuccacuuucuagccagagg

SEQ ID NO: 1682055 - RNA, 16 nt, Human
cuccacuuucuagcca

SEQ ID NO: 1682056 - RNA, 19 nt, Human
cuccacuuucuagccagag

SEQ ID NO: 1682057 - RNA, 23 nt, Human
cuccacuuggucugugagaugcu

SEQ ID NO: 1682058 - RNA, 18 nt, Human
cuaucguaaaauuaagaa

SEQ ID NO: 1682059 - RNA, 17 nt, Human
cuaucguaaaauuaaga

SEQ ID NO: 1682060 - RNA, 14 nt, Human
cuaucuaaauguug

SEQ ID NO: 1682061 - RNA, 15 nt, Human
cuaucucccccagcc

SEQ ID NO: 1682062 - RNA, 22 nt, Human
cuaguuugauuaaauucuugca

SEQ ID NO: 1682063 - RNA, 15 nt, Human
cuaguuugauuaaau

SEQ ID NO: 1682064 - RNA, 13 nt, Human
cuaguuugauuaa

SEQ ID NO: 1682065 - RNA, 22 nt, Human
cuaguuguuugauucagacagc

SEQ ID NO: 1682066 - RNA, 23 nt, Human
cuaguuguuugauucagacagcu

SEQ ID NO: 1682067 - RNA, 12 nt, Human
cuagccagagga

SEQ ID NO: 1682068 - RNA, 13 nt, Human
cuagccagaggag

SEQ ID NO: 1682069 - RNA, 15 nt, Human
cuagccagaggagag

SEQ ID NO: 1682070 - RNA, 14 nt, Human
cucaauaaaguaca

SEQ ID NO: 1682071 - RNA, 20 nt, Human
cucaaacucuugaccucagg

SEQ ID NO: 1682072 - RNA, 11 nt, Human
cucacaaaaga

SEQ ID NO: 1682073 - RNA, 13 nt, Human
cucaaugcacuga

SEQ ID NO: 1682074 - RNA, 15 nt, Human
cucaaugcacugaca

SEQ ID NO: 1682075 - RNA, 18 nt, Human
cuaucucccccagcccca

SEQ ID NO: 1682076 - RNA, 16 nt, Human
cuaucucccccagccc

SEQ ID NO: 1682077 - RNA, 17 nt, Human
cuaucucccccagcccc

SEQ ID NO: 1682078 - RNA, 17 nt, Human
cucaaaaaaagaaaaag

SEQ ID NO: 1682079 - RNA, 21 nt, Human
cuauuuuuuuucuguuauaua

SEQ ID NO: 1682080 - RNA, 20 nt, Human
cuauuuuuuuucuguuauau

SEQ ID NO: 1682081 - RNA, 18 nt, Human
cucaaaagcugggcaggu

SEQ ID NO: 1682082 - RNA, 23 nt, Human
cucaaaauaccaugccauuuaaa

SEQ ID NO: 1682083 - RNA, 23 nt, Human
cuagaauuugauaugugaacagu

SEQ ID NO: 1682084 - RNA, 23 nt, Human
cuagcauacguacacauuuuauu

SEQ ID NO: 1682085 - RNA, 21 nt, Human
cuagcauacguacacauuuua

SEQ ID NO: 1682086 - RNA, 22 nt, Human
cuagaagauuuugaaauuuuua

SEQ ID NO: 1682087 - RNA, 12 nt, Human
cuagaacucccu

SEQ ID NO: 1682088 - RNA, 13 nt, Human
cuagaacucccuu

SEQ ID NO: 1682089 - RNA, 23 nt, Human
cuaaguuuuuauggcuuuugugc

SEQ ID NO: 1682090 - RNA, 20 nt, Human
cuaaguuuuuauggcuuuug

SEQ ID NO: 1682091 - RNA, 21 nt, Human
cuaagugguacuaacuuuccu

SEQ ID NO: 1682092 - RNA, 23 nt, Human
cuaagugauccucccaccucagc

SEQ ID NO: 1682093 - RNA, 22 nt, Human
cuaaguaaaaccacagcaguug

SEQ ID NO: 1682094 - RNA, 23 nt, Human
cuaaguaaaaccacagcaguuga

SEQ ID NO: 1682095 - RNA, 11 nt, Human
cgugugugugu

SEQ ID NO: 1682096 - RNA, 20 nt, Human
cuaaguaaaaccacagcagu

SEQ ID NO: 1682097 - RNA, 17 nt, Human
cuacguuaccaggcagg

SEQ ID NO: 1682098 - RNA, 17 nt, Human
cuaccuuuguauucucu

SEQ ID NO: 1682099 - RNA, 20 nt, Human
cuacaugagguacugagagu

SEQ ID NO: 1682100 - RNA, 20 nt, Human
cuacaguccucccaucucac

SEQ ID NO: 1682101 - RNA, 21 nt, Human
cuacaguugaaaaacagcuga

SEQ ID NO: 1682102 - RNA, 22 nt, Human
cuacaguugaaaaacagcugag

SEQ ID NO: 1682103 - RNA, 18 nt, Human
cuacauacuauggaauuu

SEQ ID NO: 1682104 - RNA, 19 nt, Human
cuacaguccucccaucuca

SEQ ID NO: 1682105 - RNA, 18 nt, Human
cuacaaaaacacagcaag

SEQ ID NO: 1682106 - RNA, 16 nt, Human
cuacaaaaacacagca

SEQ ID NO: 1682107 - RNA, 17 nt, Human
cuacaaaaacacagcaa

SEQ ID NO: 1682108 - RNA, 15 nt, Human
cuacaaaaacacagc

SEQ ID NO: 1682109 - RNA, 16 nt, Human
cggagucccaccuugg

SEQ ID NO: 1682110 - RNA, 14 nt, Human
cggggacagcuccu

SEQ ID NO: 1682111 - RNA, 17 nt, Human
cgggcucugccucccau

SEQ ID NO: 1682112 - RNA, 15 nt, Human
cggggacagcuccuu

SEQ ID NO: 1682113 - RNA, 18 nt, Human
cgguguggagaagcggcu

SEQ ID NO: 1682114 - RNA, 17 nt, Human
cgggccacagagaaagu

SEQ ID NO: 1682115 - RNA, 11 nt, Human
cgggcucagca

SEQ ID NO: 1682116 - RNA, 15 nt, Human
cgggcucagcaaaag

SEQ ID NO: 1682117 - RNA, 14 nt, Human
cgggcucugccucc

SEQ ID NO: 1682118 - RNA, 16 nt, Human
cgggcucugccuccca

SEQ ID NO: 1682119 - RNA, 12 nt, Human
cgggccacagag

SEQ ID NO: 1682120 - RNA, 14 nt, Human
cgggccacagagaa

SEQ ID NO: 1682121 - RNA, 13 nt, Human
cggcuccaggcuc

SEQ ID NO: 1682122 - RNA, 14 nt, Human
cggcuccaggcucc

SEQ ID NO: 1682123 - RNA, 15 nt, Human
cggcuccaggcuccu

SEQ ID NO: 1682124 - RNA, 16 nt, Human
cggcuccaggcuccuu

SEQ ID NO: 1682125 - RNA, 18 nt, Human
cggagucccaccuuggcu

SEQ ID NO: 1682126 - RNA, 20 nt, Human
cggagucccaccuuggcugc

SEQ ID NO: 1682127 - RNA, 15 nt, Human
cggcucacugcagcc

SEQ ID NO: 1682128 - RNA, 16 nt, Human
cggcucacugcagccu

SEQ ID NO: 1682129 - RNA, 17 nt, Human
cggcucacugcagccuc

SEQ ID NO: 1682130 - RNA, 12 nt, Human
cggcuccaggcu

SEQ ID NO: 1682131 - RNA, 14 nt, Human
cgugcacacaccag

SEQ ID NO: 1682132 - RNA, 20 nt, Human
cguguaaccauggacccaau

SEQ ID NO: 1682133 - RNA, 17 nt, Human
cgugaguccuggcaugg

SEQ ID NO: 1682134 - RNA, 17 nt, Human
cgugaggccagagacac

SEQ ID NO: 1682135 - RNA, 16 nt, Human
cgugaguccuggcaug

SEQ ID NO: 1682136 - RNA, 14 nt, Human
cguaaaauuaagaa

SEQ ID NO: 1682137 - RNA, 23 nt, Human
cgguguuuaagacauuuuuggaa

SEQ ID NO: 1682138 - RNA, 16 nt, Human
cgguuuuacugcagcu

SEQ ID NO: 1682139 - RNA, 19 nt, Human
cgacccuugccgucuaccu

SEQ ID NO: 1682140 - RNA, 20 nt, Human
cgacccuugccgucuaccug

SEQ ID NO: 1682141 - RNA, 17 nt, Human
cgacugcccggcagggu

SEQ ID NO: 1682142 - RNA, 15 nt, Human
ccuuuuucauuauuu

SEQ ID NO: 1682143 - RNA, 16 nt, Human
ccuuuuuuaaauaaau

SEQ ID NO: 1682144 - RNA, 21 nt, Human
ccuuuuuuagaguugauacua

SEQ ID NO: 1682145 - RNA, 14 nt, Human
cgacagccuggcac

SEQ ID NO: 1682146 - RNA, 12 nt, Human
cgacagccuggc

SEQ ID NO: 1682147 - RNA, 13 nt, Human
cgacagccuggca

SEQ ID NO: 1682148 - RNA, 13 nt, Human
cgacaaugcaaac

SEQ ID NO: 1682149 - RNA, 12 nt, Human
cgacaaugcaaa

SEQ ID NO: 1682150 - RNA, 16 nt, Human
ccuugccgucuaccug

SEQ ID NO: 1682151 - RNA, 17 nt, Human
ccuugccgucuaccuga

SEQ ID NO: 1682152 - RNA, 15 nt, Human
ccuuucacaaccuuc

SEQ ID NO: 1682153 - RNA, 21 nt, Human
ccuuucaauaggaaaaacuga

SEQ ID NO: 1682154 - RNA, 15 nt, Human
ccuuuugagugccuu

SEQ ID NO: 1682155 - RNA, 17 nt, Human
ccuuuugagugccuuac

SEQ ID NO: 1682156 - RNA, 12 nt, Human
ccuuucauauuu

SEQ ID NO: 1682157 - RNA, 16 nt, Human
cgagucucuucuccac

SEQ ID NO: 1682158 - RNA, 14 nt, Human
cgauagugguggug

SEQ ID NO: 1682159 - RNA, 13 nt, Human
cgcaggcuggccc

SEQ ID NO: 1682160 - RNA, 22 nt, Human
cgcaggauucuuccucccuccc

SEQ ID NO: 1682161 - RNA, 18 nt, Human
cgcaggcccccaggugcc

SEQ ID NO: 1682162 - RNA, 13 nt, Human
cgccucugcauuc

SEQ ID NO: 1682163 - RNA, 17 nt, Human
cgccagauucuuuccug

SEQ ID NO: 1682164 - RNA, 11 nt, Human
ccucuuucccu

SEQ ID NO: 1682165 - RNA, 19 nt, Human
ccugccucgaacuggcugc

SEQ ID NO: 1682166 - RNA, 21 nt, Human
ccugccucgaacuggcugcaa

SEQ ID NO: 1682167 - RNA, 23 nt, Human
ccugccucgaacuggcugcaaag

SEQ ID NO: 1682168 - RNA, 17 nt, Human
ccugcugcaguugccag

SEQ ID NO: 1682169 - RNA, 19 nt, Human
ccugcugcaguugccaguc

SEQ ID NO: 1682170 - RNA, 21 nt, Human
ccugcugcaguugccagucac

SEQ ID NO: 1682171 - RNA, 20 nt, Human
ccugcugcaguugccaguca

SEQ ID NO: 1682172 - RNA, 13 nt, Human
ccugcccaggccc

SEQ ID NO: 1682173 - RNA, 17 nt, Human
ccugccccagggcuccc

SEQ ID NO: 1682174 - RNA, 12 nt, Human
ccugcccaccug

SEQ ID NO: 1682175 - RNA, 13 nt, Human
ccugcccaccugg

SEQ ID NO: 1682176 - RNA, 14 nt, Human
ccugcccaccuggc

SEQ ID NO: 1682177 - RNA, 20 nt, Human
ccugcccaccuggccucugc

SEQ ID NO: 1682178 - RNA, 16 nt, Human
ccugcacuugcagacu

SEQ ID NO: 1682179 - RNA, 17 nt, Human
ccugcacuugcagacuc

SEQ ID NO: 1682180 - RNA, 18 nt, Human
ccugcacuugcagacucu

SEQ ID NO: 1682181 - RNA, 19 nt, Human
ccugcacuugcagacucua

SEQ ID NO: 1682182 - RNA, 21 nt, Human
ccugaguagcugggauuacag

SEQ ID NO: 1682183 - RNA, 16 nt, Human
ccucuuucccucccuu

SEQ ID NO: 1682184 - RNA, 13 nt, Human
ccucuuucccucc

SEQ ID NO: 1682185 - RNA, 22 nt, Human
ccuggccuagcauacguacaca

SEQ ID NO: 1682186 - RNA, 22 nt, Human
ccuggccucaagugauucuccu

SEQ ID NO: 1682187 - RNA, 20 nt, Human
ccuggccucugcacuccccu

SEQ ID NO: 1682188 - RNA, 21 nt, Human
ccuggccucugcacuccccug

SEQ ID NO: 1682189 - RNA, 20 nt, Human
ccugggccccaguuguauuu

SEQ ID NO: 1682190 - RNA, 22 nt, Human
ccuggccucugcacuccccugc

SEQ ID NO: 1682191 - RNA, 16 nt, Human
ccugugaacugaacuc

SEQ ID NO: 1682192 - RNA, 17 nt, Human
ccugugaacugaacucu

SEQ ID NO: 1682193 - RNA, 18 nt, Human
ccugugacuucagcucug

SEQ ID NO: 1682194 - RNA, 19 nt, Human
ccugucuugccuuuuucau

SEQ ID NO: 1682195 - RNA, 20 nt, Human
ccugucuugccuuuuucauu

SEQ ID NO: 1682196 - RNA, 17 nt, Human
ccugucuugccuuuuuc

SEQ ID NO: 1682197 - RNA, 15 nt, Human
ccugucuaaugaaac

SEQ ID NO: 1682198 - RNA, 22 nt, Human
ccugucuaaugaaaccuguguc

SEQ ID NO: 1682199 - RNA, 18 nt, Human
ccugggggcugggcagag

SEQ ID NO: 1682200 - RNA, 21 nt, Human
ccugguggcagugggagcugc

SEQ ID NO: 1682201 - RNA, 13 nt, Human
ccugguuuccugc

SEQ ID NO: 1682202 - RNA, 14 nt, Human
ccugguuuccugcc

SEQ ID NO: 1682203 - RNA, 16 nt, Human
ccugguuuccugcccu

SEQ ID NO: 1682204 - RNA, 15 nt, Human
ccugguuuccugccc

SEQ ID NO: 1682205 - RNA, 19 nt, Human
ccuguccugccuaaggcug

SEQ ID NO: 1682206 - RNA, 17 nt, Human
ccuguccugccuaaggc

SEQ ID NO: 1682207 - RNA, 15 nt, Human
ccuguaaucacagcu

SEQ ID NO: 1682208 - RNA, 17 nt, Human
cccugugauggggcccu

SEQ ID NO: 1682209 - RNA, 18 nt, Human
cccugugauggggcccug

SEQ ID NO: 1682210 - RNA, 19 nt, Human
cccugugauggggcccugc

SEQ ID NO: 1682211 - RNA, 20 nt, Human
cccugugauggggcccugcc

SEQ ID NO: 1682212 - RNA, 13 nt, Human
cccuucgcuccug

SEQ ID NO: 1682213 - RNA, 16 nt, Human
cccugucuaaugaaac

SEQ ID NO: 1682214 - RNA, 20 nt, Human
cccugucucaaaaaaagaaa

SEQ ID NO: 1682215 - RNA, 23 nt, Human
cccugucucaaaaaaagaaaaag

SEQ ID NO: 1682216 - RNA, 13 nt, Human
ccggccccugcug

SEQ ID NO: 1682217 - RNA, 14 nt, Human
cccuucgcuccugu

SEQ ID NO: 1682218 - RNA, 15 nt, Human
cccuucgcuccugug

SEQ ID NO: 1682219 - RNA, 21 nt, Human
cccuucucuccagccccugga

SEQ ID NO: 1682220 - RNA, 22 nt, Human
cccuucucuccagccccuggau

SEQ ID NO: 1682221 - RNA, 14 nt, Human
ccggccccugcugg

SEQ ID NO: 1682222 - RNA, 16 nt, Human
ccucccaucucacaca

SEQ ID NO: 1682223 - RNA, 13 nt, Human
ccucccaucucac

SEQ ID NO: 1682224 - RNA, 23 nt, Human
ccucauuuuugaauacaggcaua

SEQ ID NO: 1682225 - RNA, 15 nt, Human
ccucccaccucagcc

SEQ ID NO: 1682226 - RNA, 17 nt, Human
ccucccaccucagccuc

SEQ ID NO: 1682227 - RNA, 23 nt, Human
ccucauggaauuggagcucgugg

SEQ ID NO: 1682228 - RNA, 20 nt, Human
ccuauuuuuuuucuguuaua

SEQ ID NO: 1682229 - RNA, 23 nt, Human
cccauaauuuuuuuuuuccuuuu

SEQ ID NO: 1682230 - RNA, 22 nt, Human
cccauaauuuuuuuuuuccuuu

SEQ ID NO: 1682231 - RNA, 23 nt, Human
cccauucugccugcccaggcccc

SEQ ID NO: 1682232 - RNA, 21 nt, Human
ccccagauugcaacaggcugg

SEQ ID NO: 1682233 - RNA, 22 nt, Human
ccccagauugcaacaggcuggg

SEQ ID NO: 1682234 - RNA, 23 nt, Human
ccccagauugcaacaggcugggc

SEQ ID NO: 1682235 - RNA, 17 nt, Human
ccccagcaagugagagc

SEQ ID NO: 1682236 - RNA, 22 nt, Human
ccccauccucuguacagagccc

SEQ ID NO: 1682237 - RNA, 19 nt, Human
ccccauccucuguacagag

SEQ ID NO: 1682238 - RNA, 21 nt, Human
ccccauccucuguacagagcc

SEQ ID NO: 1682239 - RNA, 19 nt, Human
ccccagcaagugagagcug

SEQ ID NO: 1682240 - RNA, 20 nt, Human
ccccagcaagugagagcugg

SEQ ID NO: 1682241 - RNA, 21 nt, Human
ccccagcaagugagagcuggg

SEQ ID NO: 1682242 - RNA, 21 nt, Human
cccauucugccugcccaggcc

SEQ ID NO: 1682243 - RNA, 22 nt, Human
cccauucugccugcccaggccc

SEQ ID NO: 1682244 - RNA, 17 nt, Human
cccagcccacuucugcc

SEQ ID NO: 1682245 - RNA, 14 nt, Human
cccagcccacuucu

SEQ ID NO: 1682246 - RNA, 23 nt, Human
cccaggaaaggcuccaggagcag

SEQ ID NO: 1682247 - RNA, 21 nt, Human
cccaggaaaggcuccaggagc

SEQ ID NO: 1682248 - RNA, 22 nt, Human
cccaggaaaggcuccaggagca

SEQ ID NO: 1682249 - RNA, 22 nt, Human
cccagcuuaaaggggcuagagu

SEQ ID NO: 1682250 - RNA, 19 nt, Human
cccaggaaaggcuccagga

SEQ ID NO: 1682251 - RNA, 21 nt, Human
cccagcugugcucuggacagg

SEQ ID NO: 1682252 - RNA, 23 nt, Human
cccagcugugcucuggacaggca

SEQ ID NO: 1682253 - RNA, 18 nt, Human
cccaggaauggagccugc

SEQ ID NO: 1682254 - RNA, 19 nt, Human
cccaggaauggagccugca

SEQ ID NO: 1682255 - RNA, 20 nt, Human
cccaggaauggagccugcac

SEQ ID NO: 1682256 - RNA, 22 nt, Human
cccaggaauggagccugcacgg

SEQ ID NO: 1682257 - RNA, 15 nt, Human
cccaggcuuagucac

SEQ ID NO: 1682258 - RNA, 20 nt, Human
cccaggcuuagucacugaga

SEQ ID NO: 1682259 - RNA, 13 nt, Human
cccucagagccac

SEQ ID NO: 1682260 - RNA, 17 nt, Human
ccccuucugacccaugc

SEQ ID NO: 1682261 - RNA, 12 nt, Human
cccgggaagggg

SEQ ID NO: 1682262 - RNA, 12 nt, Human
cccggcugcccu

SEQ ID NO: 1682263 - RNA, 13 nt, Human
cccggcugcccuu

SEQ ID NO: 1682264 - RNA, 12 nt, Human
cccggcugcgga

SEQ ID NO: 1682265 - RNA, 15 nt, Human
ccccauucugccugc

SEQ ID NO: 1682266 - RNA, 13 nt, Human
ccccauucugccu

SEQ ID NO: 1682267 - RNA, 14 nt, Human
ccccauucugccug

SEQ ID NO: 1682268 - RNA, 19 nt, Human
ccccuucgcuccugugucu

SEQ ID NO: 1682269 - RNA, 14 nt, Human
ccccuucgcuccug

SEQ ID NO: 1682270 - RNA, 15 nt, Human
ccccuucgcuccugu

SEQ ID NO: 1682271 - RNA, 17 nt, Human
ccccuucgcuccugugu

SEQ ID NO: 1682272 - RNA, 15 nt, Human
ccccugcaaagccca

SEQ ID NO: 1682273 - RNA, 16 nt, Human
ccccugcaaagcccag

SEQ ID NO: 1682274 - RNA, 17 nt, Human
ccccugcaaagcccagc

SEQ ID NO: 1682275 - RNA, 18 nt, Human
ccccugcacuccagccug

SEQ ID NO: 1682276 - RNA, 15 nt, Human
ccagcagauuauuca

SEQ ID NO: 1682277 - RNA, 21 nt, Human
ccagccccuggaugcagccuc

SEQ ID NO: 1682278 - RNA, 10 nt, Human
ccagccccuu

SEQ ID NO: 1682279 - RNA, 16 nt, Human
ccagcagauuauucac

SEQ ID NO: 1682280 - RNA, 15 nt, Human
ccagcagccuggacc

SEQ ID NO: 1682281 - RNA, 19 nt, Human
ccagcagccuggacccugu

SEQ ID NO: 1682282 - RNA, 20 nt, Human
ccagcagccuggacccugug

SEQ ID NO: 1682283 - RNA, 18 nt, Human
ccagcuugaaaccuucac

SEQ ID NO: 1682284 - RNA, 20 nt, Human
ccagcuugaaaccuucacuu

SEQ ID NO: 1682285 - RNA, 21 nt, Human
ccaggaaaggcuccaggagca

SEQ ID NO: 1682286 - RNA, 22 nt, Human
ccaggaaaggcuccaggagcag

SEQ ID NO: 1682287 - RNA, 23 nt, Human
ccaggaaaggcuccaggagcagc

SEQ ID NO: 1682288 - RNA, 23 nt, Human
ccagcagagcaccuuagacaguc

SEQ ID NO: 1682289 - RNA, 19 nt, Human
ccagcagagcaccuuagac

SEQ ID NO: 1682290 - RNA, 14 nt, Human
ccagucccccugcc

SEQ ID NO: 1682291 - RNA, 20 nt, Human
ccaguauuguacaaaguauu

SEQ ID NO: 1682292 - RNA, 22 nt, Human
ccaguauuguacaaaguauuaa

SEQ ID NO: 1682293 - RNA, 12 nt, Human
ccagucaccccg

SEQ ID NO: 1682294 - RNA, 13 nt, Human
ccagucaccccgg

SEQ ID NO: 1682295 - RNA, 20 nt, Human
ccagucaccccggccaccug

SEQ ID NO: 1682296 - RNA, 21 nt, Human
ccagucaccccggccaccugc

SEQ ID NO: 1682297 - RNA, 15 nt, Human
ccaggcugggagagc

SEQ ID NO: 1682298 - RNA, 17 nt, Human
ccaggcugggagagccu

SEQ ID NO: 1682299 - RNA, 18 nt, Human
ccaggcugggagagccuu

SEQ ID NO: 1682300 - RNA, 21 nt, Human
ccaggcugggagagccuucca

SEQ ID NO: 1682301 - RNA, 23 nt, Human
ccaggcugggagagccuuccagg

SEQ ID NO: 1682302 - RNA, 22 nt, Human
ccaggcugggagagccuuccag

SEQ ID NO: 1682303 - RNA, 17 nt, Human
ccaggcaacuugggaac

SEQ ID NO: 1682304 - RNA, 13 nt, Human
ccaggcugggaga

SEQ ID NO: 1682305 - RNA, 14 nt, Human
ccaggcugggagag

SEQ ID NO: 1682306 - RNA, 22 nt, Human
ccaggauguacaaggacagccc

SEQ ID NO: 1682307 - RNA, 16 nt, Human
ccauccccuguagagu

SEQ ID NO: 1682308 - RNA, 22 nt, Human
ccauccccuguagagugggagc

SEQ ID NO: 1682309 - RNA, 14 nt, Human
ccaugagccucagc

SEQ ID NO: 1682310 - RNA, 18 nt, Human
ccaugagccucagcaucc

SEQ ID NO: 1682311 - RNA, 19 nt, Human
ccaugagccucagcauccu

SEQ ID NO: 1682312 - RNA, 13 nt, Human
ccaugaguccccu

SEQ ID NO: 1682313 - RNA, 14 nt, Human
ccaugaguccccug

SEQ ID NO: 1682314 - RNA, 15 nt, Human
ccaugaguccccugu

SEQ ID NO: 1682315 - RNA, 16 nt, Human
ccaugaguccccuguu

SEQ ID NO: 1682316 - RNA, 13 nt, Human
ccaugggccuccu

SEQ ID NO: 1682317 - RNA, 16 nt, Human
ccaguuuuguuuggac

SEQ ID NO: 1682318 - RNA, 19 nt, Human
ccaguuuuguuuggaccaa

SEQ ID NO: 1682319 - RNA, 23 nt, Human
ccaucccaaacccuucagugcca

SEQ ID NO: 1682320 - RNA, 12 nt, Human
ccaucccagccc

SEQ ID NO: 1682321 - RNA, 13 nt, Human
ccaucccagcccc

SEQ ID NO: 1682322 - RNA, 20 nt, Human
ccauaauuuuuuuuuuccuu

SEQ ID NO: 1682323 - RNA, 13 nt, Human
ccauacauuugug

SEQ ID NO: 1682324 - RNA, 14 nt, Human
ccauacauuugugu

SEQ ID NO: 1682325 - RNA, 17 nt, Human
ccaugggccuccugugu

SEQ ID NO: 1682326 - RNA, 14 nt, Human
ccaugggccuccug

SEQ ID NO: 1682327 - RNA, 15 nt, Human
ccaugggccuccugu

SEQ ID NO: 1682328 - RNA, 22 nt, Human
ccauuuaaagcuuauuaaaacu

SEQ ID NO: 1682329 - RNA, 15 nt, Human
cagauucuuuccuga

SEQ ID NO: 1682330 - RNA, 17 nt, Human
cagauucuuuccugagg

SEQ ID NO: 1682331 - RNA, 18 nt, Human
cagauucuuuccugaggc

SEQ ID NO: 1682332 - RNA, 19 nt, Human
cagauucuuuccugaggcu

SEQ ID NO: 1682333 - RNA, 19 nt, Human
cagauccccaagccuggca

SEQ ID NO: 1682334 - RNA, 15 nt, Human
cagauccccaagccu

SEQ ID NO: 1682335 - RNA, 13 nt, Human
cagauccuggaaa

SEQ ID NO: 1682336 - RNA, 12 nt, Human
cagauccuggaa

SEQ ID NO: 1682337 - RNA, 22 nt, Human
cagaggggguggccucccaacu

SEQ ID NO: 1682338 - RNA, 23 nt, Human
cagaggggguggccucccaacuc

SEQ ID NO: 1682339 - RNA, 21 nt, Human
cagaguaauccaagcaaaugu

SEQ ID NO: 1682340 - RNA, 15 nt, Human
cagagguccacaaca

SEQ ID NO: 1682341 - RNA, 20 nt, Human
cagagguccacaacacacag

SEQ ID NO: 1682342 - RNA, 17 nt, Human
cagagguugcagugagc

SEQ ID NO: 1682343 - RNA, 20 nt, Human
cagcaucauggagguuugaa

SEQ ID NO: 1682344 - RNA, 13 nt, Human
cagccaguaaaug

SEQ ID NO: 1682345 - RNA, 20 nt, Human
cagcacgauuucuguuuaga

SEQ ID NO: 1682346 - RNA, 19 nt, Human
cagcacgauuucuguuuag

SEQ ID NO: 1682347 - RNA, 18 nt, Human
cagcacgauuucuguuua

SEQ ID NO: 1682348 - RNA, 16 nt, Human
cagcacgauuucuguu

SEQ ID NO: 1682349 - RNA, 17 nt, Human
cagauugcaacaggcug

SEQ ID NO: 1682350 - RNA, 20 nt, Human
cagauucuuuccugaggcug

SEQ ID NO: 1682351 - RNA, 22 nt, Human
cagauucuuuccugaggcuggg

SEQ ID NO: 1682352 - RNA, 13 nt, Human
cagcauaauacuu

SEQ ID NO: 1682353 - RNA, 17 nt, Human
cagcauagaaguaacuu

SEQ ID NO: 1682354 - RNA, 13 nt, Human
cagcaguucagag

SEQ ID NO: 1682355 - RNA, 19 nt, Human
cagccgagauagccaaggc

SEQ ID NO: 1682356 - RNA, 20 nt, Human
cagccgagauagccaaggcc

SEQ ID NO: 1682357 - RNA, 19 nt, Human
cagccugcuaauuccccag

SEQ ID NO: 1682358 - RNA, 15 nt, Human
cagccugcuccagcu

SEQ ID NO: 1682359 - RNA, 12 nt, Human
cagccugcucca

SEQ ID NO: 1682360 - RNA, 18 nt, Human
cagcggggacagcuccuu

SEQ ID NO: 1682361 - RNA, 19 nt, Human
cagcggggacagcuccuuc

SEQ ID NO: 1682362 - RNA, 21 nt, Human
cagcggggacagcuccuucug

SEQ ID NO: 1682363 - RNA, 18 nt, Human
caggaaaagcugcugaca

SEQ ID NO: 1682364 - RNA, 15 nt, Human
caggaaaagcugcug

SEQ ID NO: 1682365 - RNA, 16 nt, Human
caggaaaagcugcuga

SEQ ID NO: 1682366 - RNA, 24 nt, Human
cagcugugcucuggacaggcaugu

SEQ ID NO: 1682367 - RNA, 15 nt, Human
cagcugccugggauc

SEQ ID NO: 1682368 - RNA, 20 nt, Human
cagcugugcucuggacaggc

SEQ ID NO: 1682369 - RNA, 12 nt, Human
cagcugccuggg

SEQ ID NO: 1682370 - RNA, 12 nt, Human
cagcugccugca

SEQ ID NO: 1682371 - RNA, 13 nt, Human
cagcugccuggga

SEQ ID NO: 1682372 - RNA, 14 nt, Human
cagcugccugggau

SEQ ID NO: 1682373 - RNA, 21 nt, Human
cagcuccccucggagaagagc

SEQ ID NO: 1682374 - RNA, 22 nt, Human
cagcuccccucggagaagagcu

SEQ ID NO: 1682375 - RNA, 15 nt, Human
caggccacuugauga

SEQ ID NO: 1682376 - RNA, 18 nt, Human
caggcagauacaggaaaa

SEQ ID NO: 1682377 - RNA, 13 nt, Human
caggccagaggga

SEQ ID NO: 1682378 - RNA, 15 nt, Human
caggccagagggagu

SEQ ID NO: 1682379 - RNA, 17 nt, Human
caggccagcugcuuggg

SEQ ID NO: 1682380 - RNA, 19 nt, Human
caggccagcugcuugggcu

SEQ ID NO: 1682381 - RNA, 21 nt, Human
caggccagcugcuugggcuuc

SEQ ID NO: 1682382 - RNA, 23 nt, Human
caggccagcugcuugggcuucau

SEQ ID NO: 1682383 - RNA, 17 nt, Human
caggccaggcccucugc

SEQ ID NO: 1682384 - RNA, 18 nt, Human
caggccaggcccucugcc

SEQ ID NO: 1682385 - RNA, 19 nt, Human
caggccaggcccucugccc

SEQ ID NO: 1682386 - RNA, 16 nt, Human
caggccagagggagug

SEQ ID NO: 1682387 - RNA, 20 nt, Human
caggccaggcccucugccca

SEQ ID NO: 1682388 - RNA, 20 nt, Human
caggggaaaaucagccugcu

SEQ ID NO: 1682389 - RNA, 19 nt, Human
caggggaaaaucagccugc

SEQ ID NO: 1682390 - RNA, 21 nt, Human
cagggcucagcggggacagcu

SEQ ID NO: 1682391 - RNA, 23 nt, Human
cagggcucagcggggacagcucc

SEQ ID NO: 1682392 - RNA, 21 nt, Human
caggcugggcuucaguggcag

SEQ ID NO: 1682393 - RNA, 22 nt, Human
caggcugggcuucaguggcagc

SEQ ID NO: 1682394 - RNA, 12 nt, Human
caggcugggaga

SEQ ID NO: 1682395 - RNA, 14 nt, Human
caggcugggagagc

SEQ ID NO: 1682396 - RNA, 15 nt, Human
caggcugggagagcc

SEQ ID NO: 1682397 - RNA, 20 nt, Human
caggcugggcuucaguggca

SEQ ID NO: 1682398 - RNA, 16 nt, Human
cagucaccucauggaa

SEQ ID NO: 1682399 - RNA, 15 nt, Human
cagucacauuccaag

SEQ ID NO: 1682400 - RNA, 14 nt, Human
cagucaccccggcc

SEQ ID NO: 1682401 - RNA, 19 nt, Human
cagucaccucauggaauug

SEQ ID NO: 1682402 - RNA, 21 nt, Human
caggugauccacccaccucag

SEQ ID NO: 1682403 - RNA, 15 nt, Human
caggugcacaagcuc

SEQ ID NO: 1682404 - RNA, 22 nt, Human
caggugauccacccaccucagc

SEQ ID NO: 1682405 - RNA, 23 nt, Human
caggugauccacccaccucagcc

SEQ ID NO: 1682406 - RNA, 17 nt, Human
caggugcacaagcucca

SEQ ID NO: 1682407 - RNA, 18 nt, Human
caggugcacaagcuccaa

SEQ ID NO: 1682408 - RNA, 19 nt, Human
caggugcacaagcuccaag

SEQ ID NO: 1682409 - RNA, 20 nt, Human
caggugcacaagcuccaagc

SEQ ID NO: 1682410 - RNA, 23 nt, Human
caguaaagaacaucccuccuggg

SEQ ID NO: 1682411 - RNA, 14 nt, Human
cagguuuaagcugu

SEQ ID NO: 1682412 - RNA, 12 nt, Human
cagguuuuccug

SEQ ID NO: 1682413 - RNA, 16 nt, Human
cagguuuuccugaaga

SEQ ID NO: 1682414 - RNA, 22 nt, Human
cagguugucugaagucacugca

SEQ ID NO: 1682415 - RNA, 23 nt, Human
cagguugucugaagucacugcac

SEQ ID NO: 1682416 - RNA, 22 nt, Human
caggugcacaagcuccaagcuc

SEQ ID NO: 1682417 - RNA, 21 nt, Human
caggugcacaagcuccaagcu

SEQ ID NO: 1682418 - RNA, 19 nt, Human
caggugccaguuauggcua

SEQ ID NO: 1682419 - RNA, 14 nt, Human
caguggggaaugaa

SEQ ID NO: 1682420 - RNA, 20 nt, Human
caguggggaggggcuguggg

SEQ ID NO: 1682421 - RNA, 18 nt, Human
caguggugguuuucuguu

SEQ ID NO: 1682422 - RNA, 21 nt, Human
caguggugcgaucuggguuca

SEQ ID NO: 1682423 - RNA, 16 nt, Human
cagugcaugcuguccc

SEQ ID NO: 1682424 - RNA, 17 nt, Human
cagugcaugcugucccu

SEQ ID NO: 1682425 - RNA, 13 nt, Human
cagugcccacagg

SEQ ID NO: 1682426 - RNA, 15 nt, Human
cagugcccacaggau

SEQ ID NO: 1682427 - RNA, 17 nt, Human
cagugcccacaggauca

SEQ ID NO: 1682428 - RNA, 20 nt, Human
cagugggagcugccuguuca

SEQ ID NO: 1682429 - RNA, 23 nt, Human
cagugggagcugccuguucagcu

SEQ ID NO: 1682430 - RNA, 18 nt, Human
cagugcccacaggaucag

SEQ ID NO: 1682431 - RNA, 15 nt, Human
cagugcaucucagcc

SEQ ID NO: 1682432 - RNA, 16 nt, Human
cagugcaucucagccc

SEQ ID NO: 1682433 - RNA, 17 nt, Human
cagugcaucucagccca

SEQ ID NO: 1682434 - RNA, 18 nt, Human
cagugcaucucagcccac

SEQ ID NO: 1682435 - RNA, 13 nt, Human
cagugcaugcugu

SEQ ID NO: 1682436 - RNA, 14 nt, Human
cagugcaugcuguc

SEQ ID NO: 1682437 - RNA, 15 nt, Human
cagucuggaaugcag

SEQ ID NO: 1682438 - RNA, 17 nt, Human
cagucuggaaugcagug

SEQ ID NO: 1682439 - RNA, 12 nt, Human
cagugcaucuca

SEQ ID NO: 1682440 - RNA, 18 nt, Human
cagucuggaaugcagugg

SEQ ID NO: 1682441 - RNA, 20 nt, Human
cagucugacuguuuccauca

SEQ ID NO: 1682442 - RNA, 17 nt, Human
ccacucccugcaaccug

SEQ ID NO: 1682443 - RNA, 13 nt, Human
ccaccgcagacag

SEQ ID NO: 1682444 - RNA, 22 nt, Human
ccaccgcagacaggaccaggga

SEQ ID NO: 1682445 - RNA, 21 nt, Human
ccaccuuugaagaaguaagga

SEQ ID NO: 1682446 - RNA, 23 nt, Human
ccaccuuucagauaacuguuauu

SEQ ID NO: 1682447 - RNA, 13 nt, Human
ccacgcccggcua

SEQ ID NO: 1682448 - RNA, 18 nt, Human
ccacgcccccacugguga

SEQ ID NO: 1682449 - RNA, 19 nt, Human
ccacgcccccacuggugac

SEQ ID NO: 1682450 - RNA, 16 nt, Human
ccacgcccccacuggu

SEQ ID NO: 1682451 - RNA, 17 nt, Human
ccacgcccccacuggug

SEQ ID NO: 1682452 - RNA, 17 nt, Human
ccaccacacccagccca

SEQ ID NO: 1682453 - RNA, 14 nt, Human
ccacagcugcucaa

SEQ ID NO: 1682454 - RNA, 13 nt, Human
ccaccaucaagcc

SEQ ID NO: 1682455 - RNA, 14 nt, Human
ccaccaucaagcca

SEQ ID NO: 1682456 - RNA, 15 nt, Human
ccaccaucaagccac

SEQ ID NO: 1682457 - RNA, 23 nt, Human
ccacagcaguugaaaagacucca

SEQ ID NO: 1682458 - RNA, 17 nt, Human
ccacagcaguugaaaag

SEQ ID NO: 1682459 - RNA, 18 nt, Human
ccacagcaguugaaaaga

SEQ ID NO: 1682460 - RNA, 12 nt, Human
ccacagcaguug

SEQ ID NO: 1682461 - RNA, 22 nt, Human
cauuuuuuuuaagaaaaaggau

SEQ ID NO: 1682462 - RNA, 20 nt, Human
ccaaaacucuccucugcugc

SEQ ID NO: 1682463 - RNA, 21 nt, Human
ccaaaacucuccucugcugcu

SEQ ID NO: 1682464 - RNA, 16 nt, Human
cauuuguguugaagag

SEQ ID NO: 1682465 - RNA, 20 nt, Human
cauuuguguugaagagguuu

SEQ ID NO: 1682466 - RNA, 19 nt, Human
cauuuguauaaaauaauuu

SEQ ID NO: 1682467 - RNA, 20 nt, Human
cauuuguauaaaauaauuuu

SEQ ID NO: 1682468 - RNA, 17 nt, Human
ccaaugggagcucaugg

SEQ ID NO: 1682469 - RNA, 17 nt, Human
ccaauauuuaccagacc

SEQ ID NO: 1682470 - RNA, 15 nt, Human
ccaaugauggucacc

SEQ ID NO: 1682471 - RNA, 14 nt, Human
ccaaugcacuuugu

SEQ ID NO: 1682472 - RNA, 18 nt, Human
ccaagcucugcuccucuc

SEQ ID NO: 1682473 - RNA, 12 nt, Human
ccaagcucugcu

SEQ ID NO: 1682474 - RNA, 13 nt, Human
ccaagcucugcuc

SEQ ID NO: 1682475 - RNA, 16 nt, Human
ccaacucaccccagcc

SEQ ID NO: 1682476 - RNA, 17 nt, Human
ccaacucaccccagccc

SEQ ID NO: 1682477 - RNA, 18 nt, Human
ccaacucaccccagcccc

SEQ ID NO: 1682478 - RNA, 18 nt, Human
ccaaauguucaucaauga

SEQ ID NO: 1682479 - RNA, 23 nt, Human
ccaaauggaaaugggcagagcag

SEQ ID NO: 1682480 - RNA, 14 nt, Human
ccaacucaccccag

SEQ ID NO: 1682481 - RNA, 17 nt, Human
ccaaauguucaucaaug

SEQ ID NO: 1682482 - RNA, 17 nt, Human
cauggcugccaauggga

SEQ ID NO: 1682483 - RNA, 14 nt, Human
caugggaaugaaug

SEQ ID NO: 1682484 - RNA, 15 nt, Human
caugggaaugaaugu

SEQ ID NO: 1682485 - RNA, 16 nt, Human
caugggaaugaauguc

SEQ ID NO: 1682486 - RNA, 17 nt, Human
caugggaaugaauguca

SEQ ID NO: 1682487 - RNA, 14 nt, Human
caugcuacacacug

SEQ ID NO: 1682488 - RNA, 23 nt, Human
caugcuacacacugcauguuugu

SEQ ID NO: 1682489 - RNA, 20 nt, Human
caugcuacacacugcauguu

SEQ ID NO: 1682490 - RNA, 13 nt, Human
caugauguuuucc

SEQ ID NO: 1682491 - RNA, 14 nt, Human
caugauguuuagaa

SEQ ID NO: 1682492 - RNA, 16 nt, Human
caugucccuaccgagu

SEQ ID NO: 1682493 - RNA, 22 nt, Human
caugucccuaccgagucucuuc

SEQ ID NO: 1682494 - RNA, 14 nt, Human
caugucaaacguga

SEQ ID NO: 1682495 - RNA, 19 nt, Human
caugucaaacgugaaaaug

SEQ ID NO: 1682496 - RNA, 18 nt, Human
cauguauuuguuugcaua

SEQ ID NO: 1682497 - RNA, 23 nt, Human
caugucccuaccgagucucuucu

SEQ ID NO: 1682498 - RNA, 16 nt, Human
cauguuggccaggcug

SEQ ID NO: 1682499 - RNA, 14 nt, Human
cauguuggccaggc

SEQ ID NO: 1682500 - RNA, 15 nt, Human
cauguuggccaggcu

SEQ ID NO: 1682501 - RNA, 13 nt, Human
cauucuccaccug

SEQ ID NO: 1682502 - RNA, 14 nt, Human
cauucuccaccugc

SEQ ID NO: 1682503 - RNA, 16 nt, Human
cauucuccaccugcca

SEQ ID NO: 1682504 - RNA, 12 nt, Human
cauccuggaaua

SEQ ID NO: 1682505 - RNA, 23 nt, Human
cauccuggcacccggccccugcu

SEQ ID NO: 1682506 - RNA, 22 nt, Human
cauccuggcacccggccccugc

SEQ ID NO: 1682507 - RNA, 15 nt, Human
cauccuggcacccgg

SEQ ID NO: 1682508 - RNA, 12 nt, Human
caucacuucccu

SEQ ID NO: 1682509 - RNA, 14 nt, Human
caucacuucccuac

SEQ ID NO: 1682510 - RNA, 22 nt, Human
caguggugguuuucuguucuuu

SEQ ID NO: 1682511 - RNA, 21 nt, Human
caguggugguuuucuguucuu

SEQ ID NO: 1682512 - RNA, 20 nt, Human
caguggugguuuucuguucu

SEQ ID NO: 1682513 - RNA, 19 nt, Human
caguggugguuuucuguuc

SEQ ID NO: 1682514 - RNA, 16 nt, Human
cauauuaccacagaca

SEQ ID NO: 1682515 - RNA, 17 nt, Human
cauauucuguuggccag

SEQ ID NO: 1682516 - RNA, 18 nt, Human
cauauucuguuggccagu

SEQ ID NO: 1682517 - RNA, 22 nt, Human
cacagcuaacauggaaguacua

SEQ ID NO: 1682518 - RNA, 20 nt, Human
cacagcucuguccugggagu

SEQ ID NO: 1682519 - RNA, 23 nt, Human
cacagcucuguccugggagugag

SEQ ID NO: 1682520 - RNA, 10 nt, Human
cacagcucuu

SEQ ID NO: 1682521 - RNA, 19 nt, Human
cacagacccugcccugugg

SEQ ID NO: 1682522 - RNA, 20 nt, Human
cacagacccugcccuguggg

SEQ ID NO: 1682523 - RNA, 21 nt, Human
cacagacccugcccugugggc

SEQ ID NO: 1682524 - RNA, 18 nt, Human
cacagacauacuaaccag

SEQ ID NO: 1682525 - RNA, 22 nt, Human
cacagacccugcccugugggcc

SEQ ID NO: 1682526 - RNA, 15 nt, Human
cacagcuaacaugga

SEQ ID NO: 1682527 - RNA, 16 nt, Human
cacagcuaacauggaa

SEQ ID NO: 1682528 - RNA, 16 nt, Human
cacaguauuacuucug

SEQ ID NO: 1682529 - RNA, 18 nt, Human
cacaguauuacuucugcu

SEQ ID NO: 1682530 - RNA, 19 nt, Human
cacaguauuacuucugcua

SEQ ID NO: 1682531 - RNA, 17 nt, Human
cacccagcccacuucug

SEQ ID NO: 1682532 - RNA, 23 nt, Human
caccaacauacucccaucuguga

SEQ ID NO: 1682533 - RNA, 14 nt, Human
caccagcagccugg

SEQ ID NO: 1682534 - RNA, 12 nt, Human
caccagcagccu

SEQ ID NO: 1682535 - RNA, 15 nt, Human
caccagcagccugga

SEQ ID NO: 1682536 - RNA, 24 nt, Human
cacccaggagccccgaggccuucu

SEQ ID NO: 1682537 - RNA, 19 nt, Human
cacccagcccacuucugcc

SEQ ID NO: 1682538 - RNA, 20 nt, Human
cacccaggagccccgaggcc

SEQ ID NO: 1682539 - RNA, 23 nt, Human
cacccaggagccccgaggccuuc

SEQ ID NO: 1682540 - RNA, 15 nt, Human
cacauuuuauuuuau

SEQ ID NO: 1682541 - RNA, 19 nt, Human
cacaucuugcucugcugac

SEQ ID NO: 1682542 - RNA, 18 nt, Human
cacaucuugcucugcuga

SEQ ID NO: 1682543 - RNA, 21 nt, Human
cacauuuuuuaaaugcaccug

SEQ ID NO: 1682544 - RNA, 17 nt, Human
cacauuuuuuaaaugca

SEQ ID NO: 1682545 - RNA, 14 nt, Human
cacauuuuucuuag

SEQ ID NO: 1682546 - RNA, 13 nt, Human
cacauuuuucuua

SEQ ID NO: 1682547 - RNA, 20 nt, Human
caccaacauacucccaucug

SEQ ID NO: 1682548 - RNA, 21 nt, Human
caccaacauacucccaucugu

SEQ ID NO: 1682549 - RNA, 21 nt, Human
cacaucagcacgauuucuguu

SEQ ID NO: 1682550 - RNA, 20 nt, Human
cacaucagcacgauuucugu

SEQ ID NO: 1682551 - RNA, 17 nt, Human
cacaucuugcucugcug

SEQ ID NO: 1682552 - RNA, 22 nt, Human
cacaucagcacgauuucuguuu

SEQ ID NO: 1682553 - RNA, 13 nt, Human
caauaaaaaauua

SEQ ID NO: 1682554 - RNA, 16 nt, Human
caauaaaaaauuauga

SEQ ID NO: 1682555 - RNA, 17 nt, Human
caauaaaaaauuaugac

SEQ ID NO: 1682556 - RNA, 14 nt, Human
caaguauuagaaua

SEQ ID NO: 1682557 - RNA, 13 nt, Human
caaguauuauacc

SEQ ID NO: 1682558 - RNA, 20 nt, Human
caaguauuagaauaccacag

SEQ ID NO: 1682559 - RNA, 14 nt, Human
cacaagccuucggc

SEQ ID NO: 1682560 - RNA, 16 nt, Human
cacaagacugcacauc

SEQ ID NO: 1682561 - RNA, 14 nt, Human
cacaagacccuugu

SEQ ID NO: 1682562 - RNA, 16 nt, Human
cacaagacccuugugg

SEQ ID NO: 1682563 - RNA, 12 nt, Human
caauuuaaaaaa

SEQ ID NO: 1682564 - RNA, 19 nt, Human
caauucuccugccucagcc

SEQ ID NO: 1682565 - RNA, 17 nt, Human
caauucuccugccucag

SEQ ID NO: 1682566 - RNA, 22 nt, Human
caaugcugugcccuaaagugua

SEQ ID NO: 1682567 - RNA, 12 nt, Human
caauauuucaga

SEQ ID NO: 1682568 - RNA, 20 nt, Human
caauauuucagauaaucaca

SEQ ID NO: 1682569 - RNA, 21 nt, Human
caauauuucagauaaucacaa

SEQ ID NO: 1682570 - RNA, 22 nt, Human
caaugcuggcuguuggcugggg

SEQ ID NO: 1682571 - RNA, 23 nt, Human
caaugcuggcuguuggcuggggg

SEQ ID NO: 1682572 - RNA, 14 nt, Human
caaugcuguauuuu

SEQ ID NO: 1682573 - RNA, 23 nt, Human
caaugcuguauuuuaaaagaaug

SEQ ID NO: 1682574 - RNA, 17 nt, Human
cacucuugaaaaaugca

SEQ ID NO: 1682575 - RNA, 17 nt, Human
cacucuuauugcccacg

SEQ ID NO: 1682576 - RNA, 18 nt, Human
cacucuuauugcccacgc

SEQ ID NO: 1682577 - RNA, 19 nt, Human
cacucuuauugcccacgcu

SEQ ID NO: 1682578 - RNA, 14 nt, Human
cacggccaggccag

SEQ ID NO: 1682579 - RNA, 15 nt, Human
cacggccaggccaga

SEQ ID NO: 1682580 - RNA, 16 nt, Human
cacggccaggccagag

SEQ ID NO: 1682581 - RNA, 20 nt, Human
cacggagggugacgggggug

SEQ ID NO: 1682582 - RNA, 17 nt, Human
cacggccaggccagagg

SEQ ID NO: 1682583 - RNA, 23 nt, Human
cacuacggaauaguuggcuagga

SEQ ID NO: 1682584 - RNA, 11 nt, Human
cacugaagaag

SEQ ID NO: 1682585 - RNA, 14 nt, Human
caccuuuauucugg

SEQ ID NO: 1682586 - RNA, 17 nt, Human
caccuuuguccccaccg

SEQ ID NO: 1682587 - RNA, 14 nt, Human
caccuuugucccca

SEQ ID NO: 1682588 - RNA, 15 nt, Human
caccuuuguccccac

SEQ ID NO: 1682589 - RNA, 17 nt, Human
caccugccagggacaga

SEQ ID NO: 1682590 - RNA, 19 nt, Human
caccuugacagggcacacc

SEQ ID NO: 1682591 - RNA, 14 nt, Human
caccuuggcucaag

SEQ ID NO: 1682592 - RNA, 13 nt, Human
caccuuggcucaa

SEQ ID NO: 1682593 - RNA, 21 nt, Human
caccuacaugagguacugaga

SEQ ID NO: 1682594 - RNA, 20 nt, Human
caccuaccaccacgcccggc

SEQ ID NO: 1682595 - RNA, 14 nt, Human
caccugccagggac

SEQ ID NO: 1682596 - RNA, 16 nt, Human
caccugccagggacag

SEQ ID NO: 1682597 - RNA, 23 nt, Human
caccucaaaauaccaugccauuu

SEQ ID NO: 1682598 - RNA, 17 nt, Human
cacuggugacaugucuu

SEQ ID NO: 1682599 - RNA, 13 nt, Human
cacugguggcccg

SEQ ID NO: 1682600 - RNA, 21 nt, Human
cacugguggcccgacagccug

SEQ ID NO: 1682601 - RNA, 22 nt, Human
cacugguggcccgacagccugg

SEQ ID NO: 1682602 - RNA, 15 nt, Human
cacuguugcccaggc

SEQ ID NO: 1682603 - RNA, 16 nt, Human
cacuguugcccaggcu

SEQ ID NO: 1682604 - RNA, 23 nt, Human
cacugggcuuggggaccagagcu

SEQ ID NO: 1682605 - RNA, 22 nt, Human
cacugggcuuggggaccagagc

SEQ ID NO: 1682606 - RNA, 17 nt, Human
cacuuagaaauugcauu

SEQ ID NO: 1682607 - RNA, 19 nt, Human
cacuuagaaauugcauuuc

SEQ ID NO: 1682608 - RNA, 17 nt, Human
cacuguugcccaggcug

SEQ ID NO: 1682609 - RNA, 19 nt, Human
cacuguuucaaacuuuacu

SEQ ID NO: 1682610 - RNA, 20 nt, Human
cacuuagaaauugcauuucc

SEQ ID NO: 1682611 - RNA, 20 nt, Human
cacuuggucugugagaugcu

SEQ ID NO: 1682612 - RNA, 15 nt, Human
cagaacacauaauuc

SEQ ID NO: 1682613 - RNA, 23 nt, Human
cagaaguuucugccgcagcccug

SEQ ID NO: 1682614 - RNA, 22 nt, Human
cagaaguuucugccgcagcccu

SEQ ID NO: 1682615 - RNA, 20 nt, Human
cagaaguuucugccgcagcc

SEQ ID NO: 1682616 - RNA, 21 nt, Human
cagaaguuucugccgcagccc

SEQ ID NO: 1682617 - RNA, 22 nt, Human
cagaauauuagugaccucagcu

SEQ ID NO: 1682618 - RNA, 22 nt, Human
caaauccagccugcugccugcu

SEQ ID NO: 1682619 - RNA, 16 nt, Human
caaaguauuaagcaua

SEQ ID NO: 1682620 - RNA, 17 nt, Human
caaaguauuaagcauau

SEQ ID NO: 1682621 - RNA, 19 nt, Human
caaaguauuaagcauauau

SEQ ID NO: 1682622 - RNA, 21 nt, Human
caaaguauuaagcauauauuu

SEQ ID NO: 1682623 - RNA, 17 nt, Human
caaaucagcugcuacua

SEQ ID NO: 1682624 - RNA, 20 nt, Human
caaaguacacuguuucaaac

SEQ ID NO: 1682625 - RNA, 16 nt, Human
caaaguacacuguuuc

SEQ ID NO: 1682626 - RNA, 14 nt, Human
caaaguauuaagca

SEQ ID NO: 1682627 - RNA, 15 nt, Human
caaaguauuaagcau

SEQ ID NO: 1682628 - RNA, 21 nt, Human
caaaguacacuguuucaaacu

SEQ ID NO: 1682629 - RNA, 13 nt, Human
caaagaugcagcc

SEQ ID NO: 1682630 - RNA, 14 nt, Human
caaagaugcagccg

SEQ ID NO: 1682631 - RNA, 13 nt, Human
caaaugcagcuuu

SEQ ID NO: 1682632 - RNA, 21 nt, Human
caaaucugcuuuuuaaagaau

SEQ ID NO: 1682633 - RNA, 23 nt, Human
caacaaaccuguuucugcagcca

SEQ ID NO: 1682634 - RNA, 22 nt, Human
caacaccucugcacaagcugca

SEQ ID NO: 1682635 - RNA, 20 nt, Human
caacaccuuguuucccucuc

SEQ ID NO: 1682636 - RNA, 15 nt, Human
caacacgagcaggcu

SEQ ID NO: 1682637 - RNA, 18 nt, Human
caaccacugcgaccacaa

SEQ ID NO: 1682638 - RNA, 16 nt, Human
caaccaccuuucagau

SEQ ID NO: 1682639 - RNA, 13 nt, Human
caagacacaguga

SEQ ID NO: 1682640 - RNA, 23 nt, Human
caagaauuucuaggacugaauua

SEQ ID NO: 1682641 - RNA, 23 nt, Human
caagacccuuguggucccacccc

SEQ ID NO: 1682642 - RNA, 22 nt, Human
caagacccuuguggucccaccc

SEQ ID NO: 1682643 - RNA, 18 nt, Human
caagacccuugugguccc

SEQ ID NO: 1682644 - RNA, 19 nt, Human
caagacccuugugguccca

SEQ ID NO: 1682645 - RNA, 17 nt, Human
caacucaccccagcccc

SEQ ID NO: 1682646 - RNA, 16 nt, Human
caacucaccccagccc

SEQ ID NO: 1682647 - RNA, 13 nt, Human
caacucaccccag

SEQ ID NO: 1682648 - RNA, 15 nt, Human
caacucaccccagcc

SEQ ID NO: 1682649 - RNA, 15 nt, Human
caacccccagccugc

SEQ ID NO: 1682650 - RNA, 16 nt, Human
caacccccagccugcu

SEQ ID NO: 1682651 - RNA, 17 nt, Human
caacccccagccugcua

SEQ ID NO: 1682652 - RNA, 18 nt, Human
caacuaugauuuggaaaa

SEQ ID NO: 1682653 - RNA, 19 nt, Human
caacuaugauuuggaaaau

SEQ ID NO: 1682654 - RNA, 22 nt, Human
caacuaugauuuggaaaauaaa

SEQ ID NO: 1682655 - RNA, 17 nt, Human
caacuaugauuuggaaa

SEQ ID NO: 1682656 - RNA, 21 nt, Human
caacuaucucauuuccaagca

SEQ ID NO: 1682657 - RNA, 14 nt, Human
caaccauuccccau

SEQ ID NO: 1682658 - RNA, 19 nt, Human
caacccaaauguucaucaa

SEQ ID NO: 1682659 - RNA, 18 nt, Human
auuuugauccaagcuggu

SEQ ID NO: 1682660 - RNA, 13 nt, Human
auuuguuugaacu

SEQ ID NO: 1682661 - RNA, 16 nt, Human
auuuguuugaacugau

SEQ ID NO: 1682662 - RNA, 14 nt, Human
auuuguuugaacug

SEQ ID NO: 1682663 - RNA, 20 nt, Human
auuuguuugaacugauaaag

SEQ ID NO: 1682664 - RNA, 15 nt, Human
auuuuauaaaucgcu

SEQ ID NO: 1682665 - RNA, 16 nt, Human
auuuuauaaaucgcuu

SEQ ID NO: 1682666 - RNA, 17 nt, Human
auuuuauaaaucgcuuu

SEQ ID NO: 1682667 - RNA, 17 nt, Human
auuuuauagcuacuaau

SEQ ID NO: 1682668 - RNA, 20 nt, Human
auuuuauaaaucgcuuuuga

SEQ ID NO: 1682669 - RNA, 21 nt, Human
auuuuauaaaucgcuuuugau

SEQ ID NO: 1682670 - RNA, 23 nt, Human
auuuuauaaaucgcuuuugauaa

SEQ ID NO: 1682671 - RNA, 15 nt, Human
caaaagcugggcagg

SEQ ID NO: 1682672 - RNA, 19 nt, Human
caaaagcugggcagguugg

SEQ ID NO: 1682673 - RNA, 12 nt, Human
auuuuuuuuucc

SEQ ID NO: 1682674 - RNA, 13 nt, Human
auuuuuuuuuccu

SEQ ID NO: 1682675 - RNA, 16 nt, Human
auuuuuuuuuccuuca

SEQ ID NO: 1682676 - RNA, 13 nt, Human
auuuuuaagugcu

SEQ ID NO: 1682677 - RNA, 17 nt, Human
auuuuuuuuuccuucag

SEQ ID NO: 1682678 - RNA, 18 nt, Human
auugauccagaaagaaaa

SEQ ID NO: 1682679 - RNA, 19 nt, Human
auugauccagaaagaaaac

SEQ ID NO: 1682680 - RNA, 22 nt, Human
auugauccagaaagaaaacuug

SEQ ID NO: 1682681 - RNA, 18 nt, Human
auugaugggauuugguca

SEQ ID NO: 1682682 - RNA, 13 nt, Human
auuguaaaauggu

SEQ ID NO: 1682683 - RNA, 15 nt, Human
auuguaaggaaugau

SEQ ID NO: 1682684 - RNA, 16 nt, Human
auuguaaggaaugauu

SEQ ID NO: 1682685 - RNA, 23 nt, Human
auuguaauaggcguaacuaauuu

SEQ ID NO: 1682686 - RNA, 14 nt, Human
auuguaaaugugcu

SEQ ID NO: 1682687 - RNA, 15 nt, Human
auuguaaaugugcuu

SEQ ID NO: 1682688 - RNA, 17 nt, Human
auuguaaaugugcuuuu

SEQ ID NO: 1682689 - RNA, 19 nt, Human
auuguucuuaguuugcagu

SEQ ID NO: 1682690 - RNA, 23 nt, Human
auuguacaaaguauuaagcauau

SEQ ID NO: 1682691 - RNA, 22 nt, Human
auuguacaaaguauuaagcaua

SEQ ID NO: 1682692 - RNA, 20 nt, Human
auuguacaaaguauuaagca

SEQ ID NO: 1682693 - RNA, 19 nt, Human
auuguuuaaaaucauuucu

SEQ ID NO: 1682694 - RNA, 16 nt, Human
auuucuguuuagauaa

SEQ ID NO: 1682695 - RNA, 14 nt, Human
auuucuguuuagau

SEQ ID NO: 1682696 - RNA, 12 nt, Human
auuucuguuuag

SEQ ID NO: 1682697 - RNA, 15 nt, Human
auuucuaugaaauau

SEQ ID NO: 1682698 - RNA, 18 nt, Human
auuucuaugaaauauuau

SEQ ID NO: 1682699 - RNA, 20 nt, Human
auuucuaugaaauauuaugu

SEQ ID NO: 1682700 - RNA, 14 nt, Human
auuuaaugaaagac

SEQ ID NO: 1682701 - RNA, 15 nt, Human
auuuaaugaaagacu

SEQ ID NO: 1682702 - RNA, 23 nt, Human
auuuauaaucacuuuuuuccaca

SEQ ID NO: 1682703 - RNA, 16 nt, Human
auuucagcagcugcag

SEQ ID NO: 1682704 - RNA, 16 nt, Human
auugauccagaaagaa

SEQ ID NO: 1682705 - RNA, 17 nt, Human
auugauccagaaagaaa

SEQ ID NO: 1682706 - RNA, 17 nt, Human
auucuuuccugaggcug

SEQ ID NO: 1682707 - RNA, 22 nt, Human
auucuuuccugaggcugggcuc

SEQ ID NO: 1682708 - RNA, 13 nt, Human
auuccugaacagg

SEQ ID NO: 1682709 - RNA, 21 nt, Human
auucucuccuguaccucuuga

SEQ ID NO: 1682710 - RNA, 19 nt, Human
auucucuccuguaccucuu

SEQ ID NO: 1682711 - RNA, 21 nt, Human
auuccugaugcuucuucagag

SEQ ID NO: 1682712 - RNA, 17 nt, Human
auucuugccaaauauaa

SEQ ID NO: 1682713 - RNA, 20 nt, Human
auucauauuuacuucuuaua

SEQ ID NO: 1682714 - RNA, 18 nt, Human
auucauauuuacuucuua

SEQ ID NO: 1682715 - RNA, 19 nt, Human
auucauauuuacuucuuau

SEQ ID NO: 1682716 - RNA, 18 nt, Human
auucacaagacccaaaag

SEQ ID NO: 1682717 - RNA, 18 nt, Human
auuaaauucuugcaaagu

SEQ ID NO: 1682718 - RNA, 14 nt, Human
auuaaauucuugca

SEQ ID NO: 1682719 - RNA, 20 nt, Human
auuaaauucuugcaaaguau

SEQ ID NO: 1682720 - RNA, 20 nt, Human
auuauguguguuuuaaaaug

SEQ ID NO: 1682721 - RNA, 21 nt, Human
auuauguguguuuuaaaauga

SEQ ID NO: 1682722 - RNA, 15 nt, Human
auuauguguguuuua

SEQ ID NO: 1682723 - RNA, 21 nt, Human
aaaguaaaaacaaagaaauua

SEQ ID NO: 1682724 - RNA, 18 nt, Human
gguggcuggguuggaggg

SEQ ID NO: 1682725 - RNA, 19 nt, Human
gguggggaccucaggccug

SEQ ID NO: 1682726 - RNA, 13 nt, Human
ggugggacacccu

SEQ ID NO: 1682727 - RNA, 16 nt, Human
ggugggacacccugug

SEQ ID NO: 1682728 - RNA, 17 nt, Human
ggugggacacccuguga

SEQ ID NO: 1682729 - RNA, 20 nt, Human
ggugggaggaucucuugagc

SEQ ID NO: 1682730 - RNA, 18 nt, Human
aaagguucaugcaaacuu

SEQ ID NO: 1682731 - RNA, 20 nt, Human
aaagggcuguuauaaucuuu

SEQ ID NO: 1682732 - RNA, 22 nt, Human
aaagggcuguuauaaucuuuca

SEQ ID NO: 1682733 - RNA, 20 nt, Human
aaagggcccagagagggugg

SEQ ID NO: 1682734 - RNA, 13 nt, Human
aaagcuuauuaaa

SEQ ID NO: 1682735 - RNA, 14 nt, Human
aaagcuguguggca

SEQ ID NO: 1682736 - RNA, 22 nt, Human
aaagcugccagccgagauagcc

SEQ ID NO: 1682737 - RNA, 17 nt, Human
aaagcuaggccuggcca

SEQ ID NO: 1682738 - RNA, 12 nt, Human
aaagcugccagc

SEQ ID NO: 1682739 - RNA, 13 nt, Human
aaagcugccagcc

SEQ ID NO: 1682740 - RNA, 15 nt, Human
aaagcagcguuucua

SEQ ID NO: 1682741 - RNA, 13 nt, Human
aaagcagugcaug

SEQ ID NO: 1682742 - RNA, 16 nt, Human
aaagcagugcaugcug

SEQ ID NO: 1682743 - RNA, 14 nt, Human
aaagcuaggccugg

SEQ ID NO: 1682744 - RNA, 16 nt, Human
aaagcuaggccuggcc

SEQ ID NO: 1682745 - RNA, 14 nt, Human
gguggcaccagcag

SEQ ID NO: 1682746 - RNA, 20 nt, Human
gguggcaccagcagccugga

SEQ ID NO: 1682747 - RNA, 16 nt, Human
aaagcagaacagugau

SEQ ID NO: 1682748 - RNA, 12 nt, Human
aaacuuuaugcu

SEQ ID NO: 1682749 - RNA, 19 nt, Human
aaacuuuaugcuaagugaa

SEQ ID NO: 1682750 - RNA, 12 nt, Human
gguuuccugccc

SEQ ID NO: 1682751 - RNA, 13 nt, Human
gguuuccugcccu

SEQ ID NO: 1682752 - RNA, 15 nt, Human
gguuuccugcccugg

SEQ ID NO: 1682753 - RNA, 22 nt, Human
gguuucuaaagcugccagccga

SEQ ID NO: 1682754 - RNA, 16 nt, Human
gguuuccugcccuggg

SEQ ID NO: 1682755 - RNA, 19 nt, Human
gguuuccugcccugggagg

SEQ ID NO: 1682756 - RNA, 16 nt, Human
gguuucuaaagcugcc

SEQ ID NO: 1682757 - RNA, 20 nt, Human
gguuuguaaauuaacuuuua

SEQ ID NO: 1682758 - RNA, 17 nt, Human
gguuuucacauuggaaa

SEQ ID NO: 1682759 - RNA, 19 nt, Human
gguuuuauuguuuaaaauc

SEQ ID NO: 1682760 - RNA, 21 nt, Human
aaaguaucccuacuguaauuu

SEQ ID NO: 1682761 - RNA, 20 nt, Human
aaaguagaagucuuagaugu

SEQ ID NO: 1682762 - RNA, 22 nt, Human
aaaguagaagucuuagauguau

SEQ ID NO: 1682763 - RNA, 18 nt, Human
aaaguacacuguuucaaa

SEQ ID NO: 1682764 - RNA, 19 nt, Human
aaaguacacuguuucaaac

SEQ ID NO: 1682765 - RNA, 21 nt, Human
aaaguguauuuuuuuacuaau

SEQ ID NO: 1682766 - RNA, 14 nt, Human
aaaguguauuuuuu

SEQ ID NO: 1682767 - RNA, 17 nt, Human
aaaguauguuagugcaa

SEQ ID NO: 1682768 - RNA, 11 nt, Human
gguguggggga

SEQ ID NO: 1682769 - RNA, 13 nt, Human
ggugugggggaag

SEQ ID NO: 1682770 - RNA, 13 nt, Human
ggugggggccucg

SEQ ID NO: 1682771 - RNA, 14 nt, Human
gguguggagaagcg

SEQ ID NO: 1682772 - RNA, 23 nt, Human
gguguggagaagcggcuggcagc

SEQ ID NO: 1682773 - RNA, 12 nt, Human
gguguggagaag

SEQ ID NO: 1682774 - RNA, 23 nt, Human
gguucccuuugacgccaucccag

SEQ ID NO: 1682775 - RNA, 22 nt, Human
gguucccuuuuuuggcugcuga

SEQ ID NO: 1682776 - RNA, 19 nt, Human
gguguuguacucaauuuua

SEQ ID NO: 1682777 - RNA, 20 nt, Human
gguguuguacucaauuuuaa

SEQ ID NO: 1682778 - RNA, 17 nt, Human
gguguuuccuggcacug

SEQ ID NO: 1682779 - RNA, 19 nt, Human
gguguuuccuggcacugcu

SEQ ID NO: 1682780 - RNA, 17 nt, Human
gguucccauuugcuccu

SEQ ID NO: 1682781 - RNA, 16 nt, Human
guaacaagccacccca

SEQ ID NO: 1682782 - RNA, 19 nt, Human
guaacaggaaaauuuuaaa

SEQ ID NO: 1682783 - RNA, 20 nt, Human
guaacaggaaaauuuuaaaa

SEQ ID NO: 1682784 - RNA, 13 nt, Human
guaaaccuuuuau

SEQ ID NO: 1682785 - RNA, 22 nt, Human
aaauaaugugaaacuggauuaa

SEQ ID NO: 1682786 - RNA, 22 nt, Human
aaaguguauuuuuuuacuaaua

SEQ ID NO: 1682787 - RNA, 12 nt, Human
aaaguggugaga

SEQ ID NO: 1682788 - RNA, 22 nt, Human
guacaaccuguucugcuuuccu

SEQ ID NO: 1682789 - RNA, 20 nt, Human
guacaaaguauuaagcauau

SEQ ID NO: 1682790 - RNA, 21 nt, Human
guacaaaguauuaagcauaua

SEQ ID NO: 1682791 - RNA, 22 nt, Human
guaauuugugauacaaugcugu

SEQ ID NO: 1682792 - RNA, 20 nt, Human
guaauuugugauacaaugcu

SEQ ID NO: 1682793 - RNA, 17 nt, Human
guaauuugugauacaau

SEQ ID NO: 1682794 - RNA, 17 nt, Human
guaaucgaccugccucg

SEQ ID NO: 1682795 - RNA, 15 nt, Human
guaauuugugauaca

SEQ ID NO: 1682796 - RNA, 15 nt, Human
guaaucgaccugccu

SEQ ID NO: 1682797 - RNA, 23 nt, Human
guaauccuagcacuuugggaggc

SEQ ID NO: 1682798 - RNA, 12 nt, Human
aaauaucugaaa

SEQ ID NO: 1682799 - RNA, 14 nt, Human
aaauaucugaaaau

SEQ ID NO: 1682800 - RNA, 17 nt, Human
aaauaucugaaaaugua

SEQ ID NO: 1682801 - RNA, 18 nt, Human
aaauaucugaaaauguau

SEQ ID NO: 1682802 - RNA, 19 nt, Human
aaauaucugaaaauguaug

SEQ ID NO: 1682803 - RNA, 21 nt, Human
aaauaucugaaaauguaugug

SEQ ID NO: 1682804 - RNA, 22 nt, Human
aaauaucugaaaauguaugugu

SEQ ID NO: 1682805 - RNA, 23 nt, Human
aaauaucugaaaauguaugugua

SEQ ID NO: 1682806 - RNA, 13 nt, Human
aaauaugcaaagc

SEQ ID NO: 1682807 - RNA, 15 nt, Human
aaauaugcaaagcac

SEQ ID NO: 1682808 - RNA, 16 nt, Human
aaauaugcaaagcacu

SEQ ID NO: 1682809 - RNA, 17 nt, Human
aaauaugcaaagcacug

SEQ ID NO: 1682810 - RNA, 20 nt, Human
aaauauuccugcauuuguga

SEQ ID NO: 1682811 - RNA, 19 nt, Human
aaauauuaagaaagacuau

SEQ ID NO: 1682812 - RNA, 19 nt, Human
aaaucagccugcuccagcu

SEQ ID NO: 1682813 - RNA, 21 nt, Human
aaaucagccugcuccagcugu

SEQ ID NO: 1682814 - RNA, 23 nt, Human
aaaucagccugcuccagcuguuc

SEQ ID NO: 1682815 - RNA, 20 nt, Human
aaauacgugggcauucaaau

SEQ ID NO: 1682816 - RNA, 21 nt, Human
aaauacgugggcauucaaaug

SEQ ID NO: 1682817 - RNA, 15 nt, Human
aaauauaggaacuua

SEQ ID NO: 1682818 - RNA, 19 nt, Human
aaauaccagccaguaaaug

SEQ ID NO: 1682819 - RNA, 16 nt, Human
guacacacacauacac

SEQ ID NO: 1682820 - RNA, 21 nt, Human
aaauaccagccaguaaauggg

SEQ ID NO: 1682821 - RNA, 20 nt, Human
aaauaccagccaguaaaugg

SEQ ID NO: 1682822 - RNA, 21 nt, Human
aaauaccaugccauuuaaagc

SEQ ID NO: 1682823 - RNA, 22 nt, Human
aaauaucacuugucaauaaaau

SEQ ID NO: 1682824 - RNA, 16 nt, Human
aaauauauuuuaagac

SEQ ID NO: 1682825 - RNA, 22 nt, Human
aaauauauuuuaagacgaaaca

SEQ ID NO: 1682826 - RNA, 14 nt, Human
aaauauauaucaaa

SEQ ID NO: 1682827 - RNA, 18 nt, Human
aaauauaugcuaagucuu

SEQ ID NO: 1682828 - RNA, 11 nt, Human
gggggcuggga

SEQ ID NO: 1682829 - RNA, 15 nt, Human
ggggcccugccuccu

SEQ ID NO: 1682830 - RNA, 21 nt, Human
ggggucacucuggcagcucag

SEQ ID NO: 1682831 - RNA, 13 nt, Human
ggggguggccucc

SEQ ID NO: 1682832 - RNA, 15 nt, Human
gggggcugggcagag

SEQ ID NO: 1682833 - RNA, 18 nt, Human
aaaauguauguguaagua

SEQ ID NO: 1682834 - RNA, 12 nt, Human
ggggaccagagc

SEQ ID NO: 1682835 - RNA, 13 nt, Human
ggggaccagagcu

SEQ ID NO: 1682836 - RNA, 14 nt, Human
ggggaccagagcug

SEQ ID NO: 1682837 - RNA, 15 nt, Human
ggggaccagagcugc

SEQ ID NO: 1682838 - RNA, 17 nt, Human
aaaccuucacuuaggaa

SEQ ID NO: 1682839 - RNA, 22 nt, Human
aaaccugugucucugagaguag

SEQ ID NO: 1682840 - RNA, 22 nt, Human
gggucacucuggcagcucagag

SEQ ID NO: 1682841 - RNA, 14 nt, Human
gggucacucuggca

SEQ ID NO: 1682842 - RNA, 20 nt, Human
gggucacucuggcagcucag

SEQ ID NO: 1682843 - RNA, 19 nt, Human
aaacauuuugucauauaag

SEQ ID NO: 1682844 - RNA, 22 nt, Human
gguaaaucagacuaugaaguuu

SEQ ID NO: 1682845 - RNA, 13 nt, Human
gguaacaggcaga

SEQ ID NO: 1682846 - RNA, 15 nt, Human
gggugguggugauag

SEQ ID NO: 1682847 - RNA, 19 nt, Human
gggugggacacccugugau

SEQ ID NO: 1682848 - RNA, 23 nt, Human
ggguuuugccauguuggccaggc

SEQ ID NO: 1682849 - RNA, 20 nt, Human
ggguuuugccauguuggcca

SEQ ID NO: 1682850 - RNA, 21 nt, Human
aaacguggcugcuucaaggau

SEQ ID NO: 1682851 - RNA, 14 nt, Human
aaacuuaaucuaaa

SEQ ID NO: 1682852 - RNA, 15 nt, Human
gggugggacacccug

SEQ ID NO: 1682853 - RNA, 18 nt, Human
gggugggacacccuguga

SEQ ID NO: 1682854 - RNA, 14 nt, Human
gguaucaggugcug

SEQ ID NO: 1682855 - RNA, 11 nt, Human
gguaggguggg

SEQ ID NO: 1682856 - RNA, 23 nt, Human
gguagggugggccuucagggagu

SEQ ID NO: 1682857 - RNA, 20 nt, Human
gguaggguaagugagagagg

SEQ ID NO: 1682858 - RNA, 20 nt, Human
gguaaggaauaccugucccc

SEQ ID NO: 1682859 - RNA, 16 nt, Human
gguaacucuucuugau

SEQ ID NO: 1682860 - RNA, 22 nt, Human
aaacuugauguguuaucucuua

SEQ ID NO: 1682861 - RNA, 19 nt, Human
gguaucaggugcugccauc

SEQ ID NO: 1682862 - RNA, 14 nt, Human
ggucagugcaaaua

SEQ ID NO: 1682863 - RNA, 19 nt, Human
gggcugcaccggcuggccu

SEQ ID NO: 1682864 - RNA, 21 nt, Human
gggcucagcggggacagcucc

SEQ ID NO: 1682865 - RNA, 10 nt, Human
gggcuccaga

SEQ ID NO: 1682866 - RNA, 13 nt, Human
gggcuccagacac

SEQ ID NO: 1682867 - RNA, 20 nt, Human
gggcuaggaaauccagggug

SEQ ID NO: 1682868 - RNA, 15 nt, Human
gggcuaguugggcuu

SEQ ID NO: 1682869 - RNA, 18 nt, Human
gggcuaguugggcuuccu

SEQ ID NO: 1682870 - RNA, 22 nt, Human
gggcucagcaaaagaugcuucu

SEQ ID NO: 1682871 - RNA, 17 nt, Human
gggcucagcggggacag

SEQ ID NO: 1682872 - RNA, 19 nt, Human
gggcucagcggggacagcu

SEQ ID NO: 1682873 - RNA, 20 nt, Human
gggcugcaccggcuggccug

SEQ ID NO: 1682874 - RNA, 21 nt, Human
gggcugcaccggcuggccugg

SEQ ID NO: 1682875 - RNA, 15 nt, Human
gggcugggcagagga

SEQ ID NO: 1682876 - RNA, 16 nt, Human
aaaaugguuuaaaugg

SEQ ID NO: 1682877 - RNA, 18 nt, Human
aaaaugguuuaaaugguc

SEQ ID NO: 1682878 - RNA, 17 nt, Human
gggcuggguucuaccca

SEQ ID NO: 1682879 - RNA, 16 nt, Human
aaaauggguuuuacug

SEQ ID NO: 1682880 - RNA, 13 nt, Human
gggccaggagccu

SEQ ID NO: 1682881 - RNA, 14 nt, Human
gggccaggagccuc

SEQ ID NO: 1682882 - RNA, 15 nt, Human
gggccucagugccac

SEQ ID NO: 1682883 - RNA, 13 nt, Human
gggccucagugcc

SEQ ID NO: 1682884 - RNA, 14 nt, Human
gggccucagugcca

SEQ ID NO: 1682885 - RNA, 19 nt, Human
gggccucuuaugggcuggg

SEQ ID NO: 1682886 - RNA, 18 nt, Human
gggccucuuaugggcugg

SEQ ID NO: 1682887 - RNA, 22 nt, Human
gggccucgguguggagaagcgg

SEQ ID NO: 1682888 - RNA, 18 nt, Human
gggcgugagaccugcccc

SEQ ID NO: 1682889 - RNA, 19 nt, Human
gggcgugagaccugccccu

SEQ ID NO: 1682890 - RNA, 21 nt, Human
gggcggugagaggggaacaga

SEQ ID NO: 1682891 - RNA, 15 nt, Human
gggcgugguggugag

SEQ ID NO: 1682892 - RNA, 13 nt, Human
aaaaggaugcaca

SEQ ID NO: 1682893 - RNA, 22 nt, Human
aaaaggagccaauuuaaagaaa

SEQ ID NO: 1682894 - RNA, 22 nt, Human
aaaaggaugcacagaguuguua

SEQ ID NO: 1682895 - RNA, 19 nt, Human
aaaaggaugcacagaguug

SEQ ID NO: 1682896 - RNA, 15 nt, Human
aaaaggaugcacaga

SEQ ID NO: 1682897 - RNA, 14 nt, Human
aaaaggaugcacag

SEQ ID NO: 1682898 - RNA, 16 nt, Human
aaaagguuaauaaagu

SEQ ID NO: 1682899 - RNA, 17 nt, Human
aaaagguuaauaaagua

SEQ ID NO: 1682900 - RNA, 11 nt, Human
aaaaggcagga

SEQ ID NO: 1682901 - RNA, 11 nt, Human
aaaauaauuuu

SEQ ID NO: 1682902 - RNA, 14 nt, Human
aaaauaccaaggaa

SEQ ID NO: 1682903 - RNA, 13 nt, Human
aaaauaccaagga

SEQ ID NO: 1682904 - RNA, 16 nt, Human
aaaauaauuuuuauau

SEQ ID NO: 1682905 - RNA, 17 nt, Human
aaaauaauuuuuauauu

SEQ ID NO: 1682906 - RNA, 20 nt, Human
aaaauaauuuuuauauuuga

SEQ ID NO: 1682907 - RNA, 14 nt, Human
aaaauacacacuca

SEQ ID NO: 1682908 - RNA, 11 nt, Human
aaaaugagaaa

SEQ ID NO: 1682909 - RNA, 12 nt, Human
aaaaugagaaau

SEQ ID NO: 1682910 - RNA, 23 nt, Human
aaaaugcuguauuagucacagag

SEQ ID NO: 1682911 - RNA, 20 nt, Human
aaaauggaagacagcucuua

SEQ ID NO: 1682912 - RNA, 15 nt, Human
aaaauauuuuaugau

SEQ ID NO: 1682913 - RNA, 18 nt, Human
aaaauauuuuaugaucca

SEQ ID NO: 1682914 - RNA, 16 nt, Human
aaaauauuuuccugcc

SEQ ID NO: 1682915 - RNA, 22 nt, Human
aaaauaugaccacacuccagcu

SEQ ID NO: 1682916 - RNA, 15 nt, Human
aaaauauuccugcau

SEQ ID NO: 1682917 - RNA, 13 nt, Human
ggccccugccucu

SEQ ID NO: 1682918 - RNA, 17 nt, Human
ggccccugccucucugc

SEQ ID NO: 1682919 - RNA, 18 nt, Human
ggccccugccucucugca

SEQ ID NO: 1682920 - RNA, 19 nt, Human
ggccccugccucucugcag

SEQ ID NO: 1682921 - RNA, 21 nt, Human
ggccccugccucucugcaggu

SEQ ID NO: 1682922 - RNA, 17 nt, Human
ggccagaugcaccagcc

SEQ ID NO: 1682923 - RNA, 22 nt, Human
ggccagagggagugacagaggc

SEQ ID NO: 1682924 - RNA, 15 nt, Human
ggccagaugcaccag

SEQ ID NO: 1682925 - RNA, 16 nt, Human
ggccagaugcaccagc

SEQ ID NO: 1682926 - RNA, 23 nt, Human
ggccucccaacucaccccagccc

SEQ ID NO: 1682927 - RNA, 20 nt, Human
ggccucccaacucaccccag

SEQ ID NO: 1682928 - RNA, 22 nt, Human
ggccucccaacucaccccagcc

SEQ ID NO: 1682929 - RNA, 13 nt, Human
ggccucagugcca

SEQ ID NO: 1682930 - RNA, 17 nt, Human
ggccucccaacucaccc

SEQ ID NO: 1682931 - RNA, 18 nt, Human
ggccucccaacucacccc

SEQ ID NO: 1682932 - RNA, 19 nt, Human
ggccucccaacucacccca

SEQ ID NO: 1682933 - RNA, 17 nt, Human
ggccuucagggagugag

SEQ ID NO: 1682934 - RNA, 16 nt, Human
ggccuggccagaugca

SEQ ID NO: 1682935 - RNA, 14 nt, Human
ggccuggcagccgu

SEQ ID NO: 1682936 - RNA, 15 nt, Human
ggccuggcagccgug

SEQ ID NO: 1682937 - RNA, 12 nt, Human
ggccuggccaga

SEQ ID NO: 1682938 - RNA, 15 nt, Human
ggccuggccagaugc

SEQ ID NO: 1682939 - RNA, 11 nt, Human
ggccugccugu

SEQ ID NO: 1682940 - RNA, 16 nt, Human
ggccugcaagggagug

SEQ ID NO: 1682941 - RNA, 16 nt, Human
ggcuagagguucaaag

SEQ ID NO: 1682942 - RNA, 14 nt, Human
ggcuaccuuuguau

SEQ ID NO: 1682943 - RNA, 23 nt, Human
ggcuacaccuuagccugcccucc

SEQ ID NO: 1682944 - RNA, 22 nt, Human
ggcuacaccuuagccugcccuc

SEQ ID NO: 1682945 - RNA, 13 nt, Human
ggcuaccuuugua

SEQ ID NO: 1682946 - RNA, 18 nt, Human
ggcuaauuuuuguuuugu

SEQ ID NO: 1682947 - RNA, 20 nt, Human
ggcuaagugauccucccacc

SEQ ID NO: 1682948 - RNA, 16 nt, Human
ggcuaauguacugcau

SEQ ID NO: 1682949 - RNA, 14 nt, Human
ggcgugagaccugc

SEQ ID NO: 1682950 - RNA, 16 nt, Human
ggcgugagaccugccc

SEQ ID NO: 1682951 - RNA, 17 nt, Human
ggcgugagaccugcccc

SEQ ID NO: 1682952 - RNA, 18 nt, Human
ggcgugagaccugccccu

SEQ ID NO: 1682953 - RNA, 14 nt, Human
ggcgugcaguggug

SEQ ID NO: 1682954 - RNA, 20 nt, Human
ggcuaagcuucacuguaaaa

SEQ ID NO: 1682955 - RNA, 18 nt, Human
ggccuucggccuccaucc

SEQ ID NO: 1682956 - RNA, 22 nt, Human
ggccuucggccuccauccugag

SEQ ID NO: 1682957 - RNA, 16 nt, Human
ggccuucggccuccau

SEQ ID NO: 1682958 - RNA, 14 nt, Human
ggcuggguuggagg

SEQ ID NO: 1682959 - RNA, 22 nt, Human
ggcuggguucuacccaggugcu

SEQ ID NO: 1682960 - RNA, 13 nt, Human
aaaaauacaaaaa

SEQ ID NO: 1682961 - RNA, 14 nt, Human
aaaaauaaaaaaca

SEQ ID NO: 1682962 - RNA, 21 nt, Human
aaaaaggaugcacagaguugu

SEQ ID NO: 1682963 - RNA, 12 nt, Human
aaaaaggcagga

SEQ ID NO: 1682964 - RNA, 14 nt, Human
aaaaaggaggaaga

SEQ ID NO: 1682965 - RNA, 22 nt, Human
aaaaaacugcugacuguuuucu

SEQ ID NO: 1682966 - RNA, 13 nt, Human
ggcuggccuggcc

SEQ ID NO: 1682967 - RNA, 14 nt, Human
ggcuggccuggccc

SEQ ID NO: 1682968 - RNA, 15 nt, Human
ggcuggccuggcccc

SEQ ID NO: 1682969 - RNA, 12 nt, Human
ggcugcccuggu

SEQ ID NO: 1682970 - RNA, 10 nt, Human
ggcugcccuu

SEQ ID NO: 1682971 - RNA, 11 nt, Human
ggcugcccuuu

SEQ ID NO: 1682972 - RNA, 14 nt, Human
ggcugcccuuucug

SEQ ID NO: 1682973 - RNA, 18 nt, Human
ggcugcccuuucugggca

SEQ ID NO: 1682974 - RNA, 13 nt, Human
ggcucccuuccca

SEQ ID NO: 1682975 - RNA, 15 nt, Human
ggcucuuccaggcug

SEQ ID NO: 1682976 - RNA, 17 nt, Human
ggcucuuccaggcuggg

SEQ ID NO: 1682977 - RNA, 18 nt, Human
ggcucuuccaggcuggga

SEQ ID NO: 1682978 - RNA, 20 nt, Human
ggcucuuccaggcugggaga

SEQ ID NO: 1682979 - RNA, 13 nt, Human
ggcucacugcagc

SEQ ID NO: 1682980 - RNA, 14 nt, Human
ggcucacugcagcc

SEQ ID NO: 1682981 - RNA, 15 nt, Human
ggcucacugcagccu

SEQ ID NO: 1682982 - RNA, 14 nt, Human
ggauuguaguccca

SEQ ID NO: 1682983 - RNA, 13 nt, Human
ggauuguccccga

SEQ ID NO: 1682984 - RNA, 14 nt, Human
ggaugaaaaaauaa

SEQ ID NO: 1682985 - RNA, 17 nt, Human
ggauuuaacagaaaugu

SEQ ID NO: 1682986 - RNA, 16 nt, Human
ggauuuaacagaaaug

SEQ ID NO: 1682987 - RNA, 22 nt, Human
ggauuuaacagaaauguacagc

SEQ ID NO: 1682988 - RNA, 12 nt, Human
ggauuuaacaga

SEQ ID NO: 1682989 - RNA, 16 nt, Human
ggauuguccccgaccc

SEQ ID NO: 1682990 - RNA, 20 nt, Human
ggauuguccccgacccuugc

SEQ ID NO: 1682991 - RNA, 16 nt, Human
ggaguucaucuugaau

SEQ ID NO: 1682992 - RNA, 15 nt, Human
ggauccugagccaga

SEQ ID NO: 1682993 - RNA, 16 nt, Human
ggauccugagccagau

SEQ ID NO: 1682994 - RNA, 18 nt, Human
ggauccugagccagauuu

SEQ ID NO: 1682995 - RNA, 19 nt, Human
ggauccugagccagauuuc

SEQ ID NO: 1682996 - RNA, 20 nt, Human
ggauccugagccagauuuca

SEQ ID NO: 1682997 - RNA, 23 nt, Human
ggauccugagccagauuucacuc

SEQ ID NO: 1682998 - RNA, 18 nt, Human
ggaucucuugagccuggg

SEQ ID NO: 1682999 - RNA, 16 nt, Human
ggaguggccacagaaa

SEQ ID NO: 1683000 - RNA, 12 nt, Human
ggagugggccca

SEQ ID NO: 1683001 - RNA, 22 nt, Human
ggagugggcccaaugcacuuug

SEQ ID NO: 1683002 - RNA, 15 nt, Human
ggaguggccacagaa

SEQ ID NO: 1683003 - RNA, 22 nt, Human
ggagguaaggaauaccuguccc

SEQ ID NO: 1683004 - RNA, 21 nt, Human
ggagggugacgggggugaacu

SEQ ID NO: 1683005 - RNA, 22 nt, Human
ggaggugggauccuccaggugc

SEQ ID NO: 1683006 - RNA, 23 nt, Human
ggaggugggauccuccaggugca

SEQ ID NO: 1683007 - RNA, 13 nt, Human
ggaggggggaggu

SEQ ID NO: 1683008 - RNA, 14 nt, Human
ggaggggggaggug

SEQ ID NO: 1683009 - RNA, 15 nt, Human
ggaggcucuggagcc

SEQ ID NO: 1683010 - RNA, 17 nt, Human
ggccagagacacaagcc

SEQ ID NO: 1683011 - RNA, 18 nt, Human
ggccagagacacaagccu

SEQ ID NO: 1683012 - RNA, 17 nt, Human
ggccagagggagugaca

SEQ ID NO: 1683013 - RNA, 19 nt, Human
ggccagagggagugacaga

SEQ ID NO: 1683014 - RNA, 17 nt, Human
ggcauuuguuugaacug

SEQ ID NO: 1683015 - RNA, 14 nt, Human
ggccaaaggaagca

SEQ ID NO: 1683016 - RNA, 16 nt, Human
ggccaaaggaagcaca

SEQ ID NO: 1683017 - RNA, 21 nt, Human
ggccaaaggaagcacaugccu

SEQ ID NO: 1683018 - RNA, 19 nt, Human
ggccaaaggaagcacaugc

SEQ ID NO: 1683019 - RNA, 20 nt, Human
ggcaucgcaauguaagacuc

SEQ ID NO: 1683020 - RNA, 14 nt, Human
ggcauuugcugaau

SEQ ID NO: 1683021 - RNA, 19 nt, Human
ggcagggagggccugggcc

SEQ ID NO: 1683022 - RNA, 20 nt, Human
ggcagggagggccugggccc

SEQ ID NO: 1683023 - RNA, 17 nt, Human
ggcagggagggccuggg

SEQ ID NO: 1683024 - RNA, 18 nt, Human
ggcagggagggccugggc

SEQ ID NO: 1683025 - RNA, 10 nt, Human
ggcagggagg

SEQ ID NO: 1683026 - RNA, 18 nt, Human
ggcaggaggaucacuuga

SEQ ID NO: 1683027 - RNA, 14 nt, Human
ggcagccaggccac

SEQ ID NO: 1683028 - RNA, 13 nt, Human
ggcagccaggcca

SEQ ID NO: 1683029 - RNA, 22 nt, Human
ggcacugcuuccagugaggcuc

SEQ ID NO: 1683030 - RNA, 20 nt, Human
ggcacugcuuccagugaggc

SEQ ID NO: 1683031 - RNA, 16 nt, Human
ggcagccucuucaaaa

SEQ ID NO: 1683032 - RNA, 23 nt, Human
ggcagccccauucugccugccca

SEQ ID NO: 1683033 - RNA, 22 nt, Human
ggcagccccauucugccugccc

SEQ ID NO: 1683034 - RNA, 16 nt, Human
ggcagccccauucugc

SEQ ID NO: 1683035 - RNA, 20 nt, Human
ggcagccccauucugccugc

SEQ ID NO: 1683036 - RNA, 21 nt, Human
ggcagccccauucugccugcc

SEQ ID NO: 1683037 - RNA, 18 nt, Human
ggcacaucagcacgauuu

SEQ ID NO: 1683038 - RNA, 16 nt, Human
ggcacugcuuccagug

SEQ ID NO: 1683039 - RNA, 18 nt, Human
ggcacaccgggcacucag

SEQ ID NO: 1683040 - RNA, 15 nt, Human
ggcaaaaaggcagga

SEQ ID NO: 1683041 - RNA, 10 nt, Human
ggcaaaauaa

SEQ ID NO: 1683042 - RNA, 20 nt, Human
gcugccccuggcagccccug

SEQ ID NO: 1683043 - RNA, 18 nt, Human
gcugccccuggcagcccc

SEQ ID NO: 1683044 - RNA, 19 nt, Human
gcugccccuggcagccccu

SEQ ID NO: 1683045 - RNA, 21 nt, Human
gcugccugggaucccucaucc

SEQ ID NO: 1683046 - RNA, 23 nt, Human
gcugcucuugaacuccugaccuc

SEQ ID NO: 1683047 - RNA, 17 nt, Human
gcugccuguucagcucc

SEQ ID NO: 1683048 - RNA, 12 nt, Human
gcugccuguuca

SEQ ID NO: 1683049 - RNA, 13 nt, Human
gcugccuguucag

SEQ ID NO: 1683050 - RNA, 20 nt, Human
gcugccugggaucccucauc

SEQ ID NO: 1683051 - RNA, 16 nt, Human
gcugccucucccauca

SEQ ID NO: 1683052 - RNA, 13 nt, Human
gcugccucaugcu

SEQ ID NO: 1683053 - RNA, 14 nt, Human
gcugccuccccucc

SEQ ID NO: 1683054 - RNA, 18 nt, Human
gcugcacccucaggcagg

SEQ ID NO: 1683055 - RNA, 19 nt, Human
gcugcacccucaggcaggu

SEQ ID NO: 1683056 - RNA, 13 nt, Human
gcugcaccggcug

SEQ ID NO: 1683057 - RNA, 14 nt, Human
gcugcaccggcugg

SEQ ID NO: 1683058 - RNA, 23 nt, Human
gcugagggugagugggugaauaa

SEQ ID NO: 1683059 - RNA, 14 nt, Human
gcugaggugggagg

SEQ ID NO: 1683060 - RNA, 15 nt, Human
gcugaggugggagga

SEQ ID NO: 1683061 - RNA, 20 nt, Human
gcuggcuguuggcugggggc

SEQ ID NO: 1683062 - RNA, 23 nt, Human
gcuggcuguuggcugggggccuc

SEQ ID NO: 1683063 - RNA, 12 nt, Human
gcugggccccug

SEQ ID NO: 1683064 - RNA, 13 nt, Human
gcugggccccugc

SEQ ID NO: 1683065 - RNA, 14 nt, Human
gcugggccccugcc

SEQ ID NO: 1683066 - RNA, 18 nt, Human
gcugggccccugccucuc

SEQ ID NO: 1683067 - RNA, 20 nt, Human
gcugggccccugccucucug

SEQ ID NO: 1683068 - RNA, 17 nt, Human
gcugggguggggaccuc

SEQ ID NO: 1683069 - RNA, 19 nt, Human
gcugggguggggaccucag

SEQ ID NO: 1683070 - RNA, 22 nt, Human
gcugggguggggaccucaggcc

SEQ ID NO: 1683071 - RNA, 23 nt, Human
gcugggguggggaccucaggccu

SEQ ID NO: 1683072 - RNA, 18 nt, Human
gcuggguucuacccaggu

SEQ ID NO: 1683073 - RNA, 17 nt, Human
gcuggguucuacccagg

SEQ ID NO: 1683074 - RNA, 20 nt, Human
gcuggguucuacccaggugc

SEQ ID NO: 1683075 - RNA, 21 nt, Human
gcuggguucuacccaggugcu

SEQ ID NO: 1683076 - RNA, 20 nt, Human
gcuggcgugcaguggugcga

SEQ ID NO: 1683077 - RNA, 15 nt, Human
gcuggcgugcagugg

SEQ ID NO: 1683078 - RNA, 18 nt, Human
gcuggcgugcaguggugc

SEQ ID NO: 1683079 - RNA, 14 nt, Human
gcuggcugccuuag

SEQ ID NO: 1683080 - RNA, 20 nt, Human
gcuggcugccuuagaaccuu

SEQ ID NO: 1683081 - RNA, 11 nt, Human
gcuggcugccu

SEQ ID NO: 1683082 - RNA, 18 nt, Human
gcuggcuguuggcugggg

SEQ ID NO: 1683083 - RNA, 19 nt, Human
gcuggcuguuggcuggggg

SEQ ID NO: 1683084 - RNA, 14 nt, Human
gcuggcgugcagug

SEQ ID NO: 1683085 - RNA, 12 nt, Human
gcugcugaaggc

SEQ ID NO: 1683086 - RNA, 13 nt, Human
gcugcugaaacaa

SEQ ID NO: 1683087 - RNA, 18 nt, Human
gcugugcucuggacaggc

SEQ ID NO: 1683088 - RNA, 15 nt, Human
gcugugcucuggaca

SEQ ID NO: 1683089 - RNA, 16 nt, Human
gcugugcucuggacag

SEQ ID NO: 1683090 - RNA, 14 nt, Human
gcugugccucugcc

SEQ ID NO: 1683091 - RNA, 15 nt, Human
gcugugccucugccu

SEQ ID NO: 1683092 - RNA, 16 nt, Human
gcugugccucugccug

SEQ ID NO: 1683093 - RNA, 13 nt, Human
gcugugcucugga

SEQ ID NO: 1683094 - RNA, 16 nt, Human
gcuguuggcugggggc

SEQ ID NO: 1683095 - RNA, 20 nt, Human
gcuguuggcugggggccuca

SEQ ID NO: 1683096 - RNA, 15 nt, Human
gcugugcugcccugc

SEQ ID NO: 1683097 - RNA, 16 nt, Human
gcugugcugcccugcc

SEQ ID NO: 1683098 - RNA, 17 nt, Human
gcugugcugcccugccc

SEQ ID NO: 1683099 - RNA, 15 nt, Human
gcuguuggcuggggg

SEQ ID NO: 1683100 - RNA, 17 nt, Human
gcuguaucccaugagcc

SEQ ID NO: 1683101 - RNA, 19 nt, Human
gcuguaucccaugagccuc

SEQ ID NO: 1683102 - RNA, 20 nt, Human
gcuguauuuuaaaagaauga

SEQ ID NO: 1683103 - RNA, 18 nt, Human
gcuguauuuuaaaagaau

SEQ ID NO: 1683104 - RNA, 21 nt, Human
gcuguauuuuaaaagaaugau

SEQ ID NO: 1683105 - RNA, 19 nt, Human
ggaauacucuuauaucuau

SEQ ID NO: 1683106 - RNA, 16 nt, Human
ggaauaccuguccccc

SEQ ID NO: 1683107 - RNA, 19 nt, Human
ggaauaccugucccccuga

SEQ ID NO: 1683108 - RNA, 16 nt, Human
ggaauauauaaccagu

SEQ ID NO: 1683109 - RNA, 15 nt, Human
ggaagccugauuaaa

SEQ ID NO: 1683110 - RNA, 16 nt, Human
ggaagcucagggccug

SEQ ID NO: 1683111 - RNA, 17 nt, Human
ggaagcucagggccugg

SEQ ID NO: 1683112 - RNA, 22 nt, Human
ggaagcucagggccuggcucag

SEQ ID NO: 1683113 - RNA, 21 nt, Human
ggaagcucagggccuggcuca

SEQ ID NO: 1683114 - RNA, 15 nt, Human
ggaauaccugucccc

SEQ ID NO: 1683115 - RNA, 12 nt, Human
ggacacccugug

SEQ ID NO: 1683116 - RNA, 14 nt, Human
ggacacagcucuuc

SEQ ID NO: 1683117 - RNA, 13 nt, Human
ggacacagcucuu

SEQ ID NO: 1683118 - RNA, 19 nt, Human
ggaaugaaugucaguguga

SEQ ID NO: 1683119 - RNA, 14 nt, Human
ggaaugauuaauua

SEQ ID NO: 1683120 - RNA, 12 nt, Human
ggacacagcucu

SEQ ID NO: 1683121 - RNA, 13 nt, Human
ggacauggacaag

SEQ ID NO: 1683122 - RNA, 14 nt, Human
ggacauggacaagg

SEQ ID NO: 1683123 - RNA, 13 nt, Human
ggacacccuguga

SEQ ID NO: 1683124 - RNA, 23 nt, Human
ggacacccugugauggggcccug

SEQ ID NO: 1683125 - RNA, 17 nt, Human
ggacagggaggugaccc

SEQ ID NO: 1683126 - RNA, 22 nt, Human
ggacagggcauggccagguggc

SEQ ID NO: 1683127 - RNA, 15 nt, Human
ggacagggcauggcc

SEQ ID NO: 1683128 - RNA, 17 nt, Human
ggacagucaccucaugg

SEQ ID NO: 1683129 - RNA, 18 nt, Human
ggacagucaccucaugga

SEQ ID NO: 1683130 - RNA, 21 nt, Human
ggacagucaccucauggaauu

SEQ ID NO: 1683131 - RNA, 16 nt, Human
ggaaauccaggguggu

SEQ ID NO: 1683132 - RNA, 13 nt, Human
ggaaaucuuuaaa

SEQ ID NO: 1683133 - RNA, 23 nt, Human
ggaaaucaccgaaaacguggcug

SEQ ID NO: 1683134 - RNA, 19 nt, Human
ggaaaucaggguuaguauu

SEQ ID NO: 1683135 - RNA, 18 nt, Human
ggaagccgcuggggccag

SEQ ID NO: 1683136 - RNA, 22 nt, Human
ggaagccagcaggcucucaggc

SEQ ID NO: 1683137 - RNA, 23 nt, Human
ggaagccagcaggcucucaggcc

SEQ ID NO: 1683138 - RNA, 21 nt, Human
ggaagccagcaggcucucagg

SEQ ID NO: 1683139 - RNA, 21 nt, Human
gcuuuucccuuuuuuuaagua

SEQ ID NO: 1683140 - RNA, 20 nt, Human
gcuuuucccuuuuuuuaagu

SEQ ID NO: 1683141 - RNA, 16 nt, Human
ggaaagcccugugcuc

SEQ ID NO: 1683142 - RNA, 20 nt, Human
ggaaagacuuuuccaacccu

SEQ ID NO: 1683143 - RNA, 14 nt, Human
ggaaagaggcucug

SEQ ID NO: 1683144 - RNA, 19 nt, Human
ggaaagcaaaggagauugg

SEQ ID NO: 1683145 - RNA, 16 nt, Human
ggaaagaguaggaaga

SEQ ID NO: 1683146 - RNA, 17 nt, Human
ggaaagaguaggaagac

SEQ ID NO: 1683147 - RNA, 19 nt, Human
gcuuuugugcauuaucuag

SEQ ID NO: 1683148 - RNA, 13 nt, Human
gcuuuugugcauu

SEQ ID NO: 1683149 - RNA, 15 nt, Human
gcuuuuuaauauuga

SEQ ID NO: 1683150 - RNA, 16 nt, Human
ggaaaaaauaacaaug

SEQ ID NO: 1683151 - RNA, 15 nt, Human
ggaaacccagcucug

SEQ ID NO: 1683152 - RNA, 20 nt, Human
ggaaacagcuaaugggacac

SEQ ID NO: 1683153 - RNA, 13 nt, Human
ggaaacugccagc

SEQ ID NO: 1683154 - RNA, 18 nt, Human
ggaaacuggguuccugca

SEQ ID NO: 1683155 - RNA, 20 nt, Human
gcuugaccgugaggccagag

SEQ ID NO: 1683156 - RNA, 22 nt, Human
gcuuggggaccagagcugccac

SEQ ID NO: 1683157 - RNA, 17 nt, Human
gcuuggggaccagagcu

SEQ ID NO: 1683158 - RNA, 18 nt, Human
gcuuggggaccagagcug

SEQ ID NO: 1683159 - RNA, 20 nt, Human
gcuuggggaccagagcugcc

SEQ ID NO: 1683160 - RNA, 21 nt, Human
gcuuggggaccagagcugcca

SEQ ID NO: 1683161 - RNA, 13 nt, Human
gcuuucuacccag

SEQ ID NO: 1683162 - RNA, 19 nt, Human
gcuuucuacccagcgagcc

SEQ ID NO: 1683163 - RNA, 22 nt, Human
gcuuucuacccagcgagcccug

SEQ ID NO: 1683164 - RNA, 23 nt, Human
gcuuucuacccagcgagcccugg

SEQ ID NO: 1683165 - RNA, 16 nt, Human
gcuucuucagagacuc

SEQ ID NO: 1683166 - RNA, 17 nt, Human
gcuuaacuucacauauu

SEQ ID NO: 1683167 - RNA, 16 nt, Human
gcuuaacuucacauau

SEQ ID NO: 1683168 - RNA, 19 nt, Human
gcuucuucagagacuccug

SEQ ID NO: 1683169 - RNA, 21 nt, Human
gcuucuucagagacuccugca

SEQ ID NO: 1683170 - RNA, 23 nt, Human
gcuucuucagagacuccugcagg

SEQ ID NO: 1683171 - RNA, 17 nt, Human
gcuugaccgugaggcca

SEQ ID NO: 1683172 - RNA, 18 nt, Human
gcuugaccgugaggccag

SEQ ID NO: 1683173 - RNA, 19 nt, Human
gcuugaccgugaggccaga

SEQ ID NO: 1683174 - RNA, 23 nt, Human
gcuugggcuucauccuccucaga

SEQ ID NO: 1683175 - RNA, 16 nt, Human
gcuuggggaccagagc

SEQ ID NO: 1683176 - RNA, 15 nt, Human
gcccacuguacuugc

SEQ ID NO: 1683177 - RNA, 20 nt, Human
gcccacuguacuugcucuug

SEQ ID NO: 1683178 - RNA, 22 nt, Human
gcccacuguacuugcucuugau

SEQ ID NO: 1683179 - RNA, 23 nt, Human
gcccacgcuggagugcagugagc

SEQ ID NO: 1683180 - RNA, 19 nt, Human
gcccacgcuggagugcagu

SEQ ID NO: 1683181 - RNA, 21 nt, Human
gcccacgcuggagugcaguga

SEQ ID NO: 1683182 - RNA, 13 nt, Human
gcccacuucugcc

SEQ ID NO: 1683183 - RNA, 24 nt, Human
gcccaggaaaggcuccaggagcag

SEQ ID NO: 1683184 - RNA, 22 nt, Human
gcccaggaaaggcuccaggagc

SEQ ID NO: 1683185 - RNA, 23 nt, Human
gcccaggaaaggcuccaggagca

SEQ ID NO: 1683186 - RNA, 17 nt, Human
gccauugacuucuuccc

SEQ ID NO: 1683187 - RNA, 16 nt, Human
gcccacgcccccacug

SEQ ID NO: 1683188 - RNA, 17 nt, Human
gcccacgcccccacugg

SEQ ID NO: 1683189 - RNA, 21 nt, Human
gcccacgcccccacuggugac

SEQ ID NO: 1683190 - RNA, 13 nt, Human
gccauguuuauua

SEQ ID NO: 1683191 - RNA, 11 nt, Human
gccauguuuau

SEQ ID NO: 1683192 - RNA, 14 nt, Human
gccauguuuauuac

SEQ ID NO: 1683193 - RNA, 18 nt, Human
gccauguuuauuacagua

SEQ ID NO: 1683194 - RNA, 22 nt, Human
gccauguuuauuacaguauaau

SEQ ID NO: 1683195 - RNA, 13 nt, Human
gcauuuagaugua

SEQ ID NO: 1683196 - RNA, 19 nt, Human
gcauuuaggccaugggaca

SEQ ID NO: 1683197 - RNA, 18 nt, Human
gcauuuacuuuguguuca

SEQ ID NO: 1683198 - RNA, 12 nt, Human
gcauuuagaugu

SEQ ID NO: 1683199 - RNA, 12 nt, Human
gcccaggcaggu

SEQ ID NO: 1683200 - RNA, 11 nt, Human
gcccaggcagg

SEQ ID NO: 1683201 - RNA, 11 nt, Human
gcccaggcccc

SEQ ID NO: 1683202 - RNA, 12 nt, Human
gcccaggccccu

SEQ ID NO: 1683203 - RNA, 20 nt, Human
gcccaggccccugccacccu

SEQ ID NO: 1683204 - RNA, 21 nt, Human
gcccaggccccugccacccug

SEQ ID NO: 1683205 - RNA, 22 nt, Human
gcccaggccccugccacccugg

SEQ ID NO: 1683206 - RNA, 15 nt, Human
gcccccucugcccug

SEQ ID NO: 1683207 - RNA, 16 nt, Human
gcccccucugcccugc

SEQ ID NO: 1683208 - RNA, 12 nt, Human
gccccugcuggu

SEQ ID NO: 1683209 - RNA, 17 nt, Human
gcccccucugcccugcg

SEQ ID NO: 1683210 - RNA, 15 nt, Human
gccccugcugguuca

SEQ ID NO: 1683211 - RNA, 16 nt, Human
gccccugcugguucag

SEQ ID NO: 1683212 - RNA, 12 nt, Human
gccccuggcagc

SEQ ID NO: 1683213 - RNA, 15 nt, Human
gccccuggcagcccc

SEQ ID NO: 1683214 - RNA, 20 nt, Human
gccccaaaacucuccucugc

SEQ ID NO: 1683215 - RNA, 21 nt, Human
gccccaaaacucuccucugcu

SEQ ID NO: 1683216 - RNA, 11 nt, Human
gccccaaaagg

SEQ ID NO: 1683217 - RNA, 16 nt, Human
gccucgaacuggcugc

SEQ ID NO: 1683218 - RNA, 22 nt, Human
gccuccuuugugaggaagccgc

SEQ ID NO: 1683219 - RNA, 13 nt, Human
gccucgaacuggc

SEQ ID NO: 1683220 - RNA, 19 nt, Human
gccuccugaguagcuggga

SEQ ID NO: 1683221 - RNA, 18 nt, Human
gccuccugcccuuaccug

SEQ ID NO: 1683222 - RNA, 13 nt, Human
gccuccauccuga

SEQ ID NO: 1683223 - RNA, 14 nt, Human
gccuccauccugag

SEQ ID NO: 1683224 - RNA, 15 nt, Human
gccuccauccugagg

SEQ ID NO: 1683225 - RNA, 19 nt, Human
gccucaugcuaagacucag

SEQ ID NO: 1683226 - RNA, 22 nt, Human
gccucauguccacugguucuuc

SEQ ID NO: 1683227 - RNA, 17 nt, Human
gccuacaggagugagca

SEQ ID NO: 1683228 - RNA, 19 nt, Human
gccuagcauacguacacau

SEQ ID NO: 1683229 - RNA, 12 nt, Human
gccuagcauacg

SEQ ID NO: 1683230 - RNA, 14 nt, Human
gcccuuccucucca

SEQ ID NO: 1683231 - RNA, 15 nt, Human
gcccuuccucuccac

SEQ ID NO: 1683232 - RNA, 22 nt, Human
gcccuuccaugucgccucugca

SEQ ID NO: 1683233 - RNA, 12 nt, Human
gcccuuccucuc

SEQ ID NO: 1683234 - RNA, 12 nt, Human
gcccuuccaugu

SEQ ID NO: 1683235 - RNA, 21 nt, Human
gcccuuccaugucgccucugc

SEQ ID NO: 1683236 - RNA, 16 nt, Human
gccuacaggagugagc

SEQ ID NO: 1683237 - RNA, 13 nt, Human
gcccugugcucca

SEQ ID NO: 1683238 - RNA, 20 nt, Human
gcccugcgggucacaggagg

SEQ ID NO: 1683239 - RNA, 14 nt, Human
gcccugcccaccug

SEQ ID NO: 1683240 - RNA, 15 nt, Human
gcccugcccaccugg

SEQ ID NO: 1683241 - RNA, 19 nt, Human
gcccuuagcagggaaacag

SEQ ID NO: 1683242 - RNA, 23 nt, Human
gcccuuaccugccaggaagccag

SEQ ID NO: 1683243 - RNA, 21 nt, Human
gcccugugggcccccaaaugg

SEQ ID NO: 1683244 - RNA, 16 nt, Human
gcccugugggccccca

SEQ ID NO: 1683245 - RNA, 17 nt, Human
gcccugugggcccccaa

SEQ ID NO: 1683246 - RNA, 22 nt, Human
gcccuuaccugccaggaagcca

SEQ ID NO: 1683247 - RNA, 21 nt, Human
gccccugcugguucaggguug

SEQ ID NO: 1683248 - RNA, 16 nt, Human
gccccuggcagccccu

SEQ ID NO: 1683249 - RNA, 17 nt, Human
gccccuggcagccccug

SEQ ID NO: 1683250 - RNA, 18 nt, Human
gcguugaaauuguaauua

SEQ ID NO: 1683251 - RNA, 11 nt, Human
gcuaaggacuu

SEQ ID NO: 1683252 - RNA, 12 nt, Human
gcuaaggacuug

SEQ ID NO: 1683253 - RNA, 12 nt, Human
gcguugaaauug

SEQ ID NO: 1683254 - RNA, 23 nt, Human
gcuaaggacuuguuagaucuagu

SEQ ID NO: 1683255 - RNA, 22 nt, Human
gcguucauggaacgcguugaaa

SEQ ID NO: 1683256 - RNA, 15 nt, Human
gcggcuggcagccca

SEQ ID NO: 1683257 - RNA, 21 nt, Human
gccuucuuuucucccuuuuaa

SEQ ID NO: 1683258 - RNA, 14 nt, Human
gccuugaacuuuga

SEQ ID NO: 1683259 - RNA, 15 nt, Human
gccuucucugaagga

SEQ ID NO: 1683260 - RNA, 16 nt, Human
gccuucucugaaggac

SEQ ID NO: 1683261 - RNA, 15 nt, Human
gccuguucagcucca

SEQ ID NO: 1683262 - RNA, 16 nt, Human
gccuguucagcuccag

SEQ ID NO: 1683263 - RNA, 17 nt, Human
gccuguucagcuccagc

SEQ ID NO: 1683264 - RNA, 23 nt, Human
gccugggaucccucauccucaua

SEQ ID NO: 1683265 - RNA, 11 nt, Human
gccugggcaga

SEQ ID NO: 1683266 - RNA, 19 nt, Human
gccugugccucugggacug

SEQ ID NO: 1683267 - RNA, 23 nt, Human
gccuugaacuuugaccucugcag

SEQ ID NO: 1683268 - RNA, 16 nt, Human
gccuugaccauucucc

SEQ ID NO: 1683269 - RNA, 22 nt, Human
gccuugaccauucuccaccugc

SEQ ID NO: 1683270 - RNA, 22 nt, Human
gcgauucuucugcuucagccuc

SEQ ID NO: 1683271 - RNA, 23 nt, Human
gccuugaccauucuccaccugcc

SEQ ID NO: 1683272 - RNA, 14 nt, Human
gcgcaggcuggccc

SEQ ID NO: 1683273 - RNA, 21 nt, Human
gcgcagcauauucaggaagcu

SEQ ID NO: 1683274 - RNA, 23 nt, Human
gcgauucuucugcuucagccucc

SEQ ID NO: 1683275 - RNA, 15 nt, Human
gcgcaggcuggcccu

SEQ ID NO: 1683276 - RNA, 16 nt, Human
gcgcaggcuggcccug

SEQ ID NO: 1683277 - RNA, 18 nt, Human
gcuaagugauccucccac

SEQ ID NO: 1683278 - RNA, 22 nt, Human
gcuaagugauccucccaccuca

SEQ ID NO: 1683279 - RNA, 18 nt, Human
gcuauuucuauauuuuca

SEQ ID NO: 1683280 - RNA, 19 nt, Human
gcuauuucuauauuuucau

SEQ ID NO: 1683281 - RNA, 20 nt, Human
gcuauuucuauauuuucauu

SEQ ID NO: 1683282 - RNA, 22 nt, Human
gcuauuucuauauuuucauucu

SEQ ID NO: 1683283 - RNA, 11 nt, Human
gcuauuucuau

SEQ ID NO: 1683284 - RNA, 13 nt, Human
gcuauuucuauau

SEQ ID NO: 1683285 - RNA, 15 nt, Human
gcuauuucuauauuu

SEQ ID NO: 1683286 - RNA, 16 nt, Human
gcuauuucuauauuuu

SEQ ID NO: 1683287 - RNA, 18 nt, Human
gcuauucaguaauaacuc

SEQ ID NO: 1683288 - RNA, 21 nt, Human
gcuaguugggcuuccucauag

SEQ ID NO: 1683289 - RNA, 14 nt, Human
gcuaguugggcuuc

SEQ ID NO: 1683290 - RNA, 16 nt, Human
gcuaguugggcuuccu

SEQ ID NO: 1683291 - RNA, 21 nt, Human
gcuaggaauuguguuuauaau

SEQ ID NO: 1683292 - RNA, 22 nt, Human
gcuaggaccccuccaugugggc

SEQ ID NO: 1683293 - RNA, 20 nt, Human
gcuaggaccccuccaugugg

SEQ ID NO: 1683294 - RNA, 16 nt, Human
gcucagagcaguguuu

SEQ ID NO: 1683295 - RNA, 22 nt, Human
gcucaggagcccugggaggcuc

SEQ ID NO: 1683296 - RNA, 23 nt, Human
gcucaggagcccugggaggcucu

SEQ ID NO: 1683297 - RNA, 13 nt, Human
gcucaggaguuug

SEQ ID NO: 1683298 - RNA, 18 nt, Human
gcucagggccuggcucag

SEQ ID NO: 1683299 - RNA, 19 nt, Human
gcucagggccuggcucagg

SEQ ID NO: 1683300 - RNA, 20 nt, Human
gcucagggccuggcucaggu

SEQ ID NO: 1683301 - RNA, 18 nt, Human
gcauccaguaucuugaag

SEQ ID NO: 1683302 - RNA, 14 nt, Human
gcauccaguaucuu

SEQ ID NO: 1683303 - RNA, 17 nt, Human
gcauccaguaucuugaa

SEQ ID NO: 1683304 - RNA, 19 nt, Human
gcaugugaugagaggaaau

SEQ ID NO: 1683305 - RNA, 21 nt, Human
gcaugugaugagaggaaauca

SEQ ID NO: 1683306 - RNA, 13 nt, Human
gcauugugggaag

SEQ ID NO: 1683307 - RNA, 15 nt, Human
gcauugugggaaggg

SEQ ID NO: 1683308 - RNA, 17 nt, Human
gcauuuaaaagauacag

SEQ ID NO: 1683309 - RNA, 16 nt, Human
gcauuuaaaagauaca

SEQ ID NO: 1683310 - RNA, 16 nt, Human
gcauugugggaagggg

SEQ ID NO: 1683311 - RNA, 18 nt, Human
gcauugugggaaggggag

SEQ ID NO: 1683312 - RNA, 22 nt, Human
gcauuuaaaagauacaguuacu

SEQ ID NO: 1683313 - RNA, 18 nt, Human
gcauuuaaaagauacagu

SEQ ID NO: 1683314 - RNA, 15 nt, Human
gcauuuacuuugugu

SEQ ID NO: 1683315 - RNA, 21 nt, Human
gcauggcugccaaugggagcu

SEQ ID NO: 1683316 - RNA, 13 nt, Human
gcaugggaaugaa

SEQ ID NO: 1683317 - RNA, 14 nt, Human
gcauccuggcaccc

SEQ ID NO: 1683318 - RNA, 17 nt, Human
gcauccuccgccucccg

SEQ ID NO: 1683319 - RNA, 13 nt, Human
gcauccuggcacc

SEQ ID NO: 1683320 - RNA, 20 nt, Human
gcaucuagcaugucgucaaa

SEQ ID NO: 1683321 - RNA, 18 nt, Human
gcauacguacacauuuua

SEQ ID NO: 1683322 - RNA, 17 nt, Human
gcauacguacacauuuu

SEQ ID NO: 1683323 - RNA, 16 nt, Human
gcauacguacacauuu

SEQ ID NO: 1683324 - RNA, 15 nt, Human
gcauacguacacauu

SEQ ID NO: 1683325 - RNA, 22 nt, Human
gcaguuguugcccacagcugua

SEQ ID NO: 1683326 - RNA, 13 nt, Human
gcagugaugucac

SEQ ID NO: 1683327 - RNA, 20 nt, Human
gcacucagaagacacugaug

SEQ ID NO: 1683328 - RNA, 18 nt, Human
gcaagugagagcugggug

SEQ ID NO: 1683329 - RNA, 19 nt, Human
gcaagugagagcugggugu

SEQ ID NO: 1683330 - RNA, 15 nt, Human
gcacuccccugcugg

SEQ ID NO: 1683331 - RNA, 16 nt, Human
gcacuccccugcuggg

SEQ ID NO: 1683332 - RNA, 18 nt, Human
gcacuuuguucuggcucu

SEQ ID NO: 1683333 - RNA, 19 nt, Human
gcacuuuguucuggcucuu

SEQ ID NO: 1683334 - RNA, 13 nt, Human
gcacuccccugcu

SEQ ID NO: 1683335 - RNA, 14 nt, Human
gcacuccccugcug

SEQ ID NO: 1683336 - RNA, 14 nt, Human
gcacuccagccugg

SEQ ID NO: 1683337 - RNA, 15 nt, Human
gcacuccagccuggg

SEQ ID NO: 1683338 - RNA, 22 nt, Human
gcacuuuguucuggcucuucca

SEQ ID NO: 1683339 - RNA, 12 nt, Human
gcagaacaguga

SEQ ID NO: 1683340 - RNA, 13 nt, Human
gcagaacagugau

SEQ ID NO: 1683341 - RNA, 14 nt, Human
gcagagggcacaga

SEQ ID NO: 1683342 - RNA, 17 nt, Human
gcagcauauucaggaag

SEQ ID NO: 1683343 - RNA, 18 nt, Human
gcagcauauucaggaagc

SEQ ID NO: 1683344 - RNA, 19 nt, Human
gcagcauauucaggaagcu

SEQ ID NO: 1683345 - RNA, 23 nt, Human
gcagcauauucaggaagcucagg

SEQ ID NO: 1683346 - RNA, 21 nt, Human
gcagaggaaagcaaaggagau

SEQ ID NO: 1683347 - RNA, 13 nt, Human
gcagaggaaagca

SEQ ID NO: 1683348 - RNA, 14 nt, Human
gcagaggaaagcaa

SEQ ID NO: 1683349 - RNA, 18 nt, Human
gcagaggaaagcaaagga

SEQ ID NO: 1683350 - RNA, 20 nt, Human
gcagaggaaagcaaaggaga

SEQ ID NO: 1683351 - RNA, 18 nt, Human
gcagaacagugauuacca

SEQ ID NO: 1683352 - RNA, 22 nt, Human
gcagaacagugauuaccaggga

SEQ ID NO: 1683353 - RNA, 15 nt, Human
gcagccacauuccug

SEQ ID NO: 1683354 - RNA, 18 nt, Human
gcagcccaccccucaaca

SEQ ID NO: 1683355 - RNA, 14 nt, Human
gcaacccccagccu

SEQ ID NO: 1683356 - RNA, 15 nt, Human
gcaacccccagccug

SEQ ID NO: 1683357 - RNA, 16 nt, Human
gcaacccccagccugc

SEQ ID NO: 1683358 - RNA, 17 nt, Human
gcaacccccagccugcu

SEQ ID NO: 1683359 - RNA, 20 nt, Human
gcaaccuccgccucuugggu

SEQ ID NO: 1683360 - RNA, 20 nt, Human
gcaaccuucgccaccugggu

SEQ ID NO: 1683361 - RNA, 16 nt, Human
gcaacaggcugggcuu

SEQ ID NO: 1683362 - RNA, 19 nt, Human
gcaacaggcugggcuucag

SEQ ID NO: 1683363 - RNA, 13 nt, Human
gcaaccaccacca

SEQ ID NO: 1683364 - RNA, 16 nt, Human
gcaaccaccaccaacc

SEQ ID NO: 1683365 - RNA, 18 nt, Human
gcaaccaccaccaaccac

SEQ ID NO: 1683366 - RNA, 14 nt, Human
gcaacaggcugggc

SEQ ID NO: 1683367 - RNA, 15 nt, Human
gcaacaggcugggcu

SEQ ID NO: 1683368 - RNA, 13 nt, Human
gcaacaggcuggg

SEQ ID NO: 1683369 - RNA, 19 nt, Human
gcaaaauguuacagaaucu

SEQ ID NO: 1683370 - RNA, 16 nt, Human
gcaagugagagcuggg

SEQ ID NO: 1683371 - RNA, 17 nt, Human
gcaaaagaugcuucuca

SEQ ID NO: 1683372 - RNA, 22 nt, Human
gcaaaagaugcuucucacugcc

SEQ ID NO: 1683373 - RNA, 14 nt, Human
gcaaaaaggcagga

SEQ ID NO: 1683374 - RNA, 21 nt, Human
gauuuuuuuuuccuucagugc

SEQ ID NO: 1683375 - RNA, 11 nt, Human
gauuucacucu

SEQ ID NO: 1683376 - RNA, 16 nt, Human
gauuuuuuuuuccuuc

SEQ ID NO: 1683377 - RNA, 12 nt, Human
gauuucacucuc

SEQ ID NO: 1683378 - RNA, 17 nt, Human
gauuuuuuuuuccuuca

SEQ ID NO: 1683379 - RNA, 18 nt, Human
gauuuuuuuuuccuucag

SEQ ID NO: 1683380 - RNA, 18 nt, Human
gauuuaacagaaauguac

SEQ ID NO: 1683381 - RNA, 17 nt, Human
gauuuaacagaaaugua

SEQ ID NO: 1683382 - RNA, 16 nt, Human
gauuuaacagaaaugu

SEQ ID NO: 1683383 - RNA, 20 nt, Human
gauucuucugcuucagccuc

SEQ ID NO: 1683384 - RNA, 19 nt, Human
gauuuaacagaaauguaca

SEQ ID NO: 1683385 - RNA, 13 nt, Human
gauucuucugcuu

SEQ ID NO: 1683386 - RNA, 15 nt, Human
gauucuucugcuuca

SEQ ID NO: 1683387 - RNA, 19 nt, Human
gauccagcagauuauucac

SEQ ID NO: 1683388 - RNA, 18 nt, Human
gauccagcagauuauuca

SEQ ID NO: 1683389 - RNA, 17 nt, Human
gaucugaugcaagcaag

SEQ ID NO: 1683390 - RNA, 19 nt, Human
gaucucuugagccugggag

SEQ ID NO: 1683391 - RNA, 16 nt, Human
gaucugccuaaggacu

SEQ ID NO: 1683392 - RNA, 17 nt, Human
gaucugccuaaggacuu

SEQ ID NO: 1683393 - RNA, 12 nt, Human
gaucugccuaag

SEQ ID NO: 1683394 - RNA, 15 nt, Human
gaucugccuaaggac

SEQ ID NO: 1683395 - RNA, 13 nt, Human
gaugauuucuaug

SEQ ID NO: 1683396 - RNA, 23 nt, Human
gaugauuucuaugcugaguuugu

SEQ ID NO: 1683397 - RNA, 12 nt, Human
gaugauuucuau

SEQ ID NO: 1683398 - RNA, 17 nt, Human
gaugcuucuucagagac

SEQ ID NO: 1683399 - RNA, 20 nt, Human
gaugcuucuucagagacucc

SEQ ID NO: 1683400 - RNA, 21 nt, Human
gaugcuucuucagagacuccu

SEQ ID NO: 1683401 - RNA, 22 nt, Human
gaugauuggaggggggaggugg

SEQ ID NO: 1683402 - RNA, 13 nt, Human
gaugauccuaggc

SEQ ID NO: 1683403 - RNA, 14 nt, Human
gaugauccuaggca

SEQ ID NO: 1683404 - RNA, 22 nt, Human
gauccacccaccucagccuccc

SEQ ID NO: 1683405 - RNA, 20 nt, Human
gauccacccaccucagccuc

SEQ ID NO: 1683406 - RNA, 21 nt, Human
gauccacccaccucagccucc

SEQ ID NO: 1683407 - RNA, 21 nt, Human
gauccaagcuggucccacuca

SEQ ID NO: 1683408 - RNA, 18 nt, Human
gauccacccaccucagcc

SEQ ID NO: 1683409 - RNA, 19 nt, Human
gauccacccaccucagccu

SEQ ID NO: 1683410 - RNA, 21 nt, Human
gaucaaccccuucgcuccugu

SEQ ID NO: 1683411 - RNA, 12 nt, Human
gauccaagcugg

SEQ ID NO: 1683412 - RNA, 16 nt, Human
gauccaagcugguccc

SEQ ID NO: 1683413 - RNA, 17 nt, Human
gauccaagcugguccca

SEQ ID NO: 1683414 - RNA, 19 nt, Human
gauccaagcuggucccacu

SEQ ID NO: 1683415 - RNA, 23 nt, Human
gaucaaaagguuaauaaaguaau

SEQ ID NO: 1683416 - RNA, 22 nt, Human
gaucaaaccccgaccaccugcc

SEQ ID NO: 1683417 - RNA, 21 nt, Human
gauauuuucaacgcagcccug

SEQ ID NO: 1683418 - RNA, 22 nt, Human
gauauuuucaacgcagcccugc

SEQ ID NO: 1683419 - RNA, 23 nt, Human
gauauuuucaacgcagcccugcu

SEQ ID NO: 1683420 - RNA, 15 nt, Human
gauauuuugcuuugu

SEQ ID NO: 1683421 - RNA, 20 nt, Human
gaucaaaagguuaauaaagu

SEQ ID NO: 1683422 - RNA, 19 nt, Human
gauauuuucaacgcagccc

SEQ ID NO: 1683423 - RNA, 18 nt, Human
gauacuuugauauuuuca

SEQ ID NO: 1683424 - RNA, 12 nt, Human
gauacugaaaua

SEQ ID NO: 1683425 - RNA, 21 nt, Human
gauacuguaucaugacaaaga

SEQ ID NO: 1683426 - RNA, 16 nt, Human
gauacuggauuguacu

SEQ ID NO: 1683427 - RNA, 20 nt, Human
gauacuggauuguacuuugu

SEQ ID NO: 1683428 - RNA, 17 nt, Human
gauacuguaucaugaca

SEQ ID NO: 1683429 - RNA, 23 nt, Human
gauacaguuacucagaauucucu

SEQ ID NO: 1683430 - RNA, 19 nt, Human
gauacaguuacucagaauu

SEQ ID NO: 1683431 - RNA, 16 nt, Human
gauacaguuacucaga

SEQ ID NO: 1683432 - RNA, 13 nt, Human
gaauuacauuugu

SEQ ID NO: 1683433 - RNA, 15 nt, Human
gaauuacauuuguau

SEQ ID NO: 1683434 - RNA, 18 nt, Human
gaauuacauuuguauaaa

SEQ ID NO: 1683435 - RNA, 20 nt, Human
gaauuacauuuguauaaaau

SEQ ID NO: 1683436 - RNA, 18 nt, Human
gaauguuugccucugccu

SEQ ID NO: 1683437 - RNA, 19 nt, Human
gaauguuugccucugccuc

SEQ ID NO: 1683438 - RNA, 14 nt, Human
gaauuaacacauga

SEQ ID NO: 1683439 - RNA, 15 nt, Human
gaauuaacacaugau

SEQ ID NO: 1683440 - RNA, 19 nt, Human
gaaugcacaaacagaggcc

SEQ ID NO: 1683441 - RNA, 16 nt, Human
gaauguuugccucugc

SEQ ID NO: 1683442 - RNA, 17 nt, Human
gaauguuugccucugcc

SEQ ID NO: 1683443 - RNA, 18 nt, Human
gaaugcacaaacagaggc

SEQ ID NO: 1683444 - RNA, 22 nt, Human
gaaugauuaugaauuacauuug

SEQ ID NO: 1683445 - RNA, 20 nt, Human
gaaugaugauccuaggcauu

SEQ ID NO: 1683446 - RNA, 14 nt, Human
gaaugaugccauga

SEQ ID NO: 1683447 - RNA, 14 nt, Human
gaaugauuaauuaa

SEQ ID NO: 1683448 - RNA, 14 nt, Human
gaaugauuaugaau

SEQ ID NO: 1683449 - RNA, 15 nt, Human
gaaugaauggcuaag

SEQ ID NO: 1683450 - RNA, 20 nt, Human
gaaugaauggcuaagcaaaa

SEQ ID NO: 1683451 - RNA, 14 nt, Human
gacaaaaagcuacu

SEQ ID NO: 1683452 - RNA, 14 nt, Human
gaauuaugaaacuu

SEQ ID NO: 1683453 - RNA, 12 nt, Human
gacacagcucuu

SEQ ID NO: 1683454 - RNA, 19 nt, Human
gacacagcucuucuccagg

SEQ ID NO: 1683455 - RNA, 20 nt, Human
gacacagcucuucuccaggc

SEQ ID NO: 1683456 - RNA, 21 nt, Human
gacacagcucuucuccaggcu

SEQ ID NO: 1683457 - RNA, 13 nt, Human
gacacagcucuuc

SEQ ID NO: 1683458 - RNA, 22 nt, Human
gaauaucuccgucaacucauau

SEQ ID NO: 1683459 - RNA, 11 nt, Human
gaauauugcug

SEQ ID NO: 1683460 - RNA, 12 nt, Human
gaauauugcuga

SEQ ID NO: 1683461 - RNA, 13 nt, Human
gaauauugcugau

SEQ ID NO: 1683462 - RNA, 15 nt, Human
gaauauauaaccagu

SEQ ID NO: 1683463 - RNA, 22 nt, Human
gaauauugcugauggugcaaug

SEQ ID NO: 1683464 - RNA, 23 nt, Human
gaauauugcugauggugcaauga

SEQ ID NO: 1683465 - RNA, 24 nt, Human
gaauauugcugauggugcaaugac

SEQ ID NO: 1683466 - RNA, 14 nt, Human
gaaugaauggcuaa

SEQ ID NO: 1683467 - RNA, 10 nt, Human
gacccugagg

SEQ ID NO: 1683468 - RNA, 14 nt, Human
gaccucaggccugg

SEQ ID NO: 1683469 - RNA, 22 nt, Human
gaccucagguaaucgaccugcc

SEQ ID NO: 1683470 - RNA, 23 nt, Human
gaccucagguaaucgaccugccu

SEQ ID NO: 1683471 - RNA, 19 nt, Human
gaccucaggccugggggcu

SEQ ID NO: 1683472 - RNA, 18 nt, Human
gaccucaggugagaagca

SEQ ID NO: 1683473 - RNA, 19 nt, Human
gaccucaggugagaagcag

SEQ ID NO: 1683474 - RNA, 21 nt, Human
gaccucaggugagaagcagag

SEQ ID NO: 1683475 - RNA, 19 nt, Human
gaccucaggugauccaccc

SEQ ID NO: 1683476 - RNA, 20 nt, Human
gaccucaggugauccaccca

SEQ ID NO: 1683477 - RNA, 21 nt, Human
gaccucaggugauccacccac

SEQ ID NO: 1683478 - RNA, 18 nt, Human
gacccggaggggccuggc

SEQ ID NO: 1683479 - RNA, 19 nt, Human
gacccggaggggccuggca

SEQ ID NO: 1683480 - RNA, 20 nt, Human
gacccggaggggccuggcag

SEQ ID NO: 1683481 - RNA, 16 nt, Human
gaccccugagcuugca

SEQ ID NO: 1683482 - RNA, 17 nt, Human
gacccggaggggccugg

SEQ ID NO: 1683483 - RNA, 22 nt, Human
gaccucugcagcaauaaagcag

SEQ ID NO: 1683484 - RNA, 18 nt, Human
gaccucugcagcaauaaa

SEQ ID NO: 1683485 - RNA, 16 nt, Human
gaccucugcagcaaua

SEQ ID NO: 1683486 - RNA, 15 nt, Human
gacgccaucccagcc

SEQ ID NO: 1683487 - RNA, 21 nt, Human
gacgccaucccagccccaaug

SEQ ID NO: 1683488 - RNA, 13 nt, Human
gaccucugccuga

SEQ ID NO: 1683489 - RNA, 12 nt, Human
gacgccauccca

SEQ ID NO: 1683490 - RNA, 13 nt, Human
gacgccaucccag

SEQ ID NO: 1683491 - RNA, 16 nt, Human
gacgcugugcugcccu

SEQ ID NO: 1683492 - RNA, 17 nt, Human
gacgcugugcugcccug

SEQ ID NO: 1683493 - RNA, 18 nt, Human
gacgcugugcugcccugc

SEQ ID NO: 1683494 - RNA, 21 nt, Human
gacgcugugcugcccugccca

SEQ ID NO: 1683495 - RNA, 22 nt, Human
gacgcuacccgggaagggggcu

SEQ ID NO: 1683496 - RNA, 23 nt, Human
gacgcuacccgggaagggggcug

SEQ ID NO: 1683497 - RNA, 14 nt, Human
gacgcucucuggcc

SEQ ID NO: 1683498 - RNA, 14 nt, Human
gacagcccgggcuc

SEQ ID NO: 1683499 - RNA, 16 nt, Human
gacagcccgggcucug

SEQ ID NO: 1683500 - RNA, 17 nt, Human
gacagcuccuucugucc

SEQ ID NO: 1683501 - RNA, 18 nt, Human
gacagcuccuucuguccu

SEQ ID NO: 1683502 - RNA, 14 nt, Human
gacagucccugcca

SEQ ID NO: 1683503 - RNA, 15 nt, Human
gacagucccugccaa

SEQ ID NO: 1683504 - RNA, 16 nt, Human
gacagucccugccaau

SEQ ID NO: 1683505 - RNA, 20 nt, Human
gacagucccugccaauggac

SEQ ID NO: 1683506 - RNA, 12 nt, Human
gacagucccugc

SEQ ID NO: 1683507 - RNA, 11 nt, Human
gacagcucuua

SEQ ID NO: 1683508 - RNA, 18 nt, Human
gacagucaccucauggaa

SEQ ID NO: 1683509 - RNA, 10 nt, Human
gacagcucuu

SEQ ID NO: 1683510 - RNA, 19 nt, Human
gacagcuccuucuguccua

SEQ ID NO: 1683511 - RNA, 12 nt, Human
gacagcucugca

SEQ ID NO: 1683512 - RNA, 19 nt, Human
gacauuguagagcuucugg

SEQ ID NO: 1683513 - RNA, 23 nt, Human
gacauugcggacagccacggcca

SEQ ID NO: 1683514 - RNA, 13 nt, Human
gagacuccugcag

SEQ ID NO: 1683515 - RNA, 14 nt, Human
gagacuccugcagg

SEQ ID NO: 1683516 - RNA, 15 nt, Human
gagagccuuccaggg

SEQ ID NO: 1683517 - RNA, 16 nt, Human
gagagccuuccagggg

SEQ ID NO: 1683518 - RNA, 13 nt, Human
gagagcugggugu

SEQ ID NO: 1683519 - RNA, 15 nt, Human
gagagcuagcagcag

SEQ ID NO: 1683520 - RNA, 21 nt, Human
gagagcuagcagcagggaggg

SEQ ID NO: 1683521 - RNA, 18 nt, Human
gagagccuuccaggggug

SEQ ID NO: 1683522 - RNA, 20 nt, Human
gagagccuuccagggguggg

SEQ ID NO: 1683523 - RNA, 15 nt, Human
gagaggacccccuga

SEQ ID NO: 1683524 - RNA, 22 nt, Human
gagagcuucuguugcugccuca

SEQ ID NO: 1683525 - RNA, 12 nt, Human
gagaggaaauca

SEQ ID NO: 1683526 - RNA, 20 nt, Human
gagagcugggugucaagagg

SEQ ID NO: 1683527 - RNA, 14 nt, Human
gagauuggaaggaa

SEQ ID NO: 1683528 - RNA, 21 nt, Human
gagauugugccccugcacucc

SEQ ID NO: 1683529 - RNA, 15 nt, Human
gagauuauguucuuu

SEQ ID NO: 1683530 - RNA, 20 nt, Human
gagaugcuagaacucccuuu

SEQ ID NO: 1683531 - RNA, 16 nt, Human
gagaugcuagaacucc

SEQ ID NO: 1683532 - RNA, 20 nt, Human
gacuuuuccaacccucauca

SEQ ID NO: 1683533 - RNA, 18 nt, Human
gacuuuuauuuccaguga

SEQ ID NO: 1683534 - RNA, 14 nt, Human
gacuuuuccaaccc

SEQ ID NO: 1683535 - RNA, 19 nt, Human
gacuuuuccaacccucauc

SEQ ID NO: 1683536 - RNA, 22 nt, Human
gacuuuuuauggcacuaguauu

SEQ ID NO: 1683537 - RNA, 18 nt, Human
gagacgggggcagagagg

SEQ ID NO: 1683538 - RNA, 16 nt, Human
gagacggagucccacc

SEQ ID NO: 1683539 - RNA, 19 nt, Human
gagacggagucccaccuug

SEQ ID NO: 1683540 - RNA, 14 nt, Human
gagacggaguccca

SEQ ID NO: 1683541 - RNA, 15 nt, Human
gagaaugaaagggcc

SEQ ID NO: 1683542 - RNA, 23 nt, Human
gagaaugaaagggcccagagagg

SEQ ID NO: 1683543 - RNA, 22 nt, Human
gagcuguucacagccagacugg

SEQ ID NO: 1683544 - RNA, 13 nt, Human
gagcccugguggc

SEQ ID NO: 1683545 - RNA, 14 nt, Human
gagcccugguggca

SEQ ID NO: 1683546 - RNA, 20 nt, Human
gagcuguucacagccagacu

SEQ ID NO: 1683547 - RNA, 12 nt, Human
gagcccugggag

SEQ ID NO: 1683548 - RNA, 16 nt, Human
gagcccugggaggcuc

SEQ ID NO: 1683549 - RNA, 18 nt, Human
gagcccugggaggcucug

SEQ ID NO: 1683550 - RNA, 19 nt, Human
gagcccugggaggcucugg

SEQ ID NO: 1683551 - RNA, 20 nt, Human
gagcccugggaggcucugga

SEQ ID NO: 1683552 - RNA, 14 nt, Human
gagccccgaggccu

SEQ ID NO: 1683553 - RNA, 17 nt, Human
gagccccgaggccuucu

SEQ ID NO: 1683554 - RNA, 17 nt, Human
gagcaucaggccaggcc

SEQ ID NO: 1683555 - RNA, 15 nt, Human
gagcaucaggccagg

SEQ ID NO: 1683556 - RNA, 16 nt, Human
gagcaucaggccaggc

SEQ ID NO: 1683557 - RNA, 21 nt, Human
gagcaugccuggauggggcug

SEQ ID NO: 1683558 - RNA, 13 nt, Human
gagcaugccugga

SEQ ID NO: 1683559 - RNA, 14 nt, Human
gagcaucaggccag

SEQ ID NO: 1683560 - RNA, 14 nt, Human
gagcagucaggaaa

SEQ ID NO: 1683561 - RNA, 16 nt, Human
gaggacuuuucuuugu

SEQ ID NO: 1683562 - RNA, 20 nt, Human
gaggacuuuucuuuguggcu

SEQ ID NO: 1683563 - RNA, 23 nt, Human
gaggacuuuucuuuguggcuucc

SEQ ID NO: 1683564 - RNA, 21 nt, Human
gaggacgcucucuggccuucg

SEQ ID NO: 1683565 - RNA, 22 nt, Human
gaggcagggucucacucugucg

SEQ ID NO: 1683566 - RNA, 19 nt, Human
gaggcagggucucacucug

SEQ ID NO: 1683567 - RNA, 20 nt, Human
gaggcagggucucacucugu

SEQ ID NO: 1683568 - RNA, 12 nt, Human
gaggagagagga

SEQ ID NO: 1683569 - RNA, 14 nt, Human
gaggagagaggacc

SEQ ID NO: 1683570 - RNA, 15 nt, Human
gaggagagaggaccc

SEQ ID NO: 1683571 - RNA, 12 nt, Human
gaggagaaacug

SEQ ID NO: 1683572 - RNA, 14 nt, Human
gaggagaaacugga

SEQ ID NO: 1683573 - RNA, 20 nt, Human
gaggcucuggagcccacugu

SEQ ID NO: 1683574 - RNA, 18 nt, Human
gaggcugagaugggagaa

SEQ ID NO: 1683575 - RNA, 17 nt, Human
gaggcuccacuuggucu

SEQ ID NO: 1683576 - RNA, 18 nt, Human
gaggcuccacuuggucug

SEQ ID NO: 1683577 - RNA, 19 nt, Human
gaggcauuuguuugaacug

SEQ ID NO: 1683578 - RNA, 22 nt, Human
gaggcaugugaugagaggaaau

SEQ ID NO: 1683579 - RNA, 20 nt, Human
gaggcaugugaugagaggaa

SEQ ID NO: 1683580 - RNA, 21 nt, Human
gaggcaugugaugagaggaaa

SEQ ID NO: 1683581 - RNA, 21 nt, Human
gaggcauuuguuugaacugau

SEQ ID NO: 1683582 - RNA, 17 nt, Human
gaggccaaggugggagg

SEQ ID NO: 1683583 - RNA, 15 nt, Human
gaggcuccacuuggu

SEQ ID NO: 1683584 - RNA, 12 nt, Human
gagggccugggc

SEQ ID NO: 1683585 - RNA, 14 nt, Human
gagggccugcaagg

SEQ ID NO: 1683586 - RNA, 17 nt, Human
gagggccugcaagggag

SEQ ID NO: 1683587 - RNA, 21 nt, Human
gagggccugcaagggagugag

SEQ ID NO: 1683588 - RNA, 18 nt, Human
cugugcucuggacaggca

SEQ ID NO: 1683589 - RNA, 19 nt, Human
cugugcucuggacaggcau

SEQ ID NO: 1683590 - RNA, 19 nt, Human
cugugagcaucacaguuuu

SEQ ID NO: 1683591 - RNA, 22 nt, Human
cugugucagguggggcagcuug

SEQ ID NO: 1683592 - RNA, 17 nt, Human
cuguuacugucuucagu

SEQ ID NO: 1683593 - RNA, 13 nt, Human
cuguuauauaaau

SEQ ID NO: 1683594 - RNA, 14 nt, Human
cuguuauauaaaug

SEQ ID NO: 1683595 - RNA, 15 nt, Human
cuguuauauaaaugg

SEQ ID NO: 1683596 - RNA, 16 nt, Human
cuguucagcuccagcu

SEQ ID NO: 1683597 - RNA, 18 nt, Human
cuguucagcuccagcuca

SEQ ID NO: 1683598 - RNA, 19 nt, Human
cuguucagcuccagcucac

SEQ ID NO: 1683599 - RNA, 22 nt, Human
cuguucagcuccagcucaccag

SEQ ID NO: 1683600 - RNA, 12 nt, Human
cuguucagcugg

SEQ ID NO: 1683601 - RNA, 18 nt, Human
cuguucagcugguugagg

SEQ ID NO: 1683602 - RNA, 19 nt, Human
cuguucacagccagacugg

SEQ ID NO: 1683603 - RNA, 22 nt, Human
cuguuauauaaaugguuaaaag

SEQ ID NO: 1683604 - RNA, 13 nt, Human
cuguucacucuac

SEQ ID NO: 1683605 - RNA, 15 nt, Human
cuguucagcuccagc

SEQ ID NO: 1683606 - RNA, 22 nt, Human
cuguucacagccagacuggcac

SEQ ID NO: 1683607 - RNA, 15 nt, Human
cugugaacuugaaau

SEQ ID NO: 1683608 - RNA, 16 nt, Human
cugugaacugaacucu

SEQ ID NO: 1683609 - RNA, 13 nt, Human
cugugaacugaac

SEQ ID NO: 1683610 - RNA, 15 nt, Human
cugugaacugaacuc

SEQ ID NO: 1683611 - RNA, 16 nt, Human
cugugaacuugaaauu

SEQ ID NO: 1683612 - RNA, 17 nt, Human
cugugaacuugaaauuu

SEQ ID NO: 1683613 - RNA, 17 nt, Human
cugugcucuggacaggc

SEQ ID NO: 1683614 - RNA, 23 nt, Human
cugugagaugcuagaacucccuu

SEQ ID NO: 1683615 - RNA, 16 nt, Human
cugugagcaucacagu

SEQ ID NO: 1683616 - RNA, 14 nt, Human
cuguugcugccuca

SEQ ID NO: 1683617 - RNA, 12 nt, Human
cuguuggccagu

SEQ ID NO: 1683618 - RNA, 15 nt, Human
cuguuggccagugug

SEQ ID NO: 1683619 - RNA, 19 nt, Human
cuuaaauaaugugaaacug

SEQ ID NO: 1683620 - RNA, 16 nt, Human
cuuaaauaaugugaaa

SEQ ID NO: 1683621 - RNA, 14 nt, Human
cuuaaauaauguga

SEQ ID NO: 1683622 - RNA, 21 nt, Human
cuuaaaaaugguuuaaauggu

SEQ ID NO: 1683623 - RNA, 13 nt, Human
cuuaaaaaugguu

SEQ ID NO: 1683624 - RNA, 20 nt, Human
cuuaaaaaugguuuaaaugg

SEQ ID NO: 1683625 - RNA, 13 nt, Human
cuggugacugauu

SEQ ID NO: 1683626 - RNA, 14 nt, Human
cuggugacugauuc

SEQ ID NO: 1683627 - RNA, 15 nt, Human
cuggugacugauucu

SEQ ID NO: 1683628 - RNA, 17 nt, Human
cuggugacugauucuuc

SEQ ID NO: 1683629 - RNA, 18 nt, Human
cuggucuuauuuguaaag

SEQ ID NO: 1683630 - RNA, 18 nt, Human
cuggugacugauucuuca

SEQ ID NO: 1683631 - RNA, 15 nt, Human
cuggugcccugcuuu

SEQ ID NO: 1683632 - RNA, 16 nt, Human
cuggugcccugcuuuc

SEQ ID NO: 1683633 - RNA, 19 nt, Human
cuggugcccugcuuucaga

SEQ ID NO: 1683634 - RNA, 21 nt, Human
cuggugcccugcuuucagaua

SEQ ID NO: 1683635 - RNA, 23 nt, Human
cuggugcccugcuuucagauacu

SEQ ID NO: 1683636 - RNA, 12 nt, Human
cuggugccucac

SEQ ID NO: 1683637 - RNA, 18 nt, Human
cuguaggaagguuaaugu

SEQ ID NO: 1683638 - RNA, 14 nt, Human
cugucauuugagca

SEQ ID NO: 1683639 - RNA, 13 nt, Human
cuguccugggagu

SEQ ID NO: 1683640 - RNA, 14 nt, Human
cuguccugggagug

SEQ ID NO: 1683641 - RNA, 20 nt, Human
cuguccugggagugagcugg

SEQ ID NO: 1683642 - RNA, 21 nt, Human
cuguccugggagugagcuggu

SEQ ID NO: 1683643 - RNA, 22 nt, Human
cugucuaaugaaaccugugucu

SEQ ID NO: 1683644 - RNA, 16 nt, Human
cuguacuugcucuuga

SEQ ID NO: 1683645 - RNA, 19 nt, Human
cuguacuugcucuugaugc

SEQ ID NO: 1683646 - RNA, 20 nt, Human
cuguacuugcucuugaugcc

SEQ ID NO: 1683647 - RNA, 21 nt, Human
cuguacuugcucuugaugccu

SEQ ID NO: 1683648 - RNA, 15 nt, Human
cuguagagugggagc

SEQ ID NO: 1683649 - RNA, 20 nt, Human
cuguaagaaaauaucacuug

SEQ ID NO: 1683650 - RNA, 14 nt, Human
cugcucacauaucu

SEQ ID NO: 1683651 - RNA, 24 nt, Human
cugcugaaggcucgagcaugccug

SEQ ID NO: 1683652 - RNA, 23 nt, Human
cugcugaaggcucgagcaugccu

SEQ ID NO: 1683653 - RNA, 18 nt, Human
cugcugaaggcucgagca

SEQ ID NO: 1683654 - RNA, 15 nt, Human
cugccuguucccauu

SEQ ID NO: 1683655 - RNA, 19 nt, Human
cugccuguucccauucuug

SEQ ID NO: 1683656 - RNA, 20 nt, Human
cugccuguucagcuccagcu

SEQ ID NO: 1683657 - RNA, 23 nt, Human
cugccuguucagcuccagcucac

SEQ ID NO: 1683658 - RNA, 18 nt, Human
cugccuccccuccucugc

SEQ ID NO: 1683659 - RNA, 17 nt, Human
cugccuccccuccucug

SEQ ID NO: 1683660 - RNA, 20 nt, Human
cugccucgaacuggcugcaa

SEQ ID NO: 1683661 - RNA, 17 nt, Human
cugccuccuuugugagg

SEQ ID NO: 1683662 - RNA, 21 nt, Human
cugccuccuuugugaggaagc

SEQ ID NO: 1683663 - RNA, 23 nt, Human
cugccuccuuugugaggaagccg

SEQ ID NO: 1683664 - RNA, 14 nt, Human
cugccucgaacugg

SEQ ID NO: 1683665 - RNA, 14 nt, Human
cugccuccuuugug

SEQ ID NO: 1683666 - RNA, 20 nt, Human
cugccuccccuccucugcuu

SEQ ID NO: 1683667 - RNA, 19 nt, Human
cugccuccccuccucugcu

SEQ ID NO: 1683668 - RNA, 21 nt, Human
cugccuccccuccucugcuug

SEQ ID NO: 1683669 - RNA, 12 nt, Human
cugcccuggugc

SEQ ID NO: 1683670 - RNA, 13 nt, Human
cugcccuggugcu

SEQ ID NO: 1683671 - RNA, 14 nt, Human
cugcccuggugcug

SEQ ID NO: 1683672 - RNA, 15 nt, Human
cugcccuggugcugc

SEQ ID NO: 1683673 - RNA, 23 nt, Human
cugcccuggugcugccacacuuc

SEQ ID NO: 1683674 - RNA, 17 nt, Human
cugcccugguuuccugc

SEQ ID NO: 1683675 - RNA, 18 nt, Human
cugcccugguuuccugcc

SEQ ID NO: 1683676 - RNA, 19 nt, Human
cugcccugguuuccugccc

SEQ ID NO: 1683677 - RNA, 21 nt, Human
cugcccugguuuccugcccug

SEQ ID NO: 1683678 - RNA, 24 nt, Human
cugcccugugaguacuacaguccu

SEQ ID NO: 1683679 - RNA, 20 nt, Human
cugcccugguuuccugcccu

SEQ ID NO: 1683680 - RNA, 14 nt, Human
cugcccugugggcc

SEQ ID NO: 1683681 - RNA, 19 nt, Human
cugcccuuaccugccagga

SEQ ID NO: 1683682 - RNA, 11 nt, Human
cugcccugugg

SEQ ID NO: 1683683 - RNA, 12 nt, Human
cugcccuguggg

SEQ ID NO: 1683684 - RNA, 22 nt, Human
cugcccuuaccugccaggaagc

SEQ ID NO: 1683685 - RNA, 23 nt, Human
cugcccuuaccugccaggaagcc

SEQ ID NO: 1683686 - RNA, 22 nt, Human
cuggacuccucuguccaggcac

SEQ ID NO: 1683687 - RNA, 23 nt, Human
cuggacuccucuguccaggcacu

SEQ ID NO: 1683688 - RNA, 21 nt, Human
cuggagaaaauggacguguua

SEQ ID NO: 1683689 - RNA, 14 nt, Human
cuggagaacuagag

SEQ ID NO: 1683690 - RNA, 15 nt, Human
cuggagaacuagaga

SEQ ID NO: 1683691 - RNA, 17 nt, Human
cuggauccaucaggcca

SEQ ID NO: 1683692 - RNA, 14 nt, Human
cugcuucaaggauc

SEQ ID NO: 1683693 - RNA, 16 nt, Human
cugcuucaaggauccu

SEQ ID NO: 1683694 - RNA, 19 nt, Human
cugcuucaaggauccugag

SEQ ID NO: 1683695 - RNA, 20 nt, Human
cugcuucaaggauccugagc

SEQ ID NO: 1683696 - RNA, 14 nt, Human
cugcuuccagugag

SEQ ID NO: 1683697 - RNA, 23 nt, Human
cuggaaaaguauguuagugcaaa

SEQ ID NO: 1683698 - RNA, 19 nt, Human
cuggauccaucaggccacu

SEQ ID NO: 1683699 - RNA, 20 nt, Human
cuggaucuccauucucucag

SEQ ID NO: 1683700 - RNA, 16 nt, Human
cuggaugcagccucac

SEQ ID NO: 1683701 - RNA, 17 nt, Human
cuggaugcagccucaca

SEQ ID NO: 1683702 - RNA, 18 nt, Human
cuggaugcagccucacag

SEQ ID NO: 1683703 - RNA, 22 nt, Human
cuggaugcagccucacaguccu

SEQ ID NO: 1683704 - RNA, 19 nt, Human
cuggcagccgugccuucag

SEQ ID NO: 1683705 - RNA, 17 nt, Human
cuggcagccgugccuuc

SEQ ID NO: 1683706 - RNA, 18 nt, Human
cuggcagccgugccuuca

SEQ ID NO: 1683707 - RNA, 16 nt, Human
cuggcagcucagagag

SEQ ID NO: 1683708 - RNA, 17 nt, Human
cuggcagcucagagagg

SEQ ID NO: 1683709 - RNA, 19 nt, Human
cuggcagcucagagagggu

SEQ ID NO: 1683710 - RNA, 19 nt, Human
cuggcucccacaggcccuu

SEQ ID NO: 1683711 - RNA, 18 nt, Human
cuggcucccacaggcccu

SEQ ID NO: 1683712 - RNA, 22 nt, Human
cuggcucccacaggcccuuccu

SEQ ID NO: 1683713 - RNA, 13 nt, Human
cuggcucuuccag

SEQ ID NO: 1683714 - RNA, 14 nt, Human
cuggcucuuccagg

SEQ ID NO: 1683715 - RNA, 15 nt, Human
cuggcucuuccaggc

SEQ ID NO: 1683716 - RNA, 17 nt, Human
cugggacuacaggcacc

SEQ ID NO: 1683717 - RNA, 21 nt, Human
cugggacuacaggcacccacc

SEQ ID NO: 1683718 - RNA, 17 nt, Human
cugggacuacaggugug

SEQ ID NO: 1683719 - RNA, 20 nt, Human
cuggcagaguugaagacaga

SEQ ID NO: 1683720 - RNA, 21 nt, Human
cuggcagaguugaagacagag

SEQ ID NO: 1683721 - RNA, 13 nt, Human
cuggcagccgugc

SEQ ID NO: 1683722 - RNA, 23 nt, Human
cuggcagccccuguucuggcaga

SEQ ID NO: 1683723 - RNA, 22 nt, Human
cuggcagaguugaagacagagc

SEQ ID NO: 1683724 - RNA, 18 nt, Human
gaaagacuaucuaaaugu

SEQ ID NO: 1683725 - RNA, 17 nt, Human
gaaaggcuccaggagca

SEQ ID NO: 1683726 - RNA, 18 nt, Human
gaaaggcuccaggagcag

SEQ ID NO: 1683727 - RNA, 19 nt, Human
gaaaggcuccaggagcagc

SEQ ID NO: 1683728 - RNA, 20 nt, Human
gaaaggcuccaggagcagcc

SEQ ID NO: 1683729 - RNA, 22 nt, Human
gaaaguacuucuccacccugcu

SEQ ID NO: 1683730 - RNA, 21 nt, Human
gaaaguacuucuccacccugc

SEQ ID NO: 1683731 - RNA, 17 nt, Human
gaaaucaaauaugcaaa

SEQ ID NO: 1683732 - RNA, 16 nt, Human
gaaaucaaauaugcaa

SEQ ID NO: 1683733 - RNA, 17 nt, Human
gaaaucaccgaaaacgu

SEQ ID NO: 1683734 - RNA, 19 nt, Human
gaaaucaccgaaaacgugg

SEQ ID NO: 1683735 - RNA, 23 nt, Human
gaaaucaaauaugcaaagcacug

SEQ ID NO: 1683736 - RNA, 18 nt, Human
gaaauuuuuauuaaauua

SEQ ID NO: 1683737 - RNA, 18 nt, Human
gaaaugaaagcagggacu

SEQ ID NO: 1683738 - RNA, 19 nt, Human
gaaauuuuuauuaaauuau

SEQ ID NO: 1683739 - RNA, 17 nt, Human
gaacaaauuuacagaga

SEQ ID NO: 1683740 - RNA, 18 nt, Human
gaacaaauuuacagagac

SEQ ID NO: 1683741 - RNA, 23 nt, Human
gaacaaauuuacagagacagaaa

SEQ ID NO: 1683742 - RNA, 14 nt, Human
gaaacuuguguaaa

SEQ ID NO: 1683743 - RNA, 16 nt, Human
gaaacuuguguaaaua

SEQ ID NO: 1683744 - RNA, 20 nt, Human
gaaacuuguguaaauacaau

SEQ ID NO: 1683745 - RNA, 18 nt, Human
gaaagaaguggggacaga

SEQ ID NO: 1683746 - RNA, 23 nt, Human
gaaacuucagcgguuuauauaag

SEQ ID NO: 1683747 - RNA, 14 nt, Human
gaacaaggcaaggc

SEQ ID NO: 1683748 - RNA, 15 nt, Human
gaacaaggcaaggcu

SEQ ID NO: 1683749 - RNA, 17 nt, Human
gaacaaggcaaggcugu

SEQ ID NO: 1683750 - RNA, 18 nt, Human
gaacaaggcaaggcuguc

SEQ ID NO: 1683751 - RNA, 21 nt, Human
gaacaaggcaaggcugucaau

SEQ ID NO: 1683752 - RNA, 14 nt, Human
gaaaaaauauauau

SEQ ID NO: 1683753 - RNA, 19 nt, Human
gaaaaaauauuuuccugcc

SEQ ID NO: 1683754 - RNA, 21 nt, Human
cuuuuuuuuuuuuuuugacaa

SEQ ID NO: 1683755 - RNA, 18 nt, Human
cuuuugugcauuaucuag

SEQ ID NO: 1683756 - RNA, 14 nt, Human
cuuuugugcauuau

SEQ ID NO: 1683757 - RNA, 15 nt, Human
cuuuuggucugugug

SEQ ID NO: 1683758 - RNA, 16 nt, Human
cuuuuggucuguguga

SEQ ID NO: 1683759 - RNA, 17 nt, Human
cuuuugucuaugggacu

SEQ ID NO: 1683760 - RNA, 13 nt, Human
cuuuugguuaagu

SEQ ID NO: 1683761 - RNA, 18 nt, Human
cuuuugccguuauuaaaa

SEQ ID NO: 1683762 - RNA, 14 nt, Human
gaaaauuaacauga

SEQ ID NO: 1683763 - RNA, 18 nt, Human
gaaaauuaggauuucaug

SEQ ID NO: 1683764 - RNA, 22 nt, Human
gaaaauuaggauuucaugauuu

SEQ ID NO: 1683765 - RNA, 19 nt, Human
gaaaacugcaacuuguaaa

SEQ ID NO: 1683766 - RNA, 18 nt, Human
gaaaacuuguauuaugug

SEQ ID NO: 1683767 - RNA, 20 nt, Human
gaaaagacuccaaagaaaug

SEQ ID NO: 1683768 - RNA, 21 nt, Human
gaaaagacuccaaagaaaugu

SEQ ID NO: 1683769 - RNA, 18 nt, Human
gaaaauuuugauguuuua

SEQ ID NO: 1683770 - RNA, 19 nt, Human
cuuuuaugugaaacauguu

SEQ ID NO: 1683771 - RNA, 21 nt, Human
cuugucucagauuuuauuaug

SEQ ID NO: 1683772 - RNA, 20 nt, Human
cuugucuuuggacccugagg

SEQ ID NO: 1683773 - RNA, 13 nt, Human
cuugucuguagau

SEQ ID NO: 1683774 - RNA, 20 nt, Human
cuugguucccauuugcuccu

SEQ ID NO: 1683775 - RNA, 16 nt, Human
cuugguucccauuugc

SEQ ID NO: 1683776 - RNA, 22 nt, Human
cuugguccugcugcaguugcca

SEQ ID NO: 1683777 - RNA, 23 nt, Human
cuuggucucagugucaaugcagc

SEQ ID NO: 1683778 - RNA, 16 nt, Human
cuugguccugcugcag

SEQ ID NO: 1683779 - RNA, 17 nt, Human
cuugguccugcugcagu

SEQ ID NO: 1683780 - RNA, 18 nt, Human
cuugguccugcugcaguu

SEQ ID NO: 1683781 - RNA, 20 nt, Human
cuugguccugcugcaguugc

SEQ ID NO: 1683782 - RNA, 15 nt, Human
cuugguccugcugca

SEQ ID NO: 1683783 - RNA, 21 nt, Human
cuugucuuuggacccugaggc

SEQ ID NO: 1683784 - RNA, 22 nt, Human
cuugucuuuggacccugaggcc

SEQ ID NO: 1683785 - RNA, 22 nt, Human
cuuuaaugucacaggcaggucc

SEQ ID NO: 1683786 - RNA, 14 nt, Human
cuuucaauaggaaa

SEQ ID NO: 1683787 - RNA, 15 nt, Human
cuuucaauaggaaaa

SEQ ID NO: 1683788 - RNA, 17 nt, Human
cuuuaaugucacaggca

SEQ ID NO: 1683789 - RNA, 18 nt, Human
cuuuaaugucacaggcag

SEQ ID NO: 1683790 - RNA, 19 nt, Human
cuuuaaugucacaggcagg

SEQ ID NO: 1683791 - RNA, 20 nt, Human
cuuuaaugucacaggcaggu

SEQ ID NO: 1683792 - RNA, 17 nt, Human
cuuucaauaggaaaaac

SEQ ID NO: 1683793 - RNA, 18 nt, Human
cuuucaauaggaaaaacu

SEQ ID NO: 1683794 - RNA, 21 nt, Human
cuuggcgcugccccuggcagc

SEQ ID NO: 1683795 - RNA, 22 nt, Human
cuuggcgcugccccuggcagcc

SEQ ID NO: 1683796 - RNA, 23 nt, Human
cuuggcgcugccccuggcagccc

SEQ ID NO: 1683797 - RNA, 22 nt, Human
cuuggauuguccccgacccuug

SEQ ID NO: 1683798 - RNA, 18 nt, Human
cuuggauuguccccgacc

SEQ ID NO: 1683799 - RNA, 20 nt, Human
cuuggauuguccccgacccu

SEQ ID NO: 1683800 - RNA, 15 nt, Human
cuuggauuguccccg

SEQ ID NO: 1683801 - RNA, 19 nt, Human
cuugccgucuaccugaggg

SEQ ID NO: 1683802 - RNA, 18 nt, Human
cuugccgucuaccugagg

SEQ ID NO: 1683803 - RNA, 19 nt, Human
cuugauucauaaugacuua

SEQ ID NO: 1683804 - RNA, 15 nt, Human
cuugauguguuaucu

SEQ ID NO: 1683805 - RNA, 20 nt, Human
cuuacauuagcaguuugcuu

SEQ ID NO: 1683806 - RNA, 19 nt, Human
cuucugaacuuggcgcugc

SEQ ID NO: 1683807 - RNA, 22 nt, Human
cuucugaacuuggcgcugcccc

SEQ ID NO: 1683808 - RNA, 16 nt, Human
cuuccucuccacugcc

SEQ ID NO: 1683809 - RNA, 17 nt, Human
cuuccucuccacugccu

SEQ ID NO: 1683810 - RNA, 19 nt, Human
cuuccucuccacugccuuc

SEQ ID NO: 1683811 - RNA, 21 nt, Human
cuuccucuccacugccuucga

SEQ ID NO: 1683812 - RNA, 11 nt, Human
cuuccucugcu

SEQ ID NO: 1683813 - RNA, 12 nt, Human
cuuccucugcug

SEQ ID NO: 1683814 - RNA, 13 nt, Human
cuuccucugcuga

SEQ ID NO: 1683815 - RNA, 12 nt, Human
cuuccucccucc

SEQ ID NO: 1683816 - RNA, 13 nt, Human
cuuccucccuccc

SEQ ID NO: 1683817 - RNA, 14 nt, Human
cuuccucccucccu

SEQ ID NO: 1683818 - RNA, 18 nt, Human
cuuccucccucccucuuu

SEQ ID NO: 1683819 - RNA, 23 nt, Human
cuucugaacuuggcgcugccccu

SEQ ID NO: 1683820 - RNA, 18 nt, Human
cuucugacccaugcugcc

SEQ ID NO: 1683821 - RNA, 16 nt, Human
cuucugacccaugcug

SEQ ID NO: 1683822 - RNA, 17 nt, Human
cuucugacccaugcugc

SEQ ID NO: 1683823 - RNA, 13 nt, Human
cuucuuauacauu

SEQ ID NO: 1683824 - RNA, 16 nt, Human
cuucuuauacauuuga

SEQ ID NO: 1683825 - RNA, 15 nt, Human
aggaacuacugagga

SEQ ID NO: 1683826 - RNA, 20 nt, Human
aggaccccuccaugugggcu

SEQ ID NO: 1683827 - RNA, 15 nt, Human
aggagagcuagcagc

SEQ ID NO: 1683828 - RNA, 15 nt, Human
aggagaggagagggg

SEQ ID NO: 1683829 - RNA, 16 nt, Human
aggagaggggcacagg

SEQ ID NO: 1683830 - RNA, 18 nt, Human
aggagaggggcacagggu

SEQ ID NO: 1683831 - RNA, 14 nt, Human
aggaccucagguga

SEQ ID NO: 1683832 - RNA, 20 nt, Human
aggaccucaggugagaagca

SEQ ID NO: 1683833 - RNA, 17 nt, Human
aggacccggaggggccu

SEQ ID NO: 1683834 - RNA, 14 nt, Human
aggcacugcugccc

SEQ ID NO: 1683835 - RNA, 16 nt, Human
aggcacugcugcccag

SEQ ID NO: 1683836 - RNA, 22 nt, Human
aggcacugcugcccagccucca

SEQ ID NO: 1683837 - RNA, 16 nt, Human
aggauucuuccucccu

SEQ ID NO: 1683838 - RNA, 12 nt, Human
aggauucuuccu

SEQ ID NO: 1683839 - RNA, 17 nt, Human
aggaggggauagagaga

SEQ ID NO: 1683840 - RNA, 17 nt, Human
aggauguugaaaaaguu

SEQ ID NO: 1683841 - RNA, 20 nt, Human
aggauguucugggacacagu

SEQ ID NO: 1683842 - RNA, 14 nt, Human
aggauguugaaaaa

SEQ ID NO: 1683843 - RNA, 17 nt, Human
agcugggugucaagagg

SEQ ID NO: 1683844 - RNA, 22 nt, Human
agcugggugucaagagggucug

SEQ ID NO: 1683845 - RNA, 14 nt, Human
agcuggugcccugc

SEQ ID NO: 1683846 - RNA, 14 nt, Human
agcuggguuggaaa

SEQ ID NO: 1683847 - RNA, 21 nt, Human
agcuggucccacucaguccau

SEQ ID NO: 1683848 - RNA, 14 nt, Human
agcuguaugauucc

SEQ ID NO: 1683849 - RNA, 22 nt, Human
aggaacguaaucguguccccua

SEQ ID NO: 1683850 - RNA, 17 nt, Human
aggaaauccaggguggu

SEQ ID NO: 1683851 - RNA, 23 nt, Human
agcuucuguugcugccucaugcu

SEQ ID NO: 1683852 - RNA, 13 nt, Human
agcuuuucccuuc

SEQ ID NO: 1683853 - RNA, 16 nt, Human
agcuuuucccuucuuu

SEQ ID NO: 1683854 - RNA, 15 nt, Human
agcuuuucccuuuuu

SEQ ID NO: 1683855 - RNA, 13 nt, Human
aggaaaaacugau

SEQ ID NO: 1683856 - RNA, 15 nt, Human
aggaaaaacugauuu

SEQ ID NO: 1683857 - RNA, 21 nt, Human
agcuucuguugcugccucaug

SEQ ID NO: 1683858 - RNA, 22 nt, Human
agcuucuguugcugccucaugc

SEQ ID NO: 1683859 - RNA, 15 nt, Human
aggggcacagggucu

SEQ ID NO: 1683860 - RNA, 21 nt, Human
aggggauagagagagaccacu

SEQ ID NO: 1683861 - RNA, 19 nt, Human
agggcgggaggauguucug

SEQ ID NO: 1683862 - RNA, 18 nt, Human
agggccuggccugagcug

SEQ ID NO: 1683863 - RNA, 17 nt, Human
agggcacaccgggcacu

SEQ ID NO: 1683864 - RNA, 22 nt, Human
agggcacagaaaauggaagaca

SEQ ID NO: 1683865 - RNA, 20 nt, Human
agggcacaccgggcacucag

SEQ ID NO: 1683866 - RNA, 21 nt, Human
agggcacaccgggcacucaga

SEQ ID NO: 1683867 - RNA, 15 nt, Human
agggccuggccugag

SEQ ID NO: 1683868 - RNA, 16 nt, Human
agggccuggccugagc

SEQ ID NO: 1683869 - RNA, 17 nt, Human
agggccuggccugagcu

SEQ ID NO: 1683870 - RNA, 20 nt, Human
aggcugaacuuguuuucugg

SEQ ID NO: 1683871 - RNA, 21 nt, Human
aggcugaacuuguuuucuggg

SEQ ID NO: 1683872 - RNA, 14 nt, Human
aggcucuucuccuu

SEQ ID NO: 1683873 - RNA, 23 nt, Human
aggcugaugccaaguuguuugag

SEQ ID NO: 1683874 - RNA, 23 nt, Human
aggcuagugugguguuuccuggc

SEQ ID NO: 1683875 - RNA, 18 nt, Human
aggcugccucucccauca

SEQ ID NO: 1683876 - RNA, 21 nt, Human
agggacgcuacccgggaaggg

SEQ ID NO: 1683877 - RNA, 12 nt, Human
agggacagaggg

SEQ ID NO: 1683878 - RNA, 13 nt, Human
agggacagagggg

SEQ ID NO: 1683879 - RNA, 20 nt, Human
agggacagaggggguggccu

SEQ ID NO: 1683880 - RNA, 17 nt, Human
aggucccuaauaaagcu

SEQ ID NO: 1683881 - RNA, 18 nt, Human
aggucccuaauaaagcug

SEQ ID NO: 1683882 - RNA, 19 nt, Human
aggucccuaauaaagcugu

SEQ ID NO: 1683883 - RNA, 20 nt, Human
aggucccuaauaaagcugug

SEQ ID NO: 1683884 - RNA, 22 nt, Human
agguacgaaaagaggggaagag

SEQ ID NO: 1683885 - RNA, 18 nt, Human
agguaaucgaccugccuc

SEQ ID NO: 1683886 - RNA, 19 nt, Human
agguaaucgaccugccucg

SEQ ID NO: 1683887 - RNA, 17 nt, Human
agguaaucgaccugccu

SEQ ID NO: 1683888 - RNA, 17 nt, Human
agguaaggaauaccugu

SEQ ID NO: 1683889 - RNA, 15 nt, Human
agguggaaauaaacu

SEQ ID NO: 1683890 - RNA, 14 nt, Human
aggucgaggcagga

SEQ ID NO: 1683891 - RNA, 16 nt, Human
aggugcugccauccag

SEQ ID NO: 1683892 - RNA, 17 nt, Human
aggugcugccauccagg

SEQ ID NO: 1683893 - RNA, 17 nt, Human
agguucaugcaaacuuu

SEQ ID NO: 1683894 - RNA, 13 nt, Human
agguucagcuugu

SEQ ID NO: 1683895 - RNA, 17 nt, Human
agguucaaagauauuuu

SEQ ID NO: 1683896 - RNA, 14 nt, Human
agguuaauguucau

SEQ ID NO: 1683897 - RNA, 15 nt, Human
agguuaauaaaguaa

SEQ ID NO: 1683898 - RNA, 20 nt, Human
agccucccaaagugcuggga

SEQ ID NO: 1683899 - RNA, 18 nt, Human
agccucccgaauagcugg

SEQ ID NO: 1683900 - RNA, 19 nt, Human
agccucccgaauagcuggg

SEQ ID NO: 1683901 - RNA, 20 nt, Human
agccucccgaauagcuggga

SEQ ID NO: 1683902 - RNA, 22 nt, Human
agccucccgaauagcugggacu

SEQ ID NO: 1683903 - RNA, 17 nt, Human
agccucccgaguagcug

SEQ ID NO: 1683904 - RNA, 23 nt, Human
agccucccuauuuuuuuucuguu

SEQ ID NO: 1683905 - RNA, 18 nt, Human
agccucccaaagugcugg

SEQ ID NO: 1683906 - RNA, 19 nt, Human
agccucccaaagugcuggg

SEQ ID NO: 1683907 - RNA, 14 nt, Human
agccgcuggggcca

SEQ ID NO: 1683908 - RNA, 22 nt, Human
agccgcuggggccaguuggucc

SEQ ID NO: 1683909 - RNA, 20 nt, Human
agccgagauugcaccacugc

SEQ ID NO: 1683910 - RNA, 21 nt, Human
agccgagaucacgccacugca

SEQ ID NO: 1683911 - RNA, 19 nt, Human
agccgagauugcaccacug

SEQ ID NO: 1683912 - RNA, 23 nt, Human
agccccauaauuuuuuuuuuccu

SEQ ID NO: 1683913 - RNA, 16 nt, Human
agccccagugcccaca

SEQ ID NO: 1683914 - RNA, 20 nt, Human
agccccaucccaaacccuuc

SEQ ID NO: 1683915 - RNA, 11 nt, Human
agccccauccu

SEQ ID NO: 1683916 - RNA, 15 nt, Human
agcccugagcuuucu

SEQ ID NO: 1683917 - RNA, 19 nt, Human
agccgagaucacgccacug

SEQ ID NO: 1683918 - RNA, 20 nt, Human
agccgagaucacgccacugc

SEQ ID NO: 1683919 - RNA, 21 nt, Human
agcagccacauuccugaugcu

SEQ ID NO: 1683920 - RNA, 20 nt, Human
agcacuaaggugugcucuga

SEQ ID NO: 1683921 - RNA, 19 nt, Human
agcacuaaggugugcucug

SEQ ID NO: 1683922 - RNA, 18 nt, Human
agcaguucagagcugccc

SEQ ID NO: 1683923 - RNA, 17 nt, Human
agcaguucagagcugcc

SEQ ID NO: 1683924 - RNA, 15 nt, Human
agcaguucagagcug

SEQ ID NO: 1683925 - RNA, 16 nt, Human
agcaguucagagcugc

SEQ ID NO: 1683926 - RNA, 23 nt, Human
agcaguugaaaagacuccaaaga

SEQ ID NO: 1683927 - RNA, 21 nt, Human
agcaguugaaaagacuccaaa

SEQ ID NO: 1683928 - RNA, 14 nt, Human
agauguagaggaga

SEQ ID NO: 1683929 - RNA, 21 nt, Human
agaugggagaaucacuugaac

SEQ ID NO: 1683930 - RNA, 19 nt, Human
agcaguucagagcugcccu

SEQ ID NO: 1683931 - RNA, 20 nt, Human
agcaguucagagcugcccuc

SEQ ID NO: 1683932 - RNA, 14 nt, Human
agcaugcacaaauu

SEQ ID NO: 1683933 - RNA, 12 nt, Human
agcaugccugga

SEQ ID NO: 1683934 - RNA, 20 nt, Human
agcaugccuggauggggcug

SEQ ID NO: 1683935 - RNA, 19 nt, Human
agccaaagcuaggccuggc

SEQ ID NO: 1683936 - RNA, 20 nt, Human
agccaaagcuaggccuggcc

SEQ ID NO: 1683937 - RNA, 23 nt, Human
agccaaagcuaggccuggccaga

SEQ ID NO: 1683938 - RNA, 20 nt, Human
agccagaggagagaggaccc

SEQ ID NO: 1683939 - RNA, 22 nt, Human
agccaaggccaaaggaagcaca

SEQ ID NO: 1683940 - RNA, 23 nt, Human
agccaaggccaaaggaagcacau

SEQ ID NO: 1683941 - RNA, 22 nt, Human
agccauguuuauuacaguauaa

SEQ ID NO: 1683942 - RNA, 15 nt, Human
agccagauuuuccug

SEQ ID NO: 1683943 - RNA, 19 nt, Human
agccagauuuuccugaaaa

SEQ ID NO: 1683944 - RNA, 14 nt, Human
agaguguugaaacg

SEQ ID NO: 1683945 - RNA, 13 nt, Human
agauagccaaggc

SEQ ID NO: 1683946 - RNA, 22 nt, Human
agauacuuggggggcugaggug

SEQ ID NO: 1683947 - RNA, 13 nt, Human
agaggagaggggc

SEQ ID NO: 1683948 - RNA, 16 nt, Human
agaggggaagagacuu

SEQ ID NO: 1683949 - RNA, 22 nt, Human
agaggggaacagacuggaagca

SEQ ID NO: 1683950 - RNA, 23 nt, Human
agauggcugugccucugccuguc

SEQ ID NO: 1683951 - RNA, 14 nt, Human
agaucuucuguggg

SEQ ID NO: 1683952 - RNA, 15 nt, Human
agauagccaaggcca

SEQ ID NO: 1683953 - RNA, 16 nt, Human
agauagccaaggccaa

SEQ ID NO: 1683954 - RNA, 21 nt, Human
agauaggucagugcaaauacu

SEQ ID NO: 1683955 - RNA, 15 nt, Human
agagcccuucauuug

SEQ ID NO: 1683956 - RNA, 14 nt, Human
agagaguggcuccu

SEQ ID NO: 1683957 - RNA, 16 nt, Human
agagaguggcuccucc

SEQ ID NO: 1683958 - RNA, 23 nt, Human
agagaggguggugaccucugccu

SEQ ID NO: 1683959 - RNA, 20 nt, Human
agagagcuucuguugcugcc

SEQ ID NO: 1683960 - RNA, 23 nt, Human
agagagcuucuguugcugccuca

SEQ ID NO: 1683961 - RNA, 16 nt, Human
agagagcuucuguugc

SEQ ID NO: 1683962 - RNA, 18 nt, Human
agagaaaguacuucucca

SEQ ID NO: 1683963 - RNA, 10 nt, Human
agagaagaga

SEQ ID NO: 1683964 - RNA, 21 nt, Human
agagaagagauugugguuuca

SEQ ID NO: 1683965 - RNA, 17 nt, Human
agacugcauuauauuua

SEQ ID NO: 1683966 - RNA, 21 nt, Human
agacaauuuauuauggcacau

SEQ ID NO: 1683967 - RNA, 15 nt, Human
agacaauuuauuaug

SEQ ID NO: 1683968 - RNA, 19 nt, Human
agacaaugacuuacuguac

SEQ ID NO: 1683969 - RNA, 17 nt, Human
agacaaugacuuacugu

SEQ ID NO: 1683970 - RNA, 13 nt, Human
agacaaugacuua

SEQ ID NO: 1683971 - RNA, 19 nt, Human
agacggagucccaccuugg

SEQ ID NO: 1683972 - RNA, 18 nt, Human
agacgggggcagagaggg

SEQ ID NO: 1683973 - RNA, 13 nt, Human
agaccaucccuga

SEQ ID NO: 1683974 - RNA, 14 nt, Human
agaccaucccugaa

SEQ ID NO: 1683975 - RNA, 17 nt, Human
agaccaucccugaaggc

SEQ ID NO: 1683976 - RNA, 18 nt, Human
agaccaucccugaaggcc

SEQ ID NO: 1683977 - RNA, 21 nt, Human
agaccaucccugaaggccccg

SEQ ID NO: 1683978 - RNA, 21 nt, Human
agacagcccgggcucugccuc

SEQ ID NO: 1683979 - RNA, 18 nt, Human
agacagcccgggcucugc

SEQ ID NO: 1683980 - RNA, 20 nt, Human
agacagcccgggcucugccu

SEQ ID NO: 1683981 - RNA, 17 nt, Human
agacagcccgggcucug

SEQ ID NO: 1683982 - RNA, 12 nt, Human
aucaccugcccu

SEQ ID NO: 1683983 - RNA, 13 nt, Human
aucaccugcccug

SEQ ID NO: 1683984 - RNA, 12 nt, Human
aucaccugucuu

SEQ ID NO: 1683985 - RNA, 21 nt, Human
aucaccugucuugccuuuuuc

SEQ ID NO: 1683986 - RNA, 22 nt, Human
aucaccugucuugccuuuuuca

SEQ ID NO: 1683987 - RNA, 11 nt, Human
aucagccuggg

SEQ ID NO: 1683988 - RNA, 20 nt, Human
aucagccugggcaaugugau

SEQ ID NO: 1683989 - RNA, 21 nt, Human
aucagccugggcaaugugaua

SEQ ID NO: 1683990 - RNA, 12 nt, Human
aucagcugcuac

SEQ ID NO: 1683991 - RNA, 13 nt, Human
aucagcugcuacu

SEQ ID NO: 1683992 - RNA, 23 nt, Human
aucagcugcuacuacuccuguag

SEQ ID NO: 1683993 - RNA, 17 nt, Human
aucagcugcugaaacaa

SEQ ID NO: 1683994 - RNA, 18 nt, Human
auccacccaccucagccu

SEQ ID NO: 1683995 - RNA, 20 nt, Human
auccacccaccucagccucc

SEQ ID NO: 1683996 - RNA, 14 nt, Human
aucccggcugcccu

SEQ ID NO: 1683997 - RNA, 15 nt, Human
aucccuacuguaauu

SEQ ID NO: 1683998 - RNA, 13 nt, Human
aucccucauccuc

SEQ ID NO: 1683999 - RNA, 18 nt, Human
auccucauacccaccccc

SEQ ID NO: 1684000 - RNA, 19 nt, Human
auccucauacccaccccca

SEQ ID NO: 1684001 - RNA, 22 nt, Human
auccucauacccacccccaccc

SEQ ID NO: 1684002 - RNA, 23 nt, Human
auccucauacccacccccaccca

SEQ ID NO: 1684003 - RNA, 11 nt, Human
auccuccucag

SEQ ID NO: 1684004 - RNA, 14 nt, Human
auccuccaggugca

SEQ ID NO: 1684005 - RNA, 19 nt, Human
auccuccaggugcacaagc

SEQ ID NO: 1684006 - RNA, 22 nt, Human
auccuccaggugcacaagcucc

SEQ ID NO: 1684007 - RNA, 13 nt, Human
aucgaugcagugc

SEQ ID NO: 1684008 - RNA, 14 nt, Human
auccuccucagauc

SEQ ID NO: 1684009 - RNA, 17 nt, Human
aucuugaagacuuuucu

SEQ ID NO: 1684010 - RNA, 22 nt, Human
aucuucugaacuuggcgcugcc

SEQ ID NO: 1684011 - RNA, 17 nt, Human
aucuucuuuauaauucu

SEQ ID NO: 1684012 - RNA, 24 nt, Human
aucuucucagaaggcaaaugacuu

SEQ ID NO: 1684013 - RNA, 22 nt, Human
aucucucgugauugauaagaac

SEQ ID NO: 1684014 - RNA, 19 nt, Human
aucuuccaacucaaacucu

SEQ ID NO: 1684015 - RNA, 21 nt, Human
aucuucuauauguuuaaaagu

SEQ ID NO: 1684016 - RNA, 15 nt, Human
aucugggccagaauu

SEQ ID NO: 1684017 - RNA, 17 nt, Human
aucugggccagaauuuc

SEQ ID NO: 1684018 - RNA, 22 nt, Human
aucuuauaauuuaaaauaugcu

SEQ ID NO: 1684019 - RNA, 13 nt, Human
augagccuggcaa

SEQ ID NO: 1684020 - RNA, 14 nt, Human
augagccuggcaag

SEQ ID NO: 1684021 - RNA, 18 nt, Human
augaagcuuuuaugugaa

SEQ ID NO: 1684022 - RNA, 19 nt, Human
augaagcuuuuaugugaaa

SEQ ID NO: 1684023 - RNA, 20 nt, Human
augaagcuuuuaugugaaac

SEQ ID NO: 1684024 - RNA, 21 nt, Human
augaagcuuuuaugugaaaca

SEQ ID NO: 1684025 - RNA, 12 nt, Human
augacccagugg

SEQ ID NO: 1684026 - RNA, 17 nt, Human
augacuccagaauuucc

SEQ ID NO: 1684027 - RNA, 12 nt, Human
augacuccagaa

SEQ ID NO: 1684028 - RNA, 16 nt, Human
augacuccagaauuuc

SEQ ID NO: 1684029 - RNA, 14 nt, Human
augaaaaaauauau

SEQ ID NO: 1684030 - RNA, 17 nt, Human
augaaaaaauauauauc

SEQ ID NO: 1684031 - RNA, 22 nt, Human
augaaaaaauauauaucaaaua

SEQ ID NO: 1684032 - RNA, 23 nt, Human
augaaaaaauauauaucaaauau

SEQ ID NO: 1684033 - RNA, 23 nt, Human
auggcugccaaugggagcucaug

SEQ ID NO: 1684034 - RNA, 21 nt, Human
augggaaugaaugucagugug

SEQ ID NO: 1684035 - RNA, 15 nt, Human
augggaaugaauguc

SEQ ID NO: 1684036 - RNA, 18 nt, Human
auggagccugcacgguga

SEQ ID NO: 1684037 - RNA, 22 nt, Human
auggagccugcacggugaaugg

SEQ ID NO: 1684038 - RNA, 13 nt, Human
auggaaauguuua

SEQ ID NO: 1684039 - RNA, 19 nt, Human
auggaaaugggcagagcag

SEQ ID NO: 1684040 - RNA, 20 nt, Human
auggaaaugggcagagcaga

SEQ ID NO: 1684041 - RNA, 23 nt, Human
augcaugaaguaauaugcacaca

SEQ ID NO: 1684042 - RNA, 18 nt, Human
augcauuugaaaauuuug

SEQ ID NO: 1684043 - RNA, 12 nt, Human
augcauuugaaa

SEQ ID NO: 1684044 - RNA, 10 nt, Human
augcauuuga

SEQ ID NO: 1684045 - RNA, 21 nt, Human
augccuggauggggcugcacc

SEQ ID NO: 1684046 - RNA, 23 nt, Human
augccuggauggggcugcaccgg

SEQ ID NO: 1684047 - RNA, 17 nt, Human
augccugggcagaagga

SEQ ID NO: 1684048 - RNA, 11 nt, Human
augccuggugg

SEQ ID NO: 1684049 - RNA, 15 nt, Human
augccugguggcagc

SEQ ID NO: 1684050 - RNA, 16 nt, Human
augccugguggcagcu

SEQ ID NO: 1684051 - RNA, 17 nt, Human
augccugguggcagcug

SEQ ID NO: 1684052 - RNA, 21 nt, Human
augcacagcuaacauggaagu

SEQ ID NO: 1684053 - RNA, 23 nt, Human
augcacacauuuuuuaaaugcac

SEQ ID NO: 1684054 - RNA, 14 nt, Human
augcacagcuaaca

SEQ ID NO: 1684055 - RNA, 22 nt, Human
augcacacauuuuuuaaaugca

SEQ ID NO: 1684056 - RNA, 19 nt, Human
augcacacauuuuuuaaau

SEQ ID NO: 1684057 - RNA, 17 nt, Human
augcacacauuuuuuaa

SEQ ID NO: 1684058 - RNA, 23 nt, Human
augauguauguugaagccuuugu

SEQ ID NO: 1684059 - RNA, 16 nt, Human
augaugugugaaaacu

SEQ ID NO: 1684060 - RNA, 21 nt, Human
augccuuuguacuuuagggaa

SEQ ID NO: 1684061 - RNA, 14 nt, Human
augccuuuucccaa

SEQ ID NO: 1684062 - RNA, 18 nt, Human
auguuucuuuguaaugaa

SEQ ID NO: 1684063 - RNA, 20 nt, Human
auguucuuucacccuuuucu

SEQ ID NO: 1684064 - RNA, 15 nt, Human
auguucuuaauucuu

SEQ ID NO: 1684065 - RNA, 20 nt, Human
auguucuuaguggauguucu

SEQ ID NO: 1684066 - RNA, 22 nt, Human
auguucugacccugcuucaaau

SEQ ID NO: 1684067 - RNA, 18 nt, Human
auguucucugaggacacu

SEQ ID NO: 1684068 - RNA, 16 nt, Human
auguuuuaagaggcag

SEQ ID NO: 1684069 - RNA, 18 nt, Human
auguuuuaagaggcaggg

SEQ ID NO: 1684070 - RNA, 14 nt, Human
auuaaaugcccagc

SEQ ID NO: 1684071 - RNA, 15 nt, Human
auuaaaugcccagcc

SEQ ID NO: 1684072 - RNA, 16 nt, Human
auuaaaugcccagccc

SEQ ID NO: 1684073 - RNA, 13 nt, Human
auuaaauucuugc

SEQ ID NO: 1684074 - RNA, 14 nt, Human
auguguaaguauuc

SEQ ID NO: 1684075 - RNA, 15 nt, Human
augucacaggcaggu

SEQ ID NO: 1684076 - RNA, 16 nt, Human
augucacaggcagguc

SEQ ID NO: 1684077 - RNA, 17 nt, Human
augucacaggcaggucc

SEQ ID NO: 1684078 - RNA, 17 nt, Human
auguacauguacugauu

SEQ ID NO: 1684079 - RNA, 16 nt, Human
augucaaucagccuag

SEQ ID NO: 1684080 - RNA, 21 nt, Human
auguaagggaaacugccagca

SEQ ID NO: 1684081 - RNA, 22 nt, Human
auguaagggaaacugccagcaa

SEQ ID NO: 1684082 - RNA, 17 nt, Human
auguaagcucuacugag

SEQ ID NO: 1684083 - RNA, 20 nt, Human
auguaagggaaacugccagc

SEQ ID NO: 1684084 - RNA, 16 nt, Human
auguaaguaaacgguc

SEQ ID NO: 1684085 - RNA, 15 nt, Human
aguuguuacauuuuu

SEQ ID NO: 1684086 - RNA, 13 nt, Human
aguuguuacauuu

SEQ ID NO: 1684087 - RNA, 16 nt, Human
aguuguuacauuuuua

SEQ ID NO: 1684088 - RNA, 11 nt, Human
aguugaauuua

SEQ ID NO: 1684089 - RNA, 13 nt, Human
aguugaauuuauu

SEQ ID NO: 1684090 - RNA, 17 nt, Human
aguugaauuuauuggcu

SEQ ID NO: 1684091 - RNA, 19 nt, Human
aguugaauuuauuggcuuu

SEQ ID NO: 1684092 - RNA, 18 nt, Human
aguuacagacaaagcgug

SEQ ID NO: 1684093 - RNA, 19 nt, Human
aguuguaccgcaaugugac

SEQ ID NO: 1684094 - RNA, 20 nt, Human
aguugaauuuauuggcuuuu

SEQ ID NO: 1684095 - RNA, 15 nt, Human
aguugaauuuuacau

SEQ ID NO: 1684096 - RNA, 18 nt, Human
aguuguaccgcaauguga

SEQ ID NO: 1684097 - RNA, 23 nt, Human
agugugacaaggauugcuacugu

SEQ ID NO: 1684098 - RNA, 18 nt, Human
agugauucucaugccuca

SEQ ID NO: 1684099 - RNA, 19 nt, Human
agugauucucaugccucag

SEQ ID NO: 1684100 - RNA, 18 nt, Human
agugauuaccagggacug

SEQ ID NO: 1684101 - RNA, 15 nt, Human
agugauuaccaggga

SEQ ID NO: 1684102 - RNA, 13 nt, Human
agugauccuccca

SEQ ID NO: 1684103 - RNA, 15 nt, Human
agucauucagauaug

SEQ ID NO: 1684104 - RNA, 20 nt, Human
agucauucagauaugauuca

SEQ ID NO: 1684105 - RNA, 23 nt, Human
agucauucagauaugauucaaau

SEQ ID NO: 1684106 - RNA, 16 nt, Human
aguccaagcauuuaga

SEQ ID NO: 1684107 - RNA, 21 nt, Human
aguccaagcauuuagauguau

SEQ ID NO: 1684108 - RNA, 20 nt, Human
agucaagugaaaaaggagga

SEQ ID NO: 1684109 - RNA, 18 nt, Human
agucaaggguaggguggg

SEQ ID NO: 1684110 - RNA, 16 nt, Human
agucaagugaaaaagg

SEQ ID NO: 1684111 - RNA, 15 nt, Human
agucaaauuguguga

SEQ ID NO: 1684112 - RNA, 17 nt, Human
agucaaauugugugaaa

SEQ ID NO: 1684113 - RNA, 13 nt, Human
agucaaauugugu

SEQ ID NO: 1684114 - RNA, 19 nt, Human
auaaguauuuaauucaugu

SEQ ID NO: 1684115 - RNA, 19 nt, Human
auaaguguguguuuuucau

SEQ ID NO: 1684116 - RNA, 22 nt, Human
auaaguguguguuuuucauaaa

SEQ ID NO: 1684117 - RNA, 18 nt, Human
auaaugugaaacuggauu

SEQ ID NO: 1684118 - RNA, 20 nt, Human
auaauuaacauguuaaacca

SEQ ID NO: 1684119 - RNA, 21 nt, Human
auaauuaacauguuaaaccau

SEQ ID NO: 1684120 - RNA, 22 nt, Human
auaauuaacauguuaaaccaug

SEQ ID NO: 1684121 - RNA, 21 nt, Human
auaaugugaaacuggauuaaa

SEQ ID NO: 1684122 - RNA, 19 nt, Human
auaaugugaaacuggauua

SEQ ID NO: 1684123 - RNA, 13 nt, Human
auaccuguccccc

SEQ ID NO: 1684124 - RNA, 12 nt, Human
auaccugucccc

SEQ ID NO: 1684125 - RNA, 17 nt, Human
auaccuacauguauuug

SEQ ID NO: 1684126 - RNA, 15 nt, Human
auaccuacauguauu

SEQ ID NO: 1684127 - RNA, 22 nt, Human
auacccccugcaaagcccagcu

SEQ ID NO: 1684128 - RNA, 19 nt, Human
auacaauuuuguuucugua

SEQ ID NO: 1684129 - RNA, 20 nt, Human
auacaauuuuguuucuguac

SEQ ID NO: 1684130 - RNA, 14 nt, Human
auaauuacuauguc

SEQ ID NO: 1684131 - RNA, 16 nt, Human
auauaggaacuuaaau

SEQ ID NO: 1684132 - RNA, 15 nt, Human
auacuugaaaauuaa

SEQ ID NO: 1684133 - RNA, 16 nt, Human
auacuugaaaauuaac

SEQ ID NO: 1684134 - RNA, 19 nt, Human
auacuugaaaauuaacaug

SEQ ID NO: 1684135 - RNA, 15 nt, Human
auaguaugguggcug

SEQ ID NO: 1684136 - RNA, 15 nt, Human
auauaaguguguguu

SEQ ID NO: 1684137 - RNA, 15 nt, Human
auauaagugauugcu

SEQ ID NO: 1684138 - RNA, 16 nt, Human
auaguaugguggcugg

SEQ ID NO: 1684139 - RNA, 23 nt, Human
auauuucagauaaucacaauaca

SEQ ID NO: 1684140 - RNA, 17 nt, Human
auauucaggaagcucag

SEQ ID NO: 1684141 - RNA, 14 nt, Human
auauucaggaagcu

SEQ ID NO: 1684142 - RNA, 16 nt, Human
auauucaggaagcuca

SEQ ID NO: 1684143 - RNA, 13 nt, Human
auauucaggaagc

SEQ ID NO: 1684144 - RNA, 18 nt, Human
auauuuaguguucauaaa

SEQ ID NO: 1684145 - RNA, 16 nt, Human
auauuuauaaaaauaa

SEQ ID NO: 1684146 - RNA, 14 nt, Human
auauuuauuacugu

SEQ ID NO: 1684147 - RNA, 19 nt, Human
auauuuauuacuguaagaa

SEQ ID NO: 1684148 - RNA, 18 nt, Human
auauuuauuuuaauaaug

SEQ ID NO: 1684149 - RNA, 22 nt, Human
auauuuauuacuguaagaaaau

SEQ ID NO: 1684150 - RNA, 18 nt, Human
auaucacuugucaauaaa

SEQ ID NO: 1684151 - RNA, 21 nt, Human
auaugcuuauacacuuacacu

SEQ ID NO: 1684152 - RNA, 14 nt, Human
auaugcuuauacac

SEQ ID NO: 1684153 - RNA, 16 nt, Human
auaugcuuauacacuu

SEQ ID NO: 1684154 - RNA, 23 nt, Human
auaugcuucuguuuuauaauuuu

SEQ ID NO: 1684155 - RNA, 19 nt, Human
auaugcuuauacacuuaca

SEQ ID NO: 1684156 - RNA, 14 nt, Human
auaugcuauuucua

SEQ ID NO: 1684157 - RNA, 22 nt, Human
auaugccugggcagaaggaaga

SEQ ID NO: 1684158 - RNA, 23 nt, Human
acauaaacaagaccacguuucua

SEQ ID NO: 1684159 - RNA, 14 nt, Human
acauaaaucuguga

SEQ ID NO: 1684160 - RNA, 15 nt, Human
acauaaaucugugaa

SEQ ID NO: 1684161 - RNA, 18 nt, Human
acauaaaucugugaacuu

SEQ ID NO: 1684162 - RNA, 20 nt, Human
acauaaauuuaguauuuugu

SEQ ID NO: 1684163 - RNA, 22 nt, Human
acaucagcacgauuucuguuua

SEQ ID NO: 1684164 - RNA, 21 nt, Human
acaucagcacgauuucuguuu

SEQ ID NO: 1684165 - RNA, 20 nt, Human
acaucagcacgauuucuguu

SEQ ID NO: 1684166 - RNA, 19 nt, Human
acaugcaaggucauuuuuu

SEQ ID NO: 1684167 - RNA, 20 nt, Human
acaugcacagcuaacaugga

SEQ ID NO: 1684168 - RNA, 23 nt, Human
acaugcacagcuaacauggaagu

SEQ ID NO: 1684169 - RNA, 21 nt, Human
acauguuuuucuucucccuca

SEQ ID NO: 1684170 - RNA, 13 nt, Human
acauguuacaaca

SEQ ID NO: 1684171 - RNA, 20 nt, Human
accacgcccggcuaauuuuu

SEQ ID NO: 1684172 - RNA, 14 nt, Human
accacgcccggcua

SEQ ID NO: 1684173 - RNA, 14 nt, Human
accacuacauucug

SEQ ID NO: 1684174 - RNA, 19 nt, Human
accacguuucuaaaggcua

SEQ ID NO: 1684175 - RNA, 15 nt, Human
accacguuucuaaag

SEQ ID NO: 1684176 - RNA, 15 nt, Human
accacuacauucugu

SEQ ID NO: 1684177 - RNA, 14 nt, Human
accagcagccugga

SEQ ID NO: 1684178 - RNA, 17 nt, Human
accagcagccuggaccc

SEQ ID NO: 1684179 - RNA, 18 nt, Human
acauuugcucauggaauu

SEQ ID NO: 1684180 - RNA, 14 nt, Human
acauuuguauaaaa

SEQ ID NO: 1684181 - RNA, 20 nt, Human
accccucaacaccucugcac

SEQ ID NO: 1684182 - RNA, 14 nt, Human
accaucaugucugg

SEQ ID NO: 1684183 - RNA, 21 nt, Human
accaucccugaaggccccgcc

SEQ ID NO: 1684184 - RNA, 22 nt, Human
accaucccugaaggccccgccc

SEQ ID NO: 1684185 - RNA, 16 nt, Human
accaucaugucuggcu

SEQ ID NO: 1684186 - RNA, 17 nt, Human
accaucaugucuggcua

SEQ ID NO: 1684187 - RNA, 12 nt, Human
accaucauugaa

SEQ ID NO: 1684188 - RNA, 18 nt, Human
accaucccugaaggcccc

SEQ ID NO: 1684189 - RNA, 22 nt, Human
accccuaaagagauacuuugau

SEQ ID NO: 1684190 - RNA, 15 nt, Human
accccggccaccugc

SEQ ID NO: 1684191 - RNA, 18 nt, Human
accccgaccaccugccca

SEQ ID NO: 1684192 - RNA, 19 nt, Human
acccaugcugcccugugag

SEQ ID NO: 1684193 - RNA, 17 nt, Human
acccaugcugcccugug

SEQ ID NO: 1684194 - RNA, 18 nt, Human
acccaugcugcccuguga

SEQ ID NO: 1684195 - RNA, 13 nt, Human
acccaagggccug

SEQ ID NO: 1684196 - RNA, 16 nt, Human
acccaagggccuggcc

SEQ ID NO: 1684197 - RNA, 16 nt, Human
acccaaguccaagcau

SEQ ID NO: 1684198 - RNA, 15 nt, Human
acccacaagaaauga

SEQ ID NO: 1684199 - RNA, 12 nt, Human
acagcuccuucu

SEQ ID NO: 1684200 - RNA, 13 nt, Human
acagcuccuucug

SEQ ID NO: 1684201 - RNA, 14 nt, Human
acagcuccuucugu

SEQ ID NO: 1684202 - RNA, 23 nt, Human
acagcugccugggaucccucauc

SEQ ID NO: 1684203 - RNA, 13 nt, Human
acagcucuguccu

SEQ ID NO: 1684204 - RNA, 14 nt, Human
acagcugccuggga

SEQ ID NO: 1684205 - RNA, 15 nt, Human
acagcuccuucuguc

SEQ ID NO: 1684206 - RNA, 20 nt, Human
acagcucugcauacucauua

SEQ ID NO: 1684207 - RNA, 21 nt, Human
acagcugcucaauaaaguaca

SEQ ID NO: 1684208 - RNA, 19 nt, Human
acaggcaagcaccuccugc

SEQ ID NO: 1684209 - RNA, 18 nt, Human
acaggcaagcaccuccug

SEQ ID NO: 1684210 - RNA, 15 nt, Human
acaggcaagcaccuc

SEQ ID NO: 1684211 - RNA, 16 nt, Human
acaggcaagcaccucc

SEQ ID NO: 1684212 - RNA, 22 nt, Human
acaggugugagccaccacgccc

SEQ ID NO: 1684213 - RNA, 21 nt, Human
acaggugugagccaccacgcc

SEQ ID NO: 1684214 - RNA, 20 nt, Human
acaggugugaaccaccacac

SEQ ID NO: 1684215 - RNA, 23 nt, Human
acaggugugaaccaccacaccca

SEQ ID NO: 1684216 - RNA, 21 nt, Human
acagaacacauaauucaggaa

SEQ ID NO: 1684217 - RNA, 15 nt, Human
acagccaugauucuu

SEQ ID NO: 1684218 - RNA, 16 nt, Human
acagccagacuggcac

SEQ ID NO: 1684219 - RNA, 13 nt, Human
acagccagacugg

SEQ ID NO: 1684220 - RNA, 15 nt, Human
acagccagacuggca

SEQ ID NO: 1684221 - RNA, 17 nt, Human
acagagucucacuguug

SEQ ID NO: 1684222 - RNA, 19 nt, Human
acagagucucacuguugcc

SEQ ID NO: 1684223 - RNA, 23 nt, Human
acagagucucacuguugcccagg

SEQ ID NO: 1684224 - RNA, 15 nt, Human
acagcaguugaaaag

SEQ ID NO: 1684225 - RNA, 18 nt, Human
acagcaguugaaaagacu

SEQ ID NO: 1684226 - RNA, 22 nt, Human
acagaggggguggccucccaac

SEQ ID NO: 1684227 - RNA, 12 nt, Human
acagagucucac

SEQ ID NO: 1684228 - RNA, 14 nt, Human
acagagucucacug

SEQ ID NO: 1684229 - RNA, 15 nt, Human
acacggacacucaaa

SEQ ID NO: 1684230 - RNA, 14 nt, Human
acacuaaccacgcu

SEQ ID NO: 1684231 - RNA, 15 nt, Human
acacuaaccacgcug

SEQ ID NO: 1684232 - RNA, 14 nt, Human
acacagcucugucc

SEQ ID NO: 1684233 - RNA, 11 nt, Human
acacagcucug

SEQ ID NO: 1684234 - RNA, 12 nt, Human
acacagcucugu

SEQ ID NO: 1684235 - RNA, 17 nt, Human
acacgcuccuuccucug

SEQ ID NO: 1684236 - RNA, 19 nt, Human
acacgcuccuuccucugag

SEQ ID NO: 1684237 - RNA, 12 nt, Human
acaccagagccc

SEQ ID NO: 1684238 - RNA, 13 nt, Human
acaccagagccca

SEQ ID NO: 1684239 - RNA, 14 nt, Human
acaccacuacauuc

SEQ ID NO: 1684240 - RNA, 15 nt, Human
acaauuuauuauggc

SEQ ID NO: 1684241 - RNA, 16 nt, Human
acaauuuauuauggca

SEQ ID NO: 1684242 - RNA, 14 nt, Human
acaauuuuguuucu

SEQ ID NO: 1684243 - RNA, 15 nt, Human
acaauuuuguuucug

SEQ ID NO: 1684244 - RNA, 17 nt, Human
acaauuuuguuucugua

SEQ ID NO: 1684245 - RNA, 18 nt, Human
acaauuuuguuucuguac

SEQ ID NO: 1684246 - RNA, 18 nt, Human
acacaaacgggcucagca

SEQ ID NO: 1684247 - RNA, 21 nt, Human
acaaaccuguuucugcagcca

SEQ ID NO: 1684248 - RNA, 15 nt, Human
acaaacgggcucagc

SEQ ID NO: 1684249 - RNA, 13 nt, Human
acaaagacugagu

SEQ ID NO: 1684250 - RNA, 18 nt, Human
acaacuaugauuuggaaa

SEQ ID NO: 1684251 - RNA, 13 nt, Human
acaacuauauugu

SEQ ID NO: 1684252 - RNA, 20 nt, Human
acaaaauggaauacucuuau

SEQ ID NO: 1684253 - RNA, 20 nt, Human
acaaaauguaggguuauaau

SEQ ID NO: 1684254 - RNA, 15 nt, Human
acaaaauggaauacu

SEQ ID NO: 1684255 - RNA, 19 nt, Human
acaaaauggaauacucuua

SEQ ID NO: 1684256 - RNA, 13 nt, Human
aauuuugaaaaac

SEQ ID NO: 1684257 - RNA, 21 nt, Human
acaaguaugaauaaagacacc

SEQ ID NO: 1684258 - RNA, 23 nt, Human
acaaguaugaauaaagacaccua

SEQ ID NO: 1684259 - RNA, 20 nt, Human
acaagucagucauucagaua

SEQ ID NO: 1684260 - RNA, 16 nt, Human
agaaaggauaaaguug

SEQ ID NO: 1684261 - RNA, 15 nt, Human
agaaauaaaguuucu

SEQ ID NO: 1684262 - RNA, 18 nt, Human
agaaauaaaguuucuguu

SEQ ID NO: 1684263 - RNA, 20 nt, Human
agaaaggaggggauagagag

SEQ ID NO: 1684264 - RNA, 23 nt, Human
agaaaggaggggauagagagaga

SEQ ID NO: 1684265 - RNA, 16 nt, Human
acuuucuagccagagg

SEQ ID NO: 1684266 - RNA, 23 nt, Human
acuuuguucuggcucuuccaggc

SEQ ID NO: 1684267 - RNA, 23 nt, Human
acuuuccuucauucaacccaccu

SEQ ID NO: 1684268 - RNA, 23 nt, Human
acuuuagggaaguacuuuuggca

SEQ ID NO: 1684269 - RNA, 18 nt, Human
agaaaaguugaauuuuac

SEQ ID NO: 1684270 - RNA, 21 nt, Human
agaaaaguugaauuuuacaug

SEQ ID NO: 1684271 - RNA, 12 nt, Human
acuuuucugaua

SEQ ID NO: 1684272 - RNA, 22 nt, Human
acuuuuauaaacuuuaccuuuu

SEQ ID NO: 1684273 - RNA, 19 nt, Human
acuuuuauaaacuuuaccu

SEQ ID NO: 1684274 - RNA, 15 nt, Human
acuuuuauaaacuuu

SEQ ID NO: 1684275 - RNA, 23 nt, Human
agaaaauggaagacagcucuuau

SEQ ID NO: 1684276 - RNA, 15 nt, Human
agaaaauggacgugu

SEQ ID NO: 1684277 - RNA, 20 nt, Human
agaaaauggacguguuauga

SEQ ID NO: 1684278 - RNA, 14 nt, Human
agaaaauaacaaua

SEQ ID NO: 1684279 - RNA, 22 nt, Human
agaaaauggacguguuaugacu

SEQ ID NO: 1684280 - RNA, 23 nt, Human
agaaaauggacguguuaugacuc

SEQ ID NO: 1684281 - RNA, 14 nt, Human
acuggagaaaaugg

SEQ ID NO: 1684282 - RNA, 14 nt, Human
acuggguuccugca

SEQ ID NO: 1684283 - RNA, 19 nt, Human
acugcccccucugcccugc

SEQ ID NO: 1684284 - RNA, 18 nt, Human
acugcccccucugcccug

SEQ ID NO: 1684285 - RNA, 20 nt, Human
acugcccccucugcccugcg

SEQ ID NO: 1684286 - RNA, 16 nt, Human
acuggaagcacagcuu

SEQ ID NO: 1684287 - RNA, 15 nt, Human
acuggaagcacagcu

SEQ ID NO: 1684288 - RNA, 14 nt, Human
acuggaagcacagc

SEQ ID NO: 1684289 - RNA, 19 nt, Human
acugucucaagagggcacu

SEQ ID NO: 1684290 - RNA, 21 nt, Human
acugguggcccgacagccugg

SEQ ID NO: 1684291 - RNA, 22 nt, Human
acugguggcccgacagccuggc

SEQ ID NO: 1684292 - RNA, 20 nt, Human
acugguggcccgacagccug

SEQ ID NO: 1684293 - RNA, 23 nt, Human
acugguggcccgacagccuggca

SEQ ID NO: 1684294 - RNA, 16 nt, Human
acugugccaugugcca

SEQ ID NO: 1684295 - RNA, 12 nt, Human
acugucuucagu

SEQ ID NO: 1684296 - RNA, 22 nt, Human
acuucugccagcauaauacuug

SEQ ID NO: 1684297 - RNA, 18 nt, Human
acuucugccauauucugu

SEQ ID NO: 1684298 - RNA, 23 nt, Human
acuucacauauugauuuccguua

SEQ ID NO: 1684299 - RNA, 21 nt, Human
acuucuuuaauuuuggaauuu

SEQ ID NO: 1684300 - RNA, 19 nt, Human
acuucugccauauucuguu

SEQ ID NO: 1684301 - RNA, 20 nt, Human
acuuguaaaggaauuuaaaa

SEQ ID NO: 1684302 - RNA, 19 nt, Human
acuuguaaaggaauuuaaa

SEQ ID NO: 1684303 - RNA, 14 nt, Human
acuuggucugugag

SEQ ID NO: 1684304 - RNA, 15 nt, Human
acuuggucugugaga

SEQ ID NO: 1684305 - RNA, 20 nt, Human
acuuguaaaugugguaaaga

SEQ ID NO: 1684306 - RNA, 18 nt, Human
acuuguaaaugugguaaa

SEQ ID NO: 1684307 - RNA, 21 nt, Human
acuuggucugugagaugcuag

SEQ ID NO: 1684308 - RNA, 13 nt, Human
acuguuucaaacu

SEQ ID NO: 1684309 - RNA, 19 nt, Human
acuucacauauugauuucc

SEQ ID NO: 1684310 - RNA, 20 nt, Human
acuuauuguagcauccugga

SEQ ID NO: 1684311 - RNA, 23 nt, Human
acuuauuguagcauccuggaaua

SEQ ID NO: 1684312 - RNA, 20 nt, Human
accugccccuccucucugcc

SEQ ID NO: 1684313 - RNA, 22 nt, Human
accugccccuccucucugcccu

SEQ ID NO: 1684314 - RNA, 14 nt, Human
accuuggcucaagu

SEQ ID NO: 1684315 - RNA, 12 nt, Human
accuuggcugca

SEQ ID NO: 1684316 - RNA, 12 nt, Human
accuuuauucug

SEQ ID NO: 1684317 - RNA, 13 nt, Human
accuuuauucugg

SEQ ID NO: 1684318 - RNA, 16 nt, Human
accuuucaauaggaaa

SEQ ID NO: 1684319 - RNA, 14 nt, Human
accuuggcugcagg

SEQ ID NO: 1684320 - RNA, 17 nt, Human
accuuucaauaggaaaa

SEQ ID NO: 1684321 - RNA, 21 nt, Human
accuuucaauaggaaaaacug

SEQ ID NO: 1684322 - RNA, 23 nt, Human
accuuucaauaggaaaaacugau

SEQ ID NO: 1684323 - RNA, 23 nt, Human
accuuucagauaacuguuauuua

SEQ ID NO: 1684324 - RNA, 21 nt, Human
accugcccaaccugcucuccu

SEQ ID NO: 1684325 - RNA, 14 nt, Human
accugccccuccuc

SEQ ID NO: 1684326 - RNA, 18 nt, Human
accugccccuccucucug

SEQ ID NO: 1684327 - RNA, 23 nt, Human
accugccccucaacucuccucca

SEQ ID NO: 1684328 - RNA, 15 nt, Human
accucugcagcaaua

SEQ ID NO: 1684329 - RNA, 21 nt, Human
accucugcacaagcugcaccc

SEQ ID NO: 1684330 - RNA, 16 nt, Human
accucugcacaagcug

SEQ ID NO: 1684331 - RNA, 18 nt, Human
accucugcacaagcugca

SEQ ID NO: 1684332 - RNA, 18 nt, Human
acgccacugcacuauagc

SEQ ID NO: 1684333 - RNA, 17 nt, Human
acgauuucuguuuagau

SEQ ID NO: 1684334 - RNA, 14 nt, Human
acgauuucuguuua

SEQ ID NO: 1684335 - RNA, 13 nt, Human
acgauuucuguuu

SEQ ID NO: 1684336 - RNA, 12 nt, Human
acgauuucuguu

SEQ ID NO: 1684337 - RNA, 13 nt, Human
acgaugucuucau

SEQ ID NO: 1684338 - RNA, 22 nt, Human
acuaaguuuuuauggcuuuugu

SEQ ID NO: 1684339 - RNA, 15 nt, Human
acuaaguuuuuaugg

SEQ ID NO: 1684340 - RNA, 17 nt, Human
acgccagauucuuuccu

SEQ ID NO: 1684341 - RNA, 16 nt, Human
acgcugugcugcccug

SEQ ID NO: 1684342 - RNA, 17 nt, Human
acgcugugcugcccugc

SEQ ID NO: 1684343 - RNA, 18 nt, Human
acgcugugcugcccugcc

SEQ ID NO: 1684344 - RNA, 13 nt, Human
acguggcugcuuc

SEQ ID NO: 1684345 - RNA, 14 nt, Human
acguggcugcuuca

SEQ ID NO: 1684346 - RNA, 15 nt, Human
acguggcugcuucaa

SEQ ID NO: 1684347 - RNA, 17 nt, Human
acguggcugcuucaagg

SEQ ID NO: 1684348 - RNA, 16 nt, Human
acuaagagagaaugag

SEQ ID NO: 1684349 - RNA, 11 nt, Human
acucuuaaaac

SEQ ID NO: 1684350 - RNA, 18 nt, Human
acucuuaaaacccaagug

SEQ ID NO: 1684351 - RNA, 16 nt, Human
acucugugucaggugg

SEQ ID NO: 1684352 - RNA, 21 nt, Human
acucuaucaaguauuauaccu

SEQ ID NO: 1684353 - RNA, 16 nt, Human
acucuaucaaguauua

SEQ ID NO: 1684354 - RNA, 14 nt, Human
acucuaucaaguau

SEQ ID NO: 1684355 - RNA, 21 nt, Human
acucuacccucuuagaaaaac

SEQ ID NO: 1684356 - RNA, 18 nt, Human
acucuacccucuuagaaa

SEQ ID NO: 1684357 - RNA, 12 nt, Human
acucccuuucaa

SEQ ID NO: 1684358 - RNA, 13 nt, Human
acucccuuucaac

SEQ ID NO: 1684359 - RNA, 16 nt, Human
acuaggguccugggga

SEQ ID NO: 1684360 - RNA, 15 nt, Human
acuaggguccugggg

SEQ ID NO: 1684361 - RNA, 14 nt, Human
acuagcuauggugu

SEQ ID NO: 1684362 - RNA, 17 nt, Human
acucaaacucuuaaaac

SEQ ID NO: 1684363 - RNA, 16 nt, Human
acucaaacucuuaaaa

SEQ ID NO: 1684364 - RNA, 11 nt, Human
acuauaaugua

SEQ ID NO: 1684365 - RNA, 14 nt, Human
acucaaaucaagaa

SEQ ID NO: 1684366 - RNA, 14 nt, Human
acucaguggggagg

SEQ ID NO: 1684367 - RNA, 12 nt, Human
acuccccuccuu

SEQ ID NO: 1684368 - RNA, 13 nt, Human
acuccccugcugg

SEQ ID NO: 1684369 - RNA, 17 nt, Human
acuccccugcugggugu

SEQ ID NO: 1684370 - RNA, 14 nt, Human
acucccccaggugg

SEQ ID NO: 1684371 - RNA, 14 nt, Human
aacccuggugacca

SEQ ID NO: 1684372 - RNA, 13 nt, Human
aacagcucgacuu

SEQ ID NO: 1684373 - RNA, 17 nt, Human
aacagcuggugcccugc

SEQ ID NO: 1684374 - RNA, 13 nt, Human
aacaugauuuggg

SEQ ID NO: 1684375 - RNA, 20 nt, Human
aaccaguauuguacaaagua

SEQ ID NO: 1684376 - RNA, 15 nt, Human
aaccaguauuguaca

SEQ ID NO: 1684377 - RNA, 21 nt, Human
aaccaguauuguacaaaguau

SEQ ID NO: 1684378 - RNA, 22 nt, Human
aaccaguauuguacaaaguauu

SEQ ID NO: 1684379 - RNA, 17 nt, Human
aaccaguguuguggauu

SEQ ID NO: 1684380 - RNA, 22 nt, Human
aaccacucuaucaaguauuaua

SEQ ID NO: 1684381 - RNA, 23 nt, Human
aacauguaauuaaguacuaugua

SEQ ID NO: 1684382 - RNA, 14 nt, Human
aacauguaauuaag

SEQ ID NO: 1684383 - RNA, 21 nt, Human
aacauguaauuaaguacuaug

SEQ ID NO: 1684384 - RNA, 14 nt, Human
aaccagaucauugu

SEQ ID NO: 1684385 - RNA, 22 nt, Human
aaccacuggaaaguuuaugguu

SEQ ID NO: 1684386 - RNA, 18 nt, Human
aaauugcauuuccugaca

SEQ ID NO: 1684387 - RNA, 16 nt, Human
aaauuggggauucuua

SEQ ID NO: 1684388 - RNA, 17 nt, Human
aaauuggggauucuuaa

SEQ ID NO: 1684389 - RNA, 15 nt, Human
aacaaagaaauuaug

SEQ ID NO: 1684390 - RNA, 17 nt, Human
aacaaagaaauuaugug

SEQ ID NO: 1684391 - RNA, 19 nt, Human
aacacauuuuucuuaggga

SEQ ID NO: 1684392 - RNA, 15 nt, Human
aacacgagcaggcua

SEQ ID NO: 1684393 - RNA, 14 nt, Human
aacugaccagccuc

SEQ ID NO: 1684394 - RNA, 19 nt, Human
aacugaccagccuccaugc

SEQ ID NO: 1684395 - RNA, 17 nt, Human
aacugauuuuuuuuucc

SEQ ID NO: 1684396 - RNA, 20 nt, Human
aacugauuuuuuuuuccuuc

SEQ ID NO: 1684397 - RNA, 19 nt, Human
aacugauuuuuuuuuccuu

SEQ ID NO: 1684398 - RNA, 17 nt, Human
aacuuaaauaaugugaa

SEQ ID NO: 1684399 - RNA, 19 nt, Human
aacuuaaauaaugugaaac

SEQ ID NO: 1684400 - RNA, 23 nt, Human
aacugaacucugacaacagacuu

SEQ ID NO: 1684401 - RNA, 19 nt, Human
aacugaacucugacaacag

SEQ ID NO: 1684402 - RNA, 20 nt, Human
aacugaacucugacaacaga

SEQ ID NO: 1684403 - RNA, 16 nt, Human
aacugaacucugacaa

SEQ ID NO: 1684404 - RNA, 12 nt, Human
aacucaccccag

SEQ ID NO: 1684405 - RNA, 15 nt, Human
aacucaccccagccc

SEQ ID NO: 1684406 - RNA, 15 nt, Human
aacucaccugccccu

SEQ ID NO: 1684407 - RNA, 16 nt, Human
aacucaccugccccuc

SEQ ID NO: 1684408 - RNA, 13 nt, Human
aacuucacauauu

SEQ ID NO: 1684409 - RNA, 13 nt, Human
aacuuuucugaua

SEQ ID NO: 1684410 - RNA, 14 nt, Human
aacuuuucugauag

SEQ ID NO: 1684411 - RNA, 12 nt, Human
aacuuuucugau

SEQ ID NO: 1684412 - RNA, 19 nt, Human
aacuuuuauaaacuuuacc

SEQ ID NO: 1684413 - RNA, 16 nt, Human
aacuuuuauaaacuuu

SEQ ID NO: 1684414 - RNA, 13 nt, Human
aagaaauguaagg

SEQ ID NO: 1684415 - RNA, 14 nt, Human
aagaaauguaaggg

SEQ ID NO: 1684416 - RNA, 17 nt, Human
aacuuugaccucugcag

SEQ ID NO: 1684417 - RNA, 14 nt, Human
aacuuugaccucug

SEQ ID NO: 1684418 - RNA, 13 nt, Human
aacuuugaccucu

SEQ ID NO: 1684419 - RNA, 15 nt, Human
aacuuuuauaaacuu

SEQ ID NO: 1684420 - RNA, 12 nt, Human
aacuuuuauaaa

SEQ ID NO: 1684421 - RNA, 20 nt, Human
aacuuugaccucugcagcaa

SEQ ID NO: 1684422 - RNA, 19 nt, Human
aacuuugaccucugcagca

SEQ ID NO: 1684423 - RNA, 17 nt, Human
aaagaguacucuuguuu

SEQ ID NO: 1684424 - RNA, 12 nt, Human
aaagaguacucu

SEQ ID NO: 1684425 - RNA, 16 nt, Human
aaagagguuuuucuua

SEQ ID NO: 1684426 - RNA, 19 nt, Human
aaagagguuuuucuuaaau

SEQ ID NO: 1684427 - RNA, 13 nt, Human
aaagaaauuaugu

SEQ ID NO: 1684428 - RNA, 15 nt, Human
aaagaaauuaugugc

SEQ ID NO: 1684429 - RNA, 11 nt, Human
aaagaacaucc

SEQ ID NO: 1684430 - RNA, 12 nt, Human
aaagaaaacuug

SEQ ID NO: 1684431 - RNA, 20 nt, Human
aaagaaaacuuguauuaugu

SEQ ID NO: 1684432 - RNA, 19 nt, Human
aaacugccagcaacgcagg

SEQ ID NO: 1684433 - RNA, 16 nt, Human
aaacugacucuuaaga

SEQ ID NO: 1684434 - RNA, 17 nt, Human
aaacugacucuuaagaa

SEQ ID NO: 1684435 - RNA, 14 nt, Human
aaacugccagcaac

SEQ ID NO: 1684436 - RNA, 15 nt, Human
aaacugccagcaacg

SEQ ID NO: 1684437 - RNA, 17 nt, Human
aaagaugaaaauauuug

SEQ ID NO: 1684438 - RNA, 13 nt, Human
aaagaugaaaaua

SEQ ID NO: 1684439 - RNA, 16 nt, Human
aaagaugaaaauauuu

SEQ ID NO: 1684440 - RNA, 19 nt, Human
aaacacuguucucugcccu

SEQ ID NO: 1684441 - RNA, 22 nt, Human
aaacacuguucucugcccucca

SEQ ID NO: 1684442 - RNA, 17 nt, Human
aaaauuggggauucuua

SEQ ID NO: 1684443 - RNA, 18 nt, Human
aaaauuggggauucuuaa

SEQ ID NO: 1684444 - RNA, 19 nt, Human
aaaauuggggauucuuaaa

SEQ ID NO: 1684445 - RNA, 13 nt, Human
aaacacucuugaa

SEQ ID NO: 1684446 - RNA, 14 nt, Human
aaacacucuugaaa

SEQ ID NO: 1684447 - RNA, 17 nt, Human
aaacacucuugaaaaau

SEQ ID NO: 1684448 - RNA, 18 nt, Human
aaacacuguucucugccc

SEQ ID NO: 1684449 - RNA, 13 nt, Human
aaaauucagugga

SEQ ID NO: 1684450 - RNA, 15 nt, Human
aaaacacauuuuucu

SEQ ID NO: 1684451 - RNA, 13 nt, Human
aaaacacauuuuu

SEQ ID NO: 1684452 - RNA, 20 nt, Human
aaagggacugagaaauuuau

SEQ ID NO: 1684453 - RNA, 16 nt, Human
aaagggacugagaaau

SEQ ID NO: 1684454 - RNA, 19 nt, Human
aaagucucuggaauuugaa

SEQ ID NO: 1684455 - RNA, 20 nt, Human
aaagucucuggaauuugaaa

SEQ ID NO: 1684456 - RNA, 22 nt, Human
aaagucucuggaauuugaaaca

SEQ ID NO: 1684457 - RNA, 11 nt, Human
aaagugcuggg

SEQ ID NO: 1684458 - RNA, 14 nt, Human
aaagugcugggauu

SEQ ID NO: 1684459 - RNA, 22 nt, Human
aaauaaaauuaaagcugaaaac

SEQ ID NO: 1684460 - RNA, 12 nt, Human
aaauaacaauga

SEQ ID NO: 1684461 - RNA, 19 nt, Human
aaauggacuguggugacuu

SEQ ID NO: 1684462 - RNA, 18 nt, Human
aaauggcuuccuggcaau

SEQ ID NO: 1684463 - RNA, 20 nt, Human
aaauggacguguuaugacuc

SEQ ID NO: 1684464 - RNA, 21 nt, Human
aaauggacguguuaugacucc

SEQ ID NO: 1684465 - RNA, 22 nt, Human
aaauggacguguuaugacucca

SEQ ID NO: 1684466 - RNA, 16 nt, Human
aaauggaaaugggcag

SEQ ID NO: 1684467 - RNA, 18 nt, Human
aaauggaagacagcucuu

SEQ ID NO: 1684468 - RNA, 18 nt, Human
aaaucaaauaugcaaagc

SEQ ID NO: 1684469 - RNA, 19 nt, Human
aaaucaaauaugcaaagca

SEQ ID NO: 1684470 - RNA, 22 nt, Human
aaauacuguuuuuaacaacuau

SEQ ID NO: 1684471 - RNA, 14 nt, Human
aaauacuguuugag

SEQ ID NO: 1684472 - RNA, 18 nt, Human
aaauauuuuaugauccag

SEQ ID NO: 1684473 - RNA, 19 nt, Human
aaauauuuuaugauccagc

SEQ ID NO: 1684474 - RNA, 14 nt, Human
aaauauuuuaugau

SEQ ID NO: 1684475 - RNA, 14 nt, Human
aaauauaauugaca

SEQ ID NO: 1684476 - RNA, 13 nt, Human
aaauaguaaaaau

SEQ ID NO: 1684477 - RNA, 16 nt, Human
aaauaguaaaaauaaa

SEQ ID NO: 1684478 - RNA, 18 nt, Human
aaggacccggaggggccu

SEQ ID NO: 1684479 - RNA, 21 nt, Human
aaggacccggaggggccuggc

SEQ ID NO: 1684480 - RNA, 18 nt, Human
aaggacuaggguccuggg

SEQ ID NO: 1684481 - RNA, 20 nt, Human
aaggacuaggguccugggga

SEQ ID NO: 1684482 - RNA, 12 nt, Human
aaggauuuuaug

SEQ ID NO: 1684483 - RNA, 13 nt, Human
aaggauuuuaugc

SEQ ID NO: 1684484 - RNA, 23 nt, Human
aaggauuuuaugcuuuaaacauu

SEQ ID NO: 1684485 - RNA, 16 nt, Human
aaggauuuuaugcuuu

SEQ ID NO: 1684486 - RNA, 20 nt, Human
aaggauuuuaugcuuuaaac

SEQ ID NO: 1684487 - RNA, 21 nt, Human
aaggauuuuaugcuuuaaaca

SEQ ID NO: 1684488 - RNA, 22 nt, Human
aaggauuuuaugcuuuaaacau

SEQ ID NO: 1684489 - RNA, 11 nt, Human
aagcugggcag

SEQ ID NO: 1684490 - RNA, 15 nt, Human
aagcugggcagguug

SEQ ID NO: 1684491 - RNA, 13 nt, Human
aagcugggcaggu

SEQ ID NO: 1684492 - RNA, 18 nt, Human
aaggacauugcggacagc

SEQ ID NO: 1684493 - RNA, 22 nt, Human
aagcugcacccucaggcaggug

SEQ ID NO: 1684494 - RNA, 21 nt, Human
aagcugcacccucaggcaggu

SEQ ID NO: 1684495 - RNA, 20 nt, Human
aagcugcacccucaggcagg

SEQ ID NO: 1684496 - RNA, 12 nt, Human
aagcguggugga

SEQ ID NO: 1684497 - RNA, 17 nt, Human
aaggcaaggcugucaau

SEQ ID NO: 1684498 - RNA, 18 nt, Human
aaggcaaggcugucaauu

SEQ ID NO: 1684499 - RNA, 13 nt, Human
aagccauguuuau

SEQ ID NO: 1684500 - RNA, 13 nt, Human
aagaaauuaugug

SEQ ID NO: 1684501 - RNA, 22 nt, Human
aagaaauuaugugccagauuua

SEQ ID NO: 1684502 - RNA, 16 nt, Human
aagauuuaccacuugu

SEQ ID NO: 1684503 - RNA, 14 nt, Human
aagcagaggaagga

SEQ ID NO: 1684504 - RNA, 21 nt, Human
aagcagaggaaggagaggaga

SEQ ID NO: 1684505 - RNA, 13 nt, Human
aagccagauuuuc

SEQ ID NO: 1684506 - RNA, 14 nt, Human
aauaaaauggguuu

SEQ ID NO: 1684507 - RNA, 12 nt, Human
aaguuguuugag

SEQ ID NO: 1684508 - RNA, 19 nt, Human
aauaaacuauuuguaaagu

SEQ ID NO: 1684509 - RNA, 17 nt, Human
aauaaacgucuuaaaua

SEQ ID NO: 1684510 - RNA, 16 nt, Human
aauaaacgucuuaaau

SEQ ID NO: 1684511 - RNA, 23 nt, Human
aauaaaauuaaagcugaaaacug

SEQ ID NO: 1684512 - RNA, 19 nt, Human
aauaaaauggguuuuacug

SEQ ID NO: 1684513 - RNA, 15 nt, Human
aaguuguuugagaaa

SEQ ID NO: 1684514 - RNA, 12 nt, Human
aauaauguaaga

SEQ ID NO: 1684515 - RNA, 19 nt, Human
aauaauguaagacaaauau

SEQ ID NO: 1684516 - RNA, 16 nt, Human
aauaaugugaaacugg

SEQ ID NO: 1684517 - RNA, 21 nt, Human
aauaauccuaaacauaugaau

SEQ ID NO: 1684518 - RNA, 19 nt, Human
aagucucuggaauuugaaa

SEQ ID NO: 1684519 - RNA, 16 nt, Human
aagucuguuuuaugac

SEQ ID NO: 1684520 - RNA, 18 nt, Human
aagucuguuuuaugacuu

SEQ ID NO: 1684521 - RNA, 19 nt, Human
aagucuguuuuaugacuuc

SEQ ID NO: 1684522 - RNA, 20 nt, Human
aagucuguuuuaugacuuca

SEQ ID NO: 1684523 - RNA, 23 nt, Human
aagucuguuuuaugacuucauua

SEQ ID NO: 1684524 - RNA, 19 nt, Human
aagucucugaagugaaacu

SEQ ID NO: 1684525 - RNA, 22 nt, Human
aagucucugaagugaaacugcu

SEQ ID NO: 1684526 - RNA, 17 nt, Human
aagucuuagauguauau

SEQ ID NO: 1684527 - RNA, 16 nt, Human
aagucuuagauguaua

SEQ ID NO: 1684528 - RNA, 15 nt, Human
aagguuaauaaagua

SEQ ID NO: 1684529 - RNA, 16 nt, Human
aagguuaauaaaguaa

SEQ ID NO: 1684530 - RNA, 20 nt, Human
aagguuaauguucaucaucc

SEQ ID NO: 1684531 - RNA, 11 nt, Human
aaggugggagg

SEQ ID NO: 1684532 - RNA, 14 nt, Human
aaguacuuuuggca

SEQ ID NO: 1684533 - RNA, 15 nt, Human
aaguacuuuuggcau

SEQ ID NO: 1684534 - RNA, 11 nt, Human
aaguacuucuu

SEQ ID NO: 1684535 - RNA, 16 nt, Human
aaguaucccuacugua

SEQ ID NO: 1684536 - RNA, 22 nt, Human
aaguaucugacaucucugcaau

SEQ ID NO: 1684537 - RNA, 23 nt, Human
aaguccaggcuuuuuuaucaugu

SEQ ID NO: 1684538 - RNA, 21 nt, Human
aauauaggaacuuaaauaaug

SEQ ID NO: 1684539 - RNA, 20 nt, Human
aauauaggaacuuaaauaau

SEQ ID NO: 1684540 - RNA, 18 nt, Human
aauauaggaacuuaaaua

SEQ ID NO: 1684541 - RNA, 13 nt, Human
aaucacaauacau

SEQ ID NO: 1684542 - RNA, 15 nt, Human
aaucaagaaacuuaa

SEQ ID NO: 1684543 - RNA, 19 nt, Human
aaucaacugggcugaacac

SEQ ID NO: 1684544 - RNA, 14 nt, Human
aaucaacugggcug

SEQ ID NO: 1684545 - RNA, 16 nt, Human
aauauuauguuaaaac

SEQ ID NO: 1684546 - RNA, 19 nt, Human
aaugaugccaugaggaaca

SEQ ID NO: 1684547 - RNA, 18 nt, Human
aauccaggguggugguga

SEQ ID NO: 1684548 - RNA, 13 nt, Human
aauccauacauuu

SEQ ID NO: 1684549 - RNA, 14 nt, Human
aauccauacauuug

SEQ ID NO: 1684550 - RNA, 14 nt, Human
aauccauuuggaaa

SEQ ID NO: 1684551 - RNA, 15 nt, Human
aauccauuuggaaau

SEQ ID NO: 1684552 - RNA, 17 nt, Human
aauccauuuggaaaucu

SEQ ID NO: 1684553 - RNA, 18 nt, Human
aauccauuuggaaaucuu

SEQ ID NO: 1684554 - RNA, 22 nt, Human
aauccauuuggaaaucuuuaaa

SEQ ID NO: 1684555 - RNA, 18 nt, Human
aaucuccaaaauaaaacu

SEQ ID NO: 1684556 - RNA, 14 nt, Human
aaucuccaaaauaa

SEQ ID NO: 1684557 - RNA, 13 nt, Human
aaucuccaaaaua

SEQ ID NO: 1684558 - RNA, 16 nt, Human
aaugaaccacaucuug

SEQ ID NO: 1684559 - RNA, 17 nt, Human
aaugaaccacaucuugc

SEQ ID NO: 1684560 - RNA, 23 nt, Human
aaugaaccacaucuugcucugcu

SEQ ID NO: 1684561 - RNA, 22 nt, Human
aaucugcuuuuuaaagaaugcu

SEQ ID NO: 1684562 - RNA, 12 nt, Human
aaugaagauacu

SEQ ID NO: 1684563 - RNA, 17 nt, Human
aaugauaacuggaaacu

SEQ ID NO: 1684564 - RNA, 21 nt, Human
aaugaugauccuaggcauuug

SEQ ID NO: 1684565 - RNA, 20 nt, Human
aaugauaacuggaaacuuca

SEQ ID NO: 1684566 - RNA, 17 nt, Human
aaugaagauacugaaau

SEQ ID NO: 1684567 - RNA, 18 nt, Human
aauuaguggcacuugcuu

SEQ ID NO: 1684568 - RNA, 14 nt, Human
aauuaguuuuauau

SEQ ID NO: 1684569 - RNA, 17 nt, Human
aauuaguuuuauaugcu

SEQ ID NO: 1684570 - RNA, 20 nt, Human
aauuaguuuuauaugcuucu

SEQ ID NO: 1684571 - RNA, 22 nt, Human
aauggucuuucuaaugugugaa

SEQ ID NO: 1684572 - RNA, 22 nt, Human
aaugguccgugcuaaggacuug

SEQ ID NO: 1684573 - RNA, 15 nt, Human
aaugucagugugacu

SEQ ID NO: 1684574 - RNA, 16 nt, Human
aaugucagugugacug

SEQ ID NO: 1684575 - RNA, 13 nt, Human
aaugucaguguga

SEQ ID NO: 1684576 - RNA, 20 nt, Human
aaugucucuuuaaugucaca

SEQ ID NO: 1684577 - RNA, 22 nt, Human
aaugucuaguuguaacaccaug

SEQ ID NO: 1684578 - RNA, 17 nt, Human
aaugucagugugacuga

SEQ ID NO: 1684579 - RNA, 21 nt, Human
aaugucagugugacugaucuc

SEQ ID NO: 1684580 - RNA, 15 nt, Human
aauggcuuuguauag

SEQ ID NO: 1684581 - RNA, 16 nt, Human
aauggcuuuguauaga

SEQ ID NO: 1684582 - RNA, 18 nt, Human
aauggcuuuguauagaac

SEQ ID NO: 1684583 - RNA, 13 nt, Human
aauggcuuuguau

SEQ ID NO: 1684584 - RNA, 15 nt, Human
aaugggcagagcaga

SEQ ID NO: 1684585 - RNA, 13 nt, Human
aaugggcagagca

SEQ ID NO: 1684586 - RNA, 18 nt, Human
aauguuugccucugccuc

SEQ ID NO: 1684587 - RNA, 19 nt, Human
aauguuugccucugccucu

SEQ ID NO: 1684588 - RNA, 18 nt, Human
aauuaaaacacaacaucu

SEQ ID NO: 1684589 - RNA, 15 nt, Human
aaaaacugauuuuuu

SEQ ID NO: 1684590 - RNA, 14 nt, Human
aaaaacauggccuu

SEQ ID NO: 1684591 - RNA, 16 nt, Human
aaaaaccaguauugua

SEQ ID NO: 1684592 - RNA, 18 nt, Human
aaaaaccaguauuguaca

SEQ ID NO: 1684593 - RNA, 13 nt, Human
aaaaacugauuuu

SEQ ID NO: 1684594 - RNA, 17 nt, Human
aaaaauuggggauucuu

SEQ ID NO: 1684595 - RNA, 18 nt, Human
aaaaauuggggauucuua

SEQ ID NO: 1684596 - RNA, 19 nt, Human
aaaaauuggggauucuuaa

SEQ ID NO: 1684597 - RNA, 20 nt, Human
aaaaauuggggauucuuaaa

SEQ ID NO: 1684598 - RNA, 12 nt, Human
aaaaagaggcua

SEQ ID NO: 1684599 - RNA, 17 nt, Human
aaaacaaggaugaauua

SEQ ID NO: 1684600 - RNA, 12 nt, Human
aaaacacauuuu

SEQ ID NO: 1684601 - RNA, 18 nt, Human
aaaacacagcaaggguga

SEQ ID NO: 1684602 - RNA, 12 nt, Human
aaaacacagcaa

SEQ ID NO: 1684603 - RNA, 13 nt, Human
aaaacacagcaag

SEQ ID NO: 1684604 - RNA, 14 nt, Human
aaaacaaggaugaa

SEQ ID NO: 1684605 - RNA, 14 nt, Human
aaaaacacaaaagu

SEQ ID NO: 1684606 - RNA, 12 nt, Human
aaaaacacagca

SEQ ID NO: 1684607 - RNA, 23 nt, Human
aaaaaauuggggauucuuaaagu

SEQ ID NO: 1684608 - RNA, 16 nt, Human
uuauauuuacaaaugg

SEQ ID NO: 1684609 - RNA, 20 nt, Human
uuauauuuauuacuguaaga

SEQ ID NO: 1684610 - RNA, 12 nt, Human
uuauauuugaaa

SEQ ID NO: 1684611 - RNA, 13 nt, Human
uuauauuugaaau

SEQ ID NO: 1684612 - RNA, 15 nt, Human
uuauauuugaaauau

SEQ ID NO: 1684613 - RNA, 14 nt, Human
uuaucuagauacug

SEQ ID NO: 1684614 - RNA, 16 nt, Human
uuaucuugaauaaugu

SEQ ID NO: 1684615 - RNA, 14 nt, Human
uuaucuugaauaau

SEQ ID NO: 1684616 - RNA, 11 nt, Human
uuaucucaaaa

SEQ ID NO: 1684617 - RNA, 23 nt, Human
uuauuaaaaaucucaaauuucua

SEQ ID NO: 1684618 - RNA, 19 nt, Human
uuauuaaaugcccagcccc

SEQ ID NO: 1684619 - RNA, 21 nt, Human
uuauuaaaugcccagccccuu

SEQ ID NO: 1684620 - RNA, 16 nt, Human
uuauuacaguauaauu

SEQ ID NO: 1684621 - RNA, 17 nt, Human
uuauggaacacucugag

SEQ ID NO: 1684622 - RNA, 21 nt, Human
uuauggacaaugacccagugg

SEQ ID NO: 1684623 - RNA, 18 nt, Human
uuauggaacacucugaga

SEQ ID NO: 1684624 - RNA, 20 nt, Human
uuauggaacacucugagacu

SEQ ID NO: 1684625 - RNA, 17 nt, Human
uuauggcuuuugugcau

SEQ ID NO: 1684626 - RNA, 18 nt, Human
uuauggcuuuugugcauu

SEQ ID NO: 1684627 - RNA, 17 nt, Human
uuauguugcauagaaua

SEQ ID NO: 1684628 - RNA, 14 nt, Human
uuauggcacaucag

SEQ ID NO: 1684629 - RNA, 16 nt, Human
uuauggcuuuugugca

SEQ ID NO: 1684630 - RNA, 18 nt, Human
uuauggcuauaggugcua

SEQ ID NO: 1684631 - RNA, 19 nt, Human
uuagugaccucagcuuuga

SEQ ID NO: 1684632 - RNA, 21 nt, Human
ugugaaaagaaaaaugagccu

SEQ ID NO: 1684633 - RNA, 17 nt, Human
ugugaaaagaaaaauga

SEQ ID NO: 1684634 - RNA, 13 nt, Human
ugugaaaagaaaa

SEQ ID NO: 1684635 - RNA, 15 nt, Human
ugugaaaagaaaaau

SEQ ID NO: 1684636 - RNA, 12 nt, Human
uuauaauuuuaa

SEQ ID NO: 1684637 - RNA, 12 nt, Human
uuauaauuuaaa

SEQ ID NO: 1684638 - RNA, 17 nt, Human
uuauaauuuuaaauguu

SEQ ID NO: 1684639 - RNA, 21 nt, Human
uuauaauuuuaaauguuuuuu

SEQ ID NO: 1684640 - RNA, 14 nt, Human
uuauaauuuuguga

SEQ ID NO: 1684641 - RNA, 15 nt, Human
uuauaauuuugugaa

SEQ ID NO: 1684642 - RNA, 18 nt, Human
uuauaauaauguuaacau

SEQ ID NO: 1684643 - RNA, 15 nt, Human
uuauaauaauguuaa

SEQ ID NO: 1684644 - RNA, 15 nt, Human
uuauaaugaaugaaa

SEQ ID NO: 1684645 - RNA, 11 nt, Human
uuauaaucuuu

SEQ ID NO: 1684646 - RNA, 13 nt, Human
uuauaaucacuuu

SEQ ID NO: 1684647 - RNA, 16 nt, Human
uuauauuaugaagcuu

SEQ ID NO: 1684648 - RNA, 20 nt, Human
uuauaucugaggaauucugu

SEQ ID NO: 1684649 - RNA, 21 nt, Human
uuauaucugaggaauucugua

SEQ ID NO: 1684650 - RNA, 14 nt, Human
uuauaucugaggaa

SEQ ID NO: 1684651 - RNA, 22 nt, Human
uuauaucugaggaauucuguau

SEQ ID NO: 1684652 - RNA, 23 nt, Human
uuauaucugaggaauucuguaua

SEQ ID NO: 1684653 - RNA, 18 nt, Human
uuauaugcuauuucuaua

SEQ ID NO: 1684654 - RNA, 16 nt, Human
uuauaugcuauuucua

SEQ ID NO: 1684655 - RNA, 19 nt, Human
uuauaucuauauuuuacau

SEQ ID NO: 1684656 - RNA, 23 nt, Human
uuauaucuauauuuuacauaaau

SEQ ID NO: 1684657 - RNA, 13 nt, Human
uuauacauaaaca

SEQ ID NO: 1684658 - RNA, 11 nt, Human
uuauacauaaa

SEQ ID NO: 1684659 - RNA, 16 nt, Human
uuauaauuuugugaag

SEQ ID NO: 1684660 - RNA, 17 nt, Human
uuauaauuuugugaagc

SEQ ID NO: 1684661 - RNA, 18 nt, Human
uuauaauuuugugaagca

SEQ ID NO: 1684662 - RNA, 22 nt, Human
uucagcuuguaaauagcucagg

SEQ ID NO: 1684663 - RNA, 14 nt, Human
uucaguggcagcug

SEQ ID NO: 1684664 - RNA, 22 nt, Human
uucagcuccagcucaccagccc

SEQ ID NO: 1684665 - RNA, 12 nt, Human
uucagcuccagc

SEQ ID NO: 1684666 - RNA, 15 nt, Human
uucagcuccagcuca

SEQ ID NO: 1684667 - RNA, 13 nt, Human
uucaguguacaug

SEQ ID NO: 1684668 - RNA, 12 nt, Human
uucaguguacau

SEQ ID NO: 1684669 - RNA, 17 nt, Human
uucaguggcagcugcuu

SEQ ID NO: 1684670 - RNA, 15 nt, Human
uucaguggcagcugc

SEQ ID NO: 1684671 - RNA, 16 nt, Human
uucaguggcagcugcu

SEQ ID NO: 1684672 - RNA, 15 nt, Human
uucauaaccuagccu

SEQ ID NO: 1684673 - RNA, 15 nt, Human
uucauccuccucaga

SEQ ID NO: 1684674 - RNA, 19 nt, Human
uucauccuccucagaucuu

SEQ ID NO: 1684675 - RNA, 20 nt, Human
uucauaaauaaaguuuguug

SEQ ID NO: 1684676 - RNA, 23 nt, Human
uucaguuauuauauuuacaaaug

SEQ ID NO: 1684677 - RNA, 14 nt, Human
uuccauggacuuug

SEQ ID NO: 1684678 - RNA, 15 nt, Human
uuccauggacuuugu

SEQ ID NO: 1684679 - RNA, 19 nt, Human
uuccaacccucaucaccaa

SEQ ID NO: 1684680 - RNA, 18 nt, Human
uuccagauccuggaaauc

SEQ ID NO: 1684681 - RNA, 20 nt, Human
uucaugcuguucaugaaaga

SEQ ID NO: 1684682 - RNA, 16 nt, Human
uuccaaaguacacugu

SEQ ID NO: 1684683 - RNA, 13 nt, Human
uuccaaaguacac

SEQ ID NO: 1684684 - RNA, 21 nt, Human
uucaauaggaaaaacugauuu

SEQ ID NO: 1684685 - RNA, 22 nt, Human
uucaauaggaaaaacugauuuu

SEQ ID NO: 1684686 - RNA, 14 nt, Human
uucaccuuuguccc

SEQ ID NO: 1684687 - RNA, 19 nt, Human
uucaccuuuguccccaccg

SEQ ID NO: 1684688 - RNA, 20 nt, Human
uucaccuuuguccccaccgc

SEQ ID NO: 1684689 - RNA, 13 nt, Human
uucacccuuuucu

SEQ ID NO: 1684690 - RNA, 21 nt, Human
uucacaaccuucuguggcuca

SEQ ID NO: 1684691 - RNA, 22 nt, Human
uucacaagacccaaaaggcaga

SEQ ID NO: 1684692 - RNA, 13 nt, Human
uucacggaagagc

SEQ ID NO: 1684693 - RNA, 22 nt, Human
uucaccuuuguccccaccgcag

SEQ ID NO: 1684694 - RNA, 17 nt, Human
uucacggaagagccuug

SEQ ID NO: 1684695 - RNA, 14 nt, Human
uucagacagcugcc

SEQ ID NO: 1684696 - RNA, 15 nt, Human
uucagacagcugccu

SEQ ID NO: 1684697 - RNA, 16 nt, Human
uucagacagcugccug

SEQ ID NO: 1684698 - RNA, 14 nt, Human
uucagcucacugca

SEQ ID NO: 1684699 - RNA, 16 nt, Human
uucagauacuggauug

SEQ ID NO: 1684700 - RNA, 20 nt, Human
uucagauacuggauuguacu

SEQ ID NO: 1684701 - RNA, 20 nt, Human
uucagagcugcccucuccug

SEQ ID NO: 1684702 - RNA, 19 nt, Human
uucagagcugcccucuccu

SEQ ID NO: 1684703 - RNA, 18 nt, Human
uucagagcugcccucucc

SEQ ID NO: 1684704 - RNA, 17 nt, Human
uucagacagcugccugg

SEQ ID NO: 1684705 - RNA, 17 nt, Human
uucagagcugcccucuc

SEQ ID NO: 1684706 - RNA, 15 nt, Human
uucagagcugcccuc

SEQ ID NO: 1684707 - RNA, 19 nt, Human
uuauuuuaauaauguuuca

SEQ ID NO: 1684708 - RNA, 15 nt, Human
uuauuuuauuaugaa

SEQ ID NO: 1684709 - RNA, 16 nt, Human
uuauuuuauuaugaaa

SEQ ID NO: 1684710 - RNA, 18 nt, Human
uuauuuuauuaugcauga

SEQ ID NO: 1684711 - RNA, 17 nt, Human
uuauuuuaauucaguug

SEQ ID NO: 1684712 - RNA, 14 nt, Human
uuauuuuauuauga

SEQ ID NO: 1684713 - RNA, 20 nt, Human
uuauuuuaauaauguuucaa

SEQ ID NO: 1684714 - RNA, 20 nt, Human
uuauuuuauuaugaaacuug

SEQ ID NO: 1684715 - RNA, 22 nt, Human
uuauuuuggaaaauaaauuauu

SEQ ID NO: 1684716 - RNA, 18 nt, Human
uucaaaugcuguaacuuu

SEQ ID NO: 1684717 - RNA, 19 nt, Human
uucaaaugguuuaacaaaa

SEQ ID NO: 1684718 - RNA, 18 nt, Human
uucaaauguauuacagug

SEQ ID NO: 1684719 - RNA, 15 nt, Human
uucaaccauucccca

SEQ ID NO: 1684720 - RNA, 17 nt, Human
uugaauuuuguguuaga

SEQ ID NO: 1684721 - RNA, 21 nt, Human
uugaauuuuguguuagagauu

SEQ ID NO: 1684722 - RNA, 12 nt, Human
uugaauuuuaca

SEQ ID NO: 1684723 - RNA, 15 nt, Human
uugaauuuauuggcu

SEQ ID NO: 1684724 - RNA, 18 nt, Human
uugaauuuauuggcuuuu

SEQ ID NO: 1684725 - RNA, 22 nt, Human
uugaauuuauuggcuuuucuga

SEQ ID NO: 1684726 - RNA, 13 nt, Human
uugaacuuugacc

SEQ ID NO: 1684727 - RNA, 17 nt, Human
uugaacuccugaccuca

SEQ ID NO: 1684728 - RNA, 18 nt, Human
uugaacuggguacuugug

SEQ ID NO: 1684729 - RNA, 16 nt, Human
uugaccucugcagcaa

SEQ ID NO: 1684730 - RNA, 17 nt, Human
uugacgccaucccagcc

SEQ ID NO: 1684731 - RNA, 18 nt, Human
uugacgccaucccagccc

SEQ ID NO: 1684732 - RNA, 19 nt, Human
uugacgccaucccagcccc

SEQ ID NO: 1684733 - RNA, 20 nt, Human
uugacgccaucccagcccca

SEQ ID NO: 1684734 - RNA, 15 nt, Human
uugaccucugcagca

SEQ ID NO: 1684735 - RNA, 14 nt, Human
uugaccucugcagc

SEQ ID NO: 1684736 - RNA, 17 nt, Human
uugaccgugaggccaga

SEQ ID NO: 1684737 - RNA, 17 nt, Human
uugacccacaagaaaug

SEQ ID NO: 1684738 - RNA, 21 nt, Human
uugcaaaguaucccuacugua

SEQ ID NO: 1684739 - RNA, 17 nt, Human
uugaugacccccaacca

SEQ ID NO: 1684740 - RNA, 16 nt, Human
uugaugaucuuugcag

SEQ ID NO: 1684741 - RNA, 16 nt, Human
uugaggguugggcugg

SEQ ID NO: 1684742 - RNA, 14 nt, Human
uugagccugggagg

SEQ ID NO: 1684743 - RNA, 13 nt, Human
uugaggguugggc

SEQ ID NO: 1684744 - RNA, 11 nt, Human
uugagccuggg

SEQ ID NO: 1684745 - RNA, 15 nt, Human
uugaggucuguucuu

SEQ ID NO: 1684746 - RNA, 23 nt, Human
uugauauccucuuugagugaagc

SEQ ID NO: 1684747 - RNA, 13 nt, Human
uugaugaagaagu

SEQ ID NO: 1684748 - RNA, 14 nt, Human
uugaugaagaaguu

SEQ ID NO: 1684749 - RNA, 23 nt, Human
uugaugaagaaguugauaugccu

SEQ ID NO: 1684750 - RNA, 15 nt, Human
uucuggcagaggagg

SEQ ID NO: 1684751 - RNA, 18 nt, Human
uucuguauuuuguuuuug

SEQ ID NO: 1684752 - RNA, 17 nt, Human
uucugucuucacaacag

SEQ ID NO: 1684753 - RNA, 18 nt, Human
uucugcuuuccucuuccu

SEQ ID NO: 1684754 - RNA, 14 nt, Human
uucugcuucagccu

SEQ ID NO: 1684755 - RNA, 15 nt, Human
uucugcuucagccuc

SEQ ID NO: 1684756 - RNA, 16 nt, Human
uucugcuucagccucc

SEQ ID NO: 1684757 - RNA, 19 nt, Human
uucugcuucagccucccga

SEQ ID NO: 1684758 - RNA, 15 nt, Human
uugaaaaaugcaugu

SEQ ID NO: 1684759 - RNA, 23 nt, Human
uugaaaacacuguucucugcccu

SEQ ID NO: 1684760 - RNA, 21 nt, Human
uucuuuccaaaguacacuguu

SEQ ID NO: 1684761 - RNA, 20 nt, Human
uugaaaaaccauuuugcugu

SEQ ID NO: 1684762 - RNA, 15 nt, Human
uugaacuccuggccu

SEQ ID NO: 1684763 - RNA, 16 nt, Human
uugaacuccuggccuc

SEQ ID NO: 1684764 - RNA, 16 nt, Human
uugaaaagacuccaaa

SEQ ID NO: 1684765 - RNA, 14 nt, Human
uucuuuccaaagua

SEQ ID NO: 1684766 - RNA, 12 nt, Human
uucuuucagcca

SEQ ID NO: 1684767 - RNA, 13 nt, Human
uucuuccucccuc

SEQ ID NO: 1684768 - RNA, 21 nt, Human
uucuuguguguuuauugucaa

SEQ ID NO: 1684769 - RNA, 21 nt, Human
uucuuccacaagagcccaggc

SEQ ID NO: 1684770 - RNA, 21 nt, Human
uucuuauacauuugauaaagu

SEQ ID NO: 1684771 - RNA, 13 nt, Human
uucucuccagccc

SEQ ID NO: 1684772 - RNA, 14 nt, Human
uucucuccagcccc

SEQ ID NO: 1684773 - RNA, 18 nt, Human
uucucuccuguaccucuu

SEQ ID NO: 1684774 - RNA, 14 nt, Human
uucucuccuguacc

SEQ ID NO: 1684775 - RNA, 15 nt, Human
uucucuccagccccu

SEQ ID NO: 1684776 - RNA, 16 nt, Human
uucucuccagccccug

SEQ ID NO: 1684777 - RNA, 19 nt, Human
uucucuccuguaccucuug

SEQ ID NO: 1684778 - RNA, 22 nt, Human
uucucuccuguaccucuugagc

SEQ ID NO: 1684779 - RNA, 14 nt, Human
uucucugaggacac

SEQ ID NO: 1684780 - RNA, 20 nt, Human
uucucugaggacacuaacca

SEQ ID NO: 1684781 - RNA, 11 nt, Human
uucucugcccu

SEQ ID NO: 1684782 - RNA, 12 nt, Human
uucucugcccuc

SEQ ID NO: 1684783 - RNA, 12 nt, Human
uucuccacugga

SEQ ID NO: 1684784 - RNA, 20 nt, Human
uucuccaccugccagggaca

SEQ ID NO: 1684785 - RNA, 16 nt, Human
uucuccaccugccagg

SEQ ID NO: 1684786 - RNA, 18 nt, Human
uucuccaccugccaggga

SEQ ID NO: 1684787 - RNA, 21 nt, Human
uucuccaccucccacaaagga

SEQ ID NO: 1684788 - RNA, 12 nt, Human
uucuccaccugc

SEQ ID NO: 1684789 - RNA, 14 nt, Human
uucuccaccugcca

SEQ ID NO: 1684790 - RNA, 15 nt, Human
uucuccaccugccag

SEQ ID NO: 1684791 - RNA, 20 nt, Human
uucucauuugccaauaauaa

SEQ ID NO: 1684792 - RNA, 14 nt, Human
uucuaugaaauauu

SEQ ID NO: 1684793 - RNA, 21 nt, Human
uucuaugaaauauuauguuaa

SEQ ID NO: 1684794 - RNA, 19 nt, Human
uucugcucacauaucuguc

SEQ ID NO: 1684795 - RNA, 19 nt, Human
uucugauccuaguuccacc

SEQ ID NO: 1684796 - RNA, 13 nt, Human
uucugauagagga

SEQ ID NO: 1684797 - RNA, 21 nt, Human
uucugauagaggaagccugau

SEQ ID NO: 1684798 - RNA, 16 nt, Human
uucucugcccuccaag

SEQ ID NO: 1684799 - RNA, 17 nt, Human
uucucugcccuccaaga

SEQ ID NO: 1684800 - RNA, 23 nt, Human
uucugacccaugcugcccuguga

SEQ ID NO: 1684801 - RNA, 22 nt, Human
uucugacccaugcugcccugug

SEQ ID NO: 1684802 - RNA, 18 nt, Human
uucugacccugcuucaaa

SEQ ID NO: 1684803 - RNA, 21 nt, Human
uucugacccugcuucaaauau

SEQ ID NO: 1684804 - RNA, 16 nt, Human
uucugagaaagacuau

SEQ ID NO: 1684805 - RNA, 21 nt, Human
uucugagaaagacuauucaaa

SEQ ID NO: 1684806 - RNA, 20 nt, Human
uuccugaggcugggcucccu

SEQ ID NO: 1684807 - RNA, 15 nt, Human
uuccugaggcugggc

SEQ ID NO: 1684808 - RNA, 13 nt, Human
uuccugcaaugaa

SEQ ID NO: 1684809 - RNA, 21 nt, Human
uuccugcaaugaagucucuga

SEQ ID NO: 1684810 - RNA, 16 nt, Human
uuccaugucgccucug

SEQ ID NO: 1684811 - RNA, 16 nt, Human
uuccauggccucuuca

SEQ ID NO: 1684812 - RNA, 12 nt, Human
uuccauggccuc

SEQ ID NO: 1684813 - RNA, 15 nt, Human
uuccugcauuuguga

SEQ ID NO: 1684814 - RNA, 21 nt, Human
uuccuugaguugauucagcuc

SEQ ID NO: 1684815 - RNA, 18 nt, Human
uucggugagcuacaaaug

SEQ ID NO: 1684816 - RNA, 17 nt, Human
uuccuuggacucauuuu

SEQ ID NO: 1684817 - RNA, 14 nt, Human
uucuauagcuuuuc

SEQ ID NO: 1684818 - RNA, 22 nt, Human
uucuacucgaguuacagacaaa

SEQ ID NO: 1684819 - RNA, 14 nt, Human
uucuacccaggugc

SEQ ID NO: 1684820 - RNA, 20 nt, Human
uucuacccagcgagcccugg

SEQ ID NO: 1684821 - RNA, 21 nt, Human
uucuacccagcgagcccuggu

SEQ ID NO: 1684822 - RNA, 13 nt, Human
uucuacuauuuau

SEQ ID NO: 1684823 - RNA, 13 nt, Human
uucuacgccaggg

SEQ ID NO: 1684824 - RNA, 23 nt, Human
uucuaaugugugaaucagagcac

SEQ ID NO: 1684825 - RNA, 15 nt, Human
uucuacauacuaugg

SEQ ID NO: 1684826 - RNA, 12 nt, Human
uucuacccagcg

SEQ ID NO: 1684827 - RNA, 19 nt, Human
uucuacccagcgagcccug

SEQ ID NO: 1684828 - RNA, 14 nt, Human
uuucauuuagguga

SEQ ID NO: 1684829 - RNA, 18 nt, Human
uuucauuuaggugaggaa

SEQ ID NO: 1684830 - RNA, 13 nt, Human
uuucaguguacau

SEQ ID NO: 1684831 - RNA, 14 nt, Human
uuucaguguacaug

SEQ ID NO: 1684832 - RNA, 13 nt, Human
uuucagauacugg

SEQ ID NO: 1684833 - RNA, 21 nt, Human
uuucagauacuggauuguacu

SEQ ID NO: 1684834 - RNA, 22 nt, Human
uuucacaaccuucuguggcuca

SEQ ID NO: 1684835 - RNA, 16 nt, Human
uuucacaaccuucugu

SEQ ID NO: 1684836 - RNA, 12 nt, Human
uuucaauaggaa

SEQ ID NO: 1684837 - RNA, 14 nt, Human
uuucaauaggaaaa

SEQ ID NO: 1684838 - RNA, 17 nt, Human
uuucaauaggaaaaacu

SEQ ID NO: 1684839 - RNA, 19 nt, Human
uuucaauaggaaaaacuga

SEQ ID NO: 1684840 - RNA, 15 nt, Human
uuucaacgcagcccu

SEQ ID NO: 1684841 - RNA, 16 nt, Human
uuucaacgcagcccug

SEQ ID NO: 1684842 - RNA, 20 nt, Human
uuucaacgcagcccugcuuu

SEQ ID NO: 1684843 - RNA, 21 nt, Human
uuucaacgcagcccugcuuug

SEQ ID NO: 1684844 - RNA, 19 nt, Human
uuuauuuaguuccuugagu

SEQ ID NO: 1684845 - RNA, 13 nt, Human
uuuauuauggcac

SEQ ID NO: 1684846 - RNA, 13 nt, Human
uuuauuaugcaug

SEQ ID NO: 1684847 - RNA, 16 nt, Human
uuuauuauguaaaucc

SEQ ID NO: 1684848 - RNA, 17 nt, Human
uuuauuauguaaauccc

SEQ ID NO: 1684849 - RNA, 14 nt, Human
uuuauuauguaaau

SEQ ID NO: 1684850 - RNA, 16 nt, Human
uuuauggcuuuugugc

SEQ ID NO: 1684851 - RNA, 14 nt, Human
uuuauggcuuuugu

SEQ ID NO: 1684852 - RNA, 22 nt, Human
uuuauaauuuugugaagcaaaa

SEQ ID NO: 1684853 - RNA, 21 nt, Human
uuuauaaaaauaaaaaacacu

SEQ ID NO: 1684854 - RNA, 23 nt, Human
uuuauaaaaauaaaaaacacugg

SEQ ID NO: 1684855 - RNA, 12 nt, Human
uuuagacagagu

SEQ ID NO: 1684856 - RNA, 14 nt, Human
uuuagaaauauaau

SEQ ID NO: 1684857 - RNA, 19 nt, Human
uuuacuucuuauacauuug

SEQ ID NO: 1684858 - RNA, 22 nt, Human
uuuacuucuuauacauuugaua

SEQ ID NO: 1684859 - RNA, 15 nt, Human
uuuacagcugccugc

SEQ ID NO: 1684860 - RNA, 16 nt, Human
uuuacagcugccugca

SEQ ID NO: 1684861 - RNA, 13 nt, Human
uuuaccacuugug

SEQ ID NO: 1684862 - RNA, 21 nt, Human
uuuaauagguuuggacaaaau

SEQ ID NO: 1684863 - RNA, 21 nt, Human
uuuaauaauuauaugcuauuu

SEQ ID NO: 1684864 - RNA, 18 nt, Human
uuuaauaauuauaugcua

SEQ ID NO: 1684865 - RNA, 16 nt, Human
uuuaacaacagcuggu

SEQ ID NO: 1684866 - RNA, 23 nt, Human
uuuaacaacuaugauuuggaaaa

SEQ ID NO: 1684867 - RNA, 21 nt, Human
uuguuuggaccaaaaaccagu

SEQ ID NO: 1684868 - RNA, 18 nt, Human
uuguuuggagacagaguc

SEQ ID NO: 1684869 - RNA, 18 nt, Human
uuuaacagaaauguacag

SEQ ID NO: 1684870 - RNA, 19 nt, Human
uuuaacucuauaauguguu

SEQ ID NO: 1684871 - RNA, 18 nt, Human
uuuaagaaaaaggaugca

SEQ ID NO: 1684872 - RNA, 19 nt, Human
uuuaagacauuuuuggaag

SEQ ID NO: 1684873 - RNA, 22 nt, Human
uuuaagaaaaaggaugcacaga

SEQ ID NO: 1684874 - RNA, 20 nt, Human
uuuaagacgaaacauuuguu

SEQ ID NO: 1684875 - RNA, 13 nt, Human
uuuaauaauguuu

SEQ ID NO: 1684876 - RNA, 13 nt, Human
uuggguguauugu

SEQ ID NO: 1684877 - RNA, 15 nt, Human
uuggguguauugugc

SEQ ID NO: 1684878 - RNA, 16 nt, Human
uuggguguauugugcg

SEQ ID NO: 1684879 - RNA, 22 nt, Human
uuggguucaagcgauucuucug

SEQ ID NO: 1684880 - RNA, 13 nt, Human
uuggucuguguga

SEQ ID NO: 1684881 - RNA, 16 nt, Human
uuggucugugagaugc

SEQ ID NO: 1684882 - RNA, 18 nt, Human
uuguacauaaugcgugca

SEQ ID NO: 1684883 - RNA, 23 nt, Human
uuguaaauuaacuuuuauaaacu

SEQ ID NO: 1684884 - RNA, 18 nt, Human
uuguaaauuaacuuuuau

SEQ ID NO: 1684885 - RNA, 16 nt, Human
uuguaaauuaacuuuu

SEQ ID NO: 1684886 - RNA, 15 nt, Human
uuguaaauuaacuuu

SEQ ID NO: 1684887 - RNA, 16 nt, Human
uuguaaaugugguaaa

SEQ ID NO: 1684888 - RNA, 21 nt, Human
uuguaaaugugguaaagaguu

SEQ ID NO: 1684889 - RNA, 17 nt, Human
uuguaaauagcucaggu

SEQ ID NO: 1684890 - RNA, 14 nt, Human
uugugaaaugaugg

SEQ ID NO: 1684891 - RNA, 13 nt, Human
uugugaaauuauu

SEQ ID NO: 1684892 - RNA, 12 nt, Human
uugugauuuuug

SEQ ID NO: 1684893 - RNA, 17 nt, Human
uugugauuuuuguaauu

SEQ ID NO: 1684894 - RNA, 16 nt, Human
uugugauuuuuguaau

SEQ ID NO: 1684895 - RNA, 20 nt, Human
uugugaaaggaaagaggcuc

SEQ ID NO: 1684896 - RNA, 22 nt, Human
uugucuuaaaaaguggaaaaau

SEQ ID NO: 1684897 - RNA, 22 nt, Human
uugucucagauuuuauuaugua

SEQ ID NO: 1684898 - RNA, 20 nt, Human
uugucugaagucacugcaca

SEQ ID NO: 1684899 - RNA, 21 nt, Human
uugucugaagucacugcacag

SEQ ID NO: 1684900 - RNA, 15 nt, Human
uugucuuaaaaagug

SEQ ID NO: 1684901 - RNA, 16 nt, Human
uugucucagauuuuau

SEQ ID NO: 1684902 - RNA, 20 nt, Human
uugucucagauuuuauuaug

SEQ ID NO: 1684903 - RNA, 13 nt, Human
uugucucagauuu

SEQ ID NO: 1684904 - RNA, 20 nt, Human
uugucuacaccauuaugugc

SEQ ID NO: 1684905 - RNA, 15 nt, Human
uugucuagugaaacu

SEQ ID NO: 1684906 - RNA, 19 nt, Human
uugucuacaccauuaugug

SEQ ID NO: 1684907 - RNA, 19 nt, Human
uuguauucucuccuguacc

SEQ ID NO: 1684908 - RNA, 16 nt, Human
uuguauucucuccugu

SEQ ID NO: 1684909 - RNA, 15 nt, Human
uuguauucucuccug

SEQ ID NO: 1684910 - RNA, 21 nt, Human
uuguauucagaguugaugguu

SEQ ID NO: 1684911 - RNA, 14 nt, Human
uuguauuacaaauc

SEQ ID NO: 1684912 - RNA, 12 nt, Human
uuguauuaagaa

SEQ ID NO: 1684913 - RNA, 13 nt, Human
uuguauuaagaau

SEQ ID NO: 1684914 - RNA, 18 nt, Human
uuguauuaagaaugaaau

SEQ ID NO: 1684915 - RNA, 15 nt, Human
uuguacucaauuuua

SEQ ID NO: 1684916 - RNA, 14 nt, Human
uuguacucaauuuu

SEQ ID NO: 1684917 - RNA, 14 nt, Human
uuguuacauuuuua

SEQ ID NO: 1684918 - RNA, 17 nt, Human
uuguuagaucuaguuca

SEQ ID NO: 1684919 - RNA, 21 nt, Human
uuguuaguaugaggcauuugu

SEQ ID NO: 1684920 - RNA, 19 nt, Human
uuguuaguaugaggcauuu

SEQ ID NO: 1684921 - RNA, 18 nt, Human
uuguguuuugcaagccag

SEQ ID NO: 1684922 - RNA, 17 nt, Human
uuguuguuuguuuaguc

SEQ ID NO: 1684923 - RNA, 22 nt, Human
uuguuaguaugaggcauuuguu

SEQ ID NO: 1684924 - RNA, 20 nt, Human
uuguuagugugucuuagugu

SEQ ID NO: 1684925 - RNA, 14 nt, Human
uuguuuaaaaucau

SEQ ID NO: 1684926 - RNA, 15 nt, Human
uuguuugagaaauua

SEQ ID NO: 1684927 - RNA, 21 nt, Human
uuguuugagaaauuaaguauc

SEQ ID NO: 1684928 - RNA, 12 nt, Human
uugugcauuugg

SEQ ID NO: 1684929 - RNA, 23 nt, Human
uugugcauuaucuagauacugua

SEQ ID NO: 1684930 - RNA, 22 nt, Human
uugugcauuaucuagauacugu

SEQ ID NO: 1684931 - RNA, 17 nt, Human
uugugcauuaucuagau

SEQ ID NO: 1684932 - RNA, 19 nt, Human
uugugcugggguuaucuga

SEQ ID NO: 1684933 - RNA, 22 nt, Human
uugugcgcuaaacuuuucugau

SEQ ID NO: 1684934 - RNA, 23 nt, Human
uugugcgcuaaacuuuucugaua

SEQ ID NO: 1684935 - RNA, 16 nt, Human
uugugccagaaugcuu

SEQ ID NO: 1684936 - RNA, 21 nt, Human
uugugccagaaugcuuuagga

SEQ ID NO: 1684937 - RNA, 12 nt, Human
uugugccccugc

SEQ ID NO: 1684938 - RNA, 17 nt, Human
uuguggacacagcucuu

SEQ ID NO: 1684939 - RNA, 21 nt, Human
uuguggaaaaugaaaauuagg

SEQ ID NO: 1684940 - RNA, 16 nt, Human
uuguggacacagcucu

SEQ ID NO: 1684941 - RNA, 21 nt, Human
uuguggauuuaacagaaaugu

SEQ ID NO: 1684942 - RNA, 20 nt, Human
uuguggauuuaacagaaaug

SEQ ID NO: 1684943 - RNA, 23 nt, Human
uuguggauuuaacagaaauguac

SEQ ID NO: 1684944 - RNA, 22 nt, Human
uuguggauuuaacagaaaugua

SEQ ID NO: 1684945 - RNA, 21 nt, Human
uuguguuuauauauaagccaa

SEQ ID NO: 1684946 - RNA, 20 nt, Human
uuguguugaagagguuuuaa

SEQ ID NO: 1684947 - RNA, 13 nt, Human
uuuuuuuugacaa

SEQ ID NO: 1684948 - RNA, 12 nt, Human
uuuuuuuuaaga

SEQ ID NO: 1684949 - RNA, 13 nt, Human
uuuuuuccacuua

SEQ ID NO: 1684950 - RNA, 11 nt, Human
uuuuuuuacua

SEQ ID NO: 1684951 - RNA, 13 nt, Human
uuuuuaaucuuua

SEQ ID NO: 1684952 - RNA, 13 nt, Human
uuuuucauuauuu

SEQ ID NO: 1684953 - RNA, 22 nt, Human
uuuuucauuauuuuauuaugaa

SEQ ID NO: 1684954 - RNA, 21 nt, Human
uuuuuccacauaaggaaacug

SEQ ID NO: 1684955 - RNA, 23 nt, Human
uuuuuaagugcugcauuuaaaag

SEQ ID NO: 1684956 - RNA, 22 nt, Human
uuuuuaagugcugcauuuaaaa

SEQ ID NO: 1684957 - RNA, 19 nt, Human
uuuuuaagugcugcauuua

SEQ ID NO: 1684958 - RNA, 18 nt, Human
uuuuuaagugcugcauuu

SEQ ID NO: 1684959 - RNA, 17 nt, Human
uuuuuaagugcugcauu

SEQ ID NO: 1684960 - RNA, 16 nt, Human
uuuuuaagugcugcau

SEQ ID NO: 1684961 - RNA, 23 nt, Human
uuuuuaagaaaaaggaugcacag

SEQ ID NO: 1684962 - RNA, 12 nt, Human
uuuuuaagaaaa

SEQ ID NO: 1684963 - RNA, 20 nt, Human
uuuuaaacccuauugguaaa

SEQ ID NO: 1684964 - RNA, 23 nt, Human
uuuuaaaauccacuuuaucuuga

SEQ ID NO: 1684965 - RNA, 14 nt, Human
uuuuaaaauccacu

SEQ ID NO: 1684966 - RNA, 16 nt, Human
uuuguugucagcugaa

SEQ ID NO: 1684967 - RNA, 15 nt, Human
uuuguugucagcuga

SEQ ID NO: 1684968 - RNA, 22 nt, Human
uuuguuaguaugaggcauuugu

SEQ ID NO: 1684969 - RNA, 14 nt, Human
uuuguauuuuuagu

SEQ ID NO: 1684970 - RNA, 24 nt, Human
uuuggaccaaaaaccaguauugua

SEQ ID NO: 1684971 - RNA, 15 nt, Human
uuuggucaacacuaa

SEQ ID NO: 1684972 - RNA, 18 nt, Human
uuuguauaaaauaauuuu

SEQ ID NO: 1684973 - RNA, 19 nt, Human
uuuguauaaaauaauuuuu

SEQ ID NO: 1684974 - RNA, 17 nt, Human
uuuggucuacacugugc

SEQ ID NO: 1684975 - RNA, 17 nt, Human
uuuguauaaaauaauuu

SEQ ID NO: 1684976 - RNA, 18 nt, Human
uuugcauaacguauaaaa

SEQ ID NO: 1684977 - RNA, 15 nt, Human
uuuggaaaucuuuaa

SEQ ID NO: 1684978 - RNA, 18 nt, Human
uuuggaccaaaaaccagu

SEQ ID NO: 1684979 - RNA, 21 nt, Human
uuuggaccaaaaaccaguauu

SEQ ID NO: 1684980 - RNA, 22 nt, Human
uuuggaccaaaaaccaguauug

SEQ ID NO: 1684981 - RNA, 13 nt, Human
uuuggacccugag

SEQ ID NO: 1684982 - RNA, 12 nt, Human
uuuggaaaauaa

SEQ ID NO: 1684983 - RNA, 17 nt, Human
uuuccguuaaaauacca

SEQ ID NO: 1684984 - RNA, 15 nt, Human
uuuccguuaaaauac

SEQ ID NO: 1684985 - RNA, 15 nt, Human
uuuccacagaagcuc

SEQ ID NO: 1684986 - RNA, 23 nt, Human
uuuccacauaaggaaacuggguu

SEQ ID NO: 1684987 - RNA, 20 nt, Human
uuuccacauaaggaaacugg

SEQ ID NO: 1684988 - RNA, 21 nt, Human
uuugagugccuuacacaaugg

SEQ ID NO: 1684989 - RNA, 17 nt, Human
uuuucaaaauaaaaaug

SEQ ID NO: 1684990 - RNA, 18 nt, Human
uuuuauuuuuagacagag

SEQ ID NO: 1684991 - RNA, 20 nt, Human
uuuuaugacuucauuaauaa

SEQ ID NO: 1684992 - RNA, 21 nt, Human
uuuuaugacuucauuaauaau

SEQ ID NO: 1684993 - RNA, 21 nt, Human
uuuuauacauaaacaagacca

SEQ ID NO: 1684994 - RNA, 13 nt, Human
uuuuauacauaaa

SEQ ID NO: 1684995 - RNA, 13 nt, Human
uuuuauauuuacu

SEQ ID NO: 1684996 - RNA, 13 nt, Human
uuuuauauuugaa

SEQ ID NO: 1684997 - RNA, 18 nt, Human
uuuuauauuugaaauauu

SEQ ID NO: 1684998 - RNA, 19 nt, Human
uuuuacaaaaaagaaaaga

SEQ ID NO: 1684999 - RNA, 17 nt, Human
uuuuacaauaaaaucuu

SEQ ID NO: 1685000 - RNA, 21 nt, Human
uuuuaaaguaacccuacaaaa

SEQ ID NO: 1685001 - RNA, 19 nt, Human
uuuuacguccaucucuugu

SEQ ID NO: 1685002 - RNA, 23 nt, Human
uuuuauaauuuugugaagcaaaa

SEQ ID NO: 1685003 - RNA, 15 nt, Human
uuuuacuaauagaca

SEQ ID NO: 1685004 - RNA, 21 nt, Human
uuuuauaauuuugugaagcaa

SEQ ID NO: 1685005 - RNA, 16 nt, Human
uuuucuuucagccaag

SEQ ID NO: 1685006 - RNA, 22 nt, Human
uuuucuuguguguuuauuguca

SEQ ID NO: 1685007 - RNA, 13 nt, Human
uuuucuucucccu

SEQ ID NO: 1685008 - RNA, 13 nt, Human
uuuucuacucgag

SEQ ID NO: 1685009 - RNA, 20 nt, Human
uuuucuacucgaguuacaga

SEQ ID NO: 1685010 - RNA, 22 nt, Human
uuuucuacucgaguuacagaca

SEQ ID NO: 1685011 - RNA, 23 nt, Human
uuuucuacucgaguuacagacaa

SEQ ID NO: 1685012 - RNA, 13 nt, Human
uuuucuuauuuca

SEQ ID NO: 1685013 - RNA, 18 nt, Human
uuuucccuauuagagaag

SEQ ID NO: 1685014 - RNA, 22 nt, Human
uuuucccuauuagagaagagau

SEQ ID NO: 1685015 - RNA, 21 nt, Human
uuuucaaaauuguuacaaauu

SEQ ID NO: 1685016 - RNA, 16 nt, Human
uuuucacauuggaaac

SEQ ID NO: 1685017 - RNA, 13 nt, Human
ugccucuuccucc

SEQ ID NO: 1685018 - RNA, 21 nt, Human
ugccucuucucuacucuaggg

SEQ ID NO: 1685019 - RNA, 13 nt, Human
ugccugcccaggc

SEQ ID NO: 1685020 - RNA, 17 nt, Human
ugccugguggcagcugc

SEQ ID NO: 1685021 - RNA, 18 nt, Human
ugccugguggcagcugcg

SEQ ID NO: 1685022 - RNA, 19 nt, Human
ugccugguggcagcugcgg

SEQ ID NO: 1685023 - RNA, 14 nt, Human
ugccuaaggacuuc

SEQ ID NO: 1685024 - RNA, 15 nt, Human
ugccuaaggacuucu

SEQ ID NO: 1685025 - RNA, 16 nt, Human
ugccuaaggacuucuu

SEQ ID NO: 1685026 - RNA, 20 nt, Human
ugccuaaggacuucuuuaau

SEQ ID NO: 1685027 - RNA, 12 nt, Human
ugccuaaggacu

SEQ ID NO: 1685028 - RNA, 13 nt, Human
ugccuaaggacuu

SEQ ID NO: 1685029 - RNA, 21 nt, Human
ugccuaaggacuucuuuaauu

SEQ ID NO: 1685030 - RNA, 22 nt, Human
ugccuccuuugugaggaagccg

SEQ ID NO: 1685031 - RNA, 21 nt, Human
ugccuccuuugugaggaagcc

SEQ ID NO: 1685032 - RNA, 20 nt, Human
ugccuccuuugugaggaagc

SEQ ID NO: 1685033 - RNA, 13 nt, Human
ugccucugccugu

SEQ ID NO: 1685034 - RNA, 14 nt, Human
ugccucugccuguc

SEQ ID NO: 1685035 - RNA, 18 nt, Human
ugccucugccugucuccc

SEQ ID NO: 1685036 - RNA, 14 nt, Human
ugccucugggacug

SEQ ID NO: 1685037 - RNA, 13 nt, Human
ugccucugggacu

SEQ ID NO: 1685038 - RNA, 19 nt, Human
ugcccugcgggucacagga

SEQ ID NO: 1685039 - RNA, 18 nt, Human
ugcccugcugagucccag

SEQ ID NO: 1685040 - RNA, 22 nt, Human
ugcccugcugagucccaggcug

SEQ ID NO: 1685041 - RNA, 23 nt, Human
ugcccugcugagucccaggcuga

SEQ ID NO: 1685042 - RNA, 19 nt, Human
ugcccuaaaguguauuuuu

SEQ ID NO: 1685043 - RNA, 17 nt, Human
ugcccuaaaguguauuu

SEQ ID NO: 1685044 - RNA, 22 nt, Human
ugcccugcccaccuggccucug

SEQ ID NO: 1685045 - RNA, 23 nt, Human
ugcccugcccaccuggccucugc

SEQ ID NO: 1685046 - RNA, 21 nt, Human
ugcccuggugcugccacacuu

SEQ ID NO: 1685047 - RNA, 20 nt, Human
ugcccuggugcugccacacu

SEQ ID NO: 1685048 - RNA, 18 nt, Human
ugcccuggugcugccaca

SEQ ID NO: 1685049 - RNA, 12 nt, Human
ugcccugcuuuc

SEQ ID NO: 1685050 - RNA, 16 nt, Human
ugcccugcuuucagau

SEQ ID NO: 1685051 - RNA, 17 nt, Human
ugcccugcuuucagaua

SEQ ID NO: 1685052 - RNA, 18 nt, Human
ugcccuggauccaucagg

SEQ ID NO: 1685053 - RNA, 15 nt, Human
ugcccugguuuccug

SEQ ID NO: 1685054 - RNA, 15 nt, Human
ugccgucuaccugag

SEQ ID NO: 1685055 - RNA, 16 nt, Human
ugccgucuaccugagg

SEQ ID NO: 1685056 - RNA, 17 nt, Human
ugccgucuaccugaggg

SEQ ID NO: 1685057 - RNA, 19 nt, Human
ugccgucuaccugaggggc

SEQ ID NO: 1685058 - RNA, 14 nt, Human
ugccaugugccagg

SEQ ID NO: 1685059 - RNA, 15 nt, Human
ugccaugugccaggu

SEQ ID NO: 1685060 - RNA, 23 nt, Human
ugccaugaggaacaaggcaaggc

SEQ ID NO: 1685061 - RNA, 20 nt, Human
ugccaugaggaacaaggcaa

SEQ ID NO: 1685062 - RNA, 18 nt, Human
ugcccacgcuggagugca

SEQ ID NO: 1685063 - RNA, 13 nt, Human
ugcccacucccug

SEQ ID NO: 1685064 - RNA, 12 nt, Human
ugccauguuggc

SEQ ID NO: 1685065 - RNA, 15 nt, Human
ugccauguuggccag

SEQ ID NO: 1685066 - RNA, 16 nt, Human
ugccauguuggccagg

SEQ ID NO: 1685067 - RNA, 20 nt, Human
ugcccaccuggccucugcac

SEQ ID NO: 1685068 - RNA, 12 nt, Human
ugccaggaagcc

SEQ ID NO: 1685069 - RNA, 16 nt, Human
ugccaggaagccagca

SEQ ID NO: 1685070 - RNA, 18 nt, Human
ugccaggaagccagcagg

SEQ ID NO: 1685071 - RNA, 19 nt, Human
ugccaggaagccagcaggc

SEQ ID NO: 1685072 - RNA, 17 nt, Human
ugccagguuuuuggucu

SEQ ID NO: 1685073 - RNA, 15 nt, Human
ugccauccagguuca

SEQ ID NO: 1685074 - RNA, 20 nt, Human
ugccauccagguucagcuug

SEQ ID NO: 1685075 - RNA, 12 nt, Human
ugccauccaggu

SEQ ID NO: 1685076 - RNA, 15 nt, Human
ugcauccuccgccuc

SEQ ID NO: 1685077 - RNA, 15 nt, Human
ugcauguuugugauu

SEQ ID NO: 1685078 - RNA, 14 nt, Human
ugcauccuccgccu

SEQ ID NO: 1685079 - RNA, 19 nt, Human
ugcagauaaacaguaguga

SEQ ID NO: 1685080 - RNA, 15 nt, Human
ugccaccacgcccgg

SEQ ID NO: 1685081 - RNA, 18 nt, Human
ugcauuaucuagauacug

SEQ ID NO: 1685082 - RNA, 17 nt, Human
ugcauuaucuagauacu

SEQ ID NO: 1685083 - RNA, 12 nt, Human
ugcauuaucuag

SEQ ID NO: 1685084 - RNA, 14 nt, Human
ugcauuauauuuau

SEQ ID NO: 1685085 - RNA, 16 nt, Human
ugauuuuuuuuuuuca

SEQ ID NO: 1685086 - RNA, 22 nt, Human
ugauuuuuuuuuccuucagugc

SEQ ID NO: 1685087 - RNA, 23 nt, Human
ugauuuuuuuuuccuucagugcc

SEQ ID NO: 1685088 - RNA, 16 nt, Human
ugauuuuuuuuuccuu

SEQ ID NO: 1685089 - RNA, 17 nt, Human
ugauuuuuuuuuccuuc

SEQ ID NO: 1685090 - RNA, 19 nt, Human
ugauuuuuuuuuccuucag

SEQ ID NO: 1685091 - RNA, 20 nt, Human
ugauuuuuuuuuccuucagu

SEQ ID NO: 1685092 - RNA, 15 nt, Human
ugauuuucauugcug

SEQ ID NO: 1685093 - RNA, 13 nt, Human
ugauuuucauugc

SEQ ID NO: 1685094 - RNA, 16 nt, Human
ugcaacuuguaaaugu

SEQ ID NO: 1685095 - RNA, 18 nt, Human
ugcaacuuguaaaugugg

SEQ ID NO: 1685096 - RNA, 18 nt, Human
ugcaacuuuguauaaaag

SEQ ID NO: 1685097 - RNA, 22 nt, Human
ugcaacucugaaggguaauuau

SEQ ID NO: 1685098 - RNA, 18 nt, Human
ugcaaccuucgccaccug

SEQ ID NO: 1685099 - RNA, 21 nt, Human
ugcaaccuucgccaccugggu

SEQ ID NO: 1685100 - RNA, 22 nt, Human
ugcaaccugauugugucucuug

SEQ ID NO: 1685101 - RNA, 19 nt, Human
ugcaaccugauugugucuc

SEQ ID NO: 1685102 - RNA, 20 nt, Human
ugcaaccugauugugucucu

SEQ ID NO: 1685103 - RNA, 18 nt, Human
ugcaaccuccgccucuug

SEQ ID NO: 1685104 - RNA, 20 nt, Human
ugcaaccuccgccucuuggg

SEQ ID NO: 1685105 - RNA, 21 nt, Human
ugcaaccuccgccucuugggu

SEQ ID NO: 1685106 - RNA, 13 nt, Human
ugcaaccuccgcc

SEQ ID NO: 1685107 - RNA, 14 nt, Human
ugcaaccuccgccu

SEQ ID NO: 1685108 - RNA, 19 nt, Human
ugcaacaggcugggcuuca

SEQ ID NO: 1685109 - RNA, 20 nt, Human
ugcaacaggcugggcuucag

SEQ ID NO: 1685110 - RNA, 14 nt, Human
ugcaacaggcuggg

SEQ ID NO: 1685111 - RNA, 15 nt, Human
ugcaacaggcugggc

SEQ ID NO: 1685112 - RNA, 16 nt, Human
ugcaacaggcugggcu

SEQ ID NO: 1685113 - RNA, 17 nt, Human
ugcaacaggcugggcuu

SEQ ID NO: 1685114 - RNA, 15 nt, Human
ugcacagugcaucuc

SEQ ID NO: 1685115 - RNA, 20 nt, Human
ugcacagaguuguuacauuu

SEQ ID NO: 1685116 - RNA, 16 nt, Human
ugcacagugcaucuca

SEQ ID NO: 1685117 - RNA, 17 nt, Human
ugcacagugcaucucag

SEQ ID NO: 1685118 - RNA, 18 nt, Human
ugcaccggcuggccuggc

SEQ ID NO: 1685119 - RNA, 19 nt, Human
ugcaccggcuggccuggcc

SEQ ID NO: 1685120 - RNA, 20 nt, Human
ugcaccggcuggccuggccc

SEQ ID NO: 1685121 - RNA, 22 nt, Human
ugcaccuggaauauauaaccag

SEQ ID NO: 1685122 - RNA, 20 nt, Human
ugcaccuggaauauauaacc

SEQ ID NO: 1685123 - RNA, 17 nt, Human
ugcaccuggaauauaua

SEQ ID NO: 1685124 - RNA, 21 nt, Human
ugcaccggcuggccuggcccc

SEQ ID NO: 1685125 - RNA, 18 nt, Human
ugcacugacauuguuggc

SEQ ID NO: 1685126 - RNA, 21 nt, Human
ugcacugacauuguuggccaa

SEQ ID NO: 1685127 - RNA, 16 nt, Human
ugcacugucaagauga

SEQ ID NO: 1685128 - RNA, 19 nt, Human
ugcagagguccacaacaca

SEQ ID NO: 1685129 - RNA, 16 nt, Human
ugcacuugcagacucu

SEQ ID NO: 1685130 - RNA, 13 nt, Human
ugcaauggcagcc

SEQ ID NO: 1685131 - RNA, 14 nt, Human
ugcaauggcagccu

SEQ ID NO: 1685132 - RNA, 15 nt, Human
ugcaauggcagccuu

SEQ ID NO: 1685133 - RNA, 16 nt, Human
ugcaauggcagccuug

SEQ ID NO: 1685134 - RNA, 13 nt, Human
ugcaaugaccuuu

SEQ ID NO: 1685135 - RNA, 16 nt, Human
ugcaaugaccuuucaa

SEQ ID NO: 1685136 - RNA, 15 nt, Human
ugcaaugaagucucu

SEQ ID NO: 1685137 - RNA, 18 nt, Human
ugcaaugaagucucugaa

SEQ ID NO: 1685138 - RNA, 22 nt, Human
ugcaaugaagucucugaaguga

SEQ ID NO: 1685139 - RNA, 17 nt, Human
ugcaaugaccuuucaau

SEQ ID NO: 1685140 - RNA, 19 nt, Human
ugcaaugaccuuucaauag

SEQ ID NO: 1685141 - RNA, 22 nt, Human
ugcaaugaccuuucaauaggaa

SEQ ID NO: 1685142 - RNA, 23 nt, Human
ugcaaugaccuuucaauaggaaa

SEQ ID NO: 1685143 - RNA, 19 nt, Human
ugcacagaguuguuacauu

SEQ ID NO: 1685144 - RNA, 18 nt, Human
ugcacagaguuguuacau

SEQ ID NO: 1685145 - RNA, 15 nt, Human
ugcacaaagcccuuc

SEQ ID NO: 1685146 - RNA, 17 nt, Human
ugcacaaagcccuucca

SEQ ID NO: 1685147 - RNA, 17 nt, Human
ugcacagaguuguuaca

SEQ ID NO: 1685148 - RNA, 20 nt, Human
ugcacaaacagaggccgcca

SEQ ID NO: 1685149 - RNA, 17 nt, Human
ugcacaaacagaggccg

SEQ ID NO: 1685150 - RNA, 19 nt, Human
ugcacaaacagaggccgcc

SEQ ID NO: 1685151 - RNA, 15 nt, Human
ugcacaaacagaggc

SEQ ID NO: 1685152 - RNA, 16 nt, Human
ugcacaaacagaggcc

SEQ ID NO: 1685153 - RNA, 13 nt, Human
ugagccucagcau

SEQ ID NO: 1685154 - RNA, 15 nt, Human
ugagccucagcaucc

SEQ ID NO: 1685155 - RNA, 17 nt, Human
ugagcagucaggaaaga

SEQ ID NO: 1685156 - RNA, 15 nt, Human
ugagcagucaggaaa

SEQ ID NO: 1685157 - RNA, 13 nt, Human
ugagcaucaggcc

SEQ ID NO: 1685158 - RNA, 20 nt, Human
ugagcagucaggaaagagaa

SEQ ID NO: 1685159 - RNA, 14 nt, Human
ugagaugcuagaac

SEQ ID NO: 1685160 - RNA, 16 nt, Human
ugagaugcuagaacuc

SEQ ID NO: 1685161 - RNA, 20 nt, Human
ugagaugcuagaacucccuu

SEQ ID NO: 1685162 - RNA, 16 nt, Human
ugagcaucaggccagg

SEQ ID NO: 1685163 - RNA, 17 nt, Human
ugagcaucacaguuuug

SEQ ID NO: 1685164 - RNA, 14 nt, Human
ugagcaucaggcca

SEQ ID NO: 1685165 - RNA, 15 nt, Human
ugagcaucaggccag

SEQ ID NO: 1685166 - RNA, 13 nt, Human
ugagccccaaaag

SEQ ID NO: 1685167 - RNA, 12 nt, Human
ugagacucuguc

SEQ ID NO: 1685168 - RNA, 13 nt, Human
ugagacucugucu

SEQ ID NO: 1685169 - RNA, 14 nt, Human
ugagacucugucuc

SEQ ID NO: 1685170 - RNA, 23 nt, Human
ugagaggcauccaguaucuugaa

SEQ ID NO: 1685171 - RNA, 22 nt, Human
ugagaggcauccaguaucuuga

SEQ ID NO: 1685172 - RNA, 17 nt, Human
ugagaguagagucacug

SEQ ID NO: 1685173 - RNA, 17 nt, Human
ugagaaaucuaaaaaac

SEQ ID NO: 1685174 - RNA, 13 nt, Human
ugagaaaucuaaa

SEQ ID NO: 1685175 - RNA, 20 nt, Human
ugagaaagacuauucaaaca

SEQ ID NO: 1685176 - RNA, 18 nt, Human
ugagaaagacuauucaaa

SEQ ID NO: 1685177 - RNA, 16 nt, Human
ugacuguacuccuccc

SEQ ID NO: 1685178 - RNA, 17 nt, Human
ugacuguacuccuccca

SEQ ID NO: 1685179 - RNA, 18 nt, Human
ugacuguacuccucccag

SEQ ID NO: 1685180 - RNA, 22 nt, Human
ugacuguacuccucccaggcgc

SEQ ID NO: 1685181 - RNA, 16 nt, Human
ugagaaagacuauuca

SEQ ID NO: 1685182 - RNA, 17 nt, Human
ugagaaagacuauucaa

SEQ ID NO: 1685183 - RNA, 12 nt, Human
ugagacccuguc

SEQ ID NO: 1685184 - RNA, 14 nt, Human
ugagacagcucugc

SEQ ID NO: 1685185 - RNA, 16 nt, Human
ugagacagcucugcau

SEQ ID NO: 1685186 - RNA, 14 nt, Human
ugagaaauuaagua

SEQ ID NO: 1685187 - RNA, 13 nt, Human
ugagaaauuaagu

SEQ ID NO: 1685188 - RNA, 16 nt, Human
ucuugaauaauguaag

SEQ ID NO: 1685189 - RNA, 15 nt, Human
ucuugaacuccuggc

SEQ ID NO: 1685190 - RNA, 17 nt, Human
ucuugaauuguaaggaa

SEQ ID NO: 1685191 - RNA, 20 nt, Human
ugaccauucuccaccugcca

SEQ ID NO: 1685192 - RNA, 21 nt, Human
ugaccauucuccaccugccag

SEQ ID NO: 1685193 - RNA, 22 nt, Human
ugaccauucuccaccugccagg

SEQ ID NO: 1685194 - RNA, 23 nt, Human
ugaccauucuccaccugccaggg

SEQ ID NO: 1685195 - RNA, 16 nt, Human
ugaccucugcagcaau

SEQ ID NO: 1685196 - RNA, 13 nt, Human
ugaccucugcagc

SEQ ID NO: 1685197 - RNA, 16 nt, Human
ugaccucagcuuugau

SEQ ID NO: 1685198 - RNA, 22 nt, Human
ugaccucaggugauccacccac

SEQ ID NO: 1685199 - RNA, 23 nt, Human
ugaccucugcagcaauaaagcag

SEQ ID NO: 1685200 - RNA, 12 nt, Human
ugaccucugccu

SEQ ID NO: 1685201 - RNA, 21 nt, Human
ugaccucugcagcaauaaagc

SEQ ID NO: 1685202 - RNA, 18 nt, Human
ugaccucugcagcaauaa

SEQ ID NO: 1685203 - RNA, 14 nt, Human
ugaccuuucaauag

SEQ ID NO: 1685204 - RNA, 15 nt, Human
ugaccuuucaauagg

SEQ ID NO: 1685205 - RNA, 16 nt, Human
ugaccuuucaauagga

SEQ ID NO: 1685206 - RNA, 18 nt, Human
ugaccuuucaauaggaaa

SEQ ID NO: 1685207 - RNA, 22 nt, Human
ugaccuuucaauaggaaaaacu

SEQ ID NO: 1685208 - RNA, 13 nt, Human
ugacgccauccca

SEQ ID NO: 1685209 - RNA, 14 nt, Human
ugacgccaucccag

SEQ ID NO: 1685210 - RNA, 15 nt, Human
ugacgccaucccagc

SEQ ID NO: 1685211 - RNA, 16 nt, Human
ugacgccaucccagcc

SEQ ID NO: 1685212 - RNA, 17 nt, Human
ugacgccaucccagccc

SEQ ID NO: 1685213 - RNA, 18 nt, Human
ugacgccaucccagcccc

SEQ ID NO: 1685214 - RNA, 19 nt, Human
ugacgccaucccagcccca

SEQ ID NO: 1685215 - RNA, 20 nt, Human
ugacgccaucccagccccaa

SEQ ID NO: 1685216 - RNA, 13 nt, Human
ugacugauucuuc

SEQ ID NO: 1685217 - RNA, 14 nt, Human
ugacugauucuuca

SEQ ID NO: 1685218 - RNA, 15 nt, Human
ugacugauucuucag

SEQ ID NO: 1685219 - RNA, 16 nt, Human
ugacugauucuucagc

SEQ ID NO: 1685220 - RNA, 17 nt, Human
ugacugauucuucagca

SEQ ID NO: 1685221 - RNA, 15 nt, Human
ugacugaauuucuuu

SEQ ID NO: 1685222 - RNA, 14 nt, Human
ugacugaauuucuu

SEQ ID NO: 1685223 - RNA, 13 nt, Human
ugacugaauuucu

SEQ ID NO: 1685224 - RNA, 12 nt, Human
ugacucuuaaga

SEQ ID NO: 1685225 - RNA, 15 nt, Human
ugagucgaggacagg

SEQ ID NO: 1685226 - RNA, 16 nt, Human
ugagucgaggacaggg

SEQ ID NO: 1685227 - RNA, 23 nt, Human
ugaguugauagcacagacccugc

SEQ ID NO: 1685228 - RNA, 16 nt, Human
ugaguugauucagcuc

SEQ ID NO: 1685229 - RNA, 19 nt, Human
ugaguugauucagcucugc

SEQ ID NO: 1685230 - RNA, 18 nt, Human
ugagucgaggacagggag

SEQ ID NO: 1685231 - RNA, 18 nt, Human
ugauagguauaaguggug

SEQ ID NO: 1685232 - RNA, 22 nt, Human
ugauagcacagacccugcccug

SEQ ID NO: 1685233 - RNA, 23 nt, Human
ugauagcacagacccugcccugu

SEQ ID NO: 1685234 - RNA, 15 nt, Human
ugauagcacagaccc

SEQ ID NO: 1685235 - RNA, 16 nt, Human
ugauagcacagacccu

SEQ ID NO: 1685236 - RNA, 17 nt, Human
ugauagcacagacccug

SEQ ID NO: 1685237 - RNA, 18 nt, Human
ugauagcacagacccugc

SEQ ID NO: 1685238 - RNA, 20 nt, Human
ugauagcacagacccugccc

SEQ ID NO: 1685239 - RNA, 21 nt, Human
ugauagcacagacccugcccu

SEQ ID NO: 1685240 - RNA, 23 nt, Human
ugaggacuuaaaauauuccugca

SEQ ID NO: 1685241 - RNA, 11 nt, Human
ugaggcugggc

SEQ ID NO: 1685242 - RNA, 15 nt, Human
ugaggucuguucuuu

SEQ ID NO: 1685243 - RNA, 14 nt, Human
ugaggucuguucuu

SEQ ID NO: 1685244 - RNA, 20 nt, Human
ugaggucuguucuuuccaaa

SEQ ID NO: 1685245 - RNA, 14 nt, Human
ugagucgaggacag

SEQ ID NO: 1685246 - RNA, 19 nt, Human
ugaguccuggcaugggaau

SEQ ID NO: 1685247 - RNA, 22 nt, Human
ugaguccuggcaugggaaugaa

SEQ ID NO: 1685248 - RNA, 11 nt, Human
ugaguccuggc

SEQ ID NO: 1685249 - RNA, 18 nt, Human
ugaguccuggcaugggaa

SEQ ID NO: 1685250 - RNA, 19 nt, Human
ugagguuucaaaccucccu

SEQ ID NO: 1685251 - RNA, 21 nt, Human
ugaguccccuguuuguuucug

SEQ ID NO: 1685252 - RNA, 16 nt, Human
ugaggugcuauguucu

SEQ ID NO: 1685253 - RNA, 15 nt, Human
ugaggugcuauguuc

SEQ ID NO: 1685254 - RNA, 20 nt, Human
ugaucugaugcaagcaagaa

SEQ ID NO: 1685255 - RNA, 21 nt, Human
ugauccacccaccucagccuc

SEQ ID NO: 1685256 - RNA, 22 nt, Human
ugauccacccaccucagccucc

SEQ ID NO: 1685257 - RNA, 19 nt, Human
ugaucuaggaagacuuugg

SEQ ID NO: 1685258 - RNA, 21 nt, Human
ugaucuaggaagacuuuggaa

SEQ ID NO: 1685259 - RNA, 13 nt, Human
ugaucauccacug

SEQ ID NO: 1685260 - RNA, 24 nt, Human
ugaucauccacugugccaugugcc

SEQ ID NO: 1685261 - RNA, 21 nt, Human
ugauccaagcuggucccacuc

SEQ ID NO: 1685262 - RNA, 15 nt, Human
ugauccacccaccuc

SEQ ID NO: 1685263 - RNA, 16 nt, Human
ugauccacccaccuca

SEQ ID NO: 1685264 - RNA, 20 nt, Human
ugauccacccaccucagccu

SEQ ID NO: 1685265 - RNA, 22 nt, Human
ugaucacggcucacugcagccu

SEQ ID NO: 1685266 - RNA, 17 nt, Human
ugauauaaguguguguu

SEQ ID NO: 1685267 - RNA, 23 nt, Human
ugauauaaguguguguuuuucau

SEQ ID NO: 1685268 - RNA, 24 nt, Human
ugauaguuguaccgcaaugugacu

SEQ ID NO: 1685269 - RNA, 22 nt, Human
ugaugaucuuugcagacaggca

SEQ ID NO: 1685270 - RNA, 23 nt, Human
ugaugaucuuugcagacaggcaa

SEQ ID NO: 1685271 - RNA, 20 nt, Human
ugaugaugaaaugaggucag

SEQ ID NO: 1685272 - RNA, 14 nt, Human
ugaugccaugagga

SEQ ID NO: 1685273 - RNA, 19 nt, Human
ugaugccaaguuguuugag

SEQ ID NO: 1685274 - RNA, 15 nt, Human
ugaugccaaguuguu

SEQ ID NO: 1685275 - RNA, 21 nt, Human
ugaugccaaguuguuugagaa

SEQ ID NO: 1685276 - RNA, 21 nt, Human
ugaucuuugcagacaggcaag

SEQ ID NO: 1685277 - RNA, 23 nt, Human
ugaucuuugcagacaggcaagca

SEQ ID NO: 1685278 - RNA, 21 nt, Human
ugaucugaugcaagcaagaaa

SEQ ID NO: 1685279 - RNA, 19 nt, Human
ugaucuuugcagacaggca

SEQ ID NO: 1685280 - RNA, 20 nt, Human
ugaucuuugcagacaggcaa

SEQ ID NO: 1685281 - RNA, 19 nt, Human
ugaugcuucuucagagacu

SEQ ID NO: 1685282 - RNA, 21 nt, Human
ugaugcuucuucagagacucc

SEQ ID NO: 1685283 - RNA, 22 nt, Human
ugaugcuucuucagagacuccu

SEQ ID NO: 1685284 - RNA, 13 nt, Human
ugauguacaugua

SEQ ID NO: 1685285 - RNA, 23 nt, Human
ugaugcuucuucagagacuccug

SEQ ID NO: 1685286 - RNA, 23 nt, Human
ugggguuaucugaagucagaucu

SEQ ID NO: 1685287 - RNA, 19 nt, Human
uggggggcugaggugggag

SEQ ID NO: 1685288 - RNA, 17 nt, Human
uggggccaggcuggguc

SEQ ID NO: 1685289 - RNA, 16 nt, Human
ugggggccucagugcc

SEQ ID NO: 1685290 - RNA, 22 nt, Human
ugggcuucauccuccucagauc

SEQ ID NO: 1685291 - RNA, 15 nt, Human
ugggcuucauccucc

SEQ ID NO: 1685292 - RNA, 22 nt, Human
ugggcuucaguggcagcugcuu

SEQ ID NO: 1685293 - RNA, 21 nt, Human
ugggcuucaguggcagcugcu

SEQ ID NO: 1685294 - RNA, 13 nt, Human
uggggcagcuuga

SEQ ID NO: 1685295 - RNA, 23 nt, Human
ugggcuuggggaccagagcugcc

SEQ ID NO: 1685296 - RNA, 17 nt, Human
ugggcuugucuguagau

SEQ ID NO: 1685297 - RNA, 21 nt, Human
ugggcuugucuguagauuuua

SEQ ID NO: 1685298 - RNA, 18 nt, Human
ugggcagagcagagacca

SEQ ID NO: 1685299 - RNA, 14 nt, Human
ugggcagagcagag

SEQ ID NO: 1685300 - RNA, 15 nt, Human
ugggcagagcagaga

SEQ ID NO: 1685301 - RNA, 17 nt, Human
ugggcagagcagagacc

SEQ ID NO: 1685302 - RNA, 23 nt, Human
ugggcagcugccuccccuccucu

SEQ ID NO: 1685303 - RNA, 22 nt, Human
ugggcagcugccuccccuccuc

SEQ ID NO: 1685304 - RNA, 20 nt, Human
ugggcagcugccuccccucc

SEQ ID NO: 1685305 - RNA, 12 nt, Human
ugggcagcugcc

SEQ ID NO: 1685306 - RNA, 13 nt, Human
ugggauaaaugcc

SEQ ID NO: 1685307 - RNA, 14 nt, Human
ugggauaaaugcca

SEQ ID NO: 1685308 - RNA, 12 nt, Human
ugggauaaaugc

SEQ ID NO: 1685309 - RNA, 18 nt, Human
ugggaggaucucuugagc

SEQ ID NO: 1685310 - RNA, 18 nt, Human
ugggaugauuggaggggg

SEQ ID NO: 1685311 - RNA, 16 nt, Human
ugggaaugaaugucag

SEQ ID NO: 1685312 - RNA, 21 nt, Human
ugggaaugaaugucaguguga

SEQ ID NO: 1685313 - RNA, 14 nt, Human
ugggacacccugug

SEQ ID NO: 1685314 - RNA, 15 nt, Human
ugggacacccuguga

SEQ ID NO: 1685315 - RNA, 16 nt, Human
ugggaggaucucuuga

SEQ ID NO: 1685316 - RNA, 14 nt, Human
ugggacagggagga

SEQ ID NO: 1685317 - RNA, 20 nt, Human
uggccuagcauacguacaca

SEQ ID NO: 1685318 - RNA, 14 nt, Human
uggccccugcccgg

SEQ ID NO: 1685319 - RNA, 21 nt, Human
uggccccucagggucccuggu

SEQ ID NO: 1685320 - RNA, 22 nt, Human
uggccccucagggucccuggug

SEQ ID NO: 1685321 - RNA, 17 nt, Human
uggcagcugcgguccac

SEQ ID NO: 1685322 - RNA, 19 nt, Human
uggcagcugcgguccaccc

SEQ ID NO: 1685323 - RNA, 13 nt, Human
uggccccucaggg

SEQ ID NO: 1685324 - RNA, 20 nt, Human
uggccccucagggucccugg

SEQ ID NO: 1685325 - RNA, 23 nt, Human
uggccuagcauacguacacauuu

SEQ ID NO: 1685326 - RNA, 18 nt, Human
uggccucaagugauucuc

SEQ ID NO: 1685327 - RNA, 23 nt, Human
uggccucaagugauucuccugcc

SEQ ID NO: 1685328 - RNA, 11 nt, Human
uggccucccaa

SEQ ID NO: 1685329 - RNA, 14 nt, Human
uggccucccaacuc

SEQ ID NO: 1685330 - RNA, 19 nt, Human
uggccucccaacucacccc

SEQ ID NO: 1685331 - RNA, 20 nt, Human
uggccucccaacucacccca

SEQ ID NO: 1685332 - RNA, 21 nt, Human
uggccucccaacucaccccag

SEQ ID NO: 1685333 - RNA, 22 nt, Human
uggccucccaacucaccccagc

SEQ ID NO: 1685334 - RNA, 16 nt, Human
uggcuuuucacugcug

SEQ ID NO: 1685335 - RNA, 18 nt, Human
uggcuuuucacugcuggc

SEQ ID NO: 1685336 - RNA, 19 nt, Human
uggcuuuucacugcuggcu

SEQ ID NO: 1685337 - RNA, 21 nt, Human
uggcuuuucacugcuggcugc

SEQ ID NO: 1685338 - RNA, 22 nt, Human
uggcuuuucacugcuggcugcc

SEQ ID NO: 1685339 - RNA, 14 nt, Human
ugggaaugaagcaa

SEQ ID NO: 1685340 - RNA, 13 nt, Human
uggcuuuucugau

SEQ ID NO: 1685341 - RNA, 19 nt, Human
uggcuucccgcucagcccu

SEQ ID NO: 1685342 - RNA, 20 nt, Human
uggcuucccgcucagcccuc

SEQ ID NO: 1685343 - RNA, 21 nt, Human
uggcuucccgcucagcccucc

SEQ ID NO: 1685344 - RNA, 22 nt, Human
uggcuucccgcucagcccuccc

SEQ ID NO: 1685345 - RNA, 22 nt, Human
uggcuuccuaaaauucagugga

SEQ ID NO: 1685346 - RNA, 13 nt, Human
uggcugcugaagg

SEQ ID NO: 1685347 - RNA, 14 nt, Human
uggcugcugaaggc

SEQ ID NO: 1685348 - RNA, 16 nt, Human
uggcugcugaaggcuc

SEQ ID NO: 1685349 - RNA, 17 nt, Human
uggcuccagcuggccgg

SEQ ID NO: 1685350 - RNA, 13 nt, Human
uggccucugcacu

SEQ ID NO: 1685351 - RNA, 23 nt, Human
uggccuucggccuccauccugag

SEQ ID NO: 1685352 - RNA, 22 nt, Human
uggccuucggccuccauccuga

SEQ ID NO: 1685353 - RNA, 19 nt, Human
uggaucaaauccagccugc

SEQ ID NO: 1685354 - RNA, 22 nt, Human
uggaugcagccucacaguccuu

SEQ ID NO: 1685355 - RNA, 13 nt, Human
uggaugcagccuc

SEQ ID NO: 1685356 - RNA, 21 nt, Human
uggaugcagccucacaguccu

SEQ ID NO: 1685357 - RNA, 23 nt, Human
uggaggggggaggugggauccuc

SEQ ID NO: 1685358 - RNA, 17 nt, Human
uggauuuaacagaaaug

SEQ ID NO: 1685359 - RNA, 15 nt, Human
uggauuuaacagaaa

SEQ ID NO: 1685360 - RNA, 21 nt, Human
uggcacuauaauguaagcucu

SEQ ID NO: 1685361 - RNA, 19 nt, Human
uggcacugcuuccagugag

SEQ ID NO: 1685362 - RNA, 22 nt, Human
uggcacuauaauguaagcucua

SEQ ID NO: 1685363 - RNA, 22 nt, Human
uggcacugcuuccagugaggcu

SEQ ID NO: 1685364 - RNA, 19 nt, Human
uggacuaacuugucuuugg

SEQ ID NO: 1685365 - RNA, 20 nt, Human
uggacuaacuugucuuugga

SEQ ID NO: 1685366 - RNA, 17 nt, Human
uggaccaaaaaccagua

SEQ ID NO: 1685367 - RNA, 19 nt, Human
uggacguguuaugacucca

SEQ ID NO: 1685368 - RNA, 23 nt, Human
uggacguguuaugacuccagaau

SEQ ID NO: 1685369 - RNA, 18 nt, Human
uggacaggcauguucucu

SEQ ID NO: 1685370 - RNA, 22 nt, Human
uggacaggcauguucucugagg

SEQ ID NO: 1685371 - RNA, 15 nt, Human
uggaccaaaaaccag

SEQ ID NO: 1685372 - RNA, 23 nt, Human
uggacaggcauguucucugagga

SEQ ID NO: 1685373 - RNA, 19 nt, Human
ugcuuaacuucacauauug

SEQ ID NO: 1685374 - RNA, 18 nt, Human
ugcuuaacuucacauauu

SEQ ID NO: 1685375 - RNA, 17 nt, Human
ugcuuaacuucacauau

SEQ ID NO: 1685376 - RNA, 14 nt, Human
ugcuuaacuucaca

SEQ ID NO: 1685377 - RNA, 13 nt, Human
ugcuuaacuucac

SEQ ID NO: 1685378 - RNA, 22 nt, Human
ugcuuccagugaggcucugccc

SEQ ID NO: 1685379 - RNA, 23 nt, Human
ugcuuccagugaggcucugcccu

SEQ ID NO: 1685380 - RNA, 17 nt, Human
ugcuucuguuuuauaau

SEQ ID NO: 1685381 - RNA, 14 nt, Human
uggaacgcguugaa

SEQ ID NO: 1685382 - RNA, 15 nt, Human
uggaacgcguugaaa

SEQ ID NO: 1685383 - RNA, 16 nt, Human
uggaacgcguugaaau

SEQ ID NO: 1685384 - RNA, 17 nt, Human
uggaacgcguugaaauu

SEQ ID NO: 1685385 - RNA, 15 nt, Human
uggaacacucugaga

SEQ ID NO: 1685386 - RNA, 17 nt, Human
uggaacacucugagacu

SEQ ID NO: 1685387 - RNA, 22 nt, Human
uggaaaaguauguuagugcaaa

SEQ ID NO: 1685388 - RNA, 13 nt, Human
ugcuuuggaaauc

SEQ ID NO: 1685389 - RNA, 17 nt, Human
ugcuuuggaaaacccag

SEQ ID NO: 1685390 - RNA, 16 nt, Human
ugcuuguuaacugagu

SEQ ID NO: 1685391 - RNA, 14 nt, Human
ugcuuguuaacuga

SEQ ID NO: 1685392 - RNA, 13 nt, Human
ugcuucuucagag

SEQ ID NO: 1685393 - RNA, 22 nt, Human
ugcuucuguuuuauaauuuugu

SEQ ID NO: 1685394 - RNA, 18 nt, Human
ugcuugugaaaggaaaga

SEQ ID NO: 1685395 - RNA, 13 nt, Human
uguccccuauccu

SEQ ID NO: 1685396 - RNA, 13 nt, Human
ugucaucucagcu

SEQ ID NO: 1685397 - RNA, 17 nt, Human
uguccccgcacugggcu

SEQ ID NO: 1685398 - RNA, 19 nt, Human
uguccccgcacugggcuug

SEQ ID NO: 1685399 - RNA, 22 nt, Human
uguccugccuaaggcugaacuu

SEQ ID NO: 1685400 - RNA, 12 nt, Human
uguccugggagu

SEQ ID NO: 1685401 - RNA, 19 nt, Human
uguccugggagugagcugg

SEQ ID NO: 1685402 - RNA, 20 nt, Human
uguccugggagugagcuggu

SEQ ID NO: 1685403 - RNA, 14 nt, Human
ugucuaaugaaacc

SEQ ID NO: 1685404 - RNA, 17 nt, Human
ugucuacaccauuaugu

SEQ ID NO: 1685405 - RNA, 17 nt, Human
ugucuacacuaagagag

SEQ ID NO: 1685406 - RNA, 18 nt, Human
ugucuacaccauuaugug

SEQ ID NO: 1685407 - RNA, 22 nt, Human
ugucuacacuaagagagaauga

SEQ ID NO: 1685408 - RNA, 14 nt, Human
ugucuaugggacuc

SEQ ID NO: 1685409 - RNA, 15 nt, Human
ugucuaugggacuca

SEQ ID NO: 1685410 - RNA, 16 nt, Human
ugucuaugggacucaa

SEQ ID NO: 1685411 - RNA, 15 nt, Human
ugucuaguuguuuga

SEQ ID NO: 1685412 - RNA, 23 nt, Human
ugucuaguuguuugauucagaca

SEQ ID NO: 1685413 - RNA, 16 nt, Human
ugucucagauuuuauu

SEQ ID NO: 1685414 - RNA, 20 nt, Human
ugucucagauuuuauuaugu

SEQ ID NO: 1685415 - RNA, 19 nt, Human
ugucucaagagggcacugg

SEQ ID NO: 1685416 - RNA, 22 nt, Human
ugucucagauuuuauuauguaa

SEQ ID NO: 1685417 - RNA, 17 nt, Human
ugucucaagagggcacu

SEQ ID NO: 1685418 - RNA, 18 nt, Human
ugucucaagagggcacug

SEQ ID NO: 1685419 - RNA, 21 nt, Human
ugucucaaaaaaagaaaaaga

SEQ ID NO: 1685420 - RNA, 16 nt, Human
ugucuuuucuugcaug

SEQ ID NO: 1685421 - RNA, 23 nt, Human
ugucuuuggacccugaggcccag

SEQ ID NO: 1685422 - RNA, 12 nt, Human
ugucuuaauuaa

SEQ ID NO: 1685423 - RNA, 15 nt, Human
ugucacaggcagguc

SEQ ID NO: 1685424 - RNA, 16 nt, Human
ugucacaggcaggucc

SEQ ID NO: 1685425 - RNA, 17 nt, Human
ugucacaggcaggucca

SEQ ID NO: 1685426 - RNA, 21 nt, Human
ugucacaggcagguccagggu

SEQ ID NO: 1685427 - RNA, 16 nt, Human
ugucagugugacugau

SEQ ID NO: 1685428 - RNA, 19 nt, Human
ugucagugugacugaucuc

SEQ ID NO: 1685429 - RNA, 15 nt, Human
ugucagugugacuga

SEQ ID NO: 1685430 - RNA, 14 nt, Human
ugucagugugacug

SEQ ID NO: 1685431 - RNA, 13 nt, Human
uguaugcgugugu

SEQ ID NO: 1685432 - RNA, 21 nt, Human
ugucaauuacaggaaguacug

SEQ ID NO: 1685433 - RNA, 13 nt, Human
ugucacacacuuu

SEQ ID NO: 1685434 - RNA, 14 nt, Human
ugucacaggcaggu

SEQ ID NO: 1685435 - RNA, 19 nt, Human
uguauuuuacuaauaaaau

SEQ ID NO: 1685436 - RNA, 15 nt, Human
uguauuuguuugcau

SEQ ID NO: 1685437 - RNA, 18 nt, Human
uguauuuuaaaagaauga

SEQ ID NO: 1685438 - RNA, 19 nt, Human
uguauuuuaaaagaaugau

SEQ ID NO: 1685439 - RNA, 23 nt, Human
uguauagaaccucuuugucuaca

SEQ ID NO: 1685440 - RNA, 15 nt, Human
uguauagauuagaau

SEQ ID NO: 1685441 - RNA, 21 nt, Human
uguauagauuagaauucugua

SEQ ID NO: 1685442 - RNA, 23 nt, Human
uguauagauuagagaguguugaa

SEQ ID NO: 1685443 - RNA, 22 nt, Human
uguaugaaagauggcugugccu

SEQ ID NO: 1685444 - RNA, 13 nt, Human
uguaucugagcag

SEQ ID NO: 1685445 - RNA, 20 nt, Human
uguaguguuggagaagaacu

SEQ ID NO: 1685446 - RNA, 21 nt, Human
uguaguguuggagaagaacug

SEQ ID NO: 1685447 - RNA, 19 nt, Human
uguaguguuggagaagaac

SEQ ID NO: 1685448 - RNA, 14 nt, Human
uguauaaaauaauu

SEQ ID NO: 1685449 - RNA, 18 nt, Human
uguaggaagguuaauguu

SEQ ID NO: 1685450 - RNA, 13 nt, Human
uguauaaaauaau

SEQ ID NO: 1685451 - RNA, 22 nt, Human
uguacagcaaggagauuuacaa

SEQ ID NO: 1685452 - RNA, 13 nt, Human
uguacagagccca

SEQ ID NO: 1685453 - RNA, 12 nt, Human
uguacagagccc

SEQ ID NO: 1685454 - RNA, 23 nt, Human
uguacagcaaggagauuuacaac

SEQ ID NO: 1685455 - RNA, 16 nt, Human
uggugucaccugaaga

SEQ ID NO: 1685456 - RNA, 15 nt, Human
uggugucgggcauga

SEQ ID NO: 1685457 - RNA, 11 nt, Human
ugguuccccug

SEQ ID NO: 1685458 - RNA, 18 nt, Human
ugguuccccuguucacuc

SEQ ID NO: 1685459 - RNA, 19 nt, Human
ugguuccccuguucacucu

SEQ ID NO: 1685460 - RNA, 20 nt, Human
ugguuccccuguucacucua

SEQ ID NO: 1685461 - RNA, 18 nt, Human
uggugucgggcaugacac

SEQ ID NO: 1685462 - RNA, 19 nt, Human
uggugucgggcaugacacg

SEQ ID NO: 1685463 - RNA, 18 nt, Human
ugguugaugaucuuugca

SEQ ID NO: 1685464 - RNA, 19 nt, Human
ugguucuuguauuaagaau

SEQ ID NO: 1685465 - RNA, 14 nt, Human
ugguucuuguauua

SEQ ID NO: 1685466 - RNA, 18 nt, Human
ugguucuuguauuaagaa

SEQ ID NO: 1685467 - RNA, 12 nt, Human
ugguuccucccc

SEQ ID NO: 1685468 - RNA, 18 nt, Human
ugguuccuccccuccucc

SEQ ID NO: 1685469 - RNA, 23 nt, Human
ugguuccuccccuccuccuggac

SEQ ID NO: 1685470 - RNA, 23 nt, Human
ugguuccccuguucacucuacuu

SEQ ID NO: 1685471 - RNA, 16 nt, Human
ugguucccuugaugaa

SEQ ID NO: 1685472 - RNA, 17 nt, Human
ugguucccuugaugaag

SEQ ID NO: 1685473 - RNA, 20 nt, Human
ugguucccuugaugaagaag

SEQ ID NO: 1685474 - RNA, 18 nt, Human
uggugguuucagaaaugu

SEQ ID NO: 1685475 - RNA, 17 nt, Human
uggugguuucagaaaug

SEQ ID NO: 1685476 - RNA, 19 nt, Human
uggugguuuucuguucuuu

SEQ ID NO: 1685477 - RNA, 21 nt, Human
ugguggcccgacagccuggca

SEQ ID NO: 1685478 - RNA, 13 nt, Human
ugguggcuggguu

SEQ ID NO: 1685479 - RNA, 16 nt, Human
uggugggggccucggu

SEQ ID NO: 1685480 - RNA, 18 nt, Human
uggugggggccucggugu

SEQ ID NO: 1685481 - RNA, 19 nt, Human
ugguggcccgacagccugg

SEQ ID NO: 1685482 - RNA, 20 nt, Human
ugguggcagugggagcugcc

SEQ ID NO: 1685483 - RNA, 13 nt, Human
ugguggcaguggg

SEQ ID NO: 1685484 - RNA, 18 nt, Human
ugguggcagugggagcug

SEQ ID NO: 1685485 - RNA, 14 nt, Human
uggugcaaugaccu

SEQ ID NO: 1685486 - RNA, 19 nt, Human
uggugcaaugaccuuucaa

SEQ ID NO: 1685487 - RNA, 20 nt, Human
uggugcaaugaccuuucaau

SEQ ID NO: 1685488 - RNA, 16 nt, Human
uggugacuuuggauaa

SEQ ID NO: 1685489 - RNA, 18 nt, Human
uggugacuuuggauaaua

SEQ ID NO: 1685490 - RNA, 19 nt, Human
uggugacuuuggauaauaa

SEQ ID NO: 1685491 - RNA, 23 nt, Human
uggugacuuuggauaauaaggaa

SEQ ID NO: 1685492 - RNA, 14 nt, Human
uggugagaggcauc

SEQ ID NO: 1685493 - RNA, 20 nt, Human
uggguacuuguggacacagc

SEQ ID NO: 1685494 - RNA, 23 nt, Human
uggguacuuguggacacagcucu

SEQ ID NO: 1685495 - RNA, 14 nt, Human
uggguagacacaca

SEQ ID NO: 1685496 - RNA, 15 nt, Human
uggugacuuuggaua

SEQ ID NO: 1685497 - RNA, 13 nt, Human
ugguugcauccua

SEQ ID NO: 1685498 - RNA, 14 nt, Human
ugguugcuuuaaua

SEQ ID NO: 1685499 - RNA, 18 nt, Human
ugguugcuuuaauaucau

SEQ ID NO: 1685500 - RNA, 20 nt, Human
ugguuguacauauaagugau

SEQ ID NO: 1685501 - RNA, 16 nt, Human
ugguuuucuguucuuu

SEQ ID NO: 1685502 - RNA, 19 nt, Human
ugguuuucuuguguguuua

SEQ ID NO: 1685503 - RNA, 21 nt, Human
ugguuuuuaaaaaacugcuga

SEQ ID NO: 1685504 - RNA, 23 nt, Human
ugguuuuuaaaaaacugcugacu

SEQ ID NO: 1685505 - RNA, 11 nt, Human
uguaaaauggu

SEQ ID NO: 1685506 - RNA, 12 nt, Human
uguaaaauggug

SEQ ID NO: 1685507 - RNA, 11 nt, Human
uguaaugaaaa

SEQ ID NO: 1685508 - RNA, 12 nt, Human
uguaaugaaaac

SEQ ID NO: 1685509 - RNA, 13 nt, Human
uguaaugaaaacc

SEQ ID NO: 1685510 - RNA, 17 nt, Human
uguacaaaguauuaagc

SEQ ID NO: 1685511 - RNA, 18 nt, Human
uguacaaaguauuaagca

SEQ ID NO: 1685512 - RNA, 19 nt, Human
uguacaaaguauuaagcau

SEQ ID NO: 1685513 - RNA, 20 nt, Human
uguacaaaguauuaagcaua

SEQ ID NO: 1685514 - RNA, 15 nt, Human
uguacaaaguauuaa

SEQ ID NO: 1685515 - RNA, 17 nt, Human
uguaaugaaaaccacau

SEQ ID NO: 1685516 - RNA, 21 nt, Human
uguacaaaguauuaagcauau

SEQ ID NO: 1685517 - RNA, 14 nt, Human
uguacagacaacaa

SEQ ID NO: 1685518 - RNA, 11 nt, Human
uguacagagcc

SEQ ID NO: 1685519 - RNA, 14 nt, Human
uguaacaagccacc

SEQ ID NO: 1685520 - RNA, 17 nt, Human
uguaacaagccacccca

SEQ ID NO: 1685521 - RNA, 11 nt, Human
ucccuccuggg

SEQ ID NO: 1685522 - RNA, 19 nt, Human
ucccuccugggaaugaagc

SEQ ID NO: 1685523 - RNA, 16 nt, Human
ucccuaauaaagcugu

SEQ ID NO: 1685524 - RNA, 16 nt, Human
ucccuauuagagaaga

SEQ ID NO: 1685525 - RNA, 15 nt, Human
ucccuaauaaagcug

SEQ ID NO: 1685526 - RNA, 17 nt, Human
uccagguuuaagcuguu

SEQ ID NO: 1685527 - RNA, 18 nt, Human
uccagguuuaagcuguua

SEQ ID NO: 1685528 - RNA, 20 nt, Human
uccccuguuuguuucugaaa

SEQ ID NO: 1685529 - RNA, 21 nt, Human
uccccuguuuguuucugaaag

SEQ ID NO: 1685530 - RNA, 20 nt, Human
ucccugccccucccuucaac

SEQ ID NO: 1685531 - RNA, 13 nt, Human
ucccugcacuugc

SEQ ID NO: 1685532 - RNA, 16 nt, Human
ucccugcaauaaaaug

SEQ ID NO: 1685533 - RNA, 14 nt, Human
ucccugcacuugca

SEQ ID NO: 1685534 - RNA, 14 nt, Human
ucccuucccaccuc

SEQ ID NO: 1685535 - RNA, 13 nt, Human
ucccuucccaccu

SEQ ID NO: 1685536 - RNA, 15 nt, Human
ucccuggccuuucau

SEQ ID NO: 1685537 - RNA, 11 nt, Human
ucccuggccuu

SEQ ID NO: 1685538 - RNA, 15 nt, Human
ucccuugaugaagaa

SEQ ID NO: 1685539 - RNA, 16 nt, Human
ucccuugaugaagaag

SEQ ID NO: 1685540 - RNA, 16 nt, Human
uccuaaucuucugaac

SEQ ID NO: 1685541 - RNA, 13 nt, Human
uccgaccagacac

SEQ ID NO: 1685542 - RNA, 17 nt, Human
uccgaccagacaccuug

SEQ ID NO: 1685543 - RNA, 22 nt, Human
uccuaaugaaugcauaaaaugu

SEQ ID NO: 1685544 - RNA, 15 nt, Human
uccuaauuccacagc

SEQ ID NO: 1685545 - RNA, 16 nt, Human
uccuaauuccacagcu

SEQ ID NO: 1685546 - RNA, 17 nt, Human
uccuaauuccacagcug

SEQ ID NO: 1685547 - RNA, 18 nt, Human
uccuaauuccacagcugc

SEQ ID NO: 1685548 - RNA, 15 nt, Human
uccuacaagacacag

SEQ ID NO: 1685549 - RNA, 18 nt, Human
uccuacccacccuccuuu

SEQ ID NO: 1685550 - RNA, 17 nt, Human
uccucauuagcauuuug

SEQ ID NO: 1685551 - RNA, 21 nt, Human
uccuauauuguuuucagugua

SEQ ID NO: 1685552 - RNA, 18 nt, Human
uccuauauuguuuucagu

SEQ ID NO: 1685553 - RNA, 19 nt, Human
uccuccuuuucacaguucu

SEQ ID NO: 1685554 - RNA, 14 nt, Human
uccucuaggagguc

SEQ ID NO: 1685555 - RNA, 21 nt, Human
uccucuuccugaauuuuauuu

SEQ ID NO: 1685556 - RNA, 16 nt, Human
uccucuguacagagcc

SEQ ID NO: 1685557 - RNA, 17 nt, Human
uccucuguacagagccc

SEQ ID NO: 1685558 - RNA, 18 nt, Human
uccucuguacagagccca

SEQ ID NO: 1685559 - RNA, 19 nt, Human
uccucuguacagagcccac

SEQ ID NO: 1685560 - RNA, 17 nt, Human
uccucuaggaggucucu

SEQ ID NO: 1685561 - RNA, 14 nt, Human
uccucugcugcugg

SEQ ID NO: 1685562 - RNA, 15 nt, Human
uccucugcugcuggc

SEQ ID NO: 1685563 - RNA, 16 nt, Human
uccucugcugcuggcu

SEQ ID NO: 1685564 - RNA, 22 nt, Human
uccucugcuugccaucccuccc

SEQ ID NO: 1685565 - RNA, 21 nt, Human
uccucugcuugccaucccucc

SEQ ID NO: 1685566 - RNA, 17 nt, Human
uccucugcugcuggcug

SEQ ID NO: 1685567 - RNA, 20 nt, Human
uccucugcuugccaucccuc

SEQ ID NO: 1685568 - RNA, 21 nt, Human
uccuucaccuuuguccccacc

SEQ ID NO: 1685569 - RNA, 22 nt, Human
uccuucaccuuuguccccaccg

SEQ ID NO: 1685570 - RNA, 16 nt, Human
uccuuaccagcagagc

SEQ ID NO: 1685571 - RNA, 17 nt, Human
uccuuaccagcagagca

SEQ ID NO: 1685572 - RNA, 18 nt, Human
uccuuaccagcagagcac

SEQ ID NO: 1685573 - RNA, 18 nt, Human
uccuucacagaugggugc

SEQ ID NO: 1685574 - RNA, 19 nt, Human
uccuucacagaugggugcu

SEQ ID NO: 1685575 - RNA, 20 nt, Human
uccuuaccagcagagcaccu

SEQ ID NO: 1685576 - RNA, 18 nt, Human
uccuucaccuuugucccc

SEQ ID NO: 1685577 - RNA, 20 nt, Human
uccuucaccuuuguccccac

SEQ ID NO: 1685578 - RNA, 15 nt, Human
ucgaacuccugaccu

SEQ ID NO: 1685579 - RNA, 13 nt, Human
ucgaacuggcugc

SEQ ID NO: 1685580 - RNA, 18 nt, Human
uccuuuucgcaggauucu

SEQ ID NO: 1685581 - RNA, 19 nt, Human
uccuuuuaaaacacuucca

SEQ ID NO: 1685582 - RNA, 23 nt, Human
uccuuuucacaguucucuccuuc

SEQ ID NO: 1685583 - RNA, 16 nt, Human
uccuuggacucauuuu

SEQ ID NO: 1685584 - RNA, 20 nt, Human
uccuguaccucuugagccuu

SEQ ID NO: 1685585 - RNA, 22 nt, Human
uccuguaccucuugagccuuga

SEQ ID NO: 1685586 - RNA, 18 nt, Human
uccuggcacugcuuccag

SEQ ID NO: 1685587 - RNA, 22 nt, Human
uccuggcacugcuuccagugag

SEQ ID NO: 1685588 - RNA, 20 nt, Human
uccuggcacccggccccugc

SEQ ID NO: 1685589 - RNA, 21 nt, Human
uccuggcacccggccccugcu

SEQ ID NO: 1685590 - RNA, 22 nt, Human
uccuggcacccggccccugcug

SEQ ID NO: 1685591 - RNA, 17 nt, Human
uccuggcacugcuucca

SEQ ID NO: 1685592 - RNA, 17 nt, Human
uccugccucagccuccc

SEQ ID NO: 1685593 - RNA, 16 nt, Human
uccugccucagccucc

SEQ ID NO: 1685594 - RNA, 13 nt, Human
uccugccucagcc

SEQ ID NO: 1685595 - RNA, 15 nt, Human
uccugccucagccuc

SEQ ID NO: 1685596 - RNA, 14 nt, Human
uccuggcacccggc

SEQ ID NO: 1685597 - RNA, 16 nt, Human
uccuggcacccggccc

SEQ ID NO: 1685598 - RNA, 19 nt, Human
uccuggcacccggccccug

SEQ ID NO: 1685599 - RNA, 13 nt, Human
uccugagccagau

SEQ ID NO: 1685600 - RNA, 14 nt, Human
uccugccucagccu

SEQ ID NO: 1685601 - RNA, 14 nt, Human
uccugagccagauu

SEQ ID NO: 1685602 - RNA, 20 nt, Human
uccugccuaagugcagcccc

SEQ ID NO: 1685603 - RNA, 14 nt, Human
ucuaaugugugaau

SEQ ID NO: 1685604 - RNA, 14 nt, Human
ucuaauauguaaca

SEQ ID NO: 1685605 - RNA, 23 nt, Human
ucuaggacugaauuaugaaacuu

SEQ ID NO: 1685606 - RNA, 16 nt, Human
ucuaggacugaauuau

SEQ ID NO: 1685607 - RNA, 22 nt, Human
ucuagugagcagucaggaaaga

SEQ ID NO: 1685608 - RNA, 18 nt, Human
ucuaggaggucucuaaga

SEQ ID NO: 1685609 - RNA, 19 nt, Human
ucuagugagcagucaggaa

SEQ ID NO: 1685610 - RNA, 20 nt, Human
ucuaugcugaguuugugcug

SEQ ID NO: 1685611 - RNA, 16 nt, Human
ucuaugcugaguuugu

SEQ ID NO: 1685612 - RNA, 15 nt, Human
ucucaacuccaaacu

SEQ ID NO: 1685613 - RNA, 17 nt, Human
ucucaaauaacuaaaag

SEQ ID NO: 1685614 - RNA, 15 nt, Human
ucuaucaaguauuau

SEQ ID NO: 1685615 - RNA, 22 nt, Human
ucuaucaaguauuauaccuuuu

SEQ ID NO: 1685616 - RNA, 21 nt, Human
ucuaucaaguauuauaccuuu

SEQ ID NO: 1685617 - RNA, 13 nt, Human
ucuaugaaauauu

SEQ ID NO: 1685618 - RNA, 14 nt, Human
ucuaugaaauauua

SEQ ID NO: 1685619 - RNA, 17 nt, Human
ucuaugaaauauuaugu

SEQ ID NO: 1685620 - RNA, 22 nt, Human
ucuaaaucuccaaaauaaaacu

SEQ ID NO: 1685621 - RNA, 21 nt, Human
ucuaaaucuccaaaauaaaac

SEQ ID NO: 1685622 - RNA, 13 nt, Human
ucguuaauuugua

SEQ ID NO: 1685623 - RNA, 22 nt, Human
ucggccucccaaagugcuggga

SEQ ID NO: 1685624 - RNA, 16 nt, Human
ucgugauugauaagaa

SEQ ID NO: 1685625 - RNA, 18 nt, Human
ucggccuccauccugagg

SEQ ID NO: 1685626 - RNA, 21 nt, Human
ucguggaacaguuaccucugc

SEQ ID NO: 1685627 - RNA, 22 nt, Human
ucgugggacagucaccucaugg

SEQ ID NO: 1685628 - RNA, 15 nt, Human
ucucugcaggucccu

SEQ ID NO: 1685629 - RNA, 16 nt, Human
ucucugcaggucccua

SEQ ID NO: 1685630 - RNA, 18 nt, Human
ucucugcaggucccuaau

SEQ ID NO: 1685631 - RNA, 13 nt, Human
ucucugcaggucc

SEQ ID NO: 1685632 - RNA, 14 nt, Human
ucucugcagguccc

SEQ ID NO: 1685633 - RNA, 15 nt, Human
ucucugauacagaaa

SEQ ID NO: 1685634 - RNA, 17 nt, Human
ucucugaggacacuaac

SEQ ID NO: 1685635 - RNA, 16 nt, Human
ucucugaagugaaacu

SEQ ID NO: 1685636 - RNA, 15 nt, Human
ucucuaguuugauua

SEQ ID NO: 1685637 - RNA, 16 nt, Human
ucucuaguuugauuaa

SEQ ID NO: 1685638 - RNA, 19 nt, Human
ucucaagagggcacuggug

SEQ ID NO: 1685639 - RNA, 17 nt, Human
ucucaagagggcacugg

SEQ ID NO: 1685640 - RNA, 18 nt, Human
ucucaagagggcacuggu

SEQ ID NO: 1685641 - RNA, 12 nt, Human
ucuccugccuca

SEQ ID NO: 1685642 - RNA, 21 nt, Human
ucuccuggaagugcuaauuuu

SEQ ID NO: 1685643 - RNA, 21 nt, Human
ucuccuggaaauauuaagaaa

SEQ ID NO: 1685644 - RNA, 15 nt, Human
ucuccuguaccucuu

SEQ ID NO: 1685645 - RNA, 19 nt, Human
ucuccugccucagccuccc

SEQ ID NO: 1685646 - RNA, 17 nt, Human
ucuccugccucagccuc

SEQ ID NO: 1685647 - RNA, 15 nt, Human
ucuccugccucagcc

SEQ ID NO: 1685648 - RNA, 17 nt, Human
ucuccuguaccucuuga

SEQ ID NO: 1685649 - RNA, 16 nt, Human
ucuccuguaccucuug

SEQ ID NO: 1685650 - RNA, 19 nt, Human
ucuccuguaccucuugagc

SEQ ID NO: 1685651 - RNA, 14 nt, Human
ucucgugauugaua

SEQ ID NO: 1685652 - RNA, 22 nt, Human
ucucgugauugauaagaaccuu

SEQ ID NO: 1685653 - RNA, 12 nt, Human
ucucuaacuuca

SEQ ID NO: 1685654 - RNA, 19 nt, Human
ucucuaacuucaccauauu

SEQ ID NO: 1685655 - RNA, 17 nt, Human
ucugaaauuuccuggga

SEQ ID NO: 1685656 - RNA, 18 nt, Human
ucugaaauuuccugggag

SEQ ID NO: 1685657 - RNA, 20 nt, Human
ucugaaauuuccugggagcu

SEQ ID NO: 1685658 - RNA, 16 nt, Human
ucugacacacagcucu

SEQ ID NO: 1685659 - RNA, 17 nt, Human
ucugacacacagcucug

SEQ ID NO: 1685660 - RNA, 18 nt, Human
ucugacacacagcucugu

SEQ ID NO: 1685661 - RNA, 19 nt, Human
ucugacacacagcucuguc

SEQ ID NO: 1685662 - RNA, 15 nt, Human
ucugacauaaguauu

SEQ ID NO: 1685663 - RNA, 13 nt, Human
ucugacccacugc

SEQ ID NO: 1685664 - RNA, 12 nt, Human
ucugacaucucu

SEQ ID NO: 1685665 - RNA, 14 nt, Human
ucugacaucucugc

SEQ ID NO: 1685666 - RNA, 15 nt, Human
ucugacaucucugca

SEQ ID NO: 1685667 - RNA, 12 nt, Human
ucugacaggcaa

SEQ ID NO: 1685668 - RNA, 21 nt, Human
ucugacaggcaaugcuggcug

SEQ ID NO: 1685669 - RNA, 22 nt, Human
ucugacaggcaaugcuggcugu

SEQ ID NO: 1685670 - RNA, 22 nt, Human
ucugaaaauugaugggauuugg

SEQ ID NO: 1685671 - RNA, 14 nt, Human
ucugaaaauguaug

SEQ ID NO: 1685672 - RNA, 14 nt, Human
ucugaaaauugaug

SEQ ID NO: 1685673 - RNA, 13 nt, Human
ucugaaaauguau

SEQ ID NO: 1685674 - RNA, 11 nt, Human
ucugaggcuga

SEQ ID NO: 1685675 - RNA, 23 nt, Human
ucugaggcugaaauucagaauau

SEQ ID NO: 1685676 - RNA, 14 nt, Human
ucugcaacucugaa

SEQ ID NO: 1685677 - RNA, 15 nt, Human
ucugcaacucugaag

SEQ ID NO: 1685678 - RNA, 14 nt, Human
ucugcacacagcac

SEQ ID NO: 1685679 - RNA, 20 nt, Human
ucugcaagaauugaagcagg

SEQ ID NO: 1685680 - RNA, 21 nt, Human
ucugcaagaauugaagcagga

SEQ ID NO: 1685681 - RNA, 15 nt, Human
ucugaggaauucugu

SEQ ID NO: 1685682 - RNA, 16 nt, Human
ucugaggaauucugua

SEQ ID NO: 1685683 - RNA, 17 nt, Human
ucugaggaauucuguau

SEQ ID NO: 1685684 - RNA, 18 nt, Human
ucugaggaauucuguaua

SEQ ID NO: 1685685 - RNA, 19 nt, Human
ucugaggaauucuguauag

SEQ ID NO: 1685686 - RNA, 14 nt, Human
ucugaggaauucug

SEQ ID NO: 1685687 - RNA, 14 nt, Human
ucugacccacugcu

SEQ ID NO: 1685688 - RNA, 15 nt, Human
ucugacccacugcuu

SEQ ID NO: 1685689 - RNA, 17 nt, Human
ucugcauucaggaucaa

SEQ ID NO: 1685690 - RNA, 14 nt, Human
ucugcaucagcugc

SEQ ID NO: 1685691 - RNA, 19 nt, Human
ucugcaucagcugcugaaa

SEQ ID NO: 1685692 - RNA, 21 nt, Human
ucugcaucagcugcugaaaca

SEQ ID NO: 1685693 - RNA, 18 nt, Human
ucugccauauucuguugg

SEQ ID NO: 1685694 - RNA, 14 nt, Human
ucugccugcccagg

SEQ ID NO: 1685695 - RNA, 15 nt, Human
ucugccugcccaggc

SEQ ID NO: 1685696 - RNA, 16 nt, Human
ucugccugcccaggcc

SEQ ID NO: 1685697 - RNA, 18 nt, Human
ucugcuccucuccccagc

SEQ ID NO: 1685698 - RNA, 21 nt, Human
ucugcuccucuccccagcaag

SEQ ID NO: 1685699 - RNA, 18 nt, Human
ucugcugacagacacagg

SEQ ID NO: 1685700 - RNA, 21 nt, Human
ucuggacaggcauguucucug

SEQ ID NO: 1685701 - RNA, 16 nt, Human
ucuggaaugcaguggu

SEQ ID NO: 1685702 - RNA, 14 nt, Human
ucuggacaggcaug

SEQ ID NO: 1685703 - RNA, 15 nt, Human
ucuggaaugcagugg

SEQ ID NO: 1685704 - RNA, 19 nt, Human
ucuggaauaaggagaauga

SEQ ID NO: 1685705 - RNA, 22 nt, Human
ucugcugauccucccaggcuuc

SEQ ID NO: 1685706 - RNA, 19 nt, Human
ucugcugacagacacaggc

SEQ ID NO: 1685707 - RNA, 20 nt, Human
ucugcugacagacacaggcc

SEQ ID NO: 1685708 - RNA, 21 nt, Human
ucugcugacagacacaggccc

SEQ ID NO: 1685709 - RNA, 22 nt, Human
ucugcugacagacacaggcccg

SEQ ID NO: 1685710 - RNA, 20 nt, Human
ucugguuccuccccuccucc

SEQ ID NO: 1685711 - RNA, 21 nt, Human
ucugguuccuccccuccuccu

SEQ ID NO: 1685712 - RNA, 14 nt, Human
ucuguccuacucug

SEQ ID NO: 1685713 - RNA, 13 nt, Human
ucugguuccuccc

SEQ ID NO: 1685714 - RNA, 22 nt, Human
ucugucucuggauuauauuaug

SEQ ID NO: 1685715 - RNA, 16 nt, Human
ucugucgcccagucug

SEQ ID NO: 1685716 - RNA, 14 nt, Human
ucugucgcccaguc

SEQ ID NO: 1685717 - RNA, 20 nt, Human
ucuguccuacucugugucag

SEQ ID NO: 1685718 - RNA, 15 nt, Human
ucuguccuacucugu

SEQ ID NO: 1685719 - RNA, 19 nt, Human
ucuguccuacucuguguca

SEQ ID NO: 1685720 - RNA, 18 nt, Human
ucuggcucuuccaggcug

SEQ ID NO: 1685721 - RNA, 23 nt, Human
ucuggcucuuccaggcugggaga

SEQ ID NO: 1685722 - RNA, 23 nt, Human
ucuggugacuuuccucuuugguc

SEQ ID NO: 1685723 - RNA, 14 nt, Human
ucugggacacaguu

SEQ ID NO: 1685724 - RNA, 15 nt, Human
ucuggcuccagcugg

SEQ ID NO: 1685725 - RNA, 22 nt, Human
ucuggcuaugcauuugaaaauu

SEQ ID NO: 1685726 - RNA, 19 nt, Human
ucuggcuaugcauuugaaa

SEQ ID NO: 1685727 - RNA, 17 nt, Human
ucuggccuucggccucc

SEQ ID NO: 1685728 - RNA, 18 nt, Human
ucuggccuucggccucca

SEQ ID NO: 1685729 - RNA, 23 nt, Human
ucuggccuucggccuccauccug

SEQ ID NO: 1685730 - RNA, 16 nt, Human
ucuuaaaguugaauuu

SEQ ID NO: 1685731 - RNA, 19 nt, Human
ucuuaaaguugaauuuauu

SEQ ID NO: 1685732 - RNA, 20 nt, Human
ucuuaaaguugaauuuauug

SEQ ID NO: 1685733 - RNA, 21 nt, Human
ucuuaaaguugaauuuauugg

SEQ ID NO: 1685734 - RNA, 22 nt, Human
ucuuaaaguugaauuuauuggc

SEQ ID NO: 1685735 - RNA, 15 nt, Human
ucuuaaauaauaaag

SEQ ID NO: 1685736 - RNA, 16 nt, Human
ucuuaaccagaucauu

SEQ ID NO: 1685737 - RNA, 17 nt, Human
ucuuaaccagaucauug

SEQ ID NO: 1685738 - RNA, 22 nt, Human
ucuuaaauauguggaguucauc

SEQ ID NO: 1685739 - RNA, 19 nt, Human
ucuuaaauaauaaagauca

SEQ ID NO: 1685740 - RNA, 22 nt, Human
ucuuaaccagaucauugugaaa

SEQ ID NO: 1685741 - RNA, 12 nt, Human
ucuuaagaagac

SEQ ID NO: 1685742 - RNA, 18 nt, Human
ucuuaagaagacugcauu

SEQ ID NO: 1685743 - RNA, 13 nt, Human
ucuuaaaguugaa

SEQ ID NO: 1685744 - RNA, 14 nt, Human
ucuuaaaguugaau

SEQ ID NO: 1685745 - RNA, 12 nt, Human
ucuuaaaguuga

SEQ ID NO: 1685746 - RNA, 13 nt, Human
ucuuaaaaagugg

SEQ ID NO: 1685747 - RNA, 20 nt, Human
ucuuaaaauguuucaaaugg

SEQ ID NO: 1685748 - RNA, 15 nt, Human
ucugucuucacaaca

SEQ ID NO: 1685749 - RNA, 12 nt, Human
ucuucuccacug

SEQ ID NO: 1685750 - RNA, 16 nt, Human
ucuucuuuuuuuguga

SEQ ID NO: 1685751 - RNA, 17 nt, Human
ucuucuuuuuuugugau

SEQ ID NO: 1685752 - RNA, 18 nt, Human
ucuucuuuuuuugugaug

SEQ ID NO: 1685753 - RNA, 14 nt, Human
ucuucuccuuucac

SEQ ID NO: 1685754 - RNA, 13 nt, Human
ucuucuccuuuca

SEQ ID NO: 1685755 - RNA, 13 nt, Human
ucuugaaaaaugc

SEQ ID NO: 1685756 - RNA, 17 nt, Human
ucuugaacuccugaccu

SEQ ID NO: 1685757 - RNA, 19 nt, Human
ucuugaacuccugaccuca

SEQ ID NO: 1685758 - RNA, 12 nt, Human
ucuugaacuccu

SEQ ID NO: 1685759 - RNA, 21 nt, Human
ucuucagcaaaaauauuuuau

SEQ ID NO: 1685760 - RNA, 22 nt, Human
ucuucagcaaaaauauuuuaug

SEQ ID NO: 1685761 - RNA, 23 nt, Human
ucuucagcaaaaauauuuuauga

SEQ ID NO: 1685762 - RNA, 23 nt, Human
ucuucagaucucuaacuucacca

SEQ ID NO: 1685763 - RNA, 18 nt, Human
ucuucagaucucuaacuu

SEQ ID NO: 1685764 - RNA, 17 nt, Human
ucuuccuggauuauuca

SEQ ID NO: 1685765 - RNA, 18 nt, Human
ucuucauaccuacaugua

SEQ ID NO: 1685766 - RNA, 21 nt, Human
ucuucauaccuacauguauuu

SEQ ID NO: 1685767 - RNA, 22 nt, Human
uauuuucccuauuagagaagag

SEQ ID NO: 1685768 - RNA, 17 nt, Human
uauuuuuuucuuuucuu

SEQ ID NO: 1685769 - RNA, 14 nt, Human
uauuuuuuuacuaa

SEQ ID NO: 1685770 - RNA, 14 nt, Human
ucaaaaaaagaaaa

SEQ ID NO: 1685771 - RNA, 15 nt, Human
ucaaaaaaagaaaaa

SEQ ID NO: 1685772 - RNA, 14 nt, Human
uauuuuuuuucugu

SEQ ID NO: 1685773 - RNA, 18 nt, Human
uauuuuauuaugaaacuu

SEQ ID NO: 1685774 - RNA, 23 nt, Human
uauuuuauuaugaaacuugugua

SEQ ID NO: 1685775 - RNA, 13 nt, Human
uauuuuauuauga

SEQ ID NO: 1685776 - RNA, 17 nt, Human
uauuuuauguugcauag

SEQ ID NO: 1685777 - RNA, 17 nt, Human
uauuuauaaucacuuuu

SEQ ID NO: 1685778 - RNA, 19 nt, Human
uauuuucaacgcagcccug

SEQ ID NO: 1685779 - RNA, 15 nt, Human
uauuuucauucuccu

SEQ ID NO: 1685780 - RNA, 17 nt, Human
uauuuuauuaugcauga

SEQ ID NO: 1685781 - RNA, 14 nt, Human
uauuuuauuaugca

SEQ ID NO: 1685782 - RNA, 21 nt, Human
ucaaauauauucagccuggcu

SEQ ID NO: 1685783 - RNA, 22 nt, Human
ucaaauauauucagccuggcuu

SEQ ID NO: 1685784 - RNA, 23 nt, Human
ucaaauauauucagccuggcuuc

SEQ ID NO: 1685785 - RNA, 16 nt, Human
ucaaauaugcaaagca

SEQ ID NO: 1685786 - RNA, 14 nt, Human
ucaaauaugcaaag

SEQ ID NO: 1685787 - RNA, 20 nt, Human
ucaaaucaagaaacuuaagg

SEQ ID NO: 1685788 - RNA, 15 nt, Human
ucaaauccuugaaga

SEQ ID NO: 1685789 - RNA, 17 nt, Human
ucaaauuguaagcaugc

SEQ ID NO: 1685790 - RNA, 20 nt, Human
ucaaauuguaagcaugcaca

SEQ ID NO: 1685791 - RNA, 14 nt, Human
ucaaauugugugaa

SEQ ID NO: 1685792 - RNA, 23 nt, Human
ucaaccccuucgcuccugugucu

SEQ ID NO: 1685793 - RNA, 15 nt, Human
ucaaauugugugaaa

SEQ ID NO: 1685794 - RNA, 17 nt, Human
ucaaugccccugaauuu

SEQ ID NO: 1685795 - RNA, 18 nt, Human
ucaaugccccugaauuua

SEQ ID NO: 1685796 - RNA, 20 nt, Human
ucaaugccccugaauuuaaa

SEQ ID NO: 1685797 - RNA, 22 nt, Human
ucaaugccccugaauuuaaaua

SEQ ID NO: 1685798 - RNA, 21 nt, Human
ucaauuacaggaaguacugga

SEQ ID NO: 1685799 - RNA, 23 nt, Human
ucaauuacaggaaguacuggaga

SEQ ID NO: 1685800 - RNA, 14 nt, Human
ucaacgcagcccug

SEQ ID NO: 1685801 - RNA, 15 nt, Human
ucaacgcagcccugc

SEQ ID NO: 1685802 - RNA, 18 nt, Human
ucaacgcagcccugcuuu

SEQ ID NO: 1685803 - RNA, 20 nt, Human
ucaagugauucuccugccuc

SEQ ID NO: 1685804 - RNA, 18 nt, Human
ucaagugauucuccugcc

SEQ ID NO: 1685805 - RNA, 21 nt, Human
ucaagugauucuccugccuca

SEQ ID NO: 1685806 - RNA, 21 nt, Human
ucaauaaaauccauacauuug

SEQ ID NO: 1685807 - RNA, 18 nt, Human
ucacauuuauucugcuca

SEQ ID NO: 1685808 - RNA, 19 nt, Human
ucacauuuauucugcucac

SEQ ID NO: 1685809 - RNA, 17 nt, Human
ucacauuuauucugcuc

SEQ ID NO: 1685810 - RNA, 16 nt, Human
ucaccacaugugcaca

SEQ ID NO: 1685811 - RNA, 19 nt, Human
ucaccaaaucagcugcuac

SEQ ID NO: 1685812 - RNA, 20 nt, Human
ucaccaaaucagcugcuacu

SEQ ID NO: 1685813 - RNA, 21 nt, Human
ucaccaaaucagcugcuacua

SEQ ID NO: 1685814 - RNA, 14 nt, Human
ucaccaaggcugau

SEQ ID NO: 1685815 - RNA, 13 nt, Human
ucacaagacccaa

SEQ ID NO: 1685816 - RNA, 17 nt, Human
ucacaagacccaaaagg

SEQ ID NO: 1685817 - RNA, 18 nt, Human
ucacaagacccaaaaggc

SEQ ID NO: 1685818 - RNA, 23 nt, Human
ucacaccccagacgaugucuuca

SEQ ID NO: 1685819 - RNA, 16 nt, Human
ucacaggcagguccag

SEQ ID NO: 1685820 - RNA, 17 nt, Human
ucacaggcagguccagg

SEQ ID NO: 1685821 - RNA, 18 nt, Human
ucacaggcagguccaggg

SEQ ID NO: 1685822 - RNA, 19 nt, Human
ucacaggcagguccagggu

SEQ ID NO: 1685823 - RNA, 22 nt, Human
ucacaguccuuaccagcagagc

SEQ ID NO: 1685824 - RNA, 23 nt, Human
ucacaguccuuaccagcagagca

SEQ ID NO: 1685825 - RNA, 19 nt, Human
ucacaguccuuaccagcag

SEQ ID NO: 1685826 - RNA, 16 nt, Human
ucacagucacauucca

SEQ ID NO: 1685827 - RNA, 24 nt, Human
uauuuauaaaaauaaaaaacacug

SEQ ID NO: 1685828 - RNA, 22 nt, Human
uauuguuuucaguguacaugga

SEQ ID NO: 1685829 - RNA, 18 nt, Human
uauuguuuucaguguaca

SEQ ID NO: 1685830 - RNA, 20 nt, Human
uauuguuuucaguguacaug

SEQ ID NO: 1685831 - RNA, 12 nt, Human
uauuguuuucag

SEQ ID NO: 1685832 - RNA, 17 nt, Human
uauucucuccuguaccu

SEQ ID NO: 1685833 - RNA, 18 nt, Human
uauucucuccuguaccuc

SEQ ID NO: 1685834 - RNA, 21 nt, Human
uauugauaugcuuauacacuu

SEQ ID NO: 1685835 - RNA, 17 nt, Human
uauugcugauggugcaa

SEQ ID NO: 1685836 - RNA, 22 nt, Human
uauugcugauggugcaaugacc

SEQ ID NO: 1685837 - RNA, 22 nt, Human
uauuggaaauuuguuauaauga

SEQ ID NO: 1685838 - RNA, 12 nt, Human
uauuacaguaua

SEQ ID NO: 1685839 - RNA, 13 nt, Human
uauuacaguauaa

SEQ ID NO: 1685840 - RNA, 14 nt, Human
uauuacaguauaau

SEQ ID NO: 1685841 - RNA, 16 nt, Human
uauuauucccauucua

SEQ ID NO: 1685842 - RNA, 17 nt, Human
uauuccugcauuuguga

SEQ ID NO: 1685843 - RNA, 19 nt, Human
uauuccugcauuugugaaa

SEQ ID NO: 1685844 - RNA, 20 nt, Human
uauuccugcauuugugaaau

SEQ ID NO: 1685845 - RNA, 21 nt, Human
uauuccugcauuugugaaaug

SEQ ID NO: 1685846 - RNA, 15 nt, Human
uauguaaaucccauu

SEQ ID NO: 1685847 - RNA, 19 nt, Human
uauguaaaucccauuauuc

SEQ ID NO: 1685848 - RNA, 20 nt, Human
uauguaaaucccauuauuca

SEQ ID NO: 1685849 - RNA, 21 nt, Human
uauguaaaucccauuauucaa

SEQ ID NO: 1685850 - RNA, 23 nt, Human
uauguaaaucccauuauucaaag

SEQ ID NO: 1685851 - RNA, 12 nt, Human
uauguaaauccc

SEQ ID NO: 1685852 - RNA, 13 nt, Human
gggaguggccaca

SEQ ID NO: 1685853 - RNA, 15 nt, Human
gggaguggccacaga

SEQ ID NO: 1685854 - RNA, 13 nt, Human
uauguacuucaug

SEQ ID NO: 1685855 - RNA, 17 nt, Human
uauguacuucaugcugu

SEQ ID NO: 1685856 - RNA, 12 nt, Human
uauuaaauuaug

SEQ ID NO: 1685857 - RNA, 16 nt, Human
uauuaagaaugaaaua

SEQ ID NO: 1685858 - RNA, 13 nt, Human
uauuaagaaugaa

SEQ ID NO: 1685859 - RNA, 14 nt, Human
uauguugauaaaag

SEQ ID NO: 1685860 - RNA, 12 nt, Human
uauguugcauag

SEQ ID NO: 1685861 - RNA, 16 nt, Human
uauguugcauagaaua

SEQ ID NO: 1685862 - RNA, 13 nt, Human
uauguugcccagg

SEQ ID NO: 1685863 - RNA, 16 nt, Human
uauguugcccaggcag

SEQ ID NO: 1685864 - RNA, 19 nt, Human
uauguugcccaggcagguc

SEQ ID NO: 1685865 - RNA, 20 nt, Human
uauguugcccaggcaggucu

SEQ ID NO: 1685866 - RNA, 19 nt, Human
ucacugcauccuccgccuc

SEQ ID NO: 1685867 - RNA, 18 nt, Human
ucacugcauccuccgccu

SEQ ID NO: 1685868 - RNA, 20 nt, Human
ucacucuuauugcccacgcu

SEQ ID NO: 1685869 - RNA, 18 nt, Human
ucacugccaugccagcuu

SEQ ID NO: 1685870 - RNA, 17 nt, Human
ucacucuuauugcccac

SEQ ID NO: 1685871 - RNA, 13 nt, Human
ucaccagccccag

SEQ ID NO: 1685872 - RNA, 16 nt, Human
ucaccagccccagugc

SEQ ID NO: 1685873 - RNA, 13 nt, Human
ucacugcuggcug

SEQ ID NO: 1685874 - RNA, 14 nt, Human
ucacugcuggcugc

SEQ ID NO: 1685875 - RNA, 15 nt, Human
ucacugcuggcugcc

SEQ ID NO: 1685876 - RNA, 16 nt, Human
ucacugcuggcugccu

SEQ ID NO: 1685877 - RNA, 12 nt, Human
ucacugcuggcu

SEQ ID NO: 1685878 - RNA, 17 nt, Human
ucacugcuggcugccuu

SEQ ID NO: 1685879 - RNA, 18 nt, Human
ucacugcuggcugccuua

SEQ ID NO: 1685880 - RNA, 22 nt, Human
ucacugcuggcugccuuagaac

SEQ ID NO: 1685881 - RNA, 14 nt, Human
ucacugcuuaacuu

SEQ ID NO: 1685882 - RNA, 20 nt, Human
ucacuuguuuuauuuaaccu

SEQ ID NO: 1685883 - RNA, 10 nt, Human
ucagaaaugu

SEQ ID NO: 1685884 - RNA, 23 nt, Human
ucagaauucucuaguuugauuaa

SEQ ID NO: 1685885 - RNA, 15 nt, Human
ucagaaauguguuau

SEQ ID NO: 1685886 - RNA, 13 nt, Human
ucagacagcugcc

SEQ ID NO: 1685887 - RNA, 14 nt, Human
ucagacagcugccu

SEQ ID NO: 1685888 - RNA, 22 nt, Human
ucagacagaucuggaaugugaa

SEQ ID NO: 1685889 - RNA, 21 nt, Human
ucagagcugcccucuccuggg

SEQ ID NO: 1685890 - RNA, 20 nt, Human
ucagagcugcccucuccugg

SEQ ID NO: 1685891 - RNA, 19 nt, Human
ucagagcugcccucuccug

SEQ ID NO: 1685892 - RNA, 21 nt, Human
ucagaguaauccaagcaaaug

SEQ ID NO: 1685893 - RNA, 22 nt, Human
ucagaguaauccaagcaaaugu

SEQ ID NO: 1685894 - RNA, 23 nt, Human
ucagagcugcccucuccugggca

SEQ ID NO: 1685895 - RNA, 22 nt, Human
ucagagcugcccucuccugggc

SEQ ID NO: 1685896 - RNA, 17 nt, Human
ucagcauucucacuccu

SEQ ID NO: 1685897 - RNA, 20 nt, Human
ucagcauucucacuccuacc

SEQ ID NO: 1685898 - RNA, 15 nt, Human
ucagauaugauucaa

SEQ ID NO: 1685899 - RNA, 20 nt, Human
ucagccucccgaguagcugg

SEQ ID NO: 1685900 - RNA, 18 nt, Human
ucagccucccgaguagcu

SEQ ID NO: 1685901 - RNA, 21 nt, Human
ucagccucccgaauagcuggg

SEQ ID NO: 1685902 - RNA, 22 nt, Human
ucagccucccgaauagcuggga

SEQ ID NO: 1685903 - RNA, 23 nt, Human
ucagcauucucacuccuaccugg

SEQ ID NO: 1685904 - RNA, 14 nt, Human
ucagccucccaaag

SEQ ID NO: 1685905 - RNA, 19 nt, Human
ucagccucccaaagugcug

SEQ ID NO: 1685906 - RNA, 21 nt, Human
ucagccucccaaagugcuggg

SEQ ID NO: 1685907 - RNA, 20 nt, Human
ucagccuccugaguagcugg

SEQ ID NO: 1685908 - RNA, 21 nt, Human
ucagccucccgaguagcuggg

SEQ ID NO: 1685909 - RNA, 22 nt, Human
ucagccucccgaguagcuggga

SEQ ID NO: 1685910 - RNA, 22 nt, Human
ucagccuccugaguagcuggga

SEQ ID NO: 1685911 - RNA, 18 nt, Human
ucagccugcuccagcugu

SEQ ID NO: 1685912 - RNA, 19 nt, Human
ucagccugcuccagcuguu

SEQ ID NO: 1685913 - RNA, 17 nt, Human
ucagcuccccucggaga

SEQ ID NO: 1685914 - RNA, 15 nt, Human
ucagcugaaccuggg

SEQ ID NO: 1685915 - RNA, 16 nt, Human
ucagcugaaccugggu

SEQ ID NO: 1685916 - RNA, 18 nt, Human
ucagcuccccucggagaa

SEQ ID NO: 1685917 - RNA, 14 nt, Human
ucagggccuggcuc

SEQ ID NO: 1685918 - RNA, 16 nt, Human
ucagggccuggcucag

SEQ ID NO: 1685919 - RNA, 15 nt, Human
ucaggugagaagcag

SEQ ID NO: 1685920 - RNA, 16 nt, Human
ucaggugagaagcaga

SEQ ID NO: 1685921 - RNA, 19 nt, Human
ucaggagcccugggaggcu

SEQ ID NO: 1685922 - RNA, 18 nt, Human
ucaggagcccugggaggc

SEQ ID NO: 1685923 - RNA, 20 nt, Human
ucaggagcccugggaggcuc

SEQ ID NO: 1685924 - RNA, 23 nt, Human
ucaggagcccugggaggcucugg

SEQ ID NO: 1685925 - RNA, 13 nt, Human
ucaggcuagaugu

SEQ ID NO: 1685926 - RNA, 17 nt, Human
ucaggcuagauguaugu

SEQ ID NO: 1685927 - RNA, 15 nt, Human
uccaggugcacaagc

SEQ ID NO: 1685928 - RNA, 23 nt, Human
uccaggggugggacacccuguga

SEQ ID NO: 1685929 - RNA, 22 nt, Human
uccaggagcagccacauuccug

SEQ ID NO: 1685930 - RNA, 17 nt, Human
uccaggagcagccacau

SEQ ID NO: 1685931 - RNA, 18 nt, Human
uccaggagcagccacauu

SEQ ID NO: 1685932 - RNA, 11 nt, Human
uccaggguggu

SEQ ID NO: 1685933 - RNA, 15 nt, Human
uccagguucagcuug

SEQ ID NO: 1685934 - RNA, 16 nt, Human
uccagguucagcuugu

SEQ ID NO: 1685935 - RNA, 18 nt, Human
uccaggugcacaagcucc

SEQ ID NO: 1685936 - RNA, 20 nt, Human
uccaggugcacaagcuccaa

SEQ ID NO: 1685937 - RNA, 21 nt, Human
uccaggugcacaagcuccaag

SEQ ID NO: 1685938 - RNA, 22 nt, Human
uccaggugcacaagcuccaagc

SEQ ID NO: 1685939 - RNA, 18 nt, Human
uccagcucaccagcccca

SEQ ID NO: 1685940 - RNA, 16 nt, Human
uccagcucaccagccc

SEQ ID NO: 1685941 - RNA, 17 nt, Human
uccagcucaccagcccc

SEQ ID NO: 1685942 - RNA, 17 nt, Human
uccagcuguucagcugg

SEQ ID NO: 1685943 - RNA, 16 nt, Human
uccaggagcagccaca

SEQ ID NO: 1685944 - RNA, 17 nt, Human
uccagccacagaaaaga

SEQ ID NO: 1685945 - RNA, 17 nt, Human
uccacuuggucugugag

SEQ ID NO: 1685946 - RNA, 15 nt, Human
uccaccuucccaugc

SEQ ID NO: 1685947 - RNA, 15 nt, Human
uccacuuggucugug

SEQ ID NO: 1685948 - RNA, 16 nt, Human
uccacuuggucuguga

SEQ ID NO: 1685949 - RNA, 19 nt, Human
uccacagaagcuccaggua

SEQ ID NO: 1685950 - RNA, 12 nt, Human
uccacccugcuc

SEQ ID NO: 1685951 - RNA, 13 nt, Human
uccacccugcucu

SEQ ID NO: 1685952 - RNA, 14 nt, Human
uccaccucccugca

SEQ ID NO: 1685953 - RNA, 13 nt, Human
uccaccucccugc

SEQ ID NO: 1685954 - RNA, 18 nt, Human
uccaccugccagggacag

SEQ ID NO: 1685955 - RNA, 21 nt, Human
uccaccugccagggacagagg

SEQ ID NO: 1685956 - RNA, 17 nt, Human
uccaccugccagggaca

SEQ ID NO: 1685957 - RNA, 15 nt, Human
uccaccugccaggga

SEQ ID NO: 1685958 - RNA, 17 nt, Human
uccaccucccugcaaua

SEQ ID NO: 1685959 - RNA, 16 nt, Human
uccaccucccugcaau

SEQ ID NO: 1685960 - RNA, 15 nt, Human
uccaccucccugcaa

SEQ ID NO: 1685961 - RNA, 17 nt, Human
uccacaaguuaaauaaa

SEQ ID NO: 1685962 - RNA, 18 nt, Human
uccacaaguuaaauaaau

SEQ ID NO: 1685963 - RNA, 16 nt, Human
uccacaagagcccagg

SEQ ID NO: 1685964 - RNA, 17 nt, Human
uccacaagagcccaggc

SEQ ID NO: 1685965 - RNA, 18 nt, Human
uccacaagagcccaggcc

SEQ ID NO: 1685966 - RNA, 19 nt, Human
uccacaagagcccaggccu

SEQ ID NO: 1685967 - RNA, 17 nt, Human
uccaauuuacauacucu

SEQ ID NO: 1685968 - RNA, 18 nt, Human
uccaauuuacauacucug

SEQ ID NO: 1685969 - RNA, 18 nt, Human
uccaaaauaaaacuuuuu

SEQ ID NO: 1685970 - RNA, 20 nt, Human
uccaaaauaaaacuuuuuaa

SEQ ID NO: 1685971 - RNA, 23 nt, Human
ucauuccaccuucccaugcccug

SEQ ID NO: 1685972 - RNA, 23 nt, Human
ucauuauuuuauuaugaaacuug

SEQ ID NO: 1685973 - RNA, 21 nt, Human
ucauucaacccaccugcgucu

SEQ ID NO: 1685974 - RNA, 19 nt, Human
ucauuaucucaaaacugca

SEQ ID NO: 1685975 - RNA, 20 nt, Human
ucauuaucucaaaacugcac

SEQ ID NO: 1685976 - RNA, 13 nt, Human
ucauuaucucaaa

SEQ ID NO: 1685977 - RNA, 12 nt, Human
ucauugugaaau

SEQ ID NO: 1685978 - RNA, 15 nt, Human
ucauugugaaauuau

SEQ ID NO: 1685979 - RNA, 17 nt, Human
ucauugugaaauuauuc

SEQ ID NO: 1685980 - RNA, 18 nt, Human
ucauugugaaauuauuca

SEQ ID NO: 1685981 - RNA, 13 nt, Human
ucauuuccugugu

SEQ ID NO: 1685982 - RNA, 16 nt, Human
ucauuuccugugucuu

SEQ ID NO: 1685983 - RNA, 13 nt, Human
ucauuuccaagca

SEQ ID NO: 1685984 - RNA, 16 nt, Human
ucauuuccaagcaagu

SEQ ID NO: 1685985 - RNA, 21 nt, Human
ucauagcccucacccuggggc

SEQ ID NO: 1685986 - RNA, 15 nt, Human
ucauacucaccucac

SEQ ID NO: 1685987 - RNA, 19 nt, Human
ucaucaccaacgucugugc

SEQ ID NO: 1685988 - RNA, 20 nt, Human
ucaucaccaacgucugugcc

SEQ ID NO: 1685989 - RNA, 21 nt, Human
ucaucaccaacgucugugcca

SEQ ID NO: 1685990 - RNA, 21 nt, Human
ucaggugagaagcagaggaag

SEQ ID NO: 1685991 - RNA, 13 nt, Human
ucaggugcugcca

SEQ ID NO: 1685992 - RNA, 14 nt, Human
ucaggugcugccau

SEQ ID NO: 1685993 - RNA, 15 nt, Human
ucaggugcugccauc

SEQ ID NO: 1685994 - RNA, 18 nt, Human
ucauaccuaucaucuuaa

SEQ ID NO: 1685995 - RNA, 15 nt, Human
ucauaccuacaugua

SEQ ID NO: 1685996 - RNA, 16 nt, Human
ucauaccuacauguau

SEQ ID NO: 1685997 - RNA, 23 nt, Human
ucaucuuagguuggcaaaaaggc

SEQ ID NO: 1685998 - RNA, 19 nt, Human
ucaucuugaauuguaagga

SEQ ID NO: 1685999 - RNA, 14 nt, Human
ucaucaguauugaa

SEQ ID NO: 1686000 - RNA, 16 nt, Human
ucaucaguauugaagc

SEQ ID NO: 1686001 - RNA, 14 nt, Human
ggagcuagaauuug

SEQ ID NO: 1686002 - RNA, 15 nt, Human
ggagccuccugcccu

SEQ ID NO: 1686003 - RNA, 20 nt, Human
ggagcccugggaggcucugg

SEQ ID NO: 1686004 - RNA, 14 nt, Human
ggagccuccugccc

SEQ ID NO: 1686005 - RNA, 16 nt, Human
ggagcccugggaggcu

SEQ ID NO: 1686006 - RNA, 19 nt, Human
ggagcccugggaggcucug

SEQ ID NO: 1686007 - RNA, 17 nt, Human
ggaggcaggaguuucgu

SEQ ID NO: 1686008 - RNA, 17 nt, Human
ggagggagggcuccaga

SEQ ID NO: 1686009 - RNA, 13 nt, Human
ggagggagggcuc

SEQ ID NO: 1686010 - RNA, 16 nt, Human
ggagggagggcuccag

SEQ ID NO: 1686011 - RNA, 18 nt, Human
ggaggauguucugggaca

SEQ ID NO: 1686012 - RNA, 21 nt, Human
ggaggauguucugggacacag

SEQ ID NO: 1686013 - RNA, 16 nt, Human
ggaggacgcucucugg

SEQ ID NO: 1686014 - RNA, 14 nt, Human
ggaggggccuggca

SEQ ID NO: 1686015 - RNA, 18 nt, Human
ggaggggccuggcagccg

SEQ ID NO: 1686016 - RNA, 21 nt, Human
ggaggggccuggcagccgugc

SEQ ID NO: 1686017 - RNA, 22 nt, Human
ggagucccaccuuggcugcagg

SEQ ID NO: 1686018 - RNA, 13 nt, Human
ggaggggccuggc

SEQ ID NO: 1686019 - RNA, 13 nt, Human
ggagggccugggc

SEQ ID NO: 1686020 - RNA, 19 nt, Human
ggaggggagcaugggaagu

SEQ ID NO: 1686021 - RNA, 18 nt, Human
ggacugagaaauuuauaa

SEQ ID NO: 1686022 - RNA, 11 nt, Human
ggagaagaacu

SEQ ID NO: 1686023 - RNA, 14 nt, Human
ggagaagaacugaa

SEQ ID NO: 1686024 - RNA, 15 nt, Human
ggagaagagcuguuc

SEQ ID NO: 1686025 - RNA, 23 nt, Human
ggagaagagcuguucacagccag

SEQ ID NO: 1686026 - RNA, 18 nt, Human
ggaccuugaacuggguac

SEQ ID NO: 1686027 - RNA, 14 nt, Human
ggacugagaaauuu

SEQ ID NO: 1686028 - RNA, 17 nt, Human
ggacugaauuaugaaac

SEQ ID NO: 1686029 - RNA, 19 nt, Human
ggacugaauuaugaaacuu

SEQ ID NO: 1686030 - RNA, 16 nt, Human
ggacgcucucuggccu

SEQ ID NO: 1686031 - RNA, 19 nt, Human
ggacgcucucuggccuucg

SEQ ID NO: 1686032 - RNA, 12 nt, Human
gcuuuucacugc

SEQ ID NO: 1686033 - RNA, 19 nt, Human
gcuuuuaugugaaacaugu

SEQ ID NO: 1686034 - RNA, 20 nt, Human
gcuuuuaugugaaacauguu

SEQ ID NO: 1686035 - RNA, 21 nt, Human
gcuuuuaugugaaacauguuu

SEQ ID NO: 1686036 - RNA, 16 nt, Human
ggacagaggggguggc

SEQ ID NO: 1686037 - RNA, 15 nt, Human
ggacagccccuccuc

SEQ ID NO: 1686038 - RNA, 16 nt, Human
ggacagccccuccucc

SEQ ID NO: 1686039 - RNA, 20 nt, Human
ggacagaggggguggccucc

SEQ ID NO: 1686040 - RNA, 11 nt, Human
ggacagcuccu

SEQ ID NO: 1686041 - RNA, 15 nt, Human
ggacagcuccuucug

SEQ ID NO: 1686042 - RNA, 16 nt, Human
ggacagcuccuucugu

SEQ ID NO: 1686043 - RNA, 17 nt, Human
ggacagcuccuucuguc

SEQ ID NO: 1686044 - RNA, 19 nt, Human
ggaccagagcugccaccug

SEQ ID NO: 1686045 - RNA, 17 nt, Human
ggacauuugcucaugga

SEQ ID NO: 1686046 - RNA, 14 nt, Human
ggaccaaaaaccag

SEQ ID NO: 1686047 - RNA, 20 nt, Human
ggacauuugcucauggaauu

SEQ ID NO: 1686048 - RNA, 12 nt, Human
ggauuauauuau

SEQ ID NO: 1686049 - RNA, 18 nt, Human
ggaugccugguggcagcu

SEQ ID NO: 1686050 - RNA, 19 nt, Human
ggaugccugguggcagcug

SEQ ID NO: 1686051 - RNA, 20 nt, Human
ggaugccugguggcagcugc

SEQ ID NO: 1686052 - RNA, 21 nt, Human
ggaugccugguggcagcugcg

SEQ ID NO: 1686053 - RNA, 18 nt, Human
ggaugaugacuauggaaa

SEQ ID NO: 1686054 - RNA, 18 nt, Human
ggaugcccaaagaugcag

SEQ ID NO: 1686055 - RNA, 17 nt, Human
ggaugccccgucccccu

SEQ ID NO: 1686056 - RNA, 19 nt, Human
ggaugcccaaagaugcagc

SEQ ID NO: 1686057 - RNA, 13 nt, Human
ggaugccuggugg

SEQ ID NO: 1686058 - RNA, 17 nt, Human
ggaugccugguggcagc

SEQ ID NO: 1686059 - RNA, 16 nt, Human
ggaugaucuaggaaga

SEQ ID NO: 1686060 - RNA, 18 nt, Human
ggaugaucuaggaagacu

SEQ ID NO: 1686061 - RNA, 22 nt, Human
ggaugaucuaggaagacuuugg

SEQ ID NO: 1686062 - RNA, 23 nt, Human
ggagucccaccuuggcugcaggg

SEQ ID NO: 1686063 - RNA, 17 nt, Human
ggcaagcaccuccugcc

SEQ ID NO: 1686064 - RNA, 13 nt, Human
ggauucuuaaagu

SEQ ID NO: 1686065 - RNA, 21 nt, Human
ggauucuuccucccucccucu

SEQ ID NO: 1686066 - RNA, 17 nt, Human
ggcaccagcagccugga

SEQ ID NO: 1686067 - RNA, 18 nt, Human
ggcaagcaccuccugccu

SEQ ID NO: 1686068 - RNA, 19 nt, Human
ggcaagcaccuccugccuc

SEQ ID NO: 1686069 - RNA, 20 nt, Human
ggcacccaccaucaugucug

SEQ ID NO: 1686070 - RNA, 18 nt, Human
ggcacccggccccugcug

SEQ ID NO: 1686071 - RNA, 19 nt, Human
ggcacccggccccugcugg

SEQ ID NO: 1686072 - RNA, 20 nt, Human
ggcacccggccccugcuggu

SEQ ID NO: 1686073 - RNA, 18 nt, Human
ggcacucagaagacacug

SEQ ID NO: 1686074 - RNA, 19 nt, Human
ggcacucagaagacacuga

SEQ ID NO: 1686075 - RNA, 20 nt, Human
ggcacucagaagacacugau

SEQ ID NO: 1686076 - RNA, 21 nt, Human
ggcagagguugcagugagccg

SEQ ID NO: 1686077 - RNA, 22 nt, Human
ggccacagaaaauucuucucca

SEQ ID NO: 1686078 - RNA, 20 nt, Human
ggcauguucucugaggacac

SEQ ID NO: 1686079 - RNA, 20 nt, Human
ggccacugugaagagaacca

SEQ ID NO: 1686080 - RNA, 11 nt, Human
ggccaggagcc

SEQ ID NO: 1686081 - RNA, 13 nt, Human
ggccaggagccuc

SEQ ID NO: 1686082 - RNA, 14 nt, Human
ggccaggcccucug

SEQ ID NO: 1686083 - RNA, 17 nt, Human
ggccaggcccucugccc

SEQ ID NO: 1686084 - RNA, 15 nt, Human
ggccaggcccucugc

SEQ ID NO: 1686085 - RNA, 16 nt, Human
ggccaggcccucugcc

SEQ ID NO: 1686086 - RNA, 22 nt, Human
ggcaugacacgaauauugcuga

SEQ ID NO: 1686087 - RNA, 15 nt, Human
ggcaugaugcgggcc

SEQ ID NO: 1686088 - RNA, 18 nt, Human
ggcaugugaugagaggaa

SEQ ID NO: 1686089 - RNA, 23 nt, Human
ggcaugugaugagaggaaaucac

SEQ ID NO: 1686090 - RNA, 17 nt, Human
ggcagggucucacucug

SEQ ID NO: 1686091 - RNA, 18 nt, Human
ggcagggucucacucugu

SEQ ID NO: 1686092 - RNA, 23 nt, Human
ggcagcugcgguccacccaggag

SEQ ID NO: 1686093 - RNA, 24 nt, Human
ggcagcugcgguccacccaggagc

SEQ ID NO: 1686094 - RNA, 12 nt, Human
ggcaggguccua

SEQ ID NO: 1686095 - RNA, 22 nt, Human
ggcagcugcuuuugucuauggg

SEQ ID NO: 1686096 - RNA, 16 nt, Human
ggcagcugccuccccu

SEQ ID NO: 1686097 - RNA, 17 nt, Human
ggcagaguugaagacag

SEQ ID NO: 1686098 - RNA, 19 nt, Human
ggcagaguugaagacagag

SEQ ID NO: 1686099 - RNA, 21 nt, Human
ggcagaguugaagacagagcu

SEQ ID NO: 1686100 - RNA, 13 nt, Human
ggcagcugccucc

SEQ ID NO: 1686101 - RNA, 12 nt, Human
ggcagcugccuc

SEQ ID NO: 1686102 - RNA, 11 nt, Human
ggcagcugccu

SEQ ID NO: 1686103 - RNA, 15 nt, Human
ggccgggagccugau

SEQ ID NO: 1686104 - RNA, 14 nt, Human
ggcccagagggccu

SEQ ID NO: 1686105 - RNA, 17 nt, Human
ggcccagagggccugca

SEQ ID NO: 1686106 - RNA, 19 nt, Human
ggcccagagggccugcaag

SEQ ID NO: 1686107 - RNA, 20 nt, Human
ggcccagagggccugcaagg

SEQ ID NO: 1686108 - RNA, 23 nt, Human
ggccuagcauacguacacauuuu

SEQ ID NO: 1686109 - RNA, 22 nt, Human
ggccuagcauacguacacauuu

SEQ ID NO: 1686110 - RNA, 20 nt, Human
ggccuagcauacguacacau

SEQ ID NO: 1686111 - RNA, 14 nt, Human
ggccucaagugauu

SEQ ID NO: 1686112 - RNA, 22 nt, Human
ggccucaagugauucuccugcc

SEQ ID NO: 1686113 - RNA, 23 nt, Human
ggccucaagugauucuccugccu

SEQ ID NO: 1686114 - RNA, 17 nt, Human
ggccucggacuuagcug

SEQ ID NO: 1686115 - RNA, 14 nt, Human
ggccuccugugugu

SEQ ID NO: 1686116 - RNA, 12 nt, Human
ggccugagcugg

SEQ ID NO: 1686117 - RNA, 13 nt, Human
ggccuggccccuc

SEQ ID NO: 1686118 - RNA, 22 nt, Human
ggccucugcacuccccugcugg

SEQ ID NO: 1686119 - RNA, 18 nt, Human
ggccucugcacuccccug

SEQ ID NO: 1686120 - RNA, 19 nt, Human
ggccucugcacuccccugc

SEQ ID NO: 1686121 - RNA, 14 nt, Human
ggccuggccccuca

SEQ ID NO: 1686122 - RNA, 15 nt, Human
ggccuggccccucag

SEQ ID NO: 1686123 - RNA, 17 nt, Human
ggccuggccccucaggg

SEQ ID NO: 1686124 - RNA, 18 nt, Human
ggccuggccccucagggu

SEQ ID NO: 1686125 - RNA, 23 nt, Human
ggccuggccccucagggucccug

SEQ ID NO: 1686126 - RNA, 10 nt, Human
ggccuggccu

SEQ ID NO: 1686127 - RNA, 13 nt, Human
ggccuggccugag

SEQ ID NO: 1686128 - RNA, 14 nt, Human
ggccuggccugagc

SEQ ID NO: 1686129 - RNA, 15 nt, Human
ggccuggccugagcu

SEQ ID NO: 1686130 - RNA, 16 nt, Human
ggccuggccugagcug

SEQ ID NO: 1686131 - RNA, 11 nt, Human
ggccugggccc

SEQ ID NO: 1686132 - RNA, 23 nt, Human
ggccugggggcugggcagaggaa

SEQ ID NO: 1686133 - RNA, 23 nt, Human
ggcgcagcauauucaggaagcuc

SEQ ID NO: 1686134 - RNA, 24 nt, Human
ggcgcagcauauucaggaagcuca

SEQ ID NO: 1686135 - RNA, 17 nt, Human
ggcucuggagcccacug

SEQ ID NO: 1686136 - RNA, 19 nt, Human
ggcucuggagcccacugua

SEQ ID NO: 1686137 - RNA, 16 nt, Human
ggcucuggagcccacu

SEQ ID NO: 1686138 - RNA, 16 nt, Human
ggcucugccucccauc

SEQ ID NO: 1686139 - RNA, 14 nt, Human
ggcucugcccuugg

SEQ ID NO: 1686140 - RNA, 15 nt, Human
ggcucugcccuuggu

SEQ ID NO: 1686141 - RNA, 13 nt, Human
ggcucugccuccc

SEQ ID NO: 1686142 - RNA, 15 nt, Human
ggcucugccucccau

SEQ ID NO: 1686143 - RNA, 12 nt, Human
ggcucugcccuu

SEQ ID NO: 1686144 - RNA, 17 nt, Human
ggcucucaggccagcug

SEQ ID NO: 1686145 - RNA, 18 nt, Human
ggcucucaggccagcugc

SEQ ID NO: 1686146 - RNA, 19 nt, Human
ggcucucaggccagcugcu

SEQ ID NO: 1686147 - RNA, 20 nt, Human
ggcucucaggccagcugcuu

SEQ ID NO: 1686148 - RNA, 15 nt, Human
ggcucucaggccagc

SEQ ID NO: 1686149 - RNA, 16 nt, Human
ggcucucaggccagcu

SEQ ID NO: 1686150 - RNA, 15 nt, Human
ggcuccaggcuccuu

SEQ ID NO: 1686151 - RNA, 14 nt, Human
ggcuccaggcuccu

SEQ ID NO: 1686152 - RNA, 10 nt, Human
ggcuccagac

SEQ ID NO: 1686153 - RNA, 14 nt, Human
ggcuccaggagcag

SEQ ID NO: 1686154 - RNA, 16 nt, Human
ggcuccaggagcagcc

SEQ ID NO: 1686155 - RNA, 18 nt, Human
ggcuccaggagcagccac

SEQ ID NO: 1686156 - RNA, 17 nt, Human
ggcuccaggagcagcca

SEQ ID NO: 1686157 - RNA, 12 nt, Human
ggcuccaggcuc

SEQ ID NO: 1686158 - RNA, 13 nt, Human
ggcuccaggcucc

SEQ ID NO: 1686159 - RNA, 14 nt, Human
ggcuaugcauuuga

SEQ ID NO: 1686160 - RNA, 13 nt, Human
ggcuaugcauuug

SEQ ID NO: 1686161 - RNA, 12 nt, Human
ggcuaugcauuu

SEQ ID NO: 1686162 - RNA, 9 nt, Human
ggcuccaga

SEQ ID NO: 1686163 - RNA, 16 nt, Human
ggcuccacuuggucug

SEQ ID NO: 1686164 - RNA, 17 nt, Human
ggcgcugccccuggcag

SEQ ID NO: 1686165 - RNA, 11 nt, Human
ggcgcugcccc

SEQ ID NO: 1686166 - RNA, 20 nt, Human
ggcuaguaucaaaagaaaga

SEQ ID NO: 1686167 - RNA, 23 nt, Human
ggcuauaggugcuacaaaaacac

SEQ ID NO: 1686168 - RNA, 15 nt, Human
ggcugggagcucugc

SEQ ID NO: 1686169 - RNA, 20 nt, Human
ggcugggcucccuucccacc

SEQ ID NO: 1686170 - RNA, 21 nt, Human
ggcugggcucccuucccaccu

SEQ ID NO: 1686171 - RNA, 11 nt, Human
ggcugggcuuc

SEQ ID NO: 1686172 - RNA, 21 nt, Human
ggcugggcuucaguggcagcu

SEQ ID NO: 1686173 - RNA, 22 nt, Human
ggcugggcuucaguggcagcug

SEQ ID NO: 1686174 - RNA, 16 nt, Human
ggcugggggaagaagc

SEQ ID NO: 1686175 - RNA, 14 nt, Human
ggcugggggccuca

SEQ ID NO: 1686176 - RNA, 18 nt, Human
ggcuggagcuagaauuug

SEQ ID NO: 1686177 - RNA, 21 nt, Human
ggcugcuucaaggauccugag

SEQ ID NO: 1686178 - RNA, 20 nt, Human
ggcugcuucaaggauccuga

SEQ ID NO: 1686179 - RNA, 23 nt, Human
ggcucuggagcccacuguacuug

SEQ ID NO: 1686180 - RNA, 17 nt, Human
ggcucugccucccauca

SEQ ID NO: 1686181 - RNA, 15 nt, Human
ggcugcuucaaggau

SEQ ID NO: 1686182 - RNA, 19 nt, Human
ggcugcuucaaggauccug

SEQ ID NO: 1686183 - RNA, 13 nt, Human
ggcugugccucug

SEQ ID NO: 1686184 - RNA, 16 nt, Human
ggcugugccucugccu

SEQ ID NO: 1686185 - RNA, 14 nt, Human
ggcuguuggcuggg

SEQ ID NO: 1686186 - RNA, 15 nt, Human
ggcuguuggcugggg

SEQ ID NO: 1686187 - RNA, 16 nt, Human
ggcuguuggcuggggg

SEQ ID NO: 1686188 - RNA, 20 nt, Human
ggcuguuggcugggggccuc

SEQ ID NO: 1686189 - RNA, 15 nt, Human
ggcuuaaaacaacac

SEQ ID NO: 1686190 - RNA, 11 nt, Human
ggcuugcugcc

SEQ ID NO: 1686191 - RNA, 17 nt, Human
ggcuuggggaccagagc

SEQ ID NO: 1686192 - RNA, 18 nt, Human
ggcuuggggaccagagcu

SEQ ID NO: 1686193 - RNA, 19 nt, Human
ggcuuggggaccagagcug

SEQ ID NO: 1686194 - RNA, 14 nt, Human
ggcuuagucacuga

SEQ ID NO: 1686195 - RNA, 15 nt, Human
ggcuuagucacugag

SEQ ID NO: 1686196 - RNA, 20 nt, Human
ggcuucacggaagagccuug

SEQ ID NO: 1686197 - RNA, 21 nt, Human
ggcuucacggaagagccuugc

SEQ ID NO: 1686198 - RNA, 12 nt, Human
ggcuucacagau

SEQ ID NO: 1686199 - RNA, 21 nt, Human
gggagccugaucaccugcccu

SEQ ID NO: 1686200 - RNA, 12 nt, Human
gggagcucugca

SEQ ID NO: 1686201 - RNA, 13 nt, Human
gggagcugccugu

SEQ ID NO: 1686202 - RNA, 21 nt, Human
gggagcugccuguucagcucc

SEQ ID NO: 1686203 - RNA, 22 nt, Human
gggagcugccuguucagcucca

SEQ ID NO: 1686204 - RNA, 23 nt, Human
gggaggaucucuugagccuggga

SEQ ID NO: 1686205 - RNA, 22 nt, Human
gggaggauguucugggacacag

SEQ ID NO: 1686206 - RNA, 21 nt, Human
gggaggauugcuugagcucag

SEQ ID NO: 1686207 - RNA, 17 nt, Human
gggaggacgcucucugg

SEQ ID NO: 1686208 - RNA, 20 nt, Human
gggaggacgcucucuggccu

SEQ ID NO: 1686209 - RNA, 21 nt, Human
gggagugaguugauagcacag

SEQ ID NO: 1686210 - RNA, 17 nt, Human
gggagugacagaggcag

SEQ ID NO: 1686211 - RNA, 23 nt, Human
gggaggauugcuugagcucagga

SEQ ID NO: 1686212 - RNA, 20 nt, Human
gggaggugggauccuccagg

SEQ ID NO: 1686213 - RNA, 11 nt, Human
gggaggcagag

SEQ ID NO: 1686214 - RNA, 13 nt, Human
ggcuuuucacugc

SEQ ID NO: 1686215 - RNA, 15 nt, Human
ggcuuuguauagaac

SEQ ID NO: 1686216 - RNA, 14 nt, Human
gggacacccuguga

SEQ ID NO: 1686217 - RNA, 19 nt, Human
gggaauguuugccucugcc

SEQ ID NO: 1686218 - RNA, 21 nt, Human
gggaauguuugccucugccuc

SEQ ID NO: 1686219 - RNA, 14 nt, Human
gggaauugaggaca

SEQ ID NO: 1686220 - RNA, 17 nt, Human
gggacucaaugcacuga

SEQ ID NO: 1686221 - RNA, 19 nt, Human
gggacucaaugcacugaca

SEQ ID NO: 1686222 - RNA, 23 nt, Human
gggacugccagucccccugcccc

SEQ ID NO: 1686223 - RNA, 15 nt, Human
gggacugagaaauuu

SEQ ID NO: 1686224 - RNA, 23 nt, Human
gggacucaaugcacugacauugu

SEQ ID NO: 1686225 - RNA, 21 nt, Human
gggacugaggggaggggagca

SEQ ID NO: 1686226 - RNA, 23 nt, Human
gcuccuggggguucuuucuuccu

SEQ ID NO: 1686227 - RNA, 14 nt, Human
gcuccucccggugc

SEQ ID NO: 1686228 - RNA, 16 nt, Human
gcuccucccggugccc

SEQ ID NO: 1686229 - RNA, 24 nt, Human
gcuccgcuuucuacccagcgagcc

SEQ ID NO: 1686230 - RNA, 20 nt, Human
gcuccuuccucugaggcuga

SEQ ID NO: 1686231 - RNA, 22 nt, Human
gcuccuuccucugaggcugaaa

SEQ ID NO: 1686232 - RNA, 18 nt, Human
gcuccuuccucugaggcu

SEQ ID NO: 1686233 - RNA, 12 nt, Human
gcuccugugucu

SEQ ID NO: 1686234 - RNA, 13 nt, Human
gcuccugugucuu

SEQ ID NO: 1686235 - RNA, 15 nt, Human
gcuccuucuguccua

SEQ ID NO: 1686236 - RNA, 13 nt, Human
gcuccuucugucc

SEQ ID NO: 1686237 - RNA, 17 nt, Human
gcuccuuuagcgcccag

SEQ ID NO: 1686238 - RNA, 19 nt, Human
gcucgagcaugccuggaug

SEQ ID NO: 1686239 - RNA, 21 nt, Human
gcucgagcaugccuggauggg

SEQ ID NO: 1686240 - RNA, 11 nt, Human
gcuccaggagc

SEQ ID NO: 1686241 - RNA, 12 nt, Human
gcuccaggagca

SEQ ID NO: 1686242 - RNA, 14 nt, Human
gcuccaggagcagc

SEQ ID NO: 1686243 - RNA, 21 nt, Human
gcuccagcuguucagcugguu

SEQ ID NO: 1686244 - RNA, 15 nt, Human
gcuccaggagcagcc

SEQ ID NO: 1686245 - RNA, 16 nt, Human
gcuccaggagcagcca

SEQ ID NO: 1686246 - RNA, 17 nt, Human
gcuccaggagcagccac

SEQ ID NO: 1686247 - RNA, 18 nt, Human
gcuccaggagcagccaca

SEQ ID NO: 1686248 - RNA, 12 nt, Human
gcuccaggcucc

SEQ ID NO: 1686249 - RNA, 15 nt, Human
gcucccacaggcccu

SEQ ID NO: 1686250 - RNA, 20 nt, Human
gcucccuucccaccucucuc

SEQ ID NO: 1686251 - RNA, 18 nt, Human
gcuccgcuuucuacccag

SEQ ID NO: 1686252 - RNA, 21 nt, Human
gcuccgcuuucuacccagcga

SEQ ID NO: 1686253 - RNA, 22 nt, Human
gcuccgcuuucuacccagcgag

SEQ ID NO: 1686254 - RNA, 23 nt, Human
gcuccgcuuucuacccagcgagc

SEQ ID NO: 1686255 - RNA, 18 nt, Human
gcucauggacuucugcca

SEQ ID NO: 1686256 - RNA, 17 nt, Human
gcucagcccucccugcc

SEQ ID NO: 1686257 - RNA, 18 nt, Human
gcucagcccucccugccc

SEQ ID NO: 1686258 - RNA, 19 nt, Human
gcucagcccucccugcccc

SEQ ID NO: 1686259 - RNA, 21 nt, Human
gcucagcccucccugccccuc

SEQ ID NO: 1686260 - RNA, 17 nt, Human
gcucagcggggacagcu

SEQ ID NO: 1686261 - RNA, 18 nt, Human
gcucagcggggacagcuc

SEQ ID NO: 1686262 - RNA, 19 nt, Human
gcucagcggggacagcucc

SEQ ID NO: 1686263 - RNA, 23 nt, Human
gcucagcggggacagcuccuucu

SEQ ID NO: 1686264 - RNA, 15 nt, Human
gcucagcccucccug

SEQ ID NO: 1686265 - RNA, 16 nt, Human
gcucagcccucccugc

SEQ ID NO: 1686266 - RNA, 12 nt, Human
gcucagcccucc

SEQ ID NO: 1686267 - RNA, 16 nt, Human
gcucaccucucccuug

SEQ ID NO: 1686268 - RNA, 17 nt, Human
gcucaccucucccuugg

SEQ ID NO: 1686269 - RNA, 18 nt, Human
gcucaccucucccuugga

SEQ ID NO: 1686270 - RNA, 22 nt, Human
gcucacagaacccuuggagcca

SEQ ID NO: 1686271 - RNA, 16 nt, Human
gcucacauaucuguca

SEQ ID NO: 1686272 - RNA, 12 nt, Human
gcucaccagccc

SEQ ID NO: 1686273 - RNA, 13 nt, Human
gcucaccagcccc

SEQ ID NO: 1686274 - RNA, 14 nt, Human
gcucaccagcccca

SEQ ID NO: 1686275 - RNA, 15 nt, Human
gcucaccagccccag

SEQ ID NO: 1686276 - RNA, 18 nt, Human
gcucaccagccccagugc

SEQ ID NO: 1686277 - RNA, 15 nt, Human
gcuaucguaaaauua

SEQ ID NO: 1686278 - RNA, 16 nt, Human
gcuaucguaaaauuaa

SEQ ID NO: 1686279 - RNA, 17 nt, Human
gcuaucguaaaauuaag

SEQ ID NO: 1686280 - RNA, 13 nt, Human
gcuaucuccccca

SEQ ID NO: 1686281 - RNA, 18 nt, Human
gcucaaguccucuuuucu

SEQ ID NO: 1686282 - RNA, 14 nt, Human
gcuaucucccccag

SEQ ID NO: 1686283 - RNA, 15 nt, Human
gcuaucucccccagc

SEQ ID NO: 1686284 - RNA, 19 nt, Human
gcucaaguccucuuuucug

SEQ ID NO: 1686285 - RNA, 22 nt, Human
gcucaaguccucuuuucugaga

SEQ ID NO: 1686286 - RNA, 20 nt, Human
gcuauaacuauguugauaaa

SEQ ID NO: 1686287 - RNA, 21 nt, Human
gcuauaggugcuacaaaaaca

SEQ ID NO: 1686288 - RNA, 19 nt, Human
gcuauaggugcuacaaaaa

SEQ ID NO: 1686289 - RNA, 14 nt, Human
gcuagauguaugua

SEQ ID NO: 1686290 - RNA, 16 nt, Human
gcuagauguauguacu

SEQ ID NO: 1686291 - RNA, 19 nt, Human
gcggugcuaucucccccag

SEQ ID NO: 1686292 - RNA, 22 nt, Human
gcggugcuaucucccccagccc

SEQ ID NO: 1686293 - RNA, 13 nt, Human
gcuagauguaugu

SEQ ID NO: 1686294 - RNA, 21 nt, Human
gcgccuuaaggauguucuagc

SEQ ID NO: 1686295 - RNA, 13 nt, Human
gcgccccuucccc

SEQ ID NO: 1686296 - RNA, 23 nt, Human
gcgcccaguuggguggaugccug

SEQ ID NO: 1686297 - RNA, 16 nt, Human
gcggagaaaggaaggg

SEQ ID NO: 1686298 - RNA, 19 nt, Human
gcggagacggagucccacc

SEQ ID NO: 1686299 - RNA, 14 nt, Human
gcggggacagcucc

SEQ ID NO: 1686300 - RNA, 18 nt, Human
gcgcugccccuggcagcc

SEQ ID NO: 1686301 - RNA, 21 nt, Human
gcgcugccccuggcagccccu

SEQ ID NO: 1686302 - RNA, 18 nt, Human
gcggggacagcuccuucu

SEQ ID NO: 1686303 - RNA, 15 nt, Human
gcggggacagcuccu

SEQ ID NO: 1686304 - RNA, 17 nt, Human
gcggggacagcuccuuc

SEQ ID NO: 1686305 - RNA, 19 nt, Human
gcggugagaggggaacaga

SEQ ID NO: 1686306 - RNA, 13 nt, Human
gcgguccacccag

SEQ ID NO: 1686307 - RNA, 14 nt, Human
gcgguccacccagg

SEQ ID NO: 1686308 - RNA, 15 nt, Human
gccuuacacaauggu

SEQ ID NO: 1686309 - RNA, 16 nt, Human
gccuuacacaaugguu

SEQ ID NO: 1686310 - RNA, 18 nt, Human
gcgcaggcuggcccugcc

SEQ ID NO: 1686311 - RNA, 19 nt, Human
gcgcaggcuggcccugccc

SEQ ID NO: 1686312 - RNA, 17 nt, Human
gcgcaggcuggcccugc

SEQ ID NO: 1686313 - RNA, 20 nt, Human
gcgcaggcuggcccugcccu

SEQ ID NO: 1686314 - RNA, 21 nt, Human
gcgcaggcuggcccugcccug

SEQ ID NO: 1686315 - RNA, 22 nt, Human
gcgcaggcuggcccugcccugg

SEQ ID NO: 1686316 - RNA, 12 nt, Human
gcgacaaugcaa

SEQ ID NO: 1686317 - RNA, 13 nt, Human
gcgacaaugcaaa

SEQ ID NO: 1686318 - RNA, 20 nt, Human
gcgacaaugcaaaccaucau

SEQ ID NO: 1686319 - RNA, 21 nt, Human
gcgacaaugcaaaccaucauu

SEQ ID NO: 1686320 - RNA, 13 nt, Human
gccuggccccuca

SEQ ID NO: 1686321 - RNA, 14 nt, Human
gccuggccccucag

SEQ ID NO: 1686322 - RNA, 18 nt, Human
gccuggcacagggcagug

SEQ ID NO: 1686323 - RNA, 19 nt, Human
gccuggcacagggcagugg

SEQ ID NO: 1686324 - RNA, 12 nt, Human
gccuggcagccg

SEQ ID NO: 1686325 - RNA, 20 nt, Human
gccuggcagccgugccuuca

SEQ ID NO: 1686326 - RNA, 21 nt, Human
gccuggcagccgugccuucag

SEQ ID NO: 1686327 - RNA, 22 nt, Human
gccuggcagccgugccuucagc

SEQ ID NO: 1686328 - RNA, 20 nt, Human
gccuggccagaugcaccagc

SEQ ID NO: 1686329 - RNA, 21 nt, Human
gccuggccagaugcaccagcc

SEQ ID NO: 1686330 - RNA, 22 nt, Human
gccuggccagaugcaccagccc

SEQ ID NO: 1686331 - RNA, 20 nt, Human
gccuguaauccuagcacuuu

SEQ ID NO: 1686332 - RNA, 15 nt, Human
gccuguaauccuagc

SEQ ID NO: 1686333 - RNA, 16 nt, Human
gccuggauggggcugc

SEQ ID NO: 1686334 - RNA, 18 nt, Human
gccuggauggggcugcac

SEQ ID NO: 1686335 - RNA, 13 nt, Human
gccuggcacaggg

SEQ ID NO: 1686336 - RNA, 14 nt, Human
gccuggcacagggc

SEQ ID NO: 1686337 - RNA, 20 nt, Human
gccuggauggggcugcaccg

SEQ ID NO: 1686338 - RNA, 12 nt, Human
gccugagcuggg

SEQ ID NO: 1686339 - RNA, 19 nt, Human
gcccaguuggguggaugcc

SEQ ID NO: 1686340 - RNA, 21 nt, Human
gcccaguuggguggaugccug

SEQ ID NO: 1686341 - RNA, 22 nt, Human
gcccaguuggguggaugccugg

SEQ ID NO: 1686342 - RNA, 16 nt, Human
gccugaagucacacag

SEQ ID NO: 1686343 - RNA, 17 nt, Human
gccugaagucacacagu

SEQ ID NO: 1686344 - RNA, 18 nt, Human
gccugaagucacacagug

SEQ ID NO: 1686345 - RNA, 17 nt, Human
gccugagcgacagugag

SEQ ID NO: 1686346 - RNA, 20 nt, Human
gccugagcgacagugagacu

SEQ ID NO: 1686347 - RNA, 19 nt, Human
gcucuuggcagguacucag

SEQ ID NO: 1686348 - RNA, 19 nt, Human
gcucuugaugccuggcggg

SEQ ID NO: 1686349 - RNA, 14 nt, Human
gcucuugaacuccu

SEQ ID NO: 1686350 - RNA, 16 nt, Human
gcucuugaacuccuga

SEQ ID NO: 1686351 - RNA, 19 nt, Human
gcucuugaacuccugaccu

SEQ ID NO: 1686352 - RNA, 21 nt, Human
gcucuugaacuccugaccuca

SEQ ID NO: 1686353 - RNA, 21 nt, Human
gcucucaggccagcugcuugg

SEQ ID NO: 1686354 - RNA, 22 nt, Human
gcugacuguuuucucuugagag

SEQ ID NO: 1686355 - RNA, 20 nt, Human
gcugacagacacaggcccgg

SEQ ID NO: 1686356 - RNA, 18 nt, Human
gcugacagacacaggccc

SEQ ID NO: 1686357 - RNA, 19 nt, Human
gcugacagacacaggcccg

SEQ ID NO: 1686358 - RNA, 16 nt, Human
gcugagaggagagaga

SEQ ID NO: 1686359 - RNA, 22 nt, Human
gcugcaaaggguaucaggugcu

SEQ ID NO: 1686360 - RNA, 23 nt, Human
gcugcaaaggguaucaggugcug

SEQ ID NO: 1686361 - RNA, 21 nt, Human
gcugauuaaaccaaggcuaga

SEQ ID NO: 1686362 - RNA, 19 nt, Human
gcugcauuuaaaagauaca

SEQ ID NO: 1686363 - RNA, 18 nt, Human
gcugcauuuaaaagauac

SEQ ID NO: 1686364 - RNA, 17 nt, Human
gcugcaguugccaguca

SEQ ID NO: 1686365 - RNA, 13 nt, Human
gcugcaguugcca

SEQ ID NO: 1686366 - RNA, 14 nt, Human
gcugcaguugccag

SEQ ID NO: 1686367 - RNA, 15 nt, Human
gcugccacacuucag

SEQ ID NO: 1686368 - RNA, 17 nt, Human
gcugccacacuucaggc

SEQ ID NO: 1686369 - RNA, 18 nt, Human
gcugccacacuucaggcu

SEQ ID NO: 1686370 - RNA, 21 nt, Human
gcugccacacuucaggcucuu

SEQ ID NO: 1686371 - RNA, 22 nt, Human
gcugccacacuucaggcucuuc

SEQ ID NO: 1686372 - RNA, 23 nt, Human
gcugccacacuucaggcucuucu

SEQ ID NO: 1686373 - RNA, 12 nt, Human
gcugccaccugc

SEQ ID NO: 1686374 - RNA, 13 nt, Human
gcugccaccugcc

SEQ ID NO: 1686375 - RNA, 12 nt, Human
gcugcccucucc

SEQ ID NO: 1686376 - RNA, 14 nt, Human
gcuggcccugcccu

SEQ ID NO: 1686377 - RNA, 15 nt, Human
gcuggcccugcccug

SEQ ID NO: 1686378 - RNA, 16 nt, Human
gcuggcccugcccugg

SEQ ID NO: 1686379 - RNA, 19 nt, Human
gcuggcccuggcucccaca

SEQ ID NO: 1686380 - RNA, 16 nt, Human
gcuggaccuugaacug

SEQ ID NO: 1686381 - RNA, 15 nt, Human
gcuggaccuugaacu

SEQ ID NO: 1686382 - RNA, 16 nt, Human
gcuggcauagagcagc

SEQ ID NO: 1686383 - RNA, 22 nt, Human
gcugcuuuugucuaugggacuc

SEQ ID NO: 1686384 - RNA, 23 nt, Human
gcuggaaugauuucagcucacug

SEQ ID NO: 1686385 - RNA, 21 nt, Human
gcuggaaaaguauguuagugc

SEQ ID NO: 1686386 - RNA, 23 nt, Human
gcuggaaaaguauguuagugcaa

SEQ ID NO: 1686387 - RNA, 17 nt, Human
gcugcccuggugcugcc

SEQ ID NO: 1686388 - RNA, 15 nt, Human
gcugccuuagaaccu

SEQ ID NO: 1686389 - RNA, 20 nt, Human
gcugccuuagaaccuuucuu

SEQ ID NO: 1686390 - RNA, 20 nt, Human
gcugccuguucagcuccagc

SEQ ID NO: 1686391 - RNA, 22 nt, Human
gcugccuguucagcuccagcuc

SEQ ID NO: 1686392 - RNA, 12 nt, Human
gcugcccuggug

SEQ ID NO: 1686393 - RNA, 13 nt, Human
gcugcccuggugc

SEQ ID NO: 1686394 - RNA, 14 nt, Human
gcugcccuggugcu

SEQ ID NO: 1686395 - RNA, 15 nt, Human
gcugcccuggugcug

SEQ ID NO: 1686396 - RNA, 18 nt, Human
gcugccuguucagcucca

SEQ ID NO: 1686397 - RNA, 19 nt, Human
gcugccuguucagcuccag

SEQ ID NO: 1686398 - RNA, 14 nt, Human
gcugcgguccaccc

SEQ ID NO: 1686399 - RNA, 15 nt, Human
gcugcgguccaccca

SEQ ID NO: 1686400 - RNA, 22 nt, Human
gcugcgguccacccaggagccc

SEQ ID NO: 1686401 - RNA, 16 nt, Human
gcugcgguccacccag

SEQ ID NO: 1686402 - RNA, 21 nt, Human
gcugcgguccacccaggagcc

SEQ ID NO: 1686403 - RNA, 16 nt, Human
gcugcccugcccaccu

SEQ ID NO: 1686404 - RNA, 18 nt, Human
gcugcccugcccaccugg

SEQ ID NO: 1686405 - RNA, 20 nt, Human
gcugcccugcccaccuggcc

SEQ ID NO: 1686406 - RNA, 21 nt, Human
gcugcccugcccaccuggccu

SEQ ID NO: 1686407 - RNA, 22 nt, Human
gcugcccugcccaccuggccuc

SEQ ID NO: 1686408 - RNA, 23 nt, Human
gcugcccugcccaccuggccucu

SEQ ID NO: 1686409 - RNA, 24 nt, Human
gcugcccugcccaccuggccucug

SEQ ID NO: 1686410 - RNA, 22 nt, Human
gcugcccucuccugggcagcug

SEQ ID NO: 1686411 - RNA, 20 nt, Human
gcugcccucuccugggcagc

SEQ ID NO: 1686412 - RNA, 18 nt, Human
gcugcccucuccugggca

SEQ ID NO: 1686413 - RNA, 17 nt, Human
gcugcccucuccugggc

SEQ ID NO: 1686414 - RNA, 16 nt, Human
gcugcccucuccuggg

SEQ ID NO: 1686415 - RNA, 15 nt, Human
gcugcccucuccugg

SEQ ID NO: 1686416 - RNA, 14 nt, Human
gcugcccucuccug

SEQ ID NO: 1686417 - RNA, 13 nt, Human
gcugcccucuccu

SEQ ID NO: 1686418 - RNA, 13 nt, Human
gcugcccugccca

SEQ ID NO: 1686419 - RNA, 14 nt, Human
gcugcccugcccac

SEQ ID NO: 1686420 - RNA, 12 nt, Human
gcugcccugccc

SEQ ID NO: 1686421 - RNA, 23 nt, Human
gcugcccucuccugggcagcugc

SEQ ID NO: 1686422 - RNA, 19 nt, Human
gcuucaguggcagcugcuu

SEQ ID NO: 1686423 - RNA, 20 nt, Human
gcuucaguggcagcugcuuu

SEQ ID NO: 1686424 - RNA, 13 nt, Human
gcuuaucucaggg

SEQ ID NO: 1686425 - RNA, 22 nt, Human
gcuucucacugccaugccagcu

SEQ ID NO: 1686426 - RNA, 17 nt, Human
gcuucuguugcugccuc

SEQ ID NO: 1686427 - RNA, 18 nt, Human
gcuucuguugcugccuca

SEQ ID NO: 1686428 - RNA, 19 nt, Human
gcuucuguugcugccucau

SEQ ID NO: 1686429 - RNA, 19 nt, Human
gcuucuguuuuauaauuuu

SEQ ID NO: 1686430 - RNA, 12 nt, Human
gcuuuguauaga

SEQ ID NO: 1686431 - RNA, 13 nt, Human
gcuuuguauagaa

SEQ ID NO: 1686432 - RNA, 19 nt, Human
gcuuugggcugcccuggug

SEQ ID NO: 1686433 - RNA, 14 nt, Human
gcuuuguauagaac

SEQ ID NO: 1686434 - RNA, 20 nt, Human
gcuuuguauagaaccucuuu

SEQ ID NO: 1686435 - RNA, 13 nt, Human
gcuuuuaugugaa

SEQ ID NO: 1686436 - RNA, 15 nt, Human
gcuuuuaugugaaac

SEQ ID NO: 1686437 - RNA, 15 nt, Human
gcuuguuuccuagca

SEQ ID NO: 1686438 - RNA, 23 nt, Human
gcuuguuuccuagcacacacuuu

SEQ ID NO: 1686439 - RNA, 22 nt, Human
gcuuuaaacauugguucuugua

SEQ ID NO: 1686440 - RNA, 21 nt, Human
gcugggcuucaguggcagcug

SEQ ID NO: 1686441 - RNA, 22 nt, Human
gcugggcuucaguggcagcugc

SEQ ID NO: 1686442 - RNA, 21 nt, Human
gcugggaugauuggagggggg

SEQ ID NO: 1686443 - RNA, 20 nt, Human
gcugggcuucaguggcagcu

SEQ ID NO: 1686444 - RNA, 19 nt, Human
gcugggaugauuggagggg

SEQ ID NO: 1686445 - RNA, 21 nt, Human
gcugggcucccuucccaccuc

SEQ ID NO: 1686446 - RNA, 13 nt, Human
gcuggccuggccc

SEQ ID NO: 1686447 - RNA, 12 nt, Human
gcuggccuggcc

SEQ ID NO: 1686448 - RNA, 14 nt, Human
gcuggccuggcccc

SEQ ID NO: 1686449 - RNA, 15 nt, Human
gcuggccuggccccu

SEQ ID NO: 1686450 - RNA, 14 nt, Human
gcugggggccucag

SEQ ID NO: 1686451 - RNA, 15 nt, Human
gcugggggccucagu

SEQ ID NO: 1686452 - RNA, 18 nt, Human
gcugggggccucagugcc

SEQ ID NO: 1686453 - RNA, 19 nt, Human
gcuggucucgaacuccuga

SEQ ID NO: 1686454 - RNA, 22 nt, Human
gcuggucucgaacuccugaccu

SEQ ID NO: 1686455 - RNA, 23 nt, Human
gcuggucucgaacuccugaccuu

SEQ ID NO: 1686456 - RNA, 14 nt, Human
gcuggucccacuca

SEQ ID NO: 1686457 - RNA, 23 nt, Human
gcuggucccagccagcaguucag

SEQ ID NO: 1686458 - RNA, 13 nt, Human
gcugucaucucag

SEQ ID NO: 1686459 - RNA, 16 nt, Human
gcuggugucaccugaa

SEQ ID NO: 1686460 - RNA, 17 nt, Human
gcugucagccauuccug

SEQ ID NO: 1686461 - RNA, 21 nt, Human
gcugguguaugugugaaguga

SEQ ID NO: 1686462 - RNA, 14 nt, Human
gcuggugucaccug

SEQ ID NO: 1686463 - RNA, 15 nt, Human
gcuggugucaccuga

SEQ ID NO: 1686464 - RNA, 23 nt, Human
gcugucccuuacgugaguccugg

SEQ ID NO: 1686465 - RNA, 16 nt, Human
gcugucccuuuuccuu

SEQ ID NO: 1686466 - RNA, 16 nt, Human
gcuguguggcagucug

SEQ ID NO: 1686467 - RNA, 15 nt, Human
gcugugucucccuuc

SEQ ID NO: 1686468 - RNA, 16 nt, Human
gccacaagacccuugu

SEQ ID NO: 1686469 - RNA, 22 nt, Human
gccacaagacccuugugguccc

SEQ ID NO: 1686470 - RNA, 23 nt, Human
gccacagagaaaguacuucucca

SEQ ID NO: 1686471 - RNA, 20 nt, Human
gccacacuucaggcucuucu

SEQ ID NO: 1686472 - RNA, 22 nt, Human
gccacacuucaggcucuucucc

SEQ ID NO: 1686473 - RNA, 23 nt, Human
gccacacuucaggcucuucuccu

SEQ ID NO: 1686474 - RNA, 13 nt, Human
gccacagagaaag

SEQ ID NO: 1686475 - RNA, 14 nt, Human
gccacagagaaagu

SEQ ID NO: 1686476 - RNA, 20 nt, Human
gccacagagaaaguacuucu

SEQ ID NO: 1686477 - RNA, 20 nt, Human
gccaauaauaauaccucccu

SEQ ID NO: 1686478 - RNA, 16 nt, Human
gccaauggagacuguc

SEQ ID NO: 1686479 - RNA, 19 nt, Human
gccaauggagacugucuca

SEQ ID NO: 1686480 - RNA, 21 nt, Human
gccaauggagacugucucaag

SEQ ID NO: 1686481 - RNA, 14 nt, Human
gccaaggugggagg

SEQ ID NO: 1686482 - RNA, 15 nt, Human
gccaaggugggagga

SEQ ID NO: 1686483 - RNA, 23 nt, Human
gccaaggugggaggauugcuuga

SEQ ID NO: 1686484 - RNA, 23 nt, Human
gcauuuggugguuucagaaaugu

SEQ ID NO: 1686485 - RNA, 22 nt, Human
gcauuuggugguuucagaaaug

SEQ ID NO: 1686486 - RNA, 20 nt, Human
gcauuugaggucuguucuuu

SEQ ID NO: 1686487 - RNA, 19 nt, Human
gcauuugaggucuguucuu

SEQ ID NO: 1686488 - RNA, 21 nt, Human
gcauuugaggucuguucuuuc

SEQ ID NO: 1686489 - RNA, 12 nt, Human
gcauuugugaaa

SEQ ID NO: 1686490 - RNA, 21 nt, Human
gccaaggcugggggaagaagc

SEQ ID NO: 1686491 - RNA, 11 nt, Human
gccaccugggu

SEQ ID NO: 1686492 - RNA, 22 nt, Human
gccaccugcggugcuaucuccc

SEQ ID NO: 1686493 - RNA, 14 nt, Human
gccaccugcggugc

SEQ ID NO: 1686494 - RNA, 20 nt, Human
gccaccugcggugcuaucuc

SEQ ID NO: 1686495 - RNA, 19 nt, Human
gccacggccaggccagagg

SEQ ID NO: 1686496 - RNA, 20 nt, Human
gccacgcccaacuaauuuuu

SEQ ID NO: 1686497 - RNA, 18 nt, Human
gccacggccaggccagag

SEQ ID NO: 1686498 - RNA, 17 nt, Human
gccaccgugccuggcca

SEQ ID NO: 1686499 - RNA, 22 nt, Human
gccaccgugccuggccacgccc

SEQ ID NO: 1686500 - RNA, 17 nt, Human
gccaccugccuguuggg

SEQ ID NO: 1686501 - RNA, 12 nt, Human
gccagaggagag

SEQ ID NO: 1686502 - RNA, 13 nt, Human
gccagaggagaga

SEQ ID NO: 1686503 - RNA, 15 nt, Human
gccagaggagagagg

SEQ ID NO: 1686504 - RNA, 17 nt, Human
gccagaggagagaggac

SEQ ID NO: 1686505 - RNA, 19 nt, Human
gccagaggagagaggaccc

SEQ ID NO: 1686506 - RNA, 22 nt, Human
gccagaggagagaggacccccu

SEQ ID NO: 1686507 - RNA, 21 nt, Human
gccagagggagugacagaggc

SEQ ID NO: 1686508 - RNA, 22 nt, Human
gccagagggagugacagaggca

SEQ ID NO: 1686509 - RNA, 23 nt, Human
gccagagggagugacagaggcag

SEQ ID NO: 1686510 - RNA, 16 nt, Human
gccagaugcaccagcc

SEQ ID NO: 1686511 - RNA, 17 nt, Human
gccagaugcaccagccc

SEQ ID NO: 1686512 - RNA, 18 nt, Human
gccagaugcaccagcccu

SEQ ID NO: 1686513 - RNA, 20 nt, Human
gccagagacacaagccuucg

SEQ ID NO: 1686514 - RNA, 10 nt, Human
gccagaggag

SEQ ID NO: 1686515 - RNA, 17 nt, Human
gccagagacacaagccu

SEQ ID NO: 1686516 - RNA, 19 nt, Human
gccagagacacaagccuuc

SEQ ID NO: 1686517 - RNA, 16 nt, Human
gccagagacacaagcc

SEQ ID NO: 1686518 - RNA, 19 nt, Human
gccagacuggcacaguuuu

SEQ ID NO: 1686519 - RNA, 20 nt, Human
gccacuauuguuagucucuu

SEQ ID NO: 1686520 - RNA, 15 nt, Human
gccagacuggcacag

SEQ ID NO: 1686521 - RNA, 18 nt, Human
gccagacuggcacaguuu

SEQ ID NO: 1686522 - RNA, 21 nt, Human
gcccaaugcacuuuguucugg

SEQ ID NO: 1686523 - RNA, 15 nt, Human
gcccagagagggugg

SEQ ID NO: 1686524 - RNA, 12 nt, Human
gcccagagggcc

SEQ ID NO: 1686525 - RNA, 14 nt, Human
gcccagagggccug

SEQ ID NO: 1686526 - RNA, 15 nt, Human
gcccagagggccugc

SEQ ID NO: 1686527 - RNA, 18 nt, Human
gcccagagggccugcaag

SEQ ID NO: 1686528 - RNA, 19 nt, Human
gcccagagggccugcaagg

SEQ ID NO: 1686529 - RNA, 22 nt, Human
gcccagagggccugcaagggag

SEQ ID NO: 1686530 - RNA, 20 nt, Human
gcccagagggccugcaaggg

SEQ ID NO: 1686531 - RNA, 21 nt, Human
gcccagagggccugcaaggga

SEQ ID NO: 1686532 - RNA, 9 nt, Human
gcccagccc

SEQ ID NO: 1686533 - RNA, 11 nt, Human
gcccagccccu

SEQ ID NO: 1686534 - RNA, 12 nt, Human
gcccagccccuu

SEQ ID NO: 1686535 - RNA, 21 nt, Human
gcccagcuugaaaccuucacu

SEQ ID NO: 1686536 - RNA, 20 nt, Human
gcccagccccuucugaccca

SEQ ID NO: 1686537 - RNA, 24 nt, Human
gcccagccccuucugacccaugcu

SEQ ID NO: 1686538 - RNA, 13 nt, Human
gcccagccccuuc

SEQ ID NO: 1686539 - RNA, 14 nt, Human
gcccagccccuucu

SEQ ID NO: 1686540 - RNA, 16 nt, Human
gcccagccccuucuga

SEQ ID NO: 1686541 - RNA, 17 nt, Human
gcccagccccuucugac

SEQ ID NO: 1686542 - RNA, 22 nt, Human
gcccaggcuggcgugcaguggu

SEQ ID NO: 1686543 - RNA, 19 nt, Human
gcccaggcuggcgugcagu

SEQ ID NO: 1686544 - RNA, 20 nt, Human
gcccaggcuggcgugcagug

SEQ ID NO: 1686545 - RNA, 18 nt, Human
gcccaggaaaggcuccag

SEQ ID NO: 1686546 - RNA, 19 nt, Human
gcccaggaaaggcuccagg

SEQ ID NO: 1686547 - RNA, 20 nt, Human
gcccaggaaaggcuccagga

SEQ ID NO: 1686548 - RNA, 21 nt, Human
gcccaggaaaggcuccaggag

SEQ ID NO: 1686549 - RNA, 23 nt, Human
gcccaggcuuagucacugagaca

SEQ ID NO: 1686550 - RNA, 19 nt, Human
gcccaggcuuagucacuga

SEQ ID NO: 1686551 - RNA, 21 nt, Human
gcccaggcuuagucacugaga

SEQ ID NO: 1686552 - RNA, 19 nt, Human
gcccagucuggaaugcagu

SEQ ID NO: 1686553 - RNA, 20 nt, Human
gcccagucuggaaugcagug

SEQ ID NO: 1686554 - RNA, 19 nt, Human
gccaugccagcuuaucuca

SEQ ID NO: 1686555 - RNA, 13 nt, Human
gccaugccagcuu

SEQ ID NO: 1686556 - RNA, 18 nt, Human
gccaugccagcuuaucuc

SEQ ID NO: 1686557 - RNA, 18 nt, Human
gccaugaggaacaaggca

SEQ ID NO: 1686558 - RNA, 20 nt, Human
gccaugaggaacaaggcaag

SEQ ID NO: 1686559 - RNA, 19 nt, Human
gccaucucaccuccugcug

SEQ ID NO: 1686560 - RNA, 20 nt, Human
gccaucucaccuccugcugg

SEQ ID NO: 1686561 - RNA, 21 nt, Human
gccaucucaccuccugcuggg

SEQ ID NO: 1686562 - RNA, 14 nt, Human
gcccaaccugcucu

SEQ ID NO: 1686563 - RNA, 15 nt, Human
gcccaaagaugcagc

SEQ ID NO: 1686564 - RNA, 23 nt, Human
gccaugggacagggaggacgcuc

SEQ ID NO: 1686565 - RNA, 12 nt, Human
gccaguaaaugg

SEQ ID NO: 1686566 - RNA, 17 nt, Human
gccagguuuuuggucug

SEQ ID NO: 1686567 - RNA, 21 nt, Human
gccagucaccccggccaccug

SEQ ID NO: 1686568 - RNA, 20 nt, Human
gccagucaccccggccaccu

SEQ ID NO: 1686569 - RNA, 17 nt, Human
gccagucaccccggcca

SEQ ID NO: 1686570 - RNA, 18 nt, Human
gccagucaccccggccac

SEQ ID NO: 1686571 - RNA, 22 nt, Human
gccaggcuggucucgaacuccu

SEQ ID NO: 1686572 - RNA, 13 nt, Human
gccagggacagag

SEQ ID NO: 1686573 - RNA, 16 nt, Human
gccagggacagagggg

SEQ ID NO: 1686574 - RNA, 18 nt, Human
gccagggacagagggggu

SEQ ID NO: 1686575 - RNA, 23 nt, Human
gccagggacagaggggguggccu

SEQ ID NO: 1686576 - RNA, 16 nt, Human
gccagauuucacucuc

SEQ ID NO: 1686577 - RNA, 18 nt, Human
gccagauuucacucuccu

SEQ ID NO: 1686578 - RNA, 21 nt, Human
gccagauuucacucuccuugg

SEQ ID NO: 1686579 - RNA, 22 nt, Human
gccaggcugcucuugaacuccu

SEQ ID NO: 1686580 - RNA, 13 nt, Human
gccaggcuggguc

SEQ ID NO: 1686581 - RNA, 13 nt, Human
gccaggcugcucu

SEQ ID NO: 1686582 - RNA, 14 nt, Human
gccaggcugcucuu

SEQ ID NO: 1686583 - RNA, 19 nt, Human
gccagauuuuccugaaaac

SEQ ID NO: 1686584 - RNA, 18 nt, Human
gcagcucagagagggugg

SEQ ID NO: 1686585 - RNA, 19 nt, Human
gcagcucagagaggguggg

SEQ ID NO: 1686586 - RNA, 16 nt, Human
gcagcucaccucuccc

SEQ ID NO: 1686587 - RNA, 17 nt, Human
gcagcucaccucucccu

SEQ ID NO: 1686588 - RNA, 20 nt, Human
gcagcucaccucucccuugg

SEQ ID NO: 1686589 - RNA, 21 nt, Human
gcagcucaccucucccuugga

SEQ ID NO: 1686590 - RNA, 14 nt, Human
gcagcucagagagg

SEQ ID NO: 1686591 - RNA, 24 nt, Human
gcagcccugcuuugggcugcccug

SEQ ID NO: 1686592 - RNA, 14 nt, Human
gcagcccugcuuug

SEQ ID NO: 1686593 - RNA, 20 nt, Human
gcagcagggagggcuucugc

SEQ ID NO: 1686594 - RNA, 18 nt, Human
gcagcagggagggcuucu

SEQ ID NO: 1686595 - RNA, 19 nt, Human
gcagcagggagggcuucug

SEQ ID NO: 1686596 - RNA, 15 nt, Human
gcagccucacagucc

SEQ ID NO: 1686597 - RNA, 17 nt, Human
gcagccucacaguccuu

SEQ ID NO: 1686598 - RNA, 19 nt, Human
gcagccucacaguccuuac

SEQ ID NO: 1686599 - RNA, 22 nt, Human
gcagagaccaucccugaaggcc

SEQ ID NO: 1686600 - RNA, 20 nt, Human
gcagagaccaucccugaagg

SEQ ID NO: 1686601 - RNA, 21 nt, Human
gcagagaccaucccugaaggc

SEQ ID NO: 1686602 - RNA, 22 nt, Human
gcacuucgggaggucgaggcag

SEQ ID NO: 1686603 - RNA, 14 nt, Human
gcacuugcagacuc

SEQ ID NO: 1686604 - RNA, 16 nt, Human
gcacuugcagacucua

SEQ ID NO: 1686605 - RNA, 17 nt, Human
gcagacucuacagaggc

SEQ ID NO: 1686606 - RNA, 18 nt, Human
gcagacucuacagaggcc

SEQ ID NO: 1686607 - RNA, 19 nt, Human
gcagacucuacagaggcca

SEQ ID NO: 1686608 - RNA, 22 nt, Human
gcagacucuacagaggccaugg

SEQ ID NO: 1686609 - RNA, 13 nt, Human
gcagauuauucac

SEQ ID NO: 1686610 - RNA, 16 nt, Human
gcagauuauucacuga

SEQ ID NO: 1686611 - RNA, 18 nt, Human
gcagauguccuugaugcu

SEQ ID NO: 1686612 - RNA, 18 nt, Human
gcagauggagaccccuug

SEQ ID NO: 1686613 - RNA, 23 nt, Human
gcagagguugcagugagccgaga

SEQ ID NO: 1686614 - RNA, 21 nt, Human
gcagagguccacaacacacag

SEQ ID NO: 1686615 - RNA, 18 nt, Human
gcagagguugcagugagc

SEQ ID NO: 1686616 - RNA, 12 nt, Human
gcacugggcuug

SEQ ID NO: 1686617 - RNA, 19 nt, Human
gcacuguuuuauuuuaauu

SEQ ID NO: 1686618 - RNA, 14 nt, Human
gcacugggcuuggg

SEQ ID NO: 1686619 - RNA, 22 nt, Human
gcacuauaauguaagcucuacu

SEQ ID NO: 1686620 - RNA, 20 nt, Human
gcacuauaauguaagcucua

SEQ ID NO: 1686621 - RNA, 14 nt, Human
gcacuauaauguaa

SEQ ID NO: 1686622 - RNA, 15 nt, Human
gcacuauaauguaag

SEQ ID NO: 1686623 - RNA, 12 nt, Human
gcacugcuucca

SEQ ID NO: 1686624 - RNA, 13 nt, Human
gcacugcuuccag

SEQ ID NO: 1686625 - RNA, 14 nt, Human
gcacugcuuccagu

SEQ ID NO: 1686626 - RNA, 15 nt, Human
gcacugcuuccagug

SEQ ID NO: 1686627 - RNA, 16 nt, Human
gcacccucaggcaggu

SEQ ID NO: 1686628 - RNA, 19 nt, Human
gcacccucaggcagguggg

SEQ ID NO: 1686629 - RNA, 14 nt, Human
gcacgugugugcac

SEQ ID NO: 1686630 - RNA, 20 nt, Human
gcacuaaggugugcucugau

SEQ ID NO: 1686631 - RNA, 17 nt, Human
gcaccaucucuccuccu

SEQ ID NO: 1686632 - RNA, 14 nt, Human
gcaccagcagccug

SEQ ID NO: 1686633 - RNA, 13 nt, Human
gcaccagcagccu

SEQ ID NO: 1686634 - RNA, 14 nt, Human
gcaccaucucuccu

SEQ ID NO: 1686635 - RNA, 15 nt, Human
gcaccaucucuccuc

SEQ ID NO: 1686636 - RNA, 20 nt, Human
gauugugucucuugguccug

SEQ ID NO: 1686637 - RNA, 15 nt, Human
gcacagccucuuaga

SEQ ID NO: 1686638 - RNA, 16 nt, Human
gcacagggcaguggga

SEQ ID NO: 1686639 - RNA, 23 nt, Human
gcacagcuucauuuccugugucu

SEQ ID NO: 1686640 - RNA, 18 nt, Human
gcacagccucuuagaugc

SEQ ID NO: 1686641 - RNA, 18 nt, Human
gcauuugaggucuguucu

SEQ ID NO: 1686642 - RNA, 22 nt, Human
gcauuccccaggaggccagccu

SEQ ID NO: 1686643 - RNA, 14 nt, Human
gcauuccccaggag

SEQ ID NO: 1686644 - RNA, 15 nt, Human
gcauuccccaggagg

SEQ ID NO: 1686645 - RNA, 16 nt, Human
gcauuccccaggaggc

SEQ ID NO: 1686646 - RNA, 17 nt, Human
gcauuccccaggaggcc

SEQ ID NO: 1686647 - RNA, 18 nt, Human
gcauuccccaggaggcca

SEQ ID NO: 1686648 - RNA, 19 nt, Human
gcauuccccaggaggccag

SEQ ID NO: 1686649 - RNA, 20 nt, Human
gcauuccccaggaggccagc

SEQ ID NO: 1686650 - RNA, 21 nt, Human
gcauuccccaggaggccagcc

SEQ ID NO: 1686651 - RNA, 24 nt, Human
gcauuaucuagauacuguaucaug

SEQ ID NO: 1686652 - RNA, 22 nt, Human
gcauuaucuagauacuguauca

SEQ ID NO: 1686653 - RNA, 15 nt, Human
gcaugccuggauggg

SEQ ID NO: 1686654 - RNA, 13 nt, Human
gcauguuacauaa

SEQ ID NO: 1686655 - RNA, 14 nt, Human
gcauguucucugag

SEQ ID NO: 1686656 - RNA, 14 nt, Human
gcaugccuggaugg

SEQ ID NO: 1686657 - RNA, 15 nt, Human
gcaucucagcccaca

SEQ ID NO: 1686658 - RNA, 22 nt, Human
gcaugaaguaauaugcacacau

SEQ ID NO: 1686659 - RNA, 21 nt, Human
gcaugaaguaauaugcacaca

SEQ ID NO: 1686660 - RNA, 20 nt, Human
gcaugaaguaauaugcacac

SEQ ID NO: 1686661 - RNA, 23 nt, Human
gcaugaaguaauaugcacacauu

SEQ ID NO: 1686662 - RNA, 21 nt, Human
gcaugacacgaauauugcuga

SEQ ID NO: 1686663 - RNA, 22 nt, Human
gcaugacacgaauauugcugau

SEQ ID NO: 1686664 - RNA, 12 nt, Human
gcaucucagccc

SEQ ID NO: 1686665 - RNA, 13 nt, Human
gcaucucagccca

SEQ ID NO: 1686666 - RNA, 14 nt, Human
gcaucucagcccac

SEQ ID NO: 1686667 - RNA, 23 nt, Human
gcaucagugcccuccaggauaga

SEQ ID NO: 1686668 - RNA, 15 nt, Human
gcaucagugcccucc

SEQ ID NO: 1686669 - RNA, 23 nt, Human
gcaucaggccaggcccucugccc

SEQ ID NO: 1686670 - RNA, 18 nt, Human
gcaucaggccaggcccuc

SEQ ID NO: 1686671 - RNA, 13 nt, Human
gcaucaggccagg

SEQ ID NO: 1686672 - RNA, 12 nt, Human
gcaucaggccag

SEQ ID NO: 1686673 - RNA, 23 nt, Human
gcaucagcugcugaaacaacaaa

SEQ ID NO: 1686674 - RNA, 22 nt, Human
gcaucagcugcugaaacaacaa

SEQ ID NO: 1686675 - RNA, 18 nt, Human
gcaggcagccaggccaca

SEQ ID NO: 1686676 - RNA, 17 nt, Human
gcaggcagccaggccac

SEQ ID NO: 1686677 - RNA, 14 nt, Human
gcaggucccuaaua

SEQ ID NO: 1686678 - RNA, 15 nt, Human
gcaggucccuaauaa

SEQ ID NO: 1686679 - RNA, 19 nt, Human
gcaggguccuagaaauucc

SEQ ID NO: 1686680 - RNA, 16 nt, Human
gcagggucucacucug

SEQ ID NO: 1686681 - RNA, 22 nt, Human
gcaggggaggguagagcggaga

SEQ ID NO: 1686682 - RNA, 16 nt, Human
gcaggucccuaauaaa

SEQ ID NO: 1686683 - RNA, 17 nt, Human
gcaggucccuaauaaag

SEQ ID NO: 1686684 - RNA, 18 nt, Human
gcaggucccuaauaaagc

SEQ ID NO: 1686685 - RNA, 19 nt, Human
gcaggucccuaauaaagcu

SEQ ID NO: 1686686 - RNA, 20 nt, Human
gcaggucccuaauaaagcug

SEQ ID NO: 1686687 - RNA, 21 nt, Human
gcaggucccuaauaaagcugu

SEQ ID NO: 1686688 - RNA, 23 nt, Human
gcaggucccuaauaaagcugugu

SEQ ID NO: 1686689 - RNA, 21 nt, Human
gcagugggacagggcauggcc

SEQ ID NO: 1686690 - RNA, 11 nt, Human
gcagugggagc

SEQ ID NO: 1686691 - RNA, 12 nt, Human
gcagugggagcu

SEQ ID NO: 1686692 - RNA, 18 nt, Human
gcaguggugcgaucuggg

SEQ ID NO: 1686693 - RNA, 19 nt, Human
gcaguggugcgaucugggu

SEQ ID NO: 1686694 - RNA, 19 nt, Human
gcaguggugguuuucuguu

SEQ ID NO: 1686695 - RNA, 22 nt, Human
gcaguggugcgaucuggguuca

SEQ ID NO: 1686696 - RNA, 20 nt, Human
gcaguggugcgaucuggguu

SEQ ID NO: 1686697 - RNA, 21 nt, Human
gcaguggugcgaucuggguuc

SEQ ID NO: 1686698 - RNA, 21 nt, Human
gcaguggugguuuucuguucu

SEQ ID NO: 1686699 - RNA, 20 nt, Human
gcaguggugguuuucuguuc

SEQ ID NO: 1686700 - RNA, 23 nt, Human
gcaguucagagcugcccucuccu

SEQ ID NO: 1686701 - RNA, 22 nt, Human
gcaguucagagcugcccucucc

SEQ ID NO: 1686702 - RNA, 20 nt, Human
gcaguucagagcugcccucu

SEQ ID NO: 1686703 - RNA, 19 nt, Human
gcaguucagagcugcccuc

SEQ ID NO: 1686704 - RNA, 22 nt, Human
gcaguggugguuuucuguucuu

SEQ ID NO: 1686705 - RNA, 16 nt, Human
gcaguugaaaagacuc

SEQ ID NO: 1686706 - RNA, 19 nt, Human
gcaguugaaaagacuccaa

SEQ ID NO: 1686707 - RNA, 19 nt, Human
gcauacguacacauuuuau

SEQ ID NO: 1686708 - RNA, 21 nt, Human
gcaguugaaaagacuccaaag

SEQ ID NO: 1686709 - RNA, 16 nt, Human
gaguacguugugcauu

SEQ ID NO: 1686710 - RNA, 19 nt, Human
gagguuuuaaaaaaauccc

SEQ ID NO: 1686711 - RNA, 19 nt, Human
gagguucaaagauauuuug

SEQ ID NO: 1686712 - RNA, 14 nt, Human
gagguucccuuuga

SEQ ID NO: 1686713 - RNA, 20 nt, Human
gaguacguugugcauuuggu

SEQ ID NO: 1686714 - RNA, 15 nt, Human
gaguacuacaguccu

SEQ ID NO: 1686715 - RNA, 18 nt, Human
gaguacguugugcauuug

SEQ ID NO: 1686716 - RNA, 17 nt, Human
gaguacguugugcauuu

SEQ ID NO: 1686717 - RNA, 18 nt, Human
gaguacuacaguccuccc

SEQ ID NO: 1686718 - RNA, 19 nt, Human
gaguacuacaguccuccca

SEQ ID NO: 1686719 - RNA, 22 nt, Human
gaggggggaggugggauccucc

SEQ ID NO: 1686720 - RNA, 18 nt, Human
gagguccacaacacacag

SEQ ID NO: 1686721 - RNA, 15 nt, Human
gaggggguggccucc

SEQ ID NO: 1686722 - RNA, 15 nt, Human
gaggggggagguggg

SEQ ID NO: 1686723 - RNA, 21 nt, Human
gaggugggauccuccaggugc

SEQ ID NO: 1686724 - RNA, 22 nt, Human
gaggugggauccuccaggugca

SEQ ID NO: 1686725 - RNA, 18 nt, Human
gaggugggauccuccagg

SEQ ID NO: 1686726 - RNA, 14 nt, Human
gagucucuucucca

SEQ ID NO: 1686727 - RNA, 15 nt, Human
gagucucuucuccac

SEQ ID NO: 1686728 - RNA, 16 nt, Human
gagucucuucuccacu

SEQ ID NO: 1686729 - RNA, 17 nt, Human
gagucucuucuccacug

SEQ ID NO: 1686730 - RNA, 18 nt, Human
gagucucuucuccacugg

SEQ ID NO: 1686731 - RNA, 21 nt, Human
gagucugaaggcuggguucug

SEQ ID NO: 1686732 - RNA, 23 nt, Human
gagucucgcuauugucaccaggg

SEQ ID NO: 1686733 - RNA, 12 nt, Human
gagucucuucuc

SEQ ID NO: 1686734 - RNA, 22 nt, Human
gagucucacuguugcccaggcu

SEQ ID NO: 1686735 - RNA, 23 nt, Human
gagucucacuguugcccaggcug

SEQ ID NO: 1686736 - RNA, 19 nt, Human
gagucucacuguugcccag

SEQ ID NO: 1686737 - RNA, 20 nt, Human
gagucucacuguugcccagg

SEQ ID NO: 1686738 - RNA, 21 nt, Human
gagucucacuguugcccaggc

SEQ ID NO: 1686739 - RNA, 17 nt, Human
gagucgaggacagggag

SEQ ID NO: 1686740 - RNA, 14 nt, Human
gaguccccuguuug

SEQ ID NO: 1686741 - RNA, 23 nt, Human
gaguccccuguuuguuucugaaa

SEQ ID NO: 1686742 - RNA, 18 nt, Human
gagucccaggcugagccu

SEQ ID NO: 1686743 - RNA, 19 nt, Human
gagucccaggcugagccuc

SEQ ID NO: 1686744 - RNA, 12 nt, Human
gaguccccuguu

SEQ ID NO: 1686745 - RNA, 12 nt, Human
gaguagcuggga

SEQ ID NO: 1686746 - RNA, 14 nt, Human
gaguagcugggacu

SEQ ID NO: 1686747 - RNA, 17 nt, Human
gagugugccugaagucc

SEQ ID NO: 1686748 - RNA, 23 nt, Human
gaguucaucuugaauuguaagga

SEQ ID NO: 1686749 - RNA, 14 nt, Human
gaguugaagacaga

SEQ ID NO: 1686750 - RNA, 21 nt, Human
gaguugaaaaucuuauaauuu

SEQ ID NO: 1686751 - RNA, 13 nt, Human
gaguggcuccucc

SEQ ID NO: 1686752 - RNA, 15 nt, Human
gaguggcuccucccg

SEQ ID NO: 1686753 - RNA, 12 nt, Human
gagugggcccaa

SEQ ID NO: 1686754 - RNA, 23 nt, Human
gagugggggaucacagccucuga

SEQ ID NO: 1686755 - RNA, 22 nt, Human
gagugaacaaauuuacagagac

SEQ ID NO: 1686756 - RNA, 23 nt, Human
gagugaacaaauuuacagagaca

SEQ ID NO: 1686757 - RNA, 19 nt, Human
gagugaacaaauuuacaga

SEQ ID NO: 1686758 - RNA, 21 nt, Human
gauauaaguguguguuuuuca

SEQ ID NO: 1686759 - RNA, 17 nt, Human
gauauaaguguguguuu

SEQ ID NO: 1686760 - RNA, 13 nt, Human
gauagccaaggcc

SEQ ID NO: 1686761 - RNA, 14 nt, Human
gauagccaaggcca

SEQ ID NO: 1686762 - RNA, 12 nt, Human
gauagccaaggc

SEQ ID NO: 1686763 - RNA, 19 nt, Human
gauagcacagacccugccc

SEQ ID NO: 1686764 - RNA, 20 nt, Human
gauagcacagacccugcccu

SEQ ID NO: 1686765 - RNA, 22 nt, Human
gaucaaccccuucgcuccugug

SEQ ID NO: 1686766 - RNA, 23 nt, Human
gauauaugcucugcauguuacau

SEQ ID NO: 1686767 - RNA, 15 nt, Human
gauagaggaagccug

SEQ ID NO: 1686768 - RNA, 21 nt, Human
gauagaggaagccugauuaaa

SEQ ID NO: 1686769 - RNA, 22 nt, Human
gauagaggaagccugauuaaag

SEQ ID NO: 1686770 - RNA, 17 nt, Human
gauagcacagacccugc

SEQ ID NO: 1686771 - RNA, 18 nt, Human
gauagcacagacccugcc

SEQ ID NO: 1686772 - RNA, 18 nt, Human
gauacaaugcugugcccu

SEQ ID NO: 1686773 - RNA, 13 nt, Human
gauacaaugcugu

SEQ ID NO: 1686774 - RNA, 14 nt, Human
gauagaggaagccu

SEQ ID NO: 1686775 - RNA, 20 nt, Human
gaugugcuuguuaacugagu

SEQ ID NO: 1686776 - RNA, 16 nt, Human
gauguucugggacaca

SEQ ID NO: 1686777 - RNA, 19 nt, Human
gaugugcuuguuaacugag

SEQ ID NO: 1686778 - RNA, 23 nt, Human
gauggugcaaugaccuuucaaua

SEQ ID NO: 1686779 - RNA, 20 nt, Human
gauggugcaaugaccuuuca

SEQ ID NO: 1686780 - RNA, 19 nt, Human
gauucaacagguuuuccug

SEQ ID NO: 1686781 - RNA, 18 nt, Human
gauuaaccacuucagcug

SEQ ID NO: 1686782 - RNA, 19 nt, Human
gauuaaccacuucagcuga

SEQ ID NO: 1686783 - RNA, 21 nt, Human
gauuaaccacuucagcugacu

SEQ ID NO: 1686784 - RNA, 19 nt, Human
gauuaaauucuugcaaagu

SEQ ID NO: 1686785 - RNA, 12 nt, Human
gauuaaauucuu

SEQ ID NO: 1686786 - RNA, 15 nt, Human
gauguuuuccaugag

SEQ ID NO: 1686787 - RNA, 23 nt, Human
gauguuuuccaugaguccccugu

SEQ ID NO: 1686788 - RNA, 14 nt, Human
gauguuuuccauga

SEQ ID NO: 1686789 - RNA, 21 nt, Human
gauguucuuucacccuuuucu

SEQ ID NO: 1686790 - RNA, 19 nt, Human
gauguugaaaaaguucugc

SEQ ID NO: 1686791 - RNA, 12 nt, Human
gauucagacagc

SEQ ID NO: 1686792 - RNA, 22 nt, Human
gauucccaagcucugcuccucu

SEQ ID NO: 1686793 - RNA, 23 nt, Human
gauugacgggacuguugguauug

SEQ ID NO: 1686794 - RNA, 15 nt, Human
gauuguccccgaccc

SEQ ID NO: 1686795 - RNA, 20 nt, Human
gauuguccccgacccuugcc

SEQ ID NO: 1686796 - RNA, 13 nt, Human
gauugugccccug

SEQ ID NO: 1686797 - RNA, 14 nt, Human
gaugacuauggaaa

SEQ ID NO: 1686798 - RNA, 11 nt, Human
gaugagaaagg

SEQ ID NO: 1686799 - RNA, 22 nt, Human
gaugagaaagguugaagcacca

SEQ ID NO: 1686800 - RNA, 23 nt, Human
gaugagaaauaaaguuucuguug

SEQ ID NO: 1686801 - RNA, 18 nt, Human
gaugcaguucugaagaag

SEQ ID NO: 1686802 - RNA, 21 nt, Human
gaugccuggcgggguggggug

SEQ ID NO: 1686803 - RNA, 14 nt, Human
gaugccugguggca

SEQ ID NO: 1686804 - RNA, 22 nt, Human
gaugggcaacccccagccugcu

SEQ ID NO: 1686805 - RNA, 16 nt, Human
gaugggaaagcauugu

SEQ ID NO: 1686806 - RNA, 16 nt, Human
gaucacgccacugcac

SEQ ID NO: 1686807 - RNA, 11 nt, Human
gauccuccagg

SEQ ID NO: 1686808 - RNA, 15 nt, Human
gaucacgccacugca

SEQ ID NO: 1686809 - RNA, 18 nt, Human
gauccuaguuccaccauc

SEQ ID NO: 1686810 - RNA, 23 nt, Human
gaucaaccccuucgcuccugugu

SEQ ID NO: 1686811 - RNA, 13 nt, Human
gaucacgccacug

SEQ ID NO: 1686812 - RNA, 14 nt, Human
gaucacgccacugc

SEQ ID NO: 1686813 - RNA, 12 nt, Human
gauccuccaggu

SEQ ID NO: 1686814 - RNA, 19 nt, Human
gauccucccaccucagccu

SEQ ID NO: 1686815 - RNA, 20 nt, Human
gauccucccaccucagccuc

SEQ ID NO: 1686816 - RNA, 21 nt, Human
gauccucccaccucagccucc

SEQ ID NO: 1686817 - RNA, 14 nt, Human
gauccugagccaga

SEQ ID NO: 1686818 - RNA, 15 nt, Human
gauccugagccagau

SEQ ID NO: 1686819 - RNA, 19 nt, Human
gauccugagccagauuuca

SEQ ID NO: 1686820 - RNA, 15 nt, Human
gauccuuuuggaguc

SEQ ID NO: 1686821 - RNA, 17 nt, Human
gauccuuuuggagucag

SEQ ID NO: 1686822 - RNA, 17 nt, Human
gaucuuugcagacaggc

SEQ ID NO: 1686823 - RNA, 15 nt, Human
gaugaaaaaauaaca

SEQ ID NO: 1686824 - RNA, 16 nt, Human
gaucuuugcagacagg

SEQ ID NO: 1686825 - RNA, 14 nt, Human
gaucuuuaaaauac

SEQ ID NO: 1686826 - RNA, 13 nt, Human
gaggacagggagg

SEQ ID NO: 1686827 - RNA, 22 nt, Human
gaggacagggaggugaccccag

SEQ ID NO: 1686828 - RNA, 23 nt, Human
gaggacagggaggugaccccagg

SEQ ID NO: 1686829 - RNA, 16 nt, Human
gaggaauucuguauag

SEQ ID NO: 1686830 - RNA, 17 nt, Human
gaggaauucuguauaga

SEQ ID NO: 1686831 - RNA, 14 nt, Human
gaggaauucuguau

SEQ ID NO: 1686832 - RNA, 15 nt, Human
gaggaauccagaccc

SEQ ID NO: 1686833 - RNA, 22 nt, Human
gagcuugaaacccguggcgcuu

SEQ ID NO: 1686834 - RNA, 21 nt, Human
gagcuucuguugcugccucau

SEQ ID NO: 1686835 - RNA, 22 nt, Human
gaggaaggaaacccagcucugg

SEQ ID NO: 1686836 - RNA, 14 nt, Human
gaggaauccagacc

SEQ ID NO: 1686837 - RNA, 12 nt, Human
gaggauguucug

SEQ ID NO: 1686838 - RNA, 17 nt, Human
gaggauguucugggaca

SEQ ID NO: 1686839 - RNA, 20 nt, Human
gaggauguucugggacacag

SEQ ID NO: 1686840 - RNA, 16 nt, Human
gaggauugcuugagcu

SEQ ID NO: 1686841 - RNA, 23 nt, Human
gaggaguuugggguaugggagag

SEQ ID NO: 1686842 - RNA, 13 nt, Human
gaggcagccccau

SEQ ID NO: 1686843 - RNA, 23 nt, Human
gaggcagccccauucugccugcc

SEQ ID NO: 1686844 - RNA, 18 nt, Human
gaggcagccccauucugc

SEQ ID NO: 1686845 - RNA, 22 nt, Human
gaggcagccccauucugccugc

SEQ ID NO: 1686846 - RNA, 12 nt, Human
gaggccagccuu

SEQ ID NO: 1686847 - RNA, 13 nt, Human
gaggccagccuug

SEQ ID NO: 1686848 - RNA, 14 nt, Human
gagggagggagggc

SEQ ID NO: 1686849 - RNA, 15 nt, Human
gagggagggagggcu

SEQ ID NO: 1686850 - RNA, 15 nt, Human
gagggagggcuccag

SEQ ID NO: 1686851 - RNA, 13 nt, Human
gaggggccuggca

SEQ ID NO: 1686852 - RNA, 14 nt, Human
gaggggccuggcag

SEQ ID NO: 1686853 - RNA, 18 nt, Human
gaggggccuggcagccgu

SEQ ID NO: 1686854 - RNA, 20 nt, Human
gaggggccuggcagccgugc

SEQ ID NO: 1686855 - RNA, 22 nt, Human
gaggggccucuuaugggcuggg

SEQ ID NO: 1686856 - RNA, 16 nt, Human
gagggcacugguggcc

SEQ ID NO: 1686857 - RNA, 18 nt, Human
gagggcacugguggcccg

SEQ ID NO: 1686858 - RNA, 12 nt, Human
gagggcacuggu

SEQ ID NO: 1686859 - RNA, 23 nt, Human
gagggcacagaaaauggaagaca

SEQ ID NO: 1686860 - RNA, 14 nt, Human
gagggcacagaaaa

SEQ ID NO: 1686861 - RNA, 22 nt, Human
gagggcacagaaaauggaagac

SEQ ID NO: 1686862 - RNA, 13 nt, Human
gagggagugacag

SEQ ID NO: 1686863 - RNA, 14 nt, Human
gagggagugacaga

SEQ ID NO: 1686864 - RNA, 16 nt, Human
gagggagggcuccaga

SEQ ID NO: 1686865 - RNA, 16 nt, Human
gagggagugacagagg

SEQ ID NO: 1686866 - RNA, 18 nt, Human
gaggcuacuguaaggcaa

SEQ ID NO: 1686867 - RNA, 20 nt, Human
gaggcguauguggcaaaaug

SEQ ID NO: 1686868 - RNA, 13 nt, Human
gaggcugggcucc

SEQ ID NO: 1686869 - RNA, 14 nt, Human
gaggcugggcuccc

SEQ ID NO: 1686870 - RNA, 16 nt, Human
gaggcugggcucccuu

SEQ ID NO: 1686871 - RNA, 15 nt, Human
gaggcugggcucccu

SEQ ID NO: 1686872 - RNA, 14 nt, Human
gaggccuucucuga

SEQ ID NO: 1686873 - RNA, 24 nt, Human
gaggcccuucucuccagccccugg

SEQ ID NO: 1686874 - RNA, 14 nt, Human
gaggcccuucucuc

SEQ ID NO: 1686875 - RNA, 23 nt, Human
gaggcccuucucuccagccccug

SEQ ID NO: 1686876 - RNA, 13 nt, Human
gaggcccggccuc

SEQ ID NO: 1686877 - RNA, 19 nt, Human
gaggcccccaucuccuuaa

SEQ ID NO: 1686878 - RNA, 23 nt, Human
gagcuacacaggggaaaagagga

SEQ ID NO: 1686879 - RNA, 14 nt, Human
gagcuacaaaugca

SEQ ID NO: 1686880 - RNA, 14 nt, Human
gagcuucuggcacu

SEQ ID NO: 1686881 - RNA, 18 nt, Human
gagcuucuguugcugccu

SEQ ID NO: 1686882 - RNA, 15 nt, Human
gagcuuaacagugug

SEQ ID NO: 1686883 - RNA, 17 nt, Human
gagcugcccucuccugg

SEQ ID NO: 1686884 - RNA, 16 nt, Human
gagcugcccucuccug

SEQ ID NO: 1686885 - RNA, 15 nt, Human
gagcugcccucuccu

SEQ ID NO: 1686886 - RNA, 16 nt, Human
gagcucugcagagcag

SEQ ID NO: 1686887 - RNA, 13 nt, Human
gagcugccaccug

SEQ ID NO: 1686888 - RNA, 15 nt, Human
gagcugccaccugcc

SEQ ID NO: 1686889 - RNA, 16 nt, Human
gagcugccaccugccu

SEQ ID NO: 1686890 - RNA, 14 nt, Human
gagcugcccucucc

SEQ ID NO: 1686891 - RNA, 23 nt, Human
gagccugcacggugaauggcuuu

SEQ ID NO: 1686892 - RNA, 17 nt, Human
gagccugcacggugaau

SEQ ID NO: 1686893 - RNA, 22 nt, Human
gagccugcacggugaauggcuu

SEQ ID NO: 1686894 - RNA, 20 nt, Human
gagccuccugcccuuaccug

SEQ ID NO: 1686895 - RNA, 22 nt, Human
gagccuccugcccuuaccugcc

SEQ ID NO: 1686896 - RNA, 18 nt, Human
gagccucagucucccucc

SEQ ID NO: 1686897 - RNA, 18 nt, Human
gagcccugguggcagugg

SEQ ID NO: 1686898 - RNA, 14 nt, Human
gagccuccugcccu

SEQ ID NO: 1686899 - RNA, 20 nt, Human
gagccucagcauccuggcac

SEQ ID NO: 1686900 - RNA, 21 nt, Human
gagccucagcauccuggcacc

SEQ ID NO: 1686901 - RNA, 15 nt, Human
gagcccugguggcag

SEQ ID NO: 1686902 - RNA, 16 nt, Human
gagcccugguggcagu

SEQ ID NO: 1686903 - RNA, 19 nt, Human
gagccucagcauccuggca

SEQ ID NO: 1686904 - RNA, 17 nt, Human
gagcccugguggcagug

SEQ ID NO: 1686905 - RNA, 15 nt, Human
gagccuggcaagaau

SEQ ID NO: 1686906 - RNA, 10 nt, Human
gagccuggca

SEQ ID NO: 1686907 - RNA, 13 nt, Human
gagccugggaggu

SEQ ID NO: 1686908 - RNA, 21 nt, Human
gagccugggaggucaaggcug

SEQ ID NO: 1686909 - RNA, 13 nt, Human
gagcuacaaaugc

SEQ ID NO: 1686910 - RNA, 12 nt, Human
gagcuacaaaug

SEQ ID NO: 1686911 - RNA, 22 nt, Human
gagccacugcaccgggccacag

SEQ ID NO: 1686912 - RNA, 13 nt, Human
gagccagauuuca

SEQ ID NO: 1686913 - RNA, 13 nt, Human
gagcccaggccuc

SEQ ID NO: 1686914 - RNA, 14 nt, Human
gagcccaggccucc

SEQ ID NO: 1686915 - RNA, 12 nt, Human
gagcccacgccc

SEQ ID NO: 1686916 - RNA, 15 nt, Human
gagcccacgccccca

SEQ ID NO: 1686917 - RNA, 16 nt, Human
gagcccacgcccccac

SEQ ID NO: 1686918 - RNA, 12 nt, Human
gagcccaggccu

SEQ ID NO: 1686919 - RNA, 18 nt, Human
gagcagccacauuccuga

SEQ ID NO: 1686920 - RNA, 14 nt, Human
gagccaccgugccu

SEQ ID NO: 1686921 - RNA, 20 nt, Human
gagccaccgugccuggccac

SEQ ID NO: 1686922 - RNA, 13 nt, Human
gagccacugcacc

SEQ ID NO: 1686923 - RNA, 21 nt, Human
gagcaggcuacugucagcucc

SEQ ID NO: 1686924 - RNA, 13 nt, Human
gagaucagccugg

SEQ ID NO: 1686925 - RNA, 14 nt, Human
gagaucagccuggg

SEQ ID NO: 1686926 - RNA, 16 nt, Human
gagaucagccugggca

SEQ ID NO: 1686927 - RNA, 20 nt, Human
gagaucaaccccuucgcucc

SEQ ID NO: 1686928 - RNA, 19 nt, Human
gagcaccuuagacaguccc

SEQ ID NO: 1686929 - RNA, 17 nt, Human
gagcaccuuagacaguc

SEQ ID NO: 1686930 - RNA, 21 nt, Human
gagcaagacgcugugcugccc

SEQ ID NO: 1686931 - RNA, 18 nt, Human
gagcaagacgcugugcug

SEQ ID NO: 1686932 - RNA, 22 nt, Human
gagcaagacgcugugcugcccu

SEQ ID NO: 1686933 - RNA, 23 nt, Human
gagcaagacgcugugcugcccug

SEQ ID NO: 1686934 - RNA, 19 nt, Human
gagcaaaaucgaugcagug

SEQ ID NO: 1686935 - RNA, 14 nt, Human
cuauuucuauauuu

SEQ ID NO: 1686936 - RNA, 16 nt, Human
cuauuucuauauuuuc

SEQ ID NO: 1686937 - RNA, 18 nt, Human
cuauuucuauauuuucau

SEQ ID NO: 1686938 - RNA, 23 nt, Human
cucaaauacgugggcauucaaau

SEQ ID NO: 1686939 - RNA, 21 nt, Human
cucaacaccucugcacaagcu

SEQ ID NO: 1686940 - RNA, 13 nt, Human
cucaaccuccugg

SEQ ID NO: 1686941 - RNA, 15 nt, Human
cucaaccuccugggc

SEQ ID NO: 1686942 - RNA, 17 nt, Human
cucaaccuccugggcua

SEQ ID NO: 1686943 - RNA, 22 nt, Human
cuauuuaugugauccuuuugga

SEQ ID NO: 1686944 - RNA, 19 nt, Human
cuauugucaccagggcugg

SEQ ID NO: 1686945 - RNA, 18 nt, Human
cuauuguuagucucuuga

SEQ ID NO: 1686946 - RNA, 17 nt, Human
cucaagugauucuccug

SEQ ID NO: 1686947 - RNA, 21 nt, Human
cucaaguccucuuuucugaga

SEQ ID NO: 1686948 - RNA, 22 nt, Human
cucacacaugagcaucaggcca

SEQ ID NO: 1686949 - RNA, 24 nt, Human
cucacacaugagcaucaggccagg

SEQ ID NO: 1686950 - RNA, 15 nt, Human
cucacaguccuuacc

SEQ ID NO: 1686951 - RNA, 17 nt, Human
cucaccagccccagugc

SEQ ID NO: 1686952 - RNA, 18 nt, Human
cucaccagccccagugcc

SEQ ID NO: 1686953 - RNA, 13 nt, Human
cucaccagcccca

SEQ ID NO: 1686954 - RNA, 14 nt, Human
cucaccagccccag

SEQ ID NO: 1686955 - RNA, 15 nt, Human
cucaccagccccagu

SEQ ID NO: 1686956 - RNA, 22 nt, Human
cucacauuuauucugcucacau

SEQ ID NO: 1686957 - RNA, 15 nt, Human
cucacauuuauucug

SEQ ID NO: 1686958 - RNA, 19 nt, Human
cucacauuuauucugcuca

SEQ ID NO: 1686959 - RNA, 17 nt, Human
cucacaguccuuaccag

SEQ ID NO: 1686960 - RNA, 19 nt, Human
cucacaguccuuaccagca

SEQ ID NO: 1686961 - RNA, 22 nt, Human
cucacaguccuuaccagcagag

SEQ ID NO: 1686962 - RNA, 23 nt, Human
cucacaguccuuaccagcagagc

SEQ ID NO: 1686963 - RNA, 15 nt, Human
cucagauuuuauuau

SEQ ID NO: 1686964 - RNA, 17 nt, Human
cucagauuuuauuaugu

SEQ ID NO: 1686965 - RNA, 18 nt, Human
cucagauuuuauuaugua

SEQ ID NO: 1686966 - RNA, 22 nt, Human
cucagauuuuauuauguaaauc

SEQ ID NO: 1686967 - RNA, 13 nt, Human
cucagauuuuauu

SEQ ID NO: 1686968 - RNA, 15 nt, Human
cucagaucuucugug

SEQ ID NO: 1686969 - RNA, 16 nt, Human
cucagcauccuggcac

SEQ ID NO: 1686970 - RNA, 17 nt, Human
cucagcauccuggcacc

SEQ ID NO: 1686971 - RNA, 18 nt, Human
cucagagagggugggagu

SEQ ID NO: 1686972 - RNA, 14 nt, Human
cucagagagggugg

SEQ ID NO: 1686973 - RNA, 21 nt, Human
cucacuguugcccaggcuggc

SEQ ID NO: 1686974 - RNA, 22 nt, Human
cucacuguugcccaggcuggcg

SEQ ID NO: 1686975 - RNA, 19 nt, Human
cucacugccaugccagcuu

SEQ ID NO: 1686976 - RNA, 22 nt, Human
cucacugccaugccagcuuauc

SEQ ID NO: 1686977 - RNA, 20 nt, Human
cucacuguugcccaggcugg

SEQ ID NO: 1686978 - RNA, 19 nt, Human
cucacuauguugcccaggc

SEQ ID NO: 1686979 - RNA, 20 nt, Human
cucacuauguugcccaggca

SEQ ID NO: 1686980 - RNA, 15 nt, Human
cucaccccagcccca

SEQ ID NO: 1686981 - RNA, 13 nt, Human
cucacuccuaccu

SEQ ID NO: 1686982 - RNA, 15 nt, Human
cucacuccuaccugg

SEQ ID NO: 1686983 - RNA, 23 nt, Human
cucacuauguugcccaggcaggu

SEQ ID NO: 1686984 - RNA, 21 nt, Human
cucacuauguugcccaggcag

SEQ ID NO: 1686985 - RNA, 22 nt, Human
cucacuauguugcccaggcagg

SEQ ID NO: 1686986 - RNA, 16 nt, Human
cucacuccuaccuggu

SEQ ID NO: 1686987 - RNA, 17 nt, Human
cucacuccuaccuggua

SEQ ID NO: 1686988 - RNA, 19 nt, Human
cucacuccuaccugguaau

SEQ ID NO: 1686989 - RNA, 13 nt, Human
cucacuccuugaa

SEQ ID NO: 1686990 - RNA, 11 nt, Human
cucacucuguc

SEQ ID NO: 1686991 - RNA, 12 nt, Human
cucacucugucg

SEQ ID NO: 1686992 - RNA, 14 nt, Human
cucacugcagccuc

SEQ ID NO: 1686993 - RNA, 13 nt, Human
cucacugcagccu

SEQ ID NO: 1686994 - RNA, 12 nt, Human
cucacugcagcc

SEQ ID NO: 1686995 - RNA, 22 nt, Human
cucacucugucgcccagucugg

SEQ ID NO: 1686996 - RNA, 13 nt, Human
cucacucugucgc

SEQ ID NO: 1686997 - RNA, 21 nt, Human
cucacucugucgcccagucug

SEQ ID NO: 1686998 - RNA, 20 nt, Human
cuaugcagagguccacaaca

SEQ ID NO: 1686999 - RNA, 13 nt, Human
cuauggccugugg

SEQ ID NO: 1687000 - RNA, 18 nt, Human
cuaugggacucaaugcac

SEQ ID NO: 1687001 - RNA, 22 nt, Human
cuaugggacucaaugcacugac

SEQ ID NO: 1687002 - RNA, 23 nt, Human
cuaugggacucaaugcacugaca

SEQ ID NO: 1687003 - RNA, 15 nt, Human
cuauuagagaagaga

SEQ ID NO: 1687004 - RNA, 23 nt, Human
cuauucaaacagucucaggaaau

SEQ ID NO: 1687005 - RNA, 18 nt, Human
cuauucaaacagucucag

SEQ ID NO: 1687006 - RNA, 16 nt, Human
cuauucaaacagucuc

SEQ ID NO: 1687007 - RNA, 21 nt, Human
cuauaauguaagcucuacuga

SEQ ID NO: 1687008 - RNA, 22 nt, Human
cuauaauuuaccugaagucuuu

SEQ ID NO: 1687009 - RNA, 16 nt, Human
cuauaauguaagcucu

SEQ ID NO: 1687010 - RNA, 19 nt, Human
cuauauuuucauucuccua

SEQ ID NO: 1687011 - RNA, 15 nt, Human
cuauauuuucauucu

SEQ ID NO: 1687012 - RNA, 17 nt, Human
cuauauuuuacauaaau

SEQ ID NO: 1687013 - RNA, 18 nt, Human
cuauauuguuugcuaagc

SEQ ID NO: 1687014 - RNA, 17 nt, Human
cuauagccuaggugaca

SEQ ID NO: 1687015 - RNA, 20 nt, Human
cuauaggugcuacaaaaaca

SEQ ID NO: 1687016 - RNA, 21 nt, Human
cuauaggugcuacaaaaacac

SEQ ID NO: 1687017 - RNA, 22 nt, Human
cuauaggugcuacaaaaacaca

SEQ ID NO: 1687018 - RNA, 22 nt, Human
cuagguaaauuacaguuccuag

SEQ ID NO: 1687019 - RNA, 23 nt, Human
cgcccaguuggguggaugccugg

SEQ ID NO: 1687020 - RNA, 20 nt, Human
cgccaucccagccccaauga

SEQ ID NO: 1687021 - RNA, 15 nt, Human
cgccaugcuccuggc

SEQ ID NO: 1687022 - RNA, 22 nt, Human
cgcccaguuggguggaugccug

SEQ ID NO: 1687023 - RNA, 14 nt, Human
cuaggugacagagu

SEQ ID NO: 1687024 - RNA, 18 nt, Human
cuaggugacagagugaga

SEQ ID NO: 1687025 - RNA, 24 nt, Human
cuaggugacagagugagacucugu

SEQ ID NO: 1687026 - RNA, 16 nt, Human
cuaguaauuggaaagg

SEQ ID NO: 1687027 - RNA, 20 nt, Human
cuagugaaacucguuaauuu

SEQ ID NO: 1687028 - RNA, 18 nt, Human
cuagugaaagaggcagcu

SEQ ID NO: 1687029 - RNA, 19 nt, Human
cuagugaaagaggcagcuu

SEQ ID NO: 1687030 - RNA, 21 nt, Human
cuagugagcagucaggaaaga

SEQ ID NO: 1687031 - RNA, 22 nt, Human
cucauacucaccucaccccacu

SEQ ID NO: 1687032 - RNA, 14 nt, Human
cucauacucaccuc

SEQ ID NO: 1687033 - RNA, 13 nt, Human
cucauagcccuca

SEQ ID NO: 1687034 - RNA, 17 nt, Human
cucauagcccucacccu

SEQ ID NO: 1687035 - RNA, 20 nt, Human
cucauagcccucacccuggg

SEQ ID NO: 1687036 - RNA, 21 nt, Human
cucauagcccucacccugggg

SEQ ID NO: 1687037 - RNA, 21 nt, Human
cucauaguaugguggcugggu

SEQ ID NO: 1687038 - RNA, 22 nt, Human
cucaggugauccacccaccuca

SEQ ID NO: 1687039 - RNA, 20 nt, Human
cucaggugauccacccaccu

SEQ ID NO: 1687040 - RNA, 18 nt, Human
cucaggugauccacccac

SEQ ID NO: 1687041 - RNA, 19 nt, Human
cucaggugauccacccacc

SEQ ID NO: 1687042 - RNA, 16 nt, Human
cucauacccaccccca

SEQ ID NO: 1687043 - RNA, 18 nt, Human
cucauacccacccccacc

SEQ ID NO: 1687044 - RNA, 19 nt, Human
cucauacccacccccaccc

SEQ ID NO: 1687045 - RNA, 21 nt, Human
cucauacccacccccacccaa

SEQ ID NO: 1687046 - RNA, 22 nt, Human
cucaucaccaacgucugugcca

SEQ ID NO: 1687047 - RNA, 21 nt, Human
cucaucaccaacgucugugcc

SEQ ID NO: 1687048 - RNA, 23 nt, Human
cucauaguaugguggcuggguug

SEQ ID NO: 1687049 - RNA, 15 nt, Human
cucauccucauaccc

SEQ ID NO: 1687050 - RNA, 19 nt, Human
cucagcccacauagugaug

SEQ ID NO: 1687051 - RNA, 21 nt, Human
cucagcccacauagugauggu

SEQ ID NO: 1687052 - RNA, 18 nt, Human
cucaggaguuugagacca

SEQ ID NO: 1687053 - RNA, 23 nt, Human
cucaggaguuugagaccaaccug

SEQ ID NO: 1687054 - RNA, 18 nt, Human
cucagcauccuggcaccc

SEQ ID NO: 1687055 - RNA, 14 nt, Human
cucagggccuggcu

SEQ ID NO: 1687056 - RNA, 15 nt, Human
cucagggccuggcuc

SEQ ID NO: 1687057 - RNA, 13 nt, Human
cucagggccuggc

SEQ ID NO: 1687058 - RNA, 16 nt, Human
cucagggccuggcuca

SEQ ID NO: 1687059 - RNA, 15 nt, Human
cucagggccuggucg

SEQ ID NO: 1687060 - RNA, 15 nt, Human
cucagggucccuggu

SEQ ID NO: 1687061 - RNA, 16 nt, Human
cucagggucccuggug

SEQ ID NO: 1687062 - RNA, 17 nt, Human
cucagggucccuggugg

SEQ ID NO: 1687063 - RNA, 18 nt, Human
cucagggucccugguggc

SEQ ID NO: 1687064 - RNA, 16 nt, Human
cucaggugagaagcag

SEQ ID NO: 1687065 - RNA, 19 nt, Human
cucaggugagaagcagagg

SEQ ID NO: 1687066 - RNA, 20 nt, Human
cucaggugagaagcagagga

SEQ ID NO: 1687067 - RNA, 15 nt, Human
cuccacccugcucuc

SEQ ID NO: 1687068 - RNA, 13 nt, Human
cuccacccugcuc

SEQ ID NO: 1687069 - RNA, 22 nt, Human
cuccaaucccaccaacccucag

SEQ ID NO: 1687070 - RNA, 22 nt, Human
cuccaauuaaggauuuuaugcu

SEQ ID NO: 1687071 - RNA, 17 nt, Human
cuccaauuaaggauuuu

SEQ ID NO: 1687072 - RNA, 20 nt, Human
cuccaauuaaggauuuuaug

SEQ ID NO: 1687073 - RNA, 16 nt, Human
cuccaaaauaaaacuu

SEQ ID NO: 1687074 - RNA, 15 nt, Human
cuccaaaauaaaacu

SEQ ID NO: 1687075 - RNA, 18 nt, Human
cucauuugucacacacuu

SEQ ID NO: 1687076 - RNA, 21 nt, Human
cuccaaacugacucuuaagaa

SEQ ID NO: 1687077 - RNA, 12 nt, Human
cuccaaagaaau

SEQ ID NO: 1687078 - RNA, 18 nt, Human
cuccaaaauaaaacuuuu

SEQ ID NO: 1687079 - RNA, 13 nt, Human
cuccaaagaaaug

SEQ ID NO: 1687080 - RNA, 17 nt, Human
cucauuugucacacacu

SEQ ID NO: 1687081 - RNA, 21 nt, Human
cucauuuccaagcaaguauua

SEQ ID NO: 1687082 - RNA, 15 nt, Human
cuccaccugccaggg

SEQ ID NO: 1687083 - RNA, 14 nt, Human
cuccaccugccagg

SEQ ID NO: 1687084 - RNA, 12 nt, Human
cuccaccugcca

SEQ ID NO: 1687085 - RNA, 13 nt, Human
cuccaccugccag

SEQ ID NO: 1687086 - RNA, 15 nt, Human
cuccagccccuggau

SEQ ID NO: 1687087 - RNA, 20 nt, Human
cuccagccccuggaugcagc

SEQ ID NO: 1687088 - RNA, 16 nt, Human
cuccagccccuggaug

SEQ ID NO: 1687089 - RNA, 17 nt, Human
cuccagccccuggaugc

SEQ ID NO: 1687090 - RNA, 14 nt, Human
cuccagcucaccag

SEQ ID NO: 1687091 - RNA, 12 nt, Human
cuccagccuggg

SEQ ID NO: 1687092 - RNA, 11 nt, Human
cuccaggagca

SEQ ID NO: 1687093 - RNA, 13 nt, Human
cuccaggagcagc

SEQ ID NO: 1687094 - RNA, 14 nt, Human
cuccaggagcagcc

SEQ ID NO: 1687095 - RNA, 15 nt, Human
cuccaggagcagcca

SEQ ID NO: 1687096 - RNA, 16 nt, Human
cuccaggagcagccac

SEQ ID NO: 1687097 - RNA, 17 nt, Human
cuccaggagcagccaca

SEQ ID NO: 1687098 - RNA, 18 nt, Human
cuccaggagcagccacau

SEQ ID NO: 1687099 - RNA, 23 nt, Human
cuccaggagcagccacauuccug

SEQ ID NO: 1687100 - RNA, 12 nt, Human
cuccauccugag

SEQ ID NO: 1687101 - RNA, 15 nt, Human
cucgccuucaucucc

SEQ ID NO: 1687102 - RNA, 23 nt, Human
cucgcucugucgcccaggcugga

SEQ ID NO: 1687103 - RNA, 13 nt, Human
cucgcgacaaugc

SEQ ID NO: 1687104 - RNA, 22 nt, Human
cucgagcaugccuggauggggc

SEQ ID NO: 1687105 - RNA, 13 nt, Human
cucgagcaugccu

SEQ ID NO: 1687106 - RNA, 15 nt, Human
cucgagcaugccugg

SEQ ID NO: 1687107 - RNA, 16 nt, Human
cucgagcaugccugga

SEQ ID NO: 1687108 - RNA, 19 nt, Human
cucgagcaugccuggaugg

SEQ ID NO: 1687109 - RNA, 23 nt, Human
cuccuuggugucgggcaugacac

SEQ ID NO: 1687110 - RNA, 12 nt, Human
cuccuggacucc

SEQ ID NO: 1687111 - RNA, 17 nt, Human
cuccuuaucaaaggaca

SEQ ID NO: 1687112 - RNA, 22 nt, Human
cuccuuaucaaaggacaccauu

SEQ ID NO: 1687113 - RNA, 11 nt, Human
cuccuggacuc

SEQ ID NO: 1687114 - RNA, 21 nt, Human
cuccugugugugcgccuacag

SEQ ID NO: 1687115 - RNA, 23 nt, Human
cuccugugugugcgccuacagga

SEQ ID NO: 1687116 - RNA, 24 nt, Human
cuccugugugugcgccuacaggag

SEQ ID NO: 1687117 - RNA, 13 nt, Human
cuccugcugggca

SEQ ID NO: 1687118 - RNA, 14 nt, Human
cuccuggaaauauu

SEQ ID NO: 1687119 - RNA, 17 nt, Human
cuccugccucagccucc

SEQ ID NO: 1687120 - RNA, 12 nt, Human
cuccugccucag

SEQ ID NO: 1687121 - RNA, 11 nt, Human
cuccugccuca

SEQ ID NO: 1687122 - RNA, 13 nt, Human
cuccucuccccag

SEQ ID NO: 1687123 - RNA, 15 nt, Human
cuccucuccccagca

SEQ ID NO: 1687124 - RNA, 22 nt, Human
cuccugccucgaacuggcugca

SEQ ID NO: 1687125 - RNA, 19 nt, Human
cuccugccucagccucccg

SEQ ID NO: 1687126 - RNA, 18 nt, Human
cuccugccucgaacuggc

SEQ ID NO: 1687127 - RNA, 20 nt, Human
cuccugccucgaacuggcug

SEQ ID NO: 1687128 - RNA, 21 nt, Human
cuccugccucgaacuggcugc

SEQ ID NO: 1687129 - RNA, 17 nt, Human
cucccugccccccagcc

SEQ ID NO: 1687130 - RNA, 23 nt, Human
cucccugccccccagcccuccuu

SEQ ID NO: 1687131 - RNA, 13 nt, Human
cucccugccccuc

SEQ ID NO: 1687132 - RNA, 14 nt, Human
cucccugccccucc

SEQ ID NO: 1687133 - RNA, 17 nt, Human
cucccugccccucccuu

SEQ ID NO: 1687134 - RNA, 18 nt, Human
cucccugccccucccuuc

SEQ ID NO: 1687135 - RNA, 20 nt, Human
cucccugccccucccuucaa

SEQ ID NO: 1687136 - RNA, 21 nt, Human
cucccugccccucccuucaac

SEQ ID NO: 1687137 - RNA, 15 nt, Human
cucccggugcccaag

SEQ ID NO: 1687138 - RNA, 21 nt, Human
cucccggugcccaagaauaga

SEQ ID NO: 1687139 - RNA, 19 nt, Human
cucccgaguagcugggacu

SEQ ID NO: 1687140 - RNA, 20 nt, Human
cucccgaguagcugggacua

SEQ ID NO: 1687141 - RNA, 12 nt, Human
cuccccuccucc

SEQ ID NO: 1687142 - RNA, 20 nt, Human
cuccccuccuccuggacucc

SEQ ID NO: 1687143 - RNA, 13 nt, Human
cuccccuccucug

SEQ ID NO: 1687144 - RNA, 11 nt, Human
cuccccuccuc

SEQ ID NO: 1687145 - RNA, 22 nt, Human
cuccccagcaagugagagcugg

SEQ ID NO: 1687146 - RNA, 23 nt, Human
cuccccagcaagugagagcuggg

SEQ ID NO: 1687147 - RNA, 14 nt, Human
cuccauccugaggc

SEQ ID NO: 1687148 - RNA, 13 nt, Human
cuccauccugagg

SEQ ID NO: 1687149 - RNA, 20 nt, Human
cuccccuccucugcuugcca

SEQ ID NO: 1687150 - RNA, 14 nt, Human
cuccuccuggacuc

SEQ ID NO: 1687151 - RNA, 15 nt, Human
cuccuccuggacucc

SEQ ID NO: 1687152 - RNA, 19 nt, Human
cuccuccuggacuccugca

SEQ ID NO: 1687153 - RNA, 17 nt, Human
cuccucccaggcgcccc

SEQ ID NO: 1687154 - RNA, 22 nt, Human
cuccucccaggcgccccuuccc

SEQ ID NO: 1687155 - RNA, 23 nt, Human
cuccucccaggcgccccuucccc

SEQ ID NO: 1687156 - RNA, 22 nt, Human
cuccuccagccgccaugcuccu

SEQ ID NO: 1687157 - RNA, 15 nt, Human
cuccuccagccgcca

SEQ ID NO: 1687158 - RNA, 13 nt, Human
cuccuccagaguc

SEQ ID NO: 1687159 - RNA, 15 nt, Human
cuccuccagagucag

SEQ ID NO: 1687160 - RNA, 18 nt, Human
cuccucagaucuucugug

SEQ ID NO: 1687161 - RNA, 19 nt, Human
cucccuuggggccuaugca

SEQ ID NO: 1687162 - RNA, 12 nt, Human
cucccuuucaac

SEQ ID NO: 1687163 - RNA, 15 nt, Human
cucugauacagaaaa

SEQ ID NO: 1687164 - RNA, 13 nt, Human
cucugcacaagcu

SEQ ID NO: 1687165 - RNA, 19 nt, Human
cucugcaggucccuaauaa

SEQ ID NO: 1687166 - RNA, 20 nt, Human
cucugcaggucccuaauaaa

SEQ ID NO: 1687167 - RNA, 14 nt, Human
cucugcacaagcug

SEQ ID NO: 1687168 - RNA, 15 nt, Human
cucugcacaagcugc

SEQ ID NO: 1687169 - RNA, 21 nt, Human
cucugcaggucccuaauaaag

SEQ ID NO: 1687170 - RNA, 22 nt, Human
cucugcaggucccuaauaaagc

SEQ ID NO: 1687171 - RNA, 18 nt, Human
cucugcaggucccuaaua

SEQ ID NO: 1687172 - RNA, 18 nt, Human
cucugcccacucccugca

SEQ ID NO: 1687173 - RNA, 20 nt, Human
cucugcccacucccugcaac

SEQ ID NO: 1687174 - RNA, 13 nt, Human
cucugcccacucc

SEQ ID NO: 1687175 - RNA, 15 nt, Human
cucugcccacucccu

SEQ ID NO: 1687176 - RNA, 16 nt, Human
cucugcccacucccug

SEQ ID NO: 1687177 - RNA, 17 nt, Human
cucugcccacucccugc

SEQ ID NO: 1687178 - RNA, 22 nt, Human
cucugcccuaaugcgcaggcug

SEQ ID NO: 1687179 - RNA, 20 nt, Human
cucugcccuaaugcgcaggc

SEQ ID NO: 1687180 - RNA, 13 nt, Human
cucugccucccau

SEQ ID NO: 1687181 - RNA, 14 nt, Human
cucugccucccauc

SEQ ID NO: 1687182 - RNA, 16 nt, Human
cucugccucccaucac

SEQ ID NO: 1687183 - RNA, 17 nt, Human
cucugccucccaucacc

SEQ ID NO: 1687184 - RNA, 19 nt, Human
cucugaaggguaauuauau

SEQ ID NO: 1687185 - RNA, 19 nt, Human
cucugaagugaaacugcuu

SEQ ID NO: 1687186 - RNA, 23 nt, Human
cucugaagugaaacugcuuguuu

SEQ ID NO: 1687187 - RNA, 16 nt, Human
cucugacaacagacuu

SEQ ID NO: 1687188 - RNA, 22 nt, Human
cucugaaggacauugcggacag

SEQ ID NO: 1687189 - RNA, 21 nt, Human
cucugacaacagacuucugaa

SEQ ID NO: 1687190 - RNA, 22 nt, Human
cucugacaacagacuucugaaa

SEQ ID NO: 1687191 - RNA, 14 nt, Human
cucugacacacagc

SEQ ID NO: 1687192 - RNA, 15 nt, Human
cucugacacacagcu

SEQ ID NO: 1687193 - RNA, 16 nt, Human
cucugacacacagcuc

SEQ ID NO: 1687194 - RNA, 17 nt, Human
cucugacacacagcucu

SEQ ID NO: 1687195 - RNA, 18 nt, Human
cucugacacacagcucug

SEQ ID NO: 1687196 - RNA, 19 nt, Human
cucugacacacagcucugu

SEQ ID NO: 1687197 - RNA, 23 nt, Human
cucugacagaagaaccccagggu

SEQ ID NO: 1687198 - RNA, 23 nt, Human
cucugagacucgcgacaaugcaa

SEQ ID NO: 1687199 - RNA, 16 nt, Human
cucugaggacacuaac

SEQ ID NO: 1687200 - RNA, 12 nt, Human
cucugaggacac

SEQ ID NO: 1687201 - RNA, 14 nt, Human
cucugaggacacua

SEQ ID NO: 1687202 - RNA, 21 nt, Human
cucugagacucgcgacaaugc

SEQ ID NO: 1687203 - RNA, 12 nt, Human
cucuucuccacu

SEQ ID NO: 1687204 - RNA, 13 nt, Human
cucuucuccacug

SEQ ID NO: 1687205 - RNA, 15 nt, Human
cucuucuccaggcug

SEQ ID NO: 1687206 - RNA, 13 nt, Human
cucuucuccaggc

SEQ ID NO: 1687207 - RNA, 20 nt, Human
cucugugucagguggggcag

SEQ ID NO: 1687208 - RNA, 21 nt, Human
cucugugucagguggggcagc

SEQ ID NO: 1687209 - RNA, 22 nt, Human
cucugugucagguggggcagcu

SEQ ID NO: 1687210 - RNA, 23 nt, Human
cucugugucagguggggcagcuu

SEQ ID NO: 1687211 - RNA, 19 nt, Human
cucuuaagaagacugcauu

SEQ ID NO: 1687212 - RNA, 18 nt, Human
cucugucgcccagucugg

SEQ ID NO: 1687213 - RNA, 19 nt, Human
cucugucgcccagucugga

SEQ ID NO: 1687214 - RNA, 18 nt, Human
cucugucgcccaggcugg

SEQ ID NO: 1687215 - RNA, 22 nt, Human
cucugucgcccaggcuggagug

SEQ ID NO: 1687216 - RNA, 17 nt, Human
cucugucgcccagucug

SEQ ID NO: 1687217 - RNA, 15 nt, Human
cucugucgcccaggc

SEQ ID NO: 1687218 - RNA, 13 nt, Human
cucugucgcccag

SEQ ID NO: 1687219 - RNA, 14 nt, Human
cucuguccugggag

SEQ ID NO: 1687220 - RNA, 15 nt, Human
cucuguccugggagu

SEQ ID NO: 1687221 - RNA, 22 nt, Human
cucuguccugggagugagcugg

SEQ ID NO: 1687222 - RNA, 19 nt, Human
cucuggauuauauuaugaa

SEQ ID NO: 1687223 - RNA, 20 nt, Human
cucuggauuauauuaugaag

SEQ ID NO: 1687224 - RNA, 10 nt, Human
cucugccuga

SEQ ID NO: 1687225 - RNA, 21 nt, Human
cucugccucccaucacccgcu

SEQ ID NO: 1687226 - RNA, 19 nt, Human
cucugccucugacacacag

SEQ ID NO: 1687227 - RNA, 20 nt, Human
cucugccucugacacacagc

SEQ ID NO: 1687228 - RNA, 23 nt, Human
cucuggcagcucagagagggugg

SEQ ID NO: 1687229 - RNA, 21 nt, Human
cucuggccuucggccuccauc

SEQ ID NO: 1687230 - RNA, 22 nt, Human
cucuggccuucggccuccaucc

SEQ ID NO: 1687231 - RNA, 21 nt, Human
cugaccagccuccaugcugcc

SEQ ID NO: 1687232 - RNA, 23 nt, Human
cugaccagccuccaugcugccuc

SEQ ID NO: 1687233 - RNA, 16 nt, Human
cugaauuaugaaacuu

SEQ ID NO: 1687234 - RNA, 14 nt, Human
cugaauuucuuuug

SEQ ID NO: 1687235 - RNA, 16 nt, Human
cugacagacacaggcc

SEQ ID NO: 1687236 - RNA, 17 nt, Human
cugaccagccuccaugc

SEQ ID NO: 1687237 - RNA, 17 nt, Human
cugacagacacaggccc

SEQ ID NO: 1687238 - RNA, 18 nt, Human
cugacagacacaggcccg

SEQ ID NO: 1687239 - RNA, 17 nt, Human
cugacuguacuccuccc

SEQ ID NO: 1687240 - RNA, 12 nt, Human
cugagaaagacu

SEQ ID NO: 1687241 - RNA, 13 nt, Human
cugagaaagacua

SEQ ID NO: 1687242 - RNA, 15 nt, Human
cugagaaagacuauu

SEQ ID NO: 1687243 - RNA, 18 nt, Human
cugagaaagacuauucaa

SEQ ID NO: 1687244 - RNA, 15 nt, Human
cugagccagauuuca

SEQ ID NO: 1687245 - RNA, 13 nt, Human
cugagccagauuu

SEQ ID NO: 1687246 - RNA, 14 nt, Human
cugagccagauuuc

SEQ ID NO: 1687247 - RNA, 16 nt, Human
cugagcaggauuuuaa

SEQ ID NO: 1687248 - RNA, 15 nt, Human
cugagcaaauguggc

SEQ ID NO: 1687249 - RNA, 17 nt, Human
cugagcaaauguggcuc

SEQ ID NO: 1687250 - RNA, 20 nt, Human
cugagcaaauguggcuccug

SEQ ID NO: 1687251 - RNA, 21 nt, Human
cugagcaaauguggcuccugg

SEQ ID NO: 1687252 - RNA, 23 nt, Human
cugagauuauaggcaccuaccac

SEQ ID NO: 1687253 - RNA, 21 nt, Human
cugagaugugaacacaucagc

SEQ ID NO: 1687254 - RNA, 20 nt, Human
cugagacagcccgggcucug

SEQ ID NO: 1687255 - RNA, 19 nt, Human
cugagacagcccgggcucu

SEQ ID NO: 1687256 - RNA, 19 nt, Human
cugagaaagacuauucaaa

SEQ ID NO: 1687257 - RNA, 20 nt, Human
cugagaaagacuauucaaac

SEQ ID NO: 1687258 - RNA, 21 nt, Human
cugagacagcccgggcucugc

SEQ ID NO: 1687259 - RNA, 22 nt, Human
cugagacagcccgggcucugcc

SEQ ID NO: 1687260 - RNA, 16 nt, Human
cugagaugugaacaca

SEQ ID NO: 1687261 - RNA, 20 nt, Human
cugagaugugaacacaucag

SEQ ID NO: 1687262 - RNA, 20 nt, Human
cugaaauaaacgucuuaaau

SEQ ID NO: 1687263 - RNA, 16 nt, Human
cucuucuccaggcugu

SEQ ID NO: 1687264 - RNA, 22 nt, Human
cucuuuggucuacacugugcug

SEQ ID NO: 1687265 - RNA, 23 nt, Human
cucuuuggucuacacugugcuga

SEQ ID NO: 1687266 - RNA, 23 nt, Human
cucuuugucuacaccauuaugug

SEQ ID NO: 1687267 - RNA, 14 nt, Human
cucuuuucaaaaca

SEQ ID NO: 1687268 - RNA, 23 nt, Human
cugaaagggacgcuacccgggaa

SEQ ID NO: 1687269 - RNA, 13 nt, Human
cugaauuaugaaa

SEQ ID NO: 1687270 - RNA, 14 nt, Human
cugaauuaugaaac

SEQ ID NO: 1687271 - RNA, 15 nt, Human
cugaauuaugaaacu

SEQ ID NO: 1687272 - RNA, 12 nt, Human
cugaauuauuuu

SEQ ID NO: 1687273 - RNA, 12 nt, Human
cugaauuucuuu

SEQ ID NO: 1687274 - RNA, 19 nt, Human
cugaaugguuuucaaaaua

SEQ ID NO: 1687275 - RNA, 20 nt, Human
cugaaugguuuucaaaauaa

SEQ ID NO: 1687276 - RNA, 17 nt, Human
cugaaguucagcugcau

SEQ ID NO: 1687277 - RNA, 22 nt, Human
cugaagucccagauacuugggg

SEQ ID NO: 1687278 - RNA, 17 nt, Human
cugaagucuuuguacag

SEQ ID NO: 1687279 - RNA, 20 nt, Human
cugaagucuuuguacagaca

SEQ ID NO: 1687280 - RNA, 13 nt, Human
cugaagucacugc

SEQ ID NO: 1687281 - RNA, 14 nt, Human
cugaagucacugca

SEQ ID NO: 1687282 - RNA, 15 nt, Human
cugaagucacugcac

SEQ ID NO: 1687283 - RNA, 21 nt, Human
cugaagucacacagugagucg

SEQ ID NO: 1687284 - RNA, 18 nt, Human
cugaagucacacagugag

SEQ ID NO: 1687285 - RNA, 19 nt, Human
cugaagucacacagugagu

SEQ ID NO: 1687286 - RNA, 17 nt, Human
cugaagucacacaguga

SEQ ID NO: 1687287 - RNA, 14 nt, Human
cugaagaagauggu

SEQ ID NO: 1687288 - RNA, 11 nt, Human
cugccaggcau

SEQ ID NO: 1687289 - RNA, 13 nt, Human
cugccaggcaugg

SEQ ID NO: 1687290 - RNA, 23 nt, Human
cugccaucucaccuccugcuggg

SEQ ID NO: 1687291 - RNA, 21 nt, Human
cugccaucucaccuccugcug

SEQ ID NO: 1687292 - RNA, 14 nt, Human
cugccaugccagcu

SEQ ID NO: 1687293 - RNA, 15 nt, Human
cugccaugccagcuu

SEQ ID NO: 1687294 - RNA, 13 nt, Human
cugcccaccuggc

SEQ ID NO: 1687295 - RNA, 14 nt, Human
cugcccaccuggcc

SEQ ID NO: 1687296 - RNA, 15 nt, Human
cugcccaccuggccu

SEQ ID NO: 1687297 - RNA, 17 nt, Human
cugcccagccuccaagc

SEQ ID NO: 1687298 - RNA, 18 nt, Human
cugcccacucccugcaac

SEQ ID NO: 1687299 - RNA, 17 nt, Human
cugcccaccuggccucu

SEQ ID NO: 1687300 - RNA, 18 nt, Human
cugcccaccuggccucug

SEQ ID NO: 1687301 - RNA, 19 nt, Human
cugcccaccuggccucugc

SEQ ID NO: 1687302 - RNA, 20 nt, Human
cugcccaccuggccucugca

SEQ ID NO: 1687303 - RNA, 22 nt, Human
cugcccaccuggccucugcacu

SEQ ID NO: 1687304 - RNA, 14 nt, Human
cugcccacucccug

SEQ ID NO: 1687305 - RNA, 15 nt, Human
cugcccacucccugc

SEQ ID NO: 1687306 - RNA, 16 nt, Human
cugcccacucccugca

SEQ ID NO: 1687307 - RNA, 18 nt, Human
cugccaaugggagcucau

SEQ ID NO: 1687308 - RNA, 19 nt, Human
cugccaaugggagcucaug

SEQ ID NO: 1687309 - RNA, 18 nt, Human
cugcaugcgggcuuccuc

SEQ ID NO: 1687310 - RNA, 22 nt, Human
cugcaugcgggcuuccuccugg

SEQ ID NO: 1687311 - RNA, 19 nt, Human
cugcauccuccgccucccg

SEQ ID NO: 1687312 - RNA, 20 nt, Human
cugcauccuccgccucccgg

SEQ ID NO: 1687313 - RNA, 16 nt, Human
cugcaucguuucaucu

SEQ ID NO: 1687314 - RNA, 22 nt, Human
cugcaucguuucaucuuccaac

SEQ ID NO: 1687315 - RNA, 21 nt, Human
cugcaguugccagucaccccg

SEQ ID NO: 1687316 - RNA, 22 nt, Human
cugcaguugccagucaccccgg

SEQ ID NO: 1687317 - RNA, 23 nt, Human
cugcacuugcagacucuacagag

SEQ ID NO: 1687318 - RNA, 19 nt, Human
cugcaguugccagucaccc

SEQ ID NO: 1687319 - RNA, 15 nt, Human
cugccucucugcagg

SEQ ID NO: 1687320 - RNA, 16 nt, Human
cugccucucugcaggu

SEQ ID NO: 1687321 - RNA, 17 nt, Human
cugccucucugcagguc

SEQ ID NO: 1687322 - RNA, 18 nt, Human
cugccucucugcaggucc

SEQ ID NO: 1687323 - RNA, 14 nt, Human
cugccuccagaaug

SEQ ID NO: 1687324 - RNA, 22 nt, Human
cugccuccagaauggucuuucu

SEQ ID NO: 1687325 - RNA, 13 nt, Human
cugccuauuuuaa

SEQ ID NO: 1687326 - RNA, 15 nt, Human
cugccucagccuccc

SEQ ID NO: 1687327 - RNA, 17 nt, Human
cugccucagccucccga

SEQ ID NO: 1687328 - RNA, 19 nt, Human
cugccucagccucccaaag

SEQ ID NO: 1687329 - RNA, 21 nt, Human
cugccccuccucucugcccua

SEQ ID NO: 1687330 - RNA, 20 nt, Human
cugccccuccucucugcccu

SEQ ID NO: 1687331 - RNA, 12 nt, Human
cugccgcagccc

SEQ ID NO: 1687332 - RNA, 13 nt, Human
cugccgcagcccu

SEQ ID NO: 1687333 - RNA, 23 nt, Human
cugccgcagcccugcagagggca

SEQ ID NO: 1687334 - RNA, 14 nt, Human
cugccgcagcccug

SEQ ID NO: 1687335 - RNA, 19 nt, Human
cugccgcagcccugcagag

SEQ ID NO: 1687336 - RNA, 20 nt, Human
cugccgcagcccugcagagg

SEQ ID NO: 1687337 - RNA, 21 nt, Human
cugccgcagcccugcagaggg

SEQ ID NO: 1687338 - RNA, 22 nt, Human
cugccgcagcccugcagagggc

SEQ ID NO: 1687339 - RNA, 19 nt, Human
cugccucucugcagguccc

SEQ ID NO: 1687340 - RNA, 17 nt, Human
cugccucugacacacag

SEQ ID NO: 1687341 - RNA, 18 nt, Human
cugccucugacacacagc

SEQ ID NO: 1687342 - RNA, 21 nt, Human
cugccucugacacacagcucu

SEQ ID NO: 1687343 - RNA, 21 nt, Human
cugccugcccaggccccugcc

SEQ ID NO: 1687344 - RNA, 22 nt, Human
cugccugcccaggccccugcca

SEQ ID NO: 1687345 - RNA, 19 nt, Human
cugcgguccacccaggagc

SEQ ID NO: 1687346 - RNA, 20 nt, Human
cugcgguccacccaggagcc

SEQ ID NO: 1687347 - RNA, 18 nt, Human
cugcgguccacccaggag

SEQ ID NO: 1687348 - RNA, 15 nt, Human
cugaucaccugcccu

SEQ ID NO: 1687349 - RNA, 22 nt, Human
cugauacagaaaaguugaauuu

SEQ ID NO: 1687350 - RNA, 20 nt, Human
cugauccuaguuccaccauc

SEQ ID NO: 1687351 - RNA, 21 nt, Human
cugauccuaguuccaccauca

SEQ ID NO: 1687352 - RNA, 14 nt, Human
cugauggugcaaug

SEQ ID NO: 1687353 - RNA, 15 nt, Human
cugauggugcaauga

SEQ ID NO: 1687354 - RNA, 16 nt, Human
cugauggugcaaugac

SEQ ID NO: 1687355 - RNA, 20 nt, Human
cugagucccaggcugagccu

SEQ ID NO: 1687356 - RNA, 18 nt, Human
cugagucugaaggcuggg

SEQ ID NO: 1687357 - RNA, 19 nt, Human
cugagucugaaggcugggu

SEQ ID NO: 1687358 - RNA, 13 nt, Human
cugaguuugugcu

SEQ ID NO: 1687359 - RNA, 18 nt, Human
cugaguuugugcuggugu

SEQ ID NO: 1687360 - RNA, 13 nt, Human
cugaggcugggcu

SEQ ID NO: 1687361 - RNA, 15 nt, Human
cugaggcugggcucc

SEQ ID NO: 1687362 - RNA, 16 nt, Human
cugaggcugggcuccc

SEQ ID NO: 1687363 - RNA, 17 nt, Human
cugaggcugggcucccu

SEQ ID NO: 1687364 - RNA, 22 nt, Human
cugaggcugggcucccuuccca

SEQ ID NO: 1687365 - RNA, 24 nt, Human
cugaggcccuucucuccagccccu

SEQ ID NO: 1687366 - RNA, 15 nt, Human
cugaggcuccacuug

SEQ ID NO: 1687367 - RNA, 21 nt, Human
cugaggcuccacuuggucugu

SEQ ID NO: 1687368 - RNA, 16 nt, Human
cugauuuuuuuuuccu

SEQ ID NO: 1687369 - RNA, 18 nt, Human
cugauuuuuuuuuccuuc

SEQ ID NO: 1687370 - RNA, 19 nt, Human
cugauuuuuuuuuccuuca

SEQ ID NO: 1687371 - RNA, 20 nt, Human
cugauuuuuuuuuccuucag

SEQ ID NO: 1687372 - RNA, 13 nt, Human
cugcaaagcccag

SEQ ID NO: 1687373 - RNA, 15 nt, Human
cugcaaagcccagcu

SEQ ID NO: 1687374 - RNA, 23 nt, Human
cugauuuuuuuuuccuucagugc

SEQ ID NO: 1687375 - RNA, 21 nt, Human
cugauuuuuuuuuccuucagu

SEQ ID NO: 1687376 - RNA, 22 nt, Human
cugauuuuuuuuuccuucagug

SEQ ID NO: 1687377 - RNA, 22 nt, Human
cugauuugacauagucuggcug

SEQ ID NO: 1687378 - RNA, 23 nt, Human
cugauuugacauagucuggcugu

SEQ ID NO: 1687379 - RNA, 21 nt, Human
cugauuugacauagucuggcu

SEQ ID NO: 1687380 - RNA, 21 nt, Human
cugauugugucucuugguccu

SEQ ID NO: 1687381 - RNA, 17 nt, Human
cugauugugucucuugg

SEQ ID NO: 1687382 - RNA, 17 nt, Human
cugauggugcaaugacc

SEQ ID NO: 1687383 - RNA, 19 nt, Human
cugauggugcaaugaccuu

SEQ ID NO: 1687384 - RNA, 20 nt, Human
cugauggugcaaugaccuuu

SEQ ID NO: 1687385 - RNA, 21 nt, Human
cugauggugcaaugaccuuuc

SEQ ID NO: 1687386 - RNA, 18 nt, Human
cugcacuugcagacucua

SEQ ID NO: 1687387 - RNA, 16 nt, Human
cugcacuccccugcug

SEQ ID NO: 1687388 - RNA, 17 nt, Human
cugcacuccccugcugg

SEQ ID NO: 1687389 - RNA, 18 nt, Human
cugcacuccccugcuggg

SEQ ID NO: 1687390 - RNA, 13 nt, Human
cugcacccucagg

SEQ ID NO: 1687391 - RNA, 14 nt, Human
cugcacccucaggc

SEQ ID NO: 1687392 - RNA, 16 nt, Human
cugcacccucaggcag

SEQ ID NO: 1687393 - RNA, 22 nt, Human
cugcaccggcuggccuggcccc

SEQ ID NO: 1687394 - RNA, 23 nt, Human
cugcaccggcuggccuggccccu

SEQ ID NO: 1687395 - RNA, 12 nt, Human
cugcaccgggcc

SEQ ID NO: 1687396 - RNA, 15 nt, Human
cugcacuccccugcu

SEQ ID NO: 1687397 - RNA, 14 nt, Human
cugcacacagcacg

SEQ ID NO: 1687398 - RNA, 20 nt, Human
cugcacacgcuccuuccucu

SEQ ID NO: 1687399 - RNA, 22 nt, Human
cugcacacgcuccuuccucuga

SEQ ID NO: 1687400 - RNA, 13 nt, Human
cugcacacagcac

SEQ ID NO: 1687401 - RNA, 22 nt, Human
cugcacaagcugcacccucagg

SEQ ID NO: 1687402 - RNA, 17 nt, Human
cugcaaagcccagcuug

SEQ ID NO: 1687403 - RNA, 15 nt, Human
cugcaauaaaauggg

SEQ ID NO: 1687404 - RNA, 18 nt, Human
cugcaauaaggggagagu

SEQ ID NO: 1687405 - RNA, 22 nt, Human
cugcaauaaaauggguuuuacu

SEQ ID NO: 1687406 - RNA, 17 nt, Human
gaaauuguaauuauauc

SEQ ID NO: 1687407 - RNA, 19 nt, Human
gaaauugcauuuccugaca

SEQ ID NO: 1687408 - RNA, 17 nt, Human
gaaauuuguuauaauga

SEQ ID NO: 1687409 - RNA, 14 nt, Human
gaaaugggcagagc

SEQ ID NO: 1687410 - RNA, 20 nt, Human
gaaaugggcagagcagagac

SEQ ID NO: 1687411 - RNA, 13 nt, Human
gaaauauuauguu

SEQ ID NO: 1687412 - RNA, 16 nt, Human
gaaauauuauguuaaa

SEQ ID NO: 1687413 - RNA, 22 nt, Human
gaaauguaagggaaacugccag

SEQ ID NO: 1687414 - RNA, 21 nt, Human
gaaauaucugaaaauguaugu

SEQ ID NO: 1687415 - RNA, 17 nt, Human
gaaauauaggaacuuaa

SEQ ID NO: 1687416 - RNA, 13 nt, Human
gaaauauaauuga

SEQ ID NO: 1687417 - RNA, 15 nt, Human
gaaauacuguuugag

SEQ ID NO: 1687418 - RNA, 19 nt, Human
gaaauacuguuugagguuu

SEQ ID NO: 1687419 - RNA, 20 nt, Human
gaaacagccugugucuuuaa

SEQ ID NO: 1687420 - RNA, 20 nt, Human
gaaacaugacucguauaugu

SEQ ID NO: 1687421 - RNA, 11 nt, Human
gaaacauuugg

SEQ ID NO: 1687422 - RNA, 21 nt, Human
gaagaagcaccaaucaugaau

SEQ ID NO: 1687423 - RNA, 13 nt, Human
gaacuuggcgcug

SEQ ID NO: 1687424 - RNA, 15 nt, Human
gaacuuggcgcugcc

SEQ ID NO: 1687425 - RNA, 16 nt, Human
gaacuuggcgcugccc

SEQ ID NO: 1687426 - RNA, 17 nt, Human
gaacuuggcgcugcccc

SEQ ID NO: 1687427 - RNA, 23 nt, Human
gaacuugguucccauuugcuccu

SEQ ID NO: 1687428 - RNA, 21 nt, Human
gaacuuguaaaggaauuuaaa

SEQ ID NO: 1687429 - RNA, 22 nt, Human
gaacuggguacuuguggacaca

SEQ ID NO: 1687430 - RNA, 15 nt, Human
gaacucccuuucaac

SEQ ID NO: 1687431 - RNA, 14 nt, Human
gaacucccuuucaa

SEQ ID NO: 1687432 - RNA, 22 nt, Human
gaacuuccagauccuggaaauc

SEQ ID NO: 1687433 - RNA, 15 nt, Human
gaacagacuggaagc

SEQ ID NO: 1687434 - RNA, 16 nt, Human
gaacagacuggaagca

SEQ ID NO: 1687435 - RNA, 19 nt, Human
gaacagacuggaagcacag

SEQ ID NO: 1687436 - RNA, 21 nt, Human
gaaccacaucuugcucugcug

SEQ ID NO: 1687437 - RNA, 16 nt, Human
gaaccaccacacccag

SEQ ID NO: 1687438 - RNA, 17 nt, Human
gaaccaccacacccagc

SEQ ID NO: 1687439 - RNA, 12 nt, Human
gaaccugacccc

SEQ ID NO: 1687440 - RNA, 11 nt, Human
gaaccugaccc

SEQ ID NO: 1687441 - RNA, 16 nt, Human
gaacgcguugaaauug

SEQ ID NO: 1687442 - RNA, 21 nt, Human
gaacuagaguuuagcuggaaa

SEQ ID NO: 1687443 - RNA, 22 nt, Human
gaacuagaguuuagcuggaaaa

SEQ ID NO: 1687444 - RNA, 18 nt, Human
gaauccagacccggcugc

SEQ ID NO: 1687445 - RNA, 15 nt, Human
gaauagcugggacua

SEQ ID NO: 1687446 - RNA, 15 nt, Human
gaauagaugcugacu

SEQ ID NO: 1687447 - RNA, 14 nt, Human
gaauagcugggacu

SEQ ID NO: 1687448 - RNA, 14 nt, Human
gaaugaaagggccc

SEQ ID NO: 1687449 - RNA, 19 nt, Human
gaaugaaagggcccagaga

SEQ ID NO: 1687450 - RNA, 21 nt, Human
gaaugaaagggcccagagagg

SEQ ID NO: 1687451 - RNA, 16 nt, Human
gaaucucaaauaacua

SEQ ID NO: 1687452 - RNA, 14 nt, Human
gaauacuuuauaaa

SEQ ID NO: 1687453 - RNA, 15 nt, Human
gaauaaauugcuccu

SEQ ID NO: 1687454 - RNA, 14 nt, Human
gaauaacauguaau

SEQ ID NO: 1687455 - RNA, 20 nt, Human
gaauaauccuaaacauauga

SEQ ID NO: 1687456 - RNA, 14 nt, Human
gaauaaagacaccu

SEQ ID NO: 1687457 - RNA, 12 nt, Human
gaauaaaauuuu

SEQ ID NO: 1687458 - RNA, 12 nt, Human
gaaguuucugcc

SEQ ID NO: 1687459 - RNA, 19 nt, Human
gaagccagcaggcucucag

SEQ ID NO: 1687460 - RNA, 23 nt, Human
gaagccagcaggcucucaggcca

SEQ ID NO: 1687461 - RNA, 22 nt, Human
gaagccacgguguucugugaua

SEQ ID NO: 1687462 - RNA, 15 nt, Human
gaagccagcaggcuc

SEQ ID NO: 1687463 - RNA, 16 nt, Human
gaagccagcaggcucu

SEQ ID NO: 1687464 - RNA, 19 nt, Human
gaagacucauucuucugua

SEQ ID NO: 1687465 - RNA, 21 nt, Human
gaagacucauucuucuguacg

SEQ ID NO: 1687466 - RNA, 14 nt, Human
gaagaagcucucuc

SEQ ID NO: 1687467 - RNA, 17 nt, Human
gaagacugcauuauauu

SEQ ID NO: 1687468 - RNA, 23 nt, Human
gaagcccaggaaaggcuccagga

SEQ ID NO: 1687469 - RNA, 20 nt, Human
gaagcccaggaaaggcucca

SEQ ID NO: 1687470 - RNA, 21 nt, Human
gaagcccaggaaaggcuccag

SEQ ID NO: 1687471 - RNA, 22 nt, Human
gaagcccaggaaaggcuccagg

SEQ ID NO: 1687472 - RNA, 18 nt, Human
gaagcuuuuaugugaaac

SEQ ID NO: 1687473 - RNA, 10 nt, Human
gaagccuuug

SEQ ID NO: 1687474 - RNA, 11 nt, Human
gaagccuuugu

SEQ ID NO: 1687475 - RNA, 14 nt, Human
gaagcggcuggcag

SEQ ID NO: 1687476 - RNA, 21 nt, Human
gaagccuuggggcugaugcag

SEQ ID NO: 1687477 - RNA, 13 nt, Human
gaaggcagggagg

SEQ ID NO: 1687478 - RNA, 14 nt, Human
gaaggcagggaggg

SEQ ID NO: 1687479 - RNA, 15 nt, Human
gaaggcaaaugacuu

SEQ ID NO: 1687480 - RNA, 16 nt, Human
gaaggcaaaugacuuu

SEQ ID NO: 1687481 - RNA, 17 nt, Human
gaaggccccgcccaggc

SEQ ID NO: 1687482 - RNA, 16 nt, Human
gaaggccccgcccagg

SEQ ID NO: 1687483 - RNA, 14 nt, Human
gaaggccccgccca

SEQ ID NO: 1687484 - RNA, 15 nt, Human
gaaggccccgcccag

SEQ ID NO: 1687485 - RNA, 16 nt, Human
gaagguucugguguga

SEQ ID NO: 1687486 - RNA, 20 nt, Human
gaagguucuggugugaacua

SEQ ID NO: 1687487 - RNA, 21 nt, Human
gaaggauacaaaagcauguga

SEQ ID NO: 1687488 - RNA, 14 nt, Human
gaaggcaaaugacu

SEQ ID NO: 1687489 - RNA, 19 nt, Human
gaaggauacaaaagcaugu

SEQ ID NO: 1687490 - RNA, 12 nt, Human
gaaggauacaaa

SEQ ID NO: 1687491 - RNA, 14 nt, Human
gaaggaaacccagc

SEQ ID NO: 1687492 - RNA, 17 nt, Human
gaaggaaacccagcucu

SEQ ID NO: 1687493 - RNA, 18 nt, Human
gaaggaaacccagcucug

SEQ ID NO: 1687494 - RNA, 20 nt, Human
cuuuuacguccaucucuugu

SEQ ID NO: 1687495 - RNA, 18 nt, Human
cuuuguuuguugucagcu

SEQ ID NO: 1687496 - RNA, 20 nt, Human
cuuuguuuguugucagcuga

SEQ ID NO: 1687497 - RNA, 22 nt, Human
cuuuucauaaccuagccuuaga

SEQ ID NO: 1687498 - RNA, 18 nt, Human
cuuuucacugcuggcugc

SEQ ID NO: 1687499 - RNA, 20 nt, Human
cuuuucacugcuggcugccu

SEQ ID NO: 1687500 - RNA, 17 nt, Human
cuuuucacugcuggcug

SEQ ID NO: 1687501 - RNA, 20 nt, Human
cuuuucauaaccuagccuua

SEQ ID NO: 1687502 - RNA, 11 nt, Human
cuuuucugaua

SEQ ID NO: 1687503 - RNA, 14 nt, Human
cuuuucugauagag

SEQ ID NO: 1687504 - RNA, 18 nt, Human
cuuuucuguccgagcuuu

SEQ ID NO: 1687505 - RNA, 23 nt, Human
cuuuucuguccgagcuuugaaaa

SEQ ID NO: 1687506 - RNA, 16 nt, Human
cuuuucuuucagccaa

SEQ ID NO: 1687507 - RNA, 18 nt, Human
cuuuucuugcaugaggcu

SEQ ID NO: 1687508 - RNA, 23 nt, Human
cuuuucuugcaugaggcuagugu

SEQ ID NO: 1687509 - RNA, 19 nt, Human
cuuuggacccugaggccca

SEQ ID NO: 1687510 - RNA, 17 nt, Human
cuuuggacccugaggcc

SEQ ID NO: 1687511 - RNA, 18 nt, Human
cuuuggacccugaggccc

SEQ ID NO: 1687512 - RNA, 15 nt, Human
cuuuggacccugagg

SEQ ID NO: 1687513 - RNA, 16 nt, Human
cuuuggacccugaggc

SEQ ID NO: 1687514 - RNA, 16 nt, Human
cuuucccaucuuccaa

SEQ ID NO: 1687515 - RNA, 14 nt, Human
cuuugugauuuuug

SEQ ID NO: 1687516 - RNA, 22 nt, Human
cuuuguccccaccgcagacagg

SEQ ID NO: 1687517 - RNA, 13 nt, Human
cuuugggaggcca

SEQ ID NO: 1687518 - RNA, 18 nt, Human
cuuuguccccaccgcaga

SEQ ID NO: 1687519 - RNA, 19 nt, Human
cuuugugauuuuuguaauu

SEQ ID NO: 1687520 - RNA, 18 nt, Human
cuuugugauuuuuguaau

SEQ ID NO: 1687521 - RNA, 17 nt, Human
cuuugugauuuuuguaa

SEQ ID NO: 1687522 - RNA, 14 nt, Human
cuuuguucuggcuc

SEQ ID NO: 1687523 - RNA, 15 nt, Human
cuuuguucuggcucu

SEQ ID NO: 1687524 - RNA, 14 nt, Human
cuuuuuucuaaagu

SEQ ID NO: 1687525 - RNA, 20 nt, Human
cuuuuuucucugauacagaa

SEQ ID NO: 1687526 - RNA, 15 nt, Human
cuuuuuucacuacau

SEQ ID NO: 1687527 - RNA, 22 nt, Human
cuuuugauaaucaacugggcug

SEQ ID NO: 1687528 - RNA, 16 nt, Human
cuuuugagcauuuaga

SEQ ID NO: 1687529 - RNA, 21 nt, Human
cuuuugagugccuuacacaau

SEQ ID NO: 1687530 - RNA, 22 nt, Human
cuuuuuucucugauacagaaaa

SEQ ID NO: 1687531 - RNA, 14 nt, Human
cuuuuuuggcugcu

SEQ ID NO: 1687532 - RNA, 15 nt, Human
cuuuuuuggcugcug

SEQ ID NO: 1687533 - RNA, 17 nt, Human
gaaaaaggaugcacaga

SEQ ID NO: 1687534 - RNA, 23 nt, Human
gaaaaaggaugcacagaguuguu

SEQ ID NO: 1687535 - RNA, 16 nt, Human
cuuuuuuggcugcuga

SEQ ID NO: 1687536 - RNA, 19 nt, Human
gaaaacguggcugcuucaa

SEQ ID NO: 1687537 - RNA, 18 nt, Human
gaaaacguggcugcuuca

SEQ ID NO: 1687538 - RNA, 15 nt, Human
gaaaacguggcugcu

SEQ ID NO: 1687539 - RNA, 16 nt, Human
gaaaacguggcugcuu

SEQ ID NO: 1687540 - RNA, 21 nt, Human
gaaaaccaagccguggcuucc

SEQ ID NO: 1687541 - RNA, 18 nt, Human
gaaaaccaagccguggcu

SEQ ID NO: 1687542 - RNA, 19 nt, Human
gaaaaccaagccguggcuu

SEQ ID NO: 1687543 - RNA, 15 nt, Human
gaaaacaugcuacac

SEQ ID NO: 1687544 - RNA, 14 nt, Human
gaaaacaugcuaca

SEQ ID NO: 1687545 - RNA, 12 nt, Human
gaaaacaugcua

SEQ ID NO: 1687546 - RNA, 14 nt, Human
gaaaacacauuuuu

SEQ ID NO: 1687547 - RNA, 13 nt, Human
gaaaacacauuuu

SEQ ID NO: 1687548 - RNA, 22 nt, Human
gaaaacaauaacgauaaaagac

SEQ ID NO: 1687549 - RNA, 16 nt, Human
gaaacacuuugcauaa

SEQ ID NO: 1687550 - RNA, 16 nt, Human
gaaacagccugugucu

SEQ ID NO: 1687551 - RNA, 17 nt, Human
gaaacagccugugucuu

SEQ ID NO: 1687552 - RNA, 15 nt, Human
gaaacagcucgacuu

SEQ ID NO: 1687553 - RNA, 20 nt, Human
gaaacagcucgacuuuaaaa

SEQ ID NO: 1687554 - RNA, 18 nt, Human
gaaacagcuaaugggaca

SEQ ID NO: 1687555 - RNA, 22 nt, Human
gaaacacugggcuucuagaacc

SEQ ID NO: 1687556 - RNA, 20 nt, Human
gaaaaucuuauaauuuaaaa

SEQ ID NO: 1687557 - RNA, 19 nt, Human
gaaaagcugcugacagugu

SEQ ID NO: 1687558 - RNA, 13 nt, Human
gaaaagcugcuga

SEQ ID NO: 1687559 - RNA, 17 nt, Human
gaaaagcugcugacagu

SEQ ID NO: 1687560 - RNA, 19 nt, Human
gaaaauaacgauaaaagac

SEQ ID NO: 1687561 - RNA, 16 nt, Human
gaaaaucagccugcuc

SEQ ID NO: 1687562 - RNA, 18 nt, Human
gaaaaucagccugcucca

SEQ ID NO: 1687563 - RNA, 19 nt, Human
gaaaaucuuauaauuuaaa

SEQ ID NO: 1687564 - RNA, 12 nt, Human
gaaaauaucacu

SEQ ID NO: 1687565 - RNA, 14 nt, Human
gaaaaucagccugc

SEQ ID NO: 1687566 - RNA, 22 nt, Human
cuuggaggaaggaaacccagcu

SEQ ID NO: 1687567 - RNA, 23 nt, Human
cuuggagggcaugaagacagaua

SEQ ID NO: 1687568 - RNA, 12 nt, Human
cuuggagggcau

SEQ ID NO: 1687569 - RNA, 16 nt, Human
cuuggcugcagggagu

SEQ ID NO: 1687570 - RNA, 17 nt, Human
cuuggcugcagggaguc

SEQ ID NO: 1687571 - RNA, 18 nt, Human
cuugggccacugugaaga

SEQ ID NO: 1687572 - RNA, 13 nt, Human
cuugggcuucauc

SEQ ID NO: 1687573 - RNA, 14 nt, Human
cuugggccacugug

SEQ ID NO: 1687574 - RNA, 20 nt, Human
cuuggggaccagagcugcca

SEQ ID NO: 1687575 - RNA, 21 nt, Human
cuuggggaccagagcugccac

SEQ ID NO: 1687576 - RNA, 22 nt, Human
cuugggcuucauccuccucaga

SEQ ID NO: 1687577 - RNA, 16 nt, Human
cuuggggaccagagcu

SEQ ID NO: 1687578 - RNA, 22 nt, Human
cuuggggaccagagcugccacc

SEQ ID NO: 1687579 - RNA, 15 nt, Human
cuuggggggcugagg

SEQ ID NO: 1687580 - RNA, 16 nt, Human
cuuggggggcugaggu

SEQ ID NO: 1687581 - RNA, 22 nt, Human
cuuggggggcugaggugggagg

SEQ ID NO: 1687582 - RNA, 19 nt, Human
cuuguaaaggaauuuaaaa

SEQ ID NO: 1687583 - RNA, 16 nt, Human
cuugcucugcugacag

SEQ ID NO: 1687584 - RNA, 17 nt, Human
cuugcucugcugacaga

SEQ ID NO: 1687585 - RNA, 20 nt, Human
cuugcuucaaccccaugaga

SEQ ID NO: 1687586 - RNA, 16 nt, Human
cuuggaaaugggagac

SEQ ID NO: 1687587 - RNA, 13 nt, Human
cuuggaagcuccg

SEQ ID NO: 1687588 - RNA, 14 nt, Human
cuuggaagcuccgc

SEQ ID NO: 1687589 - RNA, 13 nt, Human
cuuggaggaagga

SEQ ID NO: 1687590 - RNA, 14 nt, Human
cuugcucugcugac

SEQ ID NO: 1687591 - RNA, 22 nt, Human
cuugccaucccucccuccaccu

SEQ ID NO: 1687592 - RNA, 17 nt, Human
cuucuccacccugcucu

SEQ ID NO: 1687593 - RNA, 18 nt, Human
cuucuccacccugcucuc

SEQ ID NO: 1687594 - RNA, 21 nt, Human
cuucuccacccugcucuccga

SEQ ID NO: 1687595 - RNA, 14 nt, Human
cuugccacugccuc

SEQ ID NO: 1687596 - RNA, 15 nt, Human
cuugccacugccucu

SEQ ID NO: 1687597 - RNA, 21 nt, Human
cuugccaucccucccuccacc

SEQ ID NO: 1687598 - RNA, 18 nt, Human
cuuuccaaaugcccagcu

SEQ ID NO: 1687599 - RNA, 19 nt, Human
cuuuccaaaugcccagcuu

SEQ ID NO: 1687600 - RNA, 22 nt, Human
cuuuccaaaugcccagcuuaaa

SEQ ID NO: 1687601 - RNA, 13 nt, Human
cuuuccacagaag

SEQ ID NO: 1687602 - RNA, 14 nt, Human
cuuucauauuuuag

SEQ ID NO: 1687603 - RNA, 20 nt, Human
cuuuauucuggcagaggagg

SEQ ID NO: 1687604 - RNA, 13 nt, Human
cuuuauaauucua

SEQ ID NO: 1687605 - RNA, 21 nt, Human
cuuuauuuucuauaauuuaaa

SEQ ID NO: 1687606 - RNA, 19 nt, Human
cuuguuuuuuuuuuccacu

SEQ ID NO: 1687607 - RNA, 20 nt, Human
cuuguuuuuuuuuuccacuu

SEQ ID NO: 1687608 - RNA, 17 nt, Human
cuuuaaaaaaaaaauug

SEQ ID NO: 1687609 - RNA, 21 nt, Human
cuuguuuuuuuuuuccacuua

SEQ ID NO: 1687610 - RNA, 14 nt, Human
cuuguuuucuggga

SEQ ID NO: 1687611 - RNA, 20 nt, Human
cuuuaaagggauggcaagau

SEQ ID NO: 1687612 - RNA, 18 nt, Human
cuuuaaagggauggcaag

SEQ ID NO: 1687613 - RNA, 21 nt, Human
cuuguguguuuauugucaaag

SEQ ID NO: 1687614 - RNA, 14 nt, Human
cuucagugccaaaa

SEQ ID NO: 1687615 - RNA, 15 nt, Human
cuucaguaagccgug

SEQ ID NO: 1687616 - RNA, 16 nt, Human
cuucauuaauaauaaa

SEQ ID NO: 1687617 - RNA, 20 nt, Human
cuucauucaacccaccugcg

SEQ ID NO: 1687618 - RNA, 17 nt, Human
cuucauuaauaauaaau

SEQ ID NO: 1687619 - RNA, 13 nt, Human
cuuccacaagagc

SEQ ID NO: 1687620 - RNA, 14 nt, Human
cuuccacaagagcc

SEQ ID NO: 1687621 - RNA, 15 nt, Human
cuuccacaagagccc

SEQ ID NO: 1687622 - RNA, 14 nt, Human
cuucaguaagccgu

SEQ ID NO: 1687623 - RNA, 15 nt, Human
cuucagcugacuuuu

SEQ ID NO: 1687624 - RNA, 19 nt, Human
cuucagcugacuuuucugu

SEQ ID NO: 1687625 - RNA, 16 nt, Human
cuucagcgguuuauau

SEQ ID NO: 1687626 - RNA, 20 nt, Human
cuucagcaaaaauauuuuau

SEQ ID NO: 1687627 - RNA, 23 nt, Human
cuucagcaaaaauauuuuaugau

SEQ ID NO: 1687628 - RNA, 14 nt, Human
cuucagccucccga

SEQ ID NO: 1687629 - RNA, 16 nt, Human
cuucagccucccgagu

SEQ ID NO: 1687630 - RNA, 20 nt, Human
cuucagccucccgaguagcu

SEQ ID NO: 1687631 - RNA, 15 nt, Human
cuucagccugaaaga

SEQ ID NO: 1687632 - RNA, 20 nt, Human
cuucaacugaccagccucca

SEQ ID NO: 1687633 - RNA, 23 nt, Human
cuucaacugaccagccuccaugc

SEQ ID NO: 1687634 - RNA, 17 nt, Human
cuucaacugaccagccu

SEQ ID NO: 1687635 - RNA, 17 nt, Human
cuucaaggauccugagc

SEQ ID NO: 1687636 - RNA, 18 nt, Human
cuucaaggauccugagcc

SEQ ID NO: 1687637 - RNA, 19 nt, Human
cuucaaggauccugagcca

SEQ ID NO: 1687638 - RNA, 20 nt, Human
cuucaaggauccugagccag

SEQ ID NO: 1687639 - RNA, 22 nt, Human
cuuagucacugagacagcccgg

SEQ ID NO: 1687640 - RNA, 21 nt, Human
cuuagucacugagacagcccg

SEQ ID NO: 1687641 - RNA, 20 nt, Human
cuuagucacugagacagccc

SEQ ID NO: 1687642 - RNA, 17 nt, Human
cuucaaauccuugaaga

SEQ ID NO: 1687643 - RNA, 17 nt, Human
cuucagcaaaaauauuu

SEQ ID NO: 1687644 - RNA, 23 nt, Human
cuucacauauugauuuccguuaa

SEQ ID NO: 1687645 - RNA, 14 nt, Human
cuucacauauugau

SEQ ID NO: 1687646 - RNA, 23 nt, Human
cuucaaggauccugagccagauu

SEQ ID NO: 1687647 - RNA, 21 nt, Human
cuucaaggauccugagccaga

SEQ ID NO: 1687648 - RNA, 22 nt, Human
cuucaaggauccugagccagau

SEQ ID NO: 1687649 - RNA, 12 nt, Human
cuucacaacaga

SEQ ID NO: 1687650 - RNA, 14 nt, Human
cuucacaacagauu

SEQ ID NO: 1687651 - RNA, 13 nt, Human
cuuccugugacuu

SEQ ID NO: 1687652 - RNA, 16 nt, Human
cuuccugugacuucag

SEQ ID NO: 1687653 - RNA, 12 nt, Human
cuucccccucca

SEQ ID NO: 1687654 - RNA, 15 nt, Human
cuucccccuccaauc

SEQ ID NO: 1687655 - RNA, 16 nt, Human
cuuccacaagagccca

SEQ ID NO: 1687656 - RNA, 14 nt, Human
cuucgccaccuggg

SEQ ID NO: 1687657 - RNA, 21 nt, Human
cuucgauacaccgggccugga

SEQ ID NO: 1687658 - RNA, 16 nt, Human
cuucgauacaccgggc

SEQ ID NO: 1687659 - RNA, 15 nt, Human
cuucgccaccugggu

SEQ ID NO: 1687660 - RNA, 17 nt, Human
cuucgcuccugugucuu

SEQ ID NO: 1687661 - RNA, 16 nt, Human
cuucucacugccaugc

SEQ ID NO: 1687662 - RNA, 21 nt, Human
cuucucacugccaugccagcu

SEQ ID NO: 1687663 - RNA, 16 nt, Human
cuucucagaaggcaaa

SEQ ID NO: 1687664 - RNA, 22 nt, Human
cuucucagaaggcaaaugacuu

SEQ ID NO: 1687665 - RNA, 19 nt, Human
cuucgggaggucgaggcag

SEQ ID NO: 1687666 - RNA, 20 nt, Human
cuucggccuccauccugagg

SEQ ID NO: 1687667 - RNA, 18 nt, Human
cuuagaaguuuguuguga

SEQ ID NO: 1687668 - RNA, 19 nt, Human
cuuagaauuaguggcacuu

SEQ ID NO: 1687669 - RNA, 11 nt, Human
cuuagacaguc

SEQ ID NO: 1687670 - RNA, 14 nt, Human
cuuagucacugaga

SEQ ID NO: 1687671 - RNA, 23 nt, Human
cuuagguuggcaaaaaggcagga

SEQ ID NO: 1687672 - RNA, 21 nt, Human
cuuagguuggcaaaaaggcag

SEQ ID NO: 1687673 - RNA, 20 nt, Human
cuuaccugccaggaagccag

SEQ ID NO: 1687674 - RNA, 13 nt, Human
cuuacuguacaug

SEQ ID NO: 1687675 - RNA, 20 nt, Human
cuuagaaaaaccaccaccau

SEQ ID NO: 1687676 - RNA, 16 nt, Human
cuuagaaauugcauuu

SEQ ID NO: 1687677 - RNA, 17 nt, Human
cuuagaagucacacagu

SEQ ID NO: 1687678 - RNA, 20 nt, Human
cuuagaagucacacaguauu

SEQ ID NO: 1687679 - RNA, 17 nt, Human
cuuaaccagaucauugu

SEQ ID NO: 1687680 - RNA, 18 nt, Human
cuuaagaauuuugagcag

SEQ ID NO: 1687681 - RNA, 23 nt, Human
cuuaagaagacugcauuauauuu

SEQ ID NO: 1687682 - RNA, 12 nt, Human
cuuaaaaauggu

SEQ ID NO: 1687683 - RNA, 20 nt, Human
cuuaauucuuagcucauucu

SEQ ID NO: 1687684 - RNA, 19 nt, Human
cuuaauuaaaagaauauuu

SEQ ID NO: 1687685 - RNA, 20 nt, Human
cuuaauuaaaagaauauuuu

SEQ ID NO: 1687686 - RNA, 16 nt, Human
cuuaauuaaaagaaua

SEQ ID NO: 1687687 - RNA, 17 nt, Human
cuuaauuaaaagaauau

SEQ ID NO: 1687688 - RNA, 23 nt, Human
cuguucuuucuggcuaugcauuu

SEQ ID NO: 1687689 - RNA, 12 nt, Human
cuguugcccagg

SEQ ID NO: 1687690 - RNA, 13 nt, Human
cuguugcccaggc

SEQ ID NO: 1687691 - RNA, 14 nt, Human
cuguugcccaggcu

SEQ ID NO: 1687692 - RNA, 15 nt, Human
cuguugcccaggcug

SEQ ID NO: 1687693 - RNA, 16 nt, Human
cuguugcccaggcugg

SEQ ID NO: 1687694 - RNA, 16 nt, Human
cuguuaauaguucagg

SEQ ID NO: 1687695 - RNA, 21 nt, Human
cuguucuuucuggcuaugcau

SEQ ID NO: 1687696 - RNA, 14 nt, Human
cuguucuuucuggc

SEQ ID NO: 1687697 - RNA, 13 nt, Human
cuguucuuucugg

SEQ ID NO: 1687698 - RNA, 21 nt, Human
cuguucuuuccaaaguacacu

SEQ ID NO: 1687699 - RNA, 19 nt, Human
cuguucuuuccaaaguaca

SEQ ID NO: 1687700 - RNA, 16 nt, Human
cuguucuuuccaaagu

SEQ ID NO: 1687701 - RNA, 15 nt, Human
cuguucuuuccaaag

SEQ ID NO: 1687702 - RNA, 18 nt, Human
cuguugcccaggcuggcg

SEQ ID NO: 1687703 - RNA, 17 nt, Human
cuguugcccaggcuggc

SEQ ID NO: 1687704 - RNA, 17 nt, Human
cuguuuagauaauacac

SEQ ID NO: 1687705 - RNA, 14 nt, Human
cuguuuagauaaua

SEQ ID NO: 1687706 - RNA, 17 nt, Human
cuguuucaaacuuuacu

SEQ ID NO: 1687707 - RNA, 15 nt, Human
cuguuucaaacuuua

SEQ ID NO: 1687708 - RNA, 18 nt, Human
cuguuuagauaauacacc

SEQ ID NO: 1687709 - RNA, 17 nt, Human
cuguuugcuaagugagg

SEQ ID NO: 1687710 - RNA, 19 nt, Human
cuguuugcuaagugaggau

SEQ ID NO: 1687711 - RNA, 16 nt, Human
cuuaaaaaguggaaaa

SEQ ID NO: 1687712 - RNA, 17 nt, Human
cuuaaaaaguggaaaaa

SEQ ID NO: 1687713 - RNA, 13 nt, Human
cuguuuucucuug

SEQ ID NO: 1687714 - RNA, 22 nt, Human
cuguuuuacaaaaaagaaaaga

SEQ ID NO: 1687715 - RNA, 14 nt, Human
cuguuuuauaauuu

SEQ ID NO: 1687716 - RNA, 15 nt, Human
cuguuuuauaauuuu

SEQ ID NO: 1687717 - RNA, 17 nt, Human
cugguggcagcucaccu

SEQ ID NO: 1687718 - RNA, 18 nt, Human
cugguggcagcucaccuc

SEQ ID NO: 1687719 - RNA, 20 nt, Human
cugguggcagcucaccucuc

SEQ ID NO: 1687720 - RNA, 15 nt, Human
cugguggcagcugcg

SEQ ID NO: 1687721 - RNA, 14 nt, Human
cugguggcaguggg

SEQ ID NO: 1687722 - RNA, 18 nt, Human
cugguggcagugggagcu

SEQ ID NO: 1687723 - RNA, 15 nt, Human
cugguguauguguga

SEQ ID NO: 1687724 - RNA, 21 nt, Human
cugguggcagcucaccucucc

SEQ ID NO: 1687725 - RNA, 19 nt, Human
cugguggcagugggagcug

SEQ ID NO: 1687726 - RNA, 15 nt, Human
cuguaauuugugaua

SEQ ID NO: 1687727 - RNA, 14 nt, Human
cuguaauuugugau

SEQ ID NO: 1687728 - RNA, 14 nt, Human
cuguacagagccca

SEQ ID NO: 1687729 - RNA, 15 nt, Human
cuguacagagcccac

SEQ ID NO: 1687730 - RNA, 18 nt, Human
cuguacagagcccacgcc

SEQ ID NO: 1687731 - RNA, 22 nt, Human
cuguacagagcccacgccccca

SEQ ID NO: 1687732 - RNA, 19 nt, Human
cuguaauccuagcacuuug

SEQ ID NO: 1687733 - RNA, 22 nt, Human
cugguuagagguucccuuugac

SEQ ID NO: 1687734 - RNA, 16 nt, Human
cuggugugaacuaaac

SEQ ID NO: 1687735 - RNA, 21 nt, Human
cugguuagagguucccuuuga

SEQ ID NO: 1687736 - RNA, 17 nt, Human
cuggugugaacuaaacu

SEQ ID NO: 1687737 - RNA, 17 nt, Human
cuguauuagucacagag

SEQ ID NO: 1687738 - RNA, 19 nt, Human
cuguauuagucacagagau

SEQ ID NO: 1687739 - RNA, 21 nt, Human
cuguaucccaugagccucagc

SEQ ID NO: 1687740 - RNA, 22 nt, Human
cuguaucccaugagccucagca

SEQ ID NO: 1687741 - RNA, 20 nt, Human
cuguaucccaugagccucag

SEQ ID NO: 1687742 - RNA, 20 nt, Human
cuguauuuuguuuuugucuu

SEQ ID NO: 1687743 - RNA, 15 nt, Human
cugucaauuacagga

SEQ ID NO: 1687744 - RNA, 16 nt, Human
cugucaauuacaggaa

SEQ ID NO: 1687745 - RNA, 15 nt, Human
cuguacuccucccag

SEQ ID NO: 1687746 - RNA, 16 nt, Human
cuguacuccucccagg

SEQ ID NO: 1687747 - RNA, 19 nt, Human
cuguacuccucccaggcgc

SEQ ID NO: 1687748 - RNA, 21 nt, Human
cuguacuccucccaggcgccc

SEQ ID NO: 1687749 - RNA, 14 nt, Human
cuguacuccuccca

SEQ ID NO: 1687750 - RNA, 19 nt, Human
cuguacgucugacaggcaa

SEQ ID NO: 1687751 - RNA, 20 nt, Human
cuguacgucugacaggcaau

SEQ ID NO: 1687752 - RNA, 21 nt, Human
cuguacaugaaaacacauuuu

SEQ ID NO: 1687753 - RNA, 20 nt, Human
cuguacaugaaaacacauuu

SEQ ID NO: 1687754 - RNA, 17 nt, Human
cuguacaugaaaacaca

SEQ ID NO: 1687755 - RNA, 14 nt, Human
cuguacgucugaca

SEQ ID NO: 1687756 - RNA, 15 nt, Human
cuguacgucugacag

SEQ ID NO: 1687757 - RNA, 16 nt, Human
cuguacgucugacagg

SEQ ID NO: 1687758 - RNA, 18 nt, Human
cuguacgucugacaggca

SEQ ID NO: 1687759 - RNA, 16 nt, Human
cugggggccucuucug

SEQ ID NO: 1687760 - RNA, 18 nt, Human
cugggggcugggcagagg

SEQ ID NO: 1687761 - RNA, 14 nt, Human
cugggggcugggca

SEQ ID NO: 1687762 - RNA, 17 nt, Human
cugggcuucaguggcag

SEQ ID NO: 1687763 - RNA, 15 nt, Human
cugggcuucaguggc

SEQ ID NO: 1687764 - RNA, 22 nt, Human
cugggcuuggggaccagagcug

SEQ ID NO: 1687765 - RNA, 18 nt, Human
cugggcuugucuguagau

SEQ ID NO: 1687766 - RNA, 15 nt, Human
cugggucgcccugga

SEQ ID NO: 1687767 - RNA, 16 nt, Human
cugggucgcccuggac

SEQ ID NO: 1687768 - RNA, 14 nt, Human
cugggguuaucuga

SEQ ID NO: 1687769 - RNA, 24 nt, Human
cuggggugggggugggaggccagc

SEQ ID NO: 1687770 - RNA, 20 nt, Human
cuggggguucuuucuuccuc

SEQ ID NO: 1687771 - RNA, 23 nt, Human
cuggggguucuuucuuccucugc

SEQ ID NO: 1687772 - RNA, 13 nt, Human
cugggucgcccug

SEQ ID NO: 1687773 - RNA, 20 nt, Human
cugggccccugccucucugc

SEQ ID NO: 1687774 - RNA, 23 nt, Human
cugggccccugccucucugcagg

SEQ ID NO: 1687775 - RNA, 18 nt, Human
cugggauuacaggcguga

SEQ ID NO: 1687776 - RNA, 21 nt, Human
cugggauuacaagcgugagcc

SEQ ID NO: 1687777 - RNA, 18 nt, Human
cugggcugaacacuccaa

SEQ ID NO: 1687778 - RNA, 14 nt, Human
cuguggaucaaauc

SEQ ID NO: 1687779 - RNA, 24 nt, Human
cuguggaucaaauccagccugcug

SEQ ID NO: 1687780 - RNA, 12 nt, Human
cugugccucugc

SEQ ID NO: 1687781 - RNA, 13 nt, Human
cugugccucugcc

SEQ ID NO: 1687782 - RNA, 14 nt, Human
cugugccucugccu

SEQ ID NO: 1687783 - RNA, 15 nt, Human
cugugccucugccug

SEQ ID NO: 1687784 - RNA, 16 nt, Human
cugugccucugccugu

SEQ ID NO: 1687785 - RNA, 17 nt, Human
cugugccucugccuguc

SEQ ID NO: 1687786 - RNA, 21 nt, Human
cuguggguuucuaaagcugcc

SEQ ID NO: 1687787 - RNA, 15 nt, Human
cuguggugacuuugg

SEQ ID NO: 1687788 - RNA, 17 nt, Human
cuguggugacuuuggau

SEQ ID NO: 1687789 - RNA, 18 nt, Human
cuguggugacuuuggaua

SEQ ID NO: 1687790 - RNA, 20 nt, Human
cuguggugacuuuggauaau

SEQ ID NO: 1687791 - RNA, 23 nt, Human
cuguggugacuuuggauaauaag

SEQ ID NO: 1687792 - RNA, 13 nt, Human
cuguggugacuuu

SEQ ID NO: 1687793 - RNA, 14 nt, Human
cuguggugacuuug

SEQ ID NO: 1687794 - RNA, 12 nt, Human
cuguggugacuu

SEQ ID NO: 1687795 - RNA, 22 nt, Human
cuguggguuucuaaagcugcca

SEQ ID NO: 1687796 - RNA, 14 nt, Human
cugugugcucagga

SEQ ID NO: 1687797 - RNA, 19 nt, Human
cugugucuuuaaaugcugc

SEQ ID NO: 1687798 - RNA, 20 nt, Human
cugugucuuuaaaugcugcu

SEQ ID NO: 1687799 - RNA, 21 nt, Human
cugugucuuuaaaugcugcuu

SEQ ID NO: 1687800 - RNA, 20 nt, Human
cugugucuuuuuucacuaca

SEQ ID NO: 1687801 - RNA, 18 nt, Human
cugugugugcgccuacag

SEQ ID NO: 1687802 - RNA, 19 nt, Human
cuguuaaaagaugaaaaua

SEQ ID NO: 1687803 - RNA, 15 nt, Human
cuguuaaaagaugaa

SEQ ID NO: 1687804 - RNA, 16 nt, Human
cuguuaaaagaugaaa

SEQ ID NO: 1687805 - RNA, 23 nt, Human
cugucauuugagcagggcucagc

SEQ ID NO: 1687806 - RNA, 18 nt, Human
cugucaauuacaggaagu

SEQ ID NO: 1687807 - RNA, 19 nt, Human
cugucaauuacaggaagua

SEQ ID NO: 1687808 - RNA, 21 nt, Human
cugucauuugagcagggcuca

SEQ ID NO: 1687809 - RNA, 22 nt, Human
cugucauuugagcagggcucag

SEQ ID NO: 1687810 - RNA, 21 nt, Human
cugucuugccuuuuucauuau

SEQ ID NO: 1687811 - RNA, 23 nt, Human
cugucuugccuuuuucauuauuu

SEQ ID NO: 1687812 - RNA, 21 nt, Human
cugucuuuuuucuaaaguaaa

SEQ ID NO: 1687813 - RNA, 15 nt, Human
cugugaaaggaaaga

SEQ ID NO: 1687814 - RNA, 18 nt, Human
cugucuucaguaagccgu

SEQ ID NO: 1687815 - RNA, 18 nt, Human
cugucuucacaacagauu

SEQ ID NO: 1687816 - RNA, 14 nt, Human
cugugccaugugcc

SEQ ID NO: 1687817 - RNA, 19 nt, Human
cugugcccuaaaguguauu

SEQ ID NO: 1687818 - RNA, 15 nt, Human
cugugccaugugcca

SEQ ID NO: 1687819 - RNA, 15 nt, Human
cugugauggggcccu

SEQ ID NO: 1687820 - RNA, 23 nt, Human
cugugauggggcccugccuccuu

SEQ ID NO: 1687821 - RNA, 16 nt, Human
cugugauggggcccug

SEQ ID NO: 1687822 - RNA, 21 nt, Human
cugugauggggcccugccucc

SEQ ID NO: 1687823 - RNA, 16 nt, Human
cugugaaaggaaagag

SEQ ID NO: 1687824 - RNA, 22 nt, Human
cugugaaaggaaagagggaggu

SEQ ID NO: 1687825 - RNA, 23 nt, Human
cccaccgggcugggagcucugca

SEQ ID NO: 1687826 - RNA, 22 nt, Human
cccaccucucucacuccuugaa

SEQ ID NO: 1687827 - RNA, 18 nt, Human
cccaccaucaugucuggc

SEQ ID NO: 1687828 - RNA, 19 nt, Human
cccaccgcagacaggacca

SEQ ID NO: 1687829 - RNA, 20 nt, Human
cccaccgcagacaggaccag

SEQ ID NO: 1687830 - RNA, 19 nt, Human
cccacgcuggagugcagug

SEQ ID NO: 1687831 - RNA, 20 nt, Human
cccacgcuggagugcaguga

SEQ ID NO: 1687832 - RNA, 21 nt, Human
cccacgcuggagugcagugag

SEQ ID NO: 1687833 - RNA, 23 nt, Human
cccacuugagaauuacccuuuug

SEQ ID NO: 1687834 - RNA, 12 nt, Human
cccacuucugcc

SEQ ID NO: 1687835 - RNA, 17 nt, Human
cccaccuggccucugca

SEQ ID NO: 1687836 - RNA, 19 nt, Human
cccaccuggccucugcacu

SEQ ID NO: 1687837 - RNA, 21 nt, Human
cccaccuggccucugcacucc

SEQ ID NO: 1687838 - RNA, 20 nt, Human
cccacgacugcccggcaggg

SEQ ID NO: 1687839 - RNA, 21 nt, Human
cccacgacugcccggcagggu

SEQ ID NO: 1687840 - RNA, 20 nt, Human
cccacaagaaaugaaagcag

SEQ ID NO: 1687841 - RNA, 16 nt, Human
cccaaugcacuuuguu

SEQ ID NO: 1687842 - RNA, 20 nt, Human
cccaaugcacuuuguucugg

SEQ ID NO: 1687843 - RNA, 23 nt, Human
cccaaugcacuuuguucuggcuc

SEQ ID NO: 1687844 - RNA, 13 nt, Human
cccacaagaaaug

SEQ ID NO: 1687845 - RNA, 18 nt, Human
cccugcccaccuggccuc

SEQ ID NO: 1687846 - RNA, 16 nt, Human
cccugcuggguguggc

SEQ ID NO: 1687847 - RNA, 21 nt, Human
cccugcuggguguggcgcagc

SEQ ID NO: 1687848 - RNA, 14 nt, Human
cccugcccaccugg

SEQ ID NO: 1687849 - RNA, 17 nt, Human
cccugcccaccuggccu

SEQ ID NO: 1687850 - RNA, 20 nt, Human
cccugcuuugggcugcccug

SEQ ID NO: 1687851 - RNA, 22 nt, Human
cccugcuuugggcugcccuggu

SEQ ID NO: 1687852 - RNA, 17 nt, Human
cccugcuuucagauacu

SEQ ID NO: 1687853 - RNA, 17 nt, Human
cccugcuuugggcugcc

SEQ ID NO: 1687854 - RNA, 18 nt, Human
cccugcuuugggcugccc

SEQ ID NO: 1687855 - RNA, 19 nt, Human
cccugcuuugggcugcccu

SEQ ID NO: 1687856 - RNA, 22 nt, Human
cccugcuggguguggcgcagca

SEQ ID NO: 1687857 - RNA, 19 nt, Human
cccuggcuuuucacugcug

SEQ ID NO: 1687858 - RNA, 22 nt, Human
cccuggcuuuucacugcuggcu

SEQ ID NO: 1687859 - RNA, 18 nt, Human
cccugggaggcagugaug

SEQ ID NO: 1687860 - RNA, 18 nt, Human
cccuggcuuuucacugcu

SEQ ID NO: 1687861 - RNA, 21 nt, Human
cccuggacugugugcucagga

SEQ ID NO: 1687862 - RNA, 15 nt, Human
cccuggacugugugc

SEQ ID NO: 1687863 - RNA, 15 nt, Human
cccugggaggcucug

SEQ ID NO: 1687864 - RNA, 15 nt, Human
cccugguggcagcuc

SEQ ID NO: 1687865 - RNA, 16 nt, Human
cccugguggcagcuca

SEQ ID NO: 1687866 - RNA, 17 nt, Human
cccugguggcagcucac

SEQ ID NO: 1687867 - RNA, 16 nt, Human
cccugcaaagcccagc

SEQ ID NO: 1687868 - RNA, 17 nt, Human
cccugcaaagcccagcu

SEQ ID NO: 1687869 - RNA, 19 nt, Human
cccugcaaagcccagcuug

SEQ ID NO: 1687870 - RNA, 20 nt, Human
cccugcaaagcccagcuuga

SEQ ID NO: 1687871 - RNA, 23 nt, Human
cccugcacaaagcccuuccaugu

SEQ ID NO: 1687872 - RNA, 15 nt, Human
cccugcaaagcccag

SEQ ID NO: 1687873 - RNA, 22 nt, Human
cccugcacuugcagacucuaca

SEQ ID NO: 1687874 - RNA, 19 nt, Human
cccugcacuugcagacucu

SEQ ID NO: 1687875 - RNA, 12 nt, Human
cccugcacuugc

SEQ ID NO: 1687876 - RNA, 16 nt, Human
cccucuggggcuguuc

SEQ ID NO: 1687877 - RNA, 15 nt, Human
cccugaaagcccuga

SEQ ID NO: 1687878 - RNA, 13 nt, Human
cccugaggcccag

SEQ ID NO: 1687879 - RNA, 16 nt, Human
cccugaaagcccugag

SEQ ID NO: 1687880 - RNA, 14 nt, Human
cccugaggcccaga

SEQ ID NO: 1687881 - RNA, 15 nt, Human
cccugaggcccagag

SEQ ID NO: 1687882 - RNA, 16 nt, Human
cccugaggcccagagg

SEQ ID NO: 1687883 - RNA, 17 nt, Human
cccugaggcccagaggg

SEQ ID NO: 1687884 - RNA, 18 nt, Human
cccugaggcccagagggc

SEQ ID NO: 1687885 - RNA, 19 nt, Human
cccugaggcccagagggcc

SEQ ID NO: 1687886 - RNA, 20 nt, Human
cccugaggcccagagggccu

SEQ ID NO: 1687887 - RNA, 23 nt, Human
cccugaggcccagagggccugca

SEQ ID NO: 1687888 - RNA, 17 nt, Human
cccuccaccucccugca

SEQ ID NO: 1687889 - RNA, 15 nt, Human
cccuccaccucccug

SEQ ID NO: 1687890 - RNA, 19 nt, Human
cccuccaccucccugcaau

SEQ ID NO: 1687891 - RNA, 22 nt, Human
cccuauccuacuuccccuuccu

SEQ ID NO: 1687892 - RNA, 12 nt, Human
cccuccaccucc

SEQ ID NO: 1687893 - RNA, 14 nt, Human
cccuccaccucccu

SEQ ID NO: 1687894 - RNA, 13 nt, Human
cccucuccugggc

SEQ ID NO: 1687895 - RNA, 12 nt, Human
cccucuccuggg

SEQ ID NO: 1687896 - RNA, 11 nt, Human
cccucuccugg

SEQ ID NO: 1687897 - RNA, 15 nt, Human
cccucuccugggcag

SEQ ID NO: 1687898 - RNA, 14 nt, Human
cccucuccugggca

SEQ ID NO: 1687899 - RNA, 14 nt, Human
cccagagggccugc

SEQ ID NO: 1687900 - RNA, 15 nt, Human
cccagagggccugca

SEQ ID NO: 1687901 - RNA, 18 nt, Human
cccagagggccugcaagg

SEQ ID NO: 1687902 - RNA, 13 nt, Human
cccgaguagcugg

SEQ ID NO: 1687903 - RNA, 14 nt, Human
cccgaguagcuggg

SEQ ID NO: 1687904 - RNA, 15 nt, Human
cccgaguagcuggga

SEQ ID NO: 1687905 - RNA, 16 nt, Human
cccgaguagcugggac

SEQ ID NO: 1687906 - RNA, 17 nt, Human
cccgaguagcugggacu

SEQ ID NO: 1687907 - RNA, 18 nt, Human
cccgaguagcugggacua

SEQ ID NO: 1687908 - RNA, 21 nt, Human
cccgaguagcugggacuacag

SEQ ID NO: 1687909 - RNA, 12 nt, Human
cccgggcucugc

SEQ ID NO: 1687910 - RNA, 14 nt, Human
cccgggcucugccu

SEQ ID NO: 1687911 - RNA, 15 nt, Human
cccgggcucugccuc

SEQ ID NO: 1687912 - RNA, 19 nt, Human
cccgcugucagccauuccu

SEQ ID NO: 1687913 - RNA, 20 nt, Human
cccgcugucagccauuccug

SEQ ID NO: 1687914 - RNA, 22 nt, Human
cccgaguagcugggacuacagg

SEQ ID NO: 1687915 - RNA, 21 nt, Human
cccuaccgagucucuucucca

SEQ ID NO: 1687916 - RNA, 18 nt, Human
cccuaccgagucucuucu

SEQ ID NO: 1687917 - RNA, 21 nt, Human
cccuaaugcgcaggcuggccc

SEQ ID NO: 1687918 - RNA, 22 nt, Human
cccuaaugcgcaggcuggcccu

SEQ ID NO: 1687919 - RNA, 17 nt, Human
cccuaaugcgcaggcug

SEQ ID NO: 1687920 - RNA, 23 nt, Human
cccuaaugcgcaggcuggcccug

SEQ ID NO: 1687921 - RNA, 20 nt, Human
cccuacaguugaaaaacagc

SEQ ID NO: 1687922 - RNA, 16 nt, Human
cccgggcucugccucc

SEQ ID NO: 1687923 - RNA, 18 nt, Human
cccggugcccaagaauag

SEQ ID NO: 1687924 - RNA, 22 nt, Human
cccgucucugguuccuccccuc

SEQ ID NO: 1687925 - RNA, 15 nt, Human
cccgugggguuccuc

SEQ ID NO: 1687926 - RNA, 17 nt, Human
ccucccgaauagcuggg

SEQ ID NO: 1687927 - RNA, 16 nt, Human
ccucuaggaggucucu

SEQ ID NO: 1687928 - RNA, 16 nt, Human
ccucggugccuuccuc

SEQ ID NO: 1687929 - RNA, 14 nt, Human
ccucgguguggaga

SEQ ID NO: 1687930 - RNA, 18 nt, Human
ccucgguguggagaagcg

SEQ ID NO: 1687931 - RNA, 23 nt, Human
ccuccugccucgaacuggcugca

SEQ ID NO: 1687932 - RNA, 13 nt, Human
ccuccugcugggc

SEQ ID NO: 1687933 - RNA, 14 nt, Human
ccuccugggcuaag

SEQ ID NO: 1687934 - RNA, 18 nt, Human
ccuccucugcuugccauc

SEQ ID NO: 1687935 - RNA, 13 nt, Human
ccuccucugcuug

SEQ ID NO: 1687936 - RNA, 16 nt, Human
ccuccucugcuugcca

SEQ ID NO: 1687937 - RNA, 20 nt, Human
ccucccgaguagcugggacu

SEQ ID NO: 1687938 - RNA, 21 nt, Human
ccucccgaguagcugggacua

SEQ ID NO: 1687939 - RNA, 22 nt, Human
ccucccugccccucccuucaac

SEQ ID NO: 1687940 - RNA, 24 nt, Human
ccucccugccccucccuucaacca

SEQ ID NO: 1687941 - RNA, 14 nt, Human
ccuccucagaucuu

SEQ ID NO: 1687942 - RNA, 18 nt, Human
ccucccugccccucccuu

SEQ ID NO: 1687943 - RNA, 21 nt, Human
ccucccugccccucccuucaa

SEQ ID NO: 1687944 - RNA, 20 nt, Human
ccucccuccaccucccugca

SEQ ID NO: 1687945 - RNA, 10 nt, Human
ccucccuccc

SEQ ID NO: 1687946 - RNA, 17 nt, Human
ccucccuccaccucccu

SEQ ID NO: 1687947 - RNA, 23 nt, Human
ccuccaaucccaccaacccucag

SEQ ID NO: 1687948 - RNA, 21 nt, Human
ccucaucuccccaucauuggu

SEQ ID NO: 1687949 - RNA, 13 nt, Human
ccucauccucaua

SEQ ID NO: 1687950 - RNA, 20 nt, Human
ccucauccucauacccaccc

SEQ ID NO: 1687951 - RNA, 19 nt, Human
ccuaugcagagguccacaa

SEQ ID NO: 1687952 - RNA, 20 nt, Human
ccucagucuggcccuuccuu

SEQ ID NO: 1687953 - RNA, 11 nt, Human
ccucagugcca

SEQ ID NO: 1687954 - RNA, 21 nt, Human
ccucauagcccucacccuggg

SEQ ID NO: 1687955 - RNA, 22 nt, Human
ccucauagcccucacccugggg

SEQ ID NO: 1687956 - RNA, 20 nt, Human
ccucauaguaugguggcugg

SEQ ID NO: 1687957 - RNA, 17 nt, Human
ccucauagcccucaccc

SEQ ID NO: 1687958 - RNA, 18 nt, Human
ccucauagcccucacccu

SEQ ID NO: 1687959 - RNA, 13 nt, Human
ccucauacccacc

SEQ ID NO: 1687960 - RNA, 21 nt, Human
ccucauaguaugguggcuggg

SEQ ID NO: 1687961 - RNA, 22 nt, Human
ccucauaguaugguggcugggu

SEQ ID NO: 1687962 - RNA, 13 nt, Human
ccucaucaccaac

SEQ ID NO: 1687963 - RNA, 14 nt, Human
ccucaucaccaacg

SEQ ID NO: 1687964 - RNA, 14 nt, Human
ccuccaugcugccu

SEQ ID NO: 1687965 - RNA, 23 nt, Human
ccuccaugugggcuaguugggcu

SEQ ID NO: 1687966 - RNA, 15 nt, Human
ccuccaugcugccuc

SEQ ID NO: 1687967 - RNA, 15 nt, Human
ccucccaaagugcug

SEQ ID NO: 1687968 - RNA, 16 nt, Human
ccucccaaagugcugg

SEQ ID NO: 1687969 - RNA, 18 nt, Human
ccuccaucuaaacugccc

SEQ ID NO: 1687970 - RNA, 22 nt, Human
ccuccaggugcacaagcuccaa

SEQ ID NO: 1687971 - RNA, 19 nt, Human
ccuccaggugcacaagcuc

SEQ ID NO: 1687972 - RNA, 21 nt, Human
ccuccaggugcacaagcucca

SEQ ID NO: 1687973 - RNA, 22 nt, Human
ccuccaccucccugcaauaaaa

SEQ ID NO: 1687974 - RNA, 17 nt, Human
ccuccaccucccugcaa

SEQ ID NO: 1687975 - RNA, 15 nt, Human
ccuccaccucccugc

SEQ ID NO: 1687976 - RNA, 14 nt, Human
ccuccaccucccug

SEQ ID NO: 1687977 - RNA, 13 nt, Human
ccuccaccucccu

SEQ ID NO: 1687978 - RNA, 22 nt, Human
ccuaccgagucucuucuccacu

SEQ ID NO: 1687979 - RNA, 23 nt, Human
ccuaccgagucucuucuccacug

SEQ ID NO: 1687980 - RNA, 13 nt, Human
ccuacuuccugug

SEQ ID NO: 1687981 - RNA, 21 nt, Human
ccuacuuccccuuccuaauuc

SEQ ID NO: 1687982 - RNA, 15 nt, Human
ccuacuuccugugac

SEQ ID NO: 1687983 - RNA, 13 nt, Human
ccuaguuccacca

SEQ ID NO: 1687984 - RNA, 21 nt, Human
ccuaguuccaccaucaagcca

SEQ ID NO: 1687985 - RNA, 23 nt, Human
ccuaguuccaccaucaagccacc

SEQ ID NO: 1687986 - RNA, 22 nt, Human
ccuauauuguuuucaguguaca

SEQ ID NO: 1687987 - RNA, 18 nt, Human
ccuauauuguuuucagug

SEQ ID NO: 1687988 - RNA, 17 nt, Human
ccuaaauccauuuggaa

SEQ ID NO: 1687989 - RNA, 18 nt, Human
ccuaaauccauuuggaaa

SEQ ID NO: 1687990 - RNA, 15 nt, Human
ccuacaagacacagu

SEQ ID NO: 1687991 - RNA, 12 nt, Human
ccuaaauccauu

SEQ ID NO: 1687992 - RNA, 18 nt, Human
ccuaaauauauuuuaaga

SEQ ID NO: 1687993 - RNA, 16 nt, Human
ccuaaauauauuuuaa

SEQ ID NO: 1687994 - RNA, 15 nt, Human
ccuaaaauucagugg

SEQ ID NO: 1687995 - RNA, 18 nt, Human
cccugguuuccugcccug

SEQ ID NO: 1687996 - RNA, 19 nt, Human
cccugguuuccugcccugg

SEQ ID NO: 1687997 - RNA, 14 nt, Human
ccgaggccuucucu

SEQ ID NO: 1687998 - RNA, 20 nt, Human
cccugguggcagcucaccuc

SEQ ID NO: 1687999 - RNA, 16 nt, Human
cccugguuuccugccc

SEQ ID NO: 1688000 - RNA, 17 nt, Human
cccugguuuccugcccu

SEQ ID NO: 1688001 - RNA, 20 nt, Human
ccgaguagcugggacuacag

SEQ ID NO: 1688002 - RNA, 17 nt, Human
ccgaggccuucucugaa

SEQ ID NO: 1688003 - RNA, 17 nt, Human
ccgaguagcugggacua

SEQ ID NO: 1688004 - RNA, 21 nt, Human
ccgcuaagagggagggagggc

SEQ ID NO: 1688005 - RNA, 11 nt, Human
ccgcucagccc

SEQ ID NO: 1688006 - RNA, 12 nt, Human
ccgcucagcccu

SEQ ID NO: 1688007 - RNA, 13 nt, Human
ccgcucagcccuc

SEQ ID NO: 1688008 - RNA, 23 nt, Human
ccgcuaagagggagggagggcuc

SEQ ID NO: 1688009 - RNA, 14 nt, Human
ccgcacugggcuug

SEQ ID NO: 1688010 - RNA, 19 nt, Human
ccgcacugggcuuggggac

SEQ ID NO: 1688011 - RNA, 20 nt, Human
ccgggaagggggcugggaca

SEQ ID NO: 1688012 - RNA, 19 nt, Human
ccgcuuucuacccagcgag

SEQ ID NO: 1688013 - RNA, 23 nt, Human
ccgcuuucuacccagcgagcccu

SEQ ID NO: 1688014 - RNA, 17 nt, Human
ccggcuggccuggcccc

SEQ ID NO: 1688015 - RNA, 18 nt, Human
ccggcuggccuggccccu

SEQ ID NO: 1688016 - RNA, 15 nt, Human
ccgcucagcccuccc

SEQ ID NO: 1688017 - RNA, 19 nt, Human
ccgcucagcccucccugcc

SEQ ID NO: 1688018 - RNA, 21 nt, Human
ccgcucagcccucccugcccc

SEQ ID NO: 1688019 - RNA, 22 nt, Human
ccgcucagcccucccugccccu

SEQ ID NO: 1688020 - RNA, 12 nt, Human
ccgcuuucuacc

SEQ ID NO: 1688021 - RNA, 15 nt, Human
ccgugcuaaggacuu

SEQ ID NO: 1688022 - RNA, 16 nt, Human
ccgugcuaaggacuug

SEQ ID NO: 1688023 - RNA, 14 nt, Human
ccgugcuaaggacu

SEQ ID NO: 1688024 - RNA, 13 nt, Human
ccgggcugggagc

SEQ ID NO: 1688025 - RNA, 18 nt, Human
ccgggcugggagcucugc

SEQ ID NO: 1688026 - RNA, 19 nt, Human
ccgggcugggagcucugca

SEQ ID NO: 1688027 - RNA, 13 nt, Human
ccgggcucugccu

SEQ ID NO: 1688028 - RNA, 20 nt, Human
ccgggcgcgguggcucacgc

SEQ ID NO: 1688029 - RNA, 16 nt, Human
ccgggcguggugguga

SEQ ID NO: 1688030 - RNA, 12 nt, Human
ccuucagugccu

SEQ ID NO: 1688031 - RNA, 17 nt, Human
ccuuaaagaguguggca

SEQ ID NO: 1688032 - RNA, 12 nt, Human
ccuuaaaggaag

SEQ ID NO: 1688033 - RNA, 14 nt, Human
ccuuacacaauggu

SEQ ID NO: 1688034 - RNA, 20 nt, Human
ccuuacacaaugguuuucuu

SEQ ID NO: 1688035 - RNA, 17 nt, Human
ccuuagaagucacacag

SEQ ID NO: 1688036 - RNA, 18 nt, Human
ccuuagaagucacacagu

SEQ ID NO: 1688037 - RNA, 19 nt, Human
ccuuacccucauguucuua

SEQ ID NO: 1688038 - RNA, 19 nt, Human
ccuuaccugccaggaagcc

SEQ ID NO: 1688039 - RNA, 17 nt, Human
ccuuaccacugcucuga

SEQ ID NO: 1688040 - RNA, 13 nt, Human
ccuuaccagcaga

SEQ ID NO: 1688041 - RNA, 15 nt, Human
ccuuacccucauguu

SEQ ID NO: 1688042 - RNA, 20 nt, Human
ccuuaccacugcucugauga

SEQ ID NO: 1688043 - RNA, 20 nt, Human
ccuuaccagcagagcaccuu

SEQ ID NO: 1688044 - RNA, 20 nt, Human
ccugugugugcgccuacagg

SEQ ID NO: 1688045 - RNA, 21 nt, Human
ccugugugugcgccuacagga

SEQ ID NO: 1688046 - RNA, 22 nt, Human
ccugugucuuuaaaugcugcuu

SEQ ID NO: 1688047 - RNA, 22 nt, Human
ccugugucuugcaauggcagcc

SEQ ID NO: 1688048 - RNA, 17 nt, Human
ccugugucuugcaaugg

SEQ ID NO: 1688049 - RNA, 19 nt, Human
ccugugucuugcaauggca

SEQ ID NO: 1688050 - RNA, 21 nt, Human
ccugugucuugcaauggcagc

SEQ ID NO: 1688051 - RNA, 16 nt, Human
ccuguuucugcagcca

SEQ ID NO: 1688052 - RNA, 14 nt, Human
ccuguuuguuucug

SEQ ID NO: 1688053 - RNA, 18 nt, Human
ccuguuuguuucugaaag

SEQ ID NO: 1688054 - RNA, 23 nt, Human
ccuguugggccaggagccuccug

SEQ ID NO: 1688055 - RNA, 12 nt, Human
ccuguuuaagag

SEQ ID NO: 1688056 - RNA, 15 nt, Human
ccuguuuaagagaca

SEQ ID NO: 1688057 - RNA, 20 nt, Human
ccuguuaaaagaugaaaaua

SEQ ID NO: 1688058 - RNA, 21 nt, Human
ccuguuaaaagaugaaaauau

SEQ ID NO: 1688059 - RNA, 14 nt, Human
ccuucacuuaggaa

SEQ ID NO: 1688060 - RNA, 21 nt, Human
ccuucaccuuuguccccaccg

SEQ ID NO: 1688061 - RNA, 14 nt, Human
ccuuagacaguccc

SEQ ID NO: 1688062 - RNA, 17 nt, Human
ccuucacagaugggugc

SEQ ID NO: 1688063 - RNA, 19 nt, Human
ccuucaccuuuguccccac

SEQ ID NO: 1688064 - RNA, 20 nt, Human
ccuucaccuuuguccccacc

SEQ ID NO: 1688065 - RNA, 11 nt, Human
ccuucagugcc

SEQ ID NO: 1688066 - RNA, 14 nt, Human
ccuucagugccaaa

SEQ ID NO: 1688067 - RNA, 12 nt, Human
ccuucagccuga

SEQ ID NO: 1688068 - RNA, 15 nt, Human
ccuuccucugagccu

SEQ ID NO: 1688069 - RNA, 16 nt, Human
ccuuccucugagccuu

SEQ ID NO: 1688070 - RNA, 21 nt, Human
ccuuccucuccacugccuucg

SEQ ID NO: 1688071 - RNA, 20 nt, Human
ccuuccucugagccuuggga

SEQ ID NO: 1688072 - RNA, 13 nt, Human
ccuuccucugagg

SEQ ID NO: 1688073 - RNA, 14 nt, Human
ccuuccucugaggc

SEQ ID NO: 1688074 - RNA, 22 nt, Human
ccuucauuuggcauuccccacu

SEQ ID NO: 1688075 - RNA, 15 nt, Human
ccuucgauacaccgg

SEQ ID NO: 1688076 - RNA, 14 nt, Human
ccuucggccuccau

SEQ ID NO: 1688077 - RNA, 19 nt, Human
ccuucggccuccauccuga

SEQ ID NO: 1688078 - RNA, 20 nt, Human
ccuucggccuccauccugag

SEQ ID NO: 1688079 - RNA, 16 nt, Human
ccuuugacgccauccc

SEQ ID NO: 1688080 - RNA, 17 nt, Human
ccuuugacgccauccca

SEQ ID NO: 1688081 - RNA, 18 nt, Human
ccuuugacgccaucccag

SEQ ID NO: 1688082 - RNA, 12 nt, Human
ccuugggacccc

SEQ ID NO: 1688083 - RNA, 14 nt, Human
ccuugaugaagaag

SEQ ID NO: 1688084 - RNA, 22 nt, Human
ccuuggugucgggcaugacacg

SEQ ID NO: 1688085 - RNA, 21 nt, Human
ccuugguuaggcauuguggga

SEQ ID NO: 1688086 - RNA, 22 nt, Human
ccuugguuaggcauugugggaa

SEQ ID NO: 1688087 - RNA, 19 nt, Human
ccuuggggcugaugcaguu

SEQ ID NO: 1688088 - RNA, 13 nt, Human
ccuugaacuagga

SEQ ID NO: 1688089 - RNA, 20 nt, Human
ccuugaguugauucagcucu

SEQ ID NO: 1688090 - RNA, 23 nt, Human
ccuugaccauucuccaccugcca

SEQ ID NO: 1688091 - RNA, 13 nt, Human
ccuugacucuuuc

SEQ ID NO: 1688092 - RNA, 15 nt, Human
ccuucuccuucaccu

SEQ ID NO: 1688093 - RNA, 19 nt, Human
ccuucuccuucaccuuugu

SEQ ID NO: 1688094 - RNA, 15 nt, Human
ccuucggcgccuuaa

SEQ ID NO: 1688095 - RNA, 16 nt, Human
ccuucggccuccaucc

SEQ ID NO: 1688096 - RNA, 21 nt, Human
ccuucuguggcucacagaacc

SEQ ID NO: 1688097 - RNA, 14 nt, Human
ccuucuguggcuca

SEQ ID NO: 1688098 - RNA, 14 nt, Human
cgagcaugccugga

SEQ ID NO: 1688099 - RNA, 20 nt, Human
cgauuucuguuuagauaaua

SEQ ID NO: 1688100 - RNA, 18 nt, Human
cgagcccugguggcagug

SEQ ID NO: 1688101 - RNA, 18 nt, Human
cgagcaugccuggauggg

SEQ ID NO: 1688102 - RNA, 15 nt, Human
cgagcccugguggca

SEQ ID NO: 1688103 - RNA, 16 nt, Human
cgagcccugguggcag

SEQ ID NO: 1688104 - RNA, 22 nt, Human
cgccaggggaaaaucagccugc

SEQ ID NO: 1688105 - RNA, 15 nt, Human
cgcagcccugcagag

SEQ ID NO: 1688106 - RNA, 19 nt, Human
cgccagauucuuuccugag

SEQ ID NO: 1688107 - RNA, 20 nt, Human
cgccagauucuuuccugagg

SEQ ID NO: 1688108 - RNA, 21 nt, Human
cgccagauucuuuccugaggc

SEQ ID NO: 1688109 - RNA, 15 nt, Human
cgcagacaggaccag

SEQ ID NO: 1688110 - RNA, 16 nt, Human
cgcagacaggaccagg

SEQ ID NO: 1688111 - RNA, 10 nt, Human
cgcagcccug

SEQ ID NO: 1688112 - RNA, 14 nt, Human
cgcagcccugcaga

SEQ ID NO: 1688113 - RNA, 17 nt, Human
cgccaugcuccuggccc

SEQ ID NO: 1688114 - RNA, 18 nt, Human
cgagauagccaaggccaa

SEQ ID NO: 1688115 - RNA, 17 nt, Human
cgagaucacgccacugc

SEQ ID NO: 1688116 - RNA, 17 nt, Human
cgagaaacagccugugu

SEQ ID NO: 1688117 - RNA, 15 nt, Human
cgaauagcugggacu

SEQ ID NO: 1688118 - RNA, 13 nt, Human
cgaauagcuggga

SEQ ID NO: 1688119 - RNA, 14 nt, Human
cgaauagcugggac

SEQ ID NO: 1688120 - RNA, 18 nt, Human
cgagaucacgccacugca

SEQ ID NO: 1688121 - RNA, 20 nt, Human
cgagaucacgccacugcacu

SEQ ID NO: 1688122 - RNA, 20 nt, Human
cgagauugcaccacugcacu

SEQ ID NO: 1688123 - RNA, 13 nt, Human
cgagcaugccugg

SEQ ID NO: 1688124 - RNA, 16 nt, Human
cgagcaugccuggaug

SEQ ID NO: 1688125 - RNA, 17 nt, Human
cgagcaugccuggaugg

SEQ ID NO: 1688126 - RNA, 20 nt, Human
cgagcaggcuucuucccccc

SEQ ID NO: 1688127 - RNA, 18 nt, Human
cgagcaggcuacugucag

SEQ ID NO: 1688128 - RNA, 23 nt, Human
ccuuugacgccaucccagcccca

SEQ ID NO: 1688129 - RNA, 22 nt, Human
ccuuugacgccaucccagcccc

SEQ ID NO: 1688130 - RNA, 20 nt, Human
ccuuugacgccaucccagcc

SEQ ID NO: 1688131 - RNA, 21 nt, Human
ccuuugacgccaucccagccc

SEQ ID NO: 1688132 - RNA, 20 nt, Human
cgaaaacguggcugcuucaa

SEQ ID NO: 1688133 - RNA, 15 nt, Human
cgaaaacguggcugc

SEQ ID NO: 1688134 - RNA, 18 nt, Human
cgaaaacguggcugcuuc

SEQ ID NO: 1688135 - RNA, 19 nt, Human
cgaaaacguggcugcuuca

SEQ ID NO: 1688136 - RNA, 21 nt, Human
cgaaagaacaguccauugaaa

SEQ ID NO: 1688137 - RNA, 12 nt, Human
cgaaagaacagu

SEQ ID NO: 1688138 - RNA, 22 nt, Human
cgaaagggacuuggaagcuccg

SEQ ID NO: 1688139 - RNA, 20 nt, Human
cgaaaggaugaaagugacca

SEQ ID NO: 1688140 - RNA, 19 nt, Human
cgaaagggacuuggaagcu

SEQ ID NO: 1688141 - RNA, 14 nt, Human
cgaacuccugaccu

SEQ ID NO: 1688142 - RNA, 12 nt, Human
cgaacuggcugc

SEQ ID NO: 1688143 - RNA, 14 nt, Human
cgaacuggcugcaa

SEQ ID NO: 1688144 - RNA, 18 nt, Human
ccuggaauauauaaccag

SEQ ID NO: 1688145 - RNA, 22 nt, Human
ccuggcacccggccccugcugg

SEQ ID NO: 1688146 - RNA, 23 nt, Human
ccuggcacccggccccugcuggu

SEQ ID NO: 1688147 - RNA, 22 nt, Human
ccuggcacuauaauguaagcuc

SEQ ID NO: 1688148 - RNA, 12 nt, Human
ccuggcagcccc

SEQ ID NO: 1688149 - RNA, 14 nt, Human
ccuggcagccccug

SEQ ID NO: 1688150 - RNA, 13 nt, Human
ccuggcagccccu

SEQ ID NO: 1688151 - RNA, 17 nt, Human
ccuggcucccacaggcc

SEQ ID NO: 1688152 - RNA, 23 nt, Human
ccuggcucccacaggcccuuccu

SEQ ID NO: 1688153 - RNA, 22 nt, Human
ccuggcagccgugccuucagcu

SEQ ID NO: 1688154 - RNA, 15 nt, Human
ccuggccagaugcac

SEQ ID NO: 1688155 - RNA, 20 nt, Human
ccuggccagaugcaccagcc

SEQ ID NO: 1688156 - RNA, 20 nt, Human
ccuggcuuuucacugcuggc

SEQ ID NO: 1688157 - RNA, 21 nt, Human
ccuggcuuuucacugcuggcu

SEQ ID NO: 1688158 - RNA, 22 nt, Human
ccuggcuuuucacugcuggcug

SEQ ID NO: 1688159 - RNA, 23 nt, Human
ccuggcuuuucacugcuggcugc

SEQ ID NO: 1688160 - RNA, 24 nt, Human
ccuggcuuuucacugcuggcugcc

SEQ ID NO: 1688161 - RNA, 21 nt, Human
ccuggggguucuuucuuccuc

SEQ ID NO: 1688162 - RNA, 22 nt, Human
ccuggggguucuuucuuccucu

SEQ ID NO: 1688163 - RNA, 23 nt, Human
ccuggggguucuuucuuccucug

SEQ ID NO: 1688164 - RNA, 18 nt, Human
ccuggggguucuuucuuc

SEQ ID NO: 1688165 - RNA, 22 nt, Human
ccuggucacaggacucugccuc

SEQ ID NO: 1688166 - RNA, 23 nt, Human
ccuggucacaggacucugccucc

SEQ ID NO: 1688167 - RNA, 21 nt, Human
ccuggucacaggacucugccu

SEQ ID NO: 1688168 - RNA, 11 nt, Human
ccugccucagc

SEQ ID NO: 1688169 - RNA, 23 nt, Human
ccugccuguugggccaggagccu

SEQ ID NO: 1688170 - RNA, 22 nt, Human
ccugccccucaacucuccucca

SEQ ID NO: 1688171 - RNA, 18 nt, Human
ccugcgggucacaggagg

SEQ ID NO: 1688172 - RNA, 22 nt, Human
ccugcgggucacaggagggagg

SEQ ID NO: 1688173 - RNA, 16 nt, Human
ccugcggugcuaucuc

SEQ ID NO: 1688174 - RNA, 17 nt, Human
ccugcggugcuaucucc

SEQ ID NO: 1688175 - RNA, 22 nt, Human
ccugcggugcuaucucccccag

SEQ ID NO: 1688176 - RNA, 21 nt, Human
ccugcucuccgaccagacacc

SEQ ID NO: 1688177 - RNA, 22 nt, Human
ccugcucuccucuugccacugc

SEQ ID NO: 1688178 - RNA, 16 nt, Human
ccugcucuccucuugc

SEQ ID NO: 1688179 - RNA, 18 nt, Human
ccugcucuccucuugcca

SEQ ID NO: 1688180 - RNA, 19 nt, Human
ccugcucuccucuugccac

SEQ ID NO: 1688181 - RNA, 21 nt, Human
ccugcucuccucuugccacug

SEQ ID NO: 1688182 - RNA, 22 nt, Human
ccugcucuccgaccagacaccu

SEQ ID NO: 1688183 - RNA, 20 nt, Human
ccugcuuugggcugcccugg

SEQ ID NO: 1688184 - RNA, 21 nt, Human
ccugcuuugggcugcccuggu

SEQ ID NO: 1688185 - RNA, 22 nt, Human
ccugcuuugggcugcccuggug

SEQ ID NO: 1688186 - RNA, 23 nt, Human
ccugcuuugggcugcccuggugc

SEQ ID NO: 1688187 - RNA, 15 nt, Human
ccugcugagucccag

SEQ ID NO: 1688188 - RNA, 14 nt, Human
ccugcuucaaauau

SEQ ID NO: 1688189 - RNA, 23 nt, Human
ccuggaaaucaggguuaguauug

SEQ ID NO: 1688190 - RNA, 16 nt, Human
ccugacagaaggacuc

SEQ ID NO: 1688191 - RNA, 21 nt, Human
ccugaggcccagagggccugc

SEQ ID NO: 1688192 - RNA, 16 nt, Human
ccugagcuuucugcua

SEQ ID NO: 1688193 - RNA, 12 nt, Human
ccugagccagau

SEQ ID NO: 1688194 - RNA, 14 nt, Human
ccugagcuuucugc

SEQ ID NO: 1688195 - RNA, 11 nt, Human
ccugagcccca

SEQ ID NO: 1688196 - RNA, 13 nt, Human
ccugccaggaagc

SEQ ID NO: 1688197 - RNA, 14 nt, Human
ccugccaggaagcc

SEQ ID NO: 1688198 - RNA, 15 nt, Human
ccugccaggaagcca

SEQ ID NO: 1688199 - RNA, 17 nt, Human
ccugccaggaagccagc

SEQ ID NO: 1688200 - RNA, 22 nt, Human
ccugccagggacagagggggug

SEQ ID NO: 1688201 - RNA, 16 nt, Human
ccugccagggacagag

SEQ ID NO: 1688202 - RNA, 12 nt, Human
ccugccagggac

SEQ ID NO: 1688203 - RNA, 13 nt, Human
ccugccagggaca

SEQ ID NO: 1688204 - RNA, 14 nt, Human
ccugccagggacag

SEQ ID NO: 1688205 - RNA, 15 nt, Human
ccugccagggacaga

SEQ ID NO: 1688206 - RNA, 23 nt, Human
ccugccaggaagccagcaggcuc

SEQ ID NO: 1688207 - RNA, 16 nt, Human
ccugccaggcauggug

SEQ ID NO: 1688208 - RNA, 11 nt, Human
ccugccaggga

SEQ ID NO: 1688209 - RNA, 18 nt, Human
ccugccaggaagccagca

SEQ ID NO: 1688210 - RNA, 19 nt, Human
ccugccaggaagccagcag

SEQ ID NO: 1688211 - RNA, 21 nt, Human
ccugccaggaagccagcaggc

SEQ ID NO: 1688212 - RNA, 22 nt, Human
ccugccaggaagccagcaggcu

SEQ ID NO: 1688213 - RNA, 17 nt, Human
ccugauugugucucuug

SEQ ID NO: 1688214 - RNA, 19 nt, Human
ccugauugugucucuuggu

SEQ ID NO: 1688215 - RNA, 22 nt, Human
ccugcaaccugauugugucucu

SEQ ID NO: 1688216 - RNA, 21 nt, Human
ccugcaaccugauugugucuc

SEQ ID NO: 1688217 - RNA, 11 nt, Human
ccugaggcccu

SEQ ID NO: 1688218 - RNA, 12 nt, Human
ccugaggcccuu

SEQ ID NO: 1688219 - RNA, 19 nt, Human
ccugaugcuucuucagaga

SEQ ID NO: 1688220 - RNA, 20 nt, Human
ccugaugcuucuucagagac

SEQ ID NO: 1688221 - RNA, 21 nt, Human
ccugaugcuucuucagagacu

SEQ ID NO: 1688222 - RNA, 22 nt, Human
ccugaugcuucuucagagacuc

SEQ ID NO: 1688223 - RNA, 14 nt, Human
ccugaggcccuucu

SEQ ID NO: 1688224 - RNA, 15 nt, Human
ccugauugugucucu

SEQ ID NO: 1688225 - RNA, 15 nt, Human
ccugcagggccaagc

SEQ ID NO: 1688226 - RNA, 18 nt, Human
ccugcaguacuuuaccuc

SEQ ID NO: 1688227 - RNA, 20 nt, Human
ccugcaguacuuuaccuccu

SEQ ID NO: 1688228 - RNA, 14 nt, Human
ccugcaagaacaag

SEQ ID NO: 1688229 - RNA, 16 nt, Human
ccugcaauaaaauggg

SEQ ID NO: 1688230 - RNA, 20 nt, Human
ccugcacggugaauggcuuu

SEQ ID NO: 1688231 - RNA, 20 nt, Human
ccugcaaugaagucucugaa

SEQ ID NO: 1688232 - RNA, 21 nt, Human
ccugcacggugaauggcuuug

SEQ ID NO: 1688233 - RNA, 21 nt, Human
ccugcaaugaagucucugaag

SEQ ID NO: 1688234 - RNA, 19 nt, Human
ccugcaaugaagucucuga

SEQ ID NO: 1688235 - RNA, 12 nt, Human
ccacacccagcc

SEQ ID NO: 1688236 - RNA, 14 nt, Human
ccacacuccagcug

SEQ ID NO: 1688237 - RNA, 17 nt, Human
ccacacuccagcuggga

SEQ ID NO: 1688238 - RNA, 13 nt, Human
ccacacuccagcu

SEQ ID NO: 1688239 - RNA, 13 nt, Human
ccacacccagccc

SEQ ID NO: 1688240 - RNA, 14 nt, Human
ccacacccagccca

SEQ ID NO: 1688241 - RNA, 16 nt, Human
ccacccaagggccugg

SEQ ID NO: 1688242 - RNA, 17 nt, Human
ccacccaagggccuggc

SEQ ID NO: 1688243 - RNA, 19 nt, Human
ccacccaagggccuggccu

SEQ ID NO: 1688244 - RNA, 20 nt, Human
ccaccaacauacucccaucu

SEQ ID NO: 1688245 - RNA, 14 nt, Human
ccaccacacccagc

SEQ ID NO: 1688246 - RNA, 16 nt, Human
ccaccacacccagccc

SEQ ID NO: 1688247 - RNA, 16 nt, Human
ccacccaccucagccu

SEQ ID NO: 1688248 - RNA, 14 nt, Human
ccacccaccucagc

SEQ ID NO: 1688249 - RNA, 15 nt, Human
ccacccaccucagcc

SEQ ID NO: 1688250 - RNA, 20 nt, Human
ccacccaagggccuggccug

SEQ ID NO: 1688251 - RNA, 21 nt, Human
ccacccaagggccuggccuga

SEQ ID NO: 1688252 - RNA, 22 nt, Human
ccacccaagggccuggccugag

SEQ ID NO: 1688253 - RNA, 13 nt, Human
ccacccaccucag

SEQ ID NO: 1688254 - RNA, 19 nt, Human
ccacauagugaugguuccc

SEQ ID NO: 1688255 - RNA, 21 nt, Human
ccacauagugaugguuccccu

SEQ ID NO: 1688256 - RNA, 22 nt, Human
ccacauagugaugguuccccug

SEQ ID NO: 1688257 - RNA, 23 nt, Human
ccacauagugaugguuccccugu

SEQ ID NO: 1688258 - RNA, 14 nt, Human
ccacaucuugcucu

SEQ ID NO: 1688259 - RNA, 14 nt, Human
ccaccaacauacuc

SEQ ID NO: 1688260 - RNA, 18 nt, Human
ccaccaacauacucccau

SEQ ID NO: 1688261 - RNA, 16 nt, Human
ccacaucuugcucugc

SEQ ID NO: 1688262 - RNA, 22 nt, Human
ccacaucuugcucugcugacag

SEQ ID NO: 1688263 - RNA, 23 nt, Human
ccacaucuugcucugcugacaga

SEQ ID NO: 1688264 - RNA, 21 nt, Human
ccacccaggagccccgaggcc

SEQ ID NO: 1688265 - RNA, 11 nt, Human
ccacugccucu

SEQ ID NO: 1688266 - RNA, 16 nt, Human
ccacugcgaccacaag

SEQ ID NO: 1688267 - RNA, 11 nt, Human
ccacugcucug

SEQ ID NO: 1688268 - RNA, 23 nt, Human
ccacugcacuccagccuggguga

SEQ ID NO: 1688269 - RNA, 15 nt, Human
ccacucccugcaacc

SEQ ID NO: 1688270 - RNA, 19 nt, Human
ccacugcacuccagccugg

SEQ ID NO: 1688271 - RNA, 20 nt, Human
ccacugcacuccagccuggg

SEQ ID NO: 1688272 - RNA, 17 nt, Human
ccacuccagaccccugg

SEQ ID NO: 1688273 - RNA, 19 nt, Human
ccacuccagaccccuggcu

SEQ ID NO: 1688274 - RNA, 12 nt, Human
ccacucccugca

SEQ ID NO: 1688275 - RNA, 13 nt, Human
ccacucccugcaa

SEQ ID NO: 1688276 - RNA, 23 nt, Human
ccacuacggaauaguuggcuagg

SEQ ID NO: 1688277 - RNA, 18 nt, Human
ccacuacauucuguuaau

SEQ ID NO: 1688278 - RNA, 22 nt, Human
ccacuacggaauaguuggcuag

SEQ ID NO: 1688279 - RNA, 13 nt, Human
ccacguuucuaaa

SEQ ID NO: 1688280 - RNA, 19 nt, Human
ccaccccucaacaccucug

SEQ ID NO: 1688281 - RNA, 16 nt, Human
ccacccugaaagcccu

SEQ ID NO: 1688282 - RNA, 17 nt, Human
ccacccugaaagcccug

SEQ ID NO: 1688283 - RNA, 18 nt, Human
ccacccugaaagcccuga

SEQ ID NO: 1688284 - RNA, 12 nt, Human
ccaccucagccu

SEQ ID NO: 1688285 - RNA, 13 nt, Human
ccaccucagccuc

SEQ ID NO: 1688286 - RNA, 14 nt, Human
ccaccucagccucc

SEQ ID NO: 1688287 - RNA, 15 nt, Human
ccaccucagccuccc

SEQ ID NO: 1688288 - RNA, 12 nt, Human
ccacccaggagc

SEQ ID NO: 1688289 - RNA, 14 nt, Human
ccacccaggagccc

SEQ ID NO: 1688290 - RNA, 22 nt, Human
ccaccugcggugcuaucucccc

SEQ ID NO: 1688291 - RNA, 15 nt, Human
ccaccuggccucugc

SEQ ID NO: 1688292 - RNA, 16 nt, Human
ccaccuggccucugca

SEQ ID NO: 1688293 - RNA, 17 nt, Human
ccaccuggccucugcac

SEQ ID NO: 1688294 - RNA, 18 nt, Human
ccaccuggccucugcacu

SEQ ID NO: 1688295 - RNA, 12 nt, Human
ccacggccaggc

SEQ ID NO: 1688296 - RNA, 13 nt, Human
ccacggccaggcc

SEQ ID NO: 1688297 - RNA, 14 nt, Human
ccacggccaggcca

SEQ ID NO: 1688298 - RNA, 15 nt, Human
ccacggccaggccag

SEQ ID NO: 1688299 - RNA, 14 nt, Human
ccaccugcccaacc

SEQ ID NO: 1688300 - RNA, 12 nt, Human
ccaccugccagg

SEQ ID NO: 1688301 - RNA, 17 nt, Human
ccaccugccuguugggc

SEQ ID NO: 1688302 - RNA, 20 nt, Human
ccaccugccuguugggccag

SEQ ID NO: 1688303 - RNA, 17 nt, Human
ccaccucccacaaagga

SEQ ID NO: 1688304 - RNA, 14 nt, Human
ccaccucccugcaa

SEQ ID NO: 1688305 - RNA, 20 nt, Human
ccagacaccuugacagggca

SEQ ID NO: 1688306 - RNA, 21 nt, Human
ccagagaggguggugaccucu

SEQ ID NO: 1688307 - RNA, 23 nt, Human
ccagagaggguggugaccucugc

SEQ ID NO: 1688308 - RNA, 14 nt, Human
ccagagaggguggu

SEQ ID NO: 1688309 - RNA, 17 nt, Human
ccacuguacuugcucuu

SEQ ID NO: 1688310 - RNA, 18 nt, Human
ccacuguacuugcucuug

SEQ ID NO: 1688311 - RNA, 19 nt, Human
ccacuguacuugcucuuga

SEQ ID NO: 1688312 - RNA, 20 nt, Human
ccacuguacuugcucuugau

SEQ ID NO: 1688313 - RNA, 17 nt, Human
ccagacaccuugacagg

SEQ ID NO: 1688314 - RNA, 19 nt, Human
ccagacaccuugacagggc

SEQ ID NO: 1688315 - RNA, 11 nt, Human
ccagagcugcc

SEQ ID NO: 1688316 - RNA, 12 nt, Human
ccagagcugcca

SEQ ID NO: 1688317 - RNA, 13 nt, Human
ccagagcugccac

SEQ ID NO: 1688318 - RNA, 14 nt, Human
ccagagcugccacc

SEQ ID NO: 1688319 - RNA, 15 nt, Human
ccagagcugccaccu

SEQ ID NO: 1688320 - RNA, 16 nt, Human
ccagagcugccaccug

SEQ ID NO: 1688321 - RNA, 19 nt, Human
ccagagcugccaccugccu

SEQ ID NO: 1688322 - RNA, 16 nt, Human
ccagagggagugacag

SEQ ID NO: 1688323 - RNA, 17 nt, Human
ccagagggagugacaga

SEQ ID NO: 1688324 - RNA, 18 nt, Human
ccagagggagugacagag

SEQ ID NO: 1688325 - RNA, 19 nt, Human
ccagagggagugacagagg

SEQ ID NO: 1688326 - RNA, 20 nt, Human
ccagagggagugacagaggc

SEQ ID NO: 1688327 - RNA, 21 nt, Human
ccagagggagugacagaggca

SEQ ID NO: 1688328 - RNA, 21 nt, Human
ccagaggagagaggacccccu

SEQ ID NO: 1688329 - RNA, 22 nt, Human
ccagaggagagaggacccccug

SEQ ID NO: 1688330 - RNA, 22 nt, Human
ccagauuuaugcauauuauuuu

SEQ ID NO: 1688331 - RNA, 12 nt, Human
ccagauuucacu

SEQ ID NO: 1688332 - RNA, 13 nt, Human
ccagauuuaugca

SEQ ID NO: 1688333 - RNA, 21 nt, Human
ccagauugcaacaggcugggc

SEQ ID NO: 1688334 - RNA, 23 nt, Human
ccagauucuuuccugaggcuggg

SEQ ID NO: 1688335 - RNA, 19 nt, Human
ccagauugcaacaggcugg

SEQ ID NO: 1688336 - RNA, 20 nt, Human
ccagauugcaacaggcuggg

SEQ ID NO: 1688337 - RNA, 15 nt, Human
ccagagggccugcaa

SEQ ID NO: 1688338 - RNA, 16 nt, Human
ccagagggccugcaag

SEQ ID NO: 1688339 - RNA, 13 nt, Human
ccagagggccugc

SEQ ID NO: 1688340 - RNA, 22 nt, Human
ccagagggagugacagaggcag

SEQ ID NO: 1688341 - RNA, 23 nt, Human
ccagagggagugacagaggcagc

SEQ ID NO: 1688342 - RNA, 18 nt, Human
ccagauucuuuccugagg

SEQ ID NO: 1688343 - RNA, 19 nt, Human
ccagauucuuuccugaggc

SEQ ID NO: 1688344 - RNA, 20 nt, Human
ccagauucuuuccugaggcu

SEQ ID NO: 1688345 - RNA, 21 nt, Human
ccagauucuuuccugaggcug

SEQ ID NO: 1688346 - RNA, 22 nt, Human
ccagauucuuuccugaggcugg

SEQ ID NO: 1688347 - RNA, 19 nt, Human
ccagcaauucuccugccuc

SEQ ID NO: 1688348 - RNA, 20 nt, Human
ccagcaauucuccugccuca

SEQ ID NO: 1688349 - RNA, 21 nt, Human
ccagcaauucuccugccucag

SEQ ID NO: 1688350 - RNA, 16 nt, Human
ccagcaauucuccugc

SEQ ID NO: 1688351 - RNA, 18 nt, Human
ccagcaauucuccugccu

SEQ ID NO: 1688352 - RNA, 16 nt, Human
ccagcaagugagagcu

SEQ ID NO: 1688353 - RNA, 20 nt, Human
ccagcaagugagagcugggu

SEQ ID NO: 1688354 - RNA, 21 nt, Human
ccagcaagugagagcugggug

SEQ ID NO: 1688355 - RNA, 22 nt, Human
ccagcaagugagagcugggugu

SEQ ID NO: 1688356 - RNA, 14 nt, Human
ccagauuucacucu

SEQ ID NO: 1688357 - RNA, 15 nt, Human
ccagcaagugagagc

SEQ ID NO: 1688358 - RNA, 21 nt, Human
ccagccuccaagcuccaucuc

SEQ ID NO: 1688359 - RNA, 14 nt, Human
ccagccgccaugcu

SEQ ID NO: 1688360 - RNA, 18 nt, Human
ccagccgccaugcuccug

SEQ ID NO: 1688361 - RNA, 19 nt, Human
ccagccgccaugcuccugg

SEQ ID NO: 1688362 - RNA, 16 nt, Human
ccagccccagugccca

SEQ ID NO: 1688363 - RNA, 21 nt, Human
ccagcccuccuuaucaaagga

SEQ ID NO: 1688364 - RNA, 16 nt, Human
ccagcccuuagcaggg

SEQ ID NO: 1688365 - RNA, 17 nt, Human
ccagcccuuagcaggga

SEQ ID NO: 1688366 - RNA, 23 nt, Human
ccagccccaaaacucuccucugc

SEQ ID NO: 1688367 - RNA, 13 nt, Human
ccagccccagugc

SEQ ID NO: 1688368 - RNA, 15 nt, Human
ccagccccagugccc

SEQ ID NO: 1688369 - RNA, 15 nt, Human
ccagccaaagccucc

SEQ ID NO: 1688370 - RNA, 18 nt, Human
ccagccaaagccuccucc

SEQ ID NO: 1688371 - RNA, 19 nt, Human
ccagccaaagccuccucca

SEQ ID NO: 1688372 - RNA, 22 nt, Human
ccagccagcaguucagagcugc

SEQ ID NO: 1688373 - RNA, 22 nt, Human
ccagcaguucagagcugcccuc

SEQ ID NO: 1688374 - RNA, 21 nt, Human
ccagcaguucagagcugcccu

SEQ ID NO: 1688375 - RNA, 20 nt, Human
ccagcaguucagagcugccc

SEQ ID NO: 1688376 - RNA, 19 nt, Human
ccagcaguucagagcugcc

SEQ ID NO: 1688377 - RNA, 18 nt, Human
ccagcaguucagagcugc

SEQ ID NO: 1688378 - RNA, 13 nt, Human
ccagcaguucaga

SEQ ID NO: 1688379 - RNA, 23 nt, Human
ccagcauaauacuugcuuuggaa

SEQ ID NO: 1688380 - RNA, 23 nt, Human
ccagcaguucagagcugcccucu

SEQ ID NO: 1688381 - RNA, 17 nt, Human
ccagguuuuuggucuga

SEQ ID NO: 1688382 - RNA, 24 nt, Human
ccaggugcacaagcuccaagcucc

SEQ ID NO: 1688383 - RNA, 18 nt, Human
ccagucuggaaugcagug

SEQ ID NO: 1688384 - RNA, 19 nt, Human
ccagucuggaaugcagugg

SEQ ID NO: 1688385 - RNA, 20 nt, Human
ccagucuggaaugcaguggu

SEQ ID NO: 1688386 - RNA, 21 nt, Human
ccagggcuggaaugauuucag

SEQ ID NO: 1688387 - RNA, 19 nt, Human
ccaggugcacaagcuccaa

SEQ ID NO: 1688388 - RNA, 20 nt, Human
ccaggugcacaagcuccaag

SEQ ID NO: 1688389 - RNA, 18 nt, Human
ccaggugcacaagcucca

SEQ ID NO: 1688390 - RNA, 20 nt, Human
ccaggcuuagucacugagac

SEQ ID NO: 1688391 - RNA, 14 nt, Human
ccagggacagaggg

SEQ ID NO: 1688392 - RNA, 15 nt, Human
ccagggacagagggg

SEQ ID NO: 1688393 - RNA, 21 nt, Human
ccagggacagaggggguggcc

SEQ ID NO: 1688394 - RNA, 22 nt, Human
ccagggacagaggggguggccu

SEQ ID NO: 1688395 - RNA, 15 nt, Human
ccagccuccaugcug

SEQ ID NO: 1688396 - RNA, 16 nt, Human
ccagccuccaugcugc

SEQ ID NO: 1688397 - RNA, 19 nt, Human
ccaggagccccgaggccuu

SEQ ID NO: 1688398 - RNA, 20 nt, Human
ccaggagccccgaggccuuc

SEQ ID NO: 1688399 - RNA, 12 nt, Human
ccaggagccucc

SEQ ID NO: 1688400 - RNA, 18 nt, Human
ccaggcauuccccaggag

SEQ ID NO: 1688401 - RNA, 19 nt, Human
ccaggcauuccccaggagg

SEQ ID NO: 1688402 - RNA, 21 nt, Human
ccaggcauuccccaggaggcc

SEQ ID NO: 1688403 - RNA, 18 nt, Human
ccaggcgccccuuccccc

SEQ ID NO: 1688404 - RNA, 19 nt, Human
ccaggcgccccuucccccu

SEQ ID NO: 1688405 - RNA, 17 nt, Human
ccaggcuuagucacuga

SEQ ID NO: 1688406 - RNA, 24 nt, Human
ccaggcuguaucccaugagccuca

SEQ ID NO: 1688407 - RNA, 22 nt, Human
ccaggcccucugcccacucccu

SEQ ID NO: 1688408 - RNA, 23 nt, Human
ccaggcccucugcccacucccug

SEQ ID NO: 1688409 - RNA, 21 nt, Human
ccaggcccucugcccacuccc

SEQ ID NO: 1688410 - RNA, 13 nt, Human
ccaucuacccucc

SEQ ID NO: 1688411 - RNA, 16 nt, Human
ccagugaggcucugcc

SEQ ID NO: 1688412 - RNA, 14 nt, Human
ccagugaggcucug

SEQ ID NO: 1688413 - RNA, 15 nt, Human
ccagugaggcucugc

SEQ ID NO: 1688414 - RNA, 22 nt, Human
ccagugguuccuaauccucuag

SEQ ID NO: 1688415 - RNA, 20 nt, Human
ccagugccgagaaggaagcc

SEQ ID NO: 1688416 - RNA, 17 nt, Human
ccagugaggcucugccc

SEQ ID NO: 1688417 - RNA, 22 nt, Human
ccaguguuguggauuuaacaga

SEQ ID NO: 1688418 - RNA, 12 nt, Human
ccauaggucacc

SEQ ID NO: 1688419 - RNA, 21 nt, Human
ccauaguaugggacuggccuc

SEQ ID NO: 1688420 - RNA, 23 nt, Human
ccauauucuguuggccaguguga

SEQ ID NO: 1688421 - RNA, 21 nt, Human
ccaguuauggcuauaggugcu

SEQ ID NO: 1688422 - RNA, 14 nt, Human
ccaguuauggcuau

SEQ ID NO: 1688423 - RNA, 19 nt, Human
ccauucuccaccugccagg

SEQ ID NO: 1688424 - RNA, 20 nt, Human
ccauucuccaccugccaggg

SEQ ID NO: 1688425 - RNA, 14 nt, Human
ccauuuguguuuau

SEQ ID NO: 1688426 - RNA, 13 nt, Human
cccaaagugcugg

SEQ ID NO: 1688427 - RNA, 15 nt, Human
cccaaagugcuggga

SEQ ID NO: 1688428 - RNA, 20 nt, Human
cccaaaacucuccucugcug

SEQ ID NO: 1688429 - RNA, 16 nt, Human
cccaaaacucuccucu

SEQ ID NO: 1688430 - RNA, 18 nt, Human
cccaaaacucuccucugc

SEQ ID NO: 1688431 - RNA, 17 nt, Human
cccaaggcucugagcaa

SEQ ID NO: 1688432 - RNA, 15 nt, Human
cccaacccuggcacc

SEQ ID NO: 1688433 - RNA, 16 nt, Human
cccaaagugcugggau

SEQ ID NO: 1688434 - RNA, 23 nt, Human
cccaaauggaaaugggcagagca

SEQ ID NO: 1688435 - RNA, 18 nt, Human
cccaaauggaaaugggca

SEQ ID NO: 1688436 - RNA, 22 nt, Human
cccaaauggaaaugggcagagc

SEQ ID NO: 1688437 - RNA, 14 nt, Human
ccaucuaaacugcc

SEQ ID NO: 1688438 - RNA, 21 nt, Human
ccaugggaaaugucaacaagu

SEQ ID NO: 1688439 - RNA, 15 nt, Human
ccaucuaaacugccc

SEQ ID NO: 1688440 - RNA, 16 nt, Human
ccaucuaaacugcccc

SEQ ID NO: 1688441 - RNA, 14 nt, Human
ccauuauucaaagu

SEQ ID NO: 1688442 - RNA, 13 nt, Human
ccauguuuauuac

SEQ ID NO: 1688443 - RNA, 20 nt, Human
ccauguuuauuacaguauaa

SEQ ID NO: 1688444 - RNA, 17 nt, Human
ccauuauucaaaguugc

SEQ ID NO: 1688445 - RNA, 22 nt, Human
ccauuauucaaaguugccuaaa

SEQ ID NO: 1688446 - RNA, 18 nt, Human
ccauguuggccaggcugc

SEQ ID NO: 1688447 - RNA, 21 nt, Human
ccauguuggccaggcugcucu

SEQ ID NO: 1688448 - RNA, 18 nt, Human
ccauguuggccaggcugg

SEQ ID NO: 1688449 - RNA, 17 nt, Human
ccaugggauaaaugcca

SEQ ID NO: 1688450 - RNA, 17 nt, Human
ccauguuggccaggcug

SEQ ID NO: 1688451 - RNA, 13 nt, Human
ccaugggauaaau

SEQ ID NO: 1688452 - RNA, 16 nt, Human
ccaugggacagggagg

SEQ ID NO: 1688453 - RNA, 19 nt, Human
ccaugggacagggaggacg

SEQ ID NO: 1688454 - RNA, 23 nt, Human
cauucuucuguacgucugacagg

SEQ ID NO: 1688455 - RNA, 14 nt, Human
cauuccugaacagg

SEQ ID NO: 1688456 - RNA, 14 nt, Human
cauuccugaugcuu

SEQ ID NO: 1688457 - RNA, 16 nt, Human
cauuccugaugcuucu

SEQ ID NO: 1688458 - RNA, 19 nt, Human
cauuccugaugcuucuuca

SEQ ID NO: 1688459 - RNA, 22 nt, Human
cauuccugaugcuucuucagag

SEQ ID NO: 1688460 - RNA, 23 nt, Human
cauuccugaugcuucuucagaga

SEQ ID NO: 1688461 - RNA, 12 nt, Human
cauucugccugc

SEQ ID NO: 1688462 - RNA, 13 nt, Human
cauucugccugcc

SEQ ID NO: 1688463 - RNA, 15 nt, Human
cauucugccugccca

SEQ ID NO: 1688464 - RNA, 16 nt, Human
cauucugccugcccag

SEQ ID NO: 1688465 - RNA, 17 nt, Human
cauucugccugcccagg

SEQ ID NO: 1688466 - RNA, 18 nt, Human
cauucugccugcccaggc

SEQ ID NO: 1688467 - RNA, 19 nt, Human
cauucugccugcccaggcc

SEQ ID NO: 1688468 - RNA, 20 nt, Human
cauucugccugcccaggccc

SEQ ID NO: 1688469 - RNA, 17 nt, Human
cauucuguuaaucauua

SEQ ID NO: 1688470 - RNA, 13 nt, Human
cauucuggaauaa

SEQ ID NO: 1688471 - RNA, 18 nt, Human
cauuauucaaaguugccu

SEQ ID NO: 1688472 - RNA, 21 nt, Human
cauuauucaaaguugccuaaa

SEQ ID NO: 1688473 - RNA, 22 nt, Human
cauuauucaaaguugccuaaau

SEQ ID NO: 1688474 - RNA, 20 nt, Human
cauucaaauguauuacagug

SEQ ID NO: 1688475 - RNA, 14 nt, Human
cauuaauaauaaau

SEQ ID NO: 1688476 - RNA, 13 nt, Human
cauuccccaggag

SEQ ID NO: 1688477 - RNA, 15 nt, Human
cauuccccaggaggc

SEQ ID NO: 1688478 - RNA, 17 nt, Human
cauuccccaggaggcca

SEQ ID NO: 1688479 - RNA, 17 nt, Human
cauuccccgucucuggu

SEQ ID NO: 1688480 - RNA, 13 nt, Human
cauuccccauggg

SEQ ID NO: 1688481 - RNA, 20 nt, Human
cauuccccaggaggccagcc

SEQ ID NO: 1688482 - RNA, 18 nt, Human
cauuccccaggaggccag

SEQ ID NO: 1688483 - RNA, 19 nt, Human
cauuccccaggaggccagc

SEQ ID NO: 1688484 - RNA, 21 nt, Human
cauucagauaugauucaaaug

SEQ ID NO: 1688485 - RNA, 19 nt, Human
cauucauuuucuggguguu

SEQ ID NO: 1688486 - RNA, 22 nt, Human
cauuccaccuucccaugcccug

SEQ ID NO: 1688487 - RNA, 17 nt, Human
cauuccaccuucccaug

SEQ ID NO: 1688488 - RNA, 22 nt, Human
cauuccaacuaucucauuucca

SEQ ID NO: 1688489 - RNA, 17 nt, Human
cauuuggaaaucuuuaa

SEQ ID NO: 1688490 - RNA, 18 nt, Human
cauuuggaaaucuuuaaa

SEQ ID NO: 1688491 - RNA, 11 nt, Human
cauuuggaaau

SEQ ID NO: 1688492 - RNA, 22 nt, Human
cauuuggaaaucuuuaaaaaaa

SEQ ID NO: 1688493 - RNA, 23 nt, Human
cauuuuaccuuugacaaagguaa

SEQ ID NO: 1688494 - RNA, 23 nt, Human
cauuuuauuuuauuaugcaugaa

SEQ ID NO: 1688495 - RNA, 16 nt, Human
ccaaacccuucagugc

SEQ ID NO: 1688496 - RNA, 21 nt, Human
cauuuuuaagugcugcauuua

SEQ ID NO: 1688497 - RNA, 18 nt, Human
cauuuuuaguagagacag

SEQ ID NO: 1688498 - RNA, 17 nt, Human
cauuuuuaguagagaca

SEQ ID NO: 1688499 - RNA, 19 nt, Human
cauuugaaaauuuugaugu

SEQ ID NO: 1688500 - RNA, 17 nt, Human
cauuugaaaauuuugau

SEQ ID NO: 1688501 - RNA, 18 nt, Human
cauugaccugaggcccuu

SEQ ID NO: 1688502 - RNA, 14 nt, Human
cauugaccugaggc

SEQ ID NO: 1688503 - RNA, 15 nt, Human
cauugaccugaggcc

SEQ ID NO: 1688504 - RNA, 17 nt, Human
cauugaccugaggcccu

SEQ ID NO: 1688505 - RNA, 15 nt, Human
cauuuaaaaaaaauc

SEQ ID NO: 1688506 - RNA, 21 nt, Human
cauuguaaaugugcuuuuaaa

SEQ ID NO: 1688507 - RNA, 15 nt, Human
cauugugggaagggg

SEQ ID NO: 1688508 - RNA, 14 nt, Human
caugcagcaucuaa

SEQ ID NO: 1688509 - RNA, 15 nt, Human
caugcuguucaugaa

SEQ ID NO: 1688510 - RNA, 17 nt, Human
caugcugucccuuacgu

SEQ ID NO: 1688511 - RNA, 13 nt, Human
caugcugucccuu

SEQ ID NO: 1688512 - RNA, 15 nt, Human
caugcugucccuuac

SEQ ID NO: 1688513 - RNA, 17 nt, Human
caugcgggcuuccuccu

SEQ ID NO: 1688514 - RNA, 22 nt, Human
cauggacuucugccagcauaau

SEQ ID NO: 1688515 - RNA, 15 nt, Human
cauggacuuccacug

SEQ ID NO: 1688516 - RNA, 16 nt, Human
caugcuguucaugaaa

SEQ ID NO: 1688517 - RNA, 18 nt, Human
caugcuguucaugaaaga

SEQ ID NO: 1688518 - RNA, 20 nt, Human
cauggaauuggagcucgugg

SEQ ID NO: 1688519 - RNA, 18 nt, Human
caugggauaaaugccauc

SEQ ID NO: 1688520 - RNA, 23 nt, Human
caugggauaaaugccaucaauaa

SEQ ID NO: 1688521 - RNA, 16 nt, Human
caugggauaaaugcca

SEQ ID NO: 1688522 - RNA, 17 nt, Human
caugggauaaaugccau

SEQ ID NO: 1688523 - RNA, 18 nt, Human
caugggccuccugugugu

SEQ ID NO: 1688524 - RNA, 23 nt, Human
caugggacagggaggacgcucuc

SEQ ID NO: 1688525 - RNA, 23 nt, Human
cauggucggaaaacaugcuacac

SEQ ID NO: 1688526 - RNA, 19 nt, Human
cauggucggaaaacaugcu

SEQ ID NO: 1688527 - RNA, 17 nt, Human
cauggucggaaaacaug

SEQ ID NO: 1688528 - RNA, 14 nt, Human
caugucucgacuca

SEQ ID NO: 1688529 - RNA, 12 nt, Human
caugucuggcua

SEQ ID NO: 1688530 - RNA, 15 nt, Human
caugugaugagagga

SEQ ID NO: 1688531 - RNA, 16 nt, Human
caugugaugagaggaa

SEQ ID NO: 1688532 - RNA, 17 nt, Human
caugugaugagaggaaa

SEQ ID NO: 1688533 - RNA, 18 nt, Human
caugugaugagaggaaau

SEQ ID NO: 1688534 - RNA, 20 nt, Human
caugugaugagaggaaauca

SEQ ID NO: 1688535 - RNA, 21 nt, Human
caugugaugagaggaaaucac

SEQ ID NO: 1688536 - RNA, 22 nt, Human
cauguuaaaccaugggauaaau

SEQ ID NO: 1688537 - RNA, 23 nt, Human
cauguuuauuacaguauaauuaa

SEQ ID NO: 1688538 - RNA, 13 nt, Human
cauguuaaaccau

SEQ ID NO: 1688539 - RNA, 18 nt, Human
cauguguuggcagccucu

SEQ ID NO: 1688540 - RNA, 14 nt, Human
caugugcacaugca

SEQ ID NO: 1688541 - RNA, 20 nt, Human
caugugcuaguaauuggaaa

SEQ ID NO: 1688542 - RNA, 20 nt, Human
cauguuucuuuguaaugaaa

SEQ ID NO: 1688543 - RNA, 14 nt, Human
cauguuugugauug

SEQ ID NO: 1688544 - RNA, 12 nt, Human
cauguuugugau

SEQ ID NO: 1688545 - RNA, 19 nt, Human
cauguuuuucuucucccuc

SEQ ID NO: 1688546 - RNA, 20 nt, Human
cauguuuuucuucucccuca

SEQ ID NO: 1688547 - RNA, 15 nt, Human
cauguuugugauuga

SEQ ID NO: 1688548 - RNA, 16 nt, Human
caucauccuaagcuau

SEQ ID NO: 1688549 - RNA, 13 nt, Human
caucaugucuggc

SEQ ID NO: 1688550 - RNA, 14 nt, Human
caucaugucuggcu

SEQ ID NO: 1688551 - RNA, 15 nt, Human
caucaugucuggcua

SEQ ID NO: 1688552 - RNA, 20 nt, Human
caucaccaacgucugugcca

SEQ ID NO: 1688553 - RNA, 12 nt, Human
caucacccgcua

SEQ ID NO: 1688554 - RNA, 16 nt, Human
caucaguauugaagca

SEQ ID NO: 1688555 - RNA, 20 nt, Human
caucaguauugaagcauuuu

SEQ ID NO: 1688556 - RNA, 22 nt, Human
caucaguauugaagcauuuuau

SEQ ID NO: 1688557 - RNA, 12 nt, Human
cauccauccagg

SEQ ID NO: 1688558 - RNA, 20 nt, Human
caucccucccuccaccuccc

SEQ ID NO: 1688559 - RNA, 14 nt, Human
cauccacugugcca

SEQ ID NO: 1688560 - RNA, 17 nt, Human
cauccacugugccaugu

SEQ ID NO: 1688561 - RNA, 23 nt, Human
cauccacugugccaugugccagg

SEQ ID NO: 1688562 - RNA, 18 nt, Human
caucccuuaccugggaaa

SEQ ID NO: 1688563 - RNA, 15 nt, Human
caucccucuggggcu

SEQ ID NO: 1688564 - RNA, 13 nt, Human
caucccuccuggg

SEQ ID NO: 1688565 - RNA, 23 nt, Human
caucccucccuccaccucccugc

SEQ ID NO: 1688566 - RNA, 22 nt, Human
caucccucccuccaccucccug

SEQ ID NO: 1688567 - RNA, 14 nt, Human
caucaacaucuugg

SEQ ID NO: 1688568 - RNA, 16 nt, Human
cauaguaugguggcug

SEQ ID NO: 1688569 - RNA, 17 nt, Human
cauaguaugguggcugg

SEQ ID NO: 1688570 - RNA, 15 nt, Human
cauaguaugguggcu

SEQ ID NO: 1688571 - RNA, 19 nt, Human
cauagucuggcuguaccca

SEQ ID NO: 1688572 - RNA, 18 nt, Human
cauagugaugguuccccu

SEQ ID NO: 1688573 - RNA, 19 nt, Human
cauagugaugguuccccug

SEQ ID NO: 1688574 - RNA, 16 nt, Human
cauauaagugauugcu

SEQ ID NO: 1688575 - RNA, 23 nt, Human
cauauaagauucauauuuacuuc

SEQ ID NO: 1688576 - RNA, 13 nt, Human
cauauauaacaau

SEQ ID NO: 1688577 - RNA, 18 nt, Human
cauauauuuuuauauuua

SEQ ID NO: 1688578 - RNA, 15 nt, Human
cauauauaacaaugc

SEQ ID NO: 1688579 - RNA, 20 nt, Human
cauauauaacaaugcuguau

SEQ ID NO: 1688580 - RNA, 20 nt, Human
cauauauuuuuauauuuacu

SEQ ID NO: 1688581 - RNA, 21 nt, Human
cauauauuuuuauauuuacua

SEQ ID NO: 1688582 - RNA, 22 nt, Human
cauauauuuuuauauuuacuaa

SEQ ID NO: 1688583 - RNA, 13 nt, Human
cauauuguuacug

SEQ ID NO: 1688584 - RNA, 19 nt, Human
cauauuguuacugguacca

SEQ ID NO: 1688585 - RNA, 21 nt, Human
cauauugauuuccguuaaaau

SEQ ID NO: 1688586 - RNA, 17 nt, Human
cauauugauuuccguua

SEQ ID NO: 1688587 - RNA, 22 nt, Human
cauauucuguuggccaguguga

SEQ ID NO: 1688588 - RNA, 14 nt, Human
caugaaagauucaa

SEQ ID NO: 1688589 - RNA, 21 nt, Human
caugaaaacacauuuuucuua

SEQ ID NO: 1688590 - RNA, 19 nt, Human
caugaaaacacauuuuucu

SEQ ID NO: 1688591 - RNA, 12 nt, Human
caugaagacaga

SEQ ID NO: 1688592 - RNA, 17 nt, Human
caugaaaacacauuuuu

SEQ ID NO: 1688593 - RNA, 16 nt, Human
caugaaaacacauuuu

SEQ ID NO: 1688594 - RNA, 15 nt, Human
caugaaaacacauuu

SEQ ID NO: 1688595 - RNA, 14 nt, Human
caugaaaacacauu

SEQ ID NO: 1688596 - RNA, 13 nt, Human
caugaaaacacau

SEQ ID NO: 1688597 - RNA, 23 nt, Human
caugaguccccuguuuguuucug

SEQ ID NO: 1688598 - RNA, 14 nt, Human
caugaguccccugu

SEQ ID NO: 1688599 - RNA, 15 nt, Human
caugaguccccuguu

SEQ ID NO: 1688600 - RNA, 13 nt, Human
caugaguccccug

SEQ ID NO: 1688601 - RNA, 19 nt, Human
caugagguacugagaguga

SEQ ID NO: 1688602 - RNA, 22 nt, Human
caugagccucagcauccuggca

SEQ ID NO: 1688603 - RNA, 23 nt, Human
caugagccucagcauccuggcac

SEQ ID NO: 1688604 - RNA, 16 nt, Human
caugaggaacaaggca

SEQ ID NO: 1688605 - RNA, 17 nt, Human
caugaggaacaaggcaa

SEQ ID NO: 1688606 - RNA, 20 nt, Human
caugaggaacaaggcaaggc

SEQ ID NO: 1688607 - RNA, 21 nt, Human
caugaggaacaaggcaaggcu

SEQ ID NO: 1688608 - RNA, 23 nt, Human
caugaggaacaaggcaaggcugu

SEQ ID NO: 1688609 - RNA, 16 nt, Human
caugagguacugagag

SEQ ID NO: 1688610 - RNA, 15 nt, Human
caugagcaucaggcc

SEQ ID NO: 1688611 - RNA, 16 nt, Human
caugagcaucaggcca

SEQ ID NO: 1688612 - RNA, 17 nt, Human
caugagcaucaggccag

SEQ ID NO: 1688613 - RNA, 18 nt, Human
caugagcaucaggccagg

SEQ ID NO: 1688614 - RNA, 20 nt, Human
caugagcaucaggccaggcc

SEQ ID NO: 1688615 - RNA, 21 nt, Human
caugagcaucaggccaggccc

SEQ ID NO: 1688616 - RNA, 22 nt, Human
caugagcaucaggccaggcccu

SEQ ID NO: 1688617 - RNA, 23 nt, Human
caugagcaucaggccaggcccuc

SEQ ID NO: 1688618 - RNA, 12 nt, Human
caugagccucag

SEQ ID NO: 1688619 - RNA, 15 nt, Human
caugagccucagcau

SEQ ID NO: 1688620 - RNA, 17 nt, Human
caugagccucagcaucc

SEQ ID NO: 1688621 - RNA, 18 nt, Human
caugagccucagcauccu

SEQ ID NO: 1688622 - RNA, 19 nt, Human
caugagccucagcauccug

SEQ ID NO: 1688623 - RNA, 20 nt, Human
caugagccucagcauccugg

SEQ ID NO: 1688624 - RNA, 21 nt, Human
caugagccucagcauccuggc

SEQ ID NO: 1688625 - RNA, 13 nt, Human
caugagcaucagg

SEQ ID NO: 1688626 - RNA, 23 nt, Human
caugacucguauaugucucaggu

SEQ ID NO: 1688627 - RNA, 20 nt, Human
caugacucguauaugucuca

SEQ ID NO: 1688628 - RNA, 18 nt, Human
caugaagauguagaggag

SEQ ID NO: 1688629 - RNA, 19 nt, Human
caugaagauguagaggaga

SEQ ID NO: 1688630 - RNA, 19 nt, Human
caucuugcucugcugacag

SEQ ID NO: 1688631 - RNA, 16 nt, Human
caucuugcucugcuga

SEQ ID NO: 1688632 - RNA, 17 nt, Human
caucuugcucugcugac

SEQ ID NO: 1688633 - RNA, 16 nt, Human
caucuugaauuguaag

SEQ ID NO: 1688634 - RNA, 21 nt, Human
caucuugaauuguaaggaaug

SEQ ID NO: 1688635 - RNA, 18 nt, Human
cauccuacaagacacagu

SEQ ID NO: 1688636 - RNA, 19 nt, Human
cauccuacaagacacagug

SEQ ID NO: 1688637 - RNA, 16 nt, Human
caucucuacaaaaagc

SEQ ID NO: 1688638 - RNA, 15 nt, Human
caucucuccuccuuu

SEQ ID NO: 1688639 - RNA, 15 nt, Human
caucucugcaaucuu

SEQ ID NO: 1688640 - RNA, 22 nt, Human
caucucugcaaucuucucagaa

SEQ ID NO: 1688641 - RNA, 12 nt, Human
caggcugagccu

SEQ ID NO: 1688642 - RNA, 18 nt, Human
caggcucuucuccuuuca

SEQ ID NO: 1688643 - RNA, 22 nt, Human
caggcucuucuccuuucacaac

SEQ ID NO: 1688644 - RNA, 14 nt, Human
caggcucuucuccu

SEQ ID NO: 1688645 - RNA, 15 nt, Human
caggcucuucuccuu

SEQ ID NO: 1688646 - RNA, 12 nt, Human
caggcucuucuc

SEQ ID NO: 1688647 - RNA, 13 nt, Human
caggcugagccuc

SEQ ID NO: 1688648 - RNA, 14 nt, Human
caggcugagccuca

SEQ ID NO: 1688649 - RNA, 15 nt, Human
caggcugagccucag

SEQ ID NO: 1688650 - RNA, 16 nt, Human
caggcugagccucagu

SEQ ID NO: 1688651 - RNA, 17 nt, Human
caggcugagccucaguc

SEQ ID NO: 1688652 - RNA, 21 nt, Human
caggcugagccucagucuccc

SEQ ID NO: 1688653 - RNA, 23 nt, Human
caggcugcucuugaacuccugac

SEQ ID NO: 1688654 - RNA, 12 nt, Human
caggcugcucuu

SEQ ID NO: 1688655 - RNA, 20 nt, Human
caggcugcucuugaacuccu

SEQ ID NO: 1688656 - RNA, 12 nt, Human
caggcuggcccu

SEQ ID NO: 1688657 - RNA, 14 nt, Human
caggcuggcccugc

SEQ ID NO: 1688658 - RNA, 15 nt, Human
caggcuggcccugcc

SEQ ID NO: 1688659 - RNA, 16 nt, Human
caggcuggcccugccc

SEQ ID NO: 1688660 - RNA, 17 nt, Human
caggcuggcccugcccu

SEQ ID NO: 1688661 - RNA, 23 nt, Human
caggcugggucgcccuggacugu

SEQ ID NO: 1688662 - RNA, 23 nt, Human
caggcugggcuucaguggcagcu

SEQ ID NO: 1688663 - RNA, 21 nt, Human
caggcugggucgcccuggacu

SEQ ID NO: 1688664 - RNA, 14 nt, Human
caggcugugaguuu

SEQ ID NO: 1688665 - RNA, 22 nt, Human
caggcuguaucccaugagccuc

SEQ ID NO: 1688666 - RNA, 23 nt, Human
caggcuguaucccaugagccuca

SEQ ID NO: 1688667 - RNA, 16 nt, Human
caggcuuagucacuga

SEQ ID NO: 1688668 - RNA, 17 nt, Human
caggcuuagucacugag

SEQ ID NO: 1688669 - RNA, 20 nt, Human
caggcuuagucacugagaca

SEQ ID NO: 1688670 - RNA, 21 nt, Human
caggcuuagucacugagacag

SEQ ID NO: 1688671 - RNA, 12 nt, Human
caggcuggucuc

SEQ ID NO: 1688672 - RNA, 20 nt, Human
caggcuggucucgaacuccu

SEQ ID NO: 1688673 - RNA, 22 nt, Human
caggcuggucucgaacuccuga

SEQ ID NO: 1688674 - RNA, 19 nt, Human
caggcuggucucaaacucu

SEQ ID NO: 1688675 - RNA, 23 nt, Human
caggcuggucucgaacuccugac

SEQ ID NO: 1688676 - RNA, 14 nt, Human
caggcuguauccca

SEQ ID NO: 1688677 - RNA, 20 nt, Human
caggcuguaucccaugagcc

SEQ ID NO: 1688678 - RNA, 21 nt, Human
caggcuguaucccaugagccu

SEQ ID NO: 1688679 - RNA, 16 nt, Human
cagggaaacagcuaau

SEQ ID NO: 1688680 - RNA, 23 nt, Human
caggcuuuuuuaucaugugaaau

SEQ ID NO: 1688681 - RNA, 22 nt, Human
caggcuuagucacugagacagc

SEQ ID NO: 1688682 - RNA, 23 nt, Human
caggcuuagucacugagacagcc

SEQ ID NO: 1688683 - RNA, 19 nt, Human
caggcccuuccucuccacu

SEQ ID NO: 1688684 - RNA, 20 nt, Human
caggcccuuccucuccacug

SEQ ID NO: 1688685 - RNA, 21 nt, Human
caggcccuuccucuccacugc

SEQ ID NO: 1688686 - RNA, 23 nt, Human
caggcccuuccucuccacugccu

SEQ ID NO: 1688687 - RNA, 16 nt, Human
caggcccuuccucucc

SEQ ID NO: 1688688 - RNA, 17 nt, Human
caggcccuuccucucca

SEQ ID NO: 1688689 - RNA, 15 nt, Human
caggcccuuccucuc

SEQ ID NO: 1688690 - RNA, 16 nt, Human
caggcccucugcccac

SEQ ID NO: 1688691 - RNA, 17 nt, Human
caggcccucugcccacu

SEQ ID NO: 1688692 - RNA, 19 nt, Human
caggcccucugcccacucc

SEQ ID NO: 1688693 - RNA, 20 nt, Human
caggcccucugcccacuccc

SEQ ID NO: 1688694 - RNA, 21 nt, Human
caggcccucugcccacucccu

SEQ ID NO: 1688695 - RNA, 22 nt, Human
caggcccucugcccacucccug

SEQ ID NO: 1688696 - RNA, 22 nt, Human
caggcccggcuccaggcuccuu

SEQ ID NO: 1688697 - RNA, 20 nt, Human
caggcccggcuccaggcucc

SEQ ID NO: 1688698 - RNA, 21 nt, Human
caggcccggcuccaggcuccu

SEQ ID NO: 1688699 - RNA, 13 nt, Human
caggcccucugcc

SEQ ID NO: 1688700 - RNA, 14 nt, Human
caggcccucugccc

SEQ ID NO: 1688701 - RNA, 15 nt, Human
caggcccucugccca

SEQ ID NO: 1688702 - RNA, 17 nt, Human
caggcccggcuccaggc

SEQ ID NO: 1688703 - RNA, 18 nt, Human
caggcccggcuccaggcu

SEQ ID NO: 1688704 - RNA, 19 nt, Human
caggcccggcuccaggcuc

SEQ ID NO: 1688705 - RNA, 21 nt, Human
caggcuccuuuagcgcccagu

SEQ ID NO: 1688706 - RNA, 20 nt, Human
caggcucgggcuccccagcc

SEQ ID NO: 1688707 - RNA, 12 nt, Human
caggcucucagg

SEQ ID NO: 1688708 - RNA, 13 nt, Human
caggcucucaggc

SEQ ID NO: 1688709 - RNA, 14 nt, Human
caggcucucaggcc

SEQ ID NO: 1688710 - RNA, 15 nt, Human
caggcucucaggcca

SEQ ID NO: 1688711 - RNA, 16 nt, Human
caggcucucaggccag

SEQ ID NO: 1688712 - RNA, 21 nt, Human
caggcucucaggccagcugcu

SEQ ID NO: 1688713 - RNA, 23 nt, Human
caggcucucaggccagcugcuug

SEQ ID NO: 1688714 - RNA, 17 nt, Human
caggcucucaggccagc

SEQ ID NO: 1688715 - RNA, 18 nt, Human
caggcucucaggccagcu

SEQ ID NO: 1688716 - RNA, 19 nt, Human
caggcucucaggccagcug

SEQ ID NO: 1688717 - RNA, 20 nt, Human
caggcucucaggccagcugc

SEQ ID NO: 1688718 - RNA, 13 nt, Human
caggcuccugcca

SEQ ID NO: 1688719 - RNA, 14 nt, Human
caggcuccugccac

SEQ ID NO: 1688720 - RNA, 15 nt, Human
caggcuccugccacc

SEQ ID NO: 1688721 - RNA, 16 nt, Human
caggcuccugccacca

SEQ ID NO: 1688722 - RNA, 18 nt, Human
caggcuccugccaccacg

SEQ ID NO: 1688723 - RNA, 14 nt, Human
caggcuccuuuagc

SEQ ID NO: 1688724 - RNA, 19 nt, Human
caggcuccuuuagcgccca

SEQ ID NO: 1688725 - RNA, 20 nt, Human
caggcuccuuuagcgcccag

SEQ ID NO: 1688726 - RNA, 13 nt, Human
caggcuagaugua

SEQ ID NO: 1688727 - RNA, 19 nt, Human
caggcuagauguauguacu

SEQ ID NO: 1688728 - RNA, 14 nt, Human
caggcuacugucag

SEQ ID NO: 1688729 - RNA, 15 nt, Human
cagggaaggggacaa

SEQ ID NO: 1688730 - RNA, 17 nt, Human
cagggaaggggacaagg

SEQ ID NO: 1688731 - RNA, 13 nt, Human
cagggacagaggg

SEQ ID NO: 1688732 - RNA, 14 nt, Human
cagggacagagggg

SEQ ID NO: 1688733 - RNA, 20 nt, Human
cagggacagaggggguggcc

SEQ ID NO: 1688734 - RNA, 22 nt, Human
cagggaaacagcuaaugggaca

SEQ ID NO: 1688735 - RNA, 22 nt, Human
cagggcacaccgggcacucaga

SEQ ID NO: 1688736 - RNA, 23 nt, Human
cagggcacaccgggcacucagaa

SEQ ID NO: 1688737 - RNA, 15 nt, Human
cagggcacaccgggc

SEQ ID NO: 1688738 - RNA, 17 nt, Human
cagggcacaccgggcac

SEQ ID NO: 1688739 - RNA, 19 nt, Human
cagggcacaccgggcacuc

SEQ ID NO: 1688740 - RNA, 21 nt, Human
cagggcacaccgggcacucag

SEQ ID NO: 1688741 - RNA, 14 nt, Human
cagggcacaccggg

SEQ ID NO: 1688742 - RNA, 23 nt, Human
cagggacagaggggguggccucc

SEQ ID NO: 1688743 - RNA, 18 nt, Human
cagggacaggauaagagg

SEQ ID NO: 1688744 - RNA, 20 nt, Human
cagggcauggccagguggcc

SEQ ID NO: 1688745 - RNA, 17 nt, Human
cagggcauggcugggaa

SEQ ID NO: 1688746 - RNA, 19 nt, Human
caggggaggguagagcgga

SEQ ID NO: 1688747 - RNA, 16 nt, Human
cagggccuggcucagg

SEQ ID NO: 1688748 - RNA, 19 nt, Human
cagggccuggcucaggugg

SEQ ID NO: 1688749 - RNA, 13 nt, Human
cagggccuggcuc

SEQ ID NO: 1688750 - RNA, 14 nt, Human
cagggccuggcuca

SEQ ID NO: 1688751 - RNA, 15 nt, Human
cagggccuggcucag

SEQ ID NO: 1688752 - RNA, 11 nt, Human
caggggacagg

SEQ ID NO: 1688753 - RNA, 16 nt, Human
caggggacaggauggu

SEQ ID NO: 1688754 - RNA, 17 nt, Human
caggcaugguggcccac

SEQ ID NO: 1688755 - RNA, 14 nt, Human
caggcagguccagg

SEQ ID NO: 1688756 - RNA, 15 nt, Human
caggcagguccaggg

SEQ ID NO: 1688757 - RNA, 19 nt, Human
caggcagguccaggguuug

SEQ ID NO: 1688758 - RNA, 12 nt, Human
caggcaggucuu

SEQ ID NO: 1688759 - RNA, 13 nt, Human
caggcaggucuug

SEQ ID NO: 1688760 - RNA, 22 nt, Human
caggcaggucuugaacuccugg

SEQ ID NO: 1688761 - RNA, 23 nt, Human
caggcaggucuugaacuccuggc

SEQ ID NO: 1688762 - RNA, 15 nt, Human
caggcaggugggaug

SEQ ID NO: 1688763 - RNA, 24 nt, Human
caggcauuccccaggaggccagcc

SEQ ID NO: 1688764 - RNA, 22 nt, Human
caggcauuccccaggaggccag

SEQ ID NO: 1688765 - RNA, 23 nt, Human
caggcauuccccaggaggccagc

SEQ ID NO: 1688766 - RNA, 18 nt, Human
caggcauuccccaggagg

SEQ ID NO: 1688767 - RNA, 19 nt, Human
caggcauuccccaggaggc

SEQ ID NO: 1688768 - RNA, 20 nt, Human
caggcauuccccaggaggcc

SEQ ID NO: 1688769 - RNA, 21 nt, Human
caggcauuccccaggaggcca

SEQ ID NO: 1688770 - RNA, 15 nt, Human
caggcauguucucug

SEQ ID NO: 1688771 - RNA, 18 nt, Human
caggcauguucucugagg

SEQ ID NO: 1688772 - RNA, 19 nt, Human
caggcauguucucugagga

SEQ ID NO: 1688773 - RNA, 20 nt, Human
caggcauguucucugaggac

SEQ ID NO: 1688774 - RNA, 13 nt, Human
caggcauucccca

SEQ ID NO: 1688775 - RNA, 15 nt, Human
caggcauuccccagg

SEQ ID NO: 1688776 - RNA, 16 nt, Human
caggcauuccccagga

SEQ ID NO: 1688777 - RNA, 17 nt, Human
caggcauuccccaggag

SEQ ID NO: 1688778 - RNA, 13 nt, Human
caggcagguccag

SEQ ID NO: 1688779 - RNA, 20 nt, Human
caggcaggaaggcugagagg

SEQ ID NO: 1688780 - RNA, 16 nt, Human
caggcagccaggccac

SEQ ID NO: 1688781 - RNA, 17 nt, Human
caggcagccaggccaca

SEQ ID NO: 1688782 - RNA, 14 nt, Human
caggcaaugcuggc

SEQ ID NO: 1688783 - RNA, 14 nt, Human
caggcagccaggcc

SEQ ID NO: 1688784 - RNA, 15 nt, Human
caggcagccaggcca

SEQ ID NO: 1688785 - RNA, 14 nt, Human
caggcaagcaccuc

SEQ ID NO: 1688786 - RNA, 15 nt, Human
caggcaagcaccucc

SEQ ID NO: 1688787 - RNA, 16 nt, Human
caggcaagcaccuccu

SEQ ID NO: 1688788 - RNA, 21 nt, Human
caggcaagcaccuccugccuc

SEQ ID NO: 1688789 - RNA, 20 nt, Human
caggauucuuccucccuccc

SEQ ID NO: 1688790 - RNA, 16 nt, Human
caggauuuuaaucuuu

SEQ ID NO: 1688791 - RNA, 21 nt, Human
caggauauucucacagcucca

SEQ ID NO: 1688792 - RNA, 13 nt, Human
caggaucagucug

SEQ ID NO: 1688793 - RNA, 14 nt, Human
caggaucagucuga

SEQ ID NO: 1688794 - RNA, 18 nt, Human
caggaugaugacuaugga

SEQ ID NO: 1688795 - RNA, 20 nt, Human
caggaugaugacuauggaaa

SEQ ID NO: 1688796 - RNA, 22 nt, Human
caggaugaugacuauggaaaga

SEQ ID NO: 1688797 - RNA, 23 nt, Human
caggauggccgggcgcgguggcu

SEQ ID NO: 1688798 - RNA, 19 nt, Human
caggauguacaaggacagc

SEQ ID NO: 1688799 - RNA, 17 nt, Human
caggauucuuccucccu

SEQ ID NO: 1688800 - RNA, 18 nt, Human
caggauucuuccucccuc

SEQ ID NO: 1688801 - RNA, 21 nt, Human
caggaugguucccuugaugaa

SEQ ID NO: 1688802 - RNA, 23 nt, Human
caggaugguucccuugaugaaga

SEQ ID NO: 1688803 - RNA, 13 nt, Human
caggcccggcucc

SEQ ID NO: 1688804 - RNA, 14 nt, Human
caggcccggcucca

SEQ ID NO: 1688805 - RNA, 15 nt, Human
caggcccggcuccag

SEQ ID NO: 1688806 - RNA, 15 nt, Human
caggccccugccacc

SEQ ID NO: 1688807 - RNA, 17 nt, Human
caggccccugccacccu

SEQ ID NO: 1688808 - RNA, 19 nt, Human
caggccccugccacccugg

SEQ ID NO: 1688809 - RNA, 20 nt, Human
caggccccugccacccuggg

SEQ ID NO: 1688810 - RNA, 16 nt, Human
caggcccggcuccagg

SEQ ID NO: 1688811 - RNA, 18 nt, Human
caggccaaacucaccugc

SEQ ID NO: 1688812 - RNA, 23 nt, Human
caggccaaacucaccugccccuc

SEQ ID NO: 1688813 - RNA, 13 nt, Human
caggccacaagac

SEQ ID NO: 1688814 - RNA, 17 nt, Human
caggccacaagacccuu

SEQ ID NO: 1688815 - RNA, 18 nt, Human
caggccacaagacccuug

SEQ ID NO: 1688816 - RNA, 18 nt, Human
caggccauuccccgucuc

SEQ ID NO: 1688817 - RNA, 20 nt, Human
caggccacaagacccuugug

SEQ ID NO: 1688818 - RNA, 21 nt, Human
caggccaggcccucugcccac

SEQ ID NO: 1688819 - RNA, 22 nt, Human
caggccaggcccucugcccacu

SEQ ID NO: 1688820 - RNA, 21 nt, Human
caggccauuccccgucucugg

SEQ ID NO: 1688821 - RNA, 14 nt, Human
caggcccccaggug

SEQ ID NO: 1688822 - RNA, 19 nt, Human
caggcccccaggugccagu

SEQ ID NO: 1688823 - RNA, 13 nt, Human
caggccccugcca

SEQ ID NO: 1688824 - RNA, 20 nt, Human
caggcccccaggugccaguu

SEQ ID NO: 1688825 - RNA, 16 nt, Human
caggaguuggaagugu

SEQ ID NO: 1688826 - RNA, 19 nt, Human
caggaguuucguuuucaaa

SEQ ID NO: 1688827 - RNA, 21 nt, Human
caggaguuugagaccaaccug

SEQ ID NO: 1688828 - RNA, 13 nt, Human
caggauagacuuu

SEQ ID NO: 1688829 - RNA, 22 nt, Human
caggaguuugagaccaaccugg

SEQ ID NO: 1688830 - RNA, 23 nt, Human
caggaguuugagaccaaccuggg

SEQ ID NO: 1688831 - RNA, 14 nt, Human
caggagcccuggga

SEQ ID NO: 1688832 - RNA, 16 nt, Human
caggagcccugggagg

SEQ ID NO: 1688833 - RNA, 18 nt, Human
caggagcccugggaggcu

SEQ ID NO: 1688834 - RNA, 19 nt, Human
caggagcccugggaggcuc

SEQ ID NO: 1688835 - RNA, 11 nt, Human
caggagcccug

SEQ ID NO: 1688836 - RNA, 23 nt, Human
caggagccccgaggccuucucug

SEQ ID NO: 1688837 - RNA, 20 nt, Human
caggagccccgaggccuucu

SEQ ID NO: 1688838 - RNA, 22 nt, Human
caggagccccgaggccuucucu

SEQ ID NO: 1688839 - RNA, 15 nt, Human
caggagccccgaggc

SEQ ID NO: 1688840 - RNA, 16 nt, Human
caggagccccgaggcc

SEQ ID NO: 1688841 - RNA, 18 nt, Human
caggagccccgaggccuu

SEQ ID NO: 1688842 - RNA, 12 nt, Human
caggagcagcca

SEQ ID NO: 1688843 - RNA, 13 nt, Human
caggagcagccac

SEQ ID NO: 1688844 - RNA, 14 nt, Human
caggagcagccaca

SEQ ID NO: 1688845 - RNA, 19 nt, Human
caggagcagccacauuccu

SEQ ID NO: 1688846 - RNA, 12 nt, Human
caggagugagca

SEQ ID NO: 1688847 - RNA, 20 nt, Human
caggagccuccugcccuuac

SEQ ID NO: 1688848 - RNA, 14 nt, Human
caggagccuccugc

SEQ ID NO: 1688849 - RNA, 17 nt, Human
caggagccuccugcccu

SEQ ID NO: 1688850 - RNA, 21 nt, Human
caggagcccugggaggcucug

SEQ ID NO: 1688851 - RNA, 12 nt, Human
caggacucugcc

SEQ ID NO: 1688852 - RNA, 13 nt, Human
caggacucugccu

SEQ ID NO: 1688853 - RNA, 15 nt, Human
caggacucugccucc

SEQ ID NO: 1688854 - RNA, 16 nt, Human
caggacucugccuccu

SEQ ID NO: 1688855 - RNA, 23 nt, Human
caguccccgugaaggagagcccu

SEQ ID NO: 1688856 - RNA, 16 nt, Human
cagucccccugcccca

SEQ ID NO: 1688857 - RNA, 17 nt, Human
cagucccccugccccag

SEQ ID NO: 1688858 - RNA, 17 nt, Human
cagucccugccaaugga

SEQ ID NO: 1688859 - RNA, 12 nt, Human
caguccucccau

SEQ ID NO: 1688860 - RNA, 13 nt, Human
caguccucccauc

SEQ ID NO: 1688861 - RNA, 14 nt, Human
caguccucccaucu

SEQ ID NO: 1688862 - RNA, 15 nt, Human
caguccucccaucuc

SEQ ID NO: 1688863 - RNA, 12 nt, Human
cagucccugcca

SEQ ID NO: 1688864 - RNA, 13 nt, Human
cagucccugccaa

SEQ ID NO: 1688865 - RNA, 14 nt, Human
cagucccugccaau

SEQ ID NO: 1688866 - RNA, 15 nt, Human
cagucccugccaaug

SEQ ID NO: 1688867 - RNA, 16 nt, Human
cagucccugccaaugg

SEQ ID NO: 1688868 - RNA, 16 nt, Human
caguauuacuucugcu

SEQ ID NO: 1688869 - RNA, 18 nt, Human
caguauuacuucugcuac

SEQ ID NO: 1688870 - RNA, 19 nt, Human
caguauuacuucugcuaca

SEQ ID NO: 1688871 - RNA, 15 nt, Human
cagucaggaaagaga

SEQ ID NO: 1688872 - RNA, 18 nt, Human
cagucaggaaagagaacu

SEQ ID NO: 1688873 - RNA, 22 nt, Human
cagucaggaaagagaacuucca

SEQ ID NO: 1688874 - RNA, 17 nt, Human
cagucauucagauauga

SEQ ID NO: 1688875 - RNA, 20 nt, Human
cagucauucagauaugauuc

SEQ ID NO: 1688876 - RNA, 16 nt, Human
caguccauagcagaga

SEQ ID NO: 1688877 - RNA, 14 nt, Human
caguccauugaaag

SEQ ID NO: 1688878 - RNA, 13 nt, Human
caguccaugaaga

SEQ ID NO: 1688879 - RNA, 14 nt, Human
caguauaauuaaca

SEQ ID NO: 1688880 - RNA, 15 nt, Human
caguauaauuaacau

SEQ ID NO: 1688881 - RNA, 17 nt, Human
caguauaauuaacaugu

SEQ ID NO: 1688882 - RNA, 21 nt, Human
caguauaauuaacauguuaaa

SEQ ID NO: 1688883 - RNA, 12 nt, Human
caguagugauag

SEQ ID NO: 1688884 - RNA, 13 nt, Human
caguaucucaggg

SEQ ID NO: 1688885 - RNA, 15 nt, Human
caguaucucagggcc

SEQ ID NO: 1688886 - RNA, 12 nt, Human
caguaucuugaa

SEQ ID NO: 1688887 - RNA, 18 nt, Human
caguaucuugaagacuuu

SEQ ID NO: 1688888 - RNA, 21 nt, Human
caguaucuugaagacuuuucu

SEQ ID NO: 1688889 - RNA, 12 nt, Human
caguauggcagc

SEQ ID NO: 1688890 - RNA, 13 nt, Human
cagugcuccagcc

SEQ ID NO: 1688891 - RNA, 23 nt, Human
cagugccuuauggaacacucuga

SEQ ID NO: 1688892 - RNA, 15 nt, Human
cagugccgagaagga

SEQ ID NO: 1688893 - RNA, 18 nt, Human
cagugccgagaaggaagc

SEQ ID NO: 1688894 - RNA, 11 nt, Human
cagugccuuau

SEQ ID NO: 1688895 - RNA, 13 nt, Human
cagugccuuaugg

SEQ ID NO: 1688896 - RNA, 15 nt, Human
cagugccuuauggaa

SEQ ID NO: 1688897 - RNA, 16 nt, Human
cagugccuuauggaac

SEQ ID NO: 1688898 - RNA, 17 nt, Human
cagugccuuauggaaca

SEQ ID NO: 1688899 - RNA, 18 nt, Human
cagugccuuauggaacac

SEQ ID NO: 1688900 - RNA, 19 nt, Human
cagugccuuauggaacacu

SEQ ID NO: 1688901 - RNA, 20 nt, Human
cagugccuuauggaacacuc

SEQ ID NO: 1688902 - RNA, 21 nt, Human
cagugccuuauggaacacucu

SEQ ID NO: 1688903 - RNA, 22 nt, Human
cagugccuuauggaacacucug

SEQ ID NO: 1688904 - RNA, 19 nt, Human
cagugagucgaggacaggg

SEQ ID NO: 1688905 - RNA, 20 nt, Human
cagugagucgaggacaggga

SEQ ID NO: 1688906 - RNA, 22 nt, Human
cagugagucgaggacagggagg

SEQ ID NO: 1688907 - RNA, 23 nt, Human
cagugagucgaggacagggaggu

SEQ ID NO: 1688908 - RNA, 15 nt, Human
cagugcccuccagga

SEQ ID NO: 1688909 - RNA, 17 nt, Human
cagugauuaccagggac

SEQ ID NO: 1688910 - RNA, 18 nt, Human
cagugauuaccagggacu

SEQ ID NO: 1688911 - RNA, 16 nt, Human
caguccucccaucuca

SEQ ID NO: 1688912 - RNA, 17 nt, Human
caguccucccaucucac

SEQ ID NO: 1688913 - RNA, 15 nt, Human
caguccuuaccagca

SEQ ID NO: 1688914 - RNA, 18 nt, Human
caguccuuaccagcagag

SEQ ID NO: 1688915 - RNA, 19 nt, Human
caguccuuaccagcagagc

SEQ ID NO: 1688916 - RNA, 20 nt, Human
caguccuuaccagcagagca

SEQ ID NO: 1688917 - RNA, 21 nt, Human
caguccuuaccagcagagcac

SEQ ID NO: 1688918 - RNA, 19 nt, Human
cagucuggaaugcaguggu

SEQ ID NO: 1688919 - RNA, 20 nt, Human
cagugaaagaaaauaacaau

SEQ ID NO: 1688920 - RNA, 16 nt, Human
cagugaaagaaaauaa

SEQ ID NO: 1688921 - RNA, 24 nt, Human
cagugagccgagauugcaccacug

SEQ ID NO: 1688922 - RNA, 12 nt, Human
cagugaggcucu

SEQ ID NO: 1688923 - RNA, 13 nt, Human
cagugaggcucug

SEQ ID NO: 1688924 - RNA, 14 nt, Human
cagugaggcucugc

SEQ ID NO: 1688925 - RNA, 15 nt, Human
cagugaggcucugcc

SEQ ID NO: 1688926 - RNA, 16 nt, Human
cagugaggcucugccc

SEQ ID NO: 1688927 - RNA, 21 nt, Human
cagugaggcucugcccuuggu

SEQ ID NO: 1688928 - RNA, 17 nt, Human
cagugagucgaggacag

SEQ ID NO: 1688929 - RNA, 18 nt, Human
cagugagucgaggacagg

SEQ ID NO: 1688930 - RNA, 17 nt, Human
cagugaggcucugcccu

SEQ ID NO: 1688931 - RNA, 18 nt, Human
cagugaggcucugcccuu

SEQ ID NO: 1688932 - RNA, 19 nt, Human
cagugaggcucugcccuug

SEQ ID NO: 1688933 - RNA, 20 nt, Human
cagugaggcucugcccuugg

SEQ ID NO: 1688934 - RNA, 15 nt, Human
cagugagacagcucu

SEQ ID NO: 1688935 - RNA, 21 nt, Human
caguaaaugggggugcauuug

SEQ ID NO: 1688936 - RNA, 22 nt, Human
caguaaaugggggugcauuuga

SEQ ID NO: 1688937 - RNA, 12 nt, Human
cagguucagcuu

SEQ ID NO: 1688938 - RNA, 13 nt, Human
cagguucagcuug

SEQ ID NO: 1688939 - RNA, 12 nt, Human
caguaauaacuc

SEQ ID NO: 1688940 - RNA, 13 nt, Human
caguaauaacucu

SEQ ID NO: 1688941 - RNA, 21 nt, Human
caggugugagccaccacgccc

SEQ ID NO: 1688942 - RNA, 22 nt, Human
caggugugagucaccaagccca

SEQ ID NO: 1688943 - RNA, 23 nt, Human
caggugugagucaccaagcccag

SEQ ID NO: 1688944 - RNA, 18 nt, Human
caggugugagccaccacg

SEQ ID NO: 1688945 - RNA, 16 nt, Human
caggugugagucacca

SEQ ID NO: 1688946 - RNA, 20 nt, Human
caggugugagucaccaagcc

SEQ ID NO: 1688947 - RNA, 21 nt, Human
caggugugagucaccaagccc

SEQ ID NO: 1688948 - RNA, 16 nt, Human
caggugugaaccacca

SEQ ID NO: 1688949 - RNA, 19 nt, Human
caggugugaaccaccacac

SEQ ID NO: 1688950 - RNA, 22 nt, Human
caggugugaaccaccacaccca

SEQ ID NO: 1688951 - RNA, 23 nt, Human
caggugugaaccaccacacccag

SEQ ID NO: 1688952 - RNA, 15 nt, Human
caggugucccugcac

SEQ ID NO: 1688953 - RNA, 16 nt, Human
caggugucccugcacu

SEQ ID NO: 1688954 - RNA, 18 nt, Human
caggugucccugcacuug

SEQ ID NO: 1688955 - RNA, 19 nt, Human
caggugucccugcacuugc

SEQ ID NO: 1688956 - RNA, 12 nt, Human
caggugugaacc

SEQ ID NO: 1688957 - RNA, 13 nt, Human
cagguggggcagc

SEQ ID NO: 1688958 - RNA, 14 nt, Human
cagguggggcagcu

SEQ ID NO: 1688959 - RNA, 15 nt, Human
cagguggggcagcuu

SEQ ID NO: 1688960 - RNA, 16 nt, Human
cagguggggcagcuug

SEQ ID NO: 1688961 - RNA, 17 nt, Human
cagguggggcagcuuga

SEQ ID NO: 1688962 - RNA, 18 nt, Human
cagguggggucacucugg

SEQ ID NO: 1688963 - RNA, 23 nt, Human
cagguggggucacucuggcagcu

SEQ ID NO: 1688964 - RNA, 18 nt, Human
caggugguuauggagagg

SEQ ID NO: 1688965 - RNA, 19 nt, Human
cagguggggucacucuggc

SEQ ID NO: 1688966 - RNA, 20 nt, Human
cagguggggucacucuggca

SEQ ID NO: 1688967 - RNA, 21 nt, Human
cagguggggucacucuggcag

SEQ ID NO: 1688968 - RNA, 22 nt, Human
cagguggggucacucuggcagc

SEQ ID NO: 1688969 - RNA, 20 nt, Human
caggugguuauggagagggu

SEQ ID NO: 1688970 - RNA, 11 nt, Human
caggugucccu

SEQ ID NO: 1688971 - RNA, 14 nt, Human
caggugucccugca

SEQ ID NO: 1688972 - RNA, 14 nt, Human
caggggugggacac

SEQ ID NO: 1688973 - RNA, 15 nt, Human
caggggugggacacc

SEQ ID NO: 1688974 - RNA, 20 nt, Human
caggggugggacacccugug

SEQ ID NO: 1688975 - RNA, 21 nt, Human
caggggugggacacccuguga

SEQ ID NO: 1688976 - RNA, 16 nt, Human
caggguuuugccaugu

SEQ ID NO: 1688977 - RNA, 17 nt, Human
cagggucucacucuguc

SEQ ID NO: 1688978 - RNA, 16 nt, Human
cagggucucacucugu

SEQ ID NO: 1688979 - RNA, 14 nt, Human
cagguaacaggcag

SEQ ID NO: 1688980 - RNA, 15 nt, Human
cagguaacaggcaga

SEQ ID NO: 1688981 - RNA, 16 nt, Human
cagguaacaggcagau

SEQ ID NO: 1688982 - RNA, 17 nt, Human
cagguaacaggcagaua

SEQ ID NO: 1688983 - RNA, 23 nt, Human
cagggucccugguggcagcucac

SEQ ID NO: 1688984 - RNA, 18 nt, Human
caggguccuguagcccua

SEQ ID NO: 1688985 - RNA, 21 nt, Human
cagggucucacuauguugccc

SEQ ID NO: 1688986 - RNA, 22 nt, Human
cagggucucacuauguugccca

SEQ ID NO: 1688987 - RNA, 23 nt, Human
cagggucucacuauguugcccag

SEQ ID NO: 1688988 - RNA, 15 nt, Human
cagggucucacucug

SEQ ID NO: 1688989 - RNA, 21 nt, Human
caggguauuccagagugggga

SEQ ID NO: 1688990 - RNA, 20 nt, Human
caggguauuccagagugggg

SEQ ID NO: 1688991 - RNA, 12 nt, Human
cagggucccugg

SEQ ID NO: 1688992 - RNA, 14 nt, Human
cagggucccuggug

SEQ ID NO: 1688993 - RNA, 15 nt, Human
cagggucccuggugg

SEQ ID NO: 1688994 - RNA, 18 nt, Human
cagggucccugguggcag

SEQ ID NO: 1688995 - RNA, 19 nt, Human
cagggucccugguggcagc

SEQ ID NO: 1688996 - RNA, 22 nt, Human
cagggucccugguggcagcuca

SEQ ID NO: 1688997 - RNA, 19 nt, Human
caggucccuaauaaagcug

SEQ ID NO: 1688998 - RNA, 20 nt, Human
caggucccuaauaaagcugu

SEQ ID NO: 1688999 - RNA, 21 nt, Human
caggucccuaauaaagcugug

SEQ ID NO: 1689000 - RNA, 22 nt, Human
caggucccuaauaaagcugugu

SEQ ID NO: 1689001 - RNA, 18 nt, Human
caggucuugaacuccugg

SEQ ID NO: 1689002 - RNA, 19 nt, Human
caggucuugaacuccuggc

SEQ ID NO: 1689003 - RNA, 20 nt, Human
caggucuugaacuccuggcc

SEQ ID NO: 1689004 - RNA, 21 nt, Human
caggucuugaacuccuggccu

SEQ ID NO: 1689005 - RNA, 22 nt, Human
caggucuugaacuccuggccuc

SEQ ID NO: 1689006 - RNA, 23 nt, Human
caggucuugaacuccuggccuca

SEQ ID NO: 1689007 - RNA, 15 nt, Human
cagguggccacucca

SEQ ID NO: 1689008 - RNA, 16 nt, Human
cagguggccacuccag

SEQ ID NO: 1689009 - RNA, 19 nt, Human
cagguggccacuccagacc

SEQ ID NO: 1689010 - RNA, 21 nt, Human
cagguggccacuccagacccc

SEQ ID NO: 1689011 - RNA, 21 nt, Human
caggugagaagcagaggaagg

SEQ ID NO: 1689012 - RNA, 13 nt, Human
caggugagaagca

SEQ ID NO: 1689013 - RNA, 20 nt, Human
caggugagaagcagaggaag

SEQ ID NO: 1689014 - RNA, 17 nt, Human
cagguaaucgaccugcc

SEQ ID NO: 1689015 - RNA, 18 nt, Human
cagguaaucgaccugccu

SEQ ID NO: 1689016 - RNA, 19 nt, Human
cagguaaucgaccugccuc

SEQ ID NO: 1689017 - RNA, 20 nt, Human
cagguaaucgaccugccucg

SEQ ID NO: 1689018 - RNA, 20 nt, Human
cagguaacaggcagauacag

SEQ ID NO: 1689019 - RNA, 21 nt, Human
cagguaacaggcagauacagg

SEQ ID NO: 1689020 - RNA, 11 nt, Human
caggucccuaa

SEQ ID NO: 1689021 - RNA, 12 nt, Human
caggucccuaau

SEQ ID NO: 1689022 - RNA, 13 nt, Human
caggucccuaaua

SEQ ID NO: 1689023 - RNA, 14 nt, Human
caggucccuaauaa

SEQ ID NO: 1689024 - RNA, 15 nt, Human
caggucccuaauaaa

SEQ ID NO: 1689025 - RNA, 16 nt, Human
caggucccuaauaaag

SEQ ID NO: 1689026 - RNA, 17 nt, Human
caggucccuaauaaagc

SEQ ID NO: 1689027 - RNA, 18 nt, Human
caggucccuaauaaagcu

SEQ ID NO: 1689028 - RNA, 23 nt, Human
cagccugugucuuuaaaugcugc

SEQ ID NO: 1689029 - RNA, 14 nt, Human
cagccugugucuuu

SEQ ID NO: 1689030 - RNA, 17 nt, Human
cagccuugaccauucuc

SEQ ID NO: 1689031 - RNA, 20 nt, Human
cagccuugaccauucuccac

SEQ ID NO: 1689032 - RNA, 21 nt, Human
cagccuugaccauucuccacc

SEQ ID NO: 1689033 - RNA, 22 nt, Human
cagccuugaccauucuccaccu

SEQ ID NO: 1689034 - RNA, 23 nt, Human
cagccuugaccauucuccaccug

SEQ ID NO: 1689035 - RNA, 24 nt, Human
cagccuugaccauucuccaccugc

SEQ ID NO: 1689036 - RNA, 16 nt, Human
cagccugggcaaugug

SEQ ID NO: 1689037 - RNA, 19 nt, Human
cagccugggcaaugugaua

SEQ ID NO: 1689038 - RNA, 13 nt, Human
cagccuggcacag

SEQ ID NO: 1689039 - RNA, 20 nt, Human
cagccuggcacagggcagug

SEQ ID NO: 1689040 - RNA, 21 nt, Human
cagccuggcacagggcagugg

SEQ ID NO: 1689041 - RNA, 10 nt, Human
cagccuggca

SEQ ID NO: 1689042 - RNA, 15 nt, Human
cagccuggacccugu

SEQ ID NO: 1689043 - RNA, 19 nt, Human
cagccuggacccuguggau

SEQ ID NO: 1689044 - RNA, 15 nt, Human
cagccuccugaguag

SEQ ID NO: 1689045 - RNA, 20 nt, Human
cagccugcuccagcuguuca

SEQ ID NO: 1689046 - RNA, 23 nt, Human
cagccucccgaauagcugggacu

SEQ ID NO: 1689047 - RNA, 19 nt, Human
cagccucccgaguagcugg

SEQ ID NO: 1689048 - RNA, 20 nt, Human
cagccucccgaguagcuggg

SEQ ID NO: 1689049 - RNA, 21 nt, Human
cagccucccgaguagcuggga

SEQ ID NO: 1689050 - RNA, 22 nt, Human
cagccucccgaguagcugggac

SEQ ID NO: 1689051 - RNA, 23 nt, Human
cagccucccgaguagcugggacu

SEQ ID NO: 1689052 - RNA, 21 nt, Human
cagccucccuauuuuuuuucu

SEQ ID NO: 1689053 - RNA, 21 nt, Human
cagcucacugcaaccuucgcc

SEQ ID NO: 1689054 - RNA, 15 nt, Human
cagcucacugcaacc

SEQ ID NO: 1689055 - RNA, 12 nt, Human
cagcucagagag

SEQ ID NO: 1689056 - RNA, 12 nt, Human
cagcucacugca

SEQ ID NO: 1689057 - RNA, 14 nt, Human
cagcucacugcaac

SEQ ID NO: 1689058 - RNA, 19 nt, Human
cagcucaccucucccuugg

SEQ ID NO: 1689059 - RNA, 20 nt, Human
cagcucaccucucccuugga

SEQ ID NO: 1689060 - RNA, 22 nt, Human
cagcucaccagccccagugccc

SEQ ID NO: 1689061 - RNA, 20 nt, Human
cagcucaccagccccagugc

SEQ ID NO: 1689062 - RNA, 21 nt, Human
cagcucaccagccccagugcc

SEQ ID NO: 1689063 - RNA, 13 nt, Human
cagcucaccucuc

SEQ ID NO: 1689064 - RNA, 15 nt, Human
cagcucaccucuccc

SEQ ID NO: 1689065 - RNA, 16 nt, Human
cagcucaccucucccu

SEQ ID NO: 1689066 - RNA, 17 nt, Human
cagcucaccucucccuu

SEQ ID NO: 1689067 - RNA, 13 nt, Human
cagcucaccagcc

SEQ ID NO: 1689068 - RNA, 15 nt, Human
cagcucaccagcccc

SEQ ID NO: 1689069 - RNA, 16 nt, Human
cagcucaccagcccca

SEQ ID NO: 1689070 - RNA, 17 nt, Human
cagcucaccagccccag

SEQ ID NO: 1689071 - RNA, 19 nt, Human
cagcucaccagccccagug

SEQ ID NO: 1689072 - RNA, 21 nt, Human
cagcgagcccugguggcagug

SEQ ID NO: 1689073 - RNA, 19 nt, Human
cagcuaacauggaaguacu

SEQ ID NO: 1689074 - RNA, 18 nt, Human
cagcuaacauggaaguac

SEQ ID NO: 1689075 - RNA, 13 nt, Human
cagcgagcccugg

SEQ ID NO: 1689076 - RNA, 16 nt, Human
cagcgagcccuggugg

SEQ ID NO: 1689077 - RNA, 17 nt, Human
cagcgagcccugguggc

SEQ ID NO: 1689078 - RNA, 19 nt, Human
cagcgagcccugguggcag

SEQ ID NO: 1689079 - RNA, 20 nt, Human
cagcgagcccugguggcagu

SEQ ID NO: 1689080 - RNA, 20 nt, Human
cagcuaacauggaaguacua

SEQ ID NO: 1689081 - RNA, 19 nt, Human
cagcuaaucagcauucuca

SEQ ID NO: 1689082 - RNA, 15 nt, Human
cagcuaaugggacac

SEQ ID NO: 1689083 - RNA, 16 nt, Human
cagcuaaugggacacu

SEQ ID NO: 1689084 - RNA, 19 nt, Human
cagcuacuugggaggcuga

SEQ ID NO: 1689085 - RNA, 21 nt, Human
cagcccgggcucugccuccca

SEQ ID NO: 1689086 - RNA, 22 nt, Human
cagcccgggcucugccucccau

SEQ ID NO: 1689087 - RNA, 17 nt, Human
cagcccgggcucugccu

SEQ ID NO: 1689088 - RNA, 18 nt, Human
cagcccgggcucugccuc

SEQ ID NO: 1689089 - RNA, 19 nt, Human
cagcccgggcucugccucc

SEQ ID NO: 1689090 - RNA, 20 nt, Human
cagcccgggcucugccuccc

SEQ ID NO: 1689091 - RNA, 13 nt, Human
cagcccucccugc

SEQ ID NO: 1689092 - RNA, 15 nt, Human
cagcccucccugccc

SEQ ID NO: 1689093 - RNA, 23 nt, Human
cagcccuccaucuaaacugcccc

SEQ ID NO: 1689094 - RNA, 22 nt, Human
cagcccuccaucuaaacugccc

SEQ ID NO: 1689095 - RNA, 24 nt, Human
cagccccuucugacccaugcugcc

SEQ ID NO: 1689096 - RNA, 22 nt, Human
cagccccuucugacccaugcug

SEQ ID NO: 1689097 - RNA, 23 nt, Human
cagccccuucugacccaugcugc

SEQ ID NO: 1689098 - RNA, 16 nt, Human
cagccccuucugaccc

SEQ ID NO: 1689099 - RNA, 17 nt, Human
cagccccuucugaccca

SEQ ID NO: 1689100 - RNA, 19 nt, Human
cagccccuucugacccaug

SEQ ID NO: 1689101 - RNA, 21 nt, Human
cagccccuucugacccaugcu

SEQ ID NO: 1689102 - RNA, 13 nt, Human
cagcccgggcucu

SEQ ID NO: 1689103 - RNA, 14 nt, Human
cagcccgggcucug

SEQ ID NO: 1689104 - RNA, 15 nt, Human
cagcccgggcucugc

SEQ ID NO: 1689105 - RNA, 16 nt, Human
cagcccgggcucugcc

SEQ ID NO: 1689106 - RNA, 13 nt, Human
cagccccagugcc

SEQ ID NO: 1689107 - RNA, 14 nt, Human
cagccccagugccc

SEQ ID NO: 1689108 - RNA, 15 nt, Human
cagccccagugccca

SEQ ID NO: 1689109 - RNA, 16 nt, Human
cagccccagugcccac

SEQ ID NO: 1689110 - RNA, 17 nt, Human
cagccccagugcccaca

SEQ ID NO: 1689111 - RNA, 18 nt, Human
cagccccagugcccacag

SEQ ID NO: 1689112 - RNA, 11 nt, Human
cagccccaucc

SEQ ID NO: 1689113 - RNA, 21 nt, Human
cagccccaucccaaacccuuc

SEQ ID NO: 1689114 - RNA, 20 nt, Human
cagccccuguucuggcagag

SEQ ID NO: 1689115 - RNA, 21 nt, Human
cagccccuguucuggcagagu

SEQ ID NO: 1689116 - RNA, 16 nt, Human
cagccccauucugccu

SEQ ID NO: 1689117 - RNA, 17 nt, Human
cagccccauucugccug

SEQ ID NO: 1689118 - RNA, 18 nt, Human
cagccccauucugccugc

SEQ ID NO: 1689119 - RNA, 23 nt, Human
cagccccuggaugcagccucaca

SEQ ID NO: 1689120 - RNA, 22 nt, Human
cagccccaucccaaacccuuca

SEQ ID NO: 1689121 - RNA, 12 nt, Human
cagccccauccu

SEQ ID NO: 1689122 - RNA, 13 nt, Human
cagccccauccuc

SEQ ID NO: 1689123 - RNA, 14 nt, Human
cagccccauccucu

SEQ ID NO: 1689124 - RNA, 16 nt, Human
cagccccauccucugu

SEQ ID NO: 1689125 - RNA, 22 nt, Human
cagccccauccucuguacagag

SEQ ID NO: 1689126 - RNA, 13 nt, Human
cagccccauucug

SEQ ID NO: 1689127 - RNA, 14 nt, Human
cagccccauucugc

SEQ ID NO: 1689128 - RNA, 16 nt, Human
cagcccucccugcccc

SEQ ID NO: 1689129 - RNA, 17 nt, Human
cagcccucccugccccu

SEQ ID NO: 1689130 - RNA, 18 nt, Human
cagcccucccugccccuc

SEQ ID NO: 1689131 - RNA, 22 nt, Human
cagcccucccugccccucccuu

SEQ ID NO: 1689132 - RNA, 18 nt, Human
cagcccugcagagggcac

SEQ ID NO: 1689133 - RNA, 20 nt, Human
cagcccugcagagggcacag

SEQ ID NO: 1689134 - RNA, 13 nt, Human
cagcccugcagag

SEQ ID NO: 1689135 - RNA, 14 nt, Human
cagcccugcagagg

SEQ ID NO: 1689136 - RNA, 15 nt, Human
cagcccugcagaggg

SEQ ID NO: 1689137 - RNA, 16 nt, Human
cagcccugcagagggc

SEQ ID NO: 1689138 - RNA, 11 nt, Human
cagcccugcuu

SEQ ID NO: 1689139 - RNA, 13 nt, Human
cagcccugcuuug

SEQ ID NO: 1689140 - RNA, 19 nt, Human
cagcccugcuuugggcugc

SEQ ID NO: 1689141 - RNA, 20 nt, Human
cagcccugcuuugggcugcc

SEQ ID NO: 1689142 - RNA, 21 nt, Human
cagcccugcuuugggcugccc

SEQ ID NO: 1689143 - RNA, 22 nt, Human
cagcccugcuuugggcugcccu

SEQ ID NO: 1689144 - RNA, 23 nt, Human
cagcccugcuuugggcugcccug

SEQ ID NO: 1689145 - RNA, 9 nt, Human
cagccgugc

SEQ ID NO: 1689146 - RNA, 14 nt, Human
cagccgugccuuca

SEQ ID NO: 1689147 - RNA, 16 nt, Human
cagccgugccuucagc

SEQ ID NO: 1689148 - RNA, 18 nt, Human
cagccgugccuucagcuc

SEQ ID NO: 1689149 - RNA, 20 nt, Human
cagccgugccuucagcucua

SEQ ID NO: 1689150 - RNA, 21 nt, Human
cagccguguaaccauggaccc

SEQ ID NO: 1689151 - RNA, 15 nt, Human
cagccuccaugcugc

SEQ ID NO: 1689152 - RNA, 17 nt, Human
cagccuccaugcugccu

SEQ ID NO: 1689153 - RNA, 20 nt, Human
cagccuccaugcugccucca

SEQ ID NO: 1689154 - RNA, 14 nt, Human
cagccuccaugcug

SEQ ID NO: 1689155 - RNA, 19 nt, Human
cagccucccaaagugcugg

SEQ ID NO: 1689156 - RNA, 20 nt, Human
cagccucccaaagugcuggg

SEQ ID NO: 1689157 - RNA, 21 nt, Human
cagccucccaaagugcuggga

SEQ ID NO: 1689158 - RNA, 23 nt, Human
cagccucccaaagugcugggauu

SEQ ID NO: 1689159 - RNA, 20 nt, Human
cagccucccgaauagcuggg

SEQ ID NO: 1689160 - RNA, 21 nt, Human
cagccucccgaauagcuggga

SEQ ID NO: 1689161 - RNA, 22 nt, Human
cagccucccgaauagcugggac

SEQ ID NO: 1689162 - RNA, 14 nt, Human
cagccuccaagcuc

SEQ ID NO: 1689163 - RNA, 20 nt, Human
cagccuccaagcuccaucuc

SEQ ID NO: 1689164 - RNA, 14 nt, Human
cagccucacagucc

SEQ ID NO: 1689165 - RNA, 15 nt, Human
cagccucacaguccu

SEQ ID NO: 1689166 - RNA, 20 nt, Human
cagccucacaguccuuacca

SEQ ID NO: 1689167 - RNA, 19 nt, Human
cagccucaaccuccugggc

SEQ ID NO: 1689168 - RNA, 20 nt, Human
cagccucaaccuccugggcu

SEQ ID NO: 1689169 - RNA, 21 nt, Human
cagccucaaccuccugggcua

SEQ ID NO: 1689170 - RNA, 17 nt, Human
cagccucaaccuccugg

SEQ ID NO: 1689171 - RNA, 18 nt, Human
cagccucaaccuccuggg

SEQ ID NO: 1689172 - RNA, 16 nt, Human
cagccuaguugaucag

SEQ ID NO: 1689173 - RNA, 22 nt, Human
caggaagcucagggccuggcuc

SEQ ID NO: 1689174 - RNA, 10 nt, Human
cagcucuggu

SEQ ID NO: 1689175 - RNA, 13 nt, Human
cagcucuggucca

SEQ ID NO: 1689176 - RNA, 16 nt, Human
cagcucugguccauag

SEQ ID NO: 1689177 - RNA, 17 nt, Human
cagcucugguccauaga

SEQ ID NO: 1689178 - RNA, 18 nt, Human
cagcucugguccauagag

SEQ ID NO: 1689179 - RNA, 21 nt, Human
cagcucugguccauagagagc

SEQ ID NO: 1689180 - RNA, 22 nt, Human
cagcucugguccauagagagca

SEQ ID NO: 1689181 - RNA, 23 nt, Human
cagcucugguccauagagagcaa

SEQ ID NO: 1689182 - RNA, 12 nt, Human
cagcucuguccu

SEQ ID NO: 1689183 - RNA, 13 nt, Human
cagcucuguccug

SEQ ID NO: 1689184 - RNA, 14 nt, Human
cagcucuguccugg

SEQ ID NO: 1689185 - RNA, 16 nt, Human
cagcucuguccuggga

SEQ ID NO: 1689186 - RNA, 17 nt, Human
cagcucuguccugggag

SEQ ID NO: 1689187 - RNA, 18 nt, Human
cagcucuguccugggagu

SEQ ID NO: 1689188 - RNA, 23 nt, Human
cagcucuguccugggagugagcu

SEQ ID NO: 1689189 - RNA, 10 nt, Human
cagcucuuau

SEQ ID NO: 1689190 - RNA, 21 nt, Human
cagcucuuauauugccauuuc

SEQ ID NO: 1689191 - RNA, 13 nt, Human
cagcucuucucca

SEQ ID NO: 1689192 - RNA, 14 nt, Human
cagcucuucuccag

SEQ ID NO: 1689193 - RNA, 15 nt, Human
cagcucuucuccagg

SEQ ID NO: 1689194 - RNA, 16 nt, Human
cagcucuucuccaggc

SEQ ID NO: 1689195 - RNA, 17 nt, Human
cagcucuucuccaggcu

SEQ ID NO: 1689196 - RNA, 18 nt, Human
cagcucuucuccaggcug

SEQ ID NO: 1689197 - RNA, 19 nt, Human
cagcucuucuccaggcugu

SEQ ID NO: 1689198 - RNA, 23 nt, Human
cagcucuucuccaggcuguaucc

SEQ ID NO: 1689199 - RNA, 13 nt, Human
cagcucagagagg

SEQ ID NO: 1689200 - RNA, 17 nt, Human
cagcucagagagggugg

SEQ ID NO: 1689201 - RNA, 19 nt, Human
cagcucagagaggguggga

SEQ ID NO: 1689202 - RNA, 20 nt, Human
cagcucagagagggugggag

SEQ ID NO: 1689203 - RNA, 16 nt, Human
cagcuccuucuguccu

SEQ ID NO: 1689204 - RNA, 17 nt, Human
cagcuccuucuguccua

SEQ ID NO: 1689205 - RNA, 21 nt, Human
cagcuccuucuguccuacucu

SEQ ID NO: 1689206 - RNA, 23 nt, Human
cagcuccuucuguccuacucugu

SEQ ID NO: 1689207 - RNA, 15 nt, Human
cagcucugcaagaau

SEQ ID NO: 1689208 - RNA, 16 nt, Human
cagcucugcaagaauu

SEQ ID NO: 1689209 - RNA, 21 nt, Human
cagcucugcaagaauugaagc

SEQ ID NO: 1689210 - RNA, 20 nt, Human
cagcucugcauacucauuag

SEQ ID NO: 1689211 - RNA, 23 nt, Human
cagcugggaucacauguggacuu

SEQ ID NO: 1689212 - RNA, 18 nt, Human
cagcuggggccaggcugg

SEQ ID NO: 1689213 - RNA, 19 nt, Human
cagcuggggccaggcuggg

SEQ ID NO: 1689214 - RNA, 20 nt, Human
cagcuggggccaggcugggu

SEQ ID NO: 1689215 - RNA, 19 nt, Human
cagcuggccgggagccuga

SEQ ID NO: 1689216 - RNA, 23 nt, Human
cagcugcuuuugucuaugggacu

SEQ ID NO: 1689217 - RNA, 22 nt, Human
cagcugcuuuugucuaugggac

SEQ ID NO: 1689218 - RNA, 21 nt, Human
cagcuggggccaggcuggguc

SEQ ID NO: 1689219 - RNA, 22 nt, Human
cagcuggggccaggcugggucg

SEQ ID NO: 1689220 - RNA, 21 nt, Human
cagcugggguggggaccucag

SEQ ID NO: 1689221 - RNA, 22 nt, Human
cagcugggguggggaccucagg

SEQ ID NO: 1689222 - RNA, 23 nt, Human
cagcugggguggggaccucaggc

SEQ ID NO: 1689223 - RNA, 19 nt, Human
cagcuggugcccugcuuuc

SEQ ID NO: 1689224 - RNA, 20 nt, Human
cagcuggugcccugcuuuca

SEQ ID NO: 1689225 - RNA, 21 nt, Human
cagcuggugcccugcuuucag

SEQ ID NO: 1689226 - RNA, 23 nt, Human
cagcuggugcccugcuuucagau

SEQ ID NO: 1689227 - RNA, 18 nt, Human
cagcuggugcccugcuuu

SEQ ID NO: 1689228 - RNA, 17 nt, Human
cagcuggguuggaaaac

SEQ ID NO: 1689229 - RNA, 16 nt, Human
cagcuggguuggaaaa

SEQ ID NO: 1689230 - RNA, 18 nt, Human
cagcugguugagguuuca

SEQ ID NO: 1689231 - RNA, 18 nt, Human
cagcuguaugauucccag

SEQ ID NO: 1689232 - RNA, 18 nt, Human
cagcugccugggaucccu

SEQ ID NO: 1689233 - RNA, 23 nt, Human
cagcugccugggaucccucaucc

SEQ ID NO: 1689234 - RNA, 18 nt, Human
cagcugcgguccacccag

SEQ ID NO: 1689235 - RNA, 19 nt, Human
cagcugcgguccacccagg

SEQ ID NO: 1689236 - RNA, 20 nt, Human
cagcugcgguccacccagga

SEQ ID NO: 1689237 - RNA, 21 nt, Human
cagcugcgguccacccaggag

SEQ ID NO: 1689238 - RNA, 22 nt, Human
cagcugcgguccacccaggagc

SEQ ID NO: 1689239 - RNA, 23 nt, Human
cagcugcgguccacccaggagcc

SEQ ID NO: 1689240 - RNA, 24 nt, Human
cagcugcgguccacccaggagccc

SEQ ID NO: 1689241 - RNA, 13 nt, Human
cagcugcuugggc

SEQ ID NO: 1689242 - RNA, 14 nt, Human
cagcugcuugggcu

SEQ ID NO: 1689243 - RNA, 15 nt, Human
cagcugcuugggcuu

SEQ ID NO: 1689244 - RNA, 16 nt, Human
cagcugcuugggcuuc

SEQ ID NO: 1689245 - RNA, 18 nt, Human
cagcugcuugggcuucau

SEQ ID NO: 1689246 - RNA, 19 nt, Human
cagcugcuugggcuucauc

SEQ ID NO: 1689247 - RNA, 21 nt, Human
cagcugcuugggcuucauccu

SEQ ID NO: 1689248 - RNA, 22 nt, Human
cagcugcuugggcuucauccuc

SEQ ID NO: 1689249 - RNA, 21 nt, Human
cagcugcucaauaaaguacaa

SEQ ID NO: 1689250 - RNA, 17 nt, Human
cagcugcuacuacuccu

SEQ ID NO: 1689251 - RNA, 20 nt, Human
cagcugcugaaacaacaaau

SEQ ID NO: 1689252 - RNA, 21 nt, Human
cagcugcugaaacaacaaaua

SEQ ID NO: 1689253 - RNA, 18 nt, Human
cagcuugaggguugggcu

SEQ ID NO: 1689254 - RNA, 19 nt, Human
cagcuugaggguugggcug

SEQ ID NO: 1689255 - RNA, 20 nt, Human
cagcuugaggguugggcugg

SEQ ID NO: 1689256 - RNA, 21 nt, Human
cagcuugaggguugggcuggu

SEQ ID NO: 1689257 - RNA, 14 nt, Human
cagcuugaggguug

SEQ ID NO: 1689258 - RNA, 15 nt, Human
cagcuugaggguugg

SEQ ID NO: 1689259 - RNA, 18 nt, Human
cagcuugaccgugaggcc

SEQ ID NO: 1689260 - RNA, 19 nt, Human
cagcuugaccgugaggcca

SEQ ID NO: 1689261 - RNA, 20 nt, Human
cagcuugaccgugaggccag

SEQ ID NO: 1689262 - RNA, 21 nt, Human
cagcuugaccgugaggccaga

SEQ ID NO: 1689263 - RNA, 20 nt, Human
cagcuucauuuccugugucu

SEQ ID NO: 1689264 - RNA, 21 nt, Human
cagcuucauuuccugugucuu

SEQ ID NO: 1689265 - RNA, 19 nt, Human
cagcuguaugauucccagc

SEQ ID NO: 1689266 - RNA, 18 nt, Human
cagcuugaaacugagaug

SEQ ID NO: 1689267 - RNA, 14 nt, Human
cagcuuugauauuu

SEQ ID NO: 1689268 - RNA, 12 nt, Human
cagcuuuguuug

SEQ ID NO: 1689269 - RNA, 21 nt, Human
cagcuuuguuuguugucagcu

SEQ ID NO: 1689270 - RNA, 22 nt, Human
cagcuuuguuuguugucagcug

SEQ ID NO: 1689271 - RNA, 23 nt, Human
cagcuuuguuuguugucagcuga

SEQ ID NO: 1689272 - RNA, 18 nt, Human
caggaaccacaagacugc

SEQ ID NO: 1689273 - RNA, 21 nt, Human
cagcuuguaaauagcucaggu

SEQ ID NO: 1689274 - RNA, 22 nt, Human
cagcuuguaaauagcucaggug

SEQ ID NO: 1689275 - RNA, 18 nt, Human
cagcuuguaaauagcuca

SEQ ID NO: 1689276 - RNA, 19 nt, Human
cagcuuguaaauagcucag

SEQ ID NO: 1689277 - RNA, 20 nt, Human
cagcuuguaaauagcucagg

SEQ ID NO: 1689278 - RNA, 22 nt, Human
cagcuuuaaaaaauuaaucugg

SEQ ID NO: 1689279 - RNA, 23 nt, Human
cagcuuuccccaugucucgacuc

SEQ ID NO: 1689280 - RNA, 23 nt, Human
cagcuuuccucaaaacuucagac

SEQ ID NO: 1689281 - RNA, 14 nt, Human
caggaagcagcuuu

SEQ ID NO: 1689282 - RNA, 22 nt, Human
caggaagccagcaggcucucag

SEQ ID NO: 1689283 - RNA, 19 nt, Human
caggaagccagcaggcucu

SEQ ID NO: 1689284 - RNA, 21 nt, Human
caggaagccagcaggcucuca

SEQ ID NO: 1689285 - RNA, 14 nt, Human
caggaagccagcag

SEQ ID NO: 1689286 - RNA, 16 nt, Human
caggaagccagcaggc

SEQ ID NO: 1689287 - RNA, 17 nt, Human
caggaagccagcaggcu

SEQ ID NO: 1689288 - RNA, 18 nt, Human
caggaagccagcaggcuc

SEQ ID NO: 1689289 - RNA, 23 nt, Human
caggaagcucagggccuggcuca

SEQ ID NO: 1689290 - RNA, 20 nt, Human
caggaagcucagggccuggc

SEQ ID NO: 1689291 - RNA, 21 nt, Human
caggaagcucagggccuggcu

SEQ ID NO: 1689292 - RNA, 13 nt, Human
caggaagcucagg

SEQ ID NO: 1689293 - RNA, 14 nt, Human
caggaagcucaggg

SEQ ID NO: 1689294 - RNA, 15 nt, Human
caggaagcucagggc

SEQ ID NO: 1689295 - RNA, 16 nt, Human
caggaagcucagggcc

SEQ ID NO: 1689296 - RNA, 17 nt, Human
caggaagcucagggccu

SEQ ID NO: 1689297 - RNA, 18 nt, Human
caggaagcucagggccug

SEQ ID NO: 1689298 - RNA, 19 nt, Human
caggaagcucagggccugg

SEQ ID NO: 1689299 - RNA, 17 nt, Human
caggaauggagccugca

SEQ ID NO: 1689300 - RNA, 23 nt, Human
caggaauggagccugcacgguga

SEQ ID NO: 1689301 - RNA, 12 nt, Human
caggaaguacug

SEQ ID NO: 1689302 - RNA, 14 nt, Human
caggaaguacugga

SEQ ID NO: 1689303 - RNA, 16 nt, Human
caggaaguacuggaga

SEQ ID NO: 1689304 - RNA, 19 nt, Human
caggaaggcugagaggaga

SEQ ID NO: 1689305 - RNA, 15 nt, Human
caggaaggcuaaagg

SEQ ID NO: 1689306 - RNA, 16 nt, Human
caggaaguagaggagg

SEQ ID NO: 1689307 - RNA, 17 nt, Human
caggaaguacuggagaa

SEQ ID NO: 1689308 - RNA, 18 nt, Human
caggaaguacuggagaaa

SEQ ID NO: 1689309 - RNA, 20 nt, Human
caggaaguacuggagaaaau

SEQ ID NO: 1689310 - RNA, 15 nt, Human
caggaaguagaggag

SEQ ID NO: 1689311 - RNA, 18 nt, Human
cagccuccaugcugccuc

SEQ ID NO: 1689312 - RNA, 14 nt, Human
cagcucaccagccc

SEQ ID NO: 1689313 - RNA, 19 nt, Human
cagcccacauagugauggu

SEQ ID NO: 1689314 - RNA, 15 nt, Human
cagcccaccccucaa

SEQ ID NO: 1689315 - RNA, 15 nt, Human
cagcccacuucugcc

SEQ ID NO: 1689316 - RNA, 22 nt, Human
cagccccaaaacucuccucugc

SEQ ID NO: 1689317 - RNA, 20 nt, Human
cagccccaaaacucuccucu

SEQ ID NO: 1689318 - RNA, 21 nt, Human
cagccccaaaacucuccucug

SEQ ID NO: 1689319 - RNA, 18 nt, Human
cagcccacuucugccaua

SEQ ID NO: 1689320 - RNA, 23 nt, Human
cagccacggccaggccagaggga

SEQ ID NO: 1689321 - RNA, 22 nt, Human
cagccaguaaaugggggugcau

SEQ ID NO: 1689322 - RNA, 14 nt, Human
cagccacggccagg

SEQ ID NO: 1689323 - RNA, 15 nt, Human
cagccacggccaggc

SEQ ID NO: 1689324 - RNA, 16 nt, Human
cagccacggccaggcc

SEQ ID NO: 1689325 - RNA, 17 nt, Human
cagccacggccaggcca

SEQ ID NO: 1689326 - RNA, 18 nt, Human
cagccacggccaggccag

SEQ ID NO: 1689327 - RNA, 19 nt, Human
cagccacggccaggccaga

SEQ ID NO: 1689328 - RNA, 21 nt, Human
cagccacggccaggccagagg

SEQ ID NO: 1689329 - RNA, 22 nt, Human
cagccacggccaggccagaggg

SEQ ID NO: 1689330 - RNA, 14 nt, Human
cagccacauuccug

SEQ ID NO: 1689331 - RNA, 19 nt, Human
cagccacauuccugaugcu

SEQ ID NO: 1689332 - RNA, 15 nt, Human
cagccacauuccuga

SEQ ID NO: 1689333 - RNA, 17 nt, Human
cagccacauuccugaug

SEQ ID NO: 1689334 - RNA, 20 nt, Human
cagcagggagggcuucugcc

SEQ ID NO: 1689335 - RNA, 14 nt, Human
cagcauccuggcac

SEQ ID NO: 1689336 - RNA, 15 nt, Human
cagcauccuggcacc

SEQ ID NO: 1689337 - RNA, 16 nt, Human
cagcauccuggcaccc

SEQ ID NO: 1689338 - RNA, 17 nt, Human
cagcauccuggcacccg

SEQ ID NO: 1689339 - RNA, 16 nt, Human
cagcaggcucucaggc

SEQ ID NO: 1689340 - RNA, 17 nt, Human
cagcaggcucucaggcc

SEQ ID NO: 1689341 - RNA, 18 nt, Human
cagcaggcucucaggcca

SEQ ID NO: 1689342 - RNA, 19 nt, Human
cagcaggcucucaggccag

SEQ ID NO: 1689343 - RNA, 20 nt, Human
cagcaggcucucaggccagc

SEQ ID NO: 1689344 - RNA, 22 nt, Human
cagcaggcucucaggccagcug

SEQ ID NO: 1689345 - RNA, 18 nt, Human
cagcagggagggcuucug

SEQ ID NO: 1689346 - RNA, 19 nt, Human
cagcagccuggacccugug

SEQ ID NO: 1689347 - RNA, 22 nt, Human
cagcagccuggacccuguggau

SEQ ID NO: 1689348 - RNA, 12 nt, Human
cagcagccugga

SEQ ID NO: 1689349 - RNA, 14 nt, Human
cagcagccuggacc

SEQ ID NO: 1689350 - RNA, 15 nt, Human
cagcagccuggaccc

SEQ ID NO: 1689351 - RNA, 18 nt, Human
cagcagccuggacccugu

SEQ ID NO: 1689352 - RNA, 12 nt, Human
cagcaggcucuc

SEQ ID NO: 1689353 - RNA, 14 nt, Human
cagcaggcucucag

SEQ ID NO: 1689354 - RNA, 15 nt, Human
cagcaggcucucagg

SEQ ID NO: 1689355 - RNA, 18 nt, Human
cagccaacuauggccugu

SEQ ID NO: 1689356 - RNA, 18 nt, Human
cagccaaagccuccucca

SEQ ID NO: 1689357 - RNA, 21 nt, Human
cagccaaagccuccuccagcc

SEQ ID NO: 1689358 - RNA, 15 nt, Human
cagccaaagccuccu

SEQ ID NO: 1689359 - RNA, 16 nt, Human
cagccaaagccuccuc

SEQ ID NO: 1689360 - RNA, 21 nt, Human
cagcauccuggcacccggccc

SEQ ID NO: 1689361 - RNA, 19 nt, Human
cagcauccuggcacccggc

SEQ ID NO: 1689362 - RNA, 20 nt, Human
cagcauccuggcacccggcc

SEQ ID NO: 1689363 - RNA, 15 nt, Human
cagcauucucacucc

SEQ ID NO: 1689364 - RNA, 14 nt, Human
cagcauucucacuc

SEQ ID NO: 1689365 - RNA, 13 nt, Human
cagcagccccugc

SEQ ID NO: 1689366 - RNA, 16 nt, Human
cagcagccccugcaca

SEQ ID NO: 1689367 - RNA, 23 nt, Human
cagcagccccugcacaaagcccu

SEQ ID NO: 1689368 - RNA, 14 nt, Human
cagcagauuauuca

SEQ ID NO: 1689369 - RNA, 15 nt, Human
cagcagauuauucac

SEQ ID NO: 1689370 - RNA, 19 nt, Human
cagcagauuauucacugau

SEQ ID NO: 1689371 - RNA, 17 nt, Human
cagcagaaaugccuuac

SEQ ID NO: 1689372 - RNA, 15 nt, Human
cagcagaaaugccuu

SEQ ID NO: 1689373 - RNA, 11 nt, Human
cagcagagcac

SEQ ID NO: 1689374 - RNA, 13 nt, Human
cagcagagcaccu

SEQ ID NO: 1689375 - RNA, 22 nt, Human
cagcagaaaugccuuacccuca

SEQ ID NO: 1689376 - RNA, 19 nt, Human
cagcagaaaugccuuaccc

SEQ ID NO: 1689377 - RNA, 15 nt, Human
cagcaauucuccugc

SEQ ID NO: 1689378 - RNA, 16 nt, Human
cagcaauucuccugcc

SEQ ID NO: 1689379 - RNA, 17 nt, Human
cagcaauucuccugccu

SEQ ID NO: 1689380 - RNA, 18 nt, Human
cagcaauucuccugccuc

SEQ ID NO: 1689381 - RNA, 19 nt, Human
cagcaauucuccugccuca

SEQ ID NO: 1689382 - RNA, 20 nt, Human
cagcaauucuccugccucag

SEQ ID NO: 1689383 - RNA, 22 nt, Human
cagcaauaaagcagcguuucua

SEQ ID NO: 1689384 - RNA, 21 nt, Human
cagcaauaaagcagcguuucu

SEQ ID NO: 1689385 - RNA, 13 nt, Human
cagcaauaaagca

SEQ ID NO: 1689386 - RNA, 19 nt, Human
cagcaagugagagcugggu

SEQ ID NO: 1689387 - RNA, 21 nt, Human
cagcaagugagagcugggugu

SEQ ID NO: 1689388 - RNA, 14 nt, Human
cagcaagugagagc

SEQ ID NO: 1689389 - RNA, 15 nt, Human
cagcaagugagagcu

SEQ ID NO: 1689390 - RNA, 16 nt, Human
cagcaagugagagcug

SEQ ID NO: 1689391 - RNA, 17 nt, Human
cagcaagugagagcugg

SEQ ID NO: 1689392 - RNA, 12 nt, Human
cagcaagugaga

SEQ ID NO: 1689393 - RNA, 22 nt, Human
cagcaagggugaugggaaagca

SEQ ID NO: 1689394 - RNA, 23 nt, Human
cagcaagggugaugggaaagcau

SEQ ID NO: 1689395 - RNA, 18 nt, Human
cagcaaggagauuuacaa

SEQ ID NO: 1689396 - RNA, 17 nt, Human
cagcaaggagauuuaca

SEQ ID NO: 1689397 - RNA, 19 nt, Human
cagcaagggugaugggaaa

SEQ ID NO: 1689398 - RNA, 18 nt, Human
cagcaaaagaugcuucuc

SEQ ID NO: 1689399 - RNA, 23 nt, Human
cagcaacgcaggcccccaggugc

SEQ ID NO: 1689400 - RNA, 13 nt, Human
cagauuuuauuau

SEQ ID NO: 1689401 - RNA, 15 nt, Human
cagauuuuauuaugu

SEQ ID NO: 1689402 - RNA, 16 nt, Human
cagauuuuauuaugua

SEQ ID NO: 1689403 - RNA, 18 nt, Human
cagauuuuauuauguaaa

SEQ ID NO: 1689404 - RNA, 20 nt, Human
cagauuuuauuauguaaauc

SEQ ID NO: 1689405 - RNA, 21 nt, Human
cagauuuuauuauguaaaucc

SEQ ID NO: 1689406 - RNA, 22 nt, Human
cagauuuuauuauguaaauccc

SEQ ID NO: 1689407 - RNA, 14 nt, Human
cagauucuuuccug

SEQ ID NO: 1689408 - RNA, 17 nt, Human
cagcaaaaauauuuuau

SEQ ID NO: 1689409 - RNA, 22 nt, Human
cagauuuuuuacagcugccugc

SEQ ID NO: 1689410 - RNA, 19 nt, Human
cagauuuuuuacagcugcc

SEQ ID NO: 1689411 - RNA, 14 nt, Human
cagauuuuccugaa

SEQ ID NO: 1689412 - RNA, 15 nt, Human
cagauuuuccugaaa

SEQ ID NO: 1689413 - RNA, 12 nt, Human
cagauuauucac

SEQ ID NO: 1689414 - RNA, 18 nt, Human
cagauuauucacugauuu

SEQ ID NO: 1689415 - RNA, 23 nt, Human
cagauuauucacugauuugacau

SEQ ID NO: 1689416 - RNA, 23 nt, Human
cagaugggugcuuggaggaagga

SEQ ID NO: 1689417 - RNA, 15 nt, Human
cagaugcugugcaaa

SEQ ID NO: 1689418 - RNA, 18 nt, Human
cagaugggugcuuggagg

SEQ ID NO: 1689419 - RNA, 16 nt, Human
cagacaacaaaccugu

SEQ ID NO: 1689420 - RNA, 13 nt, Human
cagaccccuggcu

SEQ ID NO: 1689421 - RNA, 14 nt, Human
cagaccccuggcuu

SEQ ID NO: 1689422 - RNA, 15 nt, Human
cagaccccuggcuuu

SEQ ID NO: 1689423 - RNA, 16 nt, Human
cagaccccuggcuuuu

SEQ ID NO: 1689424 - RNA, 18 nt, Human
cagaccccuggcuuuuca

SEQ ID NO: 1689425 - RNA, 14 nt, Human
cagaccacaaaacu

SEQ ID NO: 1689426 - RNA, 20 nt, Human
cagaccacaaaacuuuucua

SEQ ID NO: 1689427 - RNA, 13 nt, Human
cagacccugcccu

SEQ ID NO: 1689428 - RNA, 14 nt, Human
cagacccugcccug

SEQ ID NO: 1689429 - RNA, 16 nt, Human
cagacccggcugcgug

SEQ ID NO: 1689430 - RNA, 12 nt, Human
cagacccugccc

SEQ ID NO: 1689431 - RNA, 21 nt, Human
cagaccccuggcuuuucacug

SEQ ID NO: 1689432 - RNA, 22 nt, Human
cagaccccuggcuuuucacugc

SEQ ID NO: 1689433 - RNA, 23 nt, Human
cagaccccuggcuuuucacugcu

SEQ ID NO: 1689434 - RNA, 12 nt, Human
cagacccggcug

SEQ ID NO: 1689435 - RNA, 14 nt, Human
cagacccggcugcg

SEQ ID NO: 1689436 - RNA, 22 nt, Human
cagacccugcccugugggcccc

SEQ ID NO: 1689437 - RNA, 15 nt, Human
cagacccugcccugu

SEQ ID NO: 1689438 - RNA, 16 nt, Human
cagacccugcccugug

SEQ ID NO: 1689439 - RNA, 17 nt, Human
cagacccugcccugugg

SEQ ID NO: 1689440 - RNA, 21 nt, Human
cagacccugcccugugggccc

SEQ ID NO: 1689441 - RNA, 20 nt, Human
cagacuuuuuuuaaauagua

SEQ ID NO: 1689442 - RNA, 19 nt, Human
cagagaaaguacuucucca

SEQ ID NO: 1689443 - RNA, 23 nt, Human
cagagaaaguacuucuccacccu

SEQ ID NO: 1689444 - RNA, 15 nt, Human
cagaaucucgcucug

SEQ ID NO: 1689445 - RNA, 14 nt, Human
cagaauuucccaaa

SEQ ID NO: 1689446 - RNA, 11 nt, Human
cagaauucuca

SEQ ID NO: 1689447 - RNA, 18 nt, Human
cagaauucucuaguuuga

SEQ ID NO: 1689448 - RNA, 15 nt, Human
cagaauucucuaguu

SEQ ID NO: 1689449 - RNA, 24 nt, Human
cagaauuucccaaagcagugcaug

SEQ ID NO: 1689450 - RNA, 12 nt, Human
cagacaaagcgu

SEQ ID NO: 1689451 - RNA, 17 nt, Human
cagaauuucccaaagca

SEQ ID NO: 1689452 - RNA, 18 nt, Human
cagaauuucccaaagcag

SEQ ID NO: 1689453 - RNA, 19 nt, Human
cagaauuucccaaagcagu

SEQ ID NO: 1689454 - RNA, 20 nt, Human
cagaauuucccaaagcagug

SEQ ID NO: 1689455 - RNA, 20 nt, Human
cagacaacaaaccuguuucu

SEQ ID NO: 1689456 - RNA, 22 nt, Human
cagacaaagcgugguggacaug

SEQ ID NO: 1689457 - RNA, 14 nt, Human
cagacacaugucca

SEQ ID NO: 1689458 - RNA, 17 nt, Human
cagacacauguccaaga

SEQ ID NO: 1689459 - RNA, 21 nt, Human
cagacacauguccaagaagcc

SEQ ID NO: 1689460 - RNA, 22 nt, Human
cagacacauguccaagaagccc

SEQ ID NO: 1689461 - RNA, 23 nt, Human
cagacacauguccaagaagccca

SEQ ID NO: 1689462 - RNA, 13 nt, Human
cagacacaggccc

SEQ ID NO: 1689463 - RNA, 14 nt, Human
cagacacaggcccg

SEQ ID NO: 1689464 - RNA, 15 nt, Human
cagacacaggcccgg

SEQ ID NO: 1689465 - RNA, 17 nt, Human
cagacacaggcccggcu

SEQ ID NO: 1689466 - RNA, 18 nt, Human
cagacacaggcccggcuc

SEQ ID NO: 1689467 - RNA, 21 nt, Human
cagacacaggcccggcuccag

SEQ ID NO: 1689468 - RNA, 22 nt, Human
cagacacaggcccggcuccagg

SEQ ID NO: 1689469 - RNA, 23 nt, Human
cagacacaggcccggcuccaggc

SEQ ID NO: 1689470 - RNA, 20 nt, Human
cagacaguuaagagaaauga

SEQ ID NO: 1689471 - RNA, 19 nt, Human
cagacaccuugacagggca

SEQ ID NO: 1689472 - RNA, 20 nt, Human
cagacaccuugacagggcac

SEQ ID NO: 1689473 - RNA, 22 nt, Human
cagacaccuugacagggcacac

SEQ ID NO: 1689474 - RNA, 19 nt, Human
cagacauacuaaccagcag

SEQ ID NO: 1689475 - RNA, 17 nt, Human
cagacauagaauuaaca

SEQ ID NO: 1689476 - RNA, 19 nt, Human
cagacauagaauuaacaca

SEQ ID NO: 1689477 - RNA, 22 nt, Human
cagaacccuuggagccaaugga

SEQ ID NO: 1689478 - RNA, 21 nt, Human
cagaagacacugaugggcaac

SEQ ID NO: 1689479 - RNA, 19 nt, Human
cagaagcaacccaaauguu

SEQ ID NO: 1689480 - RNA, 20 nt, Human
cagaagcaacccaaauguuc

SEQ ID NO: 1689481 - RNA, 17 nt, Human
cagaaucucaaauaacu

SEQ ID NO: 1689482 - RNA, 18 nt, Human
cagaaucucaaauaacua

SEQ ID NO: 1689483 - RNA, 23 nt, Human
cagaaucuaacugguggacaugg

SEQ ID NO: 1689484 - RNA, 16 nt, Human
cagaaggaagacuuca

SEQ ID NO: 1689485 - RNA, 17 nt, Human
cagaaggaagacuucau

SEQ ID NO: 1689486 - RNA, 18 nt, Human
cagaaggaagacuucauc

SEQ ID NO: 1689487 - RNA, 19 nt, Human
cagaaggaagacuucaucc

SEQ ID NO: 1689488 - RNA, 18 nt, Human
cagaaggcaaaugacuuu

SEQ ID NO: 1689489 - RNA, 19 nt, Human
cagaaggcaaaugacuuug

SEQ ID NO: 1689490 - RNA, 20 nt, Human
cagaaggcaaaugacuuugg

SEQ ID NO: 1689491 - RNA, 12 nt, Human
cacuuugcauaa

SEQ ID NO: 1689492 - RNA, 22 nt, Human
cacuuucuagccagaggagaga

SEQ ID NO: 1689493 - RNA, 16 nt, Human
cacuuugggaggccaa

SEQ ID NO: 1689494 - RNA, 12 nt, Human
cacuuugggagg

SEQ ID NO: 1689495 - RNA, 13 nt, Human
cacuuugggaggc

SEQ ID NO: 1689496 - RNA, 13 nt, Human
cacuuuguucugg

SEQ ID NO: 1689497 - RNA, 14 nt, Human
cacuuuguucuggc

SEQ ID NO: 1689498 - RNA, 16 nt, Human
cacuuuguucuggcuc

SEQ ID NO: 1689499 - RNA, 23 nt, Human
cacuuuguucuggcucuuccagg

SEQ ID NO: 1689500 - RNA, 18 nt, Human
cacuuuuauuuagcacca

SEQ ID NO: 1689501 - RNA, 14 nt, Human
cacuuuuguucuug

SEQ ID NO: 1689502 - RNA, 22 nt, Human
cacuuuuguucuugguuuguaa

SEQ ID NO: 1689503 - RNA, 22 nt, Human
cacuuuugguuaagucuguuuu

SEQ ID NO: 1689504 - RNA, 14 nt, Human
cacuuuuuuccaca

SEQ ID NO: 1689505 - RNA, 12 nt, Human
cacuuuuuucca

SEQ ID NO: 1689506 - RNA, 24 nt, Human
cagaaagaaguggggacagagcag

SEQ ID NO: 1689507 - RNA, 18 nt, Human
cagaaagcagaacaguga

SEQ ID NO: 1689508 - RNA, 19 nt, Human
cagaaagcagaacagugau

SEQ ID NO: 1689509 - RNA, 23 nt, Human
cagaacagugauuaccagggacu

SEQ ID NO: 1689510 - RNA, 21 nt, Human
cagaaaagaaaguucaugcuu

SEQ ID NO: 1689511 - RNA, 17 nt, Human
cagaaaaguugaauuuu

SEQ ID NO: 1689512 - RNA, 20 nt, Human
cagaaaaguugaauuuuaca

SEQ ID NO: 1689513 - RNA, 22 nt, Human
cagaaaaguugaauuuuacaug

SEQ ID NO: 1689514 - RNA, 16 nt, Human
cagaaaauggaagaca

SEQ ID NO: 1689515 - RNA, 20 nt, Human
cagaaaauggaagacagcuc

SEQ ID NO: 1689516 - RNA, 21 nt, Human
cagaaaauggaagacagcucu

SEQ ID NO: 1689517 - RNA, 22 nt, Human
cagaaaauggaagacagcucuu

SEQ ID NO: 1689518 - RNA, 23 nt, Human
cagaaaauggaagacagcucuua

SEQ ID NO: 1689519 - RNA, 16 nt, Human
cagaggccaugggccu

SEQ ID NO: 1689520 - RNA, 22 nt, Human
cagagccaccccuaaagagaua

SEQ ID NO: 1689521 - RNA, 15 nt, Human
cagagcccaccuugg

SEQ ID NO: 1689522 - RNA, 17 nt, Human
cagagcccaccuuggcu

SEQ ID NO: 1689523 - RNA, 19 nt, Human
cagagcccaccuuggcuca

SEQ ID NO: 1689524 - RNA, 20 nt, Human
cagagcccaccuuggcucaa

SEQ ID NO: 1689525 - RNA, 16 nt, Human
cagagcccacgccccc

SEQ ID NO: 1689526 - RNA, 23 nt, Human
cagagcaccuuagacagucccug

SEQ ID NO: 1689527 - RNA, 11 nt, Human
cagagcagaga

SEQ ID NO: 1689528 - RNA, 12 nt, Human
cagagcagagac

SEQ ID NO: 1689529 - RNA, 18 nt, Human
cagagcaccuuagacagu

SEQ ID NO: 1689530 - RNA, 19 nt, Human
cagagcaccuuagacaguc

SEQ ID NO: 1689531 - RNA, 21 nt, Human
cagagcaccuuagacaguccc

SEQ ID NO: 1689532 - RNA, 22 nt, Human
cagagcaccuuagacagucccu

SEQ ID NO: 1689533 - RNA, 13 nt, Human
cagagcagagacc

SEQ ID NO: 1689534 - RNA, 14 nt, Human
cagagcagagacca

SEQ ID NO: 1689535 - RNA, 15 nt, Human
cagagcagagaccau

SEQ ID NO: 1689536 - RNA, 17 nt, Human
cagagcagagaccaucc

SEQ ID NO: 1689537 - RNA, 18 nt, Human
cagagcagagaccauccc

SEQ ID NO: 1689538 - RNA, 19 nt, Human
cagagcagagaccaucccu

SEQ ID NO: 1689539 - RNA, 21 nt, Human
cagagcagagaccaucccuga

SEQ ID NO: 1689540 - RNA, 12 nt, Human
cagagccugcag

SEQ ID NO: 1689541 - RNA, 13 nt, Human
cagaggaaggaga

SEQ ID NO: 1689542 - RNA, 13 nt, Human
cagagccugcagu

SEQ ID NO: 1689543 - RNA, 23 nt, Human
cagagcccacgcccccacuggug

SEQ ID NO: 1689544 - RNA, 17 nt, Human
cagagcccacgccccca

SEQ ID NO: 1689545 - RNA, 19 nt, Human
cagagcccacgcccccacu

SEQ ID NO: 1689546 - RNA, 20 nt, Human
cagagcccacgcccccacug

SEQ ID NO: 1689547 - RNA, 21 nt, Human
cagagcccacgcccccacugg

SEQ ID NO: 1689548 - RNA, 20 nt, Human
cagaggagagaggacccccu

SEQ ID NO: 1689549 - RNA, 11 nt, Human
cagaggcagcc

SEQ ID NO: 1689550 - RNA, 13 nt, Human
cagaggagagagg

SEQ ID NO: 1689551 - RNA, 15 nt, Human
cagaggagagaggac

SEQ ID NO: 1689552 - RNA, 19 nt, Human
cagaggagagaggaccccc

SEQ ID NO: 1689553 - RNA, 19 nt, Human
cagagaaugaaagggccca

SEQ ID NO: 1689554 - RNA, 20 nt, Human
cagagaaugaaagggcccag

SEQ ID NO: 1689555 - RNA, 21 nt, Human
cagagaaugaaagggcccaga

SEQ ID NO: 1689556 - RNA, 15 nt, Human
cagagaauucucuua

SEQ ID NO: 1689557 - RNA, 16 nt, Human
cagagacacaagccuu

SEQ ID NO: 1689558 - RNA, 17 nt, Human
cagagacacaagccuuc

SEQ ID NO: 1689559 - RNA, 14 nt, Human
cagagacacaagcc

SEQ ID NO: 1689560 - RNA, 15 nt, Human
cagagacacaagccu

SEQ ID NO: 1689561 - RNA, 13 nt, Human
cagagaccauccc

SEQ ID NO: 1689562 - RNA, 14 nt, Human
cagagaccaucccu

SEQ ID NO: 1689563 - RNA, 16 nt, Human
cagagaccaucccuga

SEQ ID NO: 1689564 - RNA, 13 nt, Human
cagagaguggcuc

SEQ ID NO: 1689565 - RNA, 14 nt, Human
cagagaguggcucc

SEQ ID NO: 1689566 - RNA, 15 nt, Human
cagagaguggcuccu

SEQ ID NO: 1689567 - RNA, 18 nt, Human
cagagaguggcuccuccc

SEQ ID NO: 1689568 - RNA, 18 nt, Human
cagagcacagcagccccu

SEQ ID NO: 1689569 - RNA, 16 nt, Human
cagagcaccuuagaca

SEQ ID NO: 1689570 - RNA, 14 nt, Human
cagagcaagugaga

SEQ ID NO: 1689571 - RNA, 20 nt, Human
cagagcaagugagacccugu

SEQ ID NO: 1689572 - RNA, 21 nt, Human
cagagaccaucccugaaggcc

SEQ ID NO: 1689573 - RNA, 17 nt, Human
cagagaccaucccugaa

SEQ ID NO: 1689574 - RNA, 18 nt, Human
cagagaccaucccugaag

SEQ ID NO: 1689575 - RNA, 19 nt, Human
cagagaccaucccugaagg

SEQ ID NO: 1689576 - RNA, 20 nt, Human
cagagaccaucccugaaggc

SEQ ID NO: 1689577 - RNA, 13 nt, Human
cagagacuccugc

SEQ ID NO: 1689578 - RNA, 14 nt, Human
cagagacuccugca

SEQ ID NO: 1689579 - RNA, 15 nt, Human
cagagacuccugcag

SEQ ID NO: 1689580 - RNA, 16 nt, Human
cagagacuccugcagg

SEQ ID NO: 1689581 - RNA, 17 nt, Human
cagagacuccugcaggc

SEQ ID NO: 1689582 - RNA, 18 nt, Human
cagagacuccugcaggca

SEQ ID NO: 1689583 - RNA, 19 nt, Human
cagagacuccugcaggcag

SEQ ID NO: 1689584 - RNA, 23 nt, Human
cagaggcgcaugaauuugugaag

SEQ ID NO: 1689585 - RNA, 13 nt, Human
cagaggcugccuc

SEQ ID NO: 1689586 - RNA, 23 nt, Human
cagaggcugccucucccaucacu

SEQ ID NO: 1689587 - RNA, 14 nt, Human
cagagggagugaca

SEQ ID NO: 1689588 - RNA, 16 nt, Human
cagagggagugacaga

SEQ ID NO: 1689589 - RNA, 18 nt, Human
cagagggagugacagagg

SEQ ID NO: 1689590 - RNA, 19 nt, Human
cagagggagugacagaggc

SEQ ID NO: 1689591 - RNA, 23 nt, Human
cagaggcagccccauucugccug

SEQ ID NO: 1689592 - RNA, 19 nt, Human
cagaggccaugggccuccu

SEQ ID NO: 1689593 - RNA, 20 nt, Human
cagaggccaugggccuccug

SEQ ID NO: 1689594 - RNA, 21 nt, Human
cagaggccaugggccuccugu

SEQ ID NO: 1689595 - RNA, 12 nt, Human
cagaggcagccc

SEQ ID NO: 1689596 - RNA, 13 nt, Human
cagaggcagcccc

SEQ ID NO: 1689597 - RNA, 14 nt, Human
cagaggcagcccca

SEQ ID NO: 1689598 - RNA, 15 nt, Human
cagaggcagccccau

SEQ ID NO: 1689599 - RNA, 18 nt, Human
cagaggcagccccauucu

SEQ ID NO: 1689600 - RNA, 19 nt, Human
cagaggcagccccauucug

SEQ ID NO: 1689601 - RNA, 20 nt, Human
cagaggcagccccauucugc

SEQ ID NO: 1689602 - RNA, 22 nt, Human
cagaggcagccccauucugccu

SEQ ID NO: 1689603 - RNA, 13 nt, Human
cagagucucacug

SEQ ID NO: 1689604 - RNA, 17 nt, Human
cagagucucacuguugc

SEQ ID NO: 1689605 - RNA, 19 nt, Human
cagagucucacuguugccc

SEQ ID NO: 1689606 - RNA, 20 nt, Human
cagagucucacuguugccca

SEQ ID NO: 1689607 - RNA, 21 nt, Human
cagagucucacuguugcccag

SEQ ID NO: 1689608 - RNA, 15 nt, Human
cagagggccugcaag

SEQ ID NO: 1689609 - RNA, 19 nt, Human
cagagggccugcaagggag

SEQ ID NO: 1689610 - RNA, 20 nt, Human
cagagggagugacagaggca

SEQ ID NO: 1689611 - RNA, 21 nt, Human
cagagggagugacagaggcag

SEQ ID NO: 1689612 - RNA, 22 nt, Human
cagagggagugacagaggcagc

SEQ ID NO: 1689613 - RNA, 23 nt, Human
cagagggagugacagaggcagcc

SEQ ID NO: 1689614 - RNA, 22 nt, Human
cagagucucacuguugcccagg

SEQ ID NO: 1689615 - RNA, 23 nt, Human
cagagucucacuguugcccaggc

SEQ ID NO: 1689616 - RNA, 16 nt, Human
cagagugagacucugu

SEQ ID NO: 1689617 - RNA, 17 nt, Human
cagagugagacucuguc

SEQ ID NO: 1689618 - RNA, 18 nt, Human
cagagugagacucugucu

SEQ ID NO: 1689619 - RNA, 19 nt, Human
cagagugagacucugucuc

SEQ ID NO: 1689620 - RNA, 20 nt, Human
cagagugagacucugucuca

SEQ ID NO: 1689621 - RNA, 17 nt, Human
cagaugcaccagcccuu

SEQ ID NO: 1689622 - RNA, 22 nt, Human
cagaugcaccagcccuuagcag

SEQ ID NO: 1689623 - RNA, 13 nt, Human
cagaugcaccagc

SEQ ID NO: 1689624 - RNA, 14 nt, Human
cagaugcaccagcc

SEQ ID NO: 1689625 - RNA, 16 nt, Human
cagaugcaccagcccu

SEQ ID NO: 1689626 - RNA, 19 nt, Human
cagaucugccuaaggacuu

SEQ ID NO: 1689627 - RNA, 20 nt, Human
cagaucugccuaaggacuuc

SEQ ID NO: 1689628 - RNA, 21 nt, Human
cagaucugccuaaggacuucu

SEQ ID NO: 1689629 - RNA, 23 nt, Human
cagaucugccuaaggacuucuuu

SEQ ID NO: 1689630 - RNA, 16 nt, Human
cagaucugccuaagga

SEQ ID NO: 1689631 - RNA, 17 nt, Human
cagaucugccuaaggac

SEQ ID NO: 1689632 - RNA, 14 nt, Human
cagaucugccuaag

SEQ ID NO: 1689633 - RNA, 16 nt, Human
cagaucuggaauguga

SEQ ID NO: 1689634 - RNA, 20 nt, Human
cagauacaggaaaagcugcu

SEQ ID NO: 1689635 - RNA, 21 nt, Human
cagauacaggaaaagcugcug

SEQ ID NO: 1689636 - RNA, 22 nt, Human
cagauacaggaaaagcugcuga

SEQ ID NO: 1689637 - RNA, 20 nt, Human
cagaucucuaacuucaccau

SEQ ID NO: 1689638 - RNA, 14 nt, Human
cagauccuggaaau

SEQ ID NO: 1689639 - RNA, 22 nt, Human
cagaguugaagacagagcuaca

SEQ ID NO: 1689640 - RNA, 14 nt, Human
cagaguuguuacau

SEQ ID NO: 1689641 - RNA, 17 nt, Human
cagaguugaagacagag

SEQ ID NO: 1689642 - RNA, 18 nt, Human
cagaguugaagacagagc

SEQ ID NO: 1689643 - RNA, 19 nt, Human
cagaguugaagacagagcu

SEQ ID NO: 1689644 - RNA, 20 nt, Human
cagaguugaagacagagcua

SEQ ID NO: 1689645 - RNA, 14 nt, Human
cagaguugaagaca

SEQ ID NO: 1689646 - RNA, 15 nt, Human
cagaguugaagacag

SEQ ID NO: 1689647 - RNA, 16 nt, Human
cagaguugaagacaga

SEQ ID NO: 1689648 - RNA, 19 nt, Human
cagaguuguuacauuuuua

SEQ ID NO: 1689649 - RNA, 18 nt, Human
cagaguuguuacauuuuu

SEQ ID NO: 1689650 - RNA, 15 nt, Human
cagaguuguuacauu

SEQ ID NO: 1689651 - RNA, 22 nt, Human
cagauaaagguucaugcaaacu

SEQ ID NO: 1689652 - RNA, 23 nt, Human
cagauaaauaguuuaugauucca

SEQ ID NO: 1689653 - RNA, 14 nt, Human
cagauaaacaguag

SEQ ID NO: 1689654 - RNA, 14 nt, Human
cagauaaucacaau

SEQ ID NO: 1689655 - RNA, 20 nt, Human
cagauaacuguuauuuauaa

SEQ ID NO: 1689656 - RNA, 21 nt, Human
cagauaacuguuauuuauaau

SEQ ID NO: 1689657 - RNA, 14 nt, Human
cagauaacuguuau

SEQ ID NO: 1689658 - RNA, 16 nt, Human
cagauaacuguuauuu

SEQ ID NO: 1689659 - RNA, 19 nt, Human
cagauaacuguuauuuaua

SEQ ID NO: 1689660 - RNA, 16 nt, Human
cacgccagauucuuuc

SEQ ID NO: 1689661 - RNA, 12 nt, Human
caccgcagacag

SEQ ID NO: 1689662 - RNA, 13 nt, Human
caccgcagacagg

SEQ ID NO: 1689663 - RNA, 14 nt, Human
caccgcagacagga

SEQ ID NO: 1689664 - RNA, 15 nt, Human
caccgcagacaggac

SEQ ID NO: 1689665 - RNA, 17 nt, Human
caccgcagacaggacca

SEQ ID NO: 1689666 - RNA, 18 nt, Human
caccgcagacaggaccag

SEQ ID NO: 1689667 - RNA, 15 nt, Human
caccgaaaacguggc

SEQ ID NO: 1689668 - RNA, 18 nt, Human
caccgaaaacguggcugc

SEQ ID NO: 1689669 - RNA, 22 nt, Human
caccgaaaacguggcugcuuca

SEQ ID NO: 1689670 - RNA, 19 nt, Human
caccgaaaacguggcugcu

SEQ ID NO: 1689671 - RNA, 21 nt, Human
caccgaaaacguggcugcuuc

SEQ ID NO: 1689672 - RNA, 11 nt, Human
cacccugugau

SEQ ID NO: 1689673 - RNA, 12 nt, Human
cacccugugaug

SEQ ID NO: 1689674 - RNA, 15 nt, Human
cacccugugaugggg

SEQ ID NO: 1689675 - RNA, 18 nt, Human
cacccugugauggggccc

SEQ ID NO: 1689676 - RNA, 20 nt, Human
cacccugugauggggcccug

SEQ ID NO: 1689677 - RNA, 21 nt, Human
cacccugugauggggcccugc

SEQ ID NO: 1689678 - RNA, 22 nt, Human
cacccugugauggggcccugcc

SEQ ID NO: 1689679 - RNA, 23 nt, Human
cacccugugauggggcccugccu

SEQ ID NO: 1689680 - RNA, 19 nt, Human
cacccgcuaagagggaggg

SEQ ID NO: 1689681 - RNA, 12 nt, Human
cacccggccccu

SEQ ID NO: 1689682 - RNA, 13 nt, Human
cacccggccccug

SEQ ID NO: 1689683 - RNA, 14 nt, Human
cacccggccccugc

SEQ ID NO: 1689684 - RNA, 16 nt, Human
cacccggccccugcug

SEQ ID NO: 1689685 - RNA, 17 nt, Human
cacccggccccugcugg

SEQ ID NO: 1689686 - RNA, 18 nt, Human
cacccggccccugcuggu

SEQ ID NO: 1689687 - RNA, 21 nt, Human
cacccggccccugcugguuca

SEQ ID NO: 1689688 - RNA, 13 nt, Human
cacauauugauuu

SEQ ID NO: 1689689 - RNA, 20 nt, Human
caccccucaacaccucugca

SEQ ID NO: 1689690 - RNA, 20 nt, Human
cacauauugauuuccguuaa

SEQ ID NO: 1689691 - RNA, 23 nt, Human
caccuggccucugcacuccccug

SEQ ID NO: 1689692 - RNA, 17 nt, Human
caccuggccucugcacu

SEQ ID NO: 1689693 - RNA, 18 nt, Human
caccuggccucugcacuc

SEQ ID NO: 1689694 - RNA, 19 nt, Human
caccuggccucugcacucc

SEQ ID NO: 1689695 - RNA, 20 nt, Human
caccuggccucugcacuccc

SEQ ID NO: 1689696 - RNA, 12 nt, Human
caccuggccucu

SEQ ID NO: 1689697 - RNA, 13 nt, Human
caccuggccucug

SEQ ID NO: 1689698 - RNA, 14 nt, Human
caccuggccucugc

SEQ ID NO: 1689699 - RNA, 15 nt, Human
caccuggccucugca

SEQ ID NO: 1689700 - RNA, 20 nt, Human
caccuggaauauauaaccag

SEQ ID NO: 1689701 - RNA, 23 nt, Human
caccugcggugcuaucuccccca

SEQ ID NO: 1689702 - RNA, 23 nt, Human
caccugaagacucauucuucugu

SEQ ID NO: 1689703 - RNA, 14 nt, Human
caccugaagacuca

SEQ ID NO: 1689704 - RNA, 15 nt, Human
caccugaagacucau

SEQ ID NO: 1689705 - RNA, 15 nt, Human
caccucucucacucc

SEQ ID NO: 1689706 - RNA, 17 nt, Human
caccucucucacuccuu

SEQ ID NO: 1689707 - RNA, 18 nt, Human
caccucucucacuccuug

SEQ ID NO: 1689708 - RNA, 19 nt, Human
caccucucucacuccuuga

SEQ ID NO: 1689709 - RNA, 18 nt, Human
caccucugcacaagcugc

SEQ ID NO: 1689710 - RNA, 19 nt, Human
caccucugcacaagcugca

SEQ ID NO: 1689711 - RNA, 21 nt, Human
caccgcagacaggaccaggga

SEQ ID NO: 1689712 - RNA, 14 nt, Human
caccggcuggccug

SEQ ID NO: 1689713 - RNA, 15 nt, Human
caccggcuggccugg

SEQ ID NO: 1689714 - RNA, 16 nt, Human
caccggcuggccuggc

SEQ ID NO: 1689715 - RNA, 17 nt, Human
caccggcuggccuggcc

SEQ ID NO: 1689716 - RNA, 18 nt, Human
caccggcuggccuggccc

SEQ ID NO: 1689717 - RNA, 20 nt, Human
caccggcuggccuggccccu

SEQ ID NO: 1689718 - RNA, 14 nt, Human
caccgggcacucag

SEQ ID NO: 1689719 - RNA, 15 nt, Human
caccgugccuggcca

SEQ ID NO: 1689720 - RNA, 20 nt, Human
caccgugccuggccacgccc

SEQ ID NO: 1689721 - RNA, 15 nt, Human
caccggggccucgga

SEQ ID NO: 1689722 - RNA, 13 nt, Human
caccgggccugga

SEQ ID NO: 1689723 - RNA, 15 nt, Human
caccgggcacucaga

SEQ ID NO: 1689724 - RNA, 22 nt, Human
caccgggcacucagaagacacu

SEQ ID NO: 1689725 - RNA, 15 nt, Human
caccgggccacagag

SEQ ID NO: 1689726 - RNA, 18 nt, Human
caccgggccacagagaaa

SEQ ID NO: 1689727 - RNA, 14 nt, Human
caccucccccaucu

SEQ ID NO: 1689728 - RNA, 21 nt, Human
caccucccccaucucuucugg

SEQ ID NO: 1689729 - RNA, 10 nt, Human
caccucccug

SEQ ID NO: 1689730 - RNA, 11 nt, Human
caccucaugga

SEQ ID NO: 1689731 - RNA, 12 nt, Human
caccucauggaa

SEQ ID NO: 1689732 - RNA, 14 nt, Human
caccucauggaauu

SEQ ID NO: 1689733 - RNA, 17 nt, Human
caccuccugcugggcag

SEQ ID NO: 1689734 - RNA, 13 nt, Human
caccucucccuug

SEQ ID NO: 1689735 - RNA, 14 nt, Human
caccucucccuugg

SEQ ID NO: 1689736 - RNA, 17 nt, Human
caccucucccuuggauu

SEQ ID NO: 1689737 - RNA, 14 nt, Human
caccuccugcuggg

SEQ ID NO: 1689738 - RNA, 15 nt, Human
caccuccugcugggc

SEQ ID NO: 1689739 - RNA, 14 nt, Human
caccuccugccucg

SEQ ID NO: 1689740 - RNA, 13 nt, Human
caccuccugccuc

SEQ ID NO: 1689741 - RNA, 11 nt, Human
caccuccugcc

SEQ ID NO: 1689742 - RNA, 14 nt, Human
caccucccugcaau

SEQ ID NO: 1689743 - RNA, 13 nt, Human
caccucccugcaa

SEQ ID NO: 1689744 - RNA, 14 nt, Human
cacucuacuuagca

SEQ ID NO: 1689745 - RNA, 15 nt, Human
cacucuccauuuaau

SEQ ID NO: 1689746 - RNA, 17 nt, Human
cacucuccauuuaauaa

SEQ ID NO: 1689747 - RNA, 12 nt, Human
cacucuccuugg

SEQ ID NO: 1689748 - RNA, 12 nt, Human
cacucugagacu

SEQ ID NO: 1689749 - RNA, 23 nt, Human
cacucugagacucgcgacaaugc

SEQ ID NO: 1689750 - RNA, 12 nt, Human
cacucuggcagc

SEQ ID NO: 1689751 - RNA, 13 nt, Human
cacucuggcagcu

SEQ ID NO: 1689752 - RNA, 14 nt, Human
cacucuggcagcuc

SEQ ID NO: 1689753 - RNA, 15 nt, Human
cacucauugaccuga

SEQ ID NO: 1689754 - RNA, 16 nt, Human
cacucaguccauagca

SEQ ID NO: 1689755 - RNA, 18 nt, Human
cacucauugaccugaggc

SEQ ID NO: 1689756 - RNA, 19 nt, Human
cacucauugaccugaggcc

SEQ ID NO: 1689757 - RNA, 20 nt, Human
cacucauugaccugaggccc

SEQ ID NO: 1689758 - RNA, 22 nt, Human
cacucauugaccugaggcccuu

SEQ ID NO: 1689759 - RNA, 12 nt, Human
cacucccugcaa

SEQ ID NO: 1689760 - RNA, 13 nt, Human
cacucccugcaac

SEQ ID NO: 1689761 - RNA, 16 nt, Human
cacucccugcaaccug

SEQ ID NO: 1689762 - RNA, 13 nt, Human
cacuccuaccugg

SEQ ID NO: 1689763 - RNA, 14 nt, Human
cacuccuaccuggu

SEQ ID NO: 1689764 - RNA, 17 nt, Human
cacucccugcaaccuga

SEQ ID NO: 1689765 - RNA, 14 nt, Human
cacuccuucacaga

SEQ ID NO: 1689766 - RNA, 21 nt, Human
cacuccuucacagaugggugc

SEQ ID NO: 1689767 - RNA, 17 nt, Human
cacuaaggugugcucug

SEQ ID NO: 1689768 - RNA, 18 nt, Human
cacuaaggugugcucuga

SEQ ID NO: 1689769 - RNA, 18 nt, Human
cacuaaccacgcuggacc

SEQ ID NO: 1689770 - RNA, 17 nt, Human
cacuaagagagaaugag

SEQ ID NO: 1689771 - RNA, 14 nt, Human
cacuaaccacgcug

SEQ ID NO: 1689772 - RNA, 15 nt, Human
cacuaaccacgcugg

SEQ ID NO: 1689773 - RNA, 16 nt, Human
cacuaaccacgcugga

SEQ ID NO: 1689774 - RNA, 16 nt, Human
cacuaacaugauuugg

SEQ ID NO: 1689775 - RNA, 21 nt, Human
cacuaaauugacacuuaaaaa

SEQ ID NO: 1689776 - RNA, 18 nt, Human
cacuaucccggcugcccu

SEQ ID NO: 1689777 - RNA, 19 nt, Human
cacuaucccggcugcccuu

SEQ ID NO: 1689778 - RNA, 15 nt, Human
cacuauguugcccag

SEQ ID NO: 1689779 - RNA, 16 nt, Human
cacuauguugcccagg

SEQ ID NO: 1689780 - RNA, 17 nt, Human
cacuauguugcccaggc

SEQ ID NO: 1689781 - RNA, 18 nt, Human
cacuauguugcccaggca

SEQ ID NO: 1689782 - RNA, 19 nt, Human
cacuauguugcccaggcag

SEQ ID NO: 1689783 - RNA, 18 nt, Human
cacuauaauguaagcucu

SEQ ID NO: 1689784 - RNA, 14 nt, Human
cacuauagccuagg

SEQ ID NO: 1689785 - RNA, 21 nt, Human
cacuauagccuaggugacaga

SEQ ID NO: 1689786 - RNA, 14 nt, Human
cacuauaauguaag

SEQ ID NO: 1689787 - RNA, 14 nt, Human
cacuaguauuucua

SEQ ID NO: 1689788 - RNA, 19 nt, Human
cacuaguauuucuaugaaa

SEQ ID NO: 1689789 - RNA, 22 nt, Human
cacucagaagacacugaugggc

SEQ ID NO: 1689790 - RNA, 18 nt, Human
cacucagaagacacugau

SEQ ID NO: 1689791 - RNA, 19 nt, Human
cacucagaagacacugaug

SEQ ID NO: 1689792 - RNA, 19 nt, Human
cacucacauuuauucugcu

SEQ ID NO: 1689793 - RNA, 20 nt, Human
cacucacauuuauucugcuc

SEQ ID NO: 1689794 - RNA, 12 nt, Human
cacucagaagac

SEQ ID NO: 1689795 - RNA, 16 nt, Human
cacucagaagacacug

SEQ ID NO: 1689796 - RNA, 17 nt, Human
cacucagaagacacuga

SEQ ID NO: 1689797 - RNA, 20 nt, Human
cacuauguugcccaggcagg

SEQ ID NO: 1689798 - RNA, 21 nt, Human
cacuauguugcccaggcaggu

SEQ ID NO: 1689799 - RNA, 15 nt, Human
cacucaaaagcuggg

SEQ ID NO: 1689800 - RNA, 17 nt, Human
cacucaaaagcugggca

SEQ ID NO: 1689801 - RNA, 18 nt, Human
cacucaaaagcugggcag

SEQ ID NO: 1689802 - RNA, 19 nt, Human
cacucaaaagcugggcagg

SEQ ID NO: 1689803 - RNA, 20 nt, Human
cacucaaaagcugggcaggu

SEQ ID NO: 1689804 - RNA, 16 nt, Human
cacucaaaucaagaaa

SEQ ID NO: 1689805 - RNA, 19 nt, Human
cacgccuguaauccuagca

SEQ ID NO: 1689806 - RNA, 20 nt, Human
cacgccuguaauccuagcac

SEQ ID NO: 1689807 - RNA, 23 nt, Human
cacgcgugcacacaccagagccc

SEQ ID NO: 1689808 - RNA, 15 nt, Human
cacgcgugcacacac

SEQ ID NO: 1689809 - RNA, 16 nt, Human
cacgcgugcacacacc

SEQ ID NO: 1689810 - RNA, 21 nt, Human
cacgcgugcacacaccagagc

SEQ ID NO: 1689811 - RNA, 20 nt, Human
cacggugaauggcuuuguau

SEQ ID NO: 1689812 - RNA, 23 nt, Human
cacggugaauggcuuuguauaga

SEQ ID NO: 1689813 - RNA, 15 nt, Human
cacgggggccaagga

SEQ ID NO: 1689814 - RNA, 20 nt, Human
cacgcuggaccuugaacugg

SEQ ID NO: 1689815 - RNA, 14 nt, Human
cacgcuccuuccuc

SEQ ID NO: 1689816 - RNA, 17 nt, Human
cacgcuggaccuugaac

SEQ ID NO: 1689817 - RNA, 16 nt, Human
cacggcucacugcagc

SEQ ID NO: 1689818 - RNA, 17 nt, Human
cacggcucacugcagcc

SEQ ID NO: 1689819 - RNA, 19 nt, Human
cacggcucacugcagccuc

SEQ ID NO: 1689820 - RNA, 20 nt, Human
cacggcucacugcagccuca

SEQ ID NO: 1689821 - RNA, 13 nt, Human
cacgugacagccg

SEQ ID NO: 1689822 - RNA, 18 nt, Human
cacguacacacacauaca

SEQ ID NO: 1689823 - RNA, 19 nt, Human
cacguacacacacauacac

SEQ ID NO: 1689824 - RNA, 14 nt, Human
cacguacacacaca

SEQ ID NO: 1689825 - RNA, 23 nt, Human
cacguuucuaaaggcuaccuuug

SEQ ID NO: 1689826 - RNA, 14 nt, Human
cacguuucuaaagg

SEQ ID NO: 1689827 - RNA, 12 nt, Human
cacguuucuaaa

SEQ ID NO: 1689828 - RNA, 13 nt, Human
cacuaaacaaaga

SEQ ID NO: 1689829 - RNA, 16 nt, Human
cacgugguccuaaucu

SEQ ID NO: 1689830 - RNA, 19 nt, Human
cacgugguccuaaucuucu

SEQ ID NO: 1689831 - RNA, 22 nt, Human
cacguucuuacuaguuucccuu

SEQ ID NO: 1689832 - RNA, 20 nt, Human
caccugucuugccuuuuuca

SEQ ID NO: 1689833 - RNA, 17 nt, Human
caccugucuugccuuuu

SEQ ID NO: 1689834 - RNA, 14 nt, Human
caccuuagacaguc

SEQ ID NO: 1689835 - RNA, 16 nt, Human
caccuuagacaguccc

SEQ ID NO: 1689836 - RNA, 18 nt, Human
caccuuagacagucccug

SEQ ID NO: 1689837 - RNA, 19 nt, Human
caccuuagacagucccugc

SEQ ID NO: 1689838 - RNA, 22 nt, Human
caccuuagccugcccuccuuuc

SEQ ID NO: 1689839 - RNA, 21 nt, Human
caccuuagacagucccugcca

SEQ ID NO: 1689840 - RNA, 23 nt, Human
caccuuagacagucccugccaau

SEQ ID NO: 1689841 - RNA, 18 nt, Human
caccuugacagggcacac

SEQ ID NO: 1689842 - RNA, 15 nt, Human
caccuugacagggca

SEQ ID NO: 1689843 - RNA, 16 nt, Human
caccuugacagggcac

SEQ ID NO: 1689844 - RNA, 13 nt, Human
caccuucccaugc

SEQ ID NO: 1689845 - RNA, 14 nt, Human
caccuucccaugcc

SEQ ID NO: 1689846 - RNA, 13 nt, Human
caccuugacaggg

SEQ ID NO: 1689847 - RNA, 16 nt, Human
cacgacugcccggcag

SEQ ID NO: 1689848 - RNA, 17 nt, Human
cacgacugcccggcagg

SEQ ID NO: 1689849 - RNA, 16 nt, Human
cacgaauauugcugau

SEQ ID NO: 1689850 - RNA, 19 nt, Human
cacgaauauugcugauggu

SEQ ID NO: 1689851 - RNA, 22 nt, Human
cacgaauauugcugauggugca

SEQ ID NO: 1689852 - RNA, 13 nt, Human
cacgccacugcac

SEQ ID NO: 1689853 - RNA, 15 nt, Human
cacgccacugcacua

SEQ ID NO: 1689854 - RNA, 19 nt, Human
cacgccagauucuuuccug

SEQ ID NO: 1689855 - RNA, 20 nt, Human
cacgccagauucuuuccuga

SEQ ID NO: 1689856 - RNA, 22 nt, Human
cacgccagauucuuuccugagg

SEQ ID NO: 1689857 - RNA, 23 nt, Human
cacgccagauucuuuccugaggc

SEQ ID NO: 1689858 - RNA, 13 nt, Human
cacgcccccacug

SEQ ID NO: 1689859 - RNA, 15 nt, Human
cacgcccccacuggu

SEQ ID NO: 1689860 - RNA, 17 nt, Human
cacgcccccacugguga

SEQ ID NO: 1689861 - RNA, 18 nt, Human
cacgcccccacuggugac

SEQ ID NO: 1689862 - RNA, 16 nt, Human
cacgauuucuguuuag

SEQ ID NO: 1689863 - RNA, 14 nt, Human
cacgauuucuguuu

SEQ ID NO: 1689864 - RNA, 12 nt, Human
cacgauuucugu

SEQ ID NO: 1689865 - RNA, 17 nt, Human
cacgcacuucgggaggu

SEQ ID NO: 1689866 - RNA, 17 nt, Human
cacgagcaggcuacugu

SEQ ID NO: 1689867 - RNA, 19 nt, Human
cacgagcaggcuacuguca

SEQ ID NO: 1689868 - RNA, 20 nt, Human
cacgagcaggcuacugucag

SEQ ID NO: 1689869 - RNA, 22 nt, Human
cacgagcaggcuacugucagcu

SEQ ID NO: 1689870 - RNA, 15 nt, Human
cacuguacuugcucu

SEQ ID NO: 1689871 - RNA, 18 nt, Human
cacuguacuugcucuuga

SEQ ID NO: 1689872 - RNA, 19 nt, Human
cacuguacuugcucuugau

SEQ ID NO: 1689873 - RNA, 13 nt, Human
cacugugaagaga

SEQ ID NO: 1689874 - RNA, 14 nt, Human
cacugugccaugug

SEQ ID NO: 1689875 - RNA, 14 nt, Human
cacugucaagauga

SEQ ID NO: 1689876 - RNA, 13 nt, Human
cacuguucucugc

SEQ ID NO: 1689877 - RNA, 14 nt, Human
cacuguucucugcc

SEQ ID NO: 1689878 - RNA, 15 nt, Human
cacuguucucugccc

SEQ ID NO: 1689879 - RNA, 16 nt, Human
cacuguucucugcccu

SEQ ID NO: 1689880 - RNA, 17 nt, Human
cacuguucucugcccuc

SEQ ID NO: 1689881 - RNA, 19 nt, Human
cacuguucucugcccucca

SEQ ID NO: 1689882 - RNA, 21 nt, Human
cacuguucucugcccuccaag

SEQ ID NO: 1689883 - RNA, 22 nt, Human
cacuguucucugcccuccaaga

SEQ ID NO: 1689884 - RNA, 22 nt, Human
cacuguggguagacacacauga

SEQ ID NO: 1689885 - RNA, 24 nt, Human
cacuguggguagacacacaugaag

SEQ ID NO: 1689886 - RNA, 18 nt, Human
cacugugccaugugccag

SEQ ID NO: 1689887 - RNA, 15 nt, Human
cacugugccaugugc

SEQ ID NO: 1689888 - RNA, 16 nt, Human
cacugugccaugugcc

SEQ ID NO: 1689889 - RNA, 13 nt, Human
cacugugcugagu

SEQ ID NO: 1689890 - RNA, 15 nt, Human
cacugugcugagucu

SEQ ID NO: 1689891 - RNA, 17 nt, Human
cacugugcugagucuga

SEQ ID NO: 1689892 - RNA, 20 nt, Human
cacugugcugagucugaagg

SEQ ID NO: 1689893 - RNA, 21 nt, Human
cacugugcugagucugaaggc

SEQ ID NO: 1689894 - RNA, 22 nt, Human
cacugugcugagucugaaggcu

SEQ ID NO: 1689895 - RNA, 19 nt, Human
cacuguggguagacacaca

SEQ ID NO: 1689896 - RNA, 22 nt, Human
cacuucugccauauucuguugg

SEQ ID NO: 1689897 - RNA, 21 nt, Human
cacuucgggaggucgaggcag

SEQ ID NO: 1689898 - RNA, 23 nt, Human
cacuucgggaggucgaggcagga

SEQ ID NO: 1689899 - RNA, 20 nt, Human
cacuuccauaaucuggacuc

SEQ ID NO: 1689900 - RNA, 16 nt, Human
cacuucccuacaugga

SEQ ID NO: 1689901 - RNA, 14 nt, Human
cacuguugcccagg

SEQ ID NO: 1689902 - RNA, 23 nt, Human
cacuucaggcucuucuccuuuca

SEQ ID NO: 1689903 - RNA, 14 nt, Human
cacuucaggcucuu

SEQ ID NO: 1689904 - RNA, 15 nt, Human
cacuucaggcucuuc

SEQ ID NO: 1689905 - RNA, 16 nt, Human
cacuucaggcucuucu

SEQ ID NO: 1689906 - RNA, 20 nt, Human
cacuucaggcucuucuccuu

SEQ ID NO: 1689907 - RNA, 12 nt, Human
cacuucagcuga

SEQ ID NO: 1689908 - RNA, 21 nt, Human
cacuucagcugacuuuucugu

SEQ ID NO: 1689909 - RNA, 24 nt, Human
cacuugcagacucuacagaggcca

SEQ ID NO: 1689910 - RNA, 14 nt, Human
cacuugcagacucu

SEQ ID NO: 1689911 - RNA, 18 nt, Human
cacuugcagacucuacag

SEQ ID NO: 1689912 - RNA, 19 nt, Human
cacuugcagacucuacaga

SEQ ID NO: 1689913 - RNA, 22 nt, Human
cacuugcagacucuacagaggc

SEQ ID NO: 1689914 - RNA, 19 nt, Human
cacuuucuagccagaggag

SEQ ID NO: 1689915 - RNA, 20 nt, Human
cacuuucuagccagaggaga

SEQ ID NO: 1689916 - RNA, 15 nt, Human
cacuuggucugugag

SEQ ID NO: 1689917 - RNA, 17 nt, Human
cacuuggucugugagau

SEQ ID NO: 1689918 - RNA, 13 nt, Human
cacuugcagacuc

SEQ ID NO: 1689919 - RNA, 19 nt, Human
cacuugaugacccccaacc

SEQ ID NO: 1689920 - RNA, 13 nt, Human
cacuugaguccag

SEQ ID NO: 1689921 - RNA, 19 nt, Human
cacuugacaucaacugcau

SEQ ID NO: 1689922 - RNA, 17 nt, Human
cacuugagaauuacccu

SEQ ID NO: 1689923 - RNA, 20 nt, Human
cacuugagaauuacccuuuu

SEQ ID NO: 1689924 - RNA, 20 nt, Human
cacuugaacccgggaggcag

SEQ ID NO: 1689925 - RNA, 21 nt, Human
cacuugaacccgggaggcaga

SEQ ID NO: 1689926 - RNA, 16 nt, Human
cacuugacaucaacug

SEQ ID NO: 1689927 - RNA, 23 nt, Human
cacuugaacccgggaggcagagg

SEQ ID NO: 1689928 - RNA, 18 nt, Human
cacuggacucaccucccc

SEQ ID NO: 1689929 - RNA, 15 nt, Human
cacuggacucaccuc

SEQ ID NO: 1689930 - RNA, 21 nt, Human
cacugcuuuuggucuguguga

SEQ ID NO: 1689931 - RNA, 17 nt, Human
cacuggaacacuaauga

SEQ ID NO: 1689932 - RNA, 22 nt, Human
cacugcuuccagugaggcucug

SEQ ID NO: 1689933 - RNA, 20 nt, Human
cacugcuuuuggucugugug

SEQ ID NO: 1689934 - RNA, 18 nt, Human
cacugcuuccagugaggc

SEQ ID NO: 1689935 - RNA, 19 nt, Human
cacugcuuccagugaggcu

SEQ ID NO: 1689936 - RNA, 20 nt, Human
cacugcuuccagugaggcuc

SEQ ID NO: 1689937 - RNA, 21 nt, Human
cacugcuuccagugaggcucu

SEQ ID NO: 1689938 - RNA, 12 nt, Human
cacugcuggcug

SEQ ID NO: 1689939 - RNA, 13 nt, Human
cacugcuggcugc

SEQ ID NO: 1689940 - RNA, 14 nt, Human
cacugcuggcugcc

SEQ ID NO: 1689941 - RNA, 15 nt, Human
cacugcuggcugccu

SEQ ID NO: 1689942 - RNA, 16 nt, Human
cacugcuggcugccuu

SEQ ID NO: 1689943 - RNA, 21 nt, Human
cacugcuggcugccuuagaac

SEQ ID NO: 1689944 - RNA, 13 nt, Human
cacugcuuaacuu

SEQ ID NO: 1689945 - RNA, 14 nt, Human
cacugcuuccagug

SEQ ID NO: 1689946 - RNA, 15 nt, Human
cacugcuuccaguga

SEQ ID NO: 1689947 - RNA, 16 nt, Human
cacugcuuccagugag

SEQ ID NO: 1689948 - RNA, 16 nt, Human
cacugccucuuccucc

SEQ ID NO: 1689949 - RNA, 23 nt, Human
cacugcacagugcaucucagccc

SEQ ID NO: 1689950 - RNA, 14 nt, Human
cacugcaccgggcc

SEQ ID NO: 1689951 - RNA, 15 nt, Human
cacugcaccgggcca

SEQ ID NO: 1689952 - RNA, 16 nt, Human
cacugcaccgggccac

SEQ ID NO: 1689953 - RNA, 18 nt, Human
cacugcaccgggccacag

SEQ ID NO: 1689954 - RNA, 19 nt, Human
cacugcaccgggccacaga

SEQ ID NO: 1689955 - RNA, 18 nt, Human
cacugcacuauagccuag

SEQ ID NO: 1689956 - RNA, 15 nt, Human
cacugcugcccagcc

SEQ ID NO: 1689957 - RNA, 17 nt, Human
cacugcugcccagccuc

SEQ ID NO: 1689958 - RNA, 20 nt, Human
cacugcucugaugaagagga

SEQ ID NO: 1689959 - RNA, 12 nt, Human
cacugcucuggu

SEQ ID NO: 1689960 - RNA, 20 nt, Human
cacugccuucgauacaccgg

SEQ ID NO: 1689961 - RNA, 22 nt, Human
cacugccuucgauacaccgggc

SEQ ID NO: 1689962 - RNA, 20 nt, Human
cacugccuucucaacuccaa

SEQ ID NO: 1689963 - RNA, 14 nt, Human
cacugcaaccuucg

SEQ ID NO: 1689964 - RNA, 22 nt, Human
cacugcaaccuucgccaccugg

SEQ ID NO: 1689965 - RNA, 23 nt, Human
cacugcaaccuucgccaccuggg

SEQ ID NO: 1689966 - RNA, 18 nt, Human
cacugcacagugcaucuc

SEQ ID NO: 1689967 - RNA, 19 nt, Human
cacugcacagugcaucuca

SEQ ID NO: 1689968 - RNA, 21 nt, Human
cacugcacagugcaucucagc

SEQ ID NO: 1689969 - RNA, 22 nt, Human
cacugcacagugcaucucagcc

SEQ ID NO: 1689970 - RNA, 23 nt, Human
cacugcaaccuccgccucuuggg

SEQ ID NO: 1689971 - RNA, 14 nt, Human
cacugcaaccuccg

SEQ ID NO: 1689972 - RNA, 16 nt, Human
cacugcaaccuccgcc

SEQ ID NO: 1689973 - RNA, 21 nt, Human
cacugauuugacauagucugg

SEQ ID NO: 1689974 - RNA, 23 nt, Human
cacugauuugacauagucuggcu

SEQ ID NO: 1689975 - RNA, 13 nt, Human
cacugcaaccucc

SEQ ID NO: 1689976 - RNA, 14 nt, Human
cacugaugggcaac

SEQ ID NO: 1689977 - RNA, 18 nt, Human
cacugaugggcaaccccc

SEQ ID NO: 1689978 - RNA, 24 nt, Human
cacugaugggcaacccccagccug

SEQ ID NO: 1689979 - RNA, 23 nt, Human
cacugagacagcccgggcucugc

SEQ ID NO: 1689980 - RNA, 14 nt, Human
cacugagacagccc

SEQ ID NO: 1689981 - RNA, 17 nt, Human
cacugagacagcccggg

SEQ ID NO: 1689982 - RNA, 19 nt, Human
cacugagacagcccgggcu

SEQ ID NO: 1689983 - RNA, 22 nt, Human
cacugagacagcccgggcucug

SEQ ID NO: 1689984 - RNA, 12 nt, Human
cacugagacagc

SEQ ID NO: 1689985 - RNA, 13 nt, Human
cacugagacagcc

SEQ ID NO: 1689986 - RNA, 21 nt, Human
cacugacuucuaaguaaaacc

SEQ ID NO: 1689987 - RNA, 14 nt, Human
cacugacuucuaag

SEQ ID NO: 1689988 - RNA, 15 nt, Human
cacugacuucuaagu

SEQ ID NO: 1689989 - RNA, 16 nt, Human
cacugacuucuaagua

SEQ ID NO: 1689990 - RNA, 20 nt, Human
cacugacuucuaaguaaaac

SEQ ID NO: 1689991 - RNA, 23 nt, Human
cacucuggcagcucagagagggu

SEQ ID NO: 1689992 - RNA, 20 nt, Human
cacucuggcagcucagagag

SEQ ID NO: 1689993 - RNA, 21 nt, Human
cacucuggcagcucagagagg

SEQ ID NO: 1689994 - RNA, 15 nt, Human
cacucuggcagcuca

SEQ ID NO: 1689995 - RNA, 16 nt, Human
cacucuggcagcucag

SEQ ID NO: 1689996 - RNA, 17 nt, Human
cacucuggcagcucaga

SEQ ID NO: 1689997 - RNA, 19 nt, Human
cacucuggcagcucagaga

SEQ ID NO: 1689998 - RNA, 15 nt, Human
cacucugucgcccag

SEQ ID NO: 1689999 - RNA, 16 nt, Human
cacucugucgcccagu

SEQ ID NO: 1690000 - RNA, 19 nt, Human
cacucugucgcccagucug

SEQ ID NO: 1690001 - RNA, 23 nt, Human
cacugacauuguuggccaaagcc

SEQ ID NO: 1690002 - RNA, 20 nt, Human
cacucugucgcccagucugg

SEQ ID NO: 1690003 - RNA, 23 nt, Human
aaaaaauuggggauucuuaaagu

SEQ ID NO: 1690004 - RNA, 20 nt, Human
aaaaauuggggauucuuaaa

SEQ ID NO: 1690005 - RNA, 19 nt, Human
aaaaauuggggauucuuaa

SEQ ID NO: 1690006 - RNA, 18 nt, Human
aaaaauuggggauucuua

SEQ ID NO: 1690007 - RNA, 17 nt, Human
aaaaauuggggauucuu

SEQ ID NO: 1690008 - RNA, 18 nt, Human
aaaaaccaguauuguaca

SEQ ID NO: 1690009 - RNA, 16 nt, Human
aaaaaccaguauugua

SEQ ID NO: 1690010 - RNA, 13 nt, Human
aauggcuuuguau

SEQ ID NO: 1690011 - RNA, 18 nt, Human
aauggcuuuguauagaac

SEQ ID NO: 1690012 - RNA, 16 nt, Human
aauggcuuuguauaga

SEQ ID NO: 1690013 - RNA, 15 nt, Human
aauggcuuuguauag

SEQ ID NO: 1690014 - RNA, 22 nt, Human
aaugguccgugcuaaggacuug

SEQ ID NO: 1690015 - RNA, 22 nt, Human
aauccauuuggaaaucuuuaaa

SEQ ID NO: 1690016 - RNA, 18 nt, Human
aauccauuuggaaaucuu

SEQ ID NO: 1690017 - RNA, 17 nt, Human
aauccauuuggaaaucu

SEQ ID NO: 1690018 - RNA, 15 nt, Human
aauccauuuggaaau

SEQ ID NO: 1690019 - RNA, 14 nt, Human
aauccauuuggaaa

SEQ ID NO: 1690020 - RNA, 14 nt, Human
aaucaacugggcug

SEQ ID NO: 1690021 - RNA, 19 nt, Human
aaucaacugggcugaacac

SEQ ID NO: 1690022 - RNA, 22 nt, Human
aaguaucugacaucucugcaau

SEQ ID NO: 1690023 - RNA, 15 nt, Human
aaguaucugacaucu

SEQ ID NO: 1690024 - RNA, 18 nt, Human
aagguucuggugugaacu

SEQ ID NO: 1690025 - RNA, 22 nt, Human
aagucucugaagugaaacugcu

SEQ ID NO: 1690026 - RNA, 19 nt, Human
aagucucugaagugaaacu

SEQ ID NO: 1690027 - RNA, 23 nt, Human
aagucuguuuuaugacuucauua

SEQ ID NO: 1690028 - RNA, 20 nt, Human
aagucuguuuuaugacuuca

SEQ ID NO: 1690029 - RNA, 19 nt, Human
aagucuguuuuaugacuuc

SEQ ID NO: 1690030 - RNA, 18 nt, Human
aagucuguuuuaugacuu

SEQ ID NO: 1690031 - RNA, 16 nt, Human
aagucuguuuuaugac

SEQ ID NO: 1690032 - RNA, 15 nt, Human
aagucuguuuuauga

SEQ ID NO: 1690033 - RNA, 15 nt, Human
aaguuguuugagaaa

SEQ ID NO: 1690034 - RNA, 12 nt, Human
aaguuguuugag

SEQ ID NO: 1690035 - RNA, 13 nt, Human
aagccauguuuau

SEQ ID NO: 1690036 - RNA, 22 nt, Human
aaggauuuuaugcuuuaaacau

SEQ ID NO: 1690037 - RNA, 21 nt, Human
aaggauuuuaugcuuuaaaca

SEQ ID NO: 1690038 - RNA, 20 nt, Human
aaggauuuuaugcuuuaaac

SEQ ID NO: 1690039 - RNA, 16 nt, Human
aaggauuuuaugcuuu

SEQ ID NO: 1690040 - RNA, 23 nt, Human
aaggauuuuaugcuuuaaacauu

SEQ ID NO: 1690041 - RNA, 13 nt, Human
aaggauuuuaugc

SEQ ID NO: 1690042 - RNA, 12 nt, Human
aaggauuuuaug

SEQ ID NO: 1690043 - RNA, 14 nt, Human
aaauauuuuaugau

SEQ ID NO: 1690044 - RNA, 19 nt, Human
aaauauuuuaugauccagc

SEQ ID NO: 1690045 - RNA, 18 nt, Human
aaauauuuuaugauccag

SEQ ID NO: 1690046 - RNA, 14 nt, Human
aaauacuguuugag

SEQ ID NO: 1690047 - RNA, 19 nt, Human
aaauggacuguggugacuu

SEQ ID NO: 1690048 - RNA, 19 nt, Human
aaaauuggggauucuuaaa

SEQ ID NO: 1690049 - RNA, 18 nt, Human
aaaauuggggauucuuaa

SEQ ID NO: 1690050 - RNA, 17 nt, Human
aaaauuggggauucuua

SEQ ID NO: 1690051 - RNA, 19 nt, Human
aaagagguuuuucuuaaau

SEQ ID NO: 1690052 - RNA, 16 nt, Human
aaagagguuuuucuua

SEQ ID NO: 1690053 - RNA, 12 nt, Human
aacuuuucugau

SEQ ID NO: 1690054 - RNA, 14 nt, Human
aacuuuucugauag

SEQ ID NO: 1690055 - RNA, 13 nt, Human
aacuuuucugaua

SEQ ID NO: 1690056 - RNA, 17 nt, Human
aaauuggggauucuuaa

SEQ ID NO: 1690057 - RNA, 16 nt, Human
aaauuggggauucuua

SEQ ID NO: 1690058 - RNA, 22 nt, Human
aaccaguauuguacaaaguauu

SEQ ID NO: 1690059 - RNA, 21 nt, Human
aaccaguauuguacaaaguau

SEQ ID NO: 1690060 - RNA, 15 nt, Human
aaccaguauuguaca

SEQ ID NO: 1690061 - RNA, 20 nt, Human
aaccaguauuguacaaagua

SEQ ID NO: 1690062 - RNA, 17 nt, Human
aacagcuggugcccugc

SEQ ID NO: 1690063 - RNA, 13 nt, Human
acgaugucuucau

SEQ ID NO: 1690064 - RNA, 23 nt, Human
accuuucagauaacuguuauuua

SEQ ID NO: 1690065 - RNA, 21 nt, Human
acuucuuuaauuuuggaauuu

SEQ ID NO: 1690066 - RNA, 14 nt, Human
acuggguuccugca

SEQ ID NO: 1690067 - RNA, 12 nt, Human
acuuuucugaua

SEQ ID NO: 1690068 - RNA, 18 nt, Human
acaauuuuguuucuguac

SEQ ID NO: 1690069 - RNA, 17 nt, Human
acaauuuuguuucugua

SEQ ID NO: 1690070 - RNA, 15 nt, Human
acaauuuuguuucug

SEQ ID NO: 1690071 - RNA, 14 nt, Human
acaauuuuguuucu

SEQ ID NO: 1690072 - RNA, 18 nt, Human
acauaaaucugugaacuu

SEQ ID NO: 1690073 - RNA, 15 nt, Human
acauaaaucugugaa

SEQ ID NO: 1690074 - RNA, 14 nt, Human
acauaaaucuguga

SEQ ID NO: 1690075 - RNA, 14 nt, Human
auaugcuauuucua

SEQ ID NO: 1690076 - RNA, 20 nt, Human
auacaauuuuguuucuguac

SEQ ID NO: 1690077 - RNA, 19 nt, Human
auacaauuuuguuucugua

SEQ ID NO: 1690078 - RNA, 15 nt, Human
auaccuacauguauu

SEQ ID NO: 1690079 - RNA, 17 nt, Human
auaccuacauguauuug

SEQ ID NO: 1690080 - RNA, 22 nt, Human
auaauuaacauguuaaaccaug

SEQ ID NO: 1690081 - RNA, 21 nt, Human
auaauuaacauguuaaaccau

SEQ ID NO: 1690082 - RNA, 20 nt, Human
auaauuaacauguuaaacca

SEQ ID NO: 1690083 - RNA, 20 nt, Human
aguugaauuuauuggcuuuu

SEQ ID NO: 1690084 - RNA, 19 nt, Human
aguugaauuuauuggcuuu

SEQ ID NO: 1690085 - RNA, 17 nt, Human
aguugaauuuauuggcu

SEQ ID NO: 1690086 - RNA, 13 nt, Human
aguugaauuuauu

SEQ ID NO: 1690087 - RNA, 11 nt, Human
aguugaauuua

SEQ ID NO: 1690088 - RNA, 22 nt, Human
auggagccugcacggugaaugg

SEQ ID NO: 1690089 - RNA, 18 nt, Human
auggagccugcacgguga

SEQ ID NO: 1690090 - RNA, 24 nt, Human
aucuucucagaaggcaaaugacuu

SEQ ID NO: 1690091 - RNA, 22 nt, Human
aucaccugucuugccuuuuuca

SEQ ID NO: 1690092 - RNA, 21 nt, Human
aucaccugucuugccuuuuuc

SEQ ID NO: 1690093 - RNA, 12 nt, Human
aucaccugucuu

SEQ ID NO: 1690094 - RNA, 14 nt, Human
agaguguugaaacg

SEQ ID NO: 1690095 - RNA, 22 nt, Human
agccauguuuauuacaguauaa

SEQ ID NO: 1690096 - RNA, 23 nt, Human
agccucccuauuuuuuuucuguu

SEQ ID NO: 1690097 - RNA, 23 nt, Human
aggcugaugccaaguuguuugag

SEQ ID NO: 1690098 - RNA, 14 nt, Human
agcuggugcccugc

SEQ ID NO: 1690099 - RNA, 21 nt, Human
cuugucucagauuuuauuaug

SEQ ID NO: 1690100 - RNA, 13 nt, Human
cuuuugguuaagu

SEQ ID NO: 1690101 - RNA, 20 nt, Human
gaaacuuguguaaauacaau

SEQ ID NO: 1690102 - RNA, 16 nt, Human
gaaacuuguguaaaua

SEQ ID NO: 1690103 - RNA, 14 nt, Human
gaaacuuguguaaa

SEQ ID NO: 1690104 - RNA, 23 nt, Human
cuggugcccugcuuucagauacu

SEQ ID NO: 1690105 - RNA, 21 nt, Human
cuggugcccugcuuucagaua

SEQ ID NO: 1690106 - RNA, 19 nt, Human
cuggugcccugcuuucaga

SEQ ID NO: 1690107 - RNA, 16 nt, Human
cuggugcccugcuuuc

SEQ ID NO: 1690108 - RNA, 15 nt, Human
cuggugcccugcuuu

SEQ ID NO: 1690109 - RNA, 18 nt, Human
cuggugacugauucuuca

SEQ ID NO: 1690110 - RNA, 17 nt, Human
cuggugacugauucuuc

SEQ ID NO: 1690111 - RNA, 15 nt, Human
cuggugacugauucu

SEQ ID NO: 1690112 - RNA, 14 nt, Human
cuggugacugauuc

SEQ ID NO: 1690113 - RNA, 13 nt, Human
cuggugacugauu

SEQ ID NO: 1690114 - RNA, 16 nt, Human
cugugagcaucacagu

SEQ ID NO: 1690115 - RNA, 17 nt, Human
cugugaacuugaaauuu

SEQ ID NO: 1690116 - RNA, 16 nt, Human
cugugaacuugaaauu

SEQ ID NO: 1690117 - RNA, 15 nt, Human
cugugaacuugaaau

SEQ ID NO: 1690118 - RNA, 22 nt, Human
cuguuauauaaaugguuaaaag

SEQ ID NO: 1690119 - RNA, 15 nt, Human
cuguuauauaaaugg

SEQ ID NO: 1690120 - RNA, 14 nt, Human
cuguuauauaaaug

SEQ ID NO: 1690121 - RNA, 13 nt, Human
cuguuauauaaau

SEQ ID NO: 1690122 - RNA, 19 nt, Human
cugugagcaucacaguuuu

SEQ ID NO: 1690123 - RNA, 20 nt, Human
gauacuggauuguacuuugu

SEQ ID NO: 1690124 - RNA, 16 nt, Human
gauacuggauuguacu

SEQ ID NO: 1690125 - RNA, 12 nt, Human
gaugauuucuau

SEQ ID NO: 1690126 - RNA, 23 nt, Human
gaugauuucuaugcugaguuugu

SEQ ID NO: 1690127 - RNA, 13 nt, Human
gaugauuucuaug

SEQ ID NO: 1690128 - RNA, 15 nt, Human
gaucugccuaaggac

SEQ ID NO: 1690129 - RNA, 12 nt, Human
gaucugccuaag

SEQ ID NO: 1690130 - RNA, 17 nt, Human
gaucugccuaaggacuu

SEQ ID NO: 1690131 - RNA, 16 nt, Human
gaucugccuaaggacu

SEQ ID NO: 1690132 - RNA, 18 nt, Human
gauccagcagauuauuca

SEQ ID NO: 1690133 - RNA, 19 nt, Human
gauccagcagauuauucac

SEQ ID NO: 1690134 - RNA, 16 nt, Human
gcuauuucuauauuuu

SEQ ID NO: 1690135 - RNA, 15 nt, Human
gcuauuucuauauuu

SEQ ID NO: 1690136 - RNA, 13 nt, Human
gcuauuucuauau

SEQ ID NO: 1690137 - RNA, 11 nt, Human
gcuauuucuau

SEQ ID NO: 1690138 - RNA, 22 nt, Human
gcuauuucuauauuuucauucu

SEQ ID NO: 1690139 - RNA, 20 nt, Human
gcuauuucuauauuuucauu

SEQ ID NO: 1690140 - RNA, 19 nt, Human
gcuauuucuauauuuucau

SEQ ID NO: 1690141 - RNA, 18 nt, Human
gcuauuucuauauuuuca

SEQ ID NO: 1690142 - RNA, 22 nt, Human
gcguucauggaacgcguugaaa

SEQ ID NO: 1690143 - RNA, 23 nt, Human
gcuaaggacuuguuagaucuagu

SEQ ID NO: 1690144 - RNA, 12 nt, Human
gcguugaaauug

SEQ ID NO: 1690145 - RNA, 12 nt, Human
gcuaaggacuug

SEQ ID NO: 1690146 - RNA, 11 nt, Human
gcuaaggacuu

SEQ ID NO: 1690147 - RNA, 22 nt, Human
gccauguuuauuacaguauaau

SEQ ID NO: 1690148 - RNA, 18 nt, Human
gccauguuuauuacagua

SEQ ID NO: 1690149 - RNA, 14 nt, Human
gccauguuuauuac

SEQ ID NO: 1690150 - RNA, 11 nt, Human
gccauguuuau

SEQ ID NO: 1690151 - RNA, 13 nt, Human
gccauguuuauua

SEQ ID NO: 1690152 - RNA, 18 nt, Human
ggaaacuggguuccugca

SEQ ID NO: 1690153 - RNA, 13 nt, Human
ggaaaucuuuaaa

SEQ ID NO: 1690154 - RNA, 15 nt, Human
ggaagccugauuaaa

SEQ ID NO: 1690155 - RNA, 18 nt, Human
aaaauauuuuaugaucca

SEQ ID NO: 1690156 - RNA, 15 nt, Human
aaaauauuuuaugau

SEQ ID NO: 1690157 - RNA, 21 nt, Human
guacaaaguauuaagcauaua

SEQ ID NO: 1690158 - RNA, 20 nt, Human
guacaaaguauuaagcauau

SEQ ID NO: 1690159 - RNA, 20 nt, Human
gguguuguacucaauuuuaa

SEQ ID NO: 1690160 - RNA, 19 nt, Human
gguguuguacucaauuuua

SEQ ID NO: 1690161 - RNA, 23 nt, Human
auuuauaaucacuuuuuuccaca

SEQ ID NO: 1690162 - RNA, 20 nt, Human
auuguacaaaguauuaagca

SEQ ID NO: 1690163 - RNA, 22 nt, Human
auuguacaaaguauuaagcaua

SEQ ID NO: 1690164 - RNA, 23 nt, Human
auuguacaaaguauuaagcauau

SEQ ID NO: 1690165 - RNA, 23 nt, Human
auuuuauaaaucgcuuuugauaa

SEQ ID NO: 1690166 - RNA, 21 nt, Human
auuuuauaaaucgcuuuugau

SEQ ID NO: 1690167 - RNA, 20 nt, Human
auuuuauaaaucgcuuuuga

SEQ ID NO: 1690168 - RNA, 17 nt, Human
auuuuauaaaucgcuuu

SEQ ID NO: 1690169 - RNA, 16 nt, Human
auuuuauaaaucgcuu

SEQ ID NO: 1690170 - RNA, 15 nt, Human
auuuuauaaaucgcu

SEQ ID NO: 1690171 - RNA, 16 nt, Human
caaccaccuuucagau

SEQ ID NO: 1690172 - RNA, 15 nt, Human
caaaguauuaagcau

SEQ ID NO: 1690173 - RNA, 14 nt, Human
caaaguauuaagca

SEQ ID NO: 1690174 - RNA, 21 nt, Human
caaaguauuaagcauauauuu

SEQ ID NO: 1690175 - RNA, 19 nt, Human
caaaguauuaagcauauau

SEQ ID NO: 1690176 - RNA, 17 nt, Human
caaaguauuaagcauau

SEQ ID NO: 1690177 - RNA, 16 nt, Human
caaaguauuaagcaua

SEQ ID NO: 1690178 - RNA, 17 nt, Human
caauaaaaaauuaugac

SEQ ID NO: 1690179 - RNA, 16 nt, Human
caauaaaaaauuauga

SEQ ID NO: 1690180 - RNA, 13 nt, Human
caauaaaaaauua

SEQ ID NO: 1690181 - RNA, 18 nt, Human
cauguauuuguuugcaua

SEQ ID NO: 1690182 - RNA, 23 nt, Human
ccaccuuucagauaacuguuauu

SEQ ID NO: 1690183 - RNA, 19 nt, Human
ccaguuuuguuuggaccaa

SEQ ID NO: 1690184 - RNA, 16 nt, Human
ccaguuuuguuuggac

SEQ ID NO: 1690185 - RNA, 22 nt, Human
ccaguauuguacaaaguauuaa

SEQ ID NO: 1690186 - RNA, 20 nt, Human
ccaguauuguacaaaguauu

SEQ ID NO: 1690187 - RNA, 16 nt, Human
ccagcagauuauucac

SEQ ID NO: 1690188 - RNA, 15 nt, Human
ccagcagauuauuca

SEQ ID NO: 1690189 - RNA, 22 nt, Human
cccaggaauggagccugcacgg

SEQ ID NO: 1690190 - RNA, 20 nt, Human
cccaggaauggagccugcac

SEQ ID NO: 1690191 - RNA, 19 nt, Human
cccaggaauggagccugca

SEQ ID NO: 1690192 - RNA, 18 nt, Human
cccaggaauggagccugc

SEQ ID NO: 1690193 - RNA, 20 nt, Human
ccuauuuuuuuucuguuaua

SEQ ID NO: 1690194 - RNA, 17 nt, Human
ccugucuugccuuuuuc

SEQ ID NO: 1690195 - RNA, 20 nt, Human
ccugucuugccuuuuucauu

SEQ ID NO: 1690196 - RNA, 19 nt, Human
ccugucuugccuuuuucau

SEQ ID NO: 1690197 - RNA, 12 nt, Human
ccuuucauauuu

SEQ ID NO: 1690198 - RNA, 16 nt, Human
ccuuuuuuaaauaaau

SEQ ID NO: 1690199 - RNA, 15 nt, Human
ccuuuuucauuauuu

SEQ ID NO: 1690200 - RNA, 20 nt, Human
cuauuuuuuuucuguuauau

SEQ ID NO: 1690201 - RNA, 21 nt, Human
cuauuuuuuuucuguuauaua

SEQ ID NO: 1690202 - RNA, 22 nt, Human
guguaaauacaauuuuguuucu

SEQ ID NO: 1690203 - RNA, 21 nt, Human
guguaaauacaauuuuguuuc

SEQ ID NO: 1690204 - RNA, 18 nt, Human
guguaaauacaauuuugu

SEQ ID NO: 1690205 - RNA, 15 nt, Human
aagcauuuuauaaau

SEQ ID NO: 1690206 - RNA, 14 nt, Human
aagcauuuuauaaa

SEQ ID NO: 1690207 - RNA, 12 nt, Human
aagcauuuuaua

SEQ ID NO: 1690208 - RNA, 19 nt, Human
aagcauuuuauaaaucgcu

SEQ ID NO: 1690209 - RNA, 17 nt, Human
aagcauuuuauaaaucg

SEQ ID NO: 1690210 - RNA, 21 nt, Human
aagcauuuuauaaaucgcuuu

SEQ ID NO: 1690211 - RNA, 17 nt, Human
aagccauguuuauuaca

SEQ ID NO: 1690212 - RNA, 16 nt, Human
aagccauguuuauuac

SEQ ID NO: 1690213 - RNA, 15 nt, Human
aagccauguuuauua

SEQ ID NO: 1690214 - RNA, 23 nt, Human
aagcauauauuuuuauauuuacu

SEQ ID NO: 1690215 - RNA, 18 nt, Human
guuagagauuuuuuuguu

SEQ ID NO: 1690216 - RNA, 23 nt, Human
aagccauguuuauuacaguauaa

SEQ ID NO: 1690217 - RNA, 22 nt, Human
aagccauguuuauuacaguaua

SEQ ID NO: 1690218 - RNA, 21 nt, Human
aagccauguuuauuacaguau

SEQ ID NO: 1690219 - RNA, 20 nt, Human
aagccauguuuauuacagua

SEQ ID NO: 1690220 - RNA, 22 nt, Human
aagucagaucugccuaaggacu

SEQ ID NO: 1690221 - RNA, 21 nt, Human
aagucagaucugccuaaggac

SEQ ID NO: 1690222 - RNA, 18 nt, Human
aagucagaucugccuaag

SEQ ID NO: 1690223 - RNA, 18 nt, Human
guuuuaugacuucauuaa

SEQ ID NO: 1690224 - RNA, 13 nt, Human
guuuuaugacuuc

SEQ ID NO: 1690225 - RNA, 18 nt, Human
guuuggaccaaaaaccag

SEQ ID NO: 1690226 - RNA, 19 nt, Human
guuuaauauuaaagccaug

SEQ ID NO: 1690227 - RNA, 18 nt, Human
guuuaauauuaaagccau

SEQ ID NO: 1690228 - RNA, 15 nt, Human
guuuaauauuaaagc

SEQ ID NO: 1690229 - RNA, 14 nt, Human
guuuaauauuaaag

SEQ ID NO: 1690230 - RNA, 13 nt, Human
guuuaauauuaaa

SEQ ID NO: 1690231 - RNA, 17 nt, Human
guuuauuacaguauaau

SEQ ID NO: 1690232 - RNA, 13 nt, Human
guuuauuacagua

SEQ ID NO: 1690233 - RNA, 20 nt, Human
aaggaaacuggguuccugca

SEQ ID NO: 1690234 - RNA, 12 nt, Human
aaggaaaaguuu

SEQ ID NO: 1690235 - RNA, 12 nt, Human
guuguuuguuua

SEQ ID NO: 1690236 - RNA, 18 nt, Human
uaaaaaaaaaauugggga

SEQ ID NO: 1690237 - RNA, 14 nt, Human
uaaaaaaaaaauug

SEQ ID NO: 1690238 - RNA, 23 nt, Human
aagucagaucugccuaaggacuu

SEQ ID NO: 1690239 - RNA, 23 nt, Human
guauuguacaaaguauuaagcau

SEQ ID NO: 1690240 - RNA, 22 nt, Human
guauuguacaaaguauuaagca

SEQ ID NO: 1690241 - RNA, 21 nt, Human
guauuguacaaaguauuaagc

SEQ ID NO: 1690242 - RNA, 22 nt, Human
guauugaagcauuuuauaaauc

SEQ ID NO: 1690243 - RNA, 18 nt, Human
guauugaagcauuuuaua

SEQ ID NO: 1690244 - RNA, 17 nt, Human
guauugaagcauuuuau

SEQ ID NO: 1690245 - RNA, 13 nt, Human
guauugaagcauu

SEQ ID NO: 1690246 - RNA, 10 nt, Human
guauugaagc

SEQ ID NO: 1690247 - RNA, 19 nt, Human
guauuguacaaaguauuaa

SEQ ID NO: 1690248 - RNA, 12 nt, Human
aaauuugaauuu

SEQ ID NO: 1690249 - RNA, 22 nt, Human
aaauuugaauuuuguguuagag

SEQ ID NO: 1690250 - RNA, 15 nt, Human
aaauuugaauuuugu

SEQ ID NO: 1690251 - RNA, 15 nt, Human
guccgugcuaaggac

SEQ ID NO: 1690252 - RNA, 17 nt, Human
guccgugcuaaggacuu

SEQ ID NO: 1690253 - RNA, 16 nt, Human
guccgugcuaaggacu

SEQ ID NO: 1690254 - RNA, 23 nt, Human
aacauugguucuuguauuaagaa

SEQ ID NO: 1690255 - RNA, 22 nt, Human
aacauugguucuuguauuaaga

SEQ ID NO: 1690256 - RNA, 19 nt, Human
aacauugguucuuguauua

SEQ ID NO: 1690257 - RNA, 18 nt, Human
aacauugguucuuguauu

SEQ ID NO: 1690258 - RNA, 16 nt, Human
aacauugguucuugua

SEQ ID NO: 1690259 - RNA, 15 nt, Human
aacauguuaaaccau

SEQ ID NO: 1690260 - RNA, 14 nt, Human
aacauguuaaacca

SEQ ID NO: 1690261 - RNA, 16 nt, Human
aacauguuaaaccaug

SEQ ID NO: 1690262 - RNA, 23 nt, Human
gucuugucucagauuuuauuaug

SEQ ID NO: 1690263 - RNA, 15 nt, Human
gugacuuuggauaau

SEQ ID NO: 1690264 - RNA, 12 nt, Human
gugacuuuggau

SEQ ID NO: 1690265 - RNA, 12 nt, Human
aacuugaaauuu

SEQ ID NO: 1690266 - RNA, 19 nt, Human
aacuugaaauuugaauuuu

SEQ ID NO: 1690267 - RNA, 18 nt, Human
aacuugaaauuugaauuu

SEQ ID NO: 1690268 - RNA, 13 nt, Human
aacuugaaauuug

SEQ ID NO: 1690269 - RNA, 14 nt, Human
gugaucucauuuaa

SEQ ID NO: 1690270 - RNA, 23 nt, Human
uagagauuuuuuuguuguuuguu

SEQ ID NO: 1690271 - RNA, 22 nt, Human
uagcuagacuggugacugauuc

SEQ ID NO: 1690272 - RNA, 21 nt, Human
uagcuagacuggugacugauu

SEQ ID NO: 1690273 - RNA, 21 nt, Human
acaccauuaugugcgcugaua

SEQ ID NO: 1690274 - RNA, 17 nt, Human
acaccauuaugugcgcu

SEQ ID NO: 1690275 - RNA, 23 nt, Human
acacacuuuugguuaagucuguu

SEQ ID NO: 1690276 - RNA, 19 nt, Human
uauauuuacuaaaauggac

SEQ ID NO: 1690277 - RNA, 21 nt, Human
uauauuuacuaaaauggacug

SEQ ID NO: 1690278 - RNA, 20 nt, Human
uauauuuacuaaaauggacu

SEQ ID NO: 1690279 - RNA, 12 nt, Human
uaugugugaagu

SEQ ID NO: 1690280 - RNA, 14 nt, Human
uaugugugaaguga

SEQ ID NO: 1690281 - RNA, 20 nt, Human
acaguauaauuaacauguua

SEQ ID NO: 1690282 - RNA, 15 nt, Human
acaguauaauuaaca

SEQ ID NO: 1690283 - RNA, 13 nt, Human
acaguauaauuaa

SEQ ID NO: 1690284 - RNA, 16 nt, Human
uauucaaaguugccua

SEQ ID NO: 1690285 - RNA, 13 nt, Human
uauucaaaguugc

SEQ ID NO: 1690286 - RNA, 12 nt, Human
uauucaaaguug

SEQ ID NO: 1690287 - RNA, 13 nt, Human
uacauguauuugu

SEQ ID NO: 1690288 - RNA, 19 nt, Human
aauuaacauguuaaaccau

SEQ ID NO: 1690289 - RNA, 20 nt, Human
aauuaacauguuaaaccaug

SEQ ID NO: 1690290 - RNA, 23 nt, Human
aaugccaucaauaaaaaauuaug

SEQ ID NO: 1690291 - RNA, 21 nt, Human
aaugccaucaauaaaaaauua

SEQ ID NO: 1690292 - RNA, 16 nt, Human
aaugccaucaauaaaa

SEQ ID NO: 1690293 - RNA, 16 nt, Human
aauggacuguggugac

SEQ ID NO: 1690294 - RNA, 14 nt, Human
uacuggauuguacu

SEQ ID NO: 1690295 - RNA, 20 nt, Human
aauucccuggccuuucauau

SEQ ID NO: 1690296 - RNA, 19 nt, Human
aauucccuggccuuucaua

SEQ ID NO: 1690297 - RNA, 19 nt, Human
uacuauauaugugaugauc

SEQ ID NO: 1690298 - RNA, 18 nt, Human
uaaucacuuuuuuccaca

SEQ ID NO: 1690299 - RNA, 19 nt, Human
uaaucacuuuuuuccacau

SEQ ID NO: 1690300 - RNA, 17 nt, Human
uaaucacuuuuuuccac

SEQ ID NO: 1690301 - RNA, 16 nt, Human
uaaucacuuuuuucca

SEQ ID NO: 1690302 - RNA, 16 nt, Human
uaaggaaaaguuuaau

SEQ ID NO: 1690303 - RNA, 22 nt, Human
aaucugugaacuugaaauuuga

SEQ ID NO: 1690304 - RNA, 21 nt, Human
aaucugugaacuugaaauuug

SEQ ID NO: 1690305 - RNA, 20 nt, Human
aaucugugaacuugaaauuu

SEQ ID NO: 1690306 - RNA, 16 nt, Human
aauaucaucaguauug

SEQ ID NO: 1690307 - RNA, 14 nt, Human
uaacauaaaucugu

SEQ ID NO: 1690308 - RNA, 12 nt, Human
uaacauaaaucu

SEQ ID NO: 1690309 - RNA, 21 nt, Human
uaacuguuauuuauaaucacu

SEQ ID NO: 1690310 - RNA, 23 nt, Human
ucacaguuuugguugcuuuaaua

SEQ ID NO: 1690311 - RNA, 21 nt, Human
ucacaguuuugguugcuuuaa

SEQ ID NO: 1690312 - RNA, 20 nt, Human
ucacaguuuugguugcuuua

SEQ ID NO: 1690313 - RNA, 22 nt, Human
accaguauuguacaaaguauua

SEQ ID NO: 1690314 - RNA, 20 nt, Human
accaguauuguacaaaguau

SEQ ID NO: 1690315 - RNA, 15 nt, Human
accaguauuguacaa

SEQ ID NO: 1690316 - RNA, 14 nt, Human
accaguauuguaca

SEQ ID NO: 1690317 - RNA, 23 nt, Human
accaguauuguacaaaguauuaa

SEQ ID NO: 1690318 - RNA, 20 nt, Human
ucaccugucuugccuuuuuc
